United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 85

SEQ ID NO: 3047975 - RNA, 20 nt, Mycobacterium bovis subsp bovis AF2122/97
ccgccugugccgccggcgcc

SEQ ID NO: 3047976 - RNA, 16 nt, Mycobacterium bovis subsp bovis AF2122/97
ccgccuuccuggcggg

SEQ ID NO: 3047977 - RNA, 17 nt, Mycobacterium bovis subsp bovis AF2122/97
ccgccuuccuggcgggc

SEQ ID NO: 3047978 - RNA, 18 nt, Mycobacterium bovis subsp bovis AF2122/97
ccgccuuccuggcgggcg

SEQ ID NO: 3047979 - RNA, 20 nt, Mycobacterium bovis subsp bovis AF2122/97
ccgccuucgaucaucgaccu

SEQ ID NO: 3047980 - RNA, 17 nt, Mycobacterium bovis subsp bovis AF2122/97
ccgccuucucccgcacg

SEQ ID NO: 3047981 - RNA, 22 nt, Mycobacterium bovis subsp bovis AF2122/97
ccgccuucucccgcacggccgg

SEQ ID NO: 3047982 - RNA, 15 nt, Mycobacterium bovis subsp bovis AF2122/97
ccgccuucuccggcg

SEQ ID NO: 3047983 - RNA, 12 nt, Mycobacterium bovis subsp bovis AF2122/97
ccgccuucuugg

SEQ ID NO: 3047984 - RNA, 13 nt, Mycobacterium bovis subsp bovis AF2122/97
ccgccuucuuggc

SEQ ID NO: 3047985 - RNA, 16 nt, Mycobacterium bovis subsp bovis AF2122/97
ccgccuucuuggcggc

SEQ ID NO: 3047986 - RNA, 21 nt, Mycobacterium bovis subsp bovis AF2122/97
ccgccuucuuggcggccuuug

SEQ ID NO: 3047987 - RNA, 22 nt, Mycobacterium bovis subsp bovis AF2122/97
ccgccuucuuggcggccuuugu

SEQ ID NO: 3047988 - RNA, 14 nt, Mycobacterium bovis subsp bovis AF2122/97
ccgccuugaggccc

SEQ ID NO: 3047989 - RNA, 20 nt, Mycobacterium bovis subsp bovis AF2122/97
ccgccuugaggcccugcggc

SEQ ID NO: 3047990 - RNA, 12 nt, Mycobacterium bovis subsp bovis AF2122/97
ccgccuuggcca

SEQ ID NO: 3047991 - RNA, 19 nt, Mycobacterium bovis subsp bovis AF2122/97
ccgcgaggugaaucgcguc

SEQ ID NO: 3047992 - RNA, 13 nt, Mycobacterium bovis subsp bovis AF2122/97
ccgcgagucgccc

SEQ ID NO: 3047993 - RNA, 11 nt, Mycobacterium bovis subsp bovis AF2122/97
ccgcgaucacc

SEQ ID NO: 3047994 - RNA, 21 nt, Mycobacterium bovis subsp bovis AF2122/97
ccgcgauccagcgcugaccgg

SEQ ID NO: 3047995 - RNA, 15 nt, Mycobacterium bovis subsp bovis AF2122/97
ccgcgaucccggccg

SEQ ID NO: 3047996 - RNA, 17 nt, Mycobacterium bovis subsp bovis AF2122/97
ccgcgaucccggccguc

SEQ ID NO: 3047997 - RNA, 20 nt, Mycobacterium bovis subsp bovis AF2122/97
ccgcgaucccggccgucgcc

SEQ ID NO: 3047998 - RNA, 11 nt, Mycobacterium bovis subsp bovis AF2122/97
ccgcgaucgcc

SEQ ID NO: 3047999 - RNA, 15 nt, Mycobacterium bovis subsp bovis AF2122/97
ccgcgaucgccgacg

SEQ ID NO: 3048000 - RNA, 23 nt, Mycobacterium bovis subsp bovis AF2122/97
ccgcgaucgccgacgccagaacg

SEQ ID NO: 3048001 - RNA, 18 nt, Mycobacterium bovis subsp bovis AF2122/97
ccgcgaucgcgacacggc

SEQ ID NO: 3048002 - RNA, 18 nt, Mycobacterium bovis subsp bovis AF2122/97
ccgcgaucgggcccagca

SEQ ID NO: 3048003 - RNA, 15 nt, Mycobacterium bovis subsp bovis AF2122/97
ccgcgaucgggccga

SEQ ID NO: 3048004 - RNA, 20 nt, Mycobacterium bovis subsp bovis AF2122/97
ccgcgaucggugcgggcgcc

SEQ ID NO: 3048005 - RNA, 21 nt, Mycobacterium bovis subsp bovis AF2122/97
ccgcgaucggugcgggcgccg

SEQ ID NO: 3048006 - RNA, 22 nt, Mycobacterium bovis subsp bovis AF2122/97
ccgcgaucggugcgggcgccgc

SEQ ID NO: 3048007 - RNA, 20 nt, Mycobacterium bovis subsp bovis AF2122/97
ccgcgaucgugcagguugcc

SEQ ID NO: 3048008 - RNA, 13 nt, Mycobacterium bovis subsp bovis AF2122/97
ccgcgaucugcag

SEQ ID NO: 3048009 - RNA, 18 nt, Mycobacterium bovis subsp bovis AF2122/97
ccgcgaucugcagcgcgg

SEQ ID NO: 3048010 - RNA, 15 nt, Mycobacterium bovis subsp bovis AF2122/97
ccgcgaugacgaccg

SEQ ID NO: 3048011 - RNA, 23 nt, Mycobacterium bovis subsp bovis AF2122/97
ccgcgaugacgaccgaucggcgc

SEQ ID NO: 3048012 - RNA, 20 nt, Mycobacterium bovis subsp bovis AF2122/97
ccgcgaugacggugccgacc

SEQ ID NO: 3048013 - RNA, 21 nt, Mycobacterium bovis subsp bovis AF2122/97
ccgcgaugacggugccgaccg

SEQ ID NO: 3048014 - RNA, 22 nt, Mycobacterium bovis subsp bovis AF2122/97
ccgcgaugacggugccgaccgc

SEQ ID NO: 3048015 - RNA, 13 nt, Mycobacterium bovis subsp bovis AF2122/97
ccgcgaugagcgg

SEQ ID NO: 3048016 - RNA, 16 nt, Mycobacterium bovis subsp bovis AF2122/97
ccgcgaugagcggcgc

SEQ ID NO: 3048017 - RNA, 17 nt, Mycobacterium bovis subsp bovis AF2122/97
ccgcgaugagcggcgcg

SEQ ID NO: 3048018 - RNA, 23 nt, Mycobacterium bovis subsp bovis AF2122/97
ccgcgaugaucgcaucgacgugc

SEQ ID NO: 3048019 - RNA, 15 nt, Mycobacterium bovis subsp bovis AF2122/97
ccgcgaugccaccca

SEQ ID NO: 3048020 - RNA, 19 nt, Mycobacterium bovis subsp bovis AF2122/97
ccgcgaugcgcaccagcgg

SEQ ID NO: 3048021 - RNA, 20 nt, Mycobacterium bovis subsp bovis AF2122/97
ccgcgaugcgcaccagcggc

SEQ ID NO: 3048022 - RNA, 23 nt, Mycobacterium bovis subsp bovis AF2122/97
ccgcgauggcguagcccaugccg

SEQ ID NO: 3048023 - RNA, 18 nt, Mycobacterium bovis subsp bovis AF2122/97
ccgcgauggugcgccggg

SEQ ID NO: 3048024 - RNA, 19 nt, Mycobacterium bovis subsp bovis AF2122/97
ccgcgauggugcgccgggc

SEQ ID NO: 3048025 - RNA, 18 nt, Mycobacterium bovis subsp bovis AF2122/97
ccgcgauucgcggcagcc

SEQ ID NO: 3048026 - RNA, 20 nt, Mycobacterium bovis subsp bovis AF2122/97
ccgcgauucgcggcagccgg

SEQ ID NO: 3048027 - RNA, 21 nt, Mycobacterium bovis subsp bovis AF2122/97
ccgcgauucgcggcagccggc

SEQ ID NO: 3048028 - RNA, 14 nt, Mycobacterium bovis subsp bovis AF2122/97
ccgcgcaacaccuc

SEQ ID NO: 3048029 - RNA, 16 nt, Mycobacterium bovis subsp bovis AF2122/97
ccgcgcaacccggacg

SEQ ID NO: 3048030 - RNA, 19 nt, Mycobacterium bovis subsp bovis AF2122/97
ccgcgcaacuaucgcaccu

SEQ ID NO: 3048031 - RNA, 15 nt, Mycobacterium bovis subsp bovis AF2122/97
ccgcgcaccaacacc

SEQ ID NO: 3048032 - RNA, 21 nt, Mycobacterium bovis subsp bovis AF2122/97
ccgcgcaccaacaccagcgcg

SEQ ID NO: 3048033 - RNA, 19 nt, Mycobacterium bovis subsp bovis AF2122/97
ccgcgcacccguccgccgc

SEQ ID NO: 3048034 - RNA, 19 nt, Mycobacterium bovis subsp bovis AF2122/97
ccgcgcaccgaccgcaccg

SEQ ID NO: 3048035 - RNA, 16 nt, Mycobacterium bovis subsp bovis AF2122/97
ccgcgcaccgcagggu

SEQ ID NO: 3048036 - RNA, 13 nt, Mycobacterium bovis subsp bovis AF2122/97
ccgcgcaccgcgg

SEQ ID NO: 3048037 - RNA, 15 nt, Mycobacterium bovis subsp bovis AF2122/97
ccgcgcacggcuggc

SEQ ID NO: 3048038 - RNA, 19 nt, Mycobacterium bovis subsp bovis AF2122/97
ccgcgcagauacgcgugug

SEQ ID NO: 3048039 - RNA, 16 nt, Mycobacterium bovis subsp bovis AF2122/97
ccgcgcagcacugcgg

SEQ ID NO: 3048040 - RNA, 16 nt, Mycobacterium bovis subsp bovis AF2122/97
ccgcgcagcagugccg

SEQ ID NO: 3048041 - RNA, 16 nt, Mycobacterium bovis subsp bovis AF2122/97
ccgcgcagccggcccg

SEQ ID NO: 3048042 - RNA, 20 nt, Mycobacterium bovis subsp bovis AF2122/97
ccgcgcagcgcggcggcauc

SEQ ID NO: 3048043 - RNA, 17 nt, Mycobacterium bovis subsp bovis AF2122/97
ccgcgcagcgguccgcc

SEQ ID NO: 3048044 - RNA, 18 nt, Mycobacterium bovis subsp bovis AF2122/97
ccgcgcagcgguccgccg

SEQ ID NO: 3048045 - RNA, 14 nt, Mycobacterium bovis subsp bovis AF2122/97
ccgcgcagcgucaa

SEQ ID NO: 3048046 - RNA, 15 nt, Mycobacterium bovis subsp bovis AF2122/97
ccgcgcaggcuucca

SEQ ID NO: 3048047 - RNA, 14 nt, Mycobacterium bovis subsp bovis AF2122/97
ccgcgcaggggcgg

SEQ ID NO: 3048048 - RNA, 18 nt, Mycobacterium bovis subsp bovis AF2122/97
ccgcgcaucaucgcccac

SEQ ID NO: 3048049 - RNA, 17 nt, Mycobacterium bovis subsp bovis AF2122/97
ccgcgcaucugucgcgc

SEQ ID NO: 3048050 - RNA, 16 nt, Mycobacterium bovis subsp bovis AF2122/97
ccgcgccaccggcacc

SEQ ID NO: 3048051 - RNA, 20 nt, Mycobacterium bovis subsp bovis AF2122/97
ccgcgccaguaacgcccaca

SEQ ID NO: 3048052 - RNA, 16 nt, Mycobacterium bovis subsp bovis AF2122/97
ccgcgccaguggccac

SEQ ID NO: 3048053 - RNA, 20 nt, Mycobacterium bovis subsp bovis AF2122/97
ccgcgccaguggccaccauc

SEQ ID NO: 3048054 - RNA, 21 nt, Mycobacterium bovis subsp bovis AF2122/97
ccgcgccauagcagagccggg

SEQ ID NO: 3048055 - RNA, 18 nt, Mycobacterium bovis subsp bovis AF2122/97
ccgcgcccaccagcggcg

SEQ ID NO: 3048056 - RNA, 20 nt, Mycobacterium bovis subsp bovis AF2122/97
ccgcgcccaccagcggcggc

SEQ ID NO: 3048057 - RNA, 13 nt, Mycobacterium bovis subsp bovis AF2122/97
ccgcgcccacccc

SEQ ID NO: 3048058 - RNA, 14 nt, Mycobacterium bovis subsp bovis AF2122/97
ccgcgcccaccccg

SEQ ID NO: 3048059 - RNA, 17 nt, Mycobacterium bovis subsp bovis AF2122/97
ccgcgcccaccccggcc

SEQ ID NO: 3048060 - RNA, 19 nt, Mycobacterium bovis subsp bovis AF2122/97
ccgcgcccaccccggccgc

SEQ ID NO: 3048061 - RNA, 14 nt, Mycobacterium bovis subsp bovis AF2122/97
ccgcgcccagaccg

SEQ ID NO: 3048062 - RNA, 17 nt, Mycobacterium bovis subsp bovis AF2122/97
ccgcgccccagacgcgc

SEQ ID NO: 3048063 - RNA, 15 nt, Mycobacterium bovis subsp bovis AF2122/97
ccgcgccccaugggg

SEQ ID NO: 3048064 - RNA, 20 nt, Mycobacterium bovis subsp bovis AF2122/97
ccgcgccccaugggggaacc

SEQ ID NO: 3048065 - RNA, 12 nt, Mycobacterium bovis subsp bovis AF2122/97
ccgcgcccgccg

SEQ ID NO: 3048066 - RNA, 16 nt, Mycobacterium bovis subsp bovis AF2122/97
ccgcgcccgccgaucc

SEQ ID NO: 3048067 - RNA, 16 nt, Mycobacterium bovis subsp bovis AF2122/97
ccgcgcccgccgcggc

SEQ ID NO: 3048068 - RNA, 19 nt, Mycobacterium bovis subsp bovis AF2122/97
ccgcgcccgccgcggcagc

SEQ ID NO: 3048069 - RNA, 19 nt, Mycobacterium bovis subsp bovis AF2122/97
ccgcgcccgccucgaccgc

SEQ ID NO: 3048070 - RNA, 13 nt, Mycobacterium bovis subsp bovis AF2122/97
ccgcgcccggccg

SEQ ID NO: 3048071 - RNA, 14 nt, Mycobacterium bovis subsp bovis AF2122/97
ccgcgcccggccgg

SEQ ID NO: 3048072 - RNA, 14 nt, Mycobacterium bovis subsp bovis AF2122/97
ccgcgcccggcgca

SEQ ID NO: 3048073 - RNA, 22 nt, Mycobacterium bovis subsp bovis AF2122/97
ccgcgcccggcgcaagcgccgc

SEQ ID NO: 3048074 - RNA, 22 nt, Mycobacterium bovis subsp bovis AF2122/97
ccgcgcccggcgcuagcgccgc

SEQ ID NO: 3048075 - RNA, 20 nt, Mycobacterium bovis subsp bovis AF2122/97
ccgcgcccuucagcacggug

SEQ ID NO: 3048076 - RNA, 18 nt, Mycobacterium bovis subsp bovis AF2122/97
ccgcgccgaaucgcgggc

SEQ ID NO: 3048077 - RNA, 17 nt, Mycobacterium bovis subsp bovis AF2122/97
ccgcgcguugcuggucg

SEQ ID NO: 3048078 - RNA, 21 nt, Mycobacterium bovis subsp bovis AF2122/97
ccgcgcguugcuggucgccgu

SEQ ID NO: 3048079 - RNA, 20 nt, Mycobacterium bovis subsp bovis AF2122/97
ccgcgcuaaugucgauuucg

SEQ ID NO: 3048080 - RNA, 15 nt, Mycobacterium bovis subsp bovis AF2122/97
ccgcgcuagcucggc

SEQ ID NO: 3048081 - RNA, 15 nt, Mycobacterium bovis subsp bovis AF2122/97
ccgcgcucagcuccg

SEQ ID NO: 3048082 - RNA, 17 nt, Mycobacterium bovis subsp bovis AF2122/97
ccgcgcucaucgcggcg

SEQ ID NO: 3048083 - RNA, 14 nt, Mycobacterium bovis subsp bovis AF2122/97
ccgcgcucaucugc

SEQ ID NO: 3048084 - RNA, 23 nt, Mycobacterium bovis subsp bovis AF2122/97
ccgcgcuccaacaaugccagcug

SEQ ID NO: 3048085 - RNA, 13 nt, Mycobacterium bovis subsp bovis AF2122/97
ccgcgcucccggc

SEQ ID NO: 3048086 - RNA, 17 nt, Mycobacterium bovis subsp bovis AF2122/97
ccgcgcucccggcgucu

SEQ ID NO: 3048087 - RNA, 18 nt, Mycobacterium bovis subsp bovis AF2122/97
ccgcgcucgaacuccccg

SEQ ID NO: 3048088 - RNA, 21 nt, Mycobacterium bovis subsp bovis AF2122/97
ccgcgcucgacgagcacgccg

SEQ ID NO: 3048089 - RNA, 20 nt, Mycobacterium bovis subsp bovis AF2122/97
ccgcgcucgcacccgcucgg

SEQ ID NO: 3048090 - RNA, 13 nt, Mycobacterium bovis subsp bovis AF2122/97
ccgcgcucgccga

SEQ ID NO: 3048091 - RNA, 12 nt, Mycobacterium bovis subsp bovis AF2122/97
ccgcgcucgucg

SEQ ID NO: 3048092 - RNA, 13 nt, Mycobacterium bovis subsp bovis AF2122/97
ccgcgcugcagca

SEQ ID NO: 3048093 - RNA, 17 nt, Mycobacterium bovis subsp bovis AF2122/97
ccgcgcugcagcacggc

SEQ ID NO: 3048094 - RNA, 18 nt, Mycobacterium bovis subsp bovis AF2122/97
ccgcgcugcagcacggcu

SEQ ID NO: 3048095 - RNA, 22 nt, Mycobacterium bovis subsp bovis AF2122/97
ccgcgcugcagcacggcuucgc

SEQ ID NO: 3048096 - RNA, 13 nt, Mycobacterium bovis subsp bovis AF2122/97
ccgcgcugcgacg

SEQ ID NO: 3048097 - RNA, 20 nt, Mycobacterium bovis subsp bovis AF2122/97
ccgcgcuggacaacggcggu

SEQ ID NO: 3048098 - RNA, 23 nt, Mycobacterium bovis subsp bovis AF2122/97
ccgcgcuggucaacuccacgcgg

SEQ ID NO: 3048099 - RNA, 20 nt, Mycobacterium bovis subsp bovis AF2122/97
ccgcgcuggucagccgugcc

SEQ ID NO: 3048100 - RNA, 20 nt, Mycobacterium bovis subsp bovis AF2122/97
ccgcgcuggugauucgcagc

SEQ ID NO: 3048101 - RNA, 21 nt, Mycobacterium bovis subsp bovis AF2122/97
ccgcgcuggugauucgcagcc

SEQ ID NO: 3048102 - RNA, 22 nt, Mycobacterium bovis subsp bovis AF2122/97
ccgcgcuggugauucgcagccg

SEQ ID NO: 3048103 - RNA, 23 nt, Mycobacterium bovis subsp bovis AF2122/97
ccgcgcugguugaacauguccag

SEQ ID NO: 3048104 - RNA, 18 nt, Mycobacterium bovis subsp bovis AF2122/97
ccgcgcuguugccaucga

SEQ ID NO: 3048105 - RNA, 18 nt, Mycobacterium bovis subsp bovis AF2122/97
ccgcgcuucacagccacc

SEQ ID NO: 3048106 - RNA, 23 nt, Mycobacterium bovis subsp bovis AF2122/97
ccgcgcuucacagccaccagccg

SEQ ID NO: 3048107 - RNA, 18 nt, Mycobacterium bovis subsp bovis AF2122/97
ccgcgcuugcgaucgccg

SEQ ID NO: 3048108 - RNA, 19 nt, Mycobacterium bovis subsp bovis AF2122/97
ccgcgcuugcgaucgccgc

SEQ ID NO: 3048109 - RNA, 17 nt, Mycobacterium bovis subsp bovis AF2122/97
ccgcgcuugcgaucggc

SEQ ID NO: 3048110 - RNA, 20 nt, Mycobacterium bovis subsp bovis AF2122/97
ccgcgcuugcgaucggcacu

SEQ ID NO: 3048111 - RNA, 18 nt, Mycobacterium bovis subsp bovis AF2122/97
ccgcgcuugguccugcgg

SEQ ID NO: 3048112 - RNA, 19 nt, Mycobacterium bovis subsp bovis AF2122/97
ccgcgcuugguccugcggu

SEQ ID NO: 3048113 - RNA, 20 nt, Mycobacterium bovis subsp bovis AF2122/97
ccgcgcuuucgagugcagcg

SEQ ID NO: 3048114 - RNA, 15 nt, Mycobacterium bovis subsp bovis AF2122/97
ccgcggaaggccagc

SEQ ID NO: 3048115 - RNA, 16 nt, Mycobacterium bovis subsp bovis AF2122/97
ccgcggaaggccagcu

SEQ ID NO: 3048116 - RNA, 16 nt, Mycobacterium bovis subsp bovis AF2122/97
ccgcggaauaugggug

SEQ ID NO: 3048117 - RNA, 20 nt, Mycobacterium bovis subsp bovis AF2122/97
ccgcggaauaugggugugcu

SEQ ID NO: 3048118 - RNA, 15 nt, Mycobacterium bovis subsp bovis AF2122/97
ccgcggacaccagga

SEQ ID NO: 3048119 - RNA, 17 nt, Mycobacterium bovis subsp bovis AF2122/97
ccgcggacagcccggac

SEQ ID NO: 3048120 - RNA, 18 nt, Mycobacterium bovis subsp bovis AF2122/97
ccgcggacagcccggacg

SEQ ID NO: 3048121 - RNA, 16 nt, Mycobacterium bovis subsp bovis AF2122/97
ccgcggacccgcagcu

SEQ ID NO: 3048122 - RNA, 19 nt, Mycobacterium bovis subsp bovis AF2122/97
ccgcggacccgcagcugcg

SEQ ID NO: 3048123 - RNA, 15 nt, Mycobacterium bovis subsp bovis AF2122/97
ccgcggaccgcaacg

SEQ ID NO: 3048124 - RNA, 22 nt, Mycobacterium bovis subsp bovis AF2122/97
ccgcggacgugccggucccccc

SEQ ID NO: 3048125 - RNA, 15 nt, Mycobacterium bovis subsp bovis AF2122/97
ccgcggacguggucg

SEQ ID NO: 3048126 - RNA, 22 nt, Mycobacterium bovis subsp bovis AF2122/97
ccgcggacucgggcaggcccca

SEQ ID NO: 3048127 - RNA, 23 nt, Mycobacterium bovis subsp bovis AF2122/97
ccgcggacucgggcaggccccac

SEQ ID NO: 3048128 - RNA, 16 nt, Mycobacterium bovis subsp bovis AF2122/97
ccgcggacugguauuc

SEQ ID NO: 3048129 - RNA, 17 nt, Mycobacterium bovis subsp bovis AF2122/97
ccgcggacuuggcgguc

SEQ ID NO: 3048130 - RNA, 18 nt, Mycobacterium bovis subsp bovis AF2122/97
ccgcggacuuggcggucg

SEQ ID NO: 3048131 - RNA, 19 nt, Mycobacterium bovis subsp bovis AF2122/97
ccgcggacuuggcggucgg

SEQ ID NO: 3048132 - RNA, 21 nt, Mycobacterium bovis subsp bovis AF2122/97
ccgcggagaaggcgcgggcga

SEQ ID NO: 3048133 - RNA, 12 nt, Mycobacterium bovis subsp bovis AF2122/97
ccgcggagcgca

SEQ ID NO: 3048134 - RNA, 13 nt, Mycobacterium bovis subsp bovis AF2122/97
ccgcggagcgcau

SEQ ID NO: 3048135 - RNA, 17 nt, Mycobacterium bovis subsp bovis AF2122/97
ccgcggaggcggccagc

SEQ ID NO: 3048136 - RNA, 18 nt, Mycobacterium bovis subsp bovis AF2122/97
ccgcggaggcggccagcc

SEQ ID NO: 3048137 - RNA, 19 nt, Mycobacterium bovis subsp bovis AF2122/97
ccgcggaggcggccagccu

SEQ ID NO: 3048138 - RNA, 17 nt, Mycobacterium bovis subsp bovis AF2122/97
ccgcggauaggccgcgc

SEQ ID NO: 3048139 - RNA, 19 nt, Mycobacterium bovis subsp bovis AF2122/97
ccgcggaucaccaucgccg

SEQ ID NO: 3048140 - RNA, 21 nt, Mycobacterium bovis subsp bovis AF2122/97
ccgcggaucaccaucgccgcc

SEQ ID NO: 3048141 - RNA, 23 nt, Mycobacterium bovis subsp bovis AF2122/97
ccgcggaucaccaucgccgccgc

SEQ ID NO: 3048142 - RNA, 22 nt, Mycobacterium bovis subsp bovis AF2122/97
ccgcggaucauccuucgccggc

SEQ ID NO: 3048143 - RNA, 13 nt, Mycobacterium bovis subsp bovis AF2122/97
ccgcggaucgacc

SEQ ID NO: 3048144 - RNA, 21 nt, Mycobacterium bovis subsp bovis AF2122/97
ccgcggaucgacuucgacgac

SEQ ID NO: 3048145 - RNA, 21 nt, Mycobacterium bovis subsp bovis AF2122/97
ccgcggaugcucaggucaccg

SEQ ID NO: 3048146 - RNA, 22 nt, Mycobacterium bovis subsp bovis AF2122/97
ccgcggcaacaccaccucgacg

SEQ ID NO: 3048147 - RNA, 12 nt, Mycobacterium bovis subsp bovis AF2122/97
ccgcggcaacgc

SEQ ID NO: 3048148 - RNA, 17 nt, Mycobacterium bovis subsp bovis AF2122/97
ccgcggcaacgcggucu

SEQ ID NO: 3048149 - RNA, 15 nt, Mycobacterium bovis subsp bovis AF2122/97
ccgcggcaccgcccc

SEQ ID NO: 3048150 - RNA, 17 nt, Mycobacterium bovis subsp bovis AF2122/97
ccgcggcaccgccccgc

SEQ ID NO: 3048151 - RNA, 14 nt, Mycobacterium bovis subsp bovis AF2122/97
ccgcggcaccgccg

SEQ ID NO: 3048152 - RNA, 22 nt, Mycobacterium bovis subsp bovis AF2122/97
ccgcggcaccuuguagcgggca

SEQ ID NO: 3048153 - RNA, 12 nt, Mycobacterium bovis subsp bovis AF2122/97
ccgcggcacgcu

SEQ ID NO: 3048154 - RNA, 22 nt, Mycobacterium bovis subsp bovis AF2122/97
ccgcggcagcggauacauuucg

SEQ ID NO: 3048155 - RNA, 22 nt, Mycobacterium bovis subsp bovis AF2122/97
ccgcggcagcguugacggucag

SEQ ID NO: 3048156 - RNA, 16 nt, Mycobacterium bovis subsp bovis AF2122/97
ccgcggcaugauuuuu

SEQ ID NO: 3048157 - RNA, 17 nt, Mycobacterium bovis subsp bovis AF2122/97
ccgcggccacaucgcca

SEQ ID NO: 3048158 - RNA, 18 nt, Mycobacterium bovis subsp bovis AF2122/97
ccgcggccacaucgccag

SEQ ID NO: 3048159 - RNA, 21 nt, Mycobacterium bovis subsp bovis AF2122/97
ccgcggccaccaccgccgccg

SEQ ID NO: 3048160 - RNA, 12 nt, Mycobacterium bovis subsp bovis AF2122/97
ccgcggccaccg

SEQ ID NO: 3048161 - RNA, 13 nt, Mycobacterium bovis subsp bovis AF2122/97
ccgcggccaccgc

SEQ ID NO: 3048162 - RNA, 15 nt, Mycobacterium bovis subsp bovis AF2122/97
ccgcggccaccgccg

SEQ ID NO: 3048163 - RNA, 15 nt, Mycobacterium bovis subsp bovis AF2122/97
ccgcgguacgccggu

SEQ ID NO: 3048164 - RNA, 17 nt, Mycobacterium bovis subsp bovis AF2122/97
ccgcgguacgccggucg

SEQ ID NO: 3048165 - RNA, 18 nt, Mycobacterium bovis subsp bovis AF2122/97
ccgcgguacgccggucgg

SEQ ID NO: 3048166 - RNA, 17 nt, Mycobacterium bovis subsp bovis AF2122/97
ccgcgguagacgccgcc

SEQ ID NO: 3048167 - RNA, 18 nt, Mycobacterium bovis subsp bovis AF2122/97
ccgcgguagacgccgccg

SEQ ID NO: 3048168 - RNA, 22 nt, Mycobacterium bovis subsp bovis AF2122/97
ccgcgguagacggcacugugcg

SEQ ID NO: 3048169 - RNA, 15 nt, Mycobacterium bovis subsp bovis AF2122/97
ccgcgguagccgacc

SEQ ID NO: 3048170 - RNA, 18 nt, Mycobacterium bovis subsp bovis AF2122/97
ccgcgguagccgaccgac

SEQ ID NO: 3048171 - RNA, 22 nt, Mycobacterium bovis subsp bovis AF2122/97
ccgcgguagcggaccugcgaga

SEQ ID NO: 3048172 - RNA, 14 nt, Mycobacterium bovis subsp bovis AF2122/97
ccgcggucaccccg

SEQ ID NO: 3048173 - RNA, 23 nt, Mycobacterium bovis subsp bovis AF2122/97
ccgcggucaccccggcucggcca

SEQ ID NO: 3048174 - RNA, 15 nt, Mycobacterium bovis subsp bovis AF2122/97
ccgcggucagcucgg

SEQ ID NO: 3048175 - RNA, 18 nt, Mycobacterium bovis subsp bovis AF2122/97
ccgcggucagcucggcag

SEQ ID NO: 3048176 - RNA, 24 nt, Mycobacterium bovis subsp bovis AF2122/97
ccgcggucgcgacuaccaucgccg

SEQ ID NO: 3048177 - RNA, 20 nt, Mycobacterium bovis subsp bovis AF2122/97
ccgcggucggaccacccggc

SEQ ID NO: 3048178 - RNA, 20 nt, Mycobacterium bovis subsp bovis AF2122/97
ccgcggucggccaccaacuc

SEQ ID NO: 3048179 - RNA, 13 nt, Mycobacterium bovis subsp bovis AF2122/97
ccgcggucggcga

SEQ ID NO: 3048180 - RNA, 15 nt, Mycobacterium bovis subsp bovis AF2122/97
ccgcggucggcgacg

SEQ ID NO: 3048181 - RNA, 14 nt, Mycobacterium bovis subsp bovis AF2122/97
ccgcggucggcgug

SEQ ID NO: 3048182 - RNA, 16 nt, Mycobacterium bovis subsp bovis AF2122/97
ccgcggucggcgugca

SEQ ID NO: 3048183 - RNA, 16 nt, Mycobacterium bovis subsp bovis AF2122/97
ccgcggucguuggcga

SEQ ID NO: 3048184 - RNA, 23 nt, Mycobacterium bovis subsp bovis AF2122/97
ccgcggucucagugcucgcccag

SEQ ID NO: 3048185 - RNA, 22 nt, Mycobacterium bovis subsp bovis AF2122/97
ccgcggucugcgccuucgccag

SEQ ID NO: 3048186 - RNA, 15 nt, Mycobacterium bovis subsp bovis AF2122/97
ccgcggucuucuuca

SEQ ID NO: 3048187 - RNA, 21 nt, Mycobacterium bovis subsp bovis AF2122/97
ccgcggucuucuucaccgccu

SEQ ID NO: 3048188 - RNA, 17 nt, Mycobacterium bovis subsp bovis AF2122/97
ccgcggugaccaccccg

SEQ ID NO: 3048189 - RNA, 14 nt, Mycobacterium bovis subsp bovis AF2122/97
ccgcggugacgcaa

SEQ ID NO: 3048190 - RNA, 20 nt, Mycobacterium bovis subsp bovis AF2122/97
ccgcggugacgcaacaucgg

SEQ ID NO: 3048191 - RNA, 17 nt, Mycobacterium bovis subsp bovis AF2122/97
ccgcggugacgccagcc

SEQ ID NO: 3048192 - RNA, 18 nt, Mycobacterium bovis subsp bovis AF2122/97
ccgcggugacgccagccu

SEQ ID NO: 3048193 - RNA, 19 nt, Mycobacterium bovis subsp bovis AF2122/97
ccgcggugacucggccucc

SEQ ID NO: 3048194 - RNA, 21 nt, Mycobacterium bovis subsp bovis AF2122/97
ccgcggugacucggccuccgc

SEQ ID NO: 3048195 - RNA, 14 nt, Mycobacterium bovis subsp bovis AF2122/97
ccgcggugcccguc

SEQ ID NO: 3048196 - RNA, 22 nt, Mycobacterium bovis subsp bovis AF2122/97
ccgcggugcccgucggauggaa

SEQ ID NO: 3048197 - RNA, 18 nt, Mycobacterium bovis subsp bovis AF2122/97
ccgcgguggaccgggcaa

SEQ ID NO: 3048198 - RNA, 18 nt, Mycobacterium bovis subsp bovis AF2122/97
ccgcgguggcggcgagca

SEQ ID NO: 3048199 - RNA, 18 nt, Mycobacterium bovis subsp bovis AF2122/97
ccgcgguggggucgacgc

SEQ ID NO: 3048200 - RNA, 21 nt, Mycobacterium bovis subsp bovis AF2122/97
ccgcgguguauccgacgucgg

SEQ ID NO: 3048201 - RNA, 19 nt, Mycobacterium bovis subsp bovis AF2122/97
ccgcgguguggcuugcguc

SEQ ID NO: 3048202 - RNA, 18 nt, Mycobacterium bovis subsp bovis AF2122/97
ccgcgguguucguggccg

SEQ ID NO: 3048203 - RNA, 17 nt, Mycobacterium bovis subsp bovis AF2122/97
ccgcgguuggcaguggc

SEQ ID NO: 3048204 - RNA, 23 nt, Mycobacterium bovis subsp bovis AF2122/97
ccgcgguugugcugggugccgca

SEQ ID NO: 3048205 - RNA, 20 nt, Mycobacterium bovis subsp bovis AF2122/97
ccgcgguuugcacgucacgc

SEQ ID NO: 3048206 - RNA, 16 nt, Mycobacterium bovis subsp bovis AF2122/97
ccgcgguuuggcgacg

SEQ ID NO: 3048207 - RNA, 22 nt, Mycobacterium bovis subsp bovis AF2122/97
ccgcgguuuggcgacgucgaca

SEQ ID NO: 3048208 - RNA, 16 nt, Mycobacterium bovis subsp bovis AF2122/97
ccgcgguuuucgccgg

SEQ ID NO: 3048209 - RNA, 14 nt, Mycobacterium bovis subsp bovis AF2122/97
ccgcguacaggccg

SEQ ID NO: 3048210 - RNA, 21 nt, Mycobacterium bovis subsp bovis AF2122/97
ccgcguaccaauucccgcgcg

SEQ ID NO: 3048211 - RNA, 16 nt, Mycobacterium bovis subsp bovis AF2122/97
ccgcguagaccaguga

SEQ ID NO: 3048212 - RNA, 20 nt, Mycobacterium bovis subsp bovis AF2122/97
ccgcguagaccagugaccgc

SEQ ID NO: 3048213 - RNA, 17 nt, Mycobacterium bovis subsp bovis AF2122/97
ccgcguagguggccagc

SEQ ID NO: 3048214 - RNA, 20 nt, Mycobacterium bovis subsp bovis AF2122/97
ccgcguagguggccagcgcg

SEQ ID NO: 3048215 - RNA, 21 nt, Mycobacterium bovis subsp bovis AF2122/97
ccgcguagguggccagcgcgg

SEQ ID NO: 3048216 - RNA, 20 nt, Mycobacterium bovis subsp bovis AF2122/97
ccgcguagugguggaagugu

SEQ ID NO: 3048217 - RNA, 17 nt, Mycobacterium bovis subsp bovis AF2122/97
ccgcguaugccaggacu

SEQ ID NO: 3048218 - RNA, 15 nt, Mycobacterium bovis subsp bovis AF2122/97
ccgcgucaccggagg

SEQ ID NO: 3048219 - RNA, 17 nt, Mycobacterium bovis subsp bovis AF2122/97
ccgcgucacggaccugg

SEQ ID NO: 3048220 - RNA, 23 nt, Mycobacterium bovis subsp bovis AF2122/97
ccgcgucacggaccuggaacugc

SEQ ID NO: 3048221 - RNA, 18 nt, Mycobacterium bovis subsp bovis AF2122/97
ccgcgucacuucccggau

SEQ ID NO: 3048222 - RNA, 19 nt, Mycobacterium bovis subsp bovis AF2122/97
ccgcgucaguccucaucga

SEQ ID NO: 3048223 - RNA, 16 nt, Mycobacterium bovis subsp bovis AF2122/97
ccgcgucaucaccggu

SEQ ID NO: 3048224 - RNA, 17 nt, Mycobacterium bovis subsp bovis AF2122/97
ccgcgucauucaccgcg

SEQ ID NO: 3048225 - RNA, 18 nt, Mycobacterium bovis subsp bovis AF2122/97
ccgcguccaaggcgcgcu

SEQ ID NO: 3048226 - RNA, 23 nt, Mycobacterium bovis subsp bovis AF2122/97
ccgcguccaaggcgcgcugggcg

SEQ ID NO: 3048227 - RNA, 23 nt, Mycobacterium bovis subsp bovis AF2122/97
ccgcguccagaccguagcggccg

SEQ ID NO: 3048228 - RNA, 13 nt, Mycobacterium bovis subsp bovis AF2122/97
ccgcguccgcgcg

SEQ ID NO: 3048229 - RNA, 21 nt, Mycobacterium bovis subsp bovis AF2122/97
ccgcguccucgcccuggccgc

SEQ ID NO: 3048230 - RNA, 15 nt, Mycobacterium bovis subsp bovis AF2122/97
ccgcgucgaacuggg

SEQ ID NO: 3048231 - RNA, 18 nt, Mycobacterium bovis subsp bovis AF2122/97
ccgcgucgaauuccggcu

SEQ ID NO: 3048232 - RNA, 17 nt, Mycobacterium bovis subsp bovis AF2122/97
ccgcgucgagugccgcc

SEQ ID NO: 3048233 - RNA, 19 nt, Mycobacterium bovis subsp bovis AF2122/97
ccgcgucgaguggccgugg

SEQ ID NO: 3048234 - RNA, 12 nt, Mycobacterium bovis subsp bovis AF2122/97
ccgcgucgccgg

SEQ ID NO: 3048235 - RNA, 13 nt, Mycobacterium bovis subsp bovis AF2122/97
ccgcgucgccggc

SEQ ID NO: 3048236 - RNA, 20 nt, Mycobacterium bovis subsp bovis AF2122/97
ccgcgucggacuccgagaga

SEQ ID NO: 3048237 - RNA, 13 nt, Mycobacterium bovis subsp bovis AF2122/97
ccgcgucggcggc

SEQ ID NO: 3048238 - RNA, 15 nt, Mycobacterium bovis subsp bovis AF2122/97
ccgcgucggcggcca

SEQ ID NO: 3048239 - RNA, 15 nt, Mycobacterium bovis subsp bovis AF2122/97
ccgcgucggcggcga

SEQ ID NO: 3048240 - RNA, 16 nt, Mycobacterium bovis subsp bovis AF2122/97
ccgcgucggcggcgac

SEQ ID NO: 3048241 - RNA, 19 nt, Mycobacterium bovis subsp bovis AF2122/97
ccgcgucggcggcgaccgc

SEQ ID NO: 3048242 - RNA, 23 nt, Mycobacterium bovis subsp bovis AF2122/97
ccgcgucggcggcgaccgccagc

SEQ ID NO: 3048243 - RNA, 14 nt, Mycobacterium bovis subsp bovis AF2122/97
ccgcgucguagcca

SEQ ID NO: 3048244 - RNA, 19 nt, Mycobacterium bovis subsp bovis AF2122/97
ccgcgucguagccacgcau

SEQ ID NO: 3048245 - RNA, 22 nt, Mycobacterium bovis subsp bovis AF2122/97
ccgcgucgucgagaaucggcau

SEQ ID NO: 3048246 - RNA, 16 nt, Mycobacterium bovis subsp bovis AF2122/97
ccgcgucuaccaaccg

SEQ ID NO: 3048247 - RNA, 13 nt, Mycobacterium bovis subsp bovis AF2122/97
ccgcgucugcucg

SEQ ID NO: 3048248 - RNA, 16 nt, Mycobacterium bovis subsp bovis AF2122/97
ccgcgucugcucggcg

SEQ ID NO: 3048249 - RNA, 18 nt, Mycobacterium bovis subsp bovis AF2122/97
ccgcucgacggcccgccg

SEQ ID NO: 3048250 - RNA, 15 nt, Mycobacterium bovis subsp bovis AF2122/97
ccgcucgagcagcgc

SEQ ID NO: 3048251 - RNA, 19 nt, Mycobacterium bovis subsp bovis AF2122/97
ccgcucgagcagcgcgccg

SEQ ID NO: 3048252 - RNA, 21 nt, Mycobacterium bovis subsp bovis AF2122/97
ccgcucgagcuacgacgagug

SEQ ID NO: 3048253 - RNA, 15 nt, Mycobacterium bovis subsp bovis AF2122/97
ccgcucgaucggcag

SEQ ID NO: 3048254 - RNA, 17 nt, Mycobacterium bovis subsp bovis AF2122/97
ccgcucgaucggcagcc

SEQ ID NO: 3048255 - RNA, 21 nt, Mycobacterium bovis subsp bovis AF2122/97
ccgcucgaucggcagccaggg

SEQ ID NO: 3048256 - RNA, 14 nt, Mycobacterium bovis subsp bovis AF2122/97
ccgcucgcacagcc

SEQ ID NO: 3048257 - RNA, 16 nt, Mycobacterium bovis subsp bovis AF2122/97
ccgcucgcaggccggc

SEQ ID NO: 3048258 - RNA, 20 nt, Mycobacterium bovis subsp bovis AF2122/97
ccgcucgcaggccggcggcg

SEQ ID NO: 3048259 - RNA, 21 nt, Mycobacterium bovis subsp bovis AF2122/97
ccgcucgcaggccggcggcgg

SEQ ID NO: 3048260 - RNA, 12 nt, Mycobacterium bovis subsp bovis AF2122/97
ccgcucgcccgc

SEQ ID NO: 3048261 - RNA, 15 nt, Mycobacterium bovis subsp bovis AF2122/97
ccgcucgcccgccgc

SEQ ID NO: 3048262 - RNA, 19 nt, Mycobacterium bovis subsp bovis AF2122/97
ccgcucgcccgccgccacc

SEQ ID NO: 3048263 - RNA, 12 nt, Mycobacterium bovis subsp bovis AF2122/97
ccgcucgccgcc

SEQ ID NO: 3048264 - RNA, 16 nt, Mycobacterium bovis subsp bovis AF2122/97
ccgcucgcgagcggcu

SEQ ID NO: 3048265 - RNA, 18 nt, Mycobacterium bovis subsp bovis AF2122/97
ccgcucggaugaguagca

SEQ ID NO: 3048266 - RNA, 12 nt, Mycobacterium bovis subsp bovis AF2122/97
ccgcucggccgc

SEQ ID NO: 3048267 - RNA, 16 nt, Mycobacterium bovis subsp bovis AF2122/97
ccgcucggccgcagcc

SEQ ID NO: 3048268 - RNA, 14 nt, Mycobacterium bovis subsp bovis AF2122/97
ccgcucggccgccg

SEQ ID NO: 3048269 - RNA, 15 nt, Mycobacterium bovis subsp bovis AF2122/97
ccgcucggccgccgg

SEQ ID NO: 3048270 - RNA, 17 nt, Mycobacterium bovis subsp bovis AF2122/97
ccgcucggccgccgggu

SEQ ID NO: 3048271 - RNA, 15 nt, Mycobacterium bovis subsp bovis AF2122/97
ccgcucggccgucag

SEQ ID NO: 3048272 - RNA, 14 nt, Mycobacterium bovis subsp bovis AF2122/97
ccgcucggcgcgcg

SEQ ID NO: 3048273 - RNA, 17 nt, Mycobacterium bovis subsp bovis AF2122/97
ccgcucggcgcgcgggu

SEQ ID NO: 3048274 - RNA, 23 nt, Mycobacterium bovis subsp bovis AF2122/97
ccgcucggcgcgcggguugucgg

SEQ ID NO: 3048275 - RNA, 15 nt, Mycobacterium bovis subsp bovis AF2122/97
ccgcucggcggucgg

SEQ ID NO: 3048276 - RNA, 13 nt, Mycobacterium bovis subsp bovis AF2122/97
ccgcucgggcgcg

SEQ ID NO: 3048277 - RNA, 17 nt, Mycobacterium bovis subsp bovis AF2122/97
ccgcucgggguggucgg

SEQ ID NO: 3048278 - RNA, 18 nt, Mycobacterium bovis subsp bovis AF2122/97
ccgcucgggguggucggc

SEQ ID NO: 3048279 - RNA, 17 nt, Mycobacterium bovis subsp bovis AF2122/97
ccgcucgguaccggucg

SEQ ID NO: 3048280 - RNA, 15 nt, Mycobacterium bovis subsp bovis AF2122/97
ccgcucgguccagcc

SEQ ID NO: 3048281 - RNA, 16 nt, Mycobacterium bovis subsp bovis AF2122/97
ccgcucgguccagccg

SEQ ID NO: 3048282 - RNA, 19 nt, Mycobacterium bovis subsp bovis AF2122/97
ccgcucgucgccgguggca

SEQ ID NO: 3048283 - RNA, 22 nt, Mycobacterium bovis subsp bovis AF2122/97
ccgcucgucgccgguggcaccc

SEQ ID NO: 3048284 - RNA, 20 nt, Mycobacterium bovis subsp bovis AF2122/97
ccgcucgucguccggccacg

SEQ ID NO: 3048285 - RNA, 17 nt, Mycobacterium bovis subsp bovis AF2122/97
ccgcucuccaccccguc

SEQ ID NO: 3048286 - RNA, 17 nt, Mycobacterium bovis subsp bovis AF2122/97
ccgcucugcggccacgc

SEQ ID NO: 3048287 - RNA, 16 nt, Mycobacterium bovis subsp bovis AF2122/97
ccgcugaacaccgugg

SEQ ID NO: 3048288 - RNA, 19 nt, Mycobacterium bovis subsp bovis AF2122/97
ccgcugaacaccgugggcg

SEQ ID NO: 3048289 - RNA, 21 nt, Mycobacterium bovis subsp bovis AF2122/97
ccgcugaacaccgugggcgga

SEQ ID NO: 3048290 - RNA, 23 nt, Mycobacterium bovis subsp bovis AF2122/97
ccgcugaagccaaaugcgcuguc

SEQ ID NO: 3048291 - RNA, 22 nt, Mycobacterium bovis subsp bovis AF2122/97
ccgcugaagcggacccgacagc

SEQ ID NO: 3048292 - RNA, 21 nt, Mycobacterium bovis subsp bovis AF2122/97
ccgcugaaguggcacaagcug

SEQ ID NO: 3048293 - RNA, 14 nt, Mycobacterium bovis subsp bovis AF2122/97
ccgcugaccaucac

SEQ ID NO: 3048294 - RNA, 13 nt, Mycobacterium bovis subsp bovis AF2122/97
ccgcugaccccgg

SEQ ID NO: 3048295 - RNA, 17 nt, Mycobacterium bovis subsp bovis AF2122/97
ccgcugaccccggcagc

SEQ ID NO: 3048296 - RNA, 20 nt, Mycobacterium bovis subsp bovis AF2122/97
ccgcugaccccggcagcgcc

SEQ ID NO: 3048297 - RNA, 12 nt, Mycobacterium bovis subsp bovis AF2122/97
ccgcugaccgca

SEQ ID NO: 3048298 - RNA, 15 nt, Mycobacterium bovis subsp bovis AF2122/97
ccgcugaccgcaacg

SEQ ID NO: 3048299 - RNA, 19 nt, Mycobacterium bovis subsp bovis AF2122/97
ccgcugaccgcaacgcgua

SEQ ID NO: 3048300 - RNA, 21 nt, Mycobacterium bovis subsp bovis AF2122/97
ccgcugacgaagcacaguucg

SEQ ID NO: 3048301 - RNA, 17 nt, Mycobacterium bovis subsp bovis AF2122/97
ccgcugacuccugcggc

SEQ ID NO: 3048302 - RNA, 16 nt, Mycobacterium bovis subsp bovis AF2122/97
ccgcugagccagcucc

SEQ ID NO: 3048303 - RNA, 13 nt, Mycobacterium bovis subsp bovis AF2122/97
ccgcugagcccug

SEQ ID NO: 3048304 - RNA, 14 nt, Mycobacterium bovis subsp bovis AF2122/97
ccgcugagcgggca

SEQ ID NO: 3048305 - RNA, 22 nt, Mycobacterium bovis subsp bovis AF2122/97
ccgcugauagcggucggucacc

SEQ ID NO: 3048306 - RNA, 15 nt, Mycobacterium bovis subsp bovis AF2122/97
ccgcugaucaacaga

SEQ ID NO: 3048307 - RNA, 23 nt, Mycobacterium bovis subsp bovis AF2122/97
ccgcugaucaacagaccuagcac

SEQ ID NO: 3048308 - RNA, 18 nt, Mycobacterium bovis subsp bovis AF2122/97
ccgcugaucaaggcgcuc

SEQ ID NO: 3048309 - RNA, 19 nt, Mycobacterium bovis subsp bovis AF2122/97
ccgcugaucagauccucga

SEQ ID NO: 3048310 - RNA, 21 nt, Mycobacterium bovis subsp bovis AF2122/97
ccgcugaucugccgccgcggc

SEQ ID NO: 3048311 - RNA, 17 nt, Mycobacterium bovis subsp bovis AF2122/97
ccgcugaugagccgcag

SEQ ID NO: 3048312 - RNA, 21 nt, Mycobacterium bovis subsp bovis AF2122/97
ccgcugauguacccggcgacg

SEQ ID NO: 3048313 - RNA, 22 nt, Mycobacterium bovis subsp bovis AF2122/97
ccgcugcaacggagcgagcuca

SEQ ID NO: 3048314 - RNA, 21 nt, Mycobacterium bovis subsp bovis AF2122/97
ccgcugcagguccaggguggu

SEQ ID NO: 3048315 - RNA, 21 nt, Mycobacterium bovis subsp bovis AF2122/97
ccgcugcagugguaccggcgc

SEQ ID NO: 3048316 - RNA, 15 nt, Mycobacterium bovis subsp bovis AF2122/97
ccgcugcauccgcag

SEQ ID NO: 3048317 - RNA, 23 nt, Mycobacterium bovis subsp bovis AF2122/97
ccgcugcauccgcagcaccaagg

SEQ ID NO: 3048318 - RNA, 21 nt, Mycobacterium bovis subsp bovis AF2122/97
ccgcugccacccaucgcacgg

SEQ ID NO: 3048319 - RNA, 24 nt, Mycobacterium bovis subsp bovis AF2122/97
ccgcugccacccaucgcacggaug

SEQ ID NO: 3048320 - RNA, 13 nt, Mycobacterium bovis subsp bovis AF2122/97
ccgcugccagccg

SEQ ID NO: 3048321 - RNA, 15 nt, Mycobacterium bovis subsp bovis AF2122/97
ccgcugccaucgccu

SEQ ID NO: 3048322 - RNA, 22 nt, Mycobacterium bovis subsp bovis AF2122/97
ccgcugccaucggcaccagcgc

SEQ ID NO: 3048323 - RNA, 23 nt, Mycobacterium bovis subsp bovis AF2122/97
ccgcugccaucggcaccagcgcg

SEQ ID NO: 3048324 - RNA, 14 nt, Mycobacterium bovis subsp bovis AF2122/97
ccgcugccauugcc

SEQ ID NO: 3048325 - RNA, 20 nt, Mycobacterium bovis subsp bovis AF2122/97
ccgcugccauugccugggcg

SEQ ID NO: 3048326 - RNA, 20 nt, Mycobacterium bovis subsp bovis AF2122/97
ccgcugccgaagcggccacc

SEQ ID NO: 3048327 - RNA, 22 nt, Mycobacterium bovis subsp bovis AF2122/97
ccgcugccgaagcggccaccgc

SEQ ID NO: 3048328 - RNA, 17 nt, Mycobacterium bovis subsp bovis AF2122/97
ccgcugccgacgcguuc

SEQ ID NO: 3048329 - RNA, 13 nt, Mycobacterium bovis subsp bovis AF2122/97
ccgcugccgcccu

SEQ ID NO: 3048330 - RNA, 23 nt, Mycobacterium bovis subsp bovis AF2122/97
ccgcugccgcccuugccgcccgc

SEQ ID NO: 3048331 - RNA, 23 nt, Mycobacterium bovis subsp bovis AF2122/97
ccgcugccgccgagcuggcgcgc

SEQ ID NO: 3048332 - RNA, 14 nt, Mycobacterium bovis subsp bovis AF2122/97
ccgcugccgccggu

SEQ ID NO: 3048333 - RNA, 14 nt, Mycobacterium bovis subsp bovis AF2122/97
ccgcugccgcgcgg

SEQ ID NO: 3048334 - RNA, 15 nt, Mycobacterium bovis subsp bovis AF2122/97
ccgcugccgcgcggc

SEQ ID NO: 3048335 - RNA, 21 nt, Mycobacterium bovis subsp bovis AF2122/97
ccggaaguugaucuugccgcc

SEQ ID NO: 3048336 - RNA, 18 nt, Mycobacterium bovis subsp bovis AF2122/97
ccggaauacgcgccgccg

SEQ ID NO: 3048337 - RNA, 19 nt, Mycobacterium bovis subsp bovis AF2122/97
ccggaauacgcgccgccgg

SEQ ID NO: 3048338 - RNA, 20 nt, Mycobacterium bovis subsp bovis AF2122/97
ccggaauacgcgccgccggc

SEQ ID NO: 3048339 - RNA, 18 nt, Mycobacterium bovis subsp bovis AF2122/97
ccggaauauggcggccgg

SEQ ID NO: 3048340 - RNA, 18 nt, Mycobacterium bovis subsp bovis AF2122/97
ccggaauccccaagcccg

SEQ ID NO: 3048341 - RNA, 19 nt, Mycobacterium bovis subsp bovis AF2122/97
ccggaauccccccugucgc

SEQ ID NO: 3048342 - RNA, 17 nt, Mycobacterium bovis subsp bovis AF2122/97
ccggaauccuggccgcc

SEQ ID NO: 3048343 - RNA, 18 nt, Mycobacterium bovis subsp bovis AF2122/97
ccggaauccuggccgccg

SEQ ID NO: 3048344 - RNA, 14 nt, Mycobacterium bovis subsp bovis AF2122/97
ccggaaucgaugau

SEQ ID NO: 3048345 - RNA, 13 nt, Mycobacterium bovis subsp bovis AF2122/97
ccggaaucgcccg

SEQ ID NO: 3048346 - RNA, 19 nt, Mycobacterium bovis subsp bovis AF2122/97
ccggaaucggcggcggauu

SEQ ID NO: 3048347 - RNA, 19 nt, Mycobacterium bovis subsp bovis AF2122/97
ccggaaucgucgcggccgu

SEQ ID NO: 3048348 - RNA, 22 nt, Mycobacterium bovis subsp bovis AF2122/97
ccggaaucgucgcggccgucgc

SEQ ID NO: 3048349 - RNA, 24 nt, Mycobacterium bovis subsp bovis AF2122/97
ccggaaucgucgcggccgucgcgg

SEQ ID NO: 3048350 - RNA, 14 nt, Mycobacterium bovis subsp bovis AF2122/97
ccggacaaacaucg

SEQ ID NO: 3048351 - RNA, 18 nt, Mycobacterium bovis subsp bovis AF2122/97
ccggacaaagcugcucgu

SEQ ID NO: 3048352 - RNA, 21 nt, Mycobacterium bovis subsp bovis AF2122/97
ccggacaaagcugcucgucgg

SEQ ID NO: 3048353 - RNA, 23 nt, Mycobacterium bovis subsp bovis AF2122/97
ccggacaaagcugcucgucggcg

SEQ ID NO: 3048354 - RNA, 23 nt, Mycobacterium bovis subsp bovis AF2122/97
ccggacaacagagucaccgcgcu

SEQ ID NO: 3048355 - RNA, 20 nt, Mycobacterium bovis subsp bovis AF2122/97
ccggacaaccuggggccacc

SEQ ID NO: 3048356 - RNA, 21 nt, Mycobacterium bovis subsp bovis AF2122/97
ccggacaaccuggggccacca

SEQ ID NO: 3048357 - RNA, 18 nt, Mycobacterium bovis subsp bovis AF2122/97
ccggacacgaucagucca

SEQ ID NO: 3048358 - RNA, 23 nt, Mycobacterium bovis subsp bovis AF2122/97
ccggacacgaucaguccaugugg

SEQ ID NO: 3048359 - RNA, 14 nt, Mycobacterium bovis subsp bovis AF2122/97
ccggacagcgcauc

SEQ ID NO: 3048360 - RNA, 15 nt, Mycobacterium bovis subsp bovis AF2122/97
ccggacagcgcaucc

SEQ ID NO: 3048361 - RNA, 13 nt, Mycobacterium bovis subsp bovis AF2122/97
ccggacagcucgc

SEQ ID NO: 3048362 - RNA, 14 nt, Mycobacterium bovis subsp bovis AF2122/97
ccggacaggcuuga

SEQ ID NO: 3048363 - RNA, 13 nt, Mycobacterium bovis subsp bovis AF2122/97
ccggacagggcgg

SEQ ID NO: 3048364 - RNA, 15 nt, Mycobacterium bovis subsp bovis AF2122/97
ccggacagggcggcg

SEQ ID NO: 3048365 - RNA, 16 nt, Mycobacterium bovis subsp bovis AF2122/97
ccggacagggcggcga

SEQ ID NO: 3048366 - RNA, 17 nt, Mycobacterium bovis subsp bovis AF2122/97
ccggacagggcggcgag

SEQ ID NO: 3048367 - RNA, 17 nt, Mycobacterium bovis subsp bovis AF2122/97
ccggacauagccgcgcu

SEQ ID NO: 3048368 - RNA, 18 nt, Mycobacterium bovis subsp bovis AF2122/97
ccggacaugcgggcagca

SEQ ID NO: 3048369 - RNA, 23 nt, Mycobacterium bovis subsp bovis AF2122/97
ccggacaugcgggcagcacucuu

SEQ ID NO: 3048370 - RNA, 14 nt, Mycobacterium bovis subsp bovis AF2122/97
ccggaccaccgccg

SEQ ID NO: 3048371 - RNA, 15 nt, Mycobacterium bovis subsp bovis AF2122/97
ccggaccaccgccga

SEQ ID NO: 3048372 - RNA, 13 nt, Mycobacterium bovis subsp bovis AF2122/97
ccggaccagagcc

SEQ ID NO: 3048373 - RNA, 13 nt, Mycobacterium bovis subsp bovis AF2122/97
ccggaccaucagc

SEQ ID NO: 3048374 - RNA, 16 nt, Mycobacterium bovis subsp bovis AF2122/97
ccggaccaucgacaac

SEQ ID NO: 3048375 - RNA, 20 nt, Mycobacterium bovis subsp bovis AF2122/97
ccggaccaucgacaacgccu

SEQ ID NO: 3048376 - RNA, 21 nt, Mycobacterium bovis subsp bovis AF2122/97
ccggacccaccaauccacaga

SEQ ID NO: 3048377 - RNA, 16 nt, Mycobacterium bovis subsp bovis AF2122/97
ccggacccacccgcac

SEQ ID NO: 3048378 - RNA, 22 nt, Mycobacterium bovis subsp bovis AF2122/97
ccggacccacccgcaccgccgg

SEQ ID NO: 3048379 - RNA, 18 nt, Mycobacterium bovis subsp bovis AF2122/97
ccggacccauuggaccga

SEQ ID NO: 3048380 - RNA, 22 nt, Mycobacterium bovis subsp bovis AF2122/97
ccggacccgcccuugccgccga

SEQ ID NO: 3048381 - RNA, 20 nt, Mycobacterium bovis subsp bovis AF2122/97
ccggacccgccggguccgcc

SEQ ID NO: 3048382 - RNA, 15 nt, Mycobacterium bovis subsp bovis AF2122/97
ccggacccggugcac

SEQ ID NO: 3048383 - RNA, 14 nt, Mycobacterium bovis subsp bovis AF2122/97
ccggaccgccgcaa

SEQ ID NO: 3048384 - RNA, 22 nt, Mycobacterium bovis subsp bovis AF2122/97
ccggaccgcgacggcgccggca

SEQ ID NO: 3048385 - RNA, 22 nt, Mycobacterium bovis subsp bovis AF2122/97
ccggaccgcggauuccagcgcg

SEQ ID NO: 3048386 - RNA, 23 nt, Mycobacterium bovis subsp bovis AF2122/97
ccggaccgcggauuccagcgcgu

SEQ ID NO: 3048387 - RNA, 21 nt, Mycobacterium bovis subsp bovis AF2122/97
ccggaccgguguggcgcauca

SEQ ID NO: 3048388 - RNA, 18 nt, Mycobacterium bovis subsp bovis AF2122/97
ccggaccugaccgguggc

SEQ ID NO: 3048389 - RNA, 15 nt, Mycobacterium bovis subsp bovis AF2122/97
ccggaccuuguuggc

SEQ ID NO: 3048390 - RNA, 24 nt, Mycobacterium bovis subsp bovis AF2122/97
ccggacgaacgccgucgacgcggc

SEQ ID NO: 3048391 - RNA, 13 nt, Mycobacterium bovis subsp bovis AF2122/97
ccggacgaccgga

SEQ ID NO: 3048392 - RNA, 19 nt, Mycobacterium bovis subsp bovis AF2122/97
ccggacgagcgucagaucc

SEQ ID NO: 3048393 - RNA, 16 nt, Mycobacterium bovis subsp bovis AF2122/97
ccggacgagugcacac

SEQ ID NO: 3048394 - RNA, 13 nt, Mycobacterium bovis subsp bovis AF2122/97
ccggacgauggcg

SEQ ID NO: 3048395 - RNA, 18 nt, Mycobacterium bovis subsp bovis AF2122/97
ccggacgauggcgucggc

SEQ ID NO: 3048396 - RNA, 19 nt, Mycobacterium bovis subsp bovis AF2122/97
ccggacgauggcgucggcc

SEQ ID NO: 3048397 - RNA, 20 nt, Mycobacterium bovis subsp bovis AF2122/97
ccggacgauggcgucggcca

SEQ ID NO: 3048398 - RNA, 21 nt, Mycobacterium bovis subsp bovis AF2122/97
ccggacgauggcgucggccag

SEQ ID NO: 3048399 - RNA, 16 nt, Mycobacterium bovis subsp bovis AF2122/97
ccggacgcaacacccg

SEQ ID NO: 3048400 - RNA, 18 nt, Mycobacterium bovis subsp bovis AF2122/97
ccggacgcaacacccggg

SEQ ID NO: 3048401 - RNA, 21 nt, Mycobacterium bovis subsp bovis AF2122/97
ccggacgcaacacccgggcga

SEQ ID NO: 3048402 - RNA, 22 nt, Mycobacterium bovis subsp bovis AF2122/97
ccggacgcacgauccgcacccg

SEQ ID NO: 3048403 - RNA, 23 nt, Mycobacterium bovis subsp bovis AF2122/97
ccggacgccaugcccgcacgcuc

SEQ ID NO: 3048404 - RNA, 20 nt, Mycobacterium bovis subsp bovis AF2122/97
ccggacgcccucacgccaag

SEQ ID NO: 3048405 - RNA, 19 nt, Mycobacterium bovis subsp bovis AF2122/97
ccggacgcugauugcgacc

SEQ ID NO: 3048406 - RNA, 18 nt, Mycobacterium bovis subsp bovis AF2122/97
ccggacggcaggcuggcg

SEQ ID NO: 3048407 - RNA, 21 nt, Mycobacterium bovis subsp bovis AF2122/97
ccggacggggaggucaaaauc

SEQ ID NO: 3048408 - RNA, 17 nt, Mycobacterium bovis subsp bovis AF2122/97
ccggacgggugcagcgc

SEQ ID NO: 3048409 - RNA, 18 nt, Mycobacterium bovis subsp bovis AF2122/97
ccggacgggugcagcgca

SEQ ID NO: 3048410 - RNA, 18 nt, Mycobacterium bovis subsp bovis AF2122/97
ccggacgggugcgggccg

SEQ ID NO: 3048411 - RNA, 19 nt, Mycobacterium bovis subsp bovis AF2122/97
ccggacguaggcaccccgg

SEQ ID NO: 3048412 - RNA, 22 nt, Mycobacterium bovis subsp bovis AF2122/97
ccggacguaggcaccccggugc

SEQ ID NO: 3048413 - RNA, 14 nt, Mycobacterium bovis subsp bovis AF2122/97
ccggacgucggcgg

SEQ ID NO: 3048414 - RNA, 17 nt, Mycobacterium bovis subsp bovis AF2122/97
ccggacgucggcggccg

SEQ ID NO: 3048415 - RNA, 15 nt, Mycobacterium bovis subsp bovis AF2122/97
ccggacguucuggau

SEQ ID NO: 3048416 - RNA, 19 nt, Mycobacterium bovis subsp bovis AF2122/97
ccggacguucuggaucgug

SEQ ID NO: 3048417 - RNA, 12 nt, Mycobacterium bovis subsp bovis AF2122/97
ccggacuaccgc

SEQ ID NO: 3048418 - RNA, 16 nt, Mycobacterium bovis subsp bovis AF2122/97
ccggacuaccgccggc

SEQ ID NO: 3048419 - RNA, 17 nt, Mycobacterium bovis subsp bovis AF2122/97
ccggacuaccgccggcg

SEQ ID NO: 3048420 - RNA, 18 nt, Mycobacterium bovis subsp bovis AF2122/97
ccggacuaccgccggcgg

SEQ ID NO: 3048421 - RNA, 16 nt, Mycobacterium bovis subsp bovis AF2122/97
ccggaucugacggcgc

SEQ ID NO: 3048422 - RNA, 19 nt, Mycobacterium bovis subsp bovis AF2122/97
ccggaugacaccgaccggg

SEQ ID NO: 3048423 - RNA, 16 nt, Mycobacterium bovis subsp bovis AF2122/97
ccggaugaugucgguc

SEQ ID NO: 3048424 - RNA, 12 nt, Mycobacterium bovis subsp bovis AF2122/97
ccggaugcgcaa

SEQ ID NO: 3048425 - RNA, 13 nt, Mycobacterium bovis subsp bovis AF2122/97
ccggaugcggucc

SEQ ID NO: 3048426 - RNA, 19 nt, Mycobacterium bovis subsp bovis AF2122/97
ccggaugcggucccugauc

SEQ ID NO: 3048427 - RNA, 17 nt, Mycobacterium bovis subsp bovis AF2122/97
ccggaugcugucagcag

SEQ ID NO: 3048428 - RNA, 19 nt, Mycobacterium bovis subsp bovis AF2122/97
ccggauggccccgccaaac

SEQ ID NO: 3048429 - RNA, 18 nt, Mycobacterium bovis subsp bovis AF2122/97
ccggauggucggccacgc

SEQ ID NO: 3048430 - RNA, 17 nt, Mycobacterium bovis subsp bovis AF2122/97
ccggauguauuccaggc

SEQ ID NO: 3048431 - RNA, 13 nt, Mycobacterium bovis subsp bovis AF2122/97
ccggauguccgcc

SEQ ID NO: 3048432 - RNA, 21 nt, Mycobacterium bovis subsp bovis AF2122/97
ccggaugucgacgagcaccgc

SEQ ID NO: 3048433 - RNA, 22 nt, Mycobacterium bovis subsp bovis AF2122/97
ccggaugucgacgagcaccgcg

SEQ ID NO: 3048434 - RNA, 20 nt, Mycobacterium bovis subsp bovis AF2122/97
ccggaugucgugcgggcgca

SEQ ID NO: 3048435 - RNA, 16 nt, Mycobacterium bovis subsp bovis AF2122/97
ccggauuauucgcggu

SEQ ID NO: 3048436 - RNA, 21 nt, Mycobacterium bovis subsp bovis AF2122/97
ccggauuccucgucaccgcga

SEQ ID NO: 3048437 - RNA, 17 nt, Mycobacterium bovis subsp bovis AF2122/97
ccggauucgcccgggcg

SEQ ID NO: 3048438 - RNA, 14 nt, Mycobacterium bovis subsp bovis AF2122/97
ccggauucggcugc

SEQ ID NO: 3048439 - RNA, 15 nt, Mycobacterium bovis subsp bovis AF2122/97
ccggauucuccgccc

SEQ ID NO: 3048440 - RNA, 17 nt, Mycobacterium bovis subsp bovis AF2122/97
ccggauucuucggugaa

SEQ ID NO: 3048441 - RNA, 23 nt, Mycobacterium bovis subsp bovis AF2122/97
ccggauugaagucgucggccauc

SEQ ID NO: 3048442 - RNA, 20 nt, Mycobacterium bovis subsp bovis AF2122/97
ccggauugcuguacugcggu

SEQ ID NO: 3048443 - RNA, 17 nt, Mycobacterium bovis subsp bovis AF2122/97
ccggcaaaggacgucga

SEQ ID NO: 3048444 - RNA, 19 nt, Mycobacterium bovis subsp bovis AF2122/97
ccggcaaaggacgucgacc

SEQ ID NO: 3048445 - RNA, 13 nt, Mycobacterium bovis subsp bovis AF2122/97
ccggcaacagcac

SEQ ID NO: 3048446 - RNA, 17 nt, Mycobacterium bovis subsp bovis AF2122/97
ccggcaacagcucgccu

SEQ ID NO: 3048447 - RNA, 16 nt, Mycobacterium bovis subsp bovis AF2122/97
ccggcaacaucggguu

SEQ ID NO: 3048448 - RNA, 16 nt, Mycobacterium bovis subsp bovis AF2122/97
ccggcaaccaccggcc

SEQ ID NO: 3048449 - RNA, 18 nt, Mycobacterium bovis subsp bovis AF2122/97
ccggcaaccaccggccgc

SEQ ID NO: 3048450 - RNA, 20 nt, Mycobacterium bovis subsp bovis AF2122/97
ccggcaaccaccggccgcgc

SEQ ID NO: 3048451 - RNA, 21 nt, Mycobacterium bovis subsp bovis AF2122/97
ccggcaaccaccggccgcgca

SEQ ID NO: 3048452 - RNA, 13 nt, Mycobacterium bovis subsp bovis AF2122/97
ccggcaaccgccg

SEQ ID NO: 3048453 - RNA, 12 nt, Mycobacterium bovis subsp bovis AF2122/97
ccggcaaccggg

SEQ ID NO: 3048454 - RNA, 14 nt, Mycobacterium bovis subsp bovis AF2122/97
ccggcaaccgggau

SEQ ID NO: 3048455 - RNA, 15 nt, Mycobacterium bovis subsp bovis AF2122/97
ccggcaaccuggacu

SEQ ID NO: 3048456 - RNA, 13 nt, Mycobacterium bovis subsp bovis AF2122/97
ccggcaacgcggc

SEQ ID NO: 3048457 - RNA, 14 nt, Mycobacterium bovis subsp bovis AF2122/97
ccggcaacgcggcc

SEQ ID NO: 3048458 - RNA, 13 nt, Mycobacterium bovis subsp bovis AF2122/97
ccggcaacggcgc

SEQ ID NO: 3048459 - RNA, 20 nt, Mycobacterium bovis subsp bovis AF2122/97
ccggcaacggcgcgccgacc

SEQ ID NO: 3048460 - RNA, 16 nt, Mycobacterium bovis subsp bovis AF2122/97
ccggcaacgugcggug

SEQ ID NO: 3048461 - RNA, 20 nt, Mycobacterium bovis subsp bovis AF2122/97
ccggcaagaccgaacagcgg

SEQ ID NO: 3048462 - RNA, 16 nt, Mycobacterium bovis subsp bovis AF2122/97
ccggcaagcacaccgc

SEQ ID NO: 3048463 - RNA, 17 nt, Mycobacterium bovis subsp bovis AF2122/97
ccggcaagcacaccgcc

SEQ ID NO: 3048464 - RNA, 18 nt, Mycobacterium bovis subsp bovis AF2122/97
ccggcaagcacaccgcca

SEQ ID NO: 3048465 - RNA, 23 nt, Mycobacterium bovis subsp bovis AF2122/97
ccggcaagcacaccgccagcggc

SEQ ID NO: 3048466 - RNA, 16 nt, Mycobacterium bovis subsp bovis AF2122/97
ccggcaagccacgccg

SEQ ID NO: 3048467 - RNA, 19 nt, Mycobacterium bovis subsp bovis AF2122/97
ccggcaagccacgccgguc

SEQ ID NO: 3048468 - RNA, 17 nt, Mycobacterium bovis subsp bovis AF2122/97
ccggcaagccgauugcu

SEQ ID NO: 3048469 - RNA, 15 nt, Mycobacterium bovis subsp bovis AF2122/97
ccggcaagccugcgc

SEQ ID NO: 3048470 - RNA, 12 nt, Mycobacterium bovis subsp bovis AF2122/97
ccggcaagcgca

SEQ ID NO: 3048471 - RNA, 17 nt, Mycobacterium bovis subsp bovis AF2122/97
ccggcaagcgcagacac

SEQ ID NO: 3048472 - RNA, 16 nt, Mycobacterium bovis subsp bovis AF2122/97
ccggcaauaccgccag

SEQ ID NO: 3048473 - RNA, 19 nt, Mycobacterium bovis subsp bovis AF2122/97
ccggcaauaccgccagcgc

SEQ ID NO: 3048474 - RNA, 23 nt, Mycobacterium bovis subsp bovis AF2122/97
ccggcaauaccgccagcgccacc

SEQ ID NO: 3048475 - RNA, 15 nt, Mycobacterium bovis subsp bovis AF2122/97
ccggcaaucggcggc

SEQ ID NO: 3048476 - RNA, 16 nt, Mycobacterium bovis subsp bovis AF2122/97
ccggcaaucggcggca

SEQ ID NO: 3048477 - RNA, 18 nt, Mycobacterium bovis subsp bovis AF2122/97
ccggcaaucggcggcacc

SEQ ID NO: 3048478 - RNA, 23 nt, Mycobacterium bovis subsp bovis AF2122/97
ccggcaaucggcggcacccgggu

SEQ ID NO: 3048479 - RNA, 19 nt, Mycobacterium bovis subsp bovis AF2122/97
ccggcaaucucccgaaucg

SEQ ID NO: 3048480 - RNA, 18 nt, Mycobacterium bovis subsp bovis AF2122/97
ccggcaauuccguuaggc

SEQ ID NO: 3048481 - RNA, 19 nt, Mycobacterium bovis subsp bovis AF2122/97
ccggcaauuuucugcugcu

SEQ ID NO: 3048482 - RNA, 16 nt, Mycobacterium bovis subsp bovis AF2122/97
ccggcacacggccuug

SEQ ID NO: 3048483 - RNA, 23 nt, Mycobacterium bovis subsp bovis AF2122/97
ccggcacauugaucgacggccag

SEQ ID NO: 3048484 - RNA, 15 nt, Mycobacterium bovis subsp bovis AF2122/97
ccggcaccaaccacc

SEQ ID NO: 3048485 - RNA, 16 nt, Mycobacterium bovis subsp bovis AF2122/97
ccggcaccaaccaccg

SEQ ID NO: 3048486 - RNA, 12 nt, Mycobacterium bovis subsp bovis AF2122/97
ccggcaccaacg

SEQ ID NO: 3048487 - RNA, 21 nt, Mycobacterium bovis subsp bovis AF2122/97
ccggcaccaacgccaccgucg

SEQ ID NO: 3048488 - RNA, 13 nt, Mycobacterium bovis subsp bovis AF2122/97
ccggcaccacgau

SEQ ID NO: 3048489 - RNA, 13 nt, Mycobacterium bovis subsp bovis AF2122/97
ccggcaccagcgg

SEQ ID NO: 3048490 - RNA, 14 nt, Mycobacterium bovis subsp bovis AF2122/97
ccggcaccagcggc

SEQ ID NO: 3048491 - RNA, 15 nt, Mycobacterium bovis subsp bovis AF2122/97
ccggcaccagcggca

SEQ ID NO: 3048492 - RNA, 19 nt, Mycobacterium bovis subsp bovis AF2122/97
ccggcaccagcggcaccgc

SEQ ID NO: 3048493 - RNA, 14 nt, Mycobacterium bovis subsp bovis AF2122/97
ccggcacccaccag

SEQ ID NO: 3048494 - RNA, 13 nt, Mycobacterium bovis subsp bovis AF2122/97
ccggcacccaguu

SEQ ID NO: 3048495 - RNA, 22 nt, Mycobacterium bovis subsp bovis AF2122/97
ccggcacccaguuccacccggu

SEQ ID NO: 3048496 - RNA, 12 nt, Mycobacterium bovis subsp bovis AF2122/97
ccggcaccccac

SEQ ID NO: 3048497 - RNA, 16 nt, Mycobacterium bovis subsp bovis AF2122/97
ccggcaccccacggcc

SEQ ID NO: 3048498 - RNA, 16 nt, Mycobacterium bovis subsp bovis AF2122/97
ccggcacccccgucgc

SEQ ID NO: 3048499 - RNA, 15 nt, Mycobacterium bovis subsp bovis AF2122/97
ccggcaccccuuuga

SEQ ID NO: 3048500 - RNA, 23 nt, Mycobacterium bovis subsp bovis AF2122/97
ccggcaccccuuugacgccgagc

SEQ ID NO: 3048501 - RNA, 16 nt, Mycobacterium bovis subsp bovis AF2122/97
ccggcacccgaguuau

SEQ ID NO: 3048502 - RNA, 15 nt, Mycobacterium bovis subsp bovis AF2122/97
ccggcacccgcacgg

SEQ ID NO: 3048503 - RNA, 17 nt, Mycobacterium bovis subsp bovis AF2122/97
ccggcacccgcacggcc

SEQ ID NO: 3048504 - RNA, 20 nt, Mycobacterium bovis subsp bovis AF2122/97
ccggcacccgcacggccucc

SEQ ID NO: 3048505 - RNA, 12 nt, Mycobacterium bovis subsp bovis AF2122/97
ccggcacccgcc

SEQ ID NO: 3048506 - RNA, 14 nt, Mycobacterium bovis subsp bovis AF2122/97
ccggcacccgcggc

SEQ ID NO: 3048507 - RNA, 17 nt, Mycobacterium bovis subsp bovis AF2122/97
ccggcacccgcggcgaa

SEQ ID NO: 3048508 - RNA, 20 nt, Mycobacterium bovis subsp bovis AF2122/97
ccggcaguucgcggccaucg

SEQ ID NO: 3048509 - RNA, 22 nt, Mycobacterium bovis subsp bovis AF2122/97
ccggcauaaaccgcguccgcgc

SEQ ID NO: 3048510 - RNA, 14 nt, Mycobacterium bovis subsp bovis AF2122/97
ccggcauaacgauc

SEQ ID NO: 3048511 - RNA, 15 nt, Mycobacterium bovis subsp bovis AF2122/97
ccggcauacaccgug

SEQ ID NO: 3048512 - RNA, 20 nt, Mycobacterium bovis subsp bovis AF2122/97
ccggcaucgaagugcggccc

SEQ ID NO: 3048513 - RNA, 21 nt, Mycobacterium bovis subsp bovis AF2122/97
ccggcaucgagacgcacggcc

SEQ ID NO: 3048514 - RNA, 15 nt, Mycobacterium bovis subsp bovis AF2122/97
ccggcaucgaucaac

SEQ ID NO: 3048515 - RNA, 19 nt, Mycobacterium bovis subsp bovis AF2122/97
ccggcaucgaucaacacca

SEQ ID NO: 3048516 - RNA, 12 nt, Mycobacterium bovis subsp bovis AF2122/97
ccggcaucgcgc

SEQ ID NO: 3048517 - RNA, 14 nt, Mycobacterium bovis subsp bovis AF2122/97
ccggcaucgcgcgc

SEQ ID NO: 3048518 - RNA, 16 nt, Mycobacterium bovis subsp bovis AF2122/97
ccggcaucgcgcgcgg

SEQ ID NO: 3048519 - RNA, 15 nt, Mycobacterium bovis subsp bovis AF2122/97
ccggcaucggucagc

SEQ ID NO: 3048520 - RNA, 19 nt, Mycobacterium bovis subsp bovis AF2122/97
ccggcaucggucagcgcgg

SEQ ID NO: 3048521 - RNA, 21 nt, Mycobacterium bovis subsp bovis AF2122/97
ccggcaucgucgacgcccgau

SEQ ID NO: 3048522 - RNA, 18 nt, Mycobacterium bovis subsp bovis AF2122/97
ccggcaucuccaccgucg

SEQ ID NO: 3048523 - RNA, 23 nt, Mycobacterium bovis subsp bovis AF2122/97
ccggcaucuccaccgucgccgcc

SEQ ID NO: 3048524 - RNA, 13 nt, Mycobacterium bovis subsp bovis AF2122/97
ccggcaugcccgc

SEQ ID NO: 3048525 - RNA, 22 nt, Mycobacterium bovis subsp bovis AF2122/97
ccggcaugccgccaugcgcacc

SEQ ID NO: 3048526 - RNA, 23 nt, Mycobacterium bovis subsp bovis AF2122/97
ccggcaugccgccaugcgcacca

SEQ ID NO: 3048527 - RNA, 20 nt, Mycobacterium bovis subsp bovis AF2122/97
ccggcaugcgugccggcagc

SEQ ID NO: 3048528 - RNA, 20 nt, Mycobacterium bovis subsp bovis AF2122/97
ccggcauuccguaggccaca

SEQ ID NO: 3048529 - RNA, 22 nt, Mycobacterium bovis subsp bovis AF2122/97
ccggcauuccguaggccacagc

SEQ ID NO: 3048530 - RNA, 14 nt, Mycobacterium bovis subsp bovis AF2122/97
ccggcauugaccca

SEQ ID NO: 3048531 - RNA, 15 nt, Mycobacterium bovis subsp bovis AF2122/97
ccggcauugagccgg

SEQ ID NO: 3048532 - RNA, 17 nt, Mycobacterium bovis subsp bovis AF2122/97
ccggcauugagccgggc

SEQ ID NO: 3048533 - RNA, 14 nt, Mycobacterium bovis subsp bovis AF2122/97
ccggcauugccgcc

SEQ ID NO: 3048534 - RNA, 16 nt, Mycobacterium bovis subsp bovis AF2122/97
ccggcauugccgccgu

SEQ ID NO: 3048535 - RNA, 23 nt, Mycobacterium bovis subsp bovis AF2122/97
ccggccaaaacauaucggugccg

SEQ ID NO: 3048536 - RNA, 14 nt, Mycobacterium bovis subsp bovis AF2122/97
ccggccaaaauggc

SEQ ID NO: 3048537 - RNA, 21 nt, Mycobacterium bovis subsp bovis AF2122/97
ccggccaaaauuuugucggcc

SEQ ID NO: 3048538 - RNA, 23 nt, Mycobacterium bovis subsp bovis AF2122/97
ccggccaacagucgcagcacggc

SEQ ID NO: 3048539 - RNA, 13 nt, Mycobacterium bovis subsp bovis AF2122/97
ccggccaaccacc

SEQ ID NO: 3048540 - RNA, 15 nt, Mycobacterium bovis subsp bovis AF2122/97
ccggccaacgccgcc

SEQ ID NO: 3048541 - RNA, 18 nt, Mycobacterium bovis subsp bovis AF2122/97
ccggccaacggcacccug

SEQ ID NO: 3048542 - RNA, 13 nt, Mycobacterium bovis subsp bovis AF2122/97
ccggccaacuggg

SEQ ID NO: 3048543 - RNA, 13 nt, Mycobacterium bovis subsp bovis AF2122/97
ccggccaagccgg

SEQ ID NO: 3048544 - RNA, 14 nt, Mycobacterium bovis subsp bovis AF2122/97
ccggccaagccggc

SEQ ID NO: 3048545 - RNA, 16 nt, Mycobacterium bovis subsp bovis AF2122/97
ccggccaagccggcga

SEQ ID NO: 3048546 - RNA, 15 nt, Mycobacterium bovis subsp bovis AF2122/97
ccggccaauggccug

SEQ ID NO: 3048547 - RNA, 17 nt, Mycobacterium bovis subsp bovis AF2122/97
ccggccaauggccugca

SEQ ID NO: 3048548 - RNA, 19 nt, Mycobacterium bovis subsp bovis AF2122/97
ccggccaauggccugcagc

SEQ ID NO: 3048549 - RNA, 22 nt, Mycobacterium bovis subsp bovis AF2122/97
ccggccacaggaagcgaccguc

SEQ ID NO: 3048550 - RNA, 15 nt, Mycobacterium bovis subsp bovis AF2122/97
ccggccaccaccgcg

SEQ ID NO: 3048551 - RNA, 17 nt, Mycobacterium bovis subsp bovis AF2122/97
ccggccaccaccgcgcc

SEQ ID NO: 3048552 - RNA, 18 nt, Mycobacterium bovis subsp bovis AF2122/97
ccggccaccaccgcgccg

SEQ ID NO: 3048553 - RNA, 19 nt, Mycobacterium bovis subsp bovis AF2122/97
ccggccaccaccgcgccgu

SEQ ID NO: 3048554 - RNA, 22 nt, Mycobacterium bovis subsp bovis AF2122/97
ccggccaccaccgcgccgucgu

SEQ ID NO: 3048555 - RNA, 23 nt, Mycobacterium bovis subsp bovis AF2122/97
ccggccaccaccgcgccgucguc

SEQ ID NO: 3048556 - RNA, 14 nt, Mycobacterium bovis subsp bovis AF2122/97
ccggccaccacgug

SEQ ID NO: 3048557 - RNA, 12 nt, Mycobacterium bovis subsp bovis AF2122/97
ccggccaccagc

SEQ ID NO: 3048558 - RNA, 13 nt, Mycobacterium bovis subsp bovis AF2122/97
ccggccaccagcc

SEQ ID NO: 3048559 - RNA, 14 nt, Mycobacterium bovis subsp bovis AF2122/97
ccggccaccagccg

SEQ ID NO: 3048560 - RNA, 18 nt, Mycobacterium bovis subsp bovis AF2122/97
ccggccaccagggccacc

SEQ ID NO: 3048561 - RNA, 20 nt, Mycobacterium bovis subsp bovis AF2122/97
ccggccaccagggccaccgc

SEQ ID NO: 3048562 - RNA, 21 nt, Mycobacterium bovis subsp bovis AF2122/97
ccggccaccagggccaccgcg

SEQ ID NO: 3048563 - RNA, 22 nt, Mycobacterium bovis subsp bovis AF2122/97
ccggccaccagggccaccgcgc

SEQ ID NO: 3048564 - RNA, 14 nt, Mycobacterium bovis subsp bovis AF2122/97
ccggccacccgcgc

SEQ ID NO: 3048565 - RNA, 15 nt, Mycobacterium bovis subsp bovis AF2122/97
ccggccacgaccucg

SEQ ID NO: 3048566 - RNA, 22 nt, Mycobacterium bovis subsp bovis AF2122/97
ccggccacgauaaaugcuucga

SEQ ID NO: 3048567 - RNA, 22 nt, Mycobacterium bovis subsp bovis AF2122/97
ccggccacgcauuccagcaggc

SEQ ID NO: 3048568 - RNA, 13 nt, Mycobacterium bovis subsp bovis AF2122/97
ccggccacggucc

SEQ ID NO: 3048569 - RNA, 18 nt, Mycobacterium bovis subsp bovis AF2122/97
ccggccacgguccggccc

SEQ ID NO: 3048570 - RNA, 21 nt, Mycobacterium bovis subsp bovis AF2122/97
ccggccacgguccggcccacc

SEQ ID NO: 3048571 - RNA, 22 nt, Mycobacterium bovis subsp bovis AF2122/97
ccggccacgucgaugugcgccc

SEQ ID NO: 3048572 - RNA, 21 nt, Mycobacterium bovis subsp bovis AF2122/97
ccggccacuacggccuggcca

SEQ ID NO: 3048573 - RNA, 21 nt, Mycobacterium bovis subsp bovis AF2122/97
ccggccacucaacgaccuggg

SEQ ID NO: 3048574 - RNA, 12 nt, Mycobacterium bovis subsp bovis AF2122/97
ccggccagaccc

SEQ ID NO: 3048575 - RNA, 19 nt, Mycobacterium bovis subsp bovis AF2122/97
ccggccagacccuggccgu

SEQ ID NO: 3048576 - RNA, 22 nt, Mycobacterium bovis subsp bovis AF2122/97
ccggccagacccuggccguccc

SEQ ID NO: 3048577 - RNA, 20 nt, Mycobacterium bovis subsp bovis AF2122/97
ccggccagacggugcagcuc

SEQ ID NO: 3048578 - RNA, 13 nt, Mycobacterium bovis subsp bovis AF2122/97
ccggccagauggu

SEQ ID NO: 3048579 - RNA, 15 nt, Mycobacterium bovis subsp bovis AF2122/97
ccggccagauggugg

SEQ ID NO: 3048580 - RNA, 14 nt, Mycobacterium bovis subsp bovis AF2122/97
ccggccagcacccg

SEQ ID NO: 3048581 - RNA, 14 nt, Mycobacterium bovis subsp bovis AF2122/97
ccggccagcacucc

SEQ ID NO: 3048582 - RNA, 18 nt, Mycobacterium bovis subsp bovis AF2122/97
ccggccagcacuccgcgg

SEQ ID NO: 3048583 - RNA, 15 nt, Mycobacterium bovis subsp bovis AF2122/97
ccggccagccauggc

SEQ ID NO: 3048584 - RNA, 22 nt, Mycobacterium bovis subsp bovis AF2122/97
ccggccagccauggcagcgccg

SEQ ID NO: 3048585 - RNA, 23 nt, Mycobacterium bovis subsp bovis AF2122/97
ccggccagccauggcagcgccgc

SEQ ID NO: 3048586 - RNA, 15 nt, Mycobacterium bovis subsp bovis AF2122/97
ccggccagccgacgc

SEQ ID NO: 3048587 - RNA, 20 nt, Mycobacterium bovis subsp bovis AF2122/97
ccggccagccgacgcggcgg

SEQ ID NO: 3048588 - RNA, 14 nt, Mycobacterium bovis subsp bovis AF2122/97
ccggccagccgcac

SEQ ID NO: 3048589 - RNA, 14 nt, Mycobacterium bovis subsp bovis AF2122/97
ccggccagccgcgg

SEQ ID NO: 3048590 - RNA, 11 nt, Mycobacterium bovis subsp bovis AF2122/97
ccggccagccu

SEQ ID NO: 3048591 - RNA, 11 nt, Mycobacterium bovis subsp bovis AF2122/97
ccggccagcgg

SEQ ID NO: 3048592 - RNA, 12 nt, Mycobacterium bovis subsp bovis AF2122/97
ccggccagcggc

SEQ ID NO: 3048593 - RNA, 13 nt, Mycobacterium bovis subsp bovis AF2122/97
ccggccagcggca

SEQ ID NO: 3048594 - RNA, 15 nt, Mycobacterium bovis subsp bovis AF2122/97
ccggccagcggcagg

SEQ ID NO: 3048595 - RNA, 14 nt, Mycobacterium bovis subsp bovis AF2122/97
ccggccgagcgcac

SEQ ID NO: 3048596 - RNA, 19 nt, Mycobacterium bovis subsp bovis AF2122/97
ccggccgaugcgacccgca

SEQ ID NO: 3048597 - RNA, 21 nt, Mycobacterium bovis subsp bovis AF2122/97
ccggccgauggugugcacggc

SEQ ID NO: 3048598 - RNA, 15 nt, Mycobacterium bovis subsp bovis AF2122/97
ccggccgcacgccga

SEQ ID NO: 3048599 - RNA, 20 nt, Mycobacterium bovis subsp bovis AF2122/97
ccggccgcacgccgaccagc

SEQ ID NO: 3048600 - RNA, 23 nt, Mycobacterium bovis subsp bovis AF2122/97
ccggccgcacgccgaccagcacc

SEQ ID NO: 3048601 - RNA, 21 nt, Mycobacterium bovis subsp bovis AF2122/97
ccggccgcacgccggccagcg

SEQ ID NO: 3048602 - RNA, 13 nt, Mycobacterium bovis subsp bovis AF2122/97
ccggccgccaacu

SEQ ID NO: 3048603 - RNA, 15 nt, Mycobacterium bovis subsp bovis AF2122/97
ccggccgccaacucc

SEQ ID NO: 3048604 - RNA, 14 nt, Mycobacterium bovis subsp bovis AF2122/97
ccggccgccagcgc

SEQ ID NO: 3048605 - RNA, 17 nt, Mycobacterium bovis subsp bovis AF2122/97
ccggccgccagcgcacg

SEQ ID NO: 3048606 - RNA, 18 nt, Mycobacterium bovis subsp bovis AF2122/97
ccggccgccagcgcgccg

SEQ ID NO: 3048607 - RNA, 14 nt, Mycobacterium bovis subsp bovis AF2122/97
ccggccgccgaaac

SEQ ID NO: 3048608 - RNA, 13 nt, Mycobacterium bovis subsp bovis AF2122/97
ccggccgccgcgg

SEQ ID NO: 3048609 - RNA, 23 nt, Mycobacterium bovis subsp bovis AF2122/97
ccggccgccugccucgccugcac

SEQ ID NO: 3048610 - RNA, 22 nt, Mycobacterium bovis subsp bovis AF2122/97
ccggccgcgcacccguccgccg

SEQ ID NO: 3048611 - RNA, 12 nt, Mycobacterium bovis subsp bovis AF2122/97
ccggccgcgcgg

SEQ ID NO: 3048612 - RNA, 15 nt, Mycobacterium bovis subsp bovis AF2122/97
ccggccgcggcgccu

SEQ ID NO: 3048613 - RNA, 19 nt, Mycobacterium bovis subsp bovis AF2122/97
ccggccgcggcggccccgc

SEQ ID NO: 3048614 - RNA, 14 nt, Mycobacterium bovis subsp bovis AF2122/97
ccggccgcgggcgu

SEQ ID NO: 3048615 - RNA, 20 nt, Mycobacterium bovis subsp bovis AF2122/97
ccggccgcguaaaccggcug

SEQ ID NO: 3048616 - RNA, 20 nt, Mycobacterium bovis subsp bovis AF2122/97
ccggccgcuauggcccgggc

SEQ ID NO: 3048617 - RNA, 23 nt, Mycobacterium bovis subsp bovis AF2122/97
ccggccgcuauggcccgggccga

SEQ ID NO: 3048618 - RNA, 16 nt, Mycobacterium bovis subsp bovis AF2122/97
ccggccgcucaccccg

SEQ ID NO: 3048619 - RNA, 17 nt, Mycobacterium bovis subsp bovis AF2122/97
ccggccgcucaccccgc

SEQ ID NO: 3048620 - RNA, 13 nt, Mycobacterium bovis subsp bovis AF2122/97
ccggccgcuggcg

SEQ ID NO: 3048621 - RNA, 17 nt, Mycobacterium bovis subsp bovis AF2122/97
ccggccgcuuggccgcu

SEQ ID NO: 3048622 - RNA, 18 nt, Mycobacterium bovis subsp bovis AF2122/97
ccggccggaacgcccggc

SEQ ID NO: 3048623 - RNA, 19 nt, Mycobacterium bovis subsp bovis AF2122/97
ccggccggaacgcccggcu

SEQ ID NO: 3048624 - RNA, 23 nt, Mycobacterium bovis subsp bovis AF2122/97
ccggccggacgggugcgggccga

SEQ ID NO: 3048625 - RNA, 12 nt, Mycobacterium bovis subsp bovis AF2122/97
ccggccggcaau

SEQ ID NO: 3048626 - RNA, 14 nt, Mycobacterium bovis subsp bovis AF2122/97
ccggccggccagca

SEQ ID NO: 3048627 - RNA, 13 nt, Mycobacterium bovis subsp bovis AF2122/97
ccggccggcccau

SEQ ID NO: 3048628 - RNA, 13 nt, Mycobacterium bovis subsp bovis AF2122/97
ccggccgggcccu

SEQ ID NO: 3048629 - RNA, 15 nt, Mycobacterium bovis subsp bovis AF2122/97
ccggccgggugaacc

SEQ ID NO: 3048630 - RNA, 21 nt, Mycobacterium bovis subsp bovis AF2122/97
ccggccgguccacgguguacc

SEQ ID NO: 3048631 - RNA, 22 nt, Mycobacterium bovis subsp bovis AF2122/97
ccggccgguccgggaagucgcu

SEQ ID NO: 3048632 - RNA, 14 nt, Mycobacterium bovis subsp bovis AF2122/97
ccggccggugccag

SEQ ID NO: 3048633 - RNA, 23 nt, Mycobacterium bovis subsp bovis AF2122/97
ccggccggugccaguccaaaacc

SEQ ID NO: 3048634 - RNA, 14 nt, Mycobacterium bovis subsp bovis AF2122/97
ccggccgguucuug

SEQ ID NO: 3048635 - RNA, 17 nt, Mycobacterium bovis subsp bovis AF2122/97
ccggccgguuggccagc

SEQ ID NO: 3048636 - RNA, 18 nt, Mycobacterium bovis subsp bovis AF2122/97
ccggccgguuggccagcc

SEQ ID NO: 3048637 - RNA, 21 nt, Mycobacterium bovis subsp bovis AF2122/97
ccggccgguuggccagccaca

SEQ ID NO: 3048638 - RNA, 22 nt, Mycobacterium bovis subsp bovis AF2122/97
ccggccgguuggccagccacag

SEQ ID NO: 3048639 - RNA, 21 nt, Mycobacterium bovis subsp bovis AF2122/97
ccggccgucccgcgagcagcc

SEQ ID NO: 3048640 - RNA, 23 nt, Mycobacterium bovis subsp bovis AF2122/97
ccggccgucccgcgagcagcccg

SEQ ID NO: 3048641 - RNA, 14 nt, Mycobacterium bovis subsp bovis AF2122/97
ccggccgucgacgc

SEQ ID NO: 3048642 - RNA, 13 nt, Mycobacterium bovis subsp bovis AF2122/97
ccggccgucggcc

SEQ ID NO: 3048643 - RNA, 15 nt, Mycobacterium bovis subsp bovis AF2122/97
ccggccgucgggcag

SEQ ID NO: 3048644 - RNA, 20 nt, Mycobacterium bovis subsp bovis AF2122/97
ccggccgugaugucccgcaa

SEQ ID NO: 3048645 - RNA, 13 nt, Mycobacterium bovis subsp bovis AF2122/97
ccggccgugccgc

SEQ ID NO: 3048646 - RNA, 14 nt, Mycobacterium bovis subsp bovis AF2122/97
ccggccgugccgcc

SEQ ID NO: 3048647 - RNA, 15 nt, Mycobacterium bovis subsp bovis AF2122/97
ccggccgugccgccg

SEQ ID NO: 3048648 - RNA, 16 nt, Mycobacterium bovis subsp bovis AF2122/97
ccggccguugggaaac

SEQ ID NO: 3048649 - RNA, 15 nt, Mycobacterium bovis subsp bovis AF2122/97
ccggccuaccgagcu

SEQ ID NO: 3048650 - RNA, 16 nt, Mycobacterium bovis subsp bovis AF2122/97
ccggccuagccgaugg

SEQ ID NO: 3048651 - RNA, 17 nt, Mycobacterium bovis subsp bovis AF2122/97
ccggccuagccgauggc

SEQ ID NO: 3048652 - RNA, 14 nt, Mycobacterium bovis subsp bovis AF2122/97
ccggccucaacacc

SEQ ID NO: 3048653 - RNA, 23 nt, Mycobacterium bovis subsp bovis AF2122/97
ccggccucgaugucgcggucgcc

SEQ ID NO: 3048654 - RNA, 14 nt, Mycobacterium bovis subsp bovis AF2122/97
ccggccucgccgaa

SEQ ID NO: 3048655 - RNA, 15 nt, Mycobacterium bovis subsp bovis AF2122/97
ccggccucgccgaag

SEQ ID NO: 3048656 - RNA, 16 nt, Mycobacterium bovis subsp bovis AF2122/97
ccggccucgccggggc

SEQ ID NO: 3048657 - RNA, 13 nt, Mycobacterium bovis subsp bovis AF2122/97
ccggccucggcga

SEQ ID NO: 3048658 - RNA, 16 nt, Mycobacterium bovis subsp bovis AF2122/97
ccggccucggcgagca

SEQ ID NO: 3048659 - RNA, 22 nt, Mycobacterium bovis subsp bovis AF2122/97
ccggccucggugagcagcucgg

SEQ ID NO: 3048660 - RNA, 15 nt, Mycobacterium bovis subsp bovis AF2122/97
ccggccugcacggcg

SEQ ID NO: 3048661 - RNA, 17 nt, Mycobacterium bovis subsp bovis AF2122/97
ccggccugcgacgagcc

SEQ ID NO: 3048662 - RNA, 15 nt, Mycobacterium bovis subsp bovis AF2122/97
ccggccugcgcgacc

SEQ ID NO: 3048663 - RNA, 18 nt, Mycobacterium bovis subsp bovis AF2122/97
ccggccugcgcgaccgac

SEQ ID NO: 3048664 - RNA, 14 nt, Mycobacterium bovis subsp bovis AF2122/97
ccggccuggccgcc

SEQ ID NO: 3048665 - RNA, 20 nt, Mycobacterium bovis subsp bovis AF2122/97
ccggccuggcucguccgggu

SEQ ID NO: 3048666 - RNA, 21 nt, Mycobacterium bovis subsp bovis AF2122/97
ccggccugucccgcacccggc

SEQ ID NO: 3048667 - RNA, 18 nt, Mycobacterium bovis subsp bovis AF2122/97
ccggccuuauucacccgg

SEQ ID NO: 3048668 - RNA, 19 nt, Mycobacterium bovis subsp bovis AF2122/97
ccggccuuauucacccggu

SEQ ID NO: 3048669 - RNA, 18 nt, Mycobacterium bovis subsp bovis AF2122/97
ccggccuucaaggaagcc

SEQ ID NO: 3048670 - RNA, 22 nt, Mycobacterium bovis subsp bovis AF2122/97
ccggccuucaaggaagccgcgg

SEQ ID NO: 3048671 - RNA, 11 nt, Mycobacterium bovis subsp bovis AF2122/97
ccggccuucuc

SEQ ID NO: 3048672 - RNA, 23 nt, Mycobacterium bovis subsp bovis AF2122/97
ccggccuucuccaucgucggcaa

SEQ ID NO: 3048673 - RNA, 21 nt, Mycobacterium bovis subsp bovis AF2122/97
ccggccuucucgccguguucg

SEQ ID NO: 3048674 - RNA, 17 nt, Mycobacterium bovis subsp bovis AF2122/97
ccggccuugcccucaac

SEQ ID NO: 3048675 - RNA, 23 nt, Mycobacterium bovis subsp bovis AF2122/97
ccggccuugcccucaacggcggc

SEQ ID NO: 3048676 - RNA, 16 nt, Mycobacterium bovis subsp bovis AF2122/97
ccggccuugccgccgg

SEQ ID NO: 3048677 - RNA, 17 nt, Mycobacterium bovis subsp bovis AF2122/97
ccggccuugccgccggc

SEQ ID NO: 3048678 - RNA, 19 nt, Mycobacterium bovis subsp bovis AF2122/97
ccggccuugccgccggccc

SEQ ID NO: 3048679 - RNA, 20 nt, Mycobacterium bovis subsp bovis AF2122/97
ccggccuugccgccggcccc

SEQ ID NO: 3048680 - RNA, 21 nt, Mycobacterium bovis subsp bovis AF2122/97
ccggccuugccgccggccccg

SEQ ID NO: 3048681 - RNA, 19 nt, Mycobacterium bovis subsp bovis AF2122/97
ccggccuugccgccggcgc

SEQ ID NO: 3048682 - RNA, 22 nt, Mycobacterium bovis subsp bovis AF2122/97
ccggcgccaccgugguggacga

SEQ ID NO: 3048683 - RNA, 16 nt, Mycobacterium bovis subsp bovis AF2122/97
ccggcgccaccguugc

SEQ ID NO: 3048684 - RNA, 19 nt, Mycobacterium bovis subsp bovis AF2122/97
ccggcgccaccguugccga

SEQ ID NO: 3048685 - RNA, 16 nt, Mycobacterium bovis subsp bovis AF2122/97
ccggcgccagcgccgc

SEQ ID NO: 3048686 - RNA, 19 nt, Mycobacterium bovis subsp bovis AF2122/97
ccggcgccagcgccgccac

SEQ ID NO: 3048687 - RNA, 20 nt, Mycobacterium bovis subsp bovis AF2122/97
ccggcgccagcgccgccacc

SEQ ID NO: 3048688 - RNA, 13 nt, Mycobacterium bovis subsp bovis AF2122/97
ccggcgccaucgg

SEQ ID NO: 3048689 - RNA, 20 nt, Mycobacterium bovis subsp bovis AF2122/97
ccggcgccauucgccccacc

SEQ ID NO: 3048690 - RNA, 23 nt, Mycobacterium bovis subsp bovis AF2122/97
ccggcgcccagcgccucgauggu

SEQ ID NO: 3048691 - RNA, 13 nt, Mycobacterium bovis subsp bovis AF2122/97
ccggcgcccaggc

SEQ ID NO: 3048692 - RNA, 14 nt, Mycobacterium bovis subsp bovis AF2122/97
ccggcgcccaggcc

SEQ ID NO: 3048693 - RNA, 18 nt, Mycobacterium bovis subsp bovis AF2122/97
ccggcgcccaggccgauc

SEQ ID NO: 3048694 - RNA, 12 nt, Mycobacterium bovis subsp bovis AF2122/97
ccggcgcccgcc

SEQ ID NO: 3048695 - RNA, 15 nt, Mycobacterium bovis subsp bovis AF2122/97
ccggcgcccgccgcg

SEQ ID NO: 3048696 - RNA, 16 nt, Mycobacterium bovis subsp bovis AF2122/97
ccggcgcccgccgcga

SEQ ID NO: 3048697 - RNA, 12 nt, Mycobacterium bovis subsp bovis AF2122/97
ccggcgcccggg

SEQ ID NO: 3048698 - RNA, 13 nt, Mycobacterium bovis subsp bovis AF2122/97
ccggcgcccgggu

SEQ ID NO: 3048699 - RNA, 19 nt, Mycobacterium bovis subsp bovis AF2122/97
ccggcgccgcaaucagacg

SEQ ID NO: 3048700 - RNA, 20 nt, Mycobacterium bovis subsp bovis AF2122/97
ccggcgccgcaaucagacgg

SEQ ID NO: 3048701 - RNA, 21 nt, Mycobacterium bovis subsp bovis AF2122/97
ccggcgccgcaaucagacggc

SEQ ID NO: 3048702 - RNA, 16 nt, Mycobacterium bovis subsp bovis AF2122/97
ccggcgccgccagcac

SEQ ID NO: 3048703 - RNA, 17 nt, Mycobacterium bovis subsp bovis AF2122/97
ccggcgccgccagcacc

SEQ ID NO: 3048704 - RNA, 21 nt, Mycobacterium bovis subsp bovis AF2122/97
ccggcgccgccagcaccaccg

SEQ ID NO: 3048705 - RNA, 23 nt, Mycobacterium bovis subsp bovis AF2122/97
ccggcgccgccagcaccaccggc

SEQ ID NO: 3048706 - RNA, 13 nt, Mycobacterium bovis subsp bovis AF2122/97
ccggcgccgccau

SEQ ID NO: 3048707 - RNA, 17 nt, Mycobacterium bovis subsp bovis AF2122/97
ccggcgccgccauugcc

SEQ ID NO: 3048708 - RNA, 12 nt, Mycobacterium bovis subsp bovis AF2122/97
ccggcgccgccc

SEQ ID NO: 3048709 - RNA, 13 nt, Mycobacterium bovis subsp bovis AF2122/97
ccggcgccgccca

SEQ ID NO: 3048710 - RNA, 14 nt, Mycobacterium bovis subsp bovis AF2122/97
ccggcgccgcccgc

SEQ ID NO: 3048711 - RNA, 16 nt, Mycobacterium bovis subsp bovis AF2122/97
ccggcgccgcccgcgc

SEQ ID NO: 3048712 - RNA, 19 nt, Mycobacterium bovis subsp bovis AF2122/97
ccggcgccgcccgcgccgc

SEQ ID NO: 3048713 - RNA, 17 nt, Mycobacterium bovis subsp bovis AF2122/97
ccggcgccgcccuugcc

SEQ ID NO: 3048714 - RNA, 19 nt, Mycobacterium bovis subsp bovis AF2122/97
ccggcgccgcccuugccgc

SEQ ID NO: 3048715 - RNA, 23 nt, Mycobacterium bovis subsp bovis AF2122/97
ccggcgccgcccuugccgccggc

SEQ ID NO: 3048716 - RNA, 15 nt, Mycobacterium bovis subsp bovis AF2122/97
ccggcgccgccggca

SEQ ID NO: 3048717 - RNA, 16 nt, Mycobacterium bovis subsp bovis AF2122/97
ccggcgccgccggcac

SEQ ID NO: 3048718 - RNA, 18 nt, Mycobacterium bovis subsp bovis AF2122/97
ccggcgccgccggcgccg

SEQ ID NO: 3048719 - RNA, 20 nt, Mycobacterium bovis subsp bovis AF2122/97
ccggcgccgccggcgccgcc

SEQ ID NO: 3048720 - RNA, 14 nt, Mycobacterium bovis subsp bovis AF2122/97
ccggcgccgccggu

SEQ ID NO: 3048721 - RNA, 17 nt, Mycobacterium bovis subsp bovis AF2122/97
ccggcgccgccggugcc

SEQ ID NO: 3048722 - RNA, 14 nt, Mycobacterium bovis subsp bovis AF2122/97
ccggcgccgccguc

SEQ ID NO: 3048723 - RNA, 17 nt, Mycobacterium bovis subsp bovis AF2122/97
ccggcgccgccgucgcc

SEQ ID NO: 3048724 - RNA, 21 nt, Mycobacterium bovis subsp bovis AF2122/97
ccggcgccgccguuaccgccg

SEQ ID NO: 3048725 - RNA, 17 nt, Mycobacterium bovis subsp bovis AF2122/97
ccggcgccgccguuccc

SEQ ID NO: 3048726 - RNA, 13 nt, Mycobacterium bovis subsp bovis AF2122/97
ccggcgccgcgcg

SEQ ID NO: 3048727 - RNA, 12 nt, Mycobacterium bovis subsp bovis AF2122/97
ccggcgccgcgg

SEQ ID NO: 3048728 - RNA, 16 nt, Mycobacterium bovis subsp bovis AF2122/97
ccggcgccggagccgc

SEQ ID NO: 3048729 - RNA, 17 nt, Mycobacterium bovis subsp bovis AF2122/97
ccggcgccggagccgcc

SEQ ID NO: 3048730 - RNA, 17 nt, Mycobacterium bovis subsp bovis AF2122/97
ccggcgccggaguugaa

SEQ ID NO: 3048731 - RNA, 23 nt, Mycobacterium bovis subsp bovis AF2122/97
ccggcgccggaguugaagaagcc

SEQ ID NO: 3048732 - RNA, 18 nt, Mycobacterium bovis subsp bovis AF2122/97
ccggcgccggcgcgucgg

SEQ ID NO: 3048733 - RNA, 16 nt, Mycobacterium bovis subsp bovis AF2122/97
ccggcgccggcuugga

SEQ ID NO: 3048734 - RNA, 17 nt, Mycobacterium bovis subsp bovis AF2122/97
ccggcgccuccggcacc

SEQ ID NO: 3048735 - RNA, 23 nt, Mycobacterium bovis subsp bovis AF2122/97
ccggcgccuccggcaccuccagc

SEQ ID NO: 3048736 - RNA, 17 nt, Mycobacterium bovis subsp bovis AF2122/97
ccggcgcgauccccgcg

SEQ ID NO: 3048737 - RNA, 18 nt, Mycobacterium bovis subsp bovis AF2122/97
ccggcgcgauccccgcgc

SEQ ID NO: 3048738 - RNA, 17 nt, Mycobacterium bovis subsp bovis AF2122/97
ccggcgcgcaccccggc

SEQ ID NO: 3048739 - RNA, 15 nt, Mycobacterium bovis subsp bovis AF2122/97
ccggcgcgcagccgg

SEQ ID NO: 3048740 - RNA, 16 nt, Mycobacterium bovis subsp bovis AF2122/97
ccggcgcgcagccggg

SEQ ID NO: 3048741 - RNA, 12 nt, Mycobacterium bovis subsp bovis AF2122/97
ccggcgcgcccc

SEQ ID NO: 3048742 - RNA, 13 nt, Mycobacterium bovis subsp bovis AF2122/97
ccggcgcgcccca

SEQ ID NO: 3048743 - RNA, 14 nt, Mycobacterium bovis subsp bovis AF2122/97
ccggcgcgccccac

SEQ ID NO: 3048744 - RNA, 15 nt, Mycobacterium bovis subsp bovis AF2122/97
ccggcgcgccccacc

SEQ ID NO: 3048745 - RNA, 17 nt, Mycobacterium bovis subsp bovis AF2122/97
ccggcgcgccccaccgc

SEQ ID NO: 3048746 - RNA, 18 nt, Mycobacterium bovis subsp bovis AF2122/97
ccggcgcgccccaccgcg

SEQ ID NO: 3048747 - RNA, 19 nt, Mycobacterium bovis subsp bovis AF2122/97
ccggcgcgccccaccgcgc

SEQ ID NO: 3048748 - RNA, 22 nt, Mycobacterium bovis subsp bovis AF2122/97
ccggcgcgccccaccgcgccga

SEQ ID NO: 3048749 - RNA, 13 nt, Mycobacterium bovis subsp bovis AF2122/97
ccggcgcgccccg

SEQ ID NO: 3048750 - RNA, 14 nt, Mycobacterium bovis subsp bovis AF2122/97
ccggcgcgccccgc

SEQ ID NO: 3048751 - RNA, 15 nt, Mycobacterium bovis subsp bovis AF2122/97
ccggcgcgccccgcc

SEQ ID NO: 3048752 - RNA, 17 nt, Mycobacterium bovis subsp bovis AF2122/97
ccggcgcgccccgccgc

SEQ ID NO: 3048753 - RNA, 19 nt, Mycobacterium bovis subsp bovis AF2122/97
ccggcgcgccccgccgcac

SEQ ID NO: 3048754 - RNA, 17 nt, Mycobacterium bovis subsp bovis AF2122/97
ccggcgcgccgggcggc

SEQ ID NO: 3048755 - RNA, 19 nt, Mycobacterium bovis subsp bovis AF2122/97
ccggcgcggaacgcgucgc

SEQ ID NO: 3048756 - RNA, 20 nt, Mycobacterium bovis subsp bovis AF2122/97
ccggcgcggagugcccaggg

SEQ ID NO: 3048757 - RNA, 23 nt, Mycobacterium bovis subsp bovis AF2122/97
ccggcgcggagugcccagggccg

SEQ ID NO: 3048758 - RNA, 11 nt, Mycobacterium bovis subsp bovis AF2122/97
ccggcgcggcc

SEQ ID NO: 3048759 - RNA, 13 nt, Mycobacterium bovis subsp bovis AF2122/97
ccggcgcggccgc

SEQ ID NO: 3048760 - RNA, 14 nt, Mycobacterium bovis subsp bovis AF2122/97
ccggcgcggccgca

SEQ ID NO: 3048761 - RNA, 16 nt, Mycobacterium bovis subsp bovis AF2122/97
ccggcgcggccggccg

SEQ ID NO: 3048762 - RNA, 17 nt, Mycobacterium bovis subsp bovis AF2122/97
ccggcgcggccggccgc

SEQ ID NO: 3048763 - RNA, 20 nt, Mycobacterium bovis subsp bovis AF2122/97
ccggcgcggccggccgcuca

SEQ ID NO: 3048764 - RNA, 13 nt, Mycobacterium bovis subsp bovis AF2122/97
ccggcgcggcgga

SEQ ID NO: 3048765 - RNA, 14 nt, Mycobacterium bovis subsp bovis AF2122/97
ccggcgcggcggac

SEQ ID NO: 3048766 - RNA, 16 nt, Mycobacterium bovis subsp bovis AF2122/97
ccggcgcggcggcguc

SEQ ID NO: 3048767 - RNA, 18 nt, Mycobacterium bovis subsp bovis AF2122/97
ccggcgcggcggcgucga

SEQ ID NO: 3048768 - RNA, 22 nt, Mycobacterium bovis subsp bovis AF2122/97
ccggcgcgggcacgcccucguc

SEQ ID NO: 3048769 - RNA, 19 nt, Mycobacterium bovis subsp bovis AF2122/97
ccggcgggaugcgcgcccg

SEQ ID NO: 3048770 - RNA, 20 nt, Mycobacterium bovis subsp bovis AF2122/97
ccggcgggcccgccggcccc

SEQ ID NO: 3048771 - RNA, 15 nt, Mycobacterium bovis subsp bovis AF2122/97
ccggcgggccugccc

SEQ ID NO: 3048772 - RNA, 20 nt, Mycobacterium bovis subsp bovis AF2122/97
ccggcgggcgagugucagca

SEQ ID NO: 3048773 - RNA, 21 nt, Mycobacterium bovis subsp bovis AF2122/97
ccggcgggcgagugucagcag

SEQ ID NO: 3048774 - RNA, 20 nt, Mycobacterium bovis subsp bovis AF2122/97
ccggcgggcggugggcagca

SEQ ID NO: 3048775 - RNA, 17 nt, Mycobacterium bovis subsp bovis AF2122/97
ccggcgggcucgcccgc

SEQ ID NO: 3048776 - RNA, 21 nt, Mycobacterium bovis subsp bovis AF2122/97
ccggcgggcucgcccgcuacg

SEQ ID NO: 3048777 - RNA, 21 nt, Mycobacterium bovis subsp bovis AF2122/97
ccggcgggcucuacucgcggc

SEQ ID NO: 3048778 - RNA, 16 nt, Mycobacterium bovis subsp bovis AF2122/97
ccggcgggugccgagc

SEQ ID NO: 3048779 - RNA, 21 nt, Mycobacterium bovis subsp bovis AF2122/97
ccggcgggugccgagcuggcg

SEQ ID NO: 3048780 - RNA, 14 nt, Mycobacterium bovis subsp bovis AF2122/97
ccggcggguggccc

SEQ ID NO: 3048781 - RNA, 18 nt, Mycobacterium bovis subsp bovis AF2122/97
ccggcgguaccgccgcgg

SEQ ID NO: 3048782 - RNA, 20 nt, Mycobacterium bovis subsp bovis AF2122/97
ccggcgguaccggagcagcu

SEQ ID NO: 3048783 - RNA, 13 nt, Mycobacterium bovis subsp bovis AF2122/97
ccggcgguagcca

SEQ ID NO: 3048784 - RNA, 20 nt, Mycobacterium bovis subsp bovis AF2122/97
ccggcgguagucggccagcu

SEQ ID NO: 3048785 - RNA, 23 nt, Mycobacterium bovis subsp bovis AF2122/97
ccggcgguagucggccagcucgc

SEQ ID NO: 3048786 - RNA, 19 nt, Mycobacterium bovis subsp bovis AF2122/97
ccggcggucagcagcgccg

SEQ ID NO: 3048787 - RNA, 21 nt, Mycobacterium bovis subsp bovis AF2122/97
ccggcggucagcagcgccguc

SEQ ID NO: 3048788 - RNA, 23 nt, Mycobacterium bovis subsp bovis AF2122/97
ccggcggucagcagcgccgucag

SEQ ID NO: 3048789 - RNA, 17 nt, Mycobacterium bovis subsp bovis AF2122/97
ccggcggucagcggcuc

SEQ ID NO: 3048790 - RNA, 23 nt, Mycobacterium bovis subsp bovis AF2122/97
ccggcggucgcguaccgguggaa

SEQ ID NO: 3048791 - RNA, 13 nt, Mycobacterium bovis subsp bovis AF2122/97
ccggcggucgggc

SEQ ID NO: 3048792 - RNA, 19 nt, Mycobacterium bovis subsp bovis AF2122/97
ccggcggucgggcccggcg

SEQ ID NO: 3048793 - RNA, 19 nt, Mycobacterium bovis subsp bovis AF2122/97
ccggcggucugcagugcag

SEQ ID NO: 3048794 - RNA, 18 nt, Mycobacterium bovis subsp bovis AF2122/97
ccggcggugacggcggca

SEQ ID NO: 3048795 - RNA, 20 nt, Mycobacterium bovis subsp bovis AF2122/97
ccggcggugacggcggcaac

SEQ ID NO: 3048796 - RNA, 16 nt, Mycobacterium bovis subsp bovis AF2122/97
ccggcggugccggugg

SEQ ID NO: 3048797 - RNA, 16 nt, Mycobacterium bovis subsp bovis AF2122/97
ccggcggugccgucag

SEQ ID NO: 3048798 - RNA, 18 nt, Mycobacterium bovis subsp bovis AF2122/97
ccggcggugccgucgccg

SEQ ID NO: 3048799 - RNA, 22 nt, Mycobacterium bovis subsp bovis AF2122/97
ccggcggugccgucgccgcccu

SEQ ID NO: 3048800 - RNA, 12 nt, Mycobacterium bovis subsp bovis AF2122/97
ccggcgguggug

SEQ ID NO: 3048801 - RNA, 17 nt, Mycobacterium bovis subsp bovis AF2122/97
ccggcgguucugcggcc

SEQ ID NO: 3048802 - RNA, 18 nt, Mycobacterium bovis subsp bovis AF2122/97
ccggcgguucugcggccg

SEQ ID NO: 3048803 - RNA, 19 nt, Mycobacterium bovis subsp bovis AF2122/97
ccggcgguucugcggccgc

SEQ ID NO: 3048804 - RNA, 15 nt, Mycobacterium bovis subsp bovis AF2122/97
ccggcguacgccgua

SEQ ID NO: 3048805 - RNA, 17 nt, Mycobacterium bovis subsp bovis AF2122/97
ccggcguacgccguacc

SEQ ID NO: 3048806 - RNA, 18 nt, Mycobacterium bovis subsp bovis AF2122/97
ccggcguacgccguaccc

SEQ ID NO: 3048807 - RNA, 13 nt, Mycobacterium bovis subsp bovis AF2122/97
ccggcguacuucg

SEQ ID NO: 3048808 - RNA, 16 nt, Mycobacterium bovis subsp bovis AF2122/97
ccggcguagcggcgau

SEQ ID NO: 3048809 - RNA, 19 nt, Mycobacterium bovis subsp bovis AF2122/97
ccggcguauugcaccgcca

SEQ ID NO: 3048810 - RNA, 23 nt, Mycobacterium bovis subsp bovis AF2122/97
ccggcgucacggcgugaccacug

SEQ ID NO: 3048811 - RNA, 14 nt, Mycobacterium bovis subsp bovis AF2122/97
ccggcgucagcccc

SEQ ID NO: 3048812 - RNA, 17 nt, Mycobacterium bovis subsp bovis AF2122/97
ccggcgucagccccgac

SEQ ID NO: 3048813 - RNA, 21 nt, Mycobacterium bovis subsp bovis AF2122/97
ccggcguccaguccgaucacc

SEQ ID NO: 3048814 - RNA, 19 nt, Mycobacterium bovis subsp bovis AF2122/97
ccggcguccggagccccug

SEQ ID NO: 3048815 - RNA, 21 nt, Mycobacterium bovis subsp bovis AF2122/97
ccggcguccggagccccuguc

SEQ ID NO: 3048816 - RNA, 21 nt, Mycobacterium bovis subsp bovis AF2122/97
ccggcgucgaaggugaccagg

SEQ ID NO: 3048817 - RNA, 21 nt, Mycobacterium bovis subsp bovis AF2122/97
ccggcgucgacgauucccgcg

SEQ ID NO: 3048818 - RNA, 14 nt, Mycobacterium bovis subsp bovis AF2122/97
ccggcgucgacguc

SEQ ID NO: 3048819 - RNA, 16 nt, Mycobacterium bovis subsp bovis AF2122/97
ccggcgucgacgucgg

SEQ ID NO: 3048820 - RNA, 17 nt, Mycobacterium bovis subsp bovis AF2122/97
ccggcgucgacgucggc

SEQ ID NO: 3048821 - RNA, 18 nt, Mycobacterium bovis subsp bovis AF2122/97
ccggcgucgacgucggcc

SEQ ID NO: 3048822 - RNA, 15 nt, Mycobacterium bovis subsp bovis AF2122/97
ccggcgucgagccgg

SEQ ID NO: 3048823 - RNA, 16 nt, Mycobacterium bovis subsp bovis AF2122/97
ccggcgucgaugacga

SEQ ID NO: 3048824 - RNA, 18 nt, Mycobacterium bovis subsp bovis AF2122/97
ccggcgucgaugacgacg

SEQ ID NO: 3048825 - RNA, 21 nt, Mycobacterium bovis subsp bovis AF2122/97
ccggcgucgaugacgacgccg

SEQ ID NO: 3048826 - RNA, 13 nt, Mycobacterium bovis subsp bovis AF2122/97
ccggcgucgcugg

SEQ ID NO: 3048827 - RNA, 15 nt, Mycobacterium bovis subsp bovis AF2122/97
ccggcgucgcuggcc

SEQ ID NO: 3048828 - RNA, 17 nt, Mycobacterium bovis subsp bovis AF2122/97
ccggcgucgcuggccag

SEQ ID NO: 3048829 - RNA, 23 nt, Mycobacterium bovis subsp bovis AF2122/97
ccggcgucggcgcccagcucgau

SEQ ID NO: 3048830 - RNA, 15 nt, Mycobacterium bovis subsp bovis AF2122/97
ccggcgucggcgcgg

SEQ ID NO: 3048831 - RNA, 18 nt, Mycobacterium bovis subsp bovis AF2122/97
ccggcgucggcgcggccg

SEQ ID NO: 3048832 - RNA, 17 nt, Mycobacterium bovis subsp bovis AF2122/97
ccggcgucggucgucgg

SEQ ID NO: 3048833 - RNA, 22 nt, Mycobacterium bovis subsp bovis AF2122/97
ccggcgucggucgucggguagg

SEQ ID NO: 3048834 - RNA, 19 nt, Mycobacterium bovis subsp bovis AF2122/97
ccggcgucguugaccaaug

SEQ ID NO: 3048835 - RNA, 14 nt, Mycobacterium bovis subsp bovis AF2122/97
ccggcgucucgcag

SEQ ID NO: 3048836 - RNA, 21 nt, Mycobacterium bovis subsp bovis AF2122/97
ccggcgucucgcagcaacggc

SEQ ID NO: 3048837 - RNA, 18 nt, Mycobacterium bovis subsp bovis AF2122/97
ccggcgucugcccgccca

SEQ ID NO: 3048838 - RNA, 21 nt, Mycobacterium bovis subsp bovis AF2122/97
ccggcgucugcccgcccagcc

SEQ ID NO: 3048839 - RNA, 14 nt, Mycobacterium bovis subsp bovis AF2122/97
ccggcgugcacucc

SEQ ID NO: 3048840 - RNA, 18 nt, Mycobacterium bovis subsp bovis AF2122/97
ccggcgugcagcaccccc

SEQ ID NO: 3048841 - RNA, 17 nt, Mycobacterium bovis subsp bovis AF2122/97
ccggcgugcgcaaggca

SEQ ID NO: 3048842 - RNA, 16 nt, Mycobacterium bovis subsp bovis AF2122/97
ccggcgugcggcgagg

SEQ ID NO: 3048843 - RNA, 13 nt, Mycobacterium bovis subsp bovis AF2122/97
ccggcguggaucc

SEQ ID NO: 3048844 - RNA, 23 nt, Mycobacterium bovis subsp bovis AF2122/97
ccggcguggcuucacccaacccc

SEQ ID NO: 3048845 - RNA, 22 nt, Mycobacterium bovis subsp bovis AF2122/97
ccggcguggugagccucggcga

SEQ ID NO: 3048846 - RNA, 14 nt, Mycobacterium bovis subsp bovis AF2122/97
ccggcgugucgccg

SEQ ID NO: 3048847 - RNA, 15 nt, Mycobacterium bovis subsp bovis AF2122/97
ccggcgugucgccgc

SEQ ID NO: 3048848 - RNA, 19 nt, Mycobacterium bovis subsp bovis AF2122/97
ccggcgugucgccgccacc

SEQ ID NO: 3048849 - RNA, 21 nt, Mycobacterium bovis subsp bovis AF2122/97
ccggcgugucgcgucgugcga

SEQ ID NO: 3048850 - RNA, 13 nt, Mycobacterium bovis subsp bovis AF2122/97
ccggcguguucug

SEQ ID NO: 3048851 - RNA, 17 nt, Mycobacterium bovis subsp bovis AF2122/97
ccggcguguucugaucg

SEQ ID NO: 3048852 - RNA, 19 nt, Mycobacterium bovis subsp bovis AF2122/97
ccggcguucaccugcgucg

SEQ ID NO: 3048853 - RNA, 16 nt, Mycobacterium bovis subsp bovis AF2122/97
ccggcguucccacugg

SEQ ID NO: 3048854 - RNA, 17 nt, Mycobacterium bovis subsp bovis AF2122/97
ccggcguucccccacuc

SEQ ID NO: 3048855 - RNA, 17 nt, Mycobacterium bovis subsp bovis AF2122/97
ccggcuguuaggcgaua

SEQ ID NO: 3048856 - RNA, 22 nt, Mycobacterium bovis subsp bovis AF2122/97
ccggcuguuaggcgauaucgca

SEQ ID NO: 3048857 - RNA, 13 nt, Mycobacterium bovis subsp bovis AF2122/97
ccggcuguucucg

SEQ ID NO: 3048858 - RNA, 16 nt, Mycobacterium bovis subsp bovis AF2122/97
ccggcuguucucgccg

SEQ ID NO: 3048859 - RNA, 16 nt, Mycobacterium bovis subsp bovis AF2122/97
ccggcuuaccggcggg

SEQ ID NO: 3048860 - RNA, 20 nt, Mycobacterium bovis subsp bovis AF2122/97
ccggcuuaccggcgggcgaa

SEQ ID NO: 3048861 - RNA, 15 nt, Mycobacterium bovis subsp bovis AF2122/97
ccggcuuccccagca

SEQ ID NO: 3048862 - RNA, 13 nt, Mycobacterium bovis subsp bovis AF2122/97
ccggcuucgccca

SEQ ID NO: 3048863 - RNA, 19 nt, Mycobacterium bovis subsp bovis AF2122/97
ccggcuucgcccagagccg

SEQ ID NO: 3048864 - RNA, 16 nt, Mycobacterium bovis subsp bovis AF2122/97
ccggcuucggccagca

SEQ ID NO: 3048865 - RNA, 23 nt, Mycobacterium bovis subsp bovis AF2122/97
ccggcuucggcgaacccuccgca

SEQ ID NO: 3048866 - RNA, 22 nt, Mycobacterium bovis subsp bovis AF2122/97
ccggcuucggguguucgcgcgc

SEQ ID NO: 3048867 - RNA, 16 nt, Mycobacterium bovis subsp bovis AF2122/97
ccggcuucguccaccg

SEQ ID NO: 3048868 - RNA, 19 nt, Mycobacterium bovis subsp bovis AF2122/97
ccggcuucguccaccgcga

SEQ ID NO: 3048869 - RNA, 16 nt, Mycobacterium bovis subsp bovis AF2122/97
ccggcuucgucggcca

SEQ ID NO: 3048870 - RNA, 17 nt, Mycobacterium bovis subsp bovis AF2122/97
ccggcuucgucggccag

SEQ ID NO: 3048871 - RNA, 19 nt, Mycobacterium bovis subsp bovis AF2122/97
ccggcuucgucggccagca

SEQ ID NO: 3048872 - RNA, 21 nt, Mycobacterium bovis subsp bovis AF2122/97
ccggcuucgucggccagcagc

SEQ ID NO: 3048873 - RNA, 20 nt, Mycobacterium bovis subsp bovis AF2122/97
ccggcuugcccggcucggca

SEQ ID NO: 3048874 - RNA, 13 nt, Mycobacterium bovis subsp bovis AF2122/97
ccggcuuggauac

SEQ ID NO: 3048875 - RNA, 15 nt, Mycobacterium bovis subsp bovis AF2122/97
ccggcuuggccuuug

SEQ ID NO: 3048876 - RNA, 17 nt, Mycobacterium bovis subsp bovis AF2122/97
ccggcuuggccuuugcc

SEQ ID NO: 3048877 - RNA, 21 nt, Mycobacterium bovis subsp bovis AF2122/97
ccggcuuggccuuugccgucg

SEQ ID NO: 3048878 - RNA, 13 nt, Mycobacterium bovis subsp bovis AF2122/97
ccggcuuggcggc

SEQ ID NO: 3048879 - RNA, 17 nt, Mycobacterium bovis subsp bovis AF2122/97
ccggcuuggcggcgauc

SEQ ID NO: 3048880 - RNA, 18 nt, Mycobacterium bovis subsp bovis AF2122/97
ccggcuuggcgggaccgu

SEQ ID NO: 3048881 - RNA, 13 nt, Mycobacterium bovis subsp bovis AF2122/97
ccggcuugggcca

SEQ ID NO: 3048882 - RNA, 16 nt, Mycobacterium bovis subsp bovis AF2122/97
ccggcuugggccaggc

SEQ ID NO: 3048883 - RNA, 17 nt, Mycobacterium bovis subsp bovis AF2122/97
ccggcuugggccaggcc

SEQ ID NO: 3048884 - RNA, 22 nt, Mycobacterium bovis subsp bovis AF2122/97
ccggcuugggccaggcccagcu

SEQ ID NO: 3048885 - RNA, 16 nt, Mycobacterium bovis subsp bovis AF2122/97
ccggcuugggcgguag

SEQ ID NO: 3048886 - RNA, 19 nt, Mycobacterium bovis subsp bovis AF2122/97
ccggcuuggugaaccgcgc

SEQ ID NO: 3048887 - RNA, 18 nt, Mycobacterium bovis subsp bovis AF2122/97
ccggcuuguccgugagca

SEQ ID NO: 3048888 - RNA, 14 nt, Mycobacterium bovis subsp bovis AF2122/97
ccggcuugucgacc

SEQ ID NO: 3048889 - RNA, 21 nt, Mycobacterium bovis subsp bovis AF2122/97
ccggcuugucgaccacgaccg

SEQ ID NO: 3048890 - RNA, 23 nt, Mycobacterium bovis subsp bovis AF2122/97
ccggcuugucgaccacgaccguc

SEQ ID NO: 3048891 - RNA, 16 nt, Mycobacterium bovis subsp bovis AF2122/97
ccggcuuuugcgccca

SEQ ID NO: 3048892 - RNA, 17 nt, Mycobacterium bovis subsp bovis AF2122/97
ccgggaaauaucucggu

SEQ ID NO: 3048893 - RNA, 17 nt, Mycobacterium bovis subsp bovis AF2122/97
ccgggaacaggguggug

SEQ ID NO: 3048894 - RNA, 15 nt, Mycobacterium bovis subsp bovis AF2122/97
ccgggaaccaacacc

SEQ ID NO: 3048895 - RNA, 21 nt, Mycobacterium bovis subsp bovis AF2122/97
ccgggaaccacggucagcacg

SEQ ID NO: 3048896 - RNA, 16 nt, Mycobacterium bovis subsp bovis AF2122/97
ccgggaacccgagcuu

SEQ ID NO: 3048897 - RNA, 18 nt, Mycobacterium bovis subsp bovis AF2122/97
ccgggaacgccucagggg

SEQ ID NO: 3048898 - RNA, 19 nt, Mycobacterium bovis subsp bovis AF2122/97
ccgggaacgcugacgcccu

SEQ ID NO: 3048899 - RNA, 21 nt, Mycobacterium bovis subsp bovis AF2122/97
ccgggaagccguuuucgaaac

SEQ ID NO: 3048900 - RNA, 16 nt, Mycobacterium bovis subsp bovis AF2122/97
ccgggaaggaaccggg

SEQ ID NO: 3048901 - RNA, 19 nt, Mycobacterium bovis subsp bovis AF2122/97
ccgggaaggaaccgggcaa

SEQ ID NO: 3048902 - RNA, 14 nt, Mycobacterium bovis subsp bovis AF2122/97
ccgggaagucgcug

SEQ ID NO: 3048903 - RNA, 21 nt, Mycobacterium bovis subsp bovis AF2122/97
ccgggaagucgcugaagccgu

SEQ ID NO: 3048904 - RNA, 16 nt, Mycobacterium bovis subsp bovis AF2122/97
ccgggaauggacaggu

SEQ ID NO: 3048905 - RNA, 18 nt, Mycobacterium bovis subsp bovis AF2122/97
ccgggacaaucucggccg

SEQ ID NO: 3048906 - RNA, 19 nt, Mycobacterium bovis subsp bovis AF2122/97
ccgggacaaucucggccgc

SEQ ID NO: 3048907 - RNA, 19 nt, Mycobacterium bovis subsp bovis AF2122/97
ccgggaccaggccaacggc

SEQ ID NO: 3048908 - RNA, 23 nt, Mycobacterium bovis subsp bovis AF2122/97
ccgggaccgccccggccaggaca

SEQ ID NO: 3048909 - RNA, 11 nt, Mycobacterium bovis subsp bovis AF2122/97
ccgggaccgga

SEQ ID NO: 3048910 - RNA, 18 nt, Mycobacterium bovis subsp bovis AF2122/97
ccgggacgaaucccgcgc

SEQ ID NO: 3048911 - RNA, 20 nt, Mycobacterium bovis subsp bovis AF2122/97
ccgggacgaaucccgcgccc

SEQ ID NO: 3048912 - RNA, 18 nt, Mycobacterium bovis subsp bovis AF2122/97
ccgggacgauucucgagu

SEQ ID NO: 3048913 - RNA, 13 nt, Mycobacterium bovis subsp bovis AF2122/97
ccgggacggcgau

SEQ ID NO: 3048914 - RNA, 15 nt, Mycobacterium bovis subsp bovis AF2122/97
ccgggacggugaaac

SEQ ID NO: 3048915 - RNA, 18 nt, Mycobacterium bovis subsp bovis AF2122/97
ccgggacggugaaaccgg

SEQ ID NO: 3048916 - RNA, 20 nt, Mycobacterium bovis subsp bovis AF2122/97
ccgggacguuguccaccgcc

SEQ ID NO: 3048917 - RNA, 21 nt, Mycobacterium bovis subsp bovis AF2122/97
ccgggacguuguccaccgcca

SEQ ID NO: 3048918 - RNA, 14 nt, Mycobacterium bovis subsp bovis AF2122/97
ccgggacuaccacc

SEQ ID NO: 3048919 - RNA, 17 nt, Mycobacterium bovis subsp bovis AF2122/97
ccgggacuaccacccgc

SEQ ID NO: 3048920 - RNA, 17 nt, Mycobacterium bovis subsp bovis AF2122/97
ccgggaggacaccagcu

SEQ ID NO: 3048921 - RNA, 15 nt, Mycobacterium bovis subsp bovis AF2122/97
ccgggaggccaccgc

SEQ ID NO: 3048922 - RNA, 21 nt, Mycobacterium bovis subsp bovis AF2122/97
ccgggaggccggcuaccgcgc

SEQ ID NO: 3048923 - RNA, 15 nt, Mycobacterium bovis subsp bovis AF2122/97
ccgggaggcggcgcc

SEQ ID NO: 3048924 - RNA, 17 nt, Mycobacterium bovis subsp bovis AF2122/97
ccgggaggcggcgccgc

SEQ ID NO: 3048925 - RNA, 22 nt, Mycobacterium bovis subsp bovis AF2122/97
ccgggagucgacggugccgucg

SEQ ID NO: 3048926 - RNA, 14 nt, Mycobacterium bovis subsp bovis AF2122/97
ccgggagucgucgg

SEQ ID NO: 3048927 - RNA, 16 nt, Mycobacterium bovis subsp bovis AF2122/97
ccgggagucgucggca

SEQ ID NO: 3048928 - RNA, 15 nt, Mycobacterium bovis subsp bovis AF2122/97
ccgggagugcgccgg

SEQ ID NO: 3048929 - RNA, 15 nt, Mycobacterium bovis subsp bovis AF2122/97
ccgggauaacccagc

SEQ ID NO: 3048930 - RNA, 18 nt, Mycobacterium bovis subsp bovis AF2122/97
ccgggauaacccagcacc

SEQ ID NO: 3048931 - RNA, 20 nt, Mycobacterium bovis subsp bovis AF2122/97
ccgggauagccgcgaccaga

SEQ ID NO: 3048932 - RNA, 19 nt, Mycobacterium bovis subsp bovis AF2122/97
ccgggauaguuuucggccg

SEQ ID NO: 3048933 - RNA, 15 nt, Mycobacterium bovis subsp bovis AF2122/97
ccgggaucccacggc

SEQ ID NO: 3048934 - RNA, 21 nt, Mycobacterium bovis subsp bovis AF2122/97
ccgggaucggcuccgccgcgg

SEQ ID NO: 3048935 - RNA, 20 nt, Mycobacterium bovis subsp bovis AF2122/97
ccgggaucggggcaccgugc

SEQ ID NO: 3048936 - RNA, 23 nt, Mycobacterium bovis subsp bovis AF2122/97
ccgggaucuagaugcggaacgcc

SEQ ID NO: 3048937 - RNA, 18 nt, Mycobacterium bovis subsp bovis AF2122/97
ccgggaucugggucugug

SEQ ID NO: 3048938 - RNA, 17 nt, Mycobacterium bovis subsp bovis AF2122/97
ccgggaugaagccaccc

SEQ ID NO: 3048939 - RNA, 23 nt, Mycobacterium bovis subsp bovis AF2122/97
ccgggaugaagcucgaccgcccg

SEQ ID NO: 3048940 - RNA, 21 nt, Mycobacterium bovis subsp bovis AF2122/97
ccgggaugcgacagcgcuggg

SEQ ID NO: 3048941 - RNA, 15 nt, Mycobacterium bovis subsp bovis AF2122/97
ccgggcgaccaacac

SEQ ID NO: 3048942 - RNA, 15 nt, Mycobacterium bovis subsp bovis AF2122/97
ccgggcgaccaccac

SEQ ID NO: 3048943 - RNA, 22 nt, Mycobacterium bovis subsp bovis AF2122/97
ccgggcgaccaccaccgccgcc

SEQ ID NO: 3048944 - RNA, 24 nt, Mycobacterium bovis subsp bovis AF2122/97
ccgggcgaccaccaccgccgccga

SEQ ID NO: 3048945 - RNA, 12 nt, Mycobacterium bovis subsp bovis AF2122/97
ccgggcgacggu

SEQ ID NO: 3048946 - RNA, 12 nt, Mycobacterium bovis subsp bovis AF2122/97
ccgggcgagccg

SEQ ID NO: 3048947 - RNA, 21 nt, Mycobacterium bovis subsp bovis AF2122/97
ccgggcgaguacaggcgcagc

SEQ ID NO: 3048948 - RNA, 22 nt, Mycobacterium bovis subsp bovis AF2122/97
ccgggcgaucaaagccagcacc

SEQ ID NO: 3048949 - RNA, 14 nt, Mycobacterium bovis subsp bovis AF2122/97
ccgggcgaucgccu

SEQ ID NO: 3048950 - RNA, 15 nt, Mycobacterium bovis subsp bovis AF2122/97
ccgggcgcaagcagc

SEQ ID NO: 3048951 - RNA, 18 nt, Mycobacterium bovis subsp bovis AF2122/97
ccgggcgcaagcagcccg

SEQ ID NO: 3048952 - RNA, 19 nt, Mycobacterium bovis subsp bovis AF2122/97
ccgggcgcaagcagcccgg

SEQ ID NO: 3048953 - RNA, 16 nt, Mycobacterium bovis subsp bovis AF2122/97
ccgggcgccgaucacg

SEQ ID NO: 3048954 - RNA, 13 nt, Mycobacterium bovis subsp bovis AF2122/97
ccgggcgcgccgg

SEQ ID NO: 3048955 - RNA, 14 nt, Mycobacterium bovis subsp bovis AF2122/97
ccgggcgcgccggc

SEQ ID NO: 3048956 - RNA, 15 nt, Mycobacterium bovis subsp bovis AF2122/97
ccgggcgcgccggcc

SEQ ID NO: 3048957 - RNA, 17 nt, Mycobacterium bovis subsp bovis AF2122/97
ccgggcgcgccggccau

SEQ ID NO: 3048958 - RNA, 23 nt, Mycobacterium bovis subsp bovis AF2122/97
ccgggcgcucggucuccaccacc

SEQ ID NO: 3048959 - RNA, 19 nt, Mycobacterium bovis subsp bovis AF2122/97
ccgggcgcugcuugagguc

SEQ ID NO: 3048960 - RNA, 15 nt, Mycobacterium bovis subsp bovis AF2122/97
ccgggcgcuggacgg

SEQ ID NO: 3048961 - RNA, 16 nt, Mycobacterium bovis subsp bovis AF2122/97
ccgggcgcuggacggc

SEQ ID NO: 3048962 - RNA, 23 nt, Mycobacterium bovis subsp bovis AF2122/97
ccgggcgcuggacggcgggccgc

SEQ ID NO: 3048963 - RNA, 23 nt, Mycobacterium bovis subsp bovis AF2122/97
ccgggcgcuugcaccaggggcgc

SEQ ID NO: 3048964 - RNA, 19 nt, Mycobacterium bovis subsp bovis AF2122/97
ccgggcggcauccugcacg

SEQ ID NO: 3048965 - RNA, 15 nt, Mycobacterium bovis subsp bovis AF2122/97
ccgggcggccagcug

SEQ ID NO: 3048966 - RNA, 16 nt, Mycobacterium bovis subsp bovis AF2122/97
ccgggcggccagcugc

SEQ ID NO: 3048967 - RNA, 18 nt, Mycobacterium bovis subsp bovis AF2122/97
ccgggcggccaggcgcga

SEQ ID NO: 3048968 - RNA, 21 nt, Mycobacterium bovis subsp bovis AF2122/97
ccgggcggccaggcgcgacgu

SEQ ID NO: 3048969 - RNA, 17 nt, Mycobacterium bovis subsp bovis AF2122/97
ccgggcggccucccggg

SEQ ID NO: 3048970 - RNA, 15 nt, Mycobacterium bovis subsp bovis AF2122/97
ccgggcggcggcgac

SEQ ID NO: 3048971 - RNA, 12 nt, Mycobacterium bovis subsp bovis AF2122/97
ccgggcggcguu

SEQ ID NO: 3048972 - RNA, 19 nt, Mycobacterium bovis subsp bovis AF2122/97
ccgggcgggauccacccag

SEQ ID NO: 3048973 - RNA, 21 nt, Mycobacterium bovis subsp bovis AF2122/97
ccgggcgggauccacccagug

SEQ ID NO: 3048974 - RNA, 16 nt, Mycobacterium bovis subsp bovis AF2122/97
ccgggcguccgccggc

SEQ ID NO: 3048975 - RNA, 17 nt, Mycobacterium bovis subsp bovis AF2122/97
ccgggcguccgccggcg

SEQ ID NO: 3048976 - RNA, 16 nt, Mycobacterium bovis subsp bovis AF2122/97
ccgggcgucgcuggug

SEQ ID NO: 3048977 - RNA, 15 nt, Mycobacterium bovis subsp bovis AF2122/97
ccgggcgucgucggu

SEQ ID NO: 3048978 - RNA, 17 nt, Mycobacterium bovis subsp bovis AF2122/97
ccgggcgugcggcggcc

SEQ ID NO: 3048979 - RNA, 22 nt, Mycobacterium bovis subsp bovis AF2122/97
ccgggcgugcggcggcccaucg

SEQ ID NO: 3048980 - RNA, 19 nt, Mycobacterium bovis subsp bovis AF2122/97
ccgggcgugggcaccccgc

SEQ ID NO: 3048981 - RNA, 14 nt, Mycobacterium bovis subsp bovis AF2122/97
ccgggcgugggugu

SEQ ID NO: 3048982 - RNA, 17 nt, Mycobacterium bovis subsp bovis AF2122/97
ccgggcgugggugucgg

SEQ ID NO: 3048983 - RNA, 19 nt, Mycobacterium bovis subsp bovis AF2122/97
ccgggcgugguaucgccgg

SEQ ID NO: 3048984 - RNA, 22 nt, Mycobacterium bovis subsp bovis AF2122/97
ccgggcguugggaucgcgcagc

SEQ ID NO: 3048985 - RNA, 14 nt, Mycobacterium bovis subsp bovis AF2122/97
ccgggcguuucccu

SEQ ID NO: 3048986 - RNA, 17 nt, Mycobacterium bovis subsp bovis AF2122/97
ccgggcuauccgcggga

SEQ ID NO: 3048987 - RNA, 20 nt, Mycobacterium bovis subsp bovis AF2122/97
ccgggcuccaauugcggccg

SEQ ID NO: 3048988 - RNA, 23 nt, Mycobacterium bovis subsp bovis AF2122/97
ccgggcuccaauugcggccgcgc

SEQ ID NO: 3048989 - RNA, 12 nt, Mycobacterium bovis subsp bovis AF2122/97
ccgggcucggcg

SEQ ID NO: 3048990 - RNA, 20 nt, Mycobacterium bovis subsp bovis AF2122/97
ccgggcucggcgaaggccgc

SEQ ID NO: 3048991 - RNA, 20 nt, Mycobacterium bovis subsp bovis AF2122/97
ccgggcucggcgucgccgcc

SEQ ID NO: 3048992 - RNA, 19 nt, Mycobacterium bovis subsp bovis AF2122/97
ccgggcucggugacccccg

SEQ ID NO: 3048993 - RNA, 14 nt, Mycobacterium bovis subsp bovis AF2122/97
ccgggcucuggcca

SEQ ID NO: 3048994 - RNA, 17 nt, Mycobacterium bovis subsp bovis AF2122/97
ccgggcucuggccaguc

SEQ ID NO: 3048995 - RNA, 17 nt, Mycobacterium bovis subsp bovis AF2122/97
ccgggcugaggcggcga

SEQ ID NO: 3048996 - RNA, 13 nt, Mycobacterium bovis subsp bovis AF2122/97
ccgggcugccgcc

SEQ ID NO: 3048997 - RNA, 14 nt, Mycobacterium bovis subsp bovis AF2122/97
ccgggcugccgccc

SEQ ID NO: 3048998 - RNA, 15 nt, Mycobacterium bovis subsp bovis AF2122/97
ccgggcugccgccca

SEQ ID NO: 3048999 - RNA, 17 nt, Mycobacterium bovis subsp bovis AF2122/97
ccgggcugcuugcgccc

SEQ ID NO: 3049000 - RNA, 14 nt, Mycobacterium bovis subsp bovis AF2122/97
ccgggcuggccagc

SEQ ID NO: 3049001 - RNA, 15 nt, Mycobacterium bovis subsp bovis AF2122/97
ccgggcuggccagcg

SEQ ID NO: 3049002 - RNA, 19 nt, Mycobacterium bovis subsp bovis AF2122/97
ccgggcuggccagcgcgcu

SEQ ID NO: 3049003 - RNA, 20 nt, Mycobacterium bovis subsp bovis AF2122/97
ccgggcuggccagcgcgcuc

SEQ ID NO: 3049004 - RNA, 22 nt, Mycobacterium bovis subsp bovis AF2122/97
ccgggcuguagcgaaugaucuu

SEQ ID NO: 3049005 - RNA, 23 nt, Mycobacterium bovis subsp bovis AF2122/97
ccgggcuuacuugaucucggcga

SEQ ID NO: 3049006 - RNA, 15 nt, Mycobacterium bovis subsp bovis AF2122/97
ccgggcuuaggccgc

SEQ ID NO: 3049007 - RNA, 18 nt, Mycobacterium bovis subsp bovis AF2122/97
ccgggcuucagcacgcgg

SEQ ID NO: 3049008 - RNA, 19 nt, Mycobacterium bovis subsp bovis AF2122/97
ccgggcuuggccgcgccgg

SEQ ID NO: 3049009 - RNA, 20 nt, Mycobacterium bovis subsp bovis AF2122/97
ccgggcuuggccgcgccggu

SEQ ID NO: 3049010 - RNA, 20 nt, Mycobacterium bovis subsp bovis AF2122/97
ccggggaaagccgcagccgc

SEQ ID NO: 3049011 - RNA, 23 nt, Mycobacterium bovis subsp bovis AF2122/97
ccggggaagcuaaccgcuuggug

SEQ ID NO: 3049012 - RNA, 12 nt, Mycobacterium bovis subsp bovis AF2122/97
ccggggaaugag

SEQ ID NO: 3049013 - RNA, 15 nt, Mycobacterium bovis subsp bovis AF2122/97
ccggggacagcccgg

SEQ ID NO: 3049014 - RNA, 16 nt, Mycobacterium bovis subsp bovis AF2122/97
ccggggacagcccggc

SEQ ID NO: 3049015 - RNA, 18 nt, Mycobacterium bovis subsp bovis AF2122/97
ccggggaccucggcgauc

SEQ ID NO: 3049016 - RNA, 15 nt, Mycobacterium bovis subsp bovis AF2122/97
ccggggacgccgcgg

SEQ ID NO: 3049017 - RNA, 16 nt, Mycobacterium bovis subsp bovis AF2122/97
ccggggacgccgcggc

SEQ ID NO: 3049018 - RNA, 16 nt, Mycobacterium bovis subsp bovis AF2122/97
ccggggauaccgguca

SEQ ID NO: 3049019 - RNA, 20 nt, Mycobacterium bovis subsp bovis AF2122/97
ccggggauaucacgacgccg

SEQ ID NO: 3049020 - RNA, 21 nt, Mycobacterium bovis subsp bovis AF2122/97
ccggggcagcucaccuuccuc

SEQ ID NO: 3049021 - RNA, 13 nt, Mycobacterium bovis subsp bovis AF2122/97
ccggggccacccg

SEQ ID NO: 3049022 - RNA, 14 nt, Mycobacterium bovis subsp bovis AF2122/97
ccggggccacccgc

SEQ ID NO: 3049023 - RNA, 18 nt, Mycobacterium bovis subsp bovis AF2122/97
ccggggccacccgcagac

SEQ ID NO: 3049024 - RNA, 22 nt, Mycobacterium bovis subsp bovis AF2122/97
ccggggccccaugccgaccggc

SEQ ID NO: 3049025 - RNA, 12 nt, Mycobacterium bovis subsp bovis AF2122/97
ccggggccgccg

SEQ ID NO: 3049026 - RNA, 13 nt, Mycobacterium bovis subsp bovis AF2122/97
ccggggccgccga

SEQ ID NO: 3049027 - RNA, 13 nt, Mycobacterium bovis subsp bovis AF2122/97
ccggggccgcugg

SEQ ID NO: 3049028 - RNA, 21 nt, Mycobacterium bovis subsp bovis AF2122/97
ccgggucgaugucggggccgu

SEQ ID NO: 3049029 - RNA, 17 nt, Mycobacterium bovis subsp bovis AF2122/97
ccgggucgcaaccgccg

SEQ ID NO: 3049030 - RNA, 19 nt, Mycobacterium bovis subsp bovis AF2122/97
ccgggucgcaaccgccgcc

SEQ ID NO: 3049031 - RNA, 20 nt, Mycobacterium bovis subsp bovis AF2122/97
ccgggucgcaaccgccgcca

SEQ ID NO: 3049032 - RNA, 19 nt, Mycobacterium bovis subsp bovis AF2122/97
ccgggucgccgaugacggu

SEQ ID NO: 3049033 - RNA, 14 nt, Mycobacterium bovis subsp bovis AF2122/97
ccgggucggcacga

SEQ ID NO: 3049034 - RNA, 18 nt, Mycobacterium bovis subsp bovis AF2122/97
ccgggucggcacgacccg

SEQ ID NO: 3049035 - RNA, 14 nt, Mycobacterium bovis subsp bovis AF2122/97
ccgggucggcgaac

SEQ ID NO: 3049036 - RNA, 17 nt, Mycobacterium bovis subsp bovis AF2122/97
ccgggucgggcaccgcg

SEQ ID NO: 3049037 - RNA, 20 nt, Mycobacterium bovis subsp bovis AF2122/97
ccgggucgggcaccgcgcgc

SEQ ID NO: 3049038 - RNA, 22 nt, Mycobacterium bovis subsp bovis AF2122/97
ccgggucgggcaccgcgcgcuc

SEQ ID NO: 3049039 - RNA, 19 nt, Mycobacterium bovis subsp bovis AF2122/97
ccgggucguacaacacggg

SEQ ID NO: 3049040 - RNA, 15 nt, Mycobacterium bovis subsp bovis AF2122/97
ccgggucgugcgaca

SEQ ID NO: 3049041 - RNA, 16 nt, Mycobacterium bovis subsp bovis AF2122/97
ccgggucuccggcgca

SEQ ID NO: 3049042 - RNA, 17 nt, Mycobacterium bovis subsp bovis AF2122/97
ccgggucuccggcgcac

SEQ ID NO: 3049043 - RNA, 19 nt, Mycobacterium bovis subsp bovis AF2122/97
ccgggucuccggcgcaccu

SEQ ID NO: 3049044 - RNA, 16 nt, Mycobacterium bovis subsp bovis AF2122/97
ccgggucucggugcgg

SEQ ID NO: 3049045 - RNA, 19 nt, Mycobacterium bovis subsp bovis AF2122/97
ccgggucucggugcggcug

SEQ ID NO: 3049046 - RNA, 18 nt, Mycobacterium bovis subsp bovis AF2122/97
ccgggucuguuggugaca

SEQ ID NO: 3049047 - RNA, 21 nt, Mycobacterium bovis subsp bovis AF2122/97
ccgggucuuccggugcgccga

SEQ ID NO: 3049048 - RNA, 17 nt, Mycobacterium bovis subsp bovis AF2122/97
ccgggugaguucggcgu

SEQ ID NO: 3049049 - RNA, 14 nt, Mycobacterium bovis subsp bovis AF2122/97
ccgggugcaacggc

SEQ ID NO: 3049050 - RNA, 22 nt, Mycobacterium bovis subsp bovis AF2122/97
ccgggugcaacggcguuggcgc

SEQ ID NO: 3049051 - RNA, 14 nt, Mycobacterium bovis subsp bovis AF2122/97
ccgggugcaccggc

SEQ ID NO: 3049052 - RNA, 12 nt, Mycobacterium bovis subsp bovis AF2122/97
ccgggugccggc

SEQ ID NO: 3049053 - RNA, 19 nt, Mycobacterium bovis subsp bovis AF2122/97
ccgggugcgacgcgaccgc

SEQ ID NO: 3049054 - RNA, 21 nt, Mycobacterium bovis subsp bovis AF2122/97
ccgggugcgacgcgaccgcga

SEQ ID NO: 3049055 - RNA, 17 nt, Mycobacterium bovis subsp bovis AF2122/97
ccgggugcgagcgacac

SEQ ID NO: 3049056 - RNA, 21 nt, Mycobacterium bovis subsp bovis AF2122/97
ccgggugcgaucgcaacaccg

SEQ ID NO: 3049057 - RNA, 13 nt, Mycobacterium bovis subsp bovis AF2122/97
ccgggugcgcacc

SEQ ID NO: 3049058 - RNA, 17 nt, Mycobacterium bovis subsp bovis AF2122/97
ccgggugcgcacccggg

SEQ ID NO: 3049059 - RNA, 21 nt, Mycobacterium bovis subsp bovis AF2122/97
ccgggugcgccguugccgccg

SEQ ID NO: 3049060 - RNA, 22 nt, Mycobacterium bovis subsp bovis AF2122/97
ccgggugcugugaacgaaggga

SEQ ID NO: 3049061 - RNA, 15 nt, Mycobacterium bovis subsp bovis AF2122/97
ccggguggaacaugu

SEQ ID NO: 3049062 - RNA, 14 nt, Mycobacterium bovis subsp bovis AF2122/97
ccggguggcacacc

SEQ ID NO: 3049063 - RNA, 18 nt, Mycobacterium bovis subsp bovis AF2122/97
ccggguggcgucaccgcc

SEQ ID NO: 3049064 - RNA, 16 nt, Mycobacterium bovis subsp bovis AF2122/97
ccggguggcgucgauc

SEQ ID NO: 3049065 - RNA, 18 nt, Mycobacterium bovis subsp bovis AF2122/97
ccgggugggagcagccga

SEQ ID NO: 3049066 - RNA, 24 nt, Mycobacterium bovis subsp bovis AF2122/97
ccgggugggagcagccgaaccggc

SEQ ID NO: 3049067 - RNA, 16 nt, Mycobacterium bovis subsp bovis AF2122/97
ccggguuaucggcagc

SEQ ID NO: 3049068 - RNA, 23 nt, Mycobacterium bovis subsp bovis AF2122/97
ccggguuaucggcagcaggacac

SEQ ID NO: 3049069 - RNA, 18 nt, Mycobacterium bovis subsp bovis AF2122/97
ccggguuccagcggcacc

SEQ ID NO: 3049070 - RNA, 19 nt, Mycobacterium bovis subsp bovis AF2122/97
ccggguuccagcggcaccg

SEQ ID NO: 3049071 - RNA, 21 nt, Mycobacterium bovis subsp bovis AF2122/97
ccggguuccagcggcaccgcg

SEQ ID NO: 3049072 - RNA, 15 nt, Mycobacterium bovis subsp bovis AF2122/97
ccggguugagccgcc

SEQ ID NO: 3049073 - RNA, 19 nt, Mycobacterium bovis subsp bovis AF2122/97
ccggguuggaagccgcacc

SEQ ID NO: 3049074 - RNA, 15 nt, Mycobacterium bovis subsp bovis AF2122/97
ccggguuggccgaac

SEQ ID NO: 3049075 - RNA, 16 nt, Mycobacterium bovis subsp bovis AF2122/97
ccggguuggccggcgc

SEQ ID NO: 3049076 - RNA, 14 nt, Mycobacterium bovis subsp bovis AF2122/97
ccggguuggccggg

SEQ ID NO: 3049077 - RNA, 13 nt, Mycobacterium bovis subsp bovis AF2122/97
ccggguuggcgcc

SEQ ID NO: 3049078 - RNA, 19 nt, Mycobacterium bovis subsp bovis AF2122/97
ccggguugguacccaccag

SEQ ID NO: 3049079 - RNA, 18 nt, Mycobacterium bovis subsp bovis AF2122/97
ccggguuuggugcagccg

SEQ ID NO: 3049080 - RNA, 20 nt, Mycobacterium bovis subsp bovis AF2122/97
ccggguuuugcgcggccacc

SEQ ID NO: 3049081 - RNA, 20 nt, Mycobacterium bovis subsp bovis AF2122/97
ccgguaaccgcgucgaccgg

SEQ ID NO: 3049082 - RNA, 15 nt, Mycobacterium bovis subsp bovis AF2122/97
ccgguaacgaacagc

SEQ ID NO: 3049083 - RNA, 13 nt, Mycobacterium bovis subsp bovis AF2122/97
ccgguaacgccaa

SEQ ID NO: 3049084 - RNA, 19 nt, Mycobacterium bovis subsp bovis AF2122/97
ccgguaacgccaacaccgg

SEQ ID NO: 3049085 - RNA, 20 nt, Mycobacterium bovis subsp bovis AF2122/97
ccgguaacgccaacaccggc

SEQ ID NO: 3049086 - RNA, 13 nt, Mycobacterium bovis subsp bovis AF2122/97
ccgguaacgccau

SEQ ID NO: 3049087 - RNA, 17 nt, Mycobacterium bovis subsp bovis AF2122/97
ccgguaacgccaucguc

SEQ ID NO: 3049088 - RNA, 16 nt, Mycobacterium bovis subsp bovis AF2122/97
ccgguaacuguccgcc

SEQ ID NO: 3049089 - RNA, 18 nt, Mycobacterium bovis subsp bovis AF2122/97
ccgguacaacccccaggc

SEQ ID NO: 3049090 - RNA, 23 nt, Mycobacterium bovis subsp bovis AF2122/97
ccgguacacguccaguggcagcc

SEQ ID NO: 3049091 - RNA, 20 nt, Mycobacterium bovis subsp bovis AF2122/97
ccgguacccguagcaccaca

SEQ ID NO: 3049092 - RNA, 13 nt, Mycobacterium bovis subsp bovis AF2122/97
ccgguaccgccac

SEQ ID NO: 3049093 - RNA, 21 nt, Mycobacterium bovis subsp bovis AF2122/97
ccgguaccgccggcuccgccg

SEQ ID NO: 3049094 - RNA, 13 nt, Mycobacterium bovis subsp bovis AF2122/97
ccgguaccggcga

SEQ ID NO: 3049095 - RNA, 22 nt, Mycobacterium bovis subsp bovis AF2122/97
ccgguacgcaaccaaccgucgg

SEQ ID NO: 3049096 - RNA, 18 nt, Mycobacterium bovis subsp bovis AF2122/97
ccgguagaucagcgccug

SEQ ID NO: 3049097 - RNA, 20 nt, Mycobacterium bovis subsp bovis AF2122/97
ccgguagaucagcgccuggu

SEQ ID NO: 3049098 - RNA, 16 nt, Mycobacterium bovis subsp bovis AF2122/97
ccgguagcagcgcucg

SEQ ID NO: 3049099 - RNA, 18 nt, Mycobacterium bovis subsp bovis AF2122/97
ccgguagccaggcgcgcu

SEQ ID NO: 3049100 - RNA, 18 nt, Mycobacterium bovis subsp bovis AF2122/97
ccgguagccccgucgacc

SEQ ID NO: 3049101 - RNA, 12 nt, Mycobacterium bovis subsp bovis AF2122/97
ccgguagccggg

SEQ ID NO: 3049102 - RNA, 17 nt, Mycobacterium bovis subsp bovis AF2122/97
ccgguagcgcggguggc

SEQ ID NO: 3049103 - RNA, 14 nt, Mycobacterium bovis subsp bovis AF2122/97
ccgguagcggcggc

SEQ ID NO: 3049104 - RNA, 15 nt, Mycobacterium bovis subsp bovis AF2122/97
ccgguagcggcggca

SEQ ID NO: 3049105 - RNA, 14 nt, Mycobacterium bovis subsp bovis AF2122/97
ccgguagcguucgg

SEQ ID NO: 3049106 - RNA, 20 nt, Mycobacterium bovis subsp bovis AF2122/97
ccgguaggcgagacauugac

SEQ ID NO: 3049107 - RNA, 17 nt, Mycobacterium bovis subsp bovis AF2122/97
ccgguaggcggccagcg

SEQ ID NO: 3049108 - RNA, 17 nt, Mycobacterium bovis subsp bovis AF2122/97
ccgguaguacuagcacg

SEQ ID NO: 3049109 - RNA, 16 nt, Mycobacterium bovis subsp bovis AF2122/97
ccgguaguagcugacc

SEQ ID NO: 3049110 - RNA, 14 nt, Mycobacterium bovis subsp bovis AF2122/97
ccgguaguccgcgc

SEQ ID NO: 3049111 - RNA, 15 nt, Mycobacterium bovis subsp bovis AF2122/97
ccgguaguccgcgcu

SEQ ID NO: 3049112 - RNA, 16 nt, Mycobacterium bovis subsp bovis AF2122/97
ccgguauacccggccc

SEQ ID NO: 3049113 - RNA, 17 nt, Mycobacterium bovis subsp bovis AF2122/97
ccgguauacccggcccc

SEQ ID NO: 3049114 - RNA, 21 nt, Mycobacterium bovis subsp bovis AF2122/97
ccgguaucgccaaauccggug

SEQ ID NO: 3049115 - RNA, 21 nt, Mycobacterium bovis subsp bovis AF2122/97
ccggucggcaccaccacgccg

SEQ ID NO: 3049116 - RNA, 14 nt, Mycobacterium bovis subsp bovis AF2122/97
ccggucggcagcuu

SEQ ID NO: 3049117 - RNA, 12 nt, Mycobacterium bovis subsp bovis AF2122/97
ccggucggccag

SEQ ID NO: 3049118 - RNA, 16 nt, Mycobacterium bovis subsp bovis AF2122/97
ccggucggccaggccg

SEQ ID NO: 3049119 - RNA, 19 nt, Mycobacterium bovis subsp bovis AF2122/97
ccggucggccauccaccgc

SEQ ID NO: 3049120 - RNA, 15 nt, Mycobacterium bovis subsp bovis AF2122/97
ccggucggcccacac

SEQ ID NO: 3049121 - RNA, 13 nt, Mycobacterium bovis subsp bovis AF2122/97
ccggucggcccgc

SEQ ID NO: 3049122 - RNA, 13 nt, Mycobacterium bovis subsp bovis AF2122/97
ccggucggcgaaa

SEQ ID NO: 3049123 - RNA, 12 nt, Mycobacterium bovis subsp bovis AF2122/97
ccggucggcgac

SEQ ID NO: 3049124 - RNA, 11 nt, Mycobacterium bovis subsp bovis AF2122/97
ccggucggcgg

SEQ ID NO: 3049125 - RNA, 15 nt, Mycobacterium bovis subsp bovis AF2122/97
ccggucggcgguagc

SEQ ID NO: 3049126 - RNA, 14 nt, Mycobacterium bovis subsp bovis AF2122/97
ccggucggcgucga

SEQ ID NO: 3049127 - RNA, 22 nt, Mycobacterium bovis subsp bovis AF2122/97
ccggucgggcgcggggcggccu

SEQ ID NO: 3049128 - RNA, 15 nt, Mycobacterium bovis subsp bovis AF2122/97
ccggucggugagccg

SEQ ID NO: 3049129 - RNA, 16 nt, Mycobacterium bovis subsp bovis AF2122/97
ccggucggugagccgu

SEQ ID NO: 3049130 - RNA, 20 nt, Mycobacterium bovis subsp bovis AF2122/97
ccggucggugagccgugccg

SEQ ID NO: 3049131 - RNA, 23 nt, Mycobacterium bovis subsp bovis AF2122/97
ccggucggugagccgugccgcca

SEQ ID NO: 3049132 - RNA, 13 nt, Mycobacterium bovis subsp bovis AF2122/97
ccggucggugcgg

SEQ ID NO: 3049133 - RNA, 16 nt, Mycobacterium bovis subsp bovis AF2122/97
ccggucgugccggggc

SEQ ID NO: 3049134 - RNA, 21 nt, Mycobacterium bovis subsp bovis AF2122/97
ccggucgugccggggcugccg

SEQ ID NO: 3049135 - RNA, 17 nt, Mycobacterium bovis subsp bovis AF2122/97
ccggucuacgacgucgc

SEQ ID NO: 3049136 - RNA, 23 nt, Mycobacterium bovis subsp bovis AF2122/97
ccggucuauuugccugccgcgca

SEQ ID NO: 3049137 - RNA, 22 nt, Mycobacterium bovis subsp bovis AF2122/97
ccggucugcugggcacgauggc

SEQ ID NO: 3049138 - RNA, 18 nt, Mycobacterium bovis subsp bovis AF2122/97
ccggucuggcgaugacga

SEQ ID NO: 3049139 - RNA, 15 nt, Mycobacterium bovis subsp bovis AF2122/97
ccggucuuacggucg

SEQ ID NO: 3049140 - RNA, 12 nt, Mycobacterium bovis subsp bovis AF2122/97
ccggucuucgcg

SEQ ID NO: 3049141 - RNA, 22 nt, Mycobacterium bovis subsp bovis AF2122/97
ccggucuugcaucgccaaugcg

SEQ ID NO: 3049142 - RNA, 19 nt, Mycobacterium bovis subsp bovis AF2122/97
ccggucuugggcgcgggug

SEQ ID NO: 3049143 - RNA, 22 nt, Mycobacterium bovis subsp bovis AF2122/97
ccggucuugggcgcgggugcgc

SEQ ID NO: 3049144 - RNA, 18 nt, Mycobacterium bovis subsp bovis AF2122/97
ccggugaacaccagcagg

SEQ ID NO: 3049145 - RNA, 21 nt, Mycobacterium bovis subsp bovis AF2122/97
ccggugaacaccagcaggaag

SEQ ID NO: 3049146 - RNA, 13 nt, Mycobacterium bovis subsp bovis AF2122/97
ccggugaacaggg

SEQ ID NO: 3049147 - RNA, 17 nt, Mycobacterium bovis subsp bovis AF2122/97
ccggugaacccgauugg

SEQ ID NO: 3049148 - RNA, 16 nt, Mycobacterium bovis subsp bovis AF2122/97
ccggugaacggcagca

SEQ ID NO: 3049149 - RNA, 20 nt, Mycobacterium bovis subsp bovis AF2122/97
ccggugaacggcagcacggu

SEQ ID NO: 3049150 - RNA, 16 nt, Mycobacterium bovis subsp bovis AF2122/97
ccggugaacgguagca

SEQ ID NO: 3049151 - RNA, 23 nt, Mycobacterium bovis subsp bovis AF2122/97
ccggugaacgguagcacugucga

SEQ ID NO: 3049152 - RNA, 15 nt, Mycobacterium bovis subsp bovis AF2122/97
ccggugacaaggaug

SEQ ID NO: 3049153 - RNA, 17 nt, Mycobacterium bovis subsp bovis AF2122/97
ccggugacaaguggugc

SEQ ID NO: 3049154 - RNA, 18 nt, Mycobacterium bovis subsp bovis AF2122/97
ccggugacaaguggugcc

SEQ ID NO: 3049155 - RNA, 18 nt, Mycobacterium bovis subsp bovis AF2122/97
ccggugacgacgucgccg

SEQ ID NO: 3049156 - RNA, 18 nt, Mycobacterium bovis subsp bovis AF2122/97
ccggugacgaugaccgcg

SEQ ID NO: 3049157 - RNA, 16 nt, Mycobacterium bovis subsp bovis AF2122/97
ccggugacgcacagca

SEQ ID NO: 3049158 - RNA, 23 nt, Mycobacterium bovis subsp bovis AF2122/97
ccggugacgcacagcagcaccgc

SEQ ID NO: 3049159 - RNA, 13 nt, Mycobacterium bovis subsp bovis AF2122/97
ccggugacggugu

SEQ ID NO: 3049160 - RNA, 17 nt, Mycobacterium bovis subsp bovis AF2122/97
ccggugacgguguuggu

SEQ ID NO: 3049161 - RNA, 18 nt, Mycobacterium bovis subsp bovis AF2122/97
ccggugacguggugggcu

SEQ ID NO: 3049162 - RNA, 12 nt, Mycobacterium bovis subsp bovis AF2122/97
ccggugagaaga

SEQ ID NO: 3049163 - RNA, 17 nt, Mycobacterium bovis subsp bovis AF2122/97
ccggugagaagaagccc

SEQ ID NO: 3049164 - RNA, 18 nt, Mycobacterium bovis subsp bovis AF2122/97
ccggugagaagaagccca

SEQ ID NO: 3049165 - RNA, 21 nt, Mycobacterium bovis subsp bovis AF2122/97
ccggugagaagaagcccagga

SEQ ID NO: 3049166 - RNA, 12 nt, Mycobacterium bovis subsp bovis AF2122/97
ccggugagccgg

SEQ ID NO: 3049167 - RNA, 17 nt, Mycobacterium bovis subsp bovis AF2122/97
ccggugaggcgaccgga

SEQ ID NO: 3049168 - RNA, 22 nt, Mycobacterium bovis subsp bovis AF2122/97
ccggugaggugaugcaauagcu

SEQ ID NO: 3049169 - RNA, 21 nt, Mycobacterium bovis subsp bovis AF2122/97
ccggugaucaccgacaccgug

SEQ ID NO: 3049170 - RNA, 20 nt, Mycobacterium bovis subsp bovis AF2122/97
ccggugauccaacuggccgc

SEQ ID NO: 3049171 - RNA, 22 nt, Mycobacterium bovis subsp bovis AF2122/97
ccggugaugaccgcguagagca

SEQ ID NO: 3049172 - RNA, 14 nt, Mycobacterium bovis subsp bovis AF2122/97
ccggugaugaccgg

SEQ ID NO: 3049173 - RNA, 14 nt, Mycobacterium bovis subsp bovis AF2122/97
ccggugauggccga

SEQ ID NO: 3049174 - RNA, 16 nt, Mycobacterium bovis subsp bovis AF2122/97
ccggugauggccgacc

SEQ ID NO: 3049175 - RNA, 21 nt, Mycobacterium bovis subsp bovis AF2122/97
ccggugauggugaccagcagg

SEQ ID NO: 3049176 - RNA, 20 nt, Mycobacterium bovis subsp bovis AF2122/97
ccggugauggugugcagcag

SEQ ID NO: 3049177 - RNA, 21 nt, Mycobacterium bovis subsp bovis AF2122/97
ccggugcagaugcggcugaau

SEQ ID NO: 3049178 - RNA, 22 nt, Mycobacterium bovis subsp bovis AF2122/97
ccggugccacccuugccgccgg

SEQ ID NO: 3049179 - RNA, 15 nt, Mycobacterium bovis subsp bovis AF2122/97
ccggugccaccgacg

SEQ ID NO: 3049180 - RNA, 16 nt, Mycobacterium bovis subsp bovis AF2122/97
ccggugccaccgacgc

SEQ ID NO: 3049181 - RNA, 14 nt, Mycobacterium bovis subsp bovis AF2122/97
ccggugccaccggc

SEQ ID NO: 3049182 - RNA, 21 nt, Mycobacterium bovis subsp bovis AF2122/97
ccggugccaccggcuggugcc

SEQ ID NO: 3049183 - RNA, 13 nt, Mycobacterium bovis subsp bovis AF2122/97
ccggugccacugc

SEQ ID NO: 3049184 - RNA, 15 nt, Mycobacterium bovis subsp bovis AF2122/97
ccggugccacugccg

SEQ ID NO: 3049185 - RNA, 17 nt, Mycobacterium bovis subsp bovis AF2122/97
ccggugccacugccguu

SEQ ID NO: 3049186 - RNA, 15 nt, Mycobacterium bovis subsp bovis AF2122/97
ccggugccagcagug

SEQ ID NO: 3049187 - RNA, 14 nt, Mycobacterium bovis subsp bovis AF2122/97
ccggugccagucca

SEQ ID NO: 3049188 - RNA, 19 nt, Mycobacterium bovis subsp bovis AF2122/97
ccggugcccgcaccacacc

SEQ ID NO: 3049189 - RNA, 14 nt, Mycobacterium bovis subsp bovis AF2122/97
ccggugcccgcggu

SEQ ID NO: 3049190 - RNA, 12 nt, Mycobacterium bovis subsp bovis AF2122/97
ccggugccgacg

SEQ ID NO: 3049191 - RNA, 13 nt, Mycobacterium bovis subsp bovis AF2122/97
ccggugccgcagc

SEQ ID NO: 3049192 - RNA, 23 nt, Mycobacterium bovis subsp bovis AF2122/97
ccggugccgccauugacgccguu

SEQ ID NO: 3049193 - RNA, 12 nt, Mycobacterium bovis subsp bovis AF2122/97
ccggugccgccc

SEQ ID NO: 3049194 - RNA, 14 nt, Mycobacterium bovis subsp bovis AF2122/97
ccggugccgcccgc

SEQ ID NO: 3049195 - RNA, 19 nt, Mycobacterium bovis subsp bovis AF2122/97
ccggugccgcccgcgccgc

SEQ ID NO: 3049196 - RNA, 20 nt, Mycobacterium bovis subsp bovis AF2122/97
ccggugccgcccgcgccgcc

SEQ ID NO: 3049197 - RNA, 15 nt, Mycobacterium bovis subsp bovis AF2122/97
ccggugccgccgcgg

SEQ ID NO: 3049198 - RNA, 18 nt, Mycobacterium bovis subsp bovis AF2122/97
ccggugccgccgcggcca

SEQ ID NO: 3049199 - RNA, 20 nt, Mycobacterium bovis subsp bovis AF2122/97
ccggugccgccgcggccacc

SEQ ID NO: 3049200 - RNA, 21 nt, Mycobacterium bovis subsp bovis AF2122/97
ccggugccgccgcggccacca

SEQ ID NO: 3049201 - RNA, 13 nt, Mycobacterium bovis subsp bovis AF2122/97
ccggugccgccgg

SEQ ID NO: 3049202 - RNA, 13 nt, Mycobacterium bovis subsp bovis AF2122/97
ccgguggucgcgc

SEQ ID NO: 3049203 - RNA, 15 nt, Mycobacterium bovis subsp bovis AF2122/97
ccgguggucgcgccc

SEQ ID NO: 3049204 - RNA, 14 nt, Mycobacterium bovis subsp bovis AF2122/97
ccgguggucugcgc

SEQ ID NO: 3049205 - RNA, 20 nt, Mycobacterium bovis subsp bovis AF2122/97
ccgguggugacggcgguacc

SEQ ID NO: 3049206 - RNA, 23 nt, Mycobacterium bovis subsp bovis AF2122/97
ccgguggugacggcgguaccgcc

SEQ ID NO: 3049207 - RNA, 16 nt, Mycobacterium bovis subsp bovis AF2122/97
ccgguggugccggcgc

SEQ ID NO: 3049208 - RNA, 19 nt, Mycobacterium bovis subsp bovis AF2122/97
ccgguggugccggcgccgc

SEQ ID NO: 3049209 - RNA, 21 nt, Mycobacterium bovis subsp bovis AF2122/97
ccgguggugccggcgccgcca

SEQ ID NO: 3049210 - RNA, 14 nt, Mycobacterium bovis subsp bovis AF2122/97
ccgguggugcggcc

SEQ ID NO: 3049211 - RNA, 14 nt, Mycobacterium bovis subsp bovis AF2122/97
ccgguggugcugcc

SEQ ID NO: 3049212 - RNA, 18 nt, Mycobacterium bovis subsp bovis AF2122/97
ccggugguggcgaccccg

SEQ ID NO: 3049213 - RNA, 21 nt, Mycobacterium bovis subsp bovis AF2122/97
ccggugguuucacuacggguc

SEQ ID NO: 3049214 - RNA, 19 nt, Mycobacterium bovis subsp bovis AF2122/97
ccgguguacauaucgaagc

SEQ ID NO: 3049215 - RNA, 22 nt, Mycobacterium bovis subsp bovis AF2122/97
ccgguguagcagcgccagcagc

SEQ ID NO: 3049216 - RNA, 23 nt, Mycobacterium bovis subsp bovis AF2122/97
ccgguguagcagcgccagcagcu

SEQ ID NO: 3049217 - RNA, 16 nt, Mycobacterium bovis subsp bovis AF2122/97
ccgguguaggccucgg

SEQ ID NO: 3049218 - RNA, 19 nt, Mycobacterium bovis subsp bovis AF2122/97
ccgguguaggccucggcag

SEQ ID NO: 3049219 - RNA, 17 nt, Mycobacterium bovis subsp bovis AF2122/97
ccggugucaguccgaca

SEQ ID NO: 3049220 - RNA, 15 nt, Mycobacterium bovis subsp bovis AF2122/97
ccgguguccagccac

SEQ ID NO: 3049221 - RNA, 18 nt, Mycobacterium bovis subsp bovis AF2122/97
ccgguguccagccacgcu

SEQ ID NO: 3049222 - RNA, 19 nt, Mycobacterium bovis subsp bovis AF2122/97
ccgguguccagccacgcug

SEQ ID NO: 3049223 - RNA, 20 nt, Mycobacterium bovis subsp bovis AF2122/97
ccgguguccuuggccgccac

SEQ ID NO: 3049224 - RNA, 23 nt, Mycobacterium bovis subsp bovis AF2122/97
ccgguguccuuggccgccacucg

SEQ ID NO: 3049225 - RNA, 16 nt, Mycobacterium bovis subsp bovis AF2122/97
ccggugucggccagca

SEQ ID NO: 3049226 - RNA, 18 nt, Mycobacterium bovis subsp bovis AF2122/97
ccggugucggcuggucgc

SEQ ID NO: 3049227 - RNA, 12 nt, Mycobacterium bovis subsp bovis AF2122/97
ccggugucggug

SEQ ID NO: 3049228 - RNA, 19 nt, Mycobacterium bovis subsp bovis AF2122/97
ccggugucggugcgcggca

SEQ ID NO: 3049229 - RNA, 21 nt, Mycobacterium bovis subsp bovis AF2122/97
ccggugucucccuugccgcca

SEQ ID NO: 3049230 - RNA, 21 nt, Mycobacterium bovis subsp bovis AF2122/97
ccggugucuucugccaucaac

SEQ ID NO: 3049231 - RNA, 22 nt, Mycobacterium bovis subsp bovis AF2122/97
ccggugugcaggaucacgccgc

SEQ ID NO: 3049232 - RNA, 18 nt, Mycobacterium bovis subsp bovis AF2122/97
ccggugugcucgauaucg

SEQ ID NO: 3049233 - RNA, 18 nt, Mycobacterium bovis subsp bovis AF2122/97
ccggugugcugcacggcc

SEQ ID NO: 3049234 - RNA, 20 nt, Mycobacterium bovis subsp bovis AF2122/97
ccggugugcuguuuggcccc

SEQ ID NO: 3049235 - RNA, 23 nt, Mycobacterium bovis subsp bovis AF2122/97
ccggugugcuguuuggccccguu

SEQ ID NO: 3049236 - RNA, 16 nt, Mycobacterium bovis subsp bovis AF2122/97
ccgguguguccagcgg

SEQ ID NO: 3049237 - RNA, 20 nt, Mycobacterium bovis subsp bovis AF2122/97
ccgguguguucggcccgcac

SEQ ID NO: 3049238 - RNA, 19 nt, Mycobacterium bovis subsp bovis AF2122/97
ccgguguuagugaggcccg

SEQ ID NO: 3049239 - RNA, 23 nt, Mycobacterium bovis subsp bovis AF2122/97
ccgguguucaucacgccgccgga

SEQ ID NO: 3049240 - RNA, 18 nt, Mycobacterium bovis subsp bovis AF2122/97
ccgguguuccgcccagcg

SEQ ID NO: 3049241 - RNA, 22 nt, Mycobacterium bovis subsp bovis AF2122/97
ccgguguugagaucgcccgagu

SEQ ID NO: 3049242 - RNA, 21 nt, Mycobacterium bovis subsp bovis AF2122/97
ccgguguugagcgaacccgcg

SEQ ID NO: 3049243 - RNA, 16 nt, Mycobacterium bovis subsp bovis AF2122/97
ccgguguugccgccgg

SEQ ID NO: 3049244 - RNA, 19 nt, Mycobacterium bovis subsp bovis AF2122/97
ccgguguugccgccggugc

SEQ ID NO: 3049245 - RNA, 15 nt, Mycobacterium bovis subsp bovis AF2122/97
ccgguguugccguga

SEQ ID NO: 3049246 - RNA, 17 nt, Mycobacterium bovis subsp bovis AF2122/97
ccgguguugccguuacc

SEQ ID NO: 3049247 - RNA, 23 nt, Mycobacterium bovis subsp bovis AF2122/97
ccgguguuguaggccgggccggc

SEQ ID NO: 3049248 - RNA, 22 nt, Mycobacterium bovis subsp bovis AF2122/97
ccgguucagcgcuggcaggccg

SEQ ID NO: 3049249 - RNA, 18 nt, Mycobacterium bovis subsp bovis AF2122/97
ccgguucccgggcagccg

SEQ ID NO: 3049250 - RNA, 22 nt, Mycobacterium bovis subsp bovis AF2122/97
ccgguuccgcaaugaccuggcc

SEQ ID NO: 3049251 - RNA, 14 nt, Mycobacterium bovis subsp bovis AF2122/97
ccgguuccgccggc

SEQ ID NO: 3049252 - RNA, 21 nt, Mycobacterium bovis subsp bovis AF2122/97
ccgguuccggcgaucaacgcg

SEQ ID NO: 3049253 - RNA, 23 nt, Mycobacterium bovis subsp bovis AF2122/97
ccgguucgauggcaucggccauc

SEQ ID NO: 3049254 - RNA, 14 nt, Mycobacterium bovis subsp bovis AF2122/97
ccgguucgccgccg

SEQ ID NO: 3049255 - RNA, 15 nt, Mycobacterium bovis subsp bovis AF2122/97
ccgguucgccgccgu

SEQ ID NO: 3049256 - RNA, 18 nt, Mycobacterium bovis subsp bovis AF2122/97
ccgguucgccgccguugg

SEQ ID NO: 3049257 - RNA, 21 nt, Mycobacterium bovis subsp bovis AF2122/97
ccgguucggggggcaggucga

SEQ ID NO: 3049258 - RNA, 22 nt, Mycobacterium bovis subsp bovis AF2122/97
ccgguucugcgcccacccgcgc

SEQ ID NO: 3049259 - RNA, 18 nt, Mycobacterium bovis subsp bovis AF2122/97
ccgguucugggccugcgg

SEQ ID NO: 3049260 - RNA, 16 nt, Mycobacterium bovis subsp bovis AF2122/97
ccgguugacacccggg

SEQ ID NO: 3049261 - RNA, 18 nt, Mycobacterium bovis subsp bovis AF2122/97
ccgguugaugguccgcca

SEQ ID NO: 3049262 - RNA, 15 nt, Mycobacterium bovis subsp bovis AF2122/97
ccgguuggccagcca

SEQ ID NO: 3049263 - RNA, 17 nt, Mycobacterium bovis subsp bovis AF2122/97
ccgguuggccagccaca

SEQ ID NO: 3049264 - RNA, 17 nt, Mycobacterium bovis subsp bovis AF2122/97
ccgguuggccagugacu

SEQ ID NO: 3049265 - RNA, 12 nt, Mycobacterium bovis subsp bovis AF2122/97
ccgguuggcccc

SEQ ID NO: 3049266 - RNA, 20 nt, Mycobacterium bovis subsp bovis AF2122/97
ccgguuggcugccggcaaca

SEQ ID NO: 3049267 - RNA, 14 nt, Mycobacterium bovis subsp bovis AF2122/97
ccgguugggguggc

SEQ ID NO: 3049268 - RNA, 20 nt, Mycobacterium bovis subsp bovis AF2122/97
ccgguugucgcagcgcacac

SEQ ID NO: 3049269 - RNA, 16 nt, Mycobacterium bovis subsp bovis AF2122/97
ccgguugugcgcgcgc

SEQ ID NO: 3049270 - RNA, 20 nt, Mycobacterium bovis subsp bovis AF2122/97
ccgguugugcgcgcgcccga

SEQ ID NO: 3049271 - RNA, 19 nt, Mycobacterium bovis subsp bovis AF2122/97
ccgguuguggaaccacggc

SEQ ID NO: 3049272 - RNA, 15 nt, Mycobacterium bovis subsp bovis AF2122/97
ccgguuuccgucuga

SEQ ID NO: 3049273 - RNA, 20 nt, Mycobacterium bovis subsp bovis AF2122/97
ccgguuucgaggcgaagcgg

SEQ ID NO: 3049274 - RNA, 19 nt, Mycobacterium bovis subsp bovis AF2122/97
ccgguuucuucggccagcu

SEQ ID NO: 3049275 - RNA, 15 nt, Mycobacterium bovis subsp bovis AF2122/97
ccgguuucuucuuca

SEQ ID NO: 3049276 - RNA, 13 nt, Mycobacterium bovis subsp bovis AF2122/97
ccgguuugacguc

SEQ ID NO: 3049277 - RNA, 23 nt, Mycobacterium bovis subsp bovis AF2122/97
ccgguuugacguccagggccacg

SEQ ID NO: 3049278 - RNA, 21 nt, Mycobacterium bovis subsp bovis AF2122/97
ccgguuuggagcucaucgacg

SEQ ID NO: 3049279 - RNA, 17 nt, Mycobacterium bovis subsp bovis AF2122/97
ccgguuuggucgccgcg

SEQ ID NO: 3049280 - RNA, 13 nt, Mycobacterium bovis subsp bovis AF2122/97
ccguaaaagccga

SEQ ID NO: 3049281 - RNA, 20 nt, Mycobacterium bovis subsp bovis AF2122/97
ccguaaacagcgcgccggcg

SEQ ID NO: 3049282 - RNA, 21 nt, Mycobacterium bovis subsp bovis AF2122/97
ccguaaaccgauaucgcugcg

SEQ ID NO: 3049283 - RNA, 20 nt, Mycobacterium bovis subsp bovis AF2122/97
ccguaaagccaacuggucgc

SEQ ID NO: 3049284 - RNA, 21 nt, Mycobacterium bovis subsp bovis AF2122/97
ccguaaauaucggggccacug

SEQ ID NO: 3049285 - RNA, 17 nt, Mycobacterium bovis subsp bovis AF2122/97
ccguaagcaccagccag

SEQ ID NO: 3049286 - RNA, 16 nt, Mycobacterium bovis subsp bovis AF2122/97
ccguacaaccacccac

SEQ ID NO: 3049287 - RNA, 18 nt, Mycobacterium bovis subsp bovis AF2122/97
ccguacagcggcggcguc

SEQ ID NO: 3049288 - RNA, 19 nt, Mycobacterium bovis subsp bovis AF2122/97
ccgucagggucaccugcgg

SEQ ID NO: 3049289 - RNA, 22 nt, Mycobacterium bovis subsp bovis AF2122/97
ccgucagggucaccugcgggcc

SEQ ID NO: 3049290 - RNA, 23 nt, Mycobacterium bovis subsp bovis AF2122/97
ccgucagguacgucuuggaucac

SEQ ID NO: 3049291 - RNA, 21 nt, Mycobacterium bovis subsp bovis AF2122/97
ccgucagguucuaccaaaucg

SEQ ID NO: 3049292 - RNA, 18 nt, Mycobacterium bovis subsp bovis AF2122/97
ccgucaguagccacgccc

SEQ ID NO: 3049293 - RNA, 17 nt, Mycobacterium bovis subsp bovis AF2122/97
ccgucaguucggugugc

SEQ ID NO: 3049294 - RNA, 22 nt, Mycobacterium bovis subsp bovis AF2122/97
ccgucaguucggugugcggcgc

SEQ ID NO: 3049295 - RNA, 16 nt, Mycobacterium bovis subsp bovis AF2122/97
ccgucauacucgacac

SEQ ID NO: 3049296 - RNA, 23 nt, Mycobacterium bovis subsp bovis AF2122/97
ccgucauacucgacaccgacucg

SEQ ID NO: 3049297 - RNA, 14 nt, Mycobacterium bovis subsp bovis AF2122/97
ccgucauagcaggc

SEQ ID NO: 3049298 - RNA, 14 nt, Mycobacterium bovis subsp bovis AF2122/97
ccgucaucgccggg

SEQ ID NO: 3049299 - RNA, 15 nt, Mycobacterium bovis subsp bovis AF2122/97
ccgucaucgccgggu

SEQ ID NO: 3049300 - RNA, 16 nt, Mycobacterium bovis subsp bovis AF2122/97
ccgucaucgugcccgc

SEQ ID NO: 3049301 - RNA, 19 nt, Mycobacterium bovis subsp bovis AF2122/97
ccgucaugccgacgacaac

SEQ ID NO: 3049302 - RNA, 16 nt, Mycobacterium bovis subsp bovis AF2122/97
ccgucauggcccgauc

SEQ ID NO: 3049303 - RNA, 12 nt, Mycobacterium bovis subsp bovis AF2122/97
ccgucauggcga

SEQ ID NO: 3049304 - RNA, 17 nt, Mycobacterium bovis subsp bovis AF2122/97
ccgucauggcgaaccgu

SEQ ID NO: 3049305 - RNA, 15 nt, Mycobacterium bovis subsp bovis AF2122/97
ccgucauugccacca

SEQ ID NO: 3049306 - RNA, 22 nt, Mycobacterium bovis subsp bovis AF2122/97
ccgucauuggcuuguccggugg

SEQ ID NO: 3049307 - RNA, 21 nt, Mycobacterium bovis subsp bovis AF2122/97
ccguccaacuacgccagccgc

SEQ ID NO: 3049308 - RNA, 22 nt, Mycobacterium bovis subsp bovis AF2122/97
ccguccaauuggcgucgucggc

SEQ ID NO: 3049309 - RNA, 22 nt, Mycobacterium bovis subsp bovis AF2122/97
ccguccaccgacguggccagcc

SEQ ID NO: 3049310 - RNA, 16 nt, Mycobacterium bovis subsp bovis AF2122/97
ccguccagcgccgcgg

SEQ ID NO: 3049311 - RNA, 17 nt, Mycobacterium bovis subsp bovis AF2122/97
ccguccaggacggaucg

SEQ ID NO: 3049312 - RNA, 18 nt, Mycobacterium bovis subsp bovis AF2122/97
ccguccaggcgcugcagc

SEQ ID NO: 3049313 - RNA, 19 nt, Mycobacterium bovis subsp bovis AF2122/97
ccguccaggcgcugcagca

SEQ ID NO: 3049314 - RNA, 20 nt, Mycobacterium bovis subsp bovis AF2122/97
ccgucccaaugcaacaaggc

SEQ ID NO: 3049315 - RNA, 21 nt, Mycobacterium bovis subsp bovis AF2122/97
ccgucccacgugugcggaagc

SEQ ID NO: 3049316 - RNA, 18 nt, Mycobacterium bovis subsp bovis AF2122/97
ccgucccagcugaccagc

SEQ ID NO: 3049317 - RNA, 20 nt, Mycobacterium bovis subsp bovis AF2122/97
ccgucccagcugaccagcgu

SEQ ID NO: 3049318 - RNA, 16 nt, Mycobacterium bovis subsp bovis AF2122/97
ccgucccccgcacgcg

SEQ ID NO: 3049319 - RNA, 17 nt, Mycobacterium bovis subsp bovis AF2122/97
ccgucccccgcacgcgg

SEQ ID NO: 3049320 - RNA, 18 nt, Mycobacterium bovis subsp bovis AF2122/97
ccguccccgcagcgccua

SEQ ID NO: 3049321 - RNA, 15 nt, Mycobacterium bovis subsp bovis AF2122/97
ccguccccgccgacg

SEQ ID NO: 3049322 - RNA, 21 nt, Mycobacterium bovis subsp bovis AF2122/97
ccguccccggcguccgaccgg

SEQ ID NO: 3049323 - RNA, 19 nt, Mycobacterium bovis subsp bovis AF2122/97
ccgucccgaaacgccgggu

SEQ ID NO: 3049324 - RNA, 19 nt, Mycobacterium bovis subsp bovis AF2122/97
ccgucccgauacggccggc

SEQ ID NO: 3049325 - RNA, 21 nt, Mycobacterium bovis subsp bovis AF2122/97
ccgucccgauacggccggccg

SEQ ID NO: 3049326 - RNA, 12 nt, Mycobacterium bovis subsp bovis AF2122/97
ccgucccgcgag

SEQ ID NO: 3049327 - RNA, 14 nt, Mycobacterium bovis subsp bovis AF2122/97
ccgucccgcgagca

SEQ ID NO: 3049328 - RNA, 20 nt, Mycobacterium bovis subsp bovis AF2122/97
ccgucccgcgagcagcccgg

SEQ ID NO: 3049329 - RNA, 16 nt, Mycobacterium bovis subsp bovis AF2122/97
ccgucccgcucgagca

SEQ ID NO: 3049330 - RNA, 14 nt, Mycobacterium bovis subsp bovis AF2122/97
ccgucccggcucga

SEQ ID NO: 3049331 - RNA, 15 nt, Mycobacterium bovis subsp bovis AF2122/97
ccguccgaccaggga

SEQ ID NO: 3049332 - RNA, 21 nt, Mycobacterium bovis subsp bovis AF2122/97
ccguccgauuucccagcgcag

SEQ ID NO: 3049333 - RNA, 22 nt, Mycobacterium bovis subsp bovis AF2122/97
ccguccgcggacuuggcggucg

SEQ ID NO: 3049334 - RNA, 21 nt, Mycobacterium bovis subsp bovis AF2122/97
ccguccgcugguggucagcac

SEQ ID NO: 3049335 - RNA, 20 nt, Mycobacterium bovis subsp bovis AF2122/97
ccguccggccgggcccucca

SEQ ID NO: 3049336 - RNA, 19 nt, Mycobacterium bovis subsp bovis AF2122/97
ccguccggggccgcggccc

SEQ ID NO: 3049337 - RNA, 18 nt, Mycobacterium bovis subsp bovis AF2122/97
ccguccgguggacgcaga

SEQ ID NO: 3049338 - RNA, 12 nt, Mycobacterium bovis subsp bovis AF2122/97
ccguccgucggc

SEQ ID NO: 3049339 - RNA, 14 nt, Mycobacterium bovis subsp bovis AF2122/97
ccguccgucggcgc

SEQ ID NO: 3049340 - RNA, 16 nt, Mycobacterium bovis subsp bovis AF2122/97
ccguccucccacaggu

SEQ ID NO: 3049341 - RNA, 14 nt, Mycobacterium bovis subsp bovis AF2122/97
ccguccucgcuauu

SEQ ID NO: 3049342 - RNA, 15 nt, Mycobacterium bovis subsp bovis AF2122/97
ccguccucggucagc

SEQ ID NO: 3049343 - RNA, 20 nt, Mycobacterium bovis subsp bovis AF2122/97
ccguccucggucagcucguc

SEQ ID NO: 3049344 - RNA, 22 nt, Mycobacterium bovis subsp bovis AF2122/97
ccguccucggucagcucgucgg

SEQ ID NO: 3049345 - RNA, 14 nt, Mycobacterium bovis subsp bovis AF2122/97
ccguccucgucggu

SEQ ID NO: 3049346 - RNA, 12 nt, Mycobacterium bovis subsp bovis AF2122/97
ccguccugcagg

SEQ ID NO: 3049347 - RNA, 14 nt, Mycobacterium bovis subsp bovis AF2122/97
ccguccuuuccagg

SEQ ID NO: 3049348 - RNA, 21 nt, Mycobacterium bovis subsp bovis AF2122/97
ccgucgaaagagaaggcggcg

SEQ ID NO: 3049349 - RNA, 18 nt, Mycobacterium bovis subsp bovis AF2122/97
ccgucgaaauacccgguc

SEQ ID NO: 3049350 - RNA, 19 nt, Mycobacterium bovis subsp bovis AF2122/97
ccgucgaaccagaggucac

SEQ ID NO: 3049351 - RNA, 17 nt, Mycobacterium bovis subsp bovis AF2122/97
ccgucgaaccaguccuc

SEQ ID NO: 3049352 - RNA, 17 nt, Mycobacterium bovis subsp bovis AF2122/97
ccgucgaaccuaccgug

SEQ ID NO: 3049353 - RNA, 20 nt, Mycobacterium bovis subsp bovis AF2122/97
ccgucgaacgguagcacggu

SEQ ID NO: 3049354 - RNA, 14 nt, Mycobacterium bovis subsp bovis AF2122/97
ccgucgacaccgcg

SEQ ID NO: 3049355 - RNA, 13 nt, Mycobacterium bovis subsp bovis AF2122/97
ccgucgaccacga

SEQ ID NO: 3049356 - RNA, 13 nt, Mycobacterium bovis subsp bovis AF2122/97
ccgucgaccggcg

SEQ ID NO: 3049357 - RNA, 16 nt, Mycobacterium bovis subsp bovis AF2122/97
ccgucgaccggcggga

SEQ ID NO: 3049358 - RNA, 23 nt, Mycobacterium bovis subsp bovis AF2122/97
ccgucgaccggcgggaugcgcgc

SEQ ID NO: 3049359 - RNA, 17 nt, Mycobacterium bovis subsp bovis AF2122/97
ccgucgacgagcgccuc

SEQ ID NO: 3049360 - RNA, 16 nt, Mycobacterium bovis subsp bovis AF2122/97
ccgucgacgaucagcg

SEQ ID NO: 3049361 - RNA, 15 nt, Mycobacterium bovis subsp bovis AF2122/97
ccgucgacgcggccg

SEQ ID NO: 3049362 - RNA, 16 nt, Mycobacterium bovis subsp bovis AF2122/97
ccgucgacgucgaugg

SEQ ID NO: 3049363 - RNA, 21 nt, Mycobacterium bovis subsp bovis AF2122/97
ccgucgagcacggugagccgg

SEQ ID NO: 3049364 - RNA, 15 nt, Mycobacterium bovis subsp bovis AF2122/97
ccgucgagccgugcc

SEQ ID NO: 3049365 - RNA, 19 nt, Mycobacterium bovis subsp bovis AF2122/97
ccgucgagguacacgccga

SEQ ID NO: 3049366 - RNA, 24 nt, Mycobacterium bovis subsp bovis AF2122/97
ccgucgaguagguaacgcgcacgc

SEQ ID NO: 3049367 - RNA, 15 nt, Mycobacterium bovis subsp bovis AF2122/97
ccgucgaguccaggc

SEQ ID NO: 3049368 - RNA, 17 nt, Mycobacterium bovis subsp bovis AF2122/97
ccgucgaguccaggccg

SEQ ID NO: 3049369 - RNA, 20 nt, Mycobacterium bovis subsp bovis AF2122/97
ccgucgaguccaggccggca

SEQ ID NO: 3049370 - RNA, 15 nt, Mycobacterium bovis subsp bovis AF2122/97
ccgucgagucgccga

SEQ ID NO: 3049371 - RNA, 19 nt, Mycobacterium bovis subsp bovis AF2122/97
ccgucgaguuccggccggu

SEQ ID NO: 3049372 - RNA, 23 nt, Mycobacterium bovis subsp bovis AF2122/97
ccgucgaucaagugcgguccggc

SEQ ID NO: 3049373 - RNA, 19 nt, Mycobacterium bovis subsp bovis AF2122/97
ccgucgaucagcggcagca

SEQ ID NO: 3049374 - RNA, 21 nt, Mycobacterium bovis subsp bovis AF2122/97
ccgucggggucaacaggccgu

SEQ ID NO: 3049375 - RNA, 18 nt, Mycobacterium bovis subsp bovis AF2122/97
ccgucggguaggccgccg

SEQ ID NO: 3049376 - RNA, 18 nt, Mycobacterium bovis subsp bovis AF2122/97
ccgucgggugcagcacgg

SEQ ID NO: 3049377 - RNA, 19 nt, Mycobacterium bovis subsp bovis AF2122/97
ccgucgguaaagggcucga

SEQ ID NO: 3049378 - RNA, 13 nt, Mycobacterium bovis subsp bovis AF2122/97
ccgucggugaugg

SEQ ID NO: 3049379 - RNA, 19 nt, Mycobacterium bovis subsp bovis AF2122/97
ccgucggugauggagccgg

SEQ ID NO: 3049380 - RNA, 13 nt, Mycobacterium bovis subsp bovis AF2122/97
ccgucggugccgc

SEQ ID NO: 3049381 - RNA, 21 nt, Mycobacterium bovis subsp bovis AF2122/97
ccgucggugccggggcugccg

SEQ ID NO: 3049382 - RNA, 21 nt, Mycobacterium bovis subsp bovis AF2122/97
ccgucggugggugccagccgg

SEQ ID NO: 3049383 - RNA, 22 nt, Mycobacterium bovis subsp bovis AF2122/97
ccgucggugggugccagccggu

SEQ ID NO: 3049384 - RNA, 23 nt, Mycobacterium bovis subsp bovis AF2122/97
ccgucggugguuuucccgucgcc

SEQ ID NO: 3049385 - RNA, 24 nt, Mycobacterium bovis subsp bovis AF2122/97
ccgucggugguuuucccgucgccg

SEQ ID NO: 3049386 - RNA, 22 nt, Mycobacterium bovis subsp bovis AF2122/97
ccgucguacucgaccgcgagca

SEQ ID NO: 3049387 - RNA, 20 nt, Mycobacterium bovis subsp bovis AF2122/97
ccgucguacucggcggccac

SEQ ID NO: 3049388 - RNA, 15 nt, Mycobacterium bovis subsp bovis AF2122/97
ccgucgucgaccacg

SEQ ID NO: 3049389 - RNA, 18 nt, Mycobacterium bovis subsp bovis AF2122/97
ccgucgucgaccacgacg

SEQ ID NO: 3049390 - RNA, 21 nt, Mycobacterium bovis subsp bovis AF2122/97
ccgucgucgagcaccacccgg

SEQ ID NO: 3049391 - RNA, 23 nt, Mycobacterium bovis subsp bovis AF2122/97
ccgucgucgagcaccacccgggc

SEQ ID NO: 3049392 - RNA, 13 nt, Mycobacterium bovis subsp bovis AF2122/97
ccgucgucgaucg

SEQ ID NO: 3049393 - RNA, 15 nt, Mycobacterium bovis subsp bovis AF2122/97
ccgucgucggucacc

SEQ ID NO: 3049394 - RNA, 23 nt, Mycobacterium bovis subsp bovis AF2122/97
ccgucgucgucgacacggugauc

SEQ ID NO: 3049395 - RNA, 15 nt, Mycobacterium bovis subsp bovis AF2122/97
ccgucgugccaccgu

SEQ ID NO: 3049396 - RNA, 15 nt, Mycobacterium bovis subsp bovis AF2122/97
ccgucguggcggugg

SEQ ID NO: 3049397 - RNA, 20 nt, Mycobacterium bovis subsp bovis AF2122/97
ccgucguuaagacggcgacg

SEQ ID NO: 3049398 - RNA, 17 nt, Mycobacterium bovis subsp bovis AF2122/97
ccgucguugcccgaccc

SEQ ID NO: 3049399 - RNA, 19 nt, Mycobacterium bovis subsp bovis AF2122/97
ccgucguugcccgacccgc

SEQ ID NO: 3049400 - RNA, 21 nt, Mycobacterium bovis subsp bovis AF2122/97
ccgucguugcccgacccgccg

SEQ ID NO: 3049401 - RNA, 14 nt, Mycobacterium bovis subsp bovis AF2122/97
ccgucguugccggc

SEQ ID NO: 3049402 - RNA, 21 nt, Mycobacterium bovis subsp bovis AF2122/97
ccgucguugccggcgaccaug

SEQ ID NO: 3049403 - RNA, 17 nt, Mycobacterium bovis subsp bovis AF2122/97
ccgucguugugccgguc

SEQ ID NO: 3049404 - RNA, 17 nt, Mycobacterium bovis subsp bovis AF2122/97
ccgucuccaucgggaau

SEQ ID NO: 3049405 - RNA, 12 nt, Mycobacterium bovis subsp bovis AF2122/97
ccgucuccggcg

SEQ ID NO: 3049406 - RNA, 17 nt, Mycobacterium bovis subsp bovis AF2122/97
ccgucuccggcgccacc

SEQ ID NO: 3049407 - RNA, 20 nt, Mycobacterium bovis subsp bovis AF2122/97
ccgucuccuggucaaccgcg

SEQ ID NO: 3049408 - RNA, 22 nt, Mycobacterium bovis subsp bovis AF2122/97
ccgucucgaagcucagcuucuu

SEQ ID NO: 3049409 - RNA, 15 nt, Mycobacterium bovis subsp bovis AF2122/97
ccgucucgaucgcgg

SEQ ID NO: 3049410 - RNA, 15 nt, Mycobacterium bovis subsp bovis AF2122/97
ccgucucgccgcgca

SEQ ID NO: 3049411 - RNA, 21 nt, Mycobacterium bovis subsp bovis AF2122/97
ccgucucgccgcgcaccgacc

SEQ ID NO: 3049412 - RNA, 16 nt, Mycobacterium bovis subsp bovis AF2122/97
ccgucugacagcaucc

SEQ ID NO: 3049413 - RNA, 17 nt, Mycobacterium bovis subsp bovis AF2122/97
ccgucugacccaccgcc

SEQ ID NO: 3049414 - RNA, 18 nt, Mycobacterium bovis subsp bovis AF2122/97
ccgucugacccaccgccc

SEQ ID NO: 3049415 - RNA, 19 nt, Mycobacterium bovis subsp bovis AF2122/97
ccgucugacccaccgcccc

SEQ ID NO: 3049416 - RNA, 20 nt, Mycobacterium bovis subsp bovis AF2122/97
ccgucugacccaccgccccg

SEQ ID NO: 3049417 - RNA, 14 nt, Mycobacterium bovis subsp bovis AF2122/97
ccgucugcaccggc

SEQ ID NO: 3049418 - RNA, 17 nt, Mycobacterium bovis subsp bovis AF2122/97
ccgucugcgacccgggc

SEQ ID NO: 3049419 - RNA, 20 nt, Mycobacterium bovis subsp bovis AF2122/97
ccgucugcggggugagugac

SEQ ID NO: 3049420 - RNA, 17 nt, Mycobacterium bovis subsp bovis AF2122/97
ccgucugcuggccgggu

SEQ ID NO: 3049421 - RNA, 22 nt, Mycobacterium bovis subsp bovis AF2122/97
ccgucuggcaugaccgcugccg

SEQ ID NO: 3049422 - RNA, 16 nt, Mycobacterium bovis subsp bovis AF2122/97
ccgucuuccagccagg

SEQ ID NO: 3049423 - RNA, 13 nt, Mycobacterium bovis subsp bovis AF2122/97
ccgucuucgccgc

SEQ ID NO: 3049424 - RNA, 14 nt, Mycobacterium bovis subsp bovis AF2122/97
ccgucuucgccgcc

SEQ ID NO: 3049425 - RNA, 20 nt, Mycobacterium bovis subsp bovis AF2122/97
ccgucuucgccgccaccggc

SEQ ID NO: 3049426 - RNA, 24 nt, Mycobacterium bovis subsp bovis AF2122/97
ccgucuuguaggacaagugccggc

SEQ ID NO: 3049427 - RNA, 20 nt, Mycobacterium bovis subsp bovis AF2122/97
ccgucuuugucacgcaccgc

SEQ ID NO: 3049428 - RNA, 17 nt, Mycobacterium bovis subsp bovis AF2122/97
ccgugaacggauguggu

SEQ ID NO: 3049429 - RNA, 15 nt, Mycobacterium bovis subsp bovis AF2122/97
ccgugaacggcucgg

SEQ ID NO: 3049430 - RNA, 12 nt, Mycobacterium bovis subsp bovis AF2122/97
ccgugaagcccu

SEQ ID NO: 3049431 - RNA, 18 nt, Mycobacterium bovis subsp bovis AF2122/97
ccgugaauucgccgaacg

SEQ ID NO: 3049432 - RNA, 13 nt, Mycobacterium bovis subsp bovis AF2122/97
ccgugacaccggg

SEQ ID NO: 3049433 - RNA, 14 nt, Mycobacterium bovis subsp bovis AF2122/97
ccgugaccagccgg

SEQ ID NO: 3049434 - RNA, 21 nt, Mycobacterium bovis subsp bovis AF2122/97
ccgugacccucagcaccgcug

SEQ ID NO: 3049435 - RNA, 22 nt, Mycobacterium bovis subsp bovis AF2122/97
ccgugacccucagcaccgcugg

SEQ ID NO: 3049436 - RNA, 18 nt, Mycobacterium bovis subsp bovis AF2122/97
ccgugaccgagaagccca

SEQ ID NO: 3049437 - RNA, 15 nt, Mycobacterium bovis subsp bovis AF2122/97
ccgugaccgagccgc

SEQ ID NO: 3049438 - RNA, 13 nt, Mycobacterium bovis subsp bovis AF2122/97
ccgugaccgccgc

SEQ ID NO: 3049439 - RNA, 15 nt, Mycobacterium bovis subsp bovis AF2122/97
ccgugaccgccgcgc

SEQ ID NO: 3049440 - RNA, 16 nt, Mycobacterium bovis subsp bovis AF2122/97
ccgugaccgccgcgcc

SEQ ID NO: 3049441 - RNA, 18 nt, Mycobacterium bovis subsp bovis AF2122/97
ccgugaccgccgcgccgg

SEQ ID NO: 3049442 - RNA, 20 nt, Mycobacterium bovis subsp bovis AF2122/97
ccgugaccgccgcgccggca

SEQ ID NO: 3049443 - RNA, 19 nt, Mycobacterium bovis subsp bovis AF2122/97
ccgugacguaucgccgcgg

SEQ ID NO: 3049444 - RNA, 22 nt, Mycobacterium bovis subsp bovis AF2122/97
ccgugacguaucgccgcgggcg

SEQ ID NO: 3049445 - RNA, 18 nt, Mycobacterium bovis subsp bovis AF2122/97
ccgugagcaccagcagca

SEQ ID NO: 3049446 - RNA, 19 nt, Mycobacterium bovis subsp bovis AF2122/97
ccgugagcaccagcagcac

SEQ ID NO: 3049447 - RNA, 21 nt, Mycobacterium bovis subsp bovis AF2122/97
ccgugagccuuucgugcaccg

SEQ ID NO: 3049448 - RNA, 18 nt, Mycobacterium bovis subsp bovis AF2122/97
ccgugaguacucggucaa

SEQ ID NO: 3049449 - RNA, 22 nt, Mycobacterium bovis subsp bovis AF2122/97
ccgugaguagguccacguucgg

SEQ ID NO: 3049450 - RNA, 23 nt, Mycobacterium bovis subsp bovis AF2122/97
ccgugauaucagagggccgcggu

SEQ ID NO: 3049451 - RNA, 16 nt, Mycobacterium bovis subsp bovis AF2122/97
ccgugaucaccacgaa

SEQ ID NO: 3049452 - RNA, 13 nt, Mycobacterium bovis subsp bovis AF2122/97
ccgugaucagcuc

SEQ ID NO: 3049453 - RNA, 17 nt, Mycobacterium bovis subsp bovis AF2122/97
ccgugauccgccgacag

SEQ ID NO: 3049454 - RNA, 17 nt, Mycobacterium bovis subsp bovis AF2122/97
ccgugaucgaggcggcg

SEQ ID NO: 3049455 - RNA, 16 nt, Mycobacterium bovis subsp bovis AF2122/97
ccgugaucggcgcccg

SEQ ID NO: 3049456 - RNA, 18 nt, Mycobacterium bovis subsp bovis AF2122/97
ccgugaucggcgcccggg

SEQ ID NO: 3049457 - RNA, 15 nt, Mycobacterium bovis subsp bovis AF2122/97
ccgugaugccacggc

SEQ ID NO: 3049458 - RNA, 23 nt, Mycobacterium bovis subsp bovis AF2122/97
ccgugauggcguuugccggccga

SEQ ID NO: 3049459 - RNA, 17 nt, Mycobacterium bovis subsp bovis AF2122/97
ccgugcaccagcgacca

SEQ ID NO: 3049460 - RNA, 17 nt, Mycobacterium bovis subsp bovis AF2122/97
ccguggguagcgaagaa

SEQ ID NO: 3049461 - RNA, 21 nt, Mycobacterium bovis subsp bovis AF2122/97
ccguggguguuuuugcgggug

SEQ ID NO: 3049462 - RNA, 15 nt, Mycobacterium bovis subsp bovis AF2122/97
ccguggucgagggcg

SEQ ID NO: 3049463 - RNA, 14 nt, Mycobacterium bovis subsp bovis AF2122/97
ccguggucgaggug

SEQ ID NO: 3049464 - RNA, 22 nt, Mycobacterium bovis subsp bovis AF2122/97
ccguggucgaggugggguggug

SEQ ID NO: 3049465 - RNA, 12 nt, Mycobacterium bovis subsp bovis AF2122/97
ccguggugauca

SEQ ID NO: 3049466 - RNA, 21 nt, Mycobacterium bovis subsp bovis AF2122/97
ccguggugaucaaacuaccga

SEQ ID NO: 3049467 - RNA, 18 nt, Mycobacterium bovis subsp bovis AF2122/97
ccguggugcuagcgccgc

SEQ ID NO: 3049468 - RNA, 20 nt, Mycobacterium bovis subsp bovis AF2122/97
ccgugguggacgaccgcgcg

SEQ ID NO: 3049469 - RNA, 18 nt, Mycobacterium bovis subsp bovis AF2122/97
ccgugguggaugagccgg

SEQ ID NO: 3049470 - RNA, 15 nt, Mycobacterium bovis subsp bovis AF2122/97
ccgugguggucgggc

SEQ ID NO: 3049471 - RNA, 20 nt, Mycobacterium bovis subsp bovis AF2122/97
ccgugguggucgggcgcaac

SEQ ID NO: 3049472 - RNA, 20 nt, Mycobacterium bovis subsp bovis AF2122/97
ccguggugguugaucagcca

SEQ ID NO: 3049473 - RNA, 21 nt, Mycobacterium bovis subsp bovis AF2122/97
ccguggugguugaucagccag

SEQ ID NO: 3049474 - RNA, 22 nt, Mycobacterium bovis subsp bovis AF2122/97
ccguggugguugaucagccaga

SEQ ID NO: 3049475 - RNA, 23 nt, Mycobacterium bovis subsp bovis AF2122/97
ccguggugguugaucagccagac

SEQ ID NO: 3049476 - RNA, 16 nt, Mycobacterium bovis subsp bovis AF2122/97
ccgugguguacccgcc

SEQ ID NO: 3049477 - RNA, 18 nt, Mycobacterium bovis subsp bovis AF2122/97
ccgugguugcacguucgg

SEQ ID NO: 3049478 - RNA, 15 nt, Mycobacterium bovis subsp bovis AF2122/97
ccguguaaccaucgu

SEQ ID NO: 3049479 - RNA, 13 nt, Mycobacterium bovis subsp bovis AF2122/97
ccguguagauggg

SEQ ID NO: 3049480 - RNA, 13 nt, Mycobacterium bovis subsp bovis AF2122/97
ccgugucaccgcc

SEQ ID NO: 3049481 - RNA, 17 nt, Mycobacterium bovis subsp bovis AF2122/97
ccgugucaccgccggga

SEQ ID NO: 3049482 - RNA, 24 nt, Mycobacterium bovis subsp bovis AF2122/97
ccgugucaccgccgggaagccgca

SEQ ID NO: 3049483 - RNA, 21 nt, Mycobacterium bovis subsp bovis AF2122/97
ccgugucacgcgaccaccgcc

SEQ ID NO: 3049484 - RNA, 14 nt, Mycobacterium bovis subsp bovis AF2122/97
ccguguccgccgga

SEQ ID NO: 3049485 - RNA, 14 nt, Mycobacterium bovis subsp bovis AF2122/97
ccgugucgacgguc

SEQ ID NO: 3049486 - RNA, 12 nt, Mycobacterium bovis subsp bovis AF2122/97
ccgugucgccgg

SEQ ID NO: 3049487 - RNA, 13 nt, Mycobacterium bovis subsp bovis AF2122/97
ccgugucgccggc

SEQ ID NO: 3049488 - RNA, 20 nt, Mycobacterium bovis subsp bovis AF2122/97
ccgugugcaucggcgaccgc

SEQ ID NO: 3049489 - RNA, 14 nt, Mycobacterium bovis subsp bovis AF2122/97
ccgugugccacggg

SEQ ID NO: 3049490 - RNA, 15 nt, Mycobacterium bovis subsp bovis AF2122/97
ccgugugccacgggg

SEQ ID NO: 3049491 - RNA, 23 nt, Mycobacterium bovis subsp bovis AF2122/97
ccgugugcggacaguucccggcc

SEQ ID NO: 3049492 - RNA, 22 nt, Mycobacterium bovis subsp bovis AF2122/97
ccgugugcucuugcgccacggc

SEQ ID NO: 3049493 - RNA, 19 nt, Mycobacterium bovis subsp bovis AF2122/97
ccgugugcuucgagcaccg

SEQ ID NO: 3049494 - RNA, 16 nt, Mycobacterium bovis subsp bovis AF2122/97
ccguguggccguuggc

SEQ ID NO: 3049495 - RNA, 20 nt, Mycobacterium bovis subsp bovis AF2122/97
ccguguggccguuggccgga

SEQ ID NO: 3049496 - RNA, 18 nt, Mycobacterium bovis subsp bovis AF2122/97
ccgugugggccccgccga

SEQ ID NO: 3049497 - RNA, 19 nt, Mycobacterium bovis subsp bovis AF2122/97
ccguguggucccggcacga

SEQ ID NO: 3049498 - RNA, 19 nt, Mycobacterium bovis subsp bovis AF2122/97
ccgugugugcgauccaggg

SEQ ID NO: 3049499 - RNA, 16 nt, Mycobacterium bovis subsp bovis AF2122/97
ccguguucagcaccca

SEQ ID NO: 3049500 - RNA, 15 nt, Mycobacterium bovis subsp bovis AF2122/97
ccguguucgccacac

SEQ ID NO: 3049501 - RNA, 17 nt, Mycobacterium bovis subsp bovis AF2122/97
ccguguugcacgcgggu

SEQ ID NO: 3049502 - RNA, 13 nt, Mycobacterium bovis subsp bovis AF2122/97
ccguuaccgccaa

SEQ ID NO: 3049503 - RNA, 13 nt, Mycobacterium bovis subsp bovis AF2122/97
ccguuaccgccgc

SEQ ID NO: 3049504 - RNA, 15 nt, Mycobacterium bovis subsp bovis AF2122/97
ccguuaccgccgcug

SEQ ID NO: 3049505 - RNA, 20 nt, Mycobacterium bovis subsp bovis AF2122/97
ccguuaccgccggcgccggu

SEQ ID NO: 3049506 - RNA, 15 nt, Mycobacterium bovis subsp bovis AF2122/97
ccguuaccgccgucg

SEQ ID NO: 3049507 - RNA, 18 nt, Mycobacterium bovis subsp bovis AF2122/97
ccguuaccgccguugccg

SEQ ID NO: 3049508 - RNA, 19 nt, Mycobacterium bovis subsp bovis AF2122/97
ccguuagcuuagcugccgu

SEQ ID NO: 3049509 - RNA, 22 nt, Mycobacterium bovis subsp bovis AF2122/97
ccguuagcuuagcugccgucgg

SEQ ID NO: 3049510 - RNA, 21 nt, Mycobacterium bovis subsp bovis AF2122/97
ccguucacccagcggaaccga

SEQ ID NO: 3049511 - RNA, 14 nt, Mycobacterium bovis subsp bovis AF2122/97
ccguucagcgacca

SEQ ID NO: 3049512 - RNA, 22 nt, Mycobacterium bovis subsp bovis AF2122/97
ccguucagcgacggccgccagc

SEQ ID NO: 3049513 - RNA, 18 nt, Mycobacterium bovis subsp bovis AF2122/97
ccguuccacgccggcauc

SEQ ID NO: 3049514 - RNA, 15 nt, Mycobacterium bovis subsp bovis AF2122/97
ccguucccaccacca

SEQ ID NO: 3049515 - RNA, 14 nt, Mycobacterium bovis subsp bovis AF2122/97
ccguucccgccggc

SEQ ID NO: 3049516 - RNA, 15 nt, Mycobacterium bovis subsp bovis AF2122/97
ccguuccguaucggg

SEQ ID NO: 3049517 - RNA, 22 nt, Mycobacterium bovis subsp bovis AF2122/97
ccguucgaaguucucggugcgc

SEQ ID NO: 3049518 - RNA, 17 nt, Mycobacterium bovis subsp bovis AF2122/97
ccguucgacccagcggu

SEQ ID NO: 3049519 - RNA, 19 nt, Mycobacterium bovis subsp bovis AF2122/97
ccguucgaccguguaacca

SEQ ID NO: 3049520 - RNA, 15 nt, Mycobacterium bovis subsp bovis AF2122/97
ccguucgcagcacca

SEQ ID NO: 3049521 - RNA, 17 nt, Mycobacterium bovis subsp bovis AF2122/97
ccguucgcccgcccguc

SEQ ID NO: 3049522 - RNA, 18 nt, Mycobacterium bovis subsp bovis AF2122/97
ccguucgcccgcccgucu

SEQ ID NO: 3049523 - RNA, 22 nt, Mycobacterium bovis subsp bovis AF2122/97
ccguucgcccgcccgucuucca

SEQ ID NO: 3049524 - RNA, 14 nt, Mycobacterium bovis subsp bovis AF2122/97
ccguucgccgucgg

SEQ ID NO: 3049525 - RNA, 13 nt, Mycobacterium bovis subsp bovis AF2122/97
ccguucgcgccgu

SEQ ID NO: 3049526 - RNA, 18 nt, Mycobacterium bovis subsp bovis AF2122/97
ccguucgcgucgccgaug

SEQ ID NO: 3049527 - RNA, 17 nt, Mycobacterium bovis subsp bovis AF2122/97
ccguucgcucccccgcu

SEQ ID NO: 3049528 - RNA, 19 nt, Mycobacterium bovis subsp bovis AF2122/97
ccguucggcgacagcgcgg

SEQ ID NO: 3049529 - RNA, 14 nt, Mycobacterium bovis subsp bovis AF2122/97
ccguucggcgcccg

SEQ ID NO: 3049530 - RNA, 16 nt, Mycobacterium bovis subsp bovis AF2122/97
ccguucggcuaagccu

SEQ ID NO: 3049531 - RNA, 20 nt, Mycobacterium bovis subsp bovis AF2122/97
ccguucggcugccgcgcgcu

SEQ ID NO: 3049532 - RNA, 17 nt, Mycobacterium bovis subsp bovis AF2122/97
ccguucgugagcggcca

SEQ ID NO: 3049533 - RNA, 19 nt, Mycobacterium bovis subsp bovis AF2122/97
ccguucgugagcggccagg

SEQ ID NO: 3049534 - RNA, 20 nt, Mycobacterium bovis subsp bovis AF2122/97
ccguucgugggcauugcggc

SEQ ID NO: 3049535 - RNA, 19 nt, Mycobacterium bovis subsp bovis AF2122/97
ccguucguucccgcucggg

SEQ ID NO: 3049536 - RNA, 18 nt, Mycobacterium bovis subsp bovis AF2122/97
ccguucucgcccacccgc

SEQ ID NO: 3049537 - RNA, 15 nt, Mycobacterium bovis subsp bovis AF2122/97
ccguucugcccaggc

SEQ ID NO: 3049538 - RNA, 19 nt, Mycobacterium bovis subsp bovis AF2122/97
ccguugaacggcaccagcg

SEQ ID NO: 3049539 - RNA, 20 nt, Mycobacterium bovis subsp bovis AF2122/97
ccguugaccucuucgggcag

SEQ ID NO: 3049540 - RNA, 14 nt, Mycobacterium bovis subsp bovis AF2122/97
ccguugacgccguu

SEQ ID NO: 3049541 - RNA, 19 nt, Mycobacterium bovis subsp bovis AF2122/97
ccguugaguguguuugagu

SEQ ID NO: 3049542 - RNA, 20 nt, Mycobacterium bovis subsp bovis AF2122/97
ccguugauaaaaaccuggcc

SEQ ID NO: 3049543 - RNA, 20 nt, Mycobacterium bovis subsp bovis AF2122/97
ccguugaucaagaaggccag

SEQ ID NO: 3049544 - RNA, 16 nt, Mycobacterium bovis subsp bovis AF2122/97
ccguugaugucggcag

SEQ ID NO: 3049545 - RNA, 15 nt, Mycobacterium bovis subsp bovis AF2122/97
ccguugauucggccg

SEQ ID NO: 3049546 - RNA, 13 nt, Mycobacterium bovis subsp bovis AF2122/97
ccuagccgcagcc

SEQ ID NO: 3049547 - RNA, 14 nt, Mycobacterium bovis subsp bovis AF2122/97
ccuagccgcggcac

SEQ ID NO: 3049548 - RNA, 14 nt, Mycobacterium bovis subsp bovis AF2122/97
ccuagccgcuccgc

SEQ ID NO: 3049549 - RNA, 12 nt, Mycobacterium bovis subsp bovis AF2122/97
ccuagccggcgc

SEQ ID NO: 3049550 - RNA, 16 nt, Mycobacterium bovis subsp bovis AF2122/97
ccuagccggcgcgccc

SEQ ID NO: 3049551 - RNA, 11 nt, Mycobacterium bovis subsp bovis AF2122/97
ccuagcgcggc

SEQ ID NO: 3049552 - RNA, 14 nt, Mycobacterium bovis subsp bovis AF2122/97
ccuagcgcggcgac

SEQ ID NO: 3049553 - RNA, 14 nt, Mycobacterium bovis subsp bovis AF2122/97
ccuagcuggugcgc

SEQ ID NO: 3049554 - RNA, 16 nt, Mycobacterium bovis subsp bovis AF2122/97
ccuagcuggugcgccc

SEQ ID NO: 3049555 - RNA, 14 nt, Mycobacterium bovis subsp bovis AF2122/97
ccuaggacaccggc

SEQ ID NO: 3049556 - RNA, 16 nt, Mycobacterium bovis subsp bovis AF2122/97
ccuagggaaaggcgcc

SEQ ID NO: 3049557 - RNA, 17 nt, Mycobacterium bovis subsp bovis AF2122/97
ccuagggcggcggcgcg

SEQ ID NO: 3049558 - RNA, 13 nt, Mycobacterium bovis subsp bovis AF2122/97
ccuaggguggcga

SEQ ID NO: 3049559 - RNA, 22 nt, Mycobacterium bovis subsp bovis AF2122/97
ccuagguagucggccuccucgu

SEQ ID NO: 3049560 - RNA, 18 nt, Mycobacterium bovis subsp bovis AF2122/97
ccuaggucgacgccgacc

SEQ ID NO: 3049561 - RNA, 18 nt, Mycobacterium bovis subsp bovis AF2122/97
ccuaggugugcgacgacg

SEQ ID NO: 3049562 - RNA, 20 nt, Mycobacterium bovis subsp bovis AF2122/97
ccuaggugugcgacgacggc

SEQ ID NO: 3049563 - RNA, 20 nt, Mycobacterium bovis subsp bovis AF2122/97
ccuagucaccuugaccgggu

SEQ ID NO: 3049564 - RNA, 20 nt, Mycobacterium bovis subsp bovis AF2122/97
ccuaguccggcacugcggcc

SEQ ID NO: 3049565 - RNA, 21 nt, Mycobacterium bovis subsp bovis AF2122/97
ccuaguccggcacugcggcca

SEQ ID NO: 3049566 - RNA, 14 nt, Mycobacterium bovis subsp bovis AF2122/97
ccuagucgcggccg

SEQ ID NO: 3049567 - RNA, 18 nt, Mycobacterium bovis subsp bovis AF2122/97
ccuagugccaggaucgcg

SEQ ID NO: 3049568 - RNA, 23 nt, Mycobacterium bovis subsp bovis AF2122/97
ccuagugccaggaucgcggcgcc

SEQ ID NO: 3049569 - RNA, 14 nt, Mycobacterium bovis subsp bovis AF2122/97
ccuauaccgcuggg

SEQ ID NO: 3049570 - RNA, 14 nt, Mycobacterium bovis subsp bovis AF2122/97
ccuauacgcaacag

SEQ ID NO: 3049571 - RNA, 18 nt, Mycobacterium bovis subsp bovis AF2122/97
ccuaucacgagccaggga

SEQ ID NO: 3049572 - RNA, 18 nt, Mycobacterium bovis subsp bovis AF2122/97
ccuaucagugagccgcca

SEQ ID NO: 3049573 - RNA, 19 nt, Mycobacterium bovis subsp bovis AF2122/97
ccuaucagugagccgccau

SEQ ID NO: 3049574 - RNA, 20 nt, Mycobacterium bovis subsp bovis AF2122/97
ccuauccaaagaccccuacc

SEQ ID NO: 3049575 - RNA, 17 nt, Mycobacterium bovis subsp bovis AF2122/97
ccuaucguuaucgacac

SEQ ID NO: 3049576 - RNA, 19 nt, Mycobacterium bovis subsp bovis AF2122/97
ccuaucguuaucgacacca

SEQ ID NO: 3049577 - RNA, 22 nt, Mycobacterium bovis subsp bovis AF2122/97
ccuaucguuaucgacaccacca

SEQ ID NO: 3049578 - RNA, 22 nt, Mycobacterium bovis subsp bovis AF2122/97
ccuaugcugcccggcaaccugg

SEQ ID NO: 3049579 - RNA, 18 nt, Mycobacterium bovis subsp bovis AF2122/97
ccuauggucaaccgcgcc

SEQ ID NO: 3049580 - RNA, 13 nt, Mycobacterium bovis subsp bovis AF2122/97
ccucaaagccucg

SEQ ID NO: 3049581 - RNA, 18 nt, Mycobacterium bovis subsp bovis AF2122/97
ccucaacgaucgcgccgu

SEQ ID NO: 3049582 - RNA, 13 nt, Mycobacterium bovis subsp bovis AF2122/97
ccucaacggcggc

SEQ ID NO: 3049583 - RNA, 16 nt, Mycobacterium bovis subsp bovis AF2122/97
ccucaacggcggcaac

SEQ ID NO: 3049584 - RNA, 19 nt, Mycobacterium bovis subsp bovis AF2122/97
ccucaaggagcccguccag

SEQ ID NO: 3049585 - RNA, 20 nt, Mycobacterium bovis subsp bovis AF2122/97
ccucaaggagcccguccagg

SEQ ID NO: 3049586 - RNA, 16 nt, Mycobacterium bovis subsp bovis AF2122/97
ccucaaggucggccag

SEQ ID NO: 3049587 - RNA, 17 nt, Mycobacterium bovis subsp bovis AF2122/97
ccucaaggucggccagg

SEQ ID NO: 3049588 - RNA, 20 nt, Mycobacterium bovis subsp bovis AF2122/97
ccucaaggucggccaggcug

SEQ ID NO: 3049589 - RNA, 20 nt, Mycobacterium bovis subsp bovis AF2122/97
ccucaaugaccaccgggcgc

SEQ ID NO: 3049590 - RNA, 14 nt, Mycobacterium bovis subsp bovis AF2122/97
ccucacaugcccgg

SEQ ID NO: 3049591 - RNA, 16 nt, Mycobacterium bovis subsp bovis AF2122/97
ccucacaugcccggac

SEQ ID NO: 3049592 - RNA, 13 nt, Mycobacterium bovis subsp bovis AF2122/97
ccucaccagucag

SEQ ID NO: 3049593 - RNA, 16 nt, Mycobacterium bovis subsp bovis AF2122/97
ccucacccacccgcgg

SEQ ID NO: 3049594 - RNA, 21 nt, Mycobacterium bovis subsp bovis AF2122/97
ccucaccgaucucgaccagcg

SEQ ID NO: 3049595 - RNA, 18 nt, Mycobacterium bovis subsp bovis AF2122/97
ccucacguggacugaccu

SEQ ID NO: 3049596 - RNA, 13 nt, Mycobacterium bovis subsp bovis AF2122/97
ccucagcaccgcu

SEQ ID NO: 3049597 - RNA, 12 nt, Mycobacterium bovis subsp bovis AF2122/97
ccucagccaccg

SEQ ID NO: 3049598 - RNA, 20 nt, Mycobacterium bovis subsp bovis AF2122/97
ccucagccaccgcggucagc

SEQ ID NO: 3049599 - RNA, 13 nt, Mycobacterium bovis subsp bovis AF2122/97
ccucagccaccgg

SEQ ID NO: 3049600 - RNA, 19 nt, Mycobacterium bovis subsp bovis AF2122/97
ccucagcccggccagccgc

SEQ ID NO: 3049601 - RNA, 23 nt, Mycobacterium bovis subsp bovis AF2122/97
ccucagcccggccagccgcacgg

SEQ ID NO: 3049602 - RNA, 13 nt, Mycobacterium bovis subsp bovis AF2122/97
ccucagccgccug

SEQ ID NO: 3049603 - RNA, 19 nt, Mycobacterium bovis subsp bovis AF2122/97
ccucagccgccugucgggc

SEQ ID NO: 3049604 - RNA, 12 nt, Mycobacterium bovis subsp bovis AF2122/97
ccucagccgcgc

SEQ ID NO: 3049605 - RNA, 14 nt, Mycobacterium bovis subsp bovis AF2122/97
ccucagccgcgccg

SEQ ID NO: 3049606 - RNA, 13 nt, Mycobacterium bovis subsp bovis AF2122/97
ccucagccgcggc

SEQ ID NO: 3049607 - RNA, 21 nt, Mycobacterium bovis subsp bovis AF2122/97
ccucagcgcgguccaucccga

SEQ ID NO: 3049608 - RNA, 19 nt, Mycobacterium bovis subsp bovis AF2122/97
ccucaguguacaccgcgcc

SEQ ID NO: 3049609 - RNA, 23 nt, Mycobacterium bovis subsp bovis AF2122/97
ccucaguguacaccgcgcccgcc

SEQ ID NO: 3049610 - RNA, 20 nt, Mycobacterium bovis subsp bovis AF2122/97
ccucaguucacguucggcga

SEQ ID NO: 3049611 - RNA, 22 nt, Mycobacterium bovis subsp bovis AF2122/97
ccucaguucacguucggcgacg

SEQ ID NO: 3049612 - RNA, 17 nt, Mycobacterium bovis subsp bovis AF2122/97
ccucauagagcggcacc

SEQ ID NO: 3049613 - RNA, 18 nt, Mycobacterium bovis subsp bovis AF2122/97
ccucauagagcggcacca

SEQ ID NO: 3049614 - RNA, 21 nt, Mycobacterium bovis subsp bovis AF2122/97
ccucauagagcggcaccagau

SEQ ID NO: 3049615 - RNA, 22 nt, Mycobacterium bovis subsp bovis AF2122/97
ccucauagauacagucgaccgg

SEQ ID NO: 3049616 - RNA, 23 nt, Mycobacterium bovis subsp bovis AF2122/97
ccucaucggacagcgccuggccg

SEQ ID NO: 3049617 - RNA, 15 nt, Mycobacterium bovis subsp bovis AF2122/97
ccucaucggcaccgu

SEQ ID NO: 3049618 - RNA, 13 nt, Mycobacterium bovis subsp bovis AF2122/97
ccucaugcacgcc

SEQ ID NO: 3049619 - RNA, 21 nt, Mycobacterium bovis subsp bovis AF2122/97
ccucauugccguucucgucga

SEQ ID NO: 3049620 - RNA, 14 nt, Mycobacterium bovis subsp bovis AF2122/97
ccuccaagcccgcc

SEQ ID NO: 3049621 - RNA, 22 nt, Mycobacterium bovis subsp bovis AF2122/97
ccuccaagcccgccggacccgc

SEQ ID NO: 3049622 - RNA, 24 nt, Mycobacterium bovis subsp bovis AF2122/97
ccuccaauugcgaaccggccgucg

SEQ ID NO: 3049623 - RNA, 14 nt, Mycobacterium bovis subsp bovis AF2122/97
ccuccacagcggcc

SEQ ID NO: 3049624 - RNA, 17 nt, Mycobacterium bovis subsp bovis AF2122/97
ccuccaccagugccccg

SEQ ID NO: 3049625 - RNA, 12 nt, Mycobacterium bovis subsp bovis AF2122/97
ccuccacccgcc

SEQ ID NO: 3049626 - RNA, 15 nt, Mycobacterium bovis subsp bovis AF2122/97
ccuccaccgccgcgc

SEQ ID NO: 3049627 - RNA, 17 nt, Mycobacterium bovis subsp bovis AF2122/97
ccuccaccgccgcgcgg

SEQ ID NO: 3049628 - RNA, 13 nt, Mycobacterium bovis subsp bovis AF2122/97
ccuccaccgcgcc

SEQ ID NO: 3049629 - RNA, 18 nt, Mycobacterium bovis subsp bovis AF2122/97
ccuccaccgcgccggcgg

SEQ ID NO: 3049630 - RNA, 18 nt, Mycobacterium bovis subsp bovis AF2122/97
ccuccacgcgccacucgu

SEQ ID NO: 3049631 - RNA, 17 nt, Mycobacterium bovis subsp bovis AF2122/97
ccuccacgcuggcgccc

SEQ ID NO: 3049632 - RNA, 19 nt, Mycobacterium bovis subsp bovis AF2122/97
ccuccacucuucgggcggc

SEQ ID NO: 3049633 - RNA, 16 nt, Mycobacterium bovis subsp bovis AF2122/97
ccucgacacccagccg

SEQ ID NO: 3049634 - RNA, 18 nt, Mycobacterium bovis subsp bovis AF2122/97
ccucgacacccagccgca

SEQ ID NO: 3049635 - RNA, 21 nt, Mycobacterium bovis subsp bovis AF2122/97
ccucgacacccagccgcagcc

SEQ ID NO: 3049636 - RNA, 16 nt, Mycobacterium bovis subsp bovis AF2122/97
ccucgacacccauccu

SEQ ID NO: 3049637 - RNA, 13 nt, Mycobacterium bovis subsp bovis AF2122/97
ccucgaccgccag

SEQ ID NO: 3049638 - RNA, 16 nt, Mycobacterium bovis subsp bovis AF2122/97
ccucgaccgccagccc

SEQ ID NO: 3049639 - RNA, 21 nt, Mycobacterium bovis subsp bovis AF2122/97
ccucgaccgcggccuuggcgg

SEQ ID NO: 3049640 - RNA, 18 nt, Mycobacterium bovis subsp bovis AF2122/97
ccucgaccgcggggcagc

SEQ ID NO: 3049641 - RNA, 12 nt, Mycobacterium bovis subsp bovis AF2122/97
ccucgaccugga

SEQ ID NO: 3049642 - RNA, 16 nt, Mycobacterium bovis subsp bovis AF2122/97
ccucgaccuggauggg

SEQ ID NO: 3049643 - RNA, 18 nt, Mycobacterium bovis subsp bovis AF2122/97
ccucgacgagucggcggg

SEQ ID NO: 3049644 - RNA, 17 nt, Mycobacterium bovis subsp bovis AF2122/97
ccucgacgaucagcacg

SEQ ID NO: 3049645 - RNA, 23 nt, Mycobacterium bovis subsp bovis AF2122/97
ccucgacgaucagcacgucgcgg

SEQ ID NO: 3049646 - RNA, 14 nt, Mycobacterium bovis subsp bovis AF2122/97
ccucgacgcccgcc

SEQ ID NO: 3049647 - RNA, 16 nt, Mycobacterium bovis subsp bovis AF2122/97
ccucgacgcccgcccu

SEQ ID NO: 3049648 - RNA, 15 nt, Mycobacterium bovis subsp bovis AF2122/97
ccucgacgccgcgca

SEQ ID NO: 3049649 - RNA, 14 nt, Mycobacterium bovis subsp bovis AF2122/97
ccucgacgcggcag

SEQ ID NO: 3049650 - RNA, 15 nt, Mycobacterium bovis subsp bovis AF2122/97
ccucgacgcggcagg

SEQ ID NO: 3049651 - RNA, 16 nt, Mycobacterium bovis subsp bovis AF2122/97
ccucgacgcggcaggc

SEQ ID NO: 3049652 - RNA, 16 nt, Mycobacterium bovis subsp bovis AF2122/97
ccucgacgucggcgag

SEQ ID NO: 3049653 - RNA, 14 nt, Mycobacterium bovis subsp bovis AF2122/97
ccucgagcaccgcg

SEQ ID NO: 3049654 - RNA, 16 nt, Mycobacterium bovis subsp bovis AF2122/97
ccucgagcagcguggg

SEQ ID NO: 3049655 - RNA, 14 nt, Mycobacterium bovis subsp bovis AF2122/97
ccucgagcgcggcg

SEQ ID NO: 3049656 - RNA, 21 nt, Mycobacterium bovis subsp bovis AF2122/97
ccucgagcgcuguggcccaca

SEQ ID NO: 3049657 - RNA, 13 nt, Mycobacterium bovis subsp bovis AF2122/97
ccucgagcggcag

SEQ ID NO: 3049658 - RNA, 18 nt, Mycobacterium bovis subsp bovis AF2122/97
ccucgagcggcagaugaa

SEQ ID NO: 3049659 - RNA, 16 nt, Mycobacterium bovis subsp bovis AF2122/97
ccucgagcugcuggcg

SEQ ID NO: 3049660 - RNA, 16 nt, Mycobacterium bovis subsp bovis AF2122/97
ccucgagguccucguc

SEQ ID NO: 3049661 - RNA, 17 nt, Mycobacterium bovis subsp bovis AF2122/97
ccucgagguccucgucg

SEQ ID NO: 3049662 - RNA, 19 nt, Mycobacterium bovis subsp bovis AF2122/97
ccucgaguacccaaccggu

SEQ ID NO: 3049663 - RNA, 18 nt, Mycobacterium bovis subsp bovis AF2122/97
ccucgaguugcgcggcag

SEQ ID NO: 3049664 - RNA, 16 nt, Mycobacterium bovis subsp bovis AF2122/97
ccucgaguuuggccag

SEQ ID NO: 3049665 - RNA, 16 nt, Mycobacterium bovis subsp bovis AF2122/97
ccucgauagcggcgcc

SEQ ID NO: 3049666 - RNA, 16 nt, Mycobacterium bovis subsp bovis AF2122/97
ccucgaucacggcggc

SEQ ID NO: 3049667 - RNA, 15 nt, Mycobacterium bovis subsp bovis AF2122/97
ccucgaucagcgccg

SEQ ID NO: 3049668 - RNA, 14 nt, Mycobacterium bovis subsp bovis AF2122/97
ccucgaucgcgccg

SEQ ID NO: 3049669 - RNA, 15 nt, Mycobacterium bovis subsp bovis AF2122/97
ccucgaucgcgccgu

SEQ ID NO: 3049670 - RNA, 16 nt, Mycobacterium bovis subsp bovis AF2122/97
ccucgaucgucgacgc

SEQ ID NO: 3049671 - RNA, 12 nt, Mycobacterium bovis subsp bovis AF2122/97
ccucgaugaccg

SEQ ID NO: 3049672 - RNA, 21 nt, Mycobacterium bovis subsp bovis AF2122/97
ccucgaugaggcgcagcgcca

SEQ ID NO: 3049673 - RNA, 22 nt, Mycobacterium bovis subsp bovis AF2122/97
ccucgaugaggcgcagcgccag

SEQ ID NO: 3049674 - RNA, 15 nt, Mycobacterium bovis subsp bovis AF2122/97
ccucgaugccgcccg

SEQ ID NO: 3049675 - RNA, 14 nt, Mycobacterium bovis subsp bovis AF2122/97
ccucgaugccgcgu

SEQ ID NO: 3049676 - RNA, 15 nt, Mycobacterium bovis subsp bovis AF2122/97
ccucgaugcgggcgc

SEQ ID NO: 3049677 - RNA, 16 nt, Mycobacterium bovis subsp bovis AF2122/97
ccucgaugcgggcgcc

SEQ ID NO: 3049678 - RNA, 13 nt, Mycobacterium bovis subsp bovis AF2122/97
ccucgauggccag

SEQ ID NO: 3049679 - RNA, 17 nt, Mycobacterium bovis subsp bovis AF2122/97
ccucgauggccuugucc

SEQ ID NO: 3049680 - RNA, 15 nt, Mycobacterium bovis subsp bovis AF2122/97
ccucgauggcggugg

SEQ ID NO: 3049681 - RNA, 19 nt, Mycobacterium bovis subsp bovis AF2122/97
ccucgaugucgcggucgcc

SEQ ID NO: 3049682 - RNA, 15 nt, Mycobacterium bovis subsp bovis AF2122/97
ccucgcaaccggcgu

SEQ ID NO: 3049683 - RNA, 20 nt, Mycobacterium bovis subsp bovis AF2122/97
ccucgcacaauggcggcgcc

SEQ ID NO: 3049684 - RNA, 22 nt, Mycobacterium bovis subsp bovis AF2122/97
ccucgcacaauggcggcgccgu

SEQ ID NO: 3049685 - RNA, 18 nt, Mycobacterium bovis subsp bovis AF2122/97
ccucgccccaccggccga

SEQ ID NO: 3049686 - RNA, 13 nt, Mycobacterium bovis subsp bovis AF2122/97
ccucgcccgcacc

SEQ ID NO: 3049687 - RNA, 12 nt, Mycobacterium bovis subsp bovis AF2122/97
ccucgcccuccc

SEQ ID NO: 3049688 - RNA, 15 nt, Mycobacterium bovis subsp bovis AF2122/97
ccucgcccuggccgc

SEQ ID NO: 3049689 - RNA, 15 nt, Mycobacterium bovis subsp bovis AF2122/97
ccucgccgcgcguga

SEQ ID NO: 3049690 - RNA, 16 nt, Mycobacterium bovis subsp bovis AF2122/97
ccucgccggacgggug

SEQ ID NO: 3049691 - RNA, 14 nt, Mycobacterium bovis subsp bovis AF2122/97
ccucgccggccacc

SEQ ID NO: 3049692 - RNA, 17 nt, Mycobacterium bovis subsp bovis AF2122/97
ccucgccggccaccagc

SEQ ID NO: 3049693 - RNA, 19 nt, Mycobacterium bovis subsp bovis AF2122/97
ccucgccggcgcgcagccg

SEQ ID NO: 3049694 - RNA, 23 nt, Mycobacterium bovis subsp bovis AF2122/97
ccucgccggcgcgcagccgggcc

SEQ ID NO: 3049695 - RNA, 19 nt, Mycobacterium bovis subsp bovis AF2122/97
ccucgccggucagcgugca

SEQ ID NO: 3049696 - RNA, 14 nt, Mycobacterium bovis subsp bovis AF2122/97
ccucgccggugacg

SEQ ID NO: 3049697 - RNA, 23 nt, Mycobacterium bovis subsp bovis AF2122/97
ccucgccugcccgaaccaccacc

SEQ ID NO: 3049698 - RNA, 16 nt, Mycobacterium bovis subsp bovis AF2122/97
ccucgcgaaaccgccg

SEQ ID NO: 3049699 - RNA, 22 nt, Mycobacterium bovis subsp bovis AF2122/97
ccucgcgaaauaacggagcggc

SEQ ID NO: 3049700 - RNA, 15 nt, Mycobacterium bovis subsp bovis AF2122/97
ccucgcgagucggcg

SEQ ID NO: 3049701 - RNA, 19 nt, Mycobacterium bovis subsp bovis AF2122/97
ccucgcgcaccggcuggcc

SEQ ID NO: 3049702 - RNA, 19 nt, Mycobacterium bovis subsp bovis AF2122/97
ccucgcggagccgucgcau

SEQ ID NO: 3049703 - RNA, 20 nt, Mycobacterium bovis subsp bovis AF2122/97
ccucgcggaugagcucggcc

SEQ ID NO: 3049704 - RNA, 22 nt, Mycobacterium bovis subsp bovis AF2122/97
ccucgcggaugagcucggccau

SEQ ID NO: 3049705 - RNA, 17 nt, Mycobacterium bovis subsp bovis AF2122/97
ccucgcgggaagucccg

SEQ ID NO: 3049706 - RNA, 17 nt, Mycobacterium bovis subsp bovis AF2122/97
ccucgcgggcgaucggc

SEQ ID NO: 3049707 - RNA, 13 nt, Mycobacterium bovis subsp bovis AF2122/97
ccucgcgggcggc

SEQ ID NO: 3049708 - RNA, 22 nt, Mycobacterium bovis subsp bovis AF2122/97
ccucgcgggcuuaugcacgacg

SEQ ID NO: 3049709 - RNA, 17 nt, Mycobacterium bovis subsp bovis AF2122/97
ccucgcuaacuccccag

SEQ ID NO: 3049710 - RNA, 17 nt, Mycobacterium bovis subsp bovis AF2122/97
ccucgcuaauugcggcc

SEQ ID NO: 3049711 - RNA, 19 nt, Mycobacterium bovis subsp bovis AF2122/97
ccucgcuaauugcggccgc

SEQ ID NO: 3049712 - RNA, 19 nt, Mycobacterium bovis subsp bovis AF2122/97
ccucgcucuccauggccga

SEQ ID NO: 3049713 - RNA, 20 nt, Mycobacterium bovis subsp bovis AF2122/97
ccucgcugcucagcaacggc

SEQ ID NO: 3049714 - RNA, 17 nt, Mycobacterium bovis subsp bovis AF2122/97
ccucggacacggcagcc

SEQ ID NO: 3049715 - RNA, 18 nt, Mycobacterium bovis subsp bovis AF2122/97
ccucggaccagacccacg

SEQ ID NO: 3049716 - RNA, 15 nt, Mycobacterium bovis subsp bovis AF2122/97
ccucggacugcagcg

SEQ ID NO: 3049717 - RNA, 18 nt, Mycobacterium bovis subsp bovis AF2122/97
ccucggacugcagcgcgg

SEQ ID NO: 3049718 - RNA, 19 nt, Mycobacterium bovis subsp bovis AF2122/97
ccucggacugcagcgcggc

SEQ ID NO: 3049719 - RNA, 20 nt, Mycobacterium bovis subsp bovis AF2122/97
ccucggagaucgagaucacc

SEQ ID NO: 3049720 - RNA, 17 nt, Mycobacterium bovis subsp bovis AF2122/97
ccucgucgaucgccgcg

SEQ ID NO: 3049721 - RNA, 15 nt, Mycobacterium bovis subsp bovis AF2122/97
ccucgucgauguucg

SEQ ID NO: 3049722 - RNA, 16 nt, Mycobacterium bovis subsp bovis AF2122/97
ccucgucgauguucgc

SEQ ID NO: 3049723 - RNA, 20 nt, Mycobacterium bovis subsp bovis AF2122/97
ccucgucgauguucgccgcg

SEQ ID NO: 3049724 - RNA, 15 nt, Mycobacterium bovis subsp bovis AF2122/97
ccucgucgccuagcc

SEQ ID NO: 3049725 - RNA, 22 nt, Mycobacterium bovis subsp bovis AF2122/97
ccucgucgccuagccgcuccgc

SEQ ID NO: 3049726 - RNA, 18 nt, Mycobacterium bovis subsp bovis AF2122/97
ccucgucgcgggccaccg

SEQ ID NO: 3049727 - RNA, 22 nt, Mycobacterium bovis subsp bovis AF2122/97
ccucgucgcgggccaccgcugu

SEQ ID NO: 3049728 - RNA, 14 nt, Mycobacterium bovis subsp bovis AF2122/97
ccucgucgcgucgc

SEQ ID NO: 3049729 - RNA, 20 nt, Mycobacterium bovis subsp bovis AF2122/97
ccucgucgcucccgguuggg

SEQ ID NO: 3049730 - RNA, 15 nt, Mycobacterium bovis subsp bovis AF2122/97
ccucgucggccgaca

SEQ ID NO: 3049731 - RNA, 23 nt, Mycobacterium bovis subsp bovis AF2122/97
ccucgucggccgacaccgccacc

SEQ ID NO: 3049732 - RNA, 22 nt, Mycobacterium bovis subsp bovis AF2122/97
ccucgucgggaucggcguccau

SEQ ID NO: 3049733 - RNA, 19 nt, Mycobacterium bovis subsp bovis AF2122/97
ccucgucggucacgugguc

SEQ ID NO: 3049734 - RNA, 22 nt, Mycobacterium bovis subsp bovis AF2122/97
ccucgucggugugccagugcug

SEQ ID NO: 3049735 - RNA, 18 nt, Mycobacterium bovis subsp bovis AF2122/97
ccucgucguaccguucgg

SEQ ID NO: 3049736 - RNA, 14 nt, Mycobacterium bovis subsp bovis AF2122/97
ccucgucgucgagg

SEQ ID NO: 3049737 - RNA, 19 nt, Mycobacterium bovis subsp bovis AF2122/97
ccucgugaguugacggugg

SEQ ID NO: 3049738 - RNA, 14 nt, Mycobacterium bovis subsp bovis AF2122/97
ccucgugcgcaucg

SEQ ID NO: 3049739 - RNA, 21 nt, Mycobacterium bovis subsp bovis AF2122/97
ccucgugcgugggcgcggcgc

SEQ ID NO: 3049740 - RNA, 22 nt, Mycobacterium bovis subsp bovis AF2122/97
ccucgugcgugggcgcggcgcc

SEQ ID NO: 3049741 - RNA, 22 nt, Mycobacterium bovis subsp bovis AF2122/97
ccucguuaucgaccgccgcgag

SEQ ID NO: 3049742 - RNA, 17 nt, Mycobacterium bovis subsp bovis AF2122/97
ccucguugaccagaacc

SEQ ID NO: 3049743 - RNA, 21 nt, Mycobacterium bovis subsp bovis AF2122/97
ccucguugaccagaaccugga

SEQ ID NO: 3049744 - RNA, 15 nt, Mycobacterium bovis subsp bovis AF2122/97
ccucguugaccgggu

SEQ ID NO: 3049745 - RNA, 17 nt, Mycobacterium bovis subsp bovis AF2122/97
ccucguugcugccggcg

SEQ ID NO: 3049746 - RNA, 21 nt, Mycobacterium bovis subsp bovis AF2122/97
ccucuagcuugacaacccugu

SEQ ID NO: 3049747 - RNA, 23 nt, Mycobacterium bovis subsp bovis AF2122/97
ccucucagcacgguuguuguaga

SEQ ID NO: 3049748 - RNA, 14 nt, Mycobacterium bovis subsp bovis AF2122/97
ccucucgggggccg

SEQ ID NO: 3049749 - RNA, 21 nt, Mycobacterium bovis subsp bovis AF2122/97
ccucucuucccaaccgcccgu

SEQ ID NO: 3049750 - RNA, 20 nt, Mycobacterium bovis subsp bovis AF2122/97
ccucugcugagcugcucgcc

SEQ ID NO: 3049751 - RNA, 14 nt, Mycobacterium bovis subsp bovis AF2122/97
ccucugguggcgcu

SEQ ID NO: 3049752 - RNA, 20 nt, Mycobacterium bovis subsp bovis AF2122/97
ccucugguggcgcugaagcc

SEQ ID NO: 3049753 - RNA, 14 nt, Mycobacterium bovis subsp bovis AF2122/97
ccucugucuucagc

SEQ ID NO: 3049754 - RNA, 18 nt, Mycobacterium bovis subsp bovis AF2122/97
ccucugucuucagcugcg

SEQ ID NO: 3049755 - RNA, 15 nt, Mycobacterium bovis subsp bovis AF2122/97
ccucuucggagguga

SEQ ID NO: 3049756 - RNA, 17 nt, Mycobacterium bovis subsp bovis AF2122/97
ccucuucgggcagcgcg

SEQ ID NO: 3049757 - RNA, 17 nt, Mycobacterium bovis subsp bovis AF2122/97
ccucuucgggugcagcc

SEQ ID NO: 3049758 - RNA, 16 nt, Mycobacterium bovis subsp bovis AF2122/97
ccugaaacggcugcag

SEQ ID NO: 3049759 - RNA, 14 nt, Mycobacterium bovis subsp bovis AF2122/97
ccugaaccggccgc

SEQ ID NO: 3049760 - RNA, 15 nt, Mycobacterium bovis subsp bovis AF2122/97
ccugaaccggccgcg

SEQ ID NO: 3049761 - RNA, 17 nt, Mycobacterium bovis subsp bovis AF2122/97
ccugaagccgcgcugcg

SEQ ID NO: 3049762 - RNA, 20 nt, Mycobacterium bovis subsp bovis AF2122/97
ccugaagccgcgcugcgacu

SEQ ID NO: 3049763 - RNA, 13 nt, Mycobacterium bovis subsp bovis AF2122/97
ccugaaggccagc

SEQ ID NO: 3049764 - RNA, 14 nt, Mycobacterium bovis subsp bovis AF2122/97
ccugaagggccgcc

SEQ ID NO: 3049765 - RNA, 18 nt, Mycobacterium bovis subsp bovis AF2122/97
ccugaaucaccggagcgc

SEQ ID NO: 3049766 - RNA, 22 nt, Mycobacterium bovis subsp bovis AF2122/97
ccugaaucaccggagcgccgag

SEQ ID NO: 3049767 - RNA, 18 nt, Mycobacterium bovis subsp bovis AF2122/97
ccugaaucgguucggcca

SEQ ID NO: 3049768 - RNA, 15 nt, Mycobacterium bovis subsp bovis AF2122/97
ccugacacaacaccg

SEQ ID NO: 3049769 - RNA, 14 nt, Mycobacterium bovis subsp bovis AF2122/97
ccugacacgcccgc

SEQ ID NO: 3049770 - RNA, 17 nt, Mycobacterium bovis subsp bovis AF2122/97
ccugacacgcccgcgag

SEQ ID NO: 3049771 - RNA, 11 nt, Mycobacterium bovis subsp bovis AF2122/97
ccugacccgga

SEQ ID NO: 3049772 - RNA, 15 nt, Mycobacterium bovis subsp bovis AF2122/97
ccugacccggagccg

SEQ ID NO: 3049773 - RNA, 18 nt, Mycobacterium bovis subsp bovis AF2122/97
ccugaccgaagucugcag

SEQ ID NO: 3049774 - RNA, 16 nt, Mycobacterium bovis subsp bovis AF2122/97
ccugaccggcucgccg

SEQ ID NO: 3049775 - RNA, 18 nt, Mycobacterium bovis subsp bovis AF2122/97
ccugaccggcucgccggc

SEQ ID NO: 3049776 - RNA, 22 nt, Mycobacterium bovis subsp bovis AF2122/97
ccugaccggcucgccggcgcgc

SEQ ID NO: 3049777 - RNA, 23 nt, Mycobacterium bovis subsp bovis AF2122/97
ccugaccggcucgccggcgcgca

SEQ ID NO: 3049778 - RNA, 18 nt, Mycobacterium bovis subsp bovis AF2122/97
ccugaccggucacccgug

SEQ ID NO: 3049779 - RNA, 23 nt, Mycobacterium bovis subsp bovis AF2122/97
ccugaccgguggccaucgcgcgg

SEQ ID NO: 3049780 - RNA, 16 nt, Mycobacterium bovis subsp bovis AF2122/97
ccugacgaucauugca

SEQ ID NO: 3049781 - RNA, 19 nt, Mycobacterium bovis subsp bovis AF2122/97
ccugacgaucauugcaccc

SEQ ID NO: 3049782 - RNA, 21 nt, Mycobacterium bovis subsp bovis AF2122/97
ccugacgaucauugcacccac

SEQ ID NO: 3049783 - RNA, 17 nt, Mycobacterium bovis subsp bovis AF2122/97
ccugacgccauucaucg

SEQ ID NO: 3049784 - RNA, 16 nt, Mycobacterium bovis subsp bovis AF2122/97
ccugacgccccgccac

SEQ ID NO: 3049785 - RNA, 23 nt, Mycobacterium bovis subsp bovis AF2122/97
ccugacgccccgccacaauggac

SEQ ID NO: 3049786 - RNA, 13 nt, Mycobacterium bovis subsp bovis AF2122/97
ccugacgcgucag

SEQ ID NO: 3049787 - RNA, 13 nt, Mycobacterium bovis subsp bovis AF2122/97
ccugacgcucggu

SEQ ID NO: 3049788 - RNA, 23 nt, Mycobacterium bovis subsp bovis AF2122/97
ccugacgguaaaugucgaacagg

SEQ ID NO: 3049789 - RNA, 19 nt, Mycobacterium bovis subsp bovis AF2122/97
ccugacgguacagcuccac

SEQ ID NO: 3049790 - RNA, 19 nt, Mycobacterium bovis subsp bovis AF2122/97
ccugacgugcggcgcggcg

SEQ ID NO: 3049791 - RNA, 21 nt, Mycobacterium bovis subsp bovis AF2122/97
ccugacgugcggcgcggcgac

SEQ ID NO: 3049792 - RNA, 19 nt, Mycobacterium bovis subsp bovis AF2122/97
ccugacuuuugucacugcg

SEQ ID NO: 3049793 - RNA, 19 nt, Mycobacterium bovis subsp bovis AF2122/97
ccugagaacacguucggcg

SEQ ID NO: 3049794 - RNA, 15 nt, Mycobacterium bovis subsp bovis AF2122/97
ccugagaugcggcca

SEQ ID NO: 3049795 - RNA, 21 nt, Mycobacterium bovis subsp bovis AF2122/97
ccugagcacguucaccgcgcg

SEQ ID NO: 3049796 - RNA, 14 nt, Mycobacterium bovis subsp bovis AF2122/97
ccugagccaccaac

SEQ ID NO: 3049797 - RNA, 20 nt, Mycobacterium bovis subsp bovis AF2122/97
ccugagccaccaacaccgcg

SEQ ID NO: 3049798 - RNA, 15 nt, Mycobacterium bovis subsp bovis AF2122/97
ccugagccucagugc

SEQ ID NO: 3049799 - RNA, 22 nt, Mycobacterium bovis subsp bovis AF2122/97
ccugagccucagugcgcacggu

SEQ ID NO: 3049800 - RNA, 17 nt, Mycobacterium bovis subsp bovis AF2122/97
ccugagcgccgcggcgg

SEQ ID NO: 3049801 - RNA, 12 nt, Mycobacterium bovis subsp bovis AF2122/97
ccugagcggcca

SEQ ID NO: 3049802 - RNA, 13 nt, Mycobacterium bovis subsp bovis AF2122/97
ccugagcggccau

SEQ ID NO: 3049803 - RNA, 14 nt, Mycobacterium bovis subsp bovis AF2122/97
ccugagcggccauc

SEQ ID NO: 3049804 - RNA, 16 nt, Mycobacterium bovis subsp bovis AF2122/97
ccugagcucccgccgg

SEQ ID NO: 3049805 - RNA, 16 nt, Mycobacterium bovis subsp bovis AF2122/97
ccugaggcaccucggc

SEQ ID NO: 3049806 - RNA, 22 nt, Mycobacterium bovis subsp bovis AF2122/97
ccugccgaucccgugguggcgc

SEQ ID NO: 3049807 - RNA, 13 nt, Mycobacterium bovis subsp bovis AF2122/97
ccugccgaucggg

SEQ ID NO: 3049808 - RNA, 22 nt, Mycobacterium bovis subsp bovis AF2122/97
ccugccgaugacgauggccgcc

SEQ ID NO: 3049809 - RNA, 19 nt, Mycobacterium bovis subsp bovis AF2122/97
ccugccgcacgggcccagg

SEQ ID NO: 3049810 - RNA, 13 nt, Mycobacterium bovis subsp bovis AF2122/97
ccugccgccggcc

SEQ ID NO: 3049811 - RNA, 16 nt, Mycobacterium bovis subsp bovis AF2122/97
ccugccgccggccccg

SEQ ID NO: 3049812 - RNA, 15 nt, Mycobacterium bovis subsp bovis AF2122/97
ccugccggcagcggc

SEQ ID NO: 3049813 - RNA, 12 nt, Mycobacterium bovis subsp bovis AF2122/97
ccugccgggcca

SEQ ID NO: 3049814 - RNA, 13 nt, Mycobacterium bovis subsp bovis AF2122/97
ccugccguuccgg

SEQ ID NO: 3049815 - RNA, 15 nt, Mycobacterium bovis subsp bovis AF2122/97
ccugccucaccgccg

SEQ ID NO: 3049816 - RNA, 17 nt, Mycobacterium bovis subsp bovis AF2122/97
ccugccucaccgccgcu

SEQ ID NO: 3049817 - RNA, 17 nt, Mycobacterium bovis subsp bovis AF2122/97
ccugcgaaacgcuggcc

SEQ ID NO: 3049818 - RNA, 19 nt, Mycobacterium bovis subsp bovis AF2122/97
ccugcgaaacgcuggccac

SEQ ID NO: 3049819 - RNA, 23 nt, Mycobacterium bovis subsp bovis AF2122/97
ccugcgaaacgcuggccacucac

SEQ ID NO: 3049820 - RNA, 17 nt, Mycobacterium bovis subsp bovis AF2122/97
ccugcgaagucgcaugg

SEQ ID NO: 3049821 - RNA, 21 nt, Mycobacterium bovis subsp bovis AF2122/97
ccugcgaagucgcauggcggc

SEQ ID NO: 3049822 - RNA, 17 nt, Mycobacterium bovis subsp bovis AF2122/97
ccugcgaauagccacca

SEQ ID NO: 3049823 - RNA, 14 nt, Mycobacterium bovis subsp bovis AF2122/97
ccugcgaccaggcg

SEQ ID NO: 3049824 - RNA, 18 nt, Mycobacterium bovis subsp bovis AF2122/97
ccugcgaccaggcgcggc

SEQ ID NO: 3049825 - RNA, 19 nt, Mycobacterium bovis subsp bovis AF2122/97
ccugcgaccaggcgcggcg

SEQ ID NO: 3049826 - RNA, 15 nt, Mycobacterium bovis subsp bovis AF2122/97
ccugcgacgagccca

SEQ ID NO: 3049827 - RNA, 23 nt, Mycobacterium bovis subsp bovis AF2122/97
ccugcgacuaagggcacuccacc

SEQ ID NO: 3049828 - RNA, 20 nt, Mycobacterium bovis subsp bovis AF2122/97
ccugcgagacuuggugaucc

SEQ ID NO: 3049829 - RNA, 17 nt, Mycobacterium bovis subsp bovis AF2122/97
ccugcgaggugccgggg

SEQ ID NO: 3049830 - RNA, 15 nt, Mycobacterium bovis subsp bovis AF2122/97
ccugcgagucgcgcu

SEQ ID NO: 3049831 - RNA, 18 nt, Mycobacterium bovis subsp bovis AF2122/97
ccugcgcaucaccacugg

SEQ ID NO: 3049832 - RNA, 16 nt, Mycobacterium bovis subsp bovis AF2122/97
ccugcgccacaauggc

SEQ ID NO: 3049833 - RNA, 13 nt, Mycobacterium bovis subsp bovis AF2122/97
ccugcgccacacc

SEQ ID NO: 3049834 - RNA, 19 nt, Mycobacterium bovis subsp bovis AF2122/97
ccugcgccacacccggcac

SEQ ID NO: 3049835 - RNA, 13 nt, Mycobacterium bovis subsp bovis AF2122/97
ccugcgccgaccc

SEQ ID NO: 3049836 - RNA, 19 nt, Mycobacterium bovis subsp bovis AF2122/97
ccugcgccgacccgcgcgc

SEQ ID NO: 3049837 - RNA, 22 nt, Mycobacterium bovis subsp bovis AF2122/97
ccugcgccgacccgcgcgccgg

SEQ ID NO: 3049838 - RNA, 15 nt, Mycobacterium bovis subsp bovis AF2122/97
ccugcgccgaguugu

SEQ ID NO: 3049839 - RNA, 19 nt, Mycobacterium bovis subsp bovis AF2122/97
ccugcgccgcacgccgacc

SEQ ID NO: 3049840 - RNA, 17 nt, Mycobacterium bovis subsp bovis AF2122/97
ccugcgccgccacagca

SEQ ID NO: 3049841 - RNA, 17 nt, Mycobacterium bovis subsp bovis AF2122/97
ccugcgccgccagcgcc

SEQ ID NO: 3049842 - RNA, 18 nt, Mycobacterium bovis subsp bovis AF2122/97
ccugcgccgccagcgccg

SEQ ID NO: 3049843 - RNA, 20 nt, Mycobacterium bovis subsp bovis AF2122/97
ccugcgccgccagcgccgcc

SEQ ID NO: 3049844 - RNA, 13 nt, Mycobacterium bovis subsp bovis AF2122/97
ccugcgccgcgcg

SEQ ID NO: 3049845 - RNA, 20 nt, Mycobacterium bovis subsp bovis AF2122/97
ccugcgccuuggucgccggc

SEQ ID NO: 3049846 - RNA, 18 nt, Mycobacterium bovis subsp bovis AF2122/97
ccugcgcgaccgaccagc

SEQ ID NO: 3049847 - RNA, 13 nt, Mycobacterium bovis subsp bovis AF2122/97
ccugcgcgacggc

SEQ ID NO: 3049848 - RNA, 19 nt, Mycobacterium bovis subsp bovis AF2122/97
ccugcgcgacggcgcugug

SEQ ID NO: 3049849 - RNA, 15 nt, Mycobacterium bovis subsp bovis AF2122/97
ccugcgcgcggccgc

SEQ ID NO: 3049850 - RNA, 18 nt, Mycobacterium bovis subsp bovis AF2122/97
ccugcgcgcggccgcgcu

SEQ ID NO: 3049851 - RNA, 13 nt, Mycobacterium bovis subsp bovis AF2122/97
ccugcgcggccac

SEQ ID NO: 3049852 - RNA, 24 nt, Mycobacterium bovis subsp bovis AF2122/97
ccugcgcggcgaucgcuccgcggc

SEQ ID NO: 3049853 - RNA, 23 nt, Mycobacterium bovis subsp bovis AF2122/97
ccugcgcggcugccgucuccugg

SEQ ID NO: 3049854 - RNA, 13 nt, Mycobacterium bovis subsp bovis AF2122/97
ccugcgcugcagc

SEQ ID NO: 3049855 - RNA, 17 nt, Mycobacterium bovis subsp bovis AF2122/97
ccugcgcuguucggcac

SEQ ID NO: 3049856 - RNA, 16 nt, Mycobacterium bovis subsp bovis AF2122/97
ccugcggcaacggcuc

SEQ ID NO: 3049857 - RNA, 15 nt, Mycobacterium bovis subsp bovis AF2122/97
ccugcggcaccgcug

SEQ ID NO: 3049858 - RNA, 20 nt, Mycobacterium bovis subsp bovis AF2122/97
ccugcggcaccgcugaggaa

SEQ ID NO: 3049859 - RNA, 20 nt, Mycobacterium bovis subsp bovis AF2122/97
ccugcggcaccucauugccg

SEQ ID NO: 3049860 - RNA, 14 nt, Mycobacterium bovis subsp bovis AF2122/97
ccugcggccacggu

SEQ ID NO: 3049861 - RNA, 16 nt, Mycobacterium bovis subsp bovis AF2122/97
ccugcgggaacgcggc

SEQ ID NO: 3049862 - RNA, 22 nt, Mycobacterium bovis subsp bovis AF2122/97
ccugcgggaacgcggcggcgaa

SEQ ID NO: 3049863 - RNA, 14 nt, Mycobacterium bovis subsp bovis AF2122/97
ccugcgggaaguug

SEQ ID NO: 3049864 - RNA, 23 nt, Mycobacterium bovis subsp bovis AF2122/97
ccugcgggaaguugcccagguga

SEQ ID NO: 3049865 - RNA, 17 nt, Mycobacterium bovis subsp bovis AF2122/97
ccugcgggacuggcuga

SEQ ID NO: 3049866 - RNA, 19 nt, Mycobacterium bovis subsp bovis AF2122/97
ccugcgggaucgccgagac

SEQ ID NO: 3049867 - RNA, 22 nt, Mycobacterium bovis subsp bovis AF2122/97
ccugcgggccgagaucacgccg

SEQ ID NO: 3049868 - RNA, 19 nt, Mycobacterium bovis subsp bovis AF2122/97
ccugcgggccggcaucguc

SEQ ID NO: 3049869 - RNA, 21 nt, Mycobacterium bovis subsp bovis AF2122/97
ccugcggguaggugacgacgu

SEQ ID NO: 3049870 - RNA, 22 nt, Mycobacterium bovis subsp bovis AF2122/97
ccugcggguaggugacgacguc

SEQ ID NO: 3049871 - RNA, 16 nt, Mycobacterium bovis subsp bovis AF2122/97
ccugcgggugcgucga

SEQ ID NO: 3049872 - RNA, 22 nt, Mycobacterium bovis subsp bovis AF2122/97
ccugcgggugcgucgaugagca

SEQ ID NO: 3049873 - RNA, 16 nt, Mycobacterium bovis subsp bovis AF2122/97
ccugcgguccgcugcc

SEQ ID NO: 3049874 - RNA, 18 nt, Mycobacterium bovis subsp bovis AF2122/97
ccugcgucgaaauccaca

SEQ ID NO: 3049875 - RNA, 15 nt, Mycobacterium bovis subsp bovis AF2122/97
ccugcguggagcgcu

SEQ ID NO: 3049876 - RNA, 20 nt, Mycobacterium bovis subsp bovis AF2122/97
ccugcucgaaaucgcacagc

SEQ ID NO: 3049877 - RNA, 18 nt, Mycobacterium bovis subsp bovis AF2122/97
ccugcucgcacagcacca

SEQ ID NO: 3049878 - RNA, 19 nt, Mycobacterium bovis subsp bovis AF2122/97
ccugcucgcagcgggcgaa

SEQ ID NO: 3049879 - RNA, 15 nt, Mycobacterium bovis subsp bovis AF2122/97
ccugcucgcugguga

SEQ ID NO: 3049880 - RNA, 19 nt, Mycobacterium bovis subsp bovis AF2122/97
ccugcucggcgaccgucgg

SEQ ID NO: 3049881 - RNA, 21 nt, Mycobacterium bovis subsp bovis AF2122/97
ccugcucggcgcgccggucgc

SEQ ID NO: 3049882 - RNA, 19 nt, Mycobacterium bovis subsp bovis AF2122/97
ccugcucgggggccgacca

SEQ ID NO: 3049883 - RNA, 17 nt, Mycobacterium bovis subsp bovis AF2122/97
ccugcucgucggccacc

SEQ ID NO: 3049884 - RNA, 16 nt, Mycobacterium bovis subsp bovis AF2122/97
ccugcugcacaucgca

SEQ ID NO: 3049885 - RNA, 19 nt, Mycobacterium bovis subsp bovis AF2122/97
ccugcugcagaaaggccaa

SEQ ID NO: 3049886 - RNA, 21 nt, Mycobacterium bovis subsp bovis AF2122/97
ccugcugcagggccuggccac

SEQ ID NO: 3049887 - RNA, 15 nt, Mycobacterium bovis subsp bovis AF2122/97
ccugcuggaucucgg

SEQ ID NO: 3049888 - RNA, 17 nt, Mycobacterium bovis subsp bovis AF2122/97
ccugcuggcccaacauc

SEQ ID NO: 3049889 - RNA, 21 nt, Mycobacterium bovis subsp bovis AF2122/97
ccugcuggcccaacaucaacg

SEQ ID NO: 3049890 - RNA, 19 nt, Mycobacterium bovis subsp bovis AF2122/97
ccugcuggcccugcuccuc

SEQ ID NO: 3049891 - RNA, 14 nt, Mycobacterium bovis subsp bovis AF2122/97
ccugcuggccgcgg

SEQ ID NO: 3049892 - RNA, 17 nt, Mycobacterium bovis subsp bovis AF2122/97
ccugcuggugucggcuc

SEQ ID NO: 3049893 - RNA, 14 nt, Mycobacterium bovis subsp bovis AF2122/97
ccugcuugcaggcg

SEQ ID NO: 3049894 - RNA, 13 nt, Mycobacterium bovis subsp bovis AF2122/97
ccugcuuguccgu

SEQ ID NO: 3049895 - RNA, 12 nt, Mycobacterium bovis subsp bovis AF2122/97
ccugcuuuccag

SEQ ID NO: 3049896 - RNA, 22 nt, Mycobacterium bovis subsp bovis AF2122/97
ccuggaaaggacggccggccgc

SEQ ID NO: 3049897 - RNA, 16 nt, Mycobacterium bovis subsp bovis AF2122/97
ccuggaaagggccgcc

SEQ ID NO: 3049898 - RNA, 23 nt, Mycobacterium bovis subsp bovis AF2122/97
ccuggaaagggccgccgcuggug

SEQ ID NO: 3049899 - RNA, 20 nt, Mycobacterium bovis subsp bovis AF2122/97
ccuggaagacggugcgggcu

SEQ ID NO: 3049900 - RNA, 23 nt, Mycobacterium bovis subsp bovis AF2122/97
ccuggaaguacacggcggcccgc

SEQ ID NO: 3049901 - RNA, 16 nt, Mycobacterium bovis subsp bovis AF2122/97
ccuggaauccaggagc

SEQ ID NO: 3049902 - RNA, 15 nt, Mycobacterium bovis subsp bovis AF2122/97
ccuggaaugccgcca

SEQ ID NO: 3049903 - RNA, 18 nt, Mycobacterium bovis subsp bovis AF2122/97
ccuggacauaccggcccg

SEQ ID NO: 3049904 - RNA, 12 nt, Mycobacterium bovis subsp bovis AF2122/97
ccuggaccucgu

SEQ ID NO: 3049905 - RNA, 21 nt, Mycobacterium bovis subsp bovis AF2122/97
ccuggaccucguugcugccgg

SEQ ID NO: 3049906 - RNA, 22 nt, Mycobacterium bovis subsp bovis AF2122/97
ccuggaccucguugcugccggc

SEQ ID NO: 3049907 - RNA, 15 nt, Mycobacterium bovis subsp bovis AF2122/97
ccuggacgccgccgg

SEQ ID NO: 3049908 - RNA, 14 nt, Mycobacterium bovis subsp bovis AF2122/97
ccuggacgucggcg

SEQ ID NO: 3049909 - RNA, 16 nt, Mycobacterium bovis subsp bovis AF2122/97
ccuggacgucggcgau

SEQ ID NO: 3049910 - RNA, 13 nt, Mycobacterium bovis subsp bovis AF2122/97
ccuggaguccagc

SEQ ID NO: 3049911 - RNA, 21 nt, Mycobacterium bovis subsp bovis AF2122/97
ccuggaguccagcucgggcau

SEQ ID NO: 3049912 - RNA, 16 nt, Mycobacterium bovis subsp bovis AF2122/97
ccuggauccaccagau

SEQ ID NO: 3049913 - RNA, 13 nt, Mycobacterium bovis subsp bovis AF2122/97
ccuggauggcgcc

SEQ ID NO: 3049914 - RNA, 16 nt, Mycobacterium bovis subsp bovis AF2122/97
ccuggaugggcucgac

SEQ ID NO: 3049915 - RNA, 17 nt, Mycobacterium bovis subsp bovis AF2122/97
ccuggaugggcucgacg

SEQ ID NO: 3049916 - RNA, 16 nt, Mycobacterium bovis subsp bovis AF2122/97
ccuggauggguugacg

SEQ ID NO: 3049917 - RNA, 17 nt, Mycobacterium bovis subsp bovis AF2122/97
ccuggauggguugacgu

SEQ ID NO: 3049918 - RNA, 13 nt, Mycobacterium bovis subsp bovis AF2122/97
ccuggcacccggg

SEQ ID NO: 3049919 - RNA, 22 nt, Mycobacterium bovis subsp bovis AF2122/97
ccuggcacccggggugcccggc

SEQ ID NO: 3049920 - RNA, 23 nt, Mycobacterium bovis subsp bovis AF2122/97
ccuggcacccggggugcccggcc

SEQ ID NO: 3049921 - RNA, 19 nt, Mycobacterium bovis subsp bovis AF2122/97
ccuggcaccucgcccuccc

SEQ ID NO: 3049922 - RNA, 14 nt, Mycobacterium bovis subsp bovis AF2122/97
ccuggcagacgccc

SEQ ID NO: 3049923 - RNA, 18 nt, Mycobacterium bovis subsp bovis AF2122/97
ccuggccacacucagcac

SEQ ID NO: 3049924 - RNA, 17 nt, Mycobacterium bovis subsp bovis AF2122/97
ccuggccaccugguuua

SEQ ID NO: 3049925 - RNA, 16 nt, Mycobacterium bovis subsp bovis AF2122/97
ccuggccacucccagc

SEQ ID NO: 3049926 - RNA, 12 nt, Mycobacterium bovis subsp bovis AF2122/97
ccuggccaucga

SEQ ID NO: 3049927 - RNA, 19 nt, Mycobacterium bovis subsp bovis AF2122/97
ccuggcccccagguaaccc

SEQ ID NO: 3049928 - RNA, 12 nt, Mycobacterium bovis subsp bovis AF2122/97
ccuggccccggc

SEQ ID NO: 3049929 - RNA, 20 nt, Mycobacterium bovis subsp bovis AF2122/97
ccuggcccgauaaaugccgc

SEQ ID NO: 3049930 - RNA, 23 nt, Mycobacterium bovis subsp bovis AF2122/97
ccuggcccgccacgaugucgucg

SEQ ID NO: 3049931 - RNA, 18 nt, Mycobacterium bovis subsp bovis AF2122/97
ccuggccgcccuggccgc

SEQ ID NO: 3049932 - RNA, 19 nt, Mycobacterium bovis subsp bovis AF2122/97
ccuggccgcccuggccgcc

SEQ ID NO: 3049933 - RNA, 12 nt, Mycobacterium bovis subsp bovis AF2122/97
ccuggccgccgc

SEQ ID NO: 3049934 - RNA, 15 nt, Mycobacterium bovis subsp bovis AF2122/97
ccuggccgccgcagu

SEQ ID NO: 3049935 - RNA, 14 nt, Mycobacterium bovis subsp bovis AF2122/97
ccuggccgccgccc

SEQ ID NO: 3049936 - RNA, 15 nt, Mycobacterium bovis subsp bovis AF2122/97
ccuggccgccggccc

SEQ ID NO: 3049937 - RNA, 16 nt, Mycobacterium bovis subsp bovis AF2122/97
ccuggccgccggcccc

SEQ ID NO: 3049938 - RNA, 14 nt, Mycobacterium bovis subsp bovis AF2122/97
ccuggccgccggcg

SEQ ID NO: 3049939 - RNA, 16 nt, Mycobacterium bovis subsp bovis AF2122/97
ccuggccgcgccgggg

SEQ ID NO: 3049940 - RNA, 15 nt, Mycobacterium bovis subsp bovis AF2122/97
ccuggccgggaccgc

SEQ ID NO: 3049941 - RNA, 17 nt, Mycobacterium bovis subsp bovis AF2122/97
ccuggccgggaccgccc

SEQ ID NO: 3049942 - RNA, 22 nt, Mycobacterium bovis subsp bovis AF2122/97
ccuggccggugguagcggacag

SEQ ID NO: 3049943 - RNA, 17 nt, Mycobacterium bovis subsp bovis AF2122/97
ccuggccgucccaccag

SEQ ID NO: 3049944 - RNA, 18 nt, Mycobacterium bovis subsp bovis AF2122/97
ccuggccugcccagcacc

SEQ ID NO: 3049945 - RNA, 22 nt, Mycobacterium bovis subsp bovis AF2122/97
ccuggccugcccagcaccaccg

SEQ ID NO: 3049946 - RNA, 21 nt, Mycobacterium bovis subsp bovis AF2122/97
ccuggcgaacucgcgcaggaa

SEQ ID NO: 3049947 - RNA, 12 nt, Mycobacterium bovis subsp bovis AF2122/97
ccuggcgagcca

SEQ ID NO: 3049948 - RNA, 13 nt, Mycobacterium bovis subsp bovis AF2122/97
ccuggcggcccgg

SEQ ID NO: 3049949 - RNA, 16 nt, Mycobacterium bovis subsp bovis AF2122/97
ccuggcggcgccgcag

SEQ ID NO: 3049950 - RNA, 21 nt, Mycobacterium bovis subsp bovis AF2122/97
ccuggcggcgccgcagaucac

SEQ ID NO: 3049951 - RNA, 17 nt, Mycobacterium bovis subsp bovis AF2122/97
ccuggcggcugcagccg

SEQ ID NO: 3049952 - RNA, 12 nt, Mycobacterium bovis subsp bovis AF2122/97
ccuggcgggcgc

SEQ ID NO: 3049953 - RNA, 19 nt, Mycobacterium bovis subsp bovis AF2122/97
ccuggcgggcgccuugguc

SEQ ID NO: 3049954 - RNA, 20 nt, Mycobacterium bovis subsp bovis AF2122/97
ccuggcgggcgccuuggucg

SEQ ID NO: 3049955 - RNA, 13 nt, Mycobacterium bovis subsp bovis AF2122/97
ccuggcggucccg

SEQ ID NO: 3049956 - RNA, 21 nt, Mycobacterium bovis subsp bovis AF2122/97
ccuggcguagaucaucuggcu

SEQ ID NO: 3049957 - RNA, 17 nt, Mycobacterium bovis subsp bovis AF2122/97
ccuggcguagugcagcu

SEQ ID NO: 3049958 - RNA, 18 nt, Mycobacterium bovis subsp bovis AF2122/97
ccuggcguagugcagcug

SEQ ID NO: 3049959 - RNA, 14 nt, Mycobacterium bovis subsp bovis AF2122/97
ccuggcgugucgcc

SEQ ID NO: 3049960 - RNA, 15 nt, Mycobacterium bovis subsp bovis AF2122/97
ccuggcgugucgccg

SEQ ID NO: 3049961 - RNA, 17 nt, Mycobacterium bovis subsp bovis AF2122/97
ccuggcgugucgccgcc

SEQ ID NO: 3049962 - RNA, 18 nt, Mycobacterium bovis subsp bovis AF2122/97
ccuggcgugucgccgcca

SEQ ID NO: 3049963 - RNA, 19 nt, Mycobacterium bovis subsp bovis AF2122/97
ccuggcgugucgccgccac

SEQ ID NO: 3049964 - RNA, 17 nt, Mycobacterium bovis subsp bovis AF2122/97
ccuggcuacgcgcgccc

SEQ ID NO: 3049965 - RNA, 22 nt, Mycobacterium bovis subsp bovis AF2122/97
ccuggcuagcgccgaucuucgc

SEQ ID NO: 3049966 - RNA, 13 nt, Mycobacterium bovis subsp bovis AF2122/97
ccuggcucggcau

SEQ ID NO: 3049967 - RNA, 15 nt, Mycobacterium bovis subsp bovis AF2122/97
ccuggcuggucagga

SEQ ID NO: 3049968 - RNA, 14 nt, Mycobacterium bovis subsp bovis AF2122/97
ccugggaaugacgg

SEQ ID NO: 3049969 - RNA, 19 nt, Mycobacterium bovis subsp bovis AF2122/97
ccugggacggcggcagucg

SEQ ID NO: 3049970 - RNA, 13 nt, Mycobacterium bovis subsp bovis AF2122/97
ccugggagaucgg

SEQ ID NO: 3049971 - RNA, 21 nt, Mycobacterium bovis subsp bovis AF2122/97
ccugggauccggcggcaggua

SEQ ID NO: 3049972 - RNA, 17 nt, Mycobacterium bovis subsp bovis AF2122/97
ccugggccagccgcuca

SEQ ID NO: 3049973 - RNA, 18 nt, Mycobacterium bovis subsp bovis AF2122/97
ccugggccaucacgguca

SEQ ID NO: 3049974 - RNA, 13 nt, Mycobacterium bovis subsp bovis AF2122/97
ccugggccgccgc

SEQ ID NO: 3049975 - RNA, 16 nt, Mycobacterium bovis subsp bovis AF2122/97
ccugggccgccgcccu

SEQ ID NO: 3049976 - RNA, 17 nt, Mycobacterium bovis subsp bovis AF2122/97
ccugggcgacuaccggc

SEQ ID NO: 3049977 - RNA, 22 nt, Mycobacterium bovis subsp bovis AF2122/97
ccugggcgauauuggacgcgca

SEQ ID NO: 3049978 - RNA, 13 nt, Mycobacterium bovis subsp bovis AF2122/97
ccugggcgccggc

SEQ ID NO: 3049979 - RNA, 21 nt, Mycobacterium bovis subsp bovis AF2122/97
ccuuaugcgcggugaccgggu

SEQ ID NO: 3049980 - RNA, 13 nt, Mycobacterium bovis subsp bovis AF2122/97
ccuuauuggacug

SEQ ID NO: 3049981 - RNA, 18 nt, Mycobacterium bovis subsp bovis AF2122/97
ccuucaacuuacgcgacg

SEQ ID NO: 3049982 - RNA, 15 nt, Mycobacterium bovis subsp bovis AF2122/97
ccuucaccagcugcg

SEQ ID NO: 3049983 - RNA, 23 nt, Mycobacterium bovis subsp bovis AF2122/97
ccuucacgcuggccuccagcuug

SEQ ID NO: 3049984 - RNA, 22 nt, Mycobacterium bovis subsp bovis AF2122/97
ccuucagcacggugaucagcag

SEQ ID NO: 3049985 - RNA, 23 nt, Mycobacterium bovis subsp bovis AF2122/97
ccuucagcacggugaucagcagc

SEQ ID NO: 3049986 - RNA, 12 nt, Mycobacterium bovis subsp bovis AF2122/97
ccuucagccagu

SEQ ID NO: 3049987 - RNA, 19 nt, Mycobacterium bovis subsp bovis AF2122/97
ccuucagcgaagccggguc

SEQ ID NO: 3049988 - RNA, 14 nt, Mycobacterium bovis subsp bovis AF2122/97
ccuucagcggucgc

SEQ ID NO: 3049989 - RNA, 17 nt, Mycobacterium bovis subsp bovis AF2122/97
ccuucagcguccuggug

SEQ ID NO: 3049990 - RNA, 18 nt, Mycobacterium bovis subsp bovis AF2122/97
ccuucaguucgacggugc

SEQ ID NO: 3049991 - RNA, 15 nt, Mycobacterium bovis subsp bovis AF2122/97
ccuuccuggcgggcg

SEQ ID NO: 3049992 - RNA, 16 nt, Mycobacterium bovis subsp bovis AF2122/97
ccuuccuggcgggcgc

SEQ ID NO: 3049993 - RNA, 21 nt, Mycobacterium bovis subsp bovis AF2122/97
ccuucgaaacgguaaucgcga

SEQ ID NO: 3049994 - RNA, 17 nt, Mycobacterium bovis subsp bovis AF2122/97
ccuucgccagcggcgcg

SEQ ID NO: 3049995 - RNA, 14 nt, Mycobacterium bovis subsp bovis AF2122/97
ccuucgccggcgcc

SEQ ID NO: 3049996 - RNA, 23 nt, Mycobacterium bovis subsp bovis AF2122/97
ccuucgcgggagaacgugccgag

SEQ ID NO: 3049997 - RNA, 17 nt, Mycobacterium bovis subsp bovis AF2122/97
ccuucgcguuggcccgc

SEQ ID NO: 3049998 - RNA, 22 nt, Mycobacterium bovis subsp bovis AF2122/97
ccuucggcccaugcagcggcga

SEQ ID NO: 3049999 - RNA, 19 nt, Mycobacterium bovis subsp bovis AF2122/97
ccuucggccgaccgggcuc

SEQ ID NO: 3050000 - RNA, 13 nt, Mycobacterium bovis subsp bovis AF2122/97
ccuucggccggcg

SEQ ID NO: 3050001 - RNA, 19 nt, Mycobacterium bovis subsp bovis AF2122/97
ccuucggcgagcggugauu

SEQ ID NO: 3050002 - RNA, 12 nt, Mycobacterium bovis subsp bovis AF2122/97
ccuucggcggug

SEQ ID NO: 3050003 - RNA, 15 nt, Mycobacterium bovis subsp bovis AF2122/97
ccuucgggcuggucg

SEQ ID NO: 3050004 - RNA, 15 nt, Mycobacterium bovis subsp bovis AF2122/97
ccuucgggguaguug

SEQ ID NO: 3050005 - RNA, 22 nt, Mycobacterium bovis subsp bovis AF2122/97
ccuucggugccggaaacgccag

SEQ ID NO: 3050006 - RNA, 18 nt, Mycobacterium bovis subsp bovis AF2122/97
ccuucguagcggccgcag

SEQ ID NO: 3050007 - RNA, 17 nt, Mycobacterium bovis subsp bovis AF2122/97
ccuucgucacauugcca

SEQ ID NO: 3050008 - RNA, 20 nt, Mycobacterium bovis subsp bovis AF2122/97
ccuucgucgcggccgcggcc

SEQ ID NO: 3050009 - RNA, 21 nt, Mycobacterium bovis subsp bovis AF2122/97
ccuucuaccgaauaaaaguac

SEQ ID NO: 3050010 - RNA, 12 nt, Mycobacterium bovis subsp bovis AF2122/97
ccuucucacgca

SEQ ID NO: 3050011 - RNA, 22 nt, Mycobacterium bovis subsp bovis AF2122/97
ccuucuccaccgaaaaguccgc

SEQ ID NO: 3050012 - RNA, 19 nt, Mycobacterium bovis subsp bovis AF2122/97
ccuucuccagauccacgcc

SEQ ID NO: 3050013 - RNA, 21 nt, Mycobacterium bovis subsp bovis AF2122/97
ccuucuccaucgucggcaaca

SEQ ID NO: 3050014 - RNA, 13 nt, Mycobacterium bovis subsp bovis AF2122/97
ccuucucgccgcc

SEQ ID NO: 3050015 - RNA, 21 nt, Mycobacterium bovis subsp bovis AF2122/97
ccuucucguaacgcggcacca

SEQ ID NO: 3050016 - RNA, 18 nt, Mycobacterium bovis subsp bovis AF2122/97
ccuucugacuaucucgcu

SEQ ID NO: 3050017 - RNA, 23 nt, Mycobacterium bovis subsp bovis AF2122/97
ccuucugacuaucucgcucgacg

SEQ ID NO: 3050018 - RNA, 23 nt, Mycobacterium bovis subsp bovis AF2122/97
ccuucugccgggagacgcugcgc

SEQ ID NO: 3050019 - RNA, 15 nt, Mycobacterium bovis subsp bovis AF2122/97
ccuucugguccagca

SEQ ID NO: 3050020 - RNA, 20 nt, Mycobacterium bovis subsp bovis AF2122/97
ccuucuucgcuaccuucuug

SEQ ID NO: 3050021 - RNA, 11 nt, Mycobacterium bovis subsp bovis AF2122/97
ccuucuuggca

SEQ ID NO: 3050022 - RNA, 15 nt, Mycobacterium bovis subsp bovis AF2122/97
ccuucuuggcaggug

SEQ ID NO: 3050023 - RNA, 21 nt, Mycobacterium bovis subsp bovis AF2122/97
ccuucuuguuggucccgauca

SEQ ID NO: 3050024 - RNA, 23 nt, Mycobacterium bovis subsp bovis AF2122/97
ccuucuuguuggucccgaucacc

SEQ ID NO: 3050025 - RNA, 17 nt, Mycobacterium bovis subsp bovis AF2122/97
ccuucuuugccggcgcc

SEQ ID NO: 3050026 - RNA, 17 nt, Mycobacterium bovis subsp bovis AF2122/97
ccuugacagcuuucuug

SEQ ID NO: 3050027 - RNA, 23 nt, Mycobacterium bovis subsp bovis AF2122/97
ccuugacagcuuucuuggcgggc

SEQ ID NO: 3050028 - RNA, 15 nt, Mycobacterium bovis subsp bovis AF2122/97
ccuugaccacagcgg

SEQ ID NO: 3050029 - RNA, 21 nt, Mycobacterium bovis subsp bovis AF2122/97
ccuugaccacagcggagacga

SEQ ID NO: 3050030 - RNA, 13 nt, Mycobacterium bovis subsp bovis AF2122/97
ccuugacccgcaa

SEQ ID NO: 3050031 - RNA, 13 nt, Mycobacterium bovis subsp bovis AF2122/97
ccuugaccgcggu

SEQ ID NO: 3050032 - RNA, 18 nt, Mycobacterium bovis subsp bovis AF2122/97
ccuugaccgcugcccagu

SEQ ID NO: 3050033 - RNA, 14 nt, Mycobacterium bovis subsp bovis AF2122/97
ccuugaccgggucg

SEQ ID NO: 3050034 - RNA, 22 nt, Mycobacterium bovis subsp bovis AF2122/97
ccuugacgaucgagcugacgau

SEQ ID NO: 3050035 - RNA, 22 nt, Mycobacterium bovis subsp bovis AF2122/97
ccuugacgcgcaacgccgccag

SEQ ID NO: 3050036 - RNA, 14 nt, Mycobacterium bovis subsp bovis AF2122/97
ccuugacgcggcca

SEQ ID NO: 3050037 - RNA, 15 nt, Mycobacterium bovis subsp bovis AF2122/97
ccuugacgcggccac

SEQ ID NO: 3050038 - RNA, 19 nt, Mycobacterium bovis subsp bovis AF2122/97
ccuugacgcggccacauac

SEQ ID NO: 3050039 - RNA, 13 nt, Mycobacterium bovis subsp bovis AF2122/97
ccuugacggugag

SEQ ID NO: 3050040 - RNA, 16 nt, Mycobacterium bovis subsp bovis AF2122/97
ccuugagcaaaauggc

SEQ ID NO: 3050041 - RNA, 18 nt, Mycobacterium bovis subsp bovis AF2122/97
ccuugagcaaaccgcgca

SEQ ID NO: 3050042 - RNA, 14 nt, Mycobacterium bovis subsp bovis AF2122/97
ccuugaggucaccc

SEQ ID NO: 3050043 - RNA, 16 nt, Mycobacterium bovis subsp bovis AF2122/97
ccuugaggucacccau

SEQ ID NO: 3050044 - RNA, 19 nt, Mycobacterium bovis subsp bovis AF2122/97
ccuugaggucaucgggcag

SEQ ID NO: 3050045 - RNA, 20 nt, Mycobacterium bovis subsp bovis AF2122/97
ccuugaucaaggugucgacg

SEQ ID NO: 3050046 - RNA, 22 nt, Mycobacterium bovis subsp bovis AF2122/97
ccuugaucgagcagggugacca

SEQ ID NO: 3050047 - RNA, 13 nt, Mycobacterium bovis subsp bovis AF2122/97
ccuugaucggcac

SEQ ID NO: 3050048 - RNA, 14 nt, Mycobacterium bovis subsp bovis AF2122/97
ccuugaucggcgag

SEQ ID NO: 3050049 - RNA, 15 nt, Mycobacterium bovis subsp bovis AF2122/97
ccuugaucugagcgc

SEQ ID NO: 3050050 - RNA, 15 nt, Mycobacterium bovis subsp bovis AF2122/97
ccuugaugcggccgc

SEQ ID NO: 3050051 - RNA, 16 nt, Mycobacterium bovis subsp bovis AF2122/97
ccuugaugcggccgcg

SEQ ID NO: 3050052 - RNA, 13 nt, Mycobacterium bovis subsp bovis AF2122/97
ccuugauggucuc

SEQ ID NO: 3050053 - RNA, 18 nt, Mycobacterium bovis subsp bovis AF2122/97
ccuugauguccgcgacgg

SEQ ID NO: 3050054 - RNA, 15 nt, Mycobacterium bovis subsp bovis AF2122/97
ccuugauugccgcgu

SEQ ID NO: 3050055 - RNA, 11 nt, Mycobacterium bovis subsp bovis AF2122/97
ccuugcacaag

SEQ ID NO: 3050056 - RNA, 13 nt, Mycobacterium bovis subsp bovis AF2122/97
ccuugcacaagcu

SEQ ID NO: 3050057 - RNA, 21 nt, Mycobacterium bovis subsp bovis AF2122/97
ccuugcagcgcccccgcugcc

SEQ ID NO: 3050058 - RNA, 20 nt, Mycobacterium bovis subsp bovis AF2122/97
ccuugcagcgcguucggcac

SEQ ID NO: 3050059 - RNA, 19 nt, Mycobacterium bovis subsp bovis AF2122/97
ccuugccaaucgccgucag

SEQ ID NO: 3050060 - RNA, 21 nt, Mycobacterium bovis subsp bovis AF2122/97
ccuugccgaugacgaugcccu

SEQ ID NO: 3050061 - RNA, 17 nt, Mycobacterium bovis subsp bovis AF2122/97
ccuugccgccagcccca

SEQ ID NO: 3050062 - RNA, 14 nt, Mycobacterium bovis subsp bovis AF2122/97
ccuugccgcccgcu

SEQ ID NO: 3050063 - RNA, 23 nt, Mycobacterium bovis subsp bovis AF2122/97
ccuugccgcccgcuccgccgucg

SEQ ID NO: 3050064 - RNA, 21 nt, Mycobacterium bovis subsp bovis AF2122/97
ccuugccgccggccccgccgg

SEQ ID NO: 3050065 - RNA, 20 nt, Mycobacterium bovis subsp bovis AF2122/97
cgaaaacauguuccacccgg

SEQ ID NO: 3050066 - RNA, 18 nt, Mycobacterium bovis subsp bovis AF2122/97
cgaaaaccgucgcagaaa

SEQ ID NO: 3050067 - RNA, 17 nt, Mycobacterium bovis subsp bovis AF2122/97
cgaaaaccuccgggucc

SEQ ID NO: 3050068 - RNA, 21 nt, Mycobacterium bovis subsp bovis AF2122/97
cgaaaaccucgaaaccguggc

SEQ ID NO: 3050069 - RNA, 17 nt, Mycobacterium bovis subsp bovis AF2122/97
cgaaaacgacaucacca

SEQ ID NO: 3050070 - RNA, 21 nt, Mycobacterium bovis subsp bovis AF2122/97
cgaaaacgacaucaccaccgc

SEQ ID NO: 3050071 - RNA, 14 nt, Mycobacterium bovis subsp bovis AF2122/97
cgaaaacugacccc

SEQ ID NO: 3050072 - RNA, 22 nt, Mycobacterium bovis subsp bovis AF2122/97
cgaaaacugacccccugacggc

SEQ ID NO: 3050073 - RNA, 13 nt, Mycobacterium bovis subsp bovis AF2122/97
cgaaaagccgugc

SEQ ID NO: 3050074 - RNA, 22 nt, Mycobacterium bovis subsp bovis AF2122/97
cgaaaagccguucgcgucgccg

SEQ ID NO: 3050075 - RNA, 22 nt, Mycobacterium bovis subsp bovis AF2122/97
cgaaaagggcgacagcggcgac

SEQ ID NO: 3050076 - RNA, 18 nt, Mycobacterium bovis subsp bovis AF2122/97
cgaaaaguagaccgagcc

SEQ ID NO: 3050077 - RNA, 17 nt, Mycobacterium bovis subsp bovis AF2122/97
cgaaaaguccgccgccu

SEQ ID NO: 3050078 - RNA, 13 nt, Mycobacterium bovis subsp bovis AF2122/97
cgaaaauugcucc

SEQ ID NO: 3050079 - RNA, 23 nt, Mycobacterium bovis subsp bovis AF2122/97
cgaaacaccggccagcggcccgu

SEQ ID NO: 3050080 - RNA, 15 nt, Mycobacterium bovis subsp bovis AF2122/97
cgaaacagcacccag

SEQ ID NO: 3050081 - RNA, 19 nt, Mycobacterium bovis subsp bovis AF2122/97
cgaaacagcacccagacga

SEQ ID NO: 3050082 - RNA, 18 nt, Mycobacterium bovis subsp bovis AF2122/97
cgaaacaucucggcgcag

SEQ ID NO: 3050083 - RNA, 14 nt, Mycobacterium bovis subsp bovis AF2122/97
cgaaacccagucgu

SEQ ID NO: 3050084 - RNA, 15 nt, Mycobacterium bovis subsp bovis AF2122/97
cgaaacccgauguua

SEQ ID NO: 3050085 - RNA, 11 nt, Mycobacterium bovis subsp bovis AF2122/97
cgaaacccgcc

SEQ ID NO: 3050086 - RNA, 15 nt, Mycobacterium bovis subsp bovis AF2122/97
cgaaaccgcagcgcg

SEQ ID NO: 3050087 - RNA, 17 nt, Mycobacterium bovis subsp bovis AF2122/97
cgaaaccgccgucccgg

SEQ ID NO: 3050088 - RNA, 16 nt, Mycobacterium bovis subsp bovis AF2122/97
cgaaaccguggccauc

SEQ ID NO: 3050089 - RNA, 16 nt, Mycobacterium bovis subsp bovis AF2122/97
cgaaacgagccggugc

SEQ ID NO: 3050090 - RNA, 17 nt, Mycobacterium bovis subsp bovis AF2122/97
cgaaacgauggccgggu

SEQ ID NO: 3050091 - RNA, 14 nt, Mycobacterium bovis subsp bovis AF2122/97
cgaaacgccaccgu

SEQ ID NO: 3050092 - RNA, 22 nt, Mycobacterium bovis subsp bovis AF2122/97
cgaaacgccauacgucgccucg

SEQ ID NO: 3050093 - RNA, 21 nt, Mycobacterium bovis subsp bovis AF2122/97
cgaaacgcccgggcggcgucg

SEQ ID NO: 3050094 - RNA, 20 nt, Mycobacterium bovis subsp bovis AF2122/97
cgaaacgcccuugugaacgg

SEQ ID NO: 3050095 - RNA, 17 nt, Mycobacterium bovis subsp bovis AF2122/97
cgaaacgccgaccgcgc

SEQ ID NO: 3050096 - RNA, 14 nt, Mycobacterium bovis subsp bovis AF2122/97
cgaaacgccggguu

SEQ ID NO: 3050097 - RNA, 23 nt, Mycobacterium bovis subsp bovis AF2122/97
cgaaacggugaaugugcauagca

SEQ ID NO: 3050098 - RNA, 16 nt, Mycobacterium bovis subsp bovis AF2122/97
cgaaacucaccagcac

SEQ ID NO: 3050099 - RNA, 20 nt, Mycobacterium bovis subsp bovis AF2122/97
cgaaacucaccagcaccccg

SEQ ID NO: 3050100 - RNA, 16 nt, Mycobacterium bovis subsp bovis AF2122/97
cgaaacucgacgugaa

SEQ ID NO: 3050101 - RNA, 12 nt, Mycobacterium bovis subsp bovis AF2122/97
cgaaacugaccc

SEQ ID NO: 3050102 - RNA, 15 nt, Mycobacterium bovis subsp bovis AF2122/97
cgaaacuucgcccgg

SEQ ID NO: 3050103 - RNA, 17 nt, Mycobacterium bovis subsp bovis AF2122/97
cgaaacuucgcccgggc

SEQ ID NO: 3050104 - RNA, 19 nt, Mycobacterium bovis subsp bovis AF2122/97
cgaaagagccagcggcacu

SEQ ID NO: 3050105 - RNA, 23 nt, Mycobacterium bovis subsp bovis AF2122/97
cgaaagcaccccaaaaccgccgg

SEQ ID NO: 3050106 - RNA, 17 nt, Mycobacterium bovis subsp bovis AF2122/97
cgaaagcacgugcacgg

SEQ ID NO: 3050107 - RNA, 20 nt, Mycobacterium bovis subsp bovis AF2122/97
cgaaagcacgugcacggcga

SEQ ID NO: 3050108 - RNA, 19 nt, Mycobacterium bovis subsp bovis AF2122/97
cgaaagccaacucgaccga

SEQ ID NO: 3050109 - RNA, 14 nt, Mycobacterium bovis subsp bovis AF2122/97
cgaaagccgccgag

SEQ ID NO: 3050110 - RNA, 14 nt, Mycobacterium bovis subsp bovis AF2122/97
cgaaagccgcggcc

SEQ ID NO: 3050111 - RNA, 16 nt, Mycobacterium bovis subsp bovis AF2122/97
cgaaagccucucuucc

SEQ ID NO: 3050112 - RNA, 15 nt, Mycobacterium bovis subsp bovis AF2122/97
cgaaagcgucgagcu

SEQ ID NO: 3050113 - RNA, 17 nt, Mycobacterium bovis subsp bovis AF2122/97
cgaaaguccugcagugc

SEQ ID NO: 3050114 - RNA, 19 nt, Mycobacterium bovis subsp bovis AF2122/97
cgaaaguccugcagugcgg

SEQ ID NO: 3050115 - RNA, 22 nt, Mycobacterium bovis subsp bovis AF2122/97
cgaaaguccugcagugcggcgu

SEQ ID NO: 3050116 - RNA, 13 nt, Mycobacterium bovis subsp bovis AF2122/97
cgaaauacccagc

SEQ ID NO: 3050117 - RNA, 15 nt, Mycobacterium bovis subsp bovis AF2122/97
cgaaauacccagcgc

SEQ ID NO: 3050118 - RNA, 19 nt, Mycobacterium bovis subsp bovis AF2122/97
cgaaauacccagcgcagca

SEQ ID NO: 3050119 - RNA, 14 nt, Mycobacterium bovis subsp bovis AF2122/97
cgaaaucagcccgc

SEQ ID NO: 3050120 - RNA, 16 nt, Mycobacterium bovis subsp bovis AF2122/97
cgaaaucagcccgccc

SEQ ID NO: 3050121 - RNA, 19 nt, Mycobacterium bovis subsp bovis AF2122/97
cgaaaucagcccgcccaau

SEQ ID NO: 3050122 - RNA, 20 nt, Mycobacterium bovis subsp bovis AF2122/97
cgaaaucaguucccgaaccc

SEQ ID NO: 3050123 - RNA, 17 nt, Mycobacterium bovis subsp bovis AF2122/97
cgaaaucaguugcgcuc

SEQ ID NO: 3050124 - RNA, 20 nt, Mycobacterium bovis subsp bovis AF2122/97
cgaaauccacaaugcccggg

SEQ ID NO: 3050125 - RNA, 18 nt, Mycobacterium bovis subsp bovis AF2122/97
cgaaauccccugcgcugc

SEQ ID NO: 3050126 - RNA, 20 nt, Mycobacterium bovis subsp bovis AF2122/97
cgaaauccccugcgcugcag

SEQ ID NO: 3050127 - RNA, 18 nt, Mycobacterium bovis subsp bovis AF2122/97
cgaaaucgacagcagcgc

SEQ ID NO: 3050128 - RNA, 20 nt, Mycobacterium bovis subsp bovis AF2122/97
cgaaaucgacagcagcgcga

SEQ ID NO: 3050129 - RNA, 17 nt, Mycobacterium bovis subsp bovis AF2122/97
cgaaaucgcacagcgca

SEQ ID NO: 3050130 - RNA, 19 nt, Mycobacterium bovis subsp bovis AF2122/97
cgaaaucgcccugacccgg

SEQ ID NO: 3050131 - RNA, 19 nt, Mycobacterium bovis subsp bovis AF2122/97
cgaaaucggccagcuuccc

SEQ ID NO: 3050132 - RNA, 16 nt, Mycobacterium bovis subsp bovis AF2122/97
cgaaaucucaucgauu

SEQ ID NO: 3050133 - RNA, 18 nt, Mycobacterium bovis subsp bovis AF2122/97
cgaaaugcccaucaccag

SEQ ID NO: 3050134 - RNA, 19 nt, Mycobacterium bovis subsp bovis AF2122/97
cgaaaugcccaucaccaga

SEQ ID NO: 3050135 - RNA, 14 nt, Mycobacterium bovis subsp bovis AF2122/97
cgaaaugccggugc

SEQ ID NO: 3050136 - RNA, 20 nt, Mycobacterium bovis subsp bovis AF2122/97
cgaaauggucguucccgccg

SEQ ID NO: 3050137 - RNA, 23 nt, Mycobacterium bovis subsp bovis AF2122/97
cgaaauguuggccguaccgguga

SEQ ID NO: 3050138 - RNA, 19 nt, Mycobacterium bovis subsp bovis AF2122/97
cgaaauuacuucggccaca

SEQ ID NO: 3050139 - RNA, 18 nt, Mycobacterium bovis subsp bovis AF2122/97
cgaaauuccgggccuggc

SEQ ID NO: 3050140 - RNA, 22 nt, Mycobacterium bovis subsp bovis AF2122/97
cgaaauuccgggccuggccugc

SEQ ID NO: 3050141 - RNA, 15 nt, Mycobacterium bovis subsp bovis AF2122/97
cgaaauucucgcccu

SEQ ID NO: 3050142 - RNA, 17 nt, Mycobacterium bovis subsp bovis AF2122/97
cgaacaaccccgguuga

SEQ ID NO: 3050143 - RNA, 14 nt, Mycobacterium bovis subsp bovis AF2122/97
cgaacaacgccgga

SEQ ID NO: 3050144 - RNA, 14 nt, Mycobacterium bovis subsp bovis AF2122/97
cgaacaacgcgacg

SEQ ID NO: 3050145 - RNA, 23 nt, Mycobacterium bovis subsp bovis AF2122/97
cgaacaaguggccagcgccaacu

SEQ ID NO: 3050146 - RNA, 13 nt, Mycobacterium bovis subsp bovis AF2122/97
cgaacaauucacg

SEQ ID NO: 3050147 - RNA, 14 nt, Mycobacterium bovis subsp bovis AF2122/97
cgaacaauucacgc

SEQ ID NO: 3050148 - RNA, 20 nt, Mycobacterium bovis subsp bovis AF2122/97
cgaacaauucacgcaccaca

SEQ ID NO: 3050149 - RNA, 20 nt, Mycobacterium bovis subsp bovis AF2122/97
cgaacaauuucugcagccca

SEQ ID NO: 3050150 - RNA, 19 nt, Mycobacterium bovis subsp bovis AF2122/97
cgaacacaccgggcgggcu

SEQ ID NO: 3050151 - RNA, 21 nt, Mycobacterium bovis subsp bovis AF2122/97
cgaacccuucgcggugugcgg

SEQ ID NO: 3050152 - RNA, 15 nt, Mycobacterium bovis subsp bovis AF2122/97
cgaaccgacccggcc

SEQ ID NO: 3050153 - RNA, 18 nt, Mycobacterium bovis subsp bovis AF2122/97
cgaaccgacguuccccuu

SEQ ID NO: 3050154 - RNA, 13 nt, Mycobacterium bovis subsp bovis AF2122/97
cgaaccgccgacg

SEQ ID NO: 3050155 - RNA, 14 nt, Mycobacterium bovis subsp bovis AF2122/97
cgaaccgccgcugc

SEQ ID NO: 3050156 - RNA, 21 nt, Mycobacterium bovis subsp bovis AF2122/97
cgaaccgccgcugccgcgcgg

SEQ ID NO: 3050157 - RNA, 16 nt, Mycobacterium bovis subsp bovis AF2122/97
cgaaccgccggcaccg

SEQ ID NO: 3050158 - RNA, 18 nt, Mycobacterium bovis subsp bovis AF2122/97
cgaaccgccggcaccgcc

SEQ ID NO: 3050159 - RNA, 21 nt, Mycobacterium bovis subsp bovis AF2122/97
cgaaccgccggcaccgccgcc

SEQ ID NO: 3050160 - RNA, 13 nt, Mycobacterium bovis subsp bovis AF2122/97
cgaaccgccggcu

SEQ ID NO: 3050161 - RNA, 15 nt, Mycobacterium bovis subsp bovis AF2122/97
cgaaccgccggcugc

SEQ ID NO: 3050162 - RNA, 14 nt, Mycobacterium bovis subsp bovis AF2122/97
cgaaccgcucagcg

SEQ ID NO: 3050163 - RNA, 14 nt, Mycobacterium bovis subsp bovis AF2122/97
cgaaccgcugcggg

SEQ ID NO: 3050164 - RNA, 15 nt, Mycobacterium bovis subsp bovis AF2122/97
cgaaccggaucaucg

SEQ ID NO: 3050165 - RNA, 22 nt, Mycobacterium bovis subsp bovis AF2122/97
cgaaccggaucaucgccgcggc

SEQ ID NO: 3050166 - RNA, 17 nt, Mycobacterium bovis subsp bovis AF2122/97
cgaaccggcaccagcgg

SEQ ID NO: 3050167 - RNA, 19 nt, Mycobacterium bovis subsp bovis AF2122/97
cgaaccggccaucgaccgu

SEQ ID NO: 3050168 - RNA, 23 nt, Mycobacterium bovis subsp bovis AF2122/97
cgaaccggccaucgaccguccgg

SEQ ID NO: 3050169 - RNA, 19 nt, Mycobacterium bovis subsp bovis AF2122/97
cgaaccggcccaccgacgg

SEQ ID NO: 3050170 - RNA, 21 nt, Mycobacterium bovis subsp bovis AF2122/97
cgaaccggccgucgacgcaug

SEQ ID NO: 3050171 - RNA, 14 nt, Mycobacterium bovis subsp bovis AF2122/97
cgaaccggcugggc

SEQ ID NO: 3050172 - RNA, 19 nt, Mycobacterium bovis subsp bovis AF2122/97
cgaaccgguguagcagcgc

SEQ ID NO: 3050173 - RNA, 24 nt, Mycobacterium bovis subsp bovis AF2122/97
cgaaccgucucgcccccucuagcg

SEQ ID NO: 3050174 - RNA, 17 nt, Mycobacterium bovis subsp bovis AF2122/97
cgaaccguucggcgaca

SEQ ID NO: 3050175 - RNA, 19 nt, Mycobacterium bovis subsp bovis AF2122/97
cgaaccguuucgccggcgc

SEQ ID NO: 3050176 - RNA, 13 nt, Mycobacterium bovis subsp bovis AF2122/97
cgaaccucggcgg

SEQ ID NO: 3050177 - RNA, 23 nt, Mycobacterium bovis subsp bovis AF2122/97
cgaaccucggcgggauccucgaa

SEQ ID NO: 3050178 - RNA, 13 nt, Mycobacterium bovis subsp bovis AF2122/97
cgaaccugcucgg

SEQ ID NO: 3050179 - RNA, 14 nt, Mycobacterium bovis subsp bovis AF2122/97
cgaaccugcucggc

SEQ ID NO: 3050180 - RNA, 19 nt, Mycobacterium bovis subsp bovis AF2122/97
cgaaccugcucggcgcgcc

SEQ ID NO: 3050181 - RNA, 18 nt, Mycobacterium bovis subsp bovis AF2122/97
cgaaccuugguugccaac

SEQ ID NO: 3050182 - RNA, 16 nt, Mycobacterium bovis subsp bovis AF2122/97
cgaacgaaccgccgcc

SEQ ID NO: 3050183 - RNA, 17 nt, Mycobacterium bovis subsp bovis AF2122/97
cgaacgaauccgcucga

SEQ ID NO: 3050184 - RNA, 14 nt, Mycobacterium bovis subsp bovis AF2122/97
cgaacgacccuggc

SEQ ID NO: 3050185 - RNA, 19 nt, Mycobacterium bovis subsp bovis AF2122/97
cgaacgacggguccgggcc

SEQ ID NO: 3050186 - RNA, 21 nt, Mycobacterium bovis subsp bovis AF2122/97
cgaacgaguccaacucggcca

SEQ ID NO: 3050187 - RNA, 17 nt, Mycobacterium bovis subsp bovis AF2122/97
cgaacgauuucggccca

SEQ ID NO: 3050188 - RNA, 16 nt, Mycobacterium bovis subsp bovis AF2122/97
cgaacgcaacagccga

SEQ ID NO: 3050189 - RNA, 16 nt, Mycobacterium bovis subsp bovis AF2122/97
cgaacgcaacgccgau

SEQ ID NO: 3050190 - RNA, 21 nt, Mycobacterium bovis subsp bovis AF2122/97
cgaacgcaccgaaacgccgac

SEQ ID NO: 3050191 - RNA, 22 nt, Mycobacterium bovis subsp bovis AF2122/97
cgaacgcaccgaaacgccgacc

SEQ ID NO: 3050192 - RNA, 14 nt, Mycobacterium bovis subsp bovis AF2122/97
cgaacgcagccagc

SEQ ID NO: 3050193 - RNA, 15 nt, Mycobacterium bovis subsp bovis AF2122/97
cgaacgcagccagcg

SEQ ID NO: 3050194 - RNA, 14 nt, Mycobacterium bovis subsp bovis AF2122/97
cgaacgccaccacc

SEQ ID NO: 3050195 - RNA, 23 nt, Mycobacterium bovis subsp bovis AF2122/97
cgaacgccaccaccuccgcgucg

SEQ ID NO: 3050196 - RNA, 16 nt, Mycobacterium bovis subsp bovis AF2122/97
cgaacgcccugacggu

SEQ ID NO: 3050197 - RNA, 23 nt, Mycobacterium bovis subsp bovis AF2122/97
cgaacgcccugacgguggugacc

SEQ ID NO: 3050198 - RNA, 16 nt, Mycobacterium bovis subsp bovis AF2122/97
cgaacgccgcccgcug

SEQ ID NO: 3050199 - RNA, 15 nt, Mycobacterium bovis subsp bovis AF2122/97
cgaacgccgucgacg

SEQ ID NO: 3050200 - RNA, 16 nt, Mycobacterium bovis subsp bovis AF2122/97
cgaacgccgucgacgc

SEQ ID NO: 3050201 - RNA, 19 nt, Mycobacterium bovis subsp bovis AF2122/97
cgaacgccgucgacgcggc

SEQ ID NO: 3050202 - RNA, 18 nt, Mycobacterium bovis subsp bovis AF2122/97
cgaacgccguggugcgca

SEQ ID NO: 3050203 - RNA, 16 nt, Mycobacterium bovis subsp bovis AF2122/97
cgaacgccucugcgau

SEQ ID NO: 3050204 - RNA, 17 nt, Mycobacterium bovis subsp bovis AF2122/97
cgaacgcgacagccacc

SEQ ID NO: 3050205 - RNA, 19 nt, Mycobacterium bovis subsp bovis AF2122/97
cgaacgcgacagccaccuc

SEQ ID NO: 3050206 - RNA, 16 nt, Mycobacterium bovis subsp bovis AF2122/97
cgaacgcgaucgaccu

SEQ ID NO: 3050207 - RNA, 19 nt, Mycobacterium bovis subsp bovis AF2122/97
cgaacgcgaucgaccuugg

SEQ ID NO: 3050208 - RNA, 17 nt, Mycobacterium bovis subsp bovis AF2122/97
cgaacgcgccggucagc

SEQ ID NO: 3050209 - RNA, 16 nt, Mycobacterium bovis subsp bovis AF2122/97
cgaacgcgcgcagccg

SEQ ID NO: 3050210 - RNA, 13 nt, Mycobacterium bovis subsp bovis AF2122/97
cgaacgcgcgcgu

SEQ ID NO: 3050211 - RNA, 14 nt, Mycobacterium bovis subsp bovis AF2122/97
cgaacgcggccacc

SEQ ID NO: 3050212 - RNA, 14 nt, Mycobacterium bovis subsp bovis AF2122/97
cgaacgcggcgucg

SEQ ID NO: 3050213 - RNA, 14 nt, Mycobacterium bovis subsp bovis AF2122/97
cgaacgcuccaggc

SEQ ID NO: 3050214 - RNA, 21 nt, Mycobacterium bovis subsp bovis AF2122/97
cgaacgcugaggaagcggcgg

SEQ ID NO: 3050215 - RNA, 17 nt, Mycobacterium bovis subsp bovis AF2122/97
cgaacgcuggcggcgug

SEQ ID NO: 3050216 - RNA, 20 nt, Mycobacterium bovis subsp bovis AF2122/97
cgaacgcuucaccucgucga

SEQ ID NO: 3050217 - RNA, 16 nt, Mycobacterium bovis subsp bovis AF2122/97
cgaacgcuuccagcgu

SEQ ID NO: 3050218 - RNA, 19 nt, Mycobacterium bovis subsp bovis AF2122/97
cgaacggauucccgcccag

SEQ ID NO: 3050219 - RNA, 21 nt, Mycobacterium bovis subsp bovis AF2122/97
cgaacggauucccgcccagca

SEQ ID NO: 3050220 - RNA, 12 nt, Mycobacterium bovis subsp bovis AF2122/97
cgaacggcaccg

SEQ ID NO: 3050221 - RNA, 14 nt, Mycobacterium bovis subsp bovis AF2122/97
cgaacggcaccgcg

SEQ ID NO: 3050222 - RNA, 15 nt, Mycobacterium bovis subsp bovis AF2122/97
cgaacggcaccgcgc

SEQ ID NO: 3050223 - RNA, 16 nt, Mycobacterium bovis subsp bovis AF2122/97
cgaacggcaccgcgcc

SEQ ID NO: 3050224 - RNA, 15 nt, Mycobacterium bovis subsp bovis AF2122/97
cgaacggcagcccgg

SEQ ID NO: 3050225 - RNA, 18 nt, Mycobacterium bovis subsp bovis AF2122/97
cgaacggcagcccgggcg

SEQ ID NO: 3050226 - RNA, 13 nt, Mycobacterium bovis subsp bovis AF2122/97
cgaacggccagga

SEQ ID NO: 3050227 - RNA, 21 nt, Mycobacterium bovis subsp bovis AF2122/97
cgaacggcgcaguuggcacca

SEQ ID NO: 3050228 - RNA, 23 nt, Mycobacterium bovis subsp bovis AF2122/97
cgaacggcuuggcgucggccggc

SEQ ID NO: 3050229 - RNA, 18 nt, Mycobacterium bovis subsp bovis AF2122/97
cgaacggguagucgggca

SEQ ID NO: 3050230 - RNA, 18 nt, Mycobacterium bovis subsp bovis AF2122/97
cgaacgggucggcgacca

SEQ ID NO: 3050231 - RNA, 21 nt, Mycobacterium bovis subsp bovis AF2122/97
cgaacgggucggcgaccaccc

SEQ ID NO: 3050232 - RNA, 14 nt, Mycobacterium bovis subsp bovis AF2122/97
cgaacgggucggga

SEQ ID NO: 3050233 - RNA, 19 nt, Mycobacterium bovis subsp bovis AF2122/97
cgaacgguagcacggucug

SEQ ID NO: 3050234 - RNA, 16 nt, Mycobacterium bovis subsp bovis AF2122/97
cgaacgguugcucguc

SEQ ID NO: 3050235 - RNA, 17 nt, Mycobacterium bovis subsp bovis AF2122/97
cgaacgguugcucgucc

SEQ ID NO: 3050236 - RNA, 19 nt, Mycobacterium bovis subsp bovis AF2122/97
cgaacgguugcucguccaa

SEQ ID NO: 3050237 - RNA, 15 nt, Mycobacterium bovis subsp bovis AF2122/97
cgaacgucaccaucg

SEQ ID NO: 3050238 - RNA, 21 nt, Mycobacterium bovis subsp bovis AF2122/97
cgaagccagaucagccgccgc

SEQ ID NO: 3050239 - RNA, 19 nt, Mycobacterium bovis subsp bovis AF2122/97
cgaagccagaucgcuagga

SEQ ID NO: 3050240 - RNA, 14 nt, Mycobacterium bovis subsp bovis AF2122/97
cgaagcccacguuu

SEQ ID NO: 3050241 - RNA, 12 nt, Mycobacterium bovis subsp bovis AF2122/97
cgaagcccagca

SEQ ID NO: 3050242 - RNA, 14 nt, Mycobacterium bovis subsp bovis AF2122/97
cgaagcccagcacc

SEQ ID NO: 3050243 - RNA, 17 nt, Mycobacterium bovis subsp bovis AF2122/97
cgaagcccccgacguug

SEQ ID NO: 3050244 - RNA, 23 nt, Mycobacterium bovis subsp bovis AF2122/97
cgaagccccucaccucggcuuug

SEQ ID NO: 3050245 - RNA, 15 nt, Mycobacterium bovis subsp bovis AF2122/97
cgaagcccgacugua

SEQ ID NO: 3050246 - RNA, 17 nt, Mycobacterium bovis subsp bovis AF2122/97
cgaagcccgaucggcgg

SEQ ID NO: 3050247 - RNA, 18 nt, Mycobacterium bovis subsp bovis AF2122/97
cgaagcccggggcgcucg

SEQ ID NO: 3050248 - RNA, 17 nt, Mycobacterium bovis subsp bovis AF2122/97
cgaagccgaccucacgg

SEQ ID NO: 3050249 - RNA, 17 nt, Mycobacterium bovis subsp bovis AF2122/97
cgaagccgccgcgacca

SEQ ID NO: 3050250 - RNA, 12 nt, Mycobacterium bovis subsp bovis AF2122/97
cgaagccgccgg

SEQ ID NO: 3050251 - RNA, 23 nt, Mycobacterium bovis subsp bovis AF2122/97
cgaagccgccgggugcgccguug

SEQ ID NO: 3050252 - RNA, 22 nt, Mycobacterium bovis subsp bovis AF2122/97
cgaagccgcgcaucugucgcgc

SEQ ID NO: 3050253 - RNA, 15 nt, Mycobacterium bovis subsp bovis AF2122/97
cgaagccggcgccgg

SEQ ID NO: 3050254 - RNA, 22 nt, Mycobacterium bovis subsp bovis AF2122/97
cgaagccggcuucggugagcgg

SEQ ID NO: 3050255 - RNA, 12 nt, Mycobacterium bovis subsp bovis AF2122/97
cgaagccgggug

SEQ ID NO: 3050256 - RNA, 20 nt, Mycobacterium bovis subsp bovis AF2122/97
cgaagccggugccggcguug

SEQ ID NO: 3050257 - RNA, 19 nt, Mycobacterium bovis subsp bovis AF2122/97
cgaagccgguucgcccagc

SEQ ID NO: 3050258 - RNA, 22 nt, Mycobacterium bovis subsp bovis AF2122/97
cgaagccgguucgcccagcagg

SEQ ID NO: 3050259 - RNA, 23 nt, Mycobacterium bovis subsp bovis AF2122/97
cgaagccgucgauguugcccagc

SEQ ID NO: 3050260 - RNA, 17 nt, Mycobacterium bovis subsp bovis AF2122/97
cgaagccuugcagcgcc

SEQ ID NO: 3050261 - RNA, 18 nt, Mycobacterium bovis subsp bovis AF2122/97
cgaagccuugcagcgccc

SEQ ID NO: 3050262 - RNA, 21 nt, Mycobacterium bovis subsp bovis AF2122/97
cgaagccuugcagcgcccccg

SEQ ID NO: 3050263 - RNA, 15 nt, Mycobacterium bovis subsp bovis AF2122/97
cgaagcgauccggcu

SEQ ID NO: 3050264 - RNA, 19 nt, Mycobacterium bovis subsp bovis AF2122/97
cgaagcgaucgccggccgc

SEQ ID NO: 3050265 - RNA, 23 nt, Mycobacterium bovis subsp bovis AF2122/97
cgaagcgaugccgugcugggccg

SEQ ID NO: 3050266 - RNA, 17 nt, Mycobacterium bovis subsp bovis AF2122/97
cgaagcgcccguuggcc

SEQ ID NO: 3050267 - RNA, 19 nt, Mycobacterium bovis subsp bovis AF2122/97
cgaagcgcccguuggccaa

SEQ ID NO: 3050268 - RNA, 15 nt, Mycobacterium bovis subsp bovis AF2122/97
cgaagcggaccagcg

SEQ ID NO: 3050269 - RNA, 16 nt, Mycobacterium bovis subsp bovis AF2122/97
cgaagcggaccagcga

SEQ ID NO: 3050270 - RNA, 18 nt, Mycobacterium bovis subsp bovis AF2122/97
cgaagcggccaccgccgc

SEQ ID NO: 3050271 - RNA, 16 nt, Mycobacterium bovis subsp bovis AF2122/97
cgaagcggcugcugcg

SEQ ID NO: 3050272 - RNA, 23 nt, Mycobacterium bovis subsp bovis AF2122/97
cgaagcggcugcugcgcggugcc

SEQ ID NO: 3050273 - RNA, 19 nt, Mycobacterium bovis subsp bovis AF2122/97
cgaagcgggaaggcucacc

SEQ ID NO: 3050274 - RNA, 21 nt, Mycobacterium bovis subsp bovis AF2122/97
cgaagcgggacugcagcgcgg

SEQ ID NO: 3050275 - RNA, 15 nt, Mycobacterium bovis subsp bovis AF2122/97
cgaagcgggcggaaa

SEQ ID NO: 3050276 - RNA, 21 nt, Mycobacterium bovis subsp bovis AF2122/97
cgaagcgggcggaaacaagca

SEQ ID NO: 3050277 - RNA, 19 nt, Mycobacterium bovis subsp bovis AF2122/97
cgaagcgggcuugagcgcc

SEQ ID NO: 3050278 - RNA, 19 nt, Mycobacterium bovis subsp bovis AF2122/97
cgaagcggugaggucggug

SEQ ID NO: 3050279 - RNA, 21 nt, Mycobacterium bovis subsp bovis AF2122/97
cgaagcgucuggucagccgcg

SEQ ID NO: 3050280 - RNA, 18 nt, Mycobacterium bovis subsp bovis AF2122/97
cgaagcguugaccgcggu

SEQ ID NO: 3050281 - RNA, 21 nt, Mycobacterium bovis subsp bovis AF2122/97
cgaagcuacgucggcucgucg

SEQ ID NO: 3050282 - RNA, 13 nt, Mycobacterium bovis subsp bovis AF2122/97
cgaagcuagcgcc

SEQ ID NO: 3050283 - RNA, 18 nt, Mycobacterium bovis subsp bovis AF2122/97
cgaagcucaucaccggcg

SEQ ID NO: 3050284 - RNA, 19 nt, Mycobacterium bovis subsp bovis AF2122/97
cgaagcucaucgccgcuac

SEQ ID NO: 3050285 - RNA, 23 nt, Mycobacterium bovis subsp bovis AF2122/97
cgaagcugcgggucagcgccgag

SEQ ID NO: 3050286 - RNA, 15 nt, Mycobacterium bovis subsp bovis AF2122/97
cgaagcuggcacgca

SEQ ID NO: 3050287 - RNA, 15 nt, Mycobacterium bovis subsp bovis AF2122/97
cgaagcuggcgugca

SEQ ID NO: 3050288 - RNA, 20 nt, Mycobacterium bovis subsp bovis AF2122/97
cgaagcuggcgugcagcagg

SEQ ID NO: 3050289 - RNA, 20 nt, Mycobacterium bovis subsp bovis AF2122/97
cgaagcuguagaccuggccg

SEQ ID NO: 3050290 - RNA, 17 nt, Mycobacterium bovis subsp bovis AF2122/97
cgaagcugugcccggcg

SEQ ID NO: 3050291 - RNA, 18 nt, Mycobacterium bovis subsp bovis AF2122/97
cgaagcugugcccggcgc

SEQ ID NO: 3050292 - RNA, 19 nt, Mycobacterium bovis subsp bovis AF2122/97
cgaagcugugcccggcgcc

SEQ ID NO: 3050293 - RNA, 18 nt, Mycobacterium bovis subsp bovis AF2122/97
cgaagcuucggccuucuu

SEQ ID NO: 3050294 - RNA, 21 nt, Mycobacterium bovis subsp bovis AF2122/97
cgaagcuugacguugccgggc

SEQ ID NO: 3050295 - RNA, 23 nt, Mycobacterium bovis subsp bovis AF2122/97
cgaagcuugacguugccgggcuu

SEQ ID NO: 3050296 - RNA, 22 nt, Mycobacterium bovis subsp bovis AF2122/97
cgaaggaugcugucagacggcg

SEQ ID NO: 3050297 - RNA, 15 nt, Mycobacterium bovis subsp bovis AF2122/97
cgaaggauugcggaa

SEQ ID NO: 3050298 - RNA, 12 nt, Mycobacterium bovis subsp bovis AF2122/97
cgaaggcacugc

SEQ ID NO: 3050299 - RNA, 17 nt, Mycobacterium bovis subsp bovis AF2122/97
cgaaggcacugcgaucg

SEQ ID NO: 3050300 - RNA, 17 nt, Mycobacterium bovis subsp bovis AF2122/97
cgaaggccgccaaccgu

SEQ ID NO: 3050301 - RNA, 19 nt, Mycobacterium bovis subsp bovis AF2122/97
cgaaggccgccaaccguuc

SEQ ID NO: 3050302 - RNA, 14 nt, Mycobacterium bovis subsp bovis AF2122/97
cgaaggcgccgaac

SEQ ID NO: 3050303 - RNA, 14 nt, Mycobacterium bovis subsp bovis AF2122/97
cgaaggcggcucca

SEQ ID NO: 3050304 - RNA, 21 nt, Mycobacterium bovis subsp bovis AF2122/97
cgaaggcggcuccaccgggcc

SEQ ID NO: 3050305 - RNA, 14 nt, Mycobacterium bovis subsp bovis AF2122/97
cgaaggcggcuucg

SEQ ID NO: 3050306 - RNA, 18 nt, Mycobacterium bovis subsp bovis AF2122/97
cgaaggcgggggagccca

SEQ ID NO: 3050307 - RNA, 17 nt, Mycobacterium bovis subsp bovis AF2122/97
cgaaggcguucgacucg

SEQ ID NO: 3050308 - RNA, 20 nt, Mycobacterium bovis subsp bovis AF2122/97
cgaaggcguucgacucgacc

SEQ ID NO: 3050309 - RNA, 20 nt, Mycobacterium bovis subsp bovis AF2122/97
cgaagggaucacgaccgcgc

SEQ ID NO: 3050310 - RNA, 15 nt, Mycobacterium bovis subsp bovis AF2122/97
cgaagggcaccggcg

SEQ ID NO: 3050311 - RNA, 16 nt, Mycobacterium bovis subsp bovis AF2122/97
cgaagggcaccggcga

SEQ ID NO: 3050312 - RNA, 19 nt, Mycobacterium bovis subsp bovis AF2122/97
cgaagggcuugucgccggc

SEQ ID NO: 3050313 - RNA, 20 nt, Mycobacterium bovis subsp bovis AF2122/97
cgaagggcuugucgccggca

SEQ ID NO: 3050314 - RNA, 23 nt, Mycobacterium bovis subsp bovis AF2122/97
cgaaggguaagaguucgcgcgcc

SEQ ID NO: 3050315 - RNA, 18 nt, Mycobacterium bovis subsp bovis AF2122/97
cgaagguccgugccgaug

SEQ ID NO: 3050316 - RNA, 20 nt, Mycobacterium bovis subsp bovis AF2122/97
cgaagguccgugccgaugcc

SEQ ID NO: 3050317 - RNA, 23 nt, Mycobacterium bovis subsp bovis AF2122/97
cgaaggucgcggucgagcaggug

SEQ ID NO: 3050318 - RNA, 21 nt, Mycobacterium bovis subsp bovis AF2122/97
cgaaggucgguaccccagcgc

SEQ ID NO: 3050319 - RNA, 14 nt, Mycobacterium bovis subsp bovis AF2122/97
cgaaggucuccggc

SEQ ID NO: 3050320 - RNA, 20 nt, Mycobacterium bovis subsp bovis AF2122/97
cgaaggucucgaaagccgcg

SEQ ID NO: 3050321 - RNA, 17 nt, Mycobacterium bovis subsp bovis AF2122/97
cgaaggugaaucgacug

SEQ ID NO: 3050322 - RNA, 22 nt, Mycobacterium bovis subsp bovis AF2122/97
cgaaggugcgcgugacgaucac

SEQ ID NO: 3050323 - RNA, 16 nt, Mycobacterium bovis subsp bovis AF2122/97
cgaagguguccuccag

SEQ ID NO: 3050324 - RNA, 21 nt, Mycobacterium bovis subsp bovis AF2122/97
cgaauugcguucgccgcccgg

SEQ ID NO: 3050325 - RNA, 14 nt, Mycobacterium bovis subsp bovis AF2122/97
cgaauuggcggaac

SEQ ID NO: 3050326 - RNA, 19 nt, Mycobacterium bovis subsp bovis AF2122/97
cgacaaaccgggcgugcca

SEQ ID NO: 3050327 - RNA, 17 nt, Mycobacterium bovis subsp bovis AF2122/97
cgacaaagcggcugccc

SEQ ID NO: 3050328 - RNA, 22 nt, Mycobacterium bovis subsp bovis AF2122/97
cgacaaaucggucgacgaucuc

SEQ ID NO: 3050329 - RNA, 15 nt, Mycobacterium bovis subsp bovis AF2122/97
cgacaacaccacggu

SEQ ID NO: 3050330 - RNA, 18 nt, Mycobacterium bovis subsp bovis AF2122/97
cgacaacaccacggugcc

SEQ ID NO: 3050331 - RNA, 14 nt, Mycobacterium bovis subsp bovis AF2122/97
cgacaacacccacg

SEQ ID NO: 3050332 - RNA, 21 nt, Mycobacterium bovis subsp bovis AF2122/97
cgacaacacccacgugcugcc

SEQ ID NO: 3050333 - RNA, 15 nt, Mycobacterium bovis subsp bovis AF2122/97
cgacaacacgccguc

SEQ ID NO: 3050334 - RNA, 21 nt, Mycobacterium bovis subsp bovis AF2122/97
cgacaacacgccgucgaccgg

SEQ ID NO: 3050335 - RNA, 14 nt, Mycobacterium bovis subsp bovis AF2122/97
cgacaacagccagc

SEQ ID NO: 3050336 - RNA, 14 nt, Mycobacterium bovis subsp bovis AF2122/97
cgacaacaggccgu

SEQ ID NO: 3050337 - RNA, 21 nt, Mycobacterium bovis subsp bovis AF2122/97
cgacaacaucgaaucagcucg

SEQ ID NO: 3050338 - RNA, 17 nt, Mycobacterium bovis subsp bovis AF2122/97
cgacaacaugcccguca

SEQ ID NO: 3050339 - RNA, 21 nt, Mycobacterium bovis subsp bovis AF2122/97
cgacaacaugcccgucagcgg

SEQ ID NO: 3050340 - RNA, 17 nt, Mycobacterium bovis subsp bovis AF2122/97
cgacaaccccgccagga

SEQ ID NO: 3050341 - RNA, 16 nt, Mycobacterium bovis subsp bovis AF2122/97
cgacaacccggcgucg

SEQ ID NO: 3050342 - RNA, 15 nt, Mycobacterium bovis subsp bovis AF2122/97
cgacaaccgcugccg

SEQ ID NO: 3050343 - RNA, 15 nt, Mycobacterium bovis subsp bovis AF2122/97
cgacaaccggccaga

SEQ ID NO: 3050344 - RNA, 23 nt, Mycobacterium bovis subsp bovis AF2122/97
cgacaacgacgucgccgacccgg

SEQ ID NO: 3050345 - RNA, 19 nt, Mycobacterium bovis subsp bovis AF2122/97
cgacaacgacugcguuccg

SEQ ID NO: 3050346 - RNA, 13 nt, Mycobacterium bovis subsp bovis AF2122/97
cgacaacgaucgc

SEQ ID NO: 3050347 - RNA, 17 nt, Mycobacterium bovis subsp bovis AF2122/97
cgacaacugcccgauga

SEQ ID NO: 3050348 - RNA, 17 nt, Mycobacterium bovis subsp bovis AF2122/97
cgacaagaauggccgcc

SEQ ID NO: 3050349 - RNA, 15 nt, Mycobacterium bovis subsp bovis AF2122/97
cgacaagccgagccc

SEQ ID NO: 3050350 - RNA, 22 nt, Mycobacterium bovis subsp bovis AF2122/97
cgacaagccgagcccgucgauc

SEQ ID NO: 3050351 - RNA, 16 nt, Mycobacterium bovis subsp bovis AF2122/97
cgacaagcugucggcg

SEQ ID NO: 3050352 - RNA, 21 nt, Mycobacterium bovis subsp bovis AF2122/97
cgacaagcugucggcgaccga

SEQ ID NO: 3050353 - RNA, 14 nt, Mycobacterium bovis subsp bovis AF2122/97
cgacaaggucgucg

SEQ ID NO: 3050354 - RNA, 23 nt, Mycobacterium bovis subsp bovis AF2122/97
cgacaagugcccggccaaccacc

SEQ ID NO: 3050355 - RNA, 14 nt, Mycobacterium bovis subsp bovis AF2122/97
cgacaauggcgcca

SEQ ID NO: 3050356 - RNA, 18 nt, Mycobacterium bovis subsp bovis AF2122/97
cgacaauggcgccagccg

SEQ ID NO: 3050357 - RNA, 19 nt, Mycobacterium bovis subsp bovis AF2122/97
cgacaauggcgccagccga

SEQ ID NO: 3050358 - RNA, 21 nt, Mycobacterium bovis subsp bovis AF2122/97
cgacaaugucggcgaugcguc

SEQ ID NO: 3050359 - RNA, 20 nt, Mycobacterium bovis subsp bovis AF2122/97
cgacacaacgggugucggcg

SEQ ID NO: 3050360 - RNA, 12 nt, Mycobacterium bovis subsp bovis AF2122/97
cgacacacccac

SEQ ID NO: 3050361 - RNA, 18 nt, Mycobacterium bovis subsp bovis AF2122/97
cgacacacgccgccggug

SEQ ID NO: 3050362 - RNA, 16 nt, Mycobacterium bovis subsp bovis AF2122/97
cgacacagcggcgggu

SEQ ID NO: 3050363 - RNA, 12 nt, Mycobacterium bovis subsp bovis AF2122/97
cgacaccaccag

SEQ ID NO: 3050364 - RNA, 20 nt, Mycobacterium bovis subsp bovis AF2122/97
cgacaccaccagguccaccc

SEQ ID NO: 3050365 - RNA, 13 nt, Mycobacterium bovis subsp bovis AF2122/97
cgacaccaccauu

SEQ ID NO: 3050366 - RNA, 23 nt, Mycobacterium bovis subsp bovis AF2122/97
cgacaccaccuuggaugcccugc

SEQ ID NO: 3050367 - RNA, 21 nt, Mycobacterium bovis subsp bovis AF2122/97
cgacaccagaucguuccaggc

SEQ ID NO: 3050368 - RNA, 21 nt, Mycobacterium bovis subsp bovis AF2122/97
cgacaccauaggccgacgggu

SEQ ID NO: 3050369 - RNA, 15 nt, Mycobacterium bovis subsp bovis AF2122/97
cgacaccccgaugcc

SEQ ID NO: 3050370 - RNA, 14 nt, Mycobacterium bovis subsp bovis AF2122/97
cgacacccgcacga

SEQ ID NO: 3050371 - RNA, 21 nt, Mycobacterium bovis subsp bovis AF2122/97
cgacacccgcauggcagcggc

SEQ ID NO: 3050372 - RNA, 23 nt, Mycobacterium bovis subsp bovis AF2122/97
cgacacccgcauggcagcggcgg

SEQ ID NO: 3050373 - RNA, 23 nt, Mycobacterium bovis subsp bovis AF2122/97
cgacacccugggugccggcagcg

SEQ ID NO: 3050374 - RNA, 14 nt, Mycobacterium bovis subsp bovis AF2122/97
cgacaccgacgcgg

SEQ ID NO: 3050375 - RNA, 17 nt, Mycobacterium bovis subsp bovis AF2122/97
cgacaccgacgcggucg

SEQ ID NO: 3050376 - RNA, 17 nt, Mycobacterium bovis subsp bovis AF2122/97
cgacaccgacucgcaau

SEQ ID NO: 3050377 - RNA, 20 nt, Mycobacterium bovis subsp bovis AF2122/97
cgacaccgagccacgaccca

SEQ ID NO: 3050378 - RNA, 22 nt, Mycobacterium bovis subsp bovis AF2122/97
cgacaccgagccacgacccagc

SEQ ID NO: 3050379 - RNA, 21 nt, Mycobacterium bovis subsp bovis AF2122/97
cgacaccgcaggugccguggc

SEQ ID NO: 3050380 - RNA, 14 nt, Mycobacterium bovis subsp bovis AF2122/97
cgacaccgccacca

SEQ ID NO: 3050381 - RNA, 17 nt, Mycobacterium bovis subsp bovis AF2122/97
cgacaccgcccgaccca

SEQ ID NO: 3050382 - RNA, 20 nt, Mycobacterium bovis subsp bovis AF2122/97
cgacaccgcccgacccauca

SEQ ID NO: 3050383 - RNA, 20 nt, Mycobacterium bovis subsp bovis AF2122/97
cgacaccgcggacccgcagc

SEQ ID NO: 3050384 - RNA, 14 nt, Mycobacterium bovis subsp bovis AF2122/97
cgacaccgcggugc

SEQ ID NO: 3050385 - RNA, 16 nt, Mycobacterium bovis subsp bovis AF2122/97
cgacaccgcggugccc

SEQ ID NO: 3050386 - RNA, 19 nt, Mycobacterium bovis subsp bovis AF2122/97
cgacaccgcggugccccgg

SEQ ID NO: 3050387 - RNA, 14 nt, Mycobacterium bovis subsp bovis AF2122/97
cgacaccggccgcg

SEQ ID NO: 3050388 - RNA, 16 nt, Mycobacterium bovis subsp bovis AF2122/97
cgacaccggccgcgac

SEQ ID NO: 3050389 - RNA, 15 nt, Mycobacterium bovis subsp bovis AF2122/97
cgacaccggcugacc

SEQ ID NO: 3050390 - RNA, 20 nt, Mycobacterium bovis subsp bovis AF2122/97
cgacaccggcugaccgaccc

SEQ ID NO: 3050391 - RNA, 21 nt, Mycobacterium bovis subsp bovis AF2122/97
cgacaccggcugaccgacccg

SEQ ID NO: 3050392 - RNA, 22 nt, Mycobacterium bovis subsp bovis AF2122/97
cgacaccggcugaccgacccgg

SEQ ID NO: 3050393 - RNA, 15 nt, Mycobacterium bovis subsp bovis AF2122/97
cgacaccguaggcga

SEQ ID NO: 3050394 - RNA, 19 nt, Mycobacterium bovis subsp bovis AF2122/97
cgacaccguccagcagcuc

SEQ ID NO: 3050395 - RNA, 20 nt, Mycobacterium bovis subsp bovis AF2122/97
cgacaccgugaccgccgcgc

SEQ ID NO: 3050396 - RNA, 22 nt, Mycobacterium bovis subsp bovis AF2122/97
cgacaccgugaccgccgcgccg

SEQ ID NO: 3050397 - RNA, 14 nt, Mycobacterium bovis subsp bovis AF2122/97
cgacaccgugccgc

SEQ ID NO: 3050398 - RNA, 15 nt, Mycobacterium bovis subsp bovis AF2122/97
cgacaccgugucgcc

SEQ ID NO: 3050399 - RNA, 17 nt, Mycobacterium bovis subsp bovis AF2122/97
cgacacgaaggucgcgg

SEQ ID NO: 3050400 - RNA, 13 nt, Mycobacterium bovis subsp bovis AF2122/97
cgacacgccagcc

SEQ ID NO: 3050401 - RNA, 15 nt, Mycobacterium bovis subsp bovis AF2122/97
cgacacgccagguga

SEQ ID NO: 3050402 - RNA, 20 nt, Mycobacterium bovis subsp bovis AF2122/97
cgacacgccaggugaugccg

SEQ ID NO: 3050403 - RNA, 22 nt, Mycobacterium bovis subsp bovis AF2122/97
cgacacgccaggugaugccgcc

SEQ ID NO: 3050404 - RNA, 17 nt, Mycobacterium bovis subsp bovis AF2122/97
cgacacgccauccacga

SEQ ID NO: 3050405 - RNA, 12 nt, Mycobacterium bovis subsp bovis AF2122/97
cgacacgccgaa

SEQ ID NO: 3050406 - RNA, 13 nt, Mycobacterium bovis subsp bovis AF2122/97
cgacacgccgugc

SEQ ID NO: 3050407 - RNA, 15 nt, Mycobacterium bovis subsp bovis AF2122/97
cgacacggccauccg

SEQ ID NO: 3050408 - RNA, 19 nt, Mycobacterium bovis subsp bovis AF2122/97
cgacacggcucgccggcuc

SEQ ID NO: 3050409 - RNA, 14 nt, Mycobacterium bovis subsp bovis AF2122/97
cgacacggugaucu

SEQ ID NO: 3050410 - RNA, 18 nt, Mycobacterium bovis subsp bovis AF2122/97
cgacaucgugauccccgc

SEQ ID NO: 3050411 - RNA, 16 nt, Mycobacterium bovis subsp bovis AF2122/97
cgacaugaaccggucg

SEQ ID NO: 3050412 - RNA, 20 nt, Mycobacterium bovis subsp bovis AF2122/97
cgacaugaaccggucgaucc

SEQ ID NO: 3050413 - RNA, 18 nt, Mycobacterium bovis subsp bovis AF2122/97
cgacaugaggcugccgaa

SEQ ID NO: 3050414 - RNA, 20 nt, Mycobacterium bovis subsp bovis AF2122/97
cgacaugaucugccaccgcg

SEQ ID NO: 3050415 - RNA, 14 nt, Mycobacterium bovis subsp bovis AF2122/97
cgacaugcagcgcc

SEQ ID NO: 3050416 - RNA, 15 nt, Mycobacterium bovis subsp bovis AF2122/97
cgacaugcagcgcca

SEQ ID NO: 3050417 - RNA, 13 nt, Mycobacterium bovis subsp bovis AF2122/97
cgacaugcgccga

SEQ ID NO: 3050418 - RNA, 16 nt, Mycobacterium bovis subsp bovis AF2122/97
cgacaugcgccgagau

SEQ ID NO: 3050419 - RNA, 17 nt, Mycobacterium bovis subsp bovis AF2122/97
cgacaugcgccgagauc

SEQ ID NO: 3050420 - RNA, 15 nt, Mycobacterium bovis subsp bovis AF2122/97
cgacauggcggugcg

SEQ ID NO: 3050421 - RNA, 22 nt, Mycobacterium bovis subsp bovis AF2122/97
cgacauggcggugcgcagcuug

SEQ ID NO: 3050422 - RNA, 22 nt, Mycobacterium bovis subsp bovis AF2122/97
cgacaugggcaggccgcguucg

SEQ ID NO: 3050423 - RNA, 21 nt, Mycobacterium bovis subsp bovis AF2122/97
cgacaugguccgaccagcggc

SEQ ID NO: 3050424 - RNA, 23 nt, Mycobacterium bovis subsp bovis AF2122/97
cgacaugucgaacgccccccacg

SEQ ID NO: 3050425 - RNA, 16 nt, Mycobacterium bovis subsp bovis AF2122/97
cgacauugccacggcg

SEQ ID NO: 3050426 - RNA, 18 nt, Mycobacterium bovis subsp bovis AF2122/97
cgacauugccacggcgcc

SEQ ID NO: 3050427 - RNA, 18 nt, Mycobacterium bovis subsp bovis AF2122/97
cgacauugggcgcggugc

SEQ ID NO: 3050428 - RNA, 18 nt, Mycobacterium bovis subsp bovis AF2122/97
cgacauuggucaccugcu

SEQ ID NO: 3050429 - RNA, 21 nt, Mycobacterium bovis subsp bovis AF2122/97
cgacauuugcccgaugguacc

SEQ ID NO: 3050430 - RNA, 20 nt, Mycobacterium bovis subsp bovis AF2122/97
cgaccaaaccgacgcgggcc

SEQ ID NO: 3050431 - RNA, 22 nt, Mycobacterium bovis subsp bovis AF2122/97
cgaccaaaccgcuguaaccggu

SEQ ID NO: 3050432 - RNA, 14 nt, Mycobacterium bovis subsp bovis AF2122/97
cgaccaacacggua

SEQ ID NO: 3050433 - RNA, 16 nt, Mycobacterium bovis subsp bovis AF2122/97
cgaccaacgcggugug

SEQ ID NO: 3050434 - RNA, 19 nt, Mycobacterium bovis subsp bovis AF2122/97
cgaccaaggccgaccugua

SEQ ID NO: 3050435 - RNA, 18 nt, Mycobacterium bovis subsp bovis AF2122/97
cgaccaagguguccagca

SEQ ID NO: 3050436 - RNA, 23 nt, Mycobacterium bovis subsp bovis AF2122/97
cgaccaaguugaccuucaccugg

SEQ ID NO: 3050437 - RNA, 17 nt, Mycobacterium bovis subsp bovis AF2122/97
cgaccaauaccaguccg

SEQ ID NO: 3050438 - RNA, 21 nt, Mycobacterium bovis subsp bovis AF2122/97
cgaccaauaccaguccguuca

SEQ ID NO: 3050439 - RNA, 17 nt, Mycobacterium bovis subsp bovis AF2122/97
cgaccaauaggucccca

SEQ ID NO: 3050440 - RNA, 22 nt, Mycobacterium bovis subsp bovis AF2122/97
cgaccaaugcguugacgucgag

SEQ ID NO: 3050441 - RNA, 15 nt, Mycobacterium bovis subsp bovis AF2122/97
cgaccaauucgcaau

SEQ ID NO: 3050442 - RNA, 20 nt, Mycobacterium bovis subsp bovis AF2122/97
cgaccaauuggucgagucga

SEQ ID NO: 3050443 - RNA, 18 nt, Mycobacterium bovis subsp bovis AF2122/97
cgaccacaccacgauggc

SEQ ID NO: 3050444 - RNA, 16 nt, Mycobacterium bovis subsp bovis AF2122/97
cgaccacaggcaucgg

SEQ ID NO: 3050445 - RNA, 19 nt, Mycobacterium bovis subsp bovis AF2122/97
cgaccacauuccgcagucc

SEQ ID NO: 3050446 - RNA, 12 nt, Mycobacterium bovis subsp bovis AF2122/97
cgaccaccaccg

SEQ ID NO: 3050447 - RNA, 13 nt, Mycobacterium bovis subsp bovis AF2122/97
cgaccaccaccgc

SEQ ID NO: 3050448 - RNA, 14 nt, Mycobacterium bovis subsp bovis AF2122/97
cgaccaccaccgcc

SEQ ID NO: 3050449 - RNA, 17 nt, Mycobacterium bovis subsp bovis AF2122/97
cgaccaccaccgccgcc

SEQ ID NO: 3050450 - RNA, 20 nt, Mycobacterium bovis subsp bovis AF2122/97
cgaccaccaccgccgccgaa

SEQ ID NO: 3050451 - RNA, 19 nt, Mycobacterium bovis subsp bovis AF2122/97
cgaccaccagagcgucgaa

SEQ ID NO: 3050452 - RNA, 20 nt, Mycobacterium bovis subsp bovis AF2122/97
cgaccaccagagcgucgaac

SEQ ID NO: 3050453 - RNA, 14 nt, Mycobacterium bovis subsp bovis AF2122/97
cgaccaccagcgcc

SEQ ID NO: 3050454 - RNA, 15 nt, Mycobacterium bovis subsp bovis AF2122/97
cgaccaccagcgccg

SEQ ID NO: 3050455 - RNA, 14 nt, Mycobacterium bovis subsp bovis AF2122/97
cgaccaccgccgag

SEQ ID NO: 3050456 - RNA, 19 nt, Mycobacterium bovis subsp bovis AF2122/97
cgaccaccgccgagccugc

SEQ ID NO: 3050457 - RNA, 22 nt, Mycobacterium bovis subsp bovis AF2122/97
cgaccaccgccggcccgcgggc

SEQ ID NO: 3050458 - RNA, 18 nt, Mycobacterium bovis subsp bovis AF2122/97
cgaccaccgcgaaagcac

SEQ ID NO: 3050459 - RNA, 12 nt, Mycobacterium bovis subsp bovis AF2122/97
cgaccaccgcgg

SEQ ID NO: 3050460 - RNA, 16 nt, Mycobacterium bovis subsp bovis AF2122/97
cgaccaccgcggcugc

SEQ ID NO: 3050461 - RNA, 17 nt, Mycobacterium bovis subsp bovis AF2122/97
cgaccaccgcggcugcu

SEQ ID NO: 3050462 - RNA, 20 nt, Mycobacterium bovis subsp bovis AF2122/97
cgaccaccgcggcugcuccg

SEQ ID NO: 3050463 - RNA, 22 nt, Mycobacterium bovis subsp bovis AF2122/97
cgaccaccgcgucgggccgcaa

SEQ ID NO: 3050464 - RNA, 17 nt, Mycobacterium bovis subsp bovis AF2122/97
cgaccaccggaucgccg

SEQ ID NO: 3050465 - RNA, 22 nt, Mycobacterium bovis subsp bovis AF2122/97
cgaccaccggaucgccgucggc

SEQ ID NO: 3050466 - RNA, 18 nt, Mycobacterium bovis subsp bovis AF2122/97
cgaccaccggguagccgg

SEQ ID NO: 3050467 - RNA, 13 nt, Mycobacterium bovis subsp bovis AF2122/97
cgaccaccgucac

SEQ ID NO: 3050468 - RNA, 18 nt, Mycobacterium bovis subsp bovis AF2122/97
cgaccaccguuugagcgg

SEQ ID NO: 3050469 - RNA, 20 nt, Mycobacterium bovis subsp bovis AF2122/97
cgaccaccuucugacgcggc

SEQ ID NO: 3050470 - RNA, 16 nt, Mycobacterium bovis subsp bovis AF2122/97
cgaccacgcaccgccc

SEQ ID NO: 3050471 - RNA, 14 nt, Mycobacterium bovis subsp bovis AF2122/97
cgaccacgccgccg

SEQ ID NO: 3050472 - RNA, 15 nt, Mycobacterium bovis subsp bovis AF2122/97
cgaccacgccgccgg

SEQ ID NO: 3050473 - RNA, 16 nt, Mycobacterium bovis subsp bovis AF2122/97
cgaccacgccgccggc

SEQ ID NO: 3050474 - RNA, 19 nt, Mycobacterium bovis subsp bovis AF2122/97
cgaccacggcaccgaucaa

SEQ ID NO: 3050475 - RNA, 16 nt, Mycobacterium bovis subsp bovis AF2122/97
cgaccacggucugcca

SEQ ID NO: 3050476 - RNA, 18 nt, Mycobacterium bovis subsp bovis AF2122/97
cgaccacggucugccacg

SEQ ID NO: 3050477 - RNA, 22 nt, Mycobacterium bovis subsp bovis AF2122/97
cgaccacgucggcgaacgcguc

SEQ ID NO: 3050478 - RNA, 14 nt, Mycobacterium bovis subsp bovis AF2122/97
cgaccacuagccca

SEQ ID NO: 3050479 - RNA, 14 nt, Mycobacterium bovis subsp bovis AF2122/97
cgaccacuccacgc

SEQ ID NO: 3050480 - RNA, 18 nt, Mycobacterium bovis subsp bovis AF2122/97
cgaccacuccacgcagcc

SEQ ID NO: 3050481 - RNA, 20 nt, Mycobacterium bovis subsp bovis AF2122/97
cgaccacucgagcgcucaca

SEQ ID NO: 3050482 - RNA, 14 nt, Mycobacterium bovis subsp bovis AF2122/97
cgaccacugcccgg

SEQ ID NO: 3050483 - RNA, 18 nt, Mycobacterium bovis subsp bovis AF2122/97
cgaccagaaucgggccga

SEQ ID NO: 3050484 - RNA, 20 nt, Mycobacterium bovis subsp bovis AF2122/97
cgaccagaaucucgccgggc

SEQ ID NO: 3050485 - RNA, 23 nt, Mycobacterium bovis subsp bovis AF2122/97
cgaccagaaucucgccgggcugc

SEQ ID NO: 3050486 - RNA, 19 nt, Mycobacterium bovis subsp bovis AF2122/97
cgaccagagccgcgagcac

SEQ ID NO: 3050487 - RNA, 21 nt, Mycobacterium bovis subsp bovis AF2122/97
cgaccagagcuucgccgcgca

SEQ ID NO: 3050488 - RNA, 21 nt, Mycobacterium bovis subsp bovis AF2122/97
cgaccagaggcgugucgacuc

SEQ ID NO: 3050489 - RNA, 22 nt, Mycobacterium bovis subsp bovis AF2122/97
cgaccagaggcgugucgacucc

SEQ ID NO: 3050490 - RNA, 15 nt, Mycobacterium bovis subsp bovis AF2122/97
cgaccagcacaccgg

SEQ ID NO: 3050491 - RNA, 13 nt, Mycobacterium bovis subsp bovis AF2122/97
cgaccagcaccag

SEQ ID NO: 3050492 - RNA, 21 nt, Mycobacterium bovis subsp bovis AF2122/97
cgaccagcaccagaaccggug

SEQ ID NO: 3050493 - RNA, 14 nt, Mycobacterium bovis subsp bovis AF2122/97
cgaccagcacccgc

SEQ ID NO: 3050494 - RNA, 21 nt, Mycobacterium bovis subsp bovis AF2122/97
cgaccagcacccgcucggccg

SEQ ID NO: 3050495 - RNA, 23 nt, Mycobacterium bovis subsp bovis AF2122/97
cgaccagcacccgcucggccgcc

SEQ ID NO: 3050496 - RNA, 18 nt, Mycobacterium bovis subsp bovis AF2122/97
cgacccgccgcgcccggc

SEQ ID NO: 3050497 - RNA, 20 nt, Mycobacterium bovis subsp bovis AF2122/97
cgacccgccuguaccggcgu

SEQ ID NO: 3050498 - RNA, 15 nt, Mycobacterium bovis subsp bovis AF2122/97
cgacccgcgcgccgg

SEQ ID NO: 3050499 - RNA, 16 nt, Mycobacterium bovis subsp bovis AF2122/97
cgacccgcgcgccggc

SEQ ID NO: 3050500 - RNA, 20 nt, Mycobacterium bovis subsp bovis AF2122/97
cgacccgcgcgccggcgacc

SEQ ID NO: 3050501 - RNA, 19 nt, Mycobacterium bovis subsp bovis AF2122/97
cgacccggaccugggcgac

SEQ ID NO: 3050502 - RNA, 23 nt, Mycobacterium bovis subsp bovis AF2122/97
cgacccggccaagggugcuuguc

SEQ ID NO: 3050503 - RNA, 18 nt, Mycobacterium bovis subsp bovis AF2122/97
cgacccggccagcggcag

SEQ ID NO: 3050504 - RNA, 18 nt, Mycobacterium bovis subsp bovis AF2122/97
cgacccggcccagcgccc

SEQ ID NO: 3050505 - RNA, 13 nt, Mycobacterium bovis subsp bovis AF2122/97
cgacccggccgcu

SEQ ID NO: 3050506 - RNA, 18 nt, Mycobacterium bovis subsp bovis AF2122/97
cgacccgggaaggaaccg

SEQ ID NO: 3050507 - RNA, 19 nt, Mycobacterium bovis subsp bovis AF2122/97
cgacccgggaaggaaccgg

SEQ ID NO: 3050508 - RNA, 20 nt, Mycobacterium bovis subsp bovis AF2122/97
cgacccgggaaggaaccggg

SEQ ID NO: 3050509 - RNA, 11 nt, Mycobacterium bovis subsp bovis AF2122/97
cgacccgggcc

SEQ ID NO: 3050510 - RNA, 13 nt, Mycobacterium bovis subsp bovis AF2122/97
cgacccgggccgc

SEQ ID NO: 3050511 - RNA, 20 nt, Mycobacterium bovis subsp bovis AF2122/97
cgacccgggccgcggcggcc

SEQ ID NO: 3050512 - RNA, 21 nt, Mycobacterium bovis subsp bovis AF2122/97
cgacccgggccgcggcggcca

SEQ ID NO: 3050513 - RNA, 23 nt, Mycobacterium bovis subsp bovis AF2122/97
cgacccgggccgcggcggccagc

SEQ ID NO: 3050514 - RNA, 19 nt, Mycobacterium bovis subsp bovis AF2122/97
cgacccgggccggucggug

SEQ ID NO: 3050515 - RNA, 12 nt, Mycobacterium bovis subsp bovis AF2122/97
cgacccgggcga

SEQ ID NO: 3050516 - RNA, 15 nt, Mycobacterium bovis subsp bovis AF2122/97
cgacccgggcgagcg

SEQ ID NO: 3050517 - RNA, 14 nt, Mycobacterium bovis subsp bovis AF2122/97
cgacccgggcgucc

SEQ ID NO: 3050518 - RNA, 17 nt, Mycobacterium bovis subsp bovis AF2122/97
cgacccgggggcgcccg

SEQ ID NO: 3050519 - RNA, 22 nt, Mycobacterium bovis subsp bovis AF2122/97
cgacccgggucggcacgacccg

SEQ ID NO: 3050520 - RNA, 23 nt, Mycobacterium bovis subsp bovis AF2122/97
cgacccgggucggcacgacccgg

SEQ ID NO: 3050521 - RNA, 12 nt, Mycobacterium bovis subsp bovis AF2122/97
cgacccggucac

SEQ ID NO: 3050522 - RNA, 15 nt, Mycobacterium bovis subsp bovis AF2122/97
cgacccgguccacgc

SEQ ID NO: 3050523 - RNA, 23 nt, Mycobacterium bovis subsp bovis AF2122/97
cgacccggucgacgggucggcgc

SEQ ID NO: 3050524 - RNA, 14 nt, Mycobacterium bovis subsp bovis AF2122/97
cgacccguaccagc

SEQ ID NO: 3050525 - RNA, 22 nt, Mycobacterium bovis subsp bovis AF2122/97
cgacccguccaacuacgccagc

SEQ ID NO: 3050526 - RNA, 19 nt, Mycobacterium bovis subsp bovis AF2122/97
cgacccgucccccgcacgc

SEQ ID NO: 3050527 - RNA, 18 nt, Mycobacterium bovis subsp bovis AF2122/97
cgacccgucgaacgcgcg

SEQ ID NO: 3050528 - RNA, 16 nt, Mycobacterium bovis subsp bovis AF2122/97
cgacccguucucggug

SEQ ID NO: 3050529 - RNA, 22 nt, Mycobacterium bovis subsp bovis AF2122/97
cgacccguugaacucgaagacc

SEQ ID NO: 3050530 - RNA, 23 nt, Mycobacterium bovis subsp bovis AF2122/97
cgacccuacuuccucgacgagca

SEQ ID NO: 3050531 - RNA, 21 nt, Mycobacterium bovis subsp bovis AF2122/97
cgacccuagauaugcacccgc

SEQ ID NO: 3050532 - RNA, 22 nt, Mycobacterium bovis subsp bovis AF2122/97
cgacccuagauaugcacccgca

SEQ ID NO: 3050533 - RNA, 23 nt, Mycobacterium bovis subsp bovis AF2122/97
cgacccuagauaugcacccgcac

SEQ ID NO: 3050534 - RNA, 12 nt, Mycobacterium bovis subsp bovis AF2122/97
cgacccuccagc

SEQ ID NO: 3050535 - RNA, 20 nt, Mycobacterium bovis subsp bovis AF2122/97
cgacccugcccagcaccccc

SEQ ID NO: 3050536 - RNA, 20 nt, Mycobacterium bovis subsp bovis AF2122/97
cgacccuucgggcuggucgg

SEQ ID NO: 3050537 - RNA, 24 nt, Mycobacterium bovis subsp bovis AF2122/97
cgaccgaaacggggcgacguccgc

SEQ ID NO: 3050538 - RNA, 21 nt, Mycobacterium bovis subsp bovis AF2122/97
cgaccgaaucagcacggugug

SEQ ID NO: 3050539 - RNA, 14 nt, Mycobacterium bovis subsp bovis AF2122/97
cgaccgacaccacc

SEQ ID NO: 3050540 - RNA, 16 nt, Mycobacterium bovis subsp bovis AF2122/97
cgaccgacaccaccag

SEQ ID NO: 3050541 - RNA, 12 nt, Mycobacterium bovis subsp bovis AF2122/97
cgaccgaccagc

SEQ ID NO: 3050542 - RNA, 14 nt, Mycobacterium bovis subsp bovis AF2122/97
cgaccgaccagccg

SEQ ID NO: 3050543 - RNA, 16 nt, Mycobacterium bovis subsp bovis AF2122/97
cgaccgaccuggucgg

SEQ ID NO: 3050544 - RNA, 16 nt, Mycobacterium bovis subsp bovis AF2122/97
cgaccgacgccggugu

SEQ ID NO: 3050545 - RNA, 12 nt, Mycobacterium bovis subsp bovis AF2122/97
cgaccgacggac

SEQ ID NO: 3050546 - RNA, 16 nt, Mycobacterium bovis subsp bovis AF2122/97
cgaccgacgucgccca

SEQ ID NO: 3050547 - RNA, 19 nt, Mycobacterium bovis subsp bovis AF2122/97
cgaccgacuuuggccaucu

SEQ ID NO: 3050548 - RNA, 19 nt, Mycobacterium bovis subsp bovis AF2122/97
cgaccgauaacacccgggc

SEQ ID NO: 3050549 - RNA, 17 nt, Mycobacterium bovis subsp bovis AF2122/97
cgaccgauagcuggccg

SEQ ID NO: 3050550 - RNA, 18 nt, Mycobacterium bovis subsp bovis AF2122/97
cgaccgauagcuggccga

SEQ ID NO: 3050551 - RNA, 20 nt, Mycobacterium bovis subsp bovis AF2122/97
cgaccgauagcuggccgaug

SEQ ID NO: 3050552 - RNA, 20 nt, Mycobacterium bovis subsp bovis AF2122/97
cgaccgaucggcgcgucgau

SEQ ID NO: 3050553 - RNA, 16 nt, Mycobacterium bovis subsp bovis AF2122/97
cgaccgcacgaccagc

SEQ ID NO: 3050554 - RNA, 23 nt, Mycobacterium bovis subsp bovis AF2122/97
cgaccgcauccggucucggccga

SEQ ID NO: 3050555 - RNA, 18 nt, Mycobacterium bovis subsp bovis AF2122/97
cgaccgcauugaacagcg

SEQ ID NO: 3050556 - RNA, 12 nt, Mycobacterium bovis subsp bovis AF2122/97
cgaccgccaccg

SEQ ID NO: 3050557 - RNA, 16 nt, Mycobacterium bovis subsp bovis AF2122/97
cgaccgccaccgccag

SEQ ID NO: 3050558 - RNA, 13 nt, Mycobacterium bovis subsp bovis AF2122/97
cgaccgccagccc

SEQ ID NO: 3050559 - RNA, 15 nt, Mycobacterium bovis subsp bovis AF2122/97
cgaccgccagcccgg

SEQ ID NO: 3050560 - RNA, 19 nt, Mycobacterium bovis subsp bovis AF2122/97
cgaccgccagccgcgagcc

SEQ ID NO: 3050561 - RNA, 22 nt, Mycobacterium bovis subsp bovis AF2122/97
cgaccgccagccgcgagccggu

SEQ ID NO: 3050562 - RNA, 15 nt, Mycobacterium bovis subsp bovis AF2122/97
cgaccgccagcgugg

SEQ ID NO: 3050563 - RNA, 17 nt, Mycobacterium bovis subsp bovis AF2122/97
cgaccgccaucacgacc

SEQ ID NO: 3050564 - RNA, 18 nt, Mycobacterium bovis subsp bovis AF2122/97
cgaccgccaucacgacca

SEQ ID NO: 3050565 - RNA, 24 nt, Mycobacterium bovis subsp bovis AF2122/97
cgaccgcccuagcgagcggcacca

SEQ ID NO: 3050566 - RNA, 15 nt, Mycobacterium bovis subsp bovis AF2122/97
cgaccgccgagcggg

SEQ ID NO: 3050567 - RNA, 16 nt, Mycobacterium bovis subsp bovis AF2122/97
cgaccgccgagcgggu

SEQ ID NO: 3050568 - RNA, 18 nt, Mycobacterium bovis subsp bovis AF2122/97
cgaccgccgcuaccccag

SEQ ID NO: 3050569 - RNA, 18 nt, Mycobacterium bovis subsp bovis AF2122/97
cgaccgccggaccgccgc

SEQ ID NO: 3050570 - RNA, 14 nt, Mycobacterium bovis subsp bovis AF2122/97
cgaccgccguggcc

SEQ ID NO: 3050571 - RNA, 12 nt, Mycobacterium bovis subsp bovis AF2122/97
cgaccgccuccu

SEQ ID NO: 3050572 - RNA, 23 nt, Mycobacterium bovis subsp bovis AF2122/97
cgaccgcgacaacaacucuucgg

SEQ ID NO: 3050573 - RNA, 18 nt, Mycobacterium bovis subsp bovis AF2122/97
cgaccgcgacccggccca

SEQ ID NO: 3050574 - RNA, 21 nt, Mycobacterium bovis subsp bovis AF2122/97
cgaccgcgagggccagcaagu

SEQ ID NO: 3050575 - RNA, 14 nt, Mycobacterium bovis subsp bovis AF2122/97
cgaccgcgcacggc

SEQ ID NO: 3050576 - RNA, 19 nt, Mycobacterium bovis subsp bovis AF2122/97
cgaccgcgccauagcagag

SEQ ID NO: 3050577 - RNA, 14 nt, Mycobacterium bovis subsp bovis AF2122/97
cgaccgcgcccgcg

SEQ ID NO: 3050578 - RNA, 13 nt, Mycobacterium bovis subsp bovis AF2122/97
cgaccgcgccgca

SEQ ID NO: 3050579 - RNA, 15 nt, Mycobacterium bovis subsp bovis AF2122/97
cgaccgcgcggcacu

SEQ ID NO: 3050580 - RNA, 14 nt, Mycobacterium bovis subsp bovis AF2122/97
cgaccgcgcucacc

SEQ ID NO: 3050581 - RNA, 15 nt, Mycobacterium bovis subsp bovis AF2122/97
cgaccgcggccccgc

SEQ ID NO: 3050582 - RNA, 17 nt, Mycobacterium bovis subsp bovis AF2122/97
cgaccgugcugggcgcc

SEQ ID NO: 3050583 - RNA, 15 nt, Mycobacterium bovis subsp bovis AF2122/97
cgaccguggcggccu

SEQ ID NO: 3050584 - RNA, 17 nt, Mycobacterium bovis subsp bovis AF2122/97
cgaccguggcggccucc

SEQ ID NO: 3050585 - RNA, 15 nt, Mycobacterium bovis subsp bovis AF2122/97
cgaccguggcugcgc

SEQ ID NO: 3050586 - RNA, 18 nt, Mycobacterium bovis subsp bovis AF2122/97
cgaccgugguggucgggc

SEQ ID NO: 3050587 - RNA, 19 nt, Mycobacterium bovis subsp bovis AF2122/97
cgaccgugguggucgggcg

SEQ ID NO: 3050588 - RNA, 22 nt, Mycobacterium bovis subsp bovis AF2122/97
cgaccgugguggucgggcgcaa

SEQ ID NO: 3050589 - RNA, 18 nt, Mycobacterium bovis subsp bovis AF2122/97
cgaccgugucaccgccgg

SEQ ID NO: 3050590 - RNA, 20 nt, Mycobacterium bovis subsp bovis AF2122/97
cgaccgugucaccgccggga

SEQ ID NO: 3050591 - RNA, 19 nt, Mycobacterium bovis subsp bovis AF2122/97
cgaccguuucuccgccgcc

SEQ ID NO: 3050592 - RNA, 22 nt, Mycobacterium bovis subsp bovis AF2122/97
cgaccuaaagaucguugccucg

SEQ ID NO: 3050593 - RNA, 17 nt, Mycobacterium bovis subsp bovis AF2122/97
cgaccuaccgucgacca

SEQ ID NO: 3050594 - RNA, 17 nt, Mycobacterium bovis subsp bovis AF2122/97
cgaccuacugcggucgc

SEQ ID NO: 3050595 - RNA, 18 nt, Mycobacterium bovis subsp bovis AF2122/97
cgaccuacugcggucgcc

SEQ ID NO: 3050596 - RNA, 20 nt, Mycobacterium bovis subsp bovis AF2122/97
cgaccuagcagcgcugcgau

SEQ ID NO: 3050597 - RNA, 14 nt, Mycobacterium bovis subsp bovis AF2122/97
cgaccuagcucgcg

SEQ ID NO: 3050598 - RNA, 15 nt, Mycobacterium bovis subsp bovis AF2122/97
cgaccucacugcggc

SEQ ID NO: 3050599 - RNA, 18 nt, Mycobacterium bovis subsp bovis AF2122/97
cgaccucacugcggcgcc

SEQ ID NO: 3050600 - RNA, 21 nt, Mycobacterium bovis subsp bovis AF2122/97
cgaccuccaccaaugcuccug

SEQ ID NO: 3050601 - RNA, 14 nt, Mycobacterium bovis subsp bovis AF2122/97
cgaccuccacgccc

SEQ ID NO: 3050602 - RNA, 18 nt, Mycobacterium bovis subsp bovis AF2122/97
cgaccuccacgcccuggc

SEQ ID NO: 3050603 - RNA, 20 nt, Mycobacterium bovis subsp bovis AF2122/97
cgaccuccggaaucgcccgg

SEQ ID NO: 3050604 - RNA, 20 nt, Mycobacterium bovis subsp bovis AF2122/97
cgaccuccucgaugaccggc

SEQ ID NO: 3050605 - RNA, 22 nt, Mycobacterium bovis subsp bovis AF2122/97
cgaccuccucgaugaccggcga

SEQ ID NO: 3050606 - RNA, 14 nt, Mycobacterium bovis subsp bovis AF2122/97
cgaccucgccgcgc

SEQ ID NO: 3050607 - RNA, 15 nt, Mycobacterium bovis subsp bovis AF2122/97
cgaccucgcggcgcu

SEQ ID NO: 3050608 - RNA, 16 nt, Mycobacterium bovis subsp bovis AF2122/97
cgaccucgcgggcgau

SEQ ID NO: 3050609 - RNA, 15 nt, Mycobacterium bovis subsp bovis AF2122/97
cgaccucgcuggccg

SEQ ID NO: 3050610 - RNA, 18 nt, Mycobacterium bovis subsp bovis AF2122/97
cgaccucgggaucggcgg

SEQ ID NO: 3050611 - RNA, 22 nt, Mycobacterium bovis subsp bovis AF2122/97
cgaccucgucggccgacaccgc

SEQ ID NO: 3050612 - RNA, 20 nt, Mycobacterium bovis subsp bovis AF2122/97
cgaccucguucgucaccacg

SEQ ID NO: 3050613 - RNA, 15 nt, Mycobacterium bovis subsp bovis AF2122/97
cgaccugaggcaccu

SEQ ID NO: 3050614 - RNA, 13 nt, Mycobacterium bovis subsp bovis AF2122/97
cgaccugcgcgac

SEQ ID NO: 3050615 - RNA, 14 nt, Mycobacterium bovis subsp bovis AF2122/97
cgaccugcgcgagg

SEQ ID NO: 3050616 - RNA, 19 nt, Mycobacterium bovis subsp bovis AF2122/97
cgaccugcgcgagguuggc

SEQ ID NO: 3050617 - RNA, 23 nt, Mycobacterium bovis subsp bovis AF2122/97
cgaccugcgcgagguuggcguug

SEQ ID NO: 3050618 - RNA, 12 nt, Mycobacterium bovis subsp bovis AF2122/97
cgaccugcucgc

SEQ ID NO: 3050619 - RNA, 14 nt, Mycobacterium bovis subsp bovis AF2122/97
cgaccugcucgcug

SEQ ID NO: 3050620 - RNA, 20 nt, Mycobacterium bovis subsp bovis AF2122/97
cgaccugcuggaucucggug

SEQ ID NO: 3050621 - RNA, 21 nt, Mycobacterium bovis subsp bovis AF2122/97
cgaccuggacaaccucgucga

SEQ ID NO: 3050622 - RNA, 23 nt, Mycobacterium bovis subsp bovis AF2122/97
cgaccuggacaaccucgucgauc

SEQ ID NO: 3050623 - RNA, 18 nt, Mycobacterium bovis subsp bovis AF2122/97
cgaccuggauugccacca

SEQ ID NO: 3050624 - RNA, 22 nt, Mycobacterium bovis subsp bovis AF2122/97
cgaccugggacaguucgcgccg

SEQ ID NO: 3050625 - RNA, 13 nt, Mycobacterium bovis subsp bovis AF2122/97
cgaccugguggac

SEQ ID NO: 3050626 - RNA, 14 nt, Mycobacterium bovis subsp bovis AF2122/97
cgaccuguccaccc

SEQ ID NO: 3050627 - RNA, 15 nt, Mycobacterium bovis subsp bovis AF2122/97
cgaccuguugucgug

SEQ ID NO: 3050628 - RNA, 17 nt, Mycobacterium bovis subsp bovis AF2122/97
cgaccuucaccgcgugu

SEQ ID NO: 3050629 - RNA, 18 nt, Mycobacterium bovis subsp bovis AF2122/97
cgaccuucgggacaaagc

SEQ ID NO: 3050630 - RNA, 22 nt, Mycobacterium bovis subsp bovis AF2122/97
cgaccuucgggacaaagccgaa

SEQ ID NO: 3050631 - RNA, 20 nt, Mycobacterium bovis subsp bovis AF2122/97
cgaccuucucgaugcugacg

SEQ ID NO: 3050632 - RNA, 21 nt, Mycobacterium bovis subsp bovis AF2122/97
cgaccuucucgaugcugacga

SEQ ID NO: 3050633 - RNA, 22 nt, Mycobacterium bovis subsp bovis AF2122/97
cgaccuuggacacuugaagugu

SEQ ID NO: 3050634 - RNA, 18 nt, Mycobacterium bovis subsp bovis AF2122/97
cgaccuuuugcggcaagc

SEQ ID NO: 3050635 - RNA, 15 nt, Mycobacterium bovis subsp bovis AF2122/97
cgacgaaaggcgcgu

SEQ ID NO: 3050636 - RNA, 17 nt, Mycobacterium bovis subsp bovis AF2122/97
cgacgaaaggcgcguug

SEQ ID NO: 3050637 - RNA, 16 nt, Mycobacterium bovis subsp bovis AF2122/97
cgacgaacaccagcgc

SEQ ID NO: 3050638 - RNA, 20 nt, Mycobacterium bovis subsp bovis AF2122/97
cgacgaacaccagcgcgccg

SEQ ID NO: 3050639 - RNA, 21 nt, Mycobacterium bovis subsp bovis AF2122/97
cgacgaacaccagcgcgccgu

SEQ ID NO: 3050640 - RNA, 19 nt, Mycobacterium bovis subsp bovis AF2122/97
cgacgaacaccccgggcgc

SEQ ID NO: 3050641 - RNA, 20 nt, Mycobacterium bovis subsp bovis AF2122/97
cgacgaacaccccgggcgcc

SEQ ID NO: 3050642 - RNA, 14 nt, Mycobacterium bovis subsp bovis AF2122/97
cgacgaacagcggu

SEQ ID NO: 3050643 - RNA, 12 nt, Mycobacterium bovis subsp bovis AF2122/97
cgacgaaccgga

SEQ ID NO: 3050644 - RNA, 16 nt, Mycobacterium bovis subsp bovis AF2122/97
cgacgaaccucggcgg

SEQ ID NO: 3050645 - RNA, 21 nt, Mycobacterium bovis subsp bovis AF2122/97
cgacgaacgaaccgccgccgc

SEQ ID NO: 3050646 - RNA, 21 nt, Mycobacterium bovis subsp bovis AF2122/97
cgacgaacuagguucagcgac

SEQ ID NO: 3050647 - RNA, 22 nt, Mycobacterium bovis subsp bovis AF2122/97
cgacgaacuagguucagcgacu

SEQ ID NO: 3050648 - RNA, 17 nt, Mycobacterium bovis subsp bovis AF2122/97
cgacgaacuccgcguug

SEQ ID NO: 3050649 - RNA, 13 nt, Mycobacterium bovis subsp bovis AF2122/97
cgacgaacucgcc

SEQ ID NO: 3050650 - RNA, 16 nt, Mycobacterium bovis subsp bovis AF2122/97
cgacgaacucgcccag

SEQ ID NO: 3050651 - RNA, 14 nt, Mycobacterium bovis subsp bovis AF2122/97
cgacgaacugcagc

SEQ ID NO: 3050652 - RNA, 17 nt, Mycobacterium bovis subsp bovis AF2122/97
cgacgaacugcagccau

SEQ ID NO: 3050653 - RNA, 13 nt, Mycobacterium bovis subsp bovis AF2122/97
cgacgaagaucgc

SEQ ID NO: 3050654 - RNA, 17 nt, Mycobacterium bovis subsp bovis AF2122/97
cgacgaagaucgcgugc

SEQ ID NO: 3050655 - RNA, 16 nt, Mycobacterium bovis subsp bovis AF2122/97
cgacgaagaucgcugc

SEQ ID NO: 3050656 - RNA, 18 nt, Mycobacterium bovis subsp bovis AF2122/97
cgacgaagaucgcugcga

SEQ ID NO: 3050657 - RNA, 15 nt, Mycobacterium bovis subsp bovis AF2122/97
cgacgaaggcgacgg

SEQ ID NO: 3050658 - RNA, 14 nt, Mycobacterium bovis subsp bovis AF2122/97
cgacgaagguggcg

SEQ ID NO: 3050659 - RNA, 13 nt, Mycobacterium bovis subsp bovis AF2122/97
cgacgaagucgca

SEQ ID NO: 3050660 - RNA, 18 nt, Mycobacterium bovis subsp bovis AF2122/97
cgacgaauaacgcggucg

SEQ ID NO: 3050661 - RNA, 21 nt, Mycobacterium bovis subsp bovis AF2122/97
cgacgaauaacgcggucggca

SEQ ID NO: 3050662 - RNA, 17 nt, Mycobacterium bovis subsp bovis AF2122/97
cgacgaauaccgggaug

SEQ ID NO: 3050663 - RNA, 20 nt, Mycobacterium bovis subsp bovis AF2122/97
cgacgaauaccgggaugcga

SEQ ID NO: 3050664 - RNA, 16 nt, Mycobacterium bovis subsp bovis AF2122/97
cgacgaaucggcaacg

SEQ ID NO: 3050665 - RNA, 14 nt, Mycobacterium bovis subsp bovis AF2122/97
cgacgaauguccgc

SEQ ID NO: 3050666 - RNA, 14 nt, Mycobacterium bovis subsp bovis AF2122/97
cgacgacaaccggc

SEQ ID NO: 3050667 - RNA, 17 nt, Mycobacterium bovis subsp bovis AF2122/97
cgacgacaaccggccag

SEQ ID NO: 3050668 - RNA, 13 nt, Mycobacterium bovis subsp bovis AF2122/97
cgacgccgcgguc

SEQ ID NO: 3050669 - RNA, 21 nt, Mycobacterium bovis subsp bovis AF2122/97
cgacgccgcucccgcacaagc

SEQ ID NO: 3050670 - RNA, 21 nt, Mycobacterium bovis subsp bovis AF2122/97
cgacgccgcuggagaucacgc

SEQ ID NO: 3050671 - RNA, 14 nt, Mycobacterium bovis subsp bovis AF2122/97
cgacgccggccagc

SEQ ID NO: 3050672 - RNA, 19 nt, Mycobacterium bovis subsp bovis AF2122/97
cgacgccggccagcggcca

SEQ ID NO: 3050673 - RNA, 20 nt, Mycobacterium bovis subsp bovis AF2122/97
cgacgccggccagcggccau

SEQ ID NO: 3050674 - RNA, 16 nt, Mycobacterium bovis subsp bovis AF2122/97
cgacgccggcccgacg

SEQ ID NO: 3050675 - RNA, 12 nt, Mycobacterium bovis subsp bovis AF2122/97
cgacgccggccu

SEQ ID NO: 3050676 - RNA, 17 nt, Mycobacterium bovis subsp bovis AF2122/97
cgacgccggccuggccg

SEQ ID NO: 3050677 - RNA, 19 nt, Mycobacterium bovis subsp bovis AF2122/97
cgacgccggccuggccgcc

SEQ ID NO: 3050678 - RNA, 13 nt, Mycobacterium bovis subsp bovis AF2122/97
cgacgccggucac

SEQ ID NO: 3050679 - RNA, 12 nt, Mycobacterium bovis subsp bovis AF2122/97
cgacgccggugc

SEQ ID NO: 3050680 - RNA, 14 nt, Mycobacterium bovis subsp bovis AF2122/97
cgacgccgguggca

SEQ ID NO: 3050681 - RNA, 23 nt, Mycobacterium bovis subsp bovis AF2122/97
cgacgccgguggcagagccgccg

SEQ ID NO: 3050682 - RNA, 22 nt, Mycobacterium bovis subsp bovis AF2122/97
cgacgccgguggggucggucug

SEQ ID NO: 3050683 - RNA, 21 nt, Mycobacterium bovis subsp bovis AF2122/97
cgacgccggugucggcugguc

SEQ ID NO: 3050684 - RNA, 22 nt, Mycobacterium bovis subsp bovis AF2122/97
cgacgccggugucggcuggucg

SEQ ID NO: 3050685 - RNA, 19 nt, Mycobacterium bovis subsp bovis AF2122/97
cgacgccugggcacggccg

SEQ ID NO: 3050686 - RNA, 17 nt, Mycobacterium bovis subsp bovis AF2122/97
cgacgccuugucggcgu

SEQ ID NO: 3050687 - RNA, 18 nt, Mycobacterium bovis subsp bovis AF2122/97
cgacgccuugucggcgug

SEQ ID NO: 3050688 - RNA, 16 nt, Mycobacterium bovis subsp bovis AF2122/97
cgacgcgaacgcggcc

SEQ ID NO: 3050689 - RNA, 13 nt, Mycobacterium bovis subsp bovis AF2122/97
cgacgcgaagcua

SEQ ID NO: 3050690 - RNA, 15 nt, Mycobacterium bovis subsp bovis AF2122/97
cgacgcgacacacgc

SEQ ID NO: 3050691 - RNA, 20 nt, Mycobacterium bovis subsp bovis AF2122/97
cgacgcgacacacgccgccg

SEQ ID NO: 3050692 - RNA, 17 nt, Mycobacterium bovis subsp bovis AF2122/97
cgacgcgacacgccgau

SEQ ID NO: 3050693 - RNA, 16 nt, Mycobacterium bovis subsp bovis AF2122/97
cgacgcgacacgccgg

SEQ ID NO: 3050694 - RNA, 19 nt, Mycobacterium bovis subsp bovis AF2122/97
cgacgcgacacgccggcgg

SEQ ID NO: 3050695 - RNA, 19 nt, Mycobacterium bovis subsp bovis AF2122/97
cgacgcgaucuguccgcga

SEQ ID NO: 3050696 - RNA, 21 nt, Mycobacterium bovis subsp bovis AF2122/97
cgacgcgaucuguccgcgaac

SEQ ID NO: 3050697 - RNA, 19 nt, Mycobacterium bovis subsp bovis AF2122/97
cgacgcgcaucgcacgggc

SEQ ID NO: 3050698 - RNA, 19 nt, Mycobacterium bovis subsp bovis AF2122/97
cgacgcgcauucgccgggc

SEQ ID NO: 3050699 - RNA, 13 nt, Mycobacterium bovis subsp bovis AF2122/97
cgacgcgcccgcg

SEQ ID NO: 3050700 - RNA, 11 nt, Mycobacterium bovis subsp bovis AF2122/97
cgacgcgccgg

SEQ ID NO: 3050701 - RNA, 17 nt, Mycobacterium bovis subsp bovis AF2122/97
cgacgcgcgcgauggac

SEQ ID NO: 3050702 - RNA, 14 nt, Mycobacterium bovis subsp bovis AF2122/97
cgacgcgcggccag

SEQ ID NO: 3050703 - RNA, 17 nt, Mycobacterium bovis subsp bovis AF2122/97
cgacgcgcggccagccc

SEQ ID NO: 3050704 - RNA, 18 nt, Mycobacterium bovis subsp bovis AF2122/97
cgacgcgcggccagccca

SEQ ID NO: 3050705 - RNA, 15 nt, Mycobacterium bovis subsp bovis AF2122/97
cgacgcgcucggcga

SEQ ID NO: 3050706 - RNA, 15 nt, Mycobacterium bovis subsp bovis AF2122/97
cgacgcgcucgggcg

SEQ ID NO: 3050707 - RNA, 22 nt, Mycobacterium bovis subsp bovis AF2122/97
cgacgcgcucgggcgagaucuu

SEQ ID NO: 3050708 - RNA, 17 nt, Mycobacterium bovis subsp bovis AF2122/97
cgacgcggccagcggca

SEQ ID NO: 3050709 - RNA, 20 nt, Mycobacterium bovis subsp bovis AF2122/97
cgacgcggccagcggcaagg

SEQ ID NO: 3050710 - RNA, 15 nt, Mycobacterium bovis subsp bovis AF2122/97
cgacgcggccggccg

SEQ ID NO: 3050711 - RNA, 16 nt, Mycobacterium bovis subsp bovis AF2122/97
cgacgcggccggccgc

SEQ ID NO: 3050712 - RNA, 17 nt, Mycobacterium bovis subsp bovis AF2122/97
cgacgcggccggccgcc

SEQ ID NO: 3050713 - RNA, 15 nt, Mycobacterium bovis subsp bovis AF2122/97
cgacgcggcgccgcc

SEQ ID NO: 3050714 - RNA, 20 nt, Mycobacterium bovis subsp bovis AF2122/97
cgacgcggcgccgccaucaa

SEQ ID NO: 3050715 - RNA, 15 nt, Mycobacterium bovis subsp bovis AF2122/97
cgacgcggucaucga

SEQ ID NO: 3050716 - RNA, 16 nt, Mycobacterium bovis subsp bovis AF2122/97
cgacgcggucggcggc

SEQ ID NO: 3050717 - RNA, 20 nt, Mycobacterium bovis subsp bovis AF2122/97
cgacgcggucggcggccgcc

SEQ ID NO: 3050718 - RNA, 19 nt, Mycobacterium bovis subsp bovis AF2122/97
cgacgcguccggugcacca

SEQ ID NO: 3050719 - RNA, 14 nt, Mycobacterium bovis subsp bovis AF2122/97
cgacgcgucggcga

SEQ ID NO: 3050720 - RNA, 21 nt, Mycobacterium bovis subsp bovis AF2122/97
cgacgcgucggcgacgcggag

SEQ ID NO: 3050721 - RNA, 18 nt, Mycobacterium bovis subsp bovis AF2122/97
cgacgcgucguggucggc

SEQ ID NO: 3050722 - RNA, 20 nt, Mycobacterium bovis subsp bovis AF2122/97
cgacgcgucguggucggcga

SEQ ID NO: 3050723 - RNA, 22 nt, Mycobacterium bovis subsp bovis AF2122/97
cgacgcguggcauccagcagcg

SEQ ID NO: 3050724 - RNA, 17 nt, Mycobacterium bovis subsp bovis AF2122/97
cgacgcgugucugggac

SEQ ID NO: 3050725 - RNA, 17 nt, Mycobacterium bovis subsp bovis AF2122/97
cgacgcguugcucgaaa

SEQ ID NO: 3050726 - RNA, 14 nt, Mycobacterium bovis subsp bovis AF2122/97
cgacgcuaccgccg

SEQ ID NO: 3050727 - RNA, 15 nt, Mycobacterium bovis subsp bovis AF2122/97
cgacgcuaccgccgg

SEQ ID NO: 3050728 - RNA, 16 nt, Mycobacterium bovis subsp bovis AF2122/97
cgacgcucgcugcagc

SEQ ID NO: 3050729 - RNA, 15 nt, Mycobacterium bovis subsp bovis AF2122/97
cgacgcugccgccag

SEQ ID NO: 3050730 - RNA, 16 nt, Mycobacterium bovis subsp bovis AF2122/97
cgacgcugccgccagg

SEQ ID NO: 3050731 - RNA, 23 nt, Mycobacterium bovis subsp bovis AF2122/97
cgacgcugccgccaggcucgagg

SEQ ID NO: 3050732 - RNA, 12 nt, Mycobacterium bovis subsp bovis AF2122/97
cgacgcuggcgg

SEQ ID NO: 3050733 - RNA, 13 nt, Mycobacterium bovis subsp bovis AF2122/97
cgacgcuggucgg

SEQ ID NO: 3050734 - RNA, 18 nt, Mycobacterium bovis subsp bovis AF2122/97
cgacgcuggucggcggcu

SEQ ID NO: 3050735 - RNA, 18 nt, Mycobacterium bovis subsp bovis AF2122/97
cgacgcuguggcucgacg

SEQ ID NO: 3050736 - RNA, 23 nt, Mycobacterium bovis subsp bovis AF2122/97
cgacgcuguggcucgacgaugcg

SEQ ID NO: 3050737 - RNA, 19 nt, Mycobacterium bovis subsp bovis AF2122/97
cgacgcuuccuggguuggc

SEQ ID NO: 3050738 - RNA, 19 nt, Mycobacterium bovis subsp bovis AF2122/97
cgacgcuuucccgaugacg

SEQ ID NO: 3050739 - RNA, 22 nt, Mycobacterium bovis subsp bovis AF2122/97
cgacgcuuucccgaugacgaag

SEQ ID NO: 3050740 - RNA, 17 nt, Mycobacterium bovis subsp bovis AF2122/97
cgacggaaugucagccg

SEQ ID NO: 3050741 - RNA, 16 nt, Mycobacterium bovis subsp bovis AF2122/97
cgacggacacccuggg

SEQ ID NO: 3050742 - RNA, 16 nt, Mycobacterium bovis subsp bovis AF2122/97
cgacggacuccggccg

SEQ ID NO: 3050743 - RNA, 22 nt, Mycobacterium bovis subsp bovis AF2122/97
cgacggacuccggccggccuag

SEQ ID NO: 3050744 - RNA, 19 nt, Mycobacterium bovis subsp bovis AF2122/97
cgacggacuucccgcgcga

SEQ ID NO: 3050745 - RNA, 18 nt, Mycobacterium bovis subsp bovis AF2122/97
cgacggaguucgacgucg

SEQ ID NO: 3050746 - RNA, 16 nt, Mycobacterium bovis subsp bovis AF2122/97
cgacggaugaucagcg

SEQ ID NO: 3050747 - RNA, 21 nt, Mycobacterium bovis subsp bovis AF2122/97
cgacggcaaaacacaccgaac

SEQ ID NO: 3050748 - RNA, 19 nt, Mycobacterium bovis subsp bovis AF2122/97
cgacggcaagcacgguggc

SEQ ID NO: 3050749 - RNA, 24 nt, Mycobacterium bovis subsp bovis AF2122/97
cgacggcaagcacgguggccgagc

SEQ ID NO: 3050750 - RNA, 22 nt, Mycobacterium bovis subsp bovis AF2122/97
cgacggcacgaucaucggggug

SEQ ID NO: 3050751 - RNA, 12 nt, Mycobacterium bovis subsp bovis AF2122/97
cgacggcagcuc

SEQ ID NO: 3050752 - RNA, 19 nt, Mycobacterium bovis subsp bovis AF2122/97
cgacggcaggcucgggcaa

SEQ ID NO: 3050753 - RNA, 19 nt, Mycobacterium bovis subsp bovis AF2122/97
cgacggcaucaacgcgggc

SEQ ID NO: 3050754 - RNA, 21 nt, Mycobacterium bovis subsp bovis AF2122/97
cgacggggauggagccgguga

SEQ ID NO: 3050755 - RNA, 19 nt, Mycobacterium bovis subsp bovis AF2122/97
cgacggggcggucggccgg

SEQ ID NO: 3050756 - RNA, 21 nt, Mycobacterium bovis subsp bovis AF2122/97
cgacggguucacccugccaga

SEQ ID NO: 3050757 - RNA, 16 nt, Mycobacterium bovis subsp bovis AF2122/97
cgacgguaggcccgcg

SEQ ID NO: 3050758 - RNA, 15 nt, Mycobacterium bovis subsp bovis AF2122/97
cgacggucaacgaca

SEQ ID NO: 3050759 - RNA, 16 nt, Mycobacterium bovis subsp bovis AF2122/97
cgacggucaacgacau

SEQ ID NO: 3050760 - RNA, 18 nt, Mycobacterium bovis subsp bovis AF2122/97
cgacggucaaggugcgcc

SEQ ID NO: 3050761 - RNA, 19 nt, Mycobacterium bovis subsp bovis AF2122/97
cgacggucaaggugcgccg

SEQ ID NO: 3050762 - RNA, 20 nt, Mycobacterium bovis subsp bovis AF2122/97
cgacggucaaggugcgccgc

SEQ ID NO: 3050763 - RNA, 22 nt, Mycobacterium bovis subsp bovis AF2122/97
cgacggucaaggugcgccgcca

SEQ ID NO: 3050764 - RNA, 20 nt, Mycobacterium bovis subsp bovis AF2122/97
cgacggucaccggcgcaccg

SEQ ID NO: 3050765 - RNA, 15 nt, Mycobacterium bovis subsp bovis AF2122/97
cgacggucacggugg

SEQ ID NO: 3050766 - RNA, 22 nt, Mycobacterium bovis subsp bovis AF2122/97
cgacggucacgguggugucagc

SEQ ID NO: 3050767 - RNA, 18 nt, Mycobacterium bovis subsp bovis AF2122/97
cgacggucagguccuggg

SEQ ID NO: 3050768 - RNA, 22 nt, Mycobacterium bovis subsp bovis AF2122/97
cgacggucggcggaaacaaccc

SEQ ID NO: 3050769 - RNA, 19 nt, Mycobacterium bovis subsp bovis AF2122/97
cgacggugaaccaccacuu

SEQ ID NO: 3050770 - RNA, 18 nt, Mycobacterium bovis subsp bovis AF2122/97
cgacggugaccggaucca

SEQ ID NO: 3050771 - RNA, 13 nt, Mycobacterium bovis subsp bovis AF2122/97
cgacggugacgac

SEQ ID NO: 3050772 - RNA, 21 nt, Mycobacterium bovis subsp bovis AF2122/97
cgacggugagggcgucgucga

SEQ ID NO: 3050773 - RNA, 14 nt, Mycobacterium bovis subsp bovis AF2122/97
cgacggugaugggg

SEQ ID NO: 3050774 - RNA, 13 nt, Mycobacterium bovis subsp bovis AF2122/97
cgacggugccacc

SEQ ID NO: 3050775 - RNA, 14 nt, Mycobacterium bovis subsp bovis AF2122/97
cgacggugccaccg

SEQ ID NO: 3050776 - RNA, 15 nt, Mycobacterium bovis subsp bovis AF2122/97
cgacggugccaccgc

SEQ ID NO: 3050777 - RNA, 17 nt, Mycobacterium bovis subsp bovis AF2122/97
cgacggugccaccgcga

SEQ ID NO: 3050778 - RNA, 19 nt, Mycobacterium bovis subsp bovis AF2122/97
cgacggugccaccgcgacg

SEQ ID NO: 3050779 - RNA, 14 nt, Mycobacterium bovis subsp bovis AF2122/97
cgacggugccgucg

SEQ ID NO: 3050780 - RNA, 15 nt, Mycobacterium bovis subsp bovis AF2122/97
cgacggugccgucgg

SEQ ID NO: 3050781 - RNA, 22 nt, Mycobacterium bovis subsp bovis AF2122/97
cgacggugccgucggugccgcg

SEQ ID NO: 3050782 - RNA, 14 nt, Mycobacterium bovis subsp bovis AF2122/97
cgacgguggcgccg

SEQ ID NO: 3050783 - RNA, 18 nt, Mycobacterium bovis subsp bovis AF2122/97
cgacgguggcgccgucgg

SEQ ID NO: 3050784 - RNA, 21 nt, Mycobacterium bovis subsp bovis AF2122/97
cgacgguguaacugcguuggc

SEQ ID NO: 3050785 - RNA, 23 nt, Mycobacterium bovis subsp bovis AF2122/97
cgacgguguagccgccggcagug

SEQ ID NO: 3050786 - RNA, 14 nt, Mycobacterium bovis subsp bovis AF2122/97
cgacgguguccgga

SEQ ID NO: 3050787 - RNA, 18 nt, Mycobacterium bovis subsp bovis AF2122/97
cgacgguucccagcuucc

SEQ ID NO: 3050788 - RNA, 19 nt, Mycobacterium bovis subsp bovis AF2122/97
cgacgguucccagcuuccg

SEQ ID NO: 3050789 - RNA, 17 nt, Mycobacterium bovis subsp bovis AF2122/97
cgacgguuccgccaccg

SEQ ID NO: 3050790 - RNA, 19 nt, Mycobacterium bovis subsp bovis AF2122/97
cgacgguuccgccaccgga

SEQ ID NO: 3050791 - RNA, 21 nt, Mycobacterium bovis subsp bovis AF2122/97
cgacgguuccgccaccggaca

SEQ ID NO: 3050792 - RNA, 21 nt, Mycobacterium bovis subsp bovis AF2122/97
cgacgguuucgaccaccaccc

SEQ ID NO: 3050793 - RNA, 16 nt, Mycobacterium bovis subsp bovis AF2122/97
cgacgguuugcaccgc

SEQ ID NO: 3050794 - RNA, 17 nt, Mycobacterium bovis subsp bovis AF2122/97
cgacgguuugcaccgcg

SEQ ID NO: 3050795 - RNA, 21 nt, Mycobacterium bovis subsp bovis AF2122/97
cgacgguuugcaccgcggcca

SEQ ID NO: 3050796 - RNA, 18 nt, Mycobacterium bovis subsp bovis AF2122/97
cgacguaaugcgcugccg

SEQ ID NO: 3050797 - RNA, 19 nt, Mycobacterium bovis subsp bovis AF2122/97
cgacguaaugcgcugccgc

SEQ ID NO: 3050798 - RNA, 17 nt, Mycobacterium bovis subsp bovis AF2122/97
cgacguaccaggguguc

SEQ ID NO: 3050799 - RNA, 17 nt, Mycobacterium bovis subsp bovis AF2122/97
cgacguagacgacgucg

SEQ ID NO: 3050800 - RNA, 18 nt, Mycobacterium bovis subsp bovis AF2122/97
cgacguagacgacgucgg

SEQ ID NO: 3050801 - RNA, 21 nt, Mycobacterium bovis subsp bovis AF2122/97
cgacguagacgacgucggccg

SEQ ID NO: 3050802 - RNA, 19 nt, Mycobacterium bovis subsp bovis AF2122/97
cgacguaggacugccagcg

SEQ ID NO: 3050803 - RNA, 23 nt, Mycobacterium bovis subsp bovis AF2122/97
cgacguaguagcgaugcacccca

SEQ ID NO: 3050804 - RNA, 18 nt, Mycobacterium bovis subsp bovis AF2122/97
cgacguaguugccggcuu

SEQ ID NO: 3050805 - RNA, 21 nt, Mycobacterium bovis subsp bovis AF2122/97
cgacguauaccgcacccuggg

SEQ ID NO: 3050806 - RNA, 23 nt, Mycobacterium bovis subsp bovis AF2122/97
cgacguauucguuggggcugccg

SEQ ID NO: 3050807 - RNA, 16 nt, Mycobacterium bovis subsp bovis AF2122/97
cgacgucaaacgcaaa

SEQ ID NO: 3050808 - RNA, 23 nt, Mycobacterium bovis subsp bovis AF2122/97
cgacgucaggcagcuccgccgcc

SEQ ID NO: 3050809 - RNA, 16 nt, Mycobacterium bovis subsp bovis AF2122/97
cgacgucaggcucacg

SEQ ID NO: 3050810 - RNA, 20 nt, Mycobacterium bovis subsp bovis AF2122/97
cgacgucaggguauccacgc

SEQ ID NO: 3050811 - RNA, 19 nt, Mycobacterium bovis subsp bovis AF2122/97
cgacgucaucgccgacccg

SEQ ID NO: 3050812 - RNA, 14 nt, Mycobacterium bovis subsp bovis AF2122/97
cgacguccaccagc

SEQ ID NO: 3050813 - RNA, 22 nt, Mycobacterium bovis subsp bovis AF2122/97
cgacguccaguccaugugccca

SEQ ID NO: 3050814 - RNA, 16 nt, Mycobacterium bovis subsp bovis AF2122/97
cgacguccaucccggc

SEQ ID NO: 3050815 - RNA, 17 nt, Mycobacterium bovis subsp bovis AF2122/97
cgacguccaucccggcg

SEQ ID NO: 3050816 - RNA, 19 nt, Mycobacterium bovis subsp bovis AF2122/97
cgacguccaucccggcgcc

SEQ ID NO: 3050817 - RNA, 21 nt, Mycobacterium bovis subsp bovis AF2122/97
cgacguccaucccggcgccgc

SEQ ID NO: 3050818 - RNA, 16 nt, Mycobacterium bovis subsp bovis AF2122/97
cgacguccgaucggug

SEQ ID NO: 3050819 - RNA, 14 nt, Mycobacterium bovis subsp bovis AF2122/97
cgacguccucgacg

SEQ ID NO: 3050820 - RNA, 24 nt, Mycobacterium bovis subsp bovis AF2122/97
cgacguccucgacgaucagcacgu

SEQ ID NO: 3050821 - RNA, 13 nt, Mycobacterium bovis subsp bovis AF2122/97
cgacgucgaccac

SEQ ID NO: 3050822 - RNA, 21 nt, Mycobacterium bovis subsp bovis AF2122/97
cgacgucgacgccggccagcg

SEQ ID NO: 3050823 - RNA, 14 nt, Mycobacterium bovis subsp bovis AF2122/97
cgacgucgauuucg

SEQ ID NO: 3050824 - RNA, 17 nt, Mycobacterium bovis subsp bovis AF2122/97
cgacgucgccaagacca

SEQ ID NO: 3050825 - RNA, 13 nt, Mycobacterium bovis subsp bovis AF2122/97
cgacgucgcccau

SEQ ID NO: 3050826 - RNA, 16 nt, Mycobacterium bovis subsp bovis AF2122/97
cgacgucgccgacccg

SEQ ID NO: 3050827 - RNA, 20 nt, Mycobacterium bovis subsp bovis AF2122/97
cgacgucgccgccgcgggcg

SEQ ID NO: 3050828 - RNA, 14 nt, Mycobacterium bovis subsp bovis AF2122/97
cgacgucggcaucg

SEQ ID NO: 3050829 - RNA, 22 nt, Mycobacterium bovis subsp bovis AF2122/97
cgacgucggcaucggcggcguc

SEQ ID NO: 3050830 - RNA, 13 nt, Mycobacterium bovis subsp bovis AF2122/97
cgacgucggccgc

SEQ ID NO: 3050831 - RNA, 14 nt, Mycobacterium bovis subsp bovis AF2122/97
cgacgucggccgca

SEQ ID NO: 3050832 - RNA, 15 nt, Mycobacterium bovis subsp bovis AF2122/97
cgacgucggccgcau

SEQ ID NO: 3050833 - RNA, 18 nt, Mycobacterium bovis subsp bovis AF2122/97
cgacgucggccgcaucgc

SEQ ID NO: 3050834 - RNA, 17 nt, Mycobacterium bovis subsp bovis AF2122/97
cgacgucggccguuucc

SEQ ID NO: 3050835 - RNA, 13 nt, Mycobacterium bovis subsp bovis AF2122/97
cgacgucggccuu

SEQ ID NO: 3050836 - RNA, 15 nt, Mycobacterium bovis subsp bovis AF2122/97
cgacgucggcgacca

SEQ ID NO: 3050837 - RNA, 15 nt, Mycobacterium bovis subsp bovis AF2122/97
cgacgucggcgagca

SEQ ID NO: 3050838 - RNA, 21 nt, Mycobacterium bovis subsp bovis AF2122/97
cgacgucggcggugacggugc

SEQ ID NO: 3050839 - RNA, 17 nt, Mycobacterium bovis subsp bovis AF2122/97
cgacgucggcuucaccu

SEQ ID NO: 3050840 - RNA, 15 nt, Mycobacterium bovis subsp bovis AF2122/97
cgacucggcggcgcg

SEQ ID NO: 3050841 - RNA, 22 nt, Mycobacterium bovis subsp bovis AF2122/97
cgacucggcggcgcggucgaag

SEQ ID NO: 3050842 - RNA, 23 nt, Mycobacterium bovis subsp bovis AF2122/97
cgacucggucucauagugcaggu

SEQ ID NO: 3050843 - RNA, 13 nt, Mycobacterium bovis subsp bovis AF2122/97
cgacucggugcgg

SEQ ID NO: 3050844 - RNA, 15 nt, Mycobacterium bovis subsp bovis AF2122/97
cgacucggugcggug

SEQ ID NO: 3050845 - RNA, 18 nt, Mycobacterium bovis subsp bovis AF2122/97
cgacucgguugaggacga

SEQ ID NO: 3050846 - RNA, 20 nt, Mycobacterium bovis subsp bovis AF2122/97
cgacucguggcgccacggca

SEQ ID NO: 3050847 - RNA, 16 nt, Mycobacterium bovis subsp bovis AF2122/97
cgacucgugucugccu

SEQ ID NO: 3050848 - RNA, 18 nt, Mycobacterium bovis subsp bovis AF2122/97
cgacucgugucugccucg

SEQ ID NO: 3050849 - RNA, 19 nt, Mycobacterium bovis subsp bovis AF2122/97
cgacucugcgucugcucac

SEQ ID NO: 3050850 - RNA, 20 nt, Mycobacterium bovis subsp bovis AF2122/97
cgacucugcgucugcucacc

SEQ ID NO: 3050851 - RNA, 16 nt, Mycobacterium bovis subsp bovis AF2122/97
cgacucugugacgggc

SEQ ID NO: 3050852 - RNA, 17 nt, Mycobacterium bovis subsp bovis AF2122/97
cgacucugugacgggca

SEQ ID NO: 3050853 - RNA, 20 nt, Mycobacterium bovis subsp bovis AF2122/97
cgacucugugacgggcacaa

SEQ ID NO: 3050854 - RNA, 23 nt, Mycobacterium bovis subsp bovis AF2122/97
cgacucugugacgggcacaacca

SEQ ID NO: 3050855 - RNA, 16 nt, Mycobacterium bovis subsp bovis AF2122/97
cgacugauccucgaug

SEQ ID NO: 3050856 - RNA, 16 nt, Mycobacterium bovis subsp bovis AF2122/97
cgacugaucgccaccc

SEQ ID NO: 3050857 - RNA, 21 nt, Mycobacterium bovis subsp bovis AF2122/97
cgacugcacauaguccgagcg

SEQ ID NO: 3050858 - RNA, 22 nt, Mycobacterium bovis subsp bovis AF2122/97
cgacugcagaaacagccgcagc

SEQ ID NO: 3050859 - RNA, 23 nt, Mycobacterium bovis subsp bovis AF2122/97
cgacugcagaaacagccgcagcg

SEQ ID NO: 3050860 - RNA, 12 nt, Mycobacterium bovis subsp bovis AF2122/97
cgacugccaccg

SEQ ID NO: 3050861 - RNA, 13 nt, Mycobacterium bovis subsp bovis AF2122/97
cgacugccagcgc

SEQ ID NO: 3050862 - RNA, 14 nt, Mycobacterium bovis subsp bovis AF2122/97
cgacugccagcgcc

SEQ ID NO: 3050863 - RNA, 20 nt, Mycobacterium bovis subsp bovis AF2122/97
cgacugccguucagcggcgg

SEQ ID NO: 3050864 - RNA, 22 nt, Mycobacterium bovis subsp bovis AF2122/97
cgacugcgcccauagcugccgg

SEQ ID NO: 3050865 - RNA, 19 nt, Mycobacterium bovis subsp bovis AF2122/97
cgacugcgucggcggcuuc

SEQ ID NO: 3050866 - RNA, 17 nt, Mycobacterium bovis subsp bovis AF2122/97
cgacugcugucaccgca

SEQ ID NO: 3050867 - RNA, 16 nt, Mycobacterium bovis subsp bovis AF2122/97
cgacuggaaggcgggc

SEQ ID NO: 3050868 - RNA, 17 nt, Mycobacterium bovis subsp bovis AF2122/97
cgacuggaaggcgggca

SEQ ID NO: 3050869 - RNA, 19 nt, Mycobacterium bovis subsp bovis AF2122/97
cgacuggaucgcgauggcc

SEQ ID NO: 3050870 - RNA, 13 nt, Mycobacterium bovis subsp bovis AF2122/97
cgacuggccccgc

SEQ ID NO: 3050871 - RNA, 17 nt, Mycobacterium bovis subsp bovis AF2122/97
cgacuggccccgccagc

SEQ ID NO: 3050872 - RNA, 18 nt, Mycobacterium bovis subsp bovis AF2122/97
cgacuggccccgccagcg

SEQ ID NO: 3050873 - RNA, 20 nt, Mycobacterium bovis subsp bovis AF2122/97
cgacuggccccgccagcggc

SEQ ID NO: 3050874 - RNA, 14 nt, Mycobacterium bovis subsp bovis AF2122/97
cgacugggacgacg

SEQ ID NO: 3050875 - RNA, 17 nt, Mycobacterium bovis subsp bovis AF2122/97
cgacugggacgacgcca

SEQ ID NO: 3050876 - RNA, 14 nt, Mycobacterium bovis subsp bovis AF2122/97
cgacugggcgccca

SEQ ID NO: 3050877 - RNA, 19 nt, Mycobacterium bovis subsp bovis AF2122/97
cgacuggguggugcucacc

SEQ ID NO: 3050878 - RNA, 16 nt, Mycobacterium bovis subsp bovis AF2122/97
cgacuggugccugccg

SEQ ID NO: 3050879 - RNA, 18 nt, Mycobacterium bovis subsp bovis AF2122/97
cgacugucccgcgcaacc

SEQ ID NO: 3050880 - RNA, 16 nt, Mycobacterium bovis subsp bovis AF2122/97
cgacugucuggucggc

SEQ ID NO: 3050881 - RNA, 23 nt, Mycobacterium bovis subsp bovis AF2122/97
cgacugugaaucucacgacgccu

SEQ ID NO: 3050882 - RNA, 23 nt, Mycobacterium bovis subsp bovis AF2122/97
cgacugugaaucugacgacgcga

SEQ ID NO: 3050883 - RNA, 15 nt, Mycobacterium bovis subsp bovis AF2122/97
cgacugugcgccgca

SEQ ID NO: 3050884 - RNA, 14 nt, Mycobacterium bovis subsp bovis AF2122/97
cgacuguggcgccg

SEQ ID NO: 3050885 - RNA, 16 nt, Mycobacterium bovis subsp bovis AF2122/97
cgacuguggcgccgcc

SEQ ID NO: 3050886 - RNA, 17 nt, Mycobacterium bovis subsp bovis AF2122/97
cgacuguggcgccgccg

SEQ ID NO: 3050887 - RNA, 18 nt, Mycobacterium bovis subsp bovis AF2122/97
cgacuguggcgccgccgg

SEQ ID NO: 3050888 - RNA, 19 nt, Mycobacterium bovis subsp bovis AF2122/97
cgacuguggcgccgccggc

SEQ ID NO: 3050889 - RNA, 22 nt, Mycobacterium bovis subsp bovis AF2122/97
cgacuguggcgccgccggcacc

SEQ ID NO: 3050890 - RNA, 14 nt, Mycobacterium bovis subsp bovis AF2122/97
cgacuucgacgaca

SEQ ID NO: 3050891 - RNA, 14 nt, Mycobacterium bovis subsp bovis AF2122/97
cgacuucgcccggg

SEQ ID NO: 3050892 - RNA, 13 nt, Mycobacterium bovis subsp bovis AF2122/97
cgacuucggcguc

SEQ ID NO: 3050893 - RNA, 20 nt, Mycobacterium bovis subsp bovis AF2122/97
cgacuucgggaacgcucguc

SEQ ID NO: 3050894 - RNA, 18 nt, Mycobacterium bovis subsp bovis AF2122/97
cgacuucuaugacgaccg

SEQ ID NO: 3050895 - RNA, 21 nt, Mycobacterium bovis subsp bovis AF2122/97
cgacuucuucgcgcaaccagc

SEQ ID NO: 3050896 - RNA, 17 nt, Mycobacterium bovis subsp bovis AF2122/97
cgacuugauuucgaucg

SEQ ID NO: 3050897 - RNA, 18 nt, Mycobacterium bovis subsp bovis AF2122/97
cgacuugauuucgaucgc

SEQ ID NO: 3050898 - RNA, 20 nt, Mycobacterium bovis subsp bovis AF2122/97
cgacuugauuucgaucgcgg

SEQ ID NO: 3050899 - RNA, 22 nt, Mycobacterium bovis subsp bovis AF2122/97
cgacuugcaggcgucccagccg

SEQ ID NO: 3050900 - RNA, 20 nt, Mycobacterium bovis subsp bovis AF2122/97
cgacuugccuagcgcgggcu

SEQ ID NO: 3050901 - RNA, 14 nt, Mycobacterium bovis subsp bovis AF2122/97
cgacuugcggugcu

SEQ ID NO: 3050902 - RNA, 18 nt, Mycobacterium bovis subsp bovis AF2122/97
cgacuugcggugcucacc

SEQ ID NO: 3050903 - RNA, 19 nt, Mycobacterium bovis subsp bovis AF2122/97
cgacuugcggugcucacca

SEQ ID NO: 3050904 - RNA, 20 nt, Mycobacterium bovis subsp bovis AF2122/97
cgacuuggauggccgaaccc

SEQ ID NO: 3050905 - RNA, 14 nt, Mycobacterium bovis subsp bovis AF2122/97
cgacuuggcaucgc

SEQ ID NO: 3050906 - RNA, 17 nt, Mycobacterium bovis subsp bovis AF2122/97
cgacuuggugacaccga

SEQ ID NO: 3050907 - RNA, 18 nt, Mycobacterium bovis subsp bovis AF2122/97
cgacuuggugacaccgag

SEQ ID NO: 3050908 - RNA, 19 nt, Mycobacterium bovis subsp bovis AF2122/97
cgacuuggugacaccgagg

SEQ ID NO: 3050909 - RNA, 17 nt, Mycobacterium bovis subsp bovis AF2122/97
cgacuuguacgcaucgc

SEQ ID NO: 3050910 - RNA, 12 nt, Mycobacterium bovis subsp bovis AF2122/97
cgacuugucgcc

SEQ ID NO: 3050911 - RNA, 23 nt, Mycobacterium bovis subsp bovis AF2122/97
cgacuuugagucguuggacggca

SEQ ID NO: 3050912 - RNA, 16 nt, Mycobacterium bovis subsp bovis AF2122/97
cgagaaacacgacagc

SEQ ID NO: 3050913 - RNA, 20 nt, Mycobacterium bovis subsp bovis AF2122/97
cgagaaacacgacagccagu

SEQ ID NO: 3050914 - RNA, 18 nt, Mycobacterium bovis subsp bovis AF2122/97
cgagaacaccggccaaca

SEQ ID NO: 3050915 - RNA, 19 nt, Mycobacterium bovis subsp bovis AF2122/97
cgagaacgauguccgcgcg

SEQ ID NO: 3050916 - RNA, 22 nt, Mycobacterium bovis subsp bovis AF2122/97
cgagaacgauguccgcgcgaac

SEQ ID NO: 3050917 - RNA, 22 nt, Mycobacterium bovis subsp bovis AF2122/97
cgagaacgcccgagugaccagg

SEQ ID NO: 3050918 - RNA, 19 nt, Mycobacterium bovis subsp bovis AF2122/97
cgagaacugcucgauccgc

SEQ ID NO: 3050919 - RNA, 16 nt, Mycobacterium bovis subsp bovis AF2122/97
cgagaagacaccgcgc

SEQ ID NO: 3050920 - RNA, 21 nt, Mycobacterium bovis subsp bovis AF2122/97
cgagaagaucucguagccgcc

SEQ ID NO: 3050921 - RNA, 21 nt, Mycobacterium bovis subsp bovis AF2122/97
cgagaagcguugcacugcugg

SEQ ID NO: 3050922 - RNA, 15 nt, Mycobacterium bovis subsp bovis AF2122/97
cgagaaucacgguca

SEQ ID NO: 3050923 - RNA, 21 nt, Mycobacterium bovis subsp bovis AF2122/97
cgagaccacuuagcuggcggg

SEQ ID NO: 3050924 - RNA, 12 nt, Mycobacterium bovis subsp bovis AF2122/97
cgagaccccgac

SEQ ID NO: 3050925 - RNA, 15 nt, Mycobacterium bovis subsp bovis AF2122/97
cgagaccgccgcugc

SEQ ID NO: 3050926 - RNA, 17 nt, Mycobacterium bovis subsp bovis AF2122/97
cgagcaacaccagggcc

SEQ ID NO: 3050927 - RNA, 21 nt, Mycobacterium bovis subsp bovis AF2122/97
cgagcaacaccgucggcagca

SEQ ID NO: 3050928 - RNA, 23 nt, Mycobacterium bovis subsp bovis AF2122/97
cgagcaacaccgucggcagcagc

SEQ ID NO: 3050929 - RNA, 14 nt, Mycobacterium bovis subsp bovis AF2122/97
cgagcaacgccacc

SEQ ID NO: 3050930 - RNA, 21 nt, Mycobacterium bovis subsp bovis AF2122/97
cgagcaacggacgaagcaccu

SEQ ID NO: 3050931 - RNA, 15 nt, Mycobacterium bovis subsp bovis AF2122/97
cgagcaacggcggca

SEQ ID NO: 3050932 - RNA, 16 nt, Mycobacterium bovis subsp bovis AF2122/97
cgagcaacggcggcag

SEQ ID NO: 3050933 - RNA, 20 nt, Mycobacterium bovis subsp bovis AF2122/97
cgagcaacggcggcaggccg

SEQ ID NO: 3050934 - RNA, 14 nt, Mycobacterium bovis subsp bovis AF2122/97
cgagcaacgggcga

SEQ ID NO: 3050935 - RNA, 18 nt, Mycobacterium bovis subsp bovis AF2122/97
cgagcaacucguccagca

SEQ ID NO: 3050936 - RNA, 21 nt, Mycobacterium bovis subsp bovis AF2122/97
cgagcaacucguccagcagug

SEQ ID NO: 3050937 - RNA, 22 nt, Mycobacterium bovis subsp bovis AF2122/97
cgagcaacucguccagcagugc

SEQ ID NO: 3050938 - RNA, 15 nt, Mycobacterium bovis subsp bovis AF2122/97
cgagcaaggggaucu

SEQ ID NO: 3050939 - RNA, 15 nt, Mycobacterium bovis subsp bovis AF2122/97
cgagcaauuccucag

SEQ ID NO: 3050940 - RNA, 16 nt, Mycobacterium bovis subsp bovis AF2122/97
cgagcacacaacaccc

SEQ ID NO: 3050941 - RNA, 23 nt, Mycobacterium bovis subsp bovis AF2122/97
cgagcacacaacacccaacgcaa

SEQ ID NO: 3050942 - RNA, 14 nt, Mycobacterium bovis subsp bovis AF2122/97
cgagcacaccgucg

SEQ ID NO: 3050943 - RNA, 18 nt, Mycobacterium bovis subsp bovis AF2122/97
cgagcacaccgucgucgu

SEQ ID NO: 3050944 - RNA, 14 nt, Mycobacterium bovis subsp bovis AF2122/97
cgagcacacgucgg

SEQ ID NO: 3050945 - RNA, 16 nt, Mycobacterium bovis subsp bovis AF2122/97
cgagcacacgucggga

SEQ ID NO: 3050946 - RNA, 17 nt, Mycobacterium bovis subsp bovis AF2122/97
cgagcacacuccuagcc

SEQ ID NO: 3050947 - RNA, 21 nt, Mycobacterium bovis subsp bovis AF2122/97
cgagcacacuccuagccaacg

SEQ ID NO: 3050948 - RNA, 18 nt, Mycobacterium bovis subsp bovis AF2122/97
cgagcacaugcugccgcu

SEQ ID NO: 3050949 - RNA, 22 nt, Mycobacterium bovis subsp bovis AF2122/97
cgagcacaugcugccgcugcga

SEQ ID NO: 3050950 - RNA, 12 nt, Mycobacterium bovis subsp bovis AF2122/97
cgagcaccaccc

SEQ ID NO: 3050951 - RNA, 14 nt, Mycobacterium bovis subsp bovis AF2122/97
cgagcaccacccca

SEQ ID NO: 3050952 - RNA, 15 nt, Mycobacterium bovis subsp bovis AF2122/97
cgagcaccaccccag

SEQ ID NO: 3050953 - RNA, 16 nt, Mycobacterium bovis subsp bovis AF2122/97
cgagcaccaccccagc

SEQ ID NO: 3050954 - RNA, 17 nt, Mycobacterium bovis subsp bovis AF2122/97
cgagcaccaccccagcg

SEQ ID NO: 3050955 - RNA, 21 nt, Mycobacterium bovis subsp bovis AF2122/97
cgagcaccaccccagcggcca

SEQ ID NO: 3050956 - RNA, 17 nt, Mycobacterium bovis subsp bovis AF2122/97
cgagcaccacccgggcc

SEQ ID NO: 3050957 - RNA, 18 nt, Mycobacterium bovis subsp bovis AF2122/97
cgagcaccacccgggccu

SEQ ID NO: 3050958 - RNA, 19 nt, Mycobacterium bovis subsp bovis AF2122/97
cgagcaccacccgggccuc

SEQ ID NO: 3050959 - RNA, 22 nt, Mycobacterium bovis subsp bovis AF2122/97
cgagcaccacccgggccucggc

SEQ ID NO: 3050960 - RNA, 15 nt, Mycobacterium bovis subsp bovis AF2122/97
cgagcaccccagggg

SEQ ID NO: 3050961 - RNA, 15 nt, Mycobacterium bovis subsp bovis AF2122/97
cgagcaccccgacgu

SEQ ID NO: 3050962 - RNA, 21 nt, Mycobacterium bovis subsp bovis AF2122/97
cgagcacccgcaaugcgcgcg

SEQ ID NO: 3050963 - RNA, 15 nt, Mycobacterium bovis subsp bovis AF2122/97
cgagcacccgcucca

SEQ ID NO: 3050964 - RNA, 16 nt, Mycobacterium bovis subsp bovis AF2122/97
cgagcacccgcuccau

SEQ ID NO: 3050965 - RNA, 14 nt, Mycobacterium bovis subsp bovis AF2122/97
cgagcacccgcugg

SEQ ID NO: 3050966 - RNA, 20 nt, Mycobacterium bovis subsp bovis AF2122/97
cgagcacccguugaucgcgg

SEQ ID NO: 3050967 - RNA, 16 nt, Mycobacterium bovis subsp bovis AF2122/97
cgagcaccgacaccgg

SEQ ID NO: 3050968 - RNA, 18 nt, Mycobacterium bovis subsp bovis AF2122/97
cgagcaccgacaccggcc

SEQ ID NO: 3050969 - RNA, 19 nt, Mycobacterium bovis subsp bovis AF2122/97
cgagcaccgacaccggccg

SEQ ID NO: 3050970 - RNA, 22 nt, Mycobacterium bovis subsp bovis AF2122/97
cgagcaccgacaccggccgcga

SEQ ID NO: 3050971 - RNA, 22 nt, Mycobacterium bovis subsp bovis AF2122/97
cgagcaccgcaaccacgccccg

SEQ ID NO: 3050972 - RNA, 23 nt, Mycobacterium bovis subsp bovis AF2122/97
cgagcaccgcaaccacgccccga

SEQ ID NO: 3050973 - RNA, 15 nt, Mycobacterium bovis subsp bovis AF2122/97
cgagcaccgcgccgc

SEQ ID NO: 3050974 - RNA, 19 nt, Mycobacterium bovis subsp bovis AF2122/97
cgagcaccgcgccgcgccg

SEQ ID NO: 3050975 - RNA, 16 nt, Mycobacterium bovis subsp bovis AF2122/97
cgagcaccggcugcgg

SEQ ID NO: 3050976 - RNA, 19 nt, Mycobacterium bovis subsp bovis AF2122/97
cgagcaccggcugcggggc

SEQ ID NO: 3050977 - RNA, 20 nt, Mycobacterium bovis subsp bovis AF2122/97
cgagcaccgugcccugggug

SEQ ID NO: 3050978 - RNA, 16 nt, Mycobacterium bovis subsp bovis AF2122/97
cgagcaccuccacugg

SEQ ID NO: 3050979 - RNA, 22 nt, Mycobacterium bovis subsp bovis AF2122/97
cgagcaccucgaaggcccgcug

SEQ ID NO: 3050980 - RNA, 17 nt, Mycobacterium bovis subsp bovis AF2122/97
cgagcaccucggccucg

SEQ ID NO: 3050981 - RNA, 21 nt, Mycobacterium bovis subsp bovis AF2122/97
cgagcaccucggccucgucgu

SEQ ID NO: 3050982 - RNA, 22 nt, Mycobacterium bovis subsp bovis AF2122/97
cgagcaccuugcgauugcgcac

SEQ ID NO: 3050983 - RNA, 14 nt, Mycobacterium bovis subsp bovis AF2122/97
cgagcacgccaacg

SEQ ID NO: 3050984 - RNA, 14 nt, Mycobacterium bovis subsp bovis AF2122/97
cgagcacgcgggca

SEQ ID NO: 3050985 - RNA, 16 nt, Mycobacterium bovis subsp bovis AF2122/97
cgagcacgcugcugcg

SEQ ID NO: 3050986 - RNA, 20 nt, Mycobacterium bovis subsp bovis AF2122/97
cgagcacgcugcugcgggug

SEQ ID NO: 3050987 - RNA, 20 nt, Mycobacterium bovis subsp bovis AF2122/97
cgagcacggugagccggugg

SEQ ID NO: 3050988 - RNA, 22 nt, Mycobacterium bovis subsp bovis AF2122/97
cgagcacggugagccgguggcc

SEQ ID NO: 3050989 - RNA, 23 nt, Mycobacterium bovis subsp bovis AF2122/97
cgagcacggugagccgguggccc

SEQ ID NO: 3050990 - RNA, 14 nt, Mycobacterium bovis subsp bovis AF2122/97
cgagcacgucacgc

SEQ ID NO: 3050991 - RNA, 12 nt, Mycobacterium bovis subsp bovis AF2122/97
cgagcacgucgg

SEQ ID NO: 3050992 - RNA, 15 nt, Mycobacterium bovis subsp bovis AF2122/97
cgagcacgucgggga

SEQ ID NO: 3050993 - RNA, 22 nt, Mycobacterium bovis subsp bovis AF2122/97
cgagcacgucggggugccggcu

SEQ ID NO: 3050994 - RNA, 20 nt, Mycobacterium bovis subsp bovis AF2122/97
cgagcacuccggagcccaca

SEQ ID NO: 3050995 - RNA, 20 nt, Mycobacterium bovis subsp bovis AF2122/97
cgagcacucggccacgacga

SEQ ID NO: 3050996 - RNA, 24 nt, Mycobacterium bovis subsp bovis AF2122/97
cgagcacugaggagaugagcacca

SEQ ID NO: 3050997 - RNA, 18 nt, Mycobacterium bovis subsp bovis AF2122/97
cgagcagacacagaaucg

SEQ ID NO: 3050998 - RNA, 20 nt, Mycobacterium bovis subsp bovis AF2122/97
cgagcagacacagaaucgca

SEQ ID NO: 3050999 - RNA, 20 nt, Mycobacterium bovis subsp bovis AF2122/97
cgagcagacacagaaucgcc

SEQ ID NO: 3051000 - RNA, 19 nt, Mycobacterium bovis subsp bovis AF2122/97
cgagcagacacuaaagccc

SEQ ID NO: 3051001 - RNA, 20 nt, Mycobacterium bovis subsp bovis AF2122/97
cgagcagacacuaaagcccu

SEQ ID NO: 3051002 - RNA, 21 nt, Mycobacterium bovis subsp bovis AF2122/97
cgagcagacgcaaaagccacc

SEQ ID NO: 3051003 - RNA, 20 nt, Mycobacterium bovis subsp bovis AF2122/97
cgagcagacgcaaaagcccc

SEQ ID NO: 3051004 - RNA, 21 nt, Mycobacterium bovis subsp bovis AF2122/97
cgagcagacgcaaaagccccc

SEQ ID NO: 3051005 - RNA, 20 nt, Mycobacterium bovis subsp bovis AF2122/97
cgagcagacgcaaaaucgca

SEQ ID NO: 3051006 - RNA, 16 nt, Mycobacterium bovis subsp bovis AF2122/97
cgagcagacgcagaau

SEQ ID NO: 3051007 - RNA, 18 nt, Mycobacterium bovis subsp bovis AF2122/97
cgagcagacgcagaaucg

SEQ ID NO: 3051008 - RNA, 19 nt, Mycobacterium bovis subsp bovis AF2122/97
cgagcagacgcagaaucgc

SEQ ID NO: 3051009 - RNA, 23 nt, Mycobacterium bovis subsp bovis AF2122/97
cgagcagacgcagaaucgcccaa

SEQ ID NO: 3051010 - RNA, 19 nt, Mycobacterium bovis subsp bovis AF2122/97
cgagcagacgcagagucgc

SEQ ID NO: 3051011 - RNA, 20 nt, Mycobacterium bovis subsp bovis AF2122/97
cgagcagacgcagagucgca

SEQ ID NO: 3051012 - RNA, 15 nt, Mycobacterium bovis subsp bovis AF2122/97
cgagcccaaggggca

SEQ ID NO: 3051013 - RNA, 20 nt, Mycobacterium bovis subsp bovis AF2122/97
cgagcccaauccgcaacagc

SEQ ID NO: 3051014 - RNA, 14 nt, Mycobacterium bovis subsp bovis AF2122/97
cgagcccaccuggg

SEQ ID NO: 3051015 - RNA, 19 nt, Mycobacterium bovis subsp bovis AF2122/97
cgagcccacguggggccgg

SEQ ID NO: 3051016 - RNA, 14 nt, Mycobacterium bovis subsp bovis AF2122/97
cgagcccagcgccu

SEQ ID NO: 3051017 - RNA, 15 nt, Mycobacterium bovis subsp bovis AF2122/97
cgagcccagcgccuc

SEQ ID NO: 3051018 - RNA, 19 nt, Mycobacterium bovis subsp bovis AF2122/97
cgagcccagcgccuccagc

SEQ ID NO: 3051019 - RNA, 14 nt, Mycobacterium bovis subsp bovis AF2122/97
cgagcccgaaccac

SEQ ID NO: 3051020 - RNA, 17 nt, Mycobacterium bovis subsp bovis AF2122/97
cgagcccgaaccaccgc

SEQ ID NO: 3051021 - RNA, 18 nt, Mycobacterium bovis subsp bovis AF2122/97
cgagcccgaaggcggcuc

SEQ ID NO: 3051022 - RNA, 16 nt, Mycobacterium bovis subsp bovis AF2122/97
cgagcccgccggguug

SEQ ID NO: 3051023 - RNA, 21 nt, Mycobacterium bovis subsp bovis AF2122/97
cgagcccgggccugaaccacg

SEQ ID NO: 3051024 - RNA, 20 nt, Mycobacterium bovis subsp bovis AF2122/97
cgagcccggugcuaccggcu

SEQ ID NO: 3051025 - RNA, 14 nt, Mycobacterium bovis subsp bovis AF2122/97
cgagcccguccucg

SEQ ID NO: 3051026 - RNA, 23 nt, Mycobacterium bovis subsp bovis AF2122/97
cgagcccguccucgucggugugc

SEQ ID NO: 3051027 - RNA, 23 nt, Mycobacterium bovis subsp bovis AF2122/97
cgagcccgucgaguagguaacgc

SEQ ID NO: 3051028 - RNA, 15 nt, Mycobacterium bovis subsp bovis AF2122/97
cgagcccgucgauca

SEQ ID NO: 3051029 - RNA, 14 nt, Mycobacterium bovis subsp bovis AF2122/97
cgagcccuccaggg

SEQ ID NO: 3051030 - RNA, 15 nt, Mycobacterium bovis subsp bovis AF2122/97
cgagcccuccagggc

SEQ ID NO: 3051031 - RNA, 23 nt, Mycobacterium bovis subsp bovis AF2122/97
cgagcccucguuaucgaccgccg

SEQ ID NO: 3051032 - RNA, 17 nt, Mycobacterium bovis subsp bovis AF2122/97
cgagccgacccgacgcu

SEQ ID NO: 3051033 - RNA, 23 nt, Mycobacterium bovis subsp bovis AF2122/97
cgagccgacccgacgcuggucgg

SEQ ID NO: 3051034 - RNA, 24 nt, Mycobacterium bovis subsp bovis AF2122/97
cgagccgacccgacgcuggucggc

SEQ ID NO: 3051035 - RNA, 14 nt, Mycobacterium bovis subsp bovis AF2122/97
cgagccgaccgcgg

SEQ ID NO: 3051036 - RNA, 12 nt, Mycobacterium bovis subsp bovis AF2122/97
cgagccgaccgg

SEQ ID NO: 3051037 - RNA, 14 nt, Mycobacterium bovis subsp bovis AF2122/97
cgagccgaccggcg

SEQ ID NO: 3051038 - RNA, 20 nt, Mycobacterium bovis subsp bovis AF2122/97
cgagccgauauaccagggca

SEQ ID NO: 3051039 - RNA, 19 nt, Mycobacterium bovis subsp bovis AF2122/97
cgagccgauauuggcaucg

SEQ ID NO: 3051040 - RNA, 13 nt, Mycobacterium bovis subsp bovis AF2122/97
cgagccgaucugc

SEQ ID NO: 3051041 - RNA, 17 nt, Mycobacterium bovis subsp bovis AF2122/97
cgagccgaucugcuguc

SEQ ID NO: 3051042 - RNA, 18 nt, Mycobacterium bovis subsp bovis AF2122/97
cgagccgcacaaacgggc

SEQ ID NO: 3051043 - RNA, 13 nt, Mycobacterium bovis subsp bovis AF2122/97
cgagccgcacagc

SEQ ID NO: 3051044 - RNA, 16 nt, Mycobacterium bovis subsp bovis AF2122/97
cgagccgcacagcaug

SEQ ID NO: 3051045 - RNA, 13 nt, Mycobacterium bovis subsp bovis AF2122/97
cgagccgcagcuc

SEQ ID NO: 3051046 - RNA, 15 nt, Mycobacterium bovis subsp bovis AF2122/97
cgagccgcagcucgc

SEQ ID NO: 3051047 - RNA, 16 nt, Mycobacterium bovis subsp bovis AF2122/97
cgagccgcagcucgcc

SEQ ID NO: 3051048 - RNA, 24 nt, Mycobacterium bovis subsp bovis AF2122/97
cgagccgccggaucgccacggugg

SEQ ID NO: 3051049 - RNA, 16 nt, Mycobacterium bovis subsp bovis AF2122/97
cgagccgcgaugcgcc

SEQ ID NO: 3051050 - RNA, 22 nt, Mycobacterium bovis subsp bovis AF2122/97
cgagccgcgauugugcagcgaa

SEQ ID NO: 3051051 - RNA, 12 nt, Mycobacterium bovis subsp bovis AF2122/97
cgagccgcggca

SEQ ID NO: 3051052 - RNA, 14 nt, Mycobacterium bovis subsp bovis AF2122/97
cgagccgcggcaac

SEQ ID NO: 3051053 - RNA, 20 nt, Mycobacterium bovis subsp bovis AF2122/97
cgagccgcggucaccccggc

SEQ ID NO: 3051054 - RNA, 14 nt, Mycobacterium bovis subsp bovis AF2122/97
cgagccgcggucgg

SEQ ID NO: 3051055 - RNA, 17 nt, Mycobacterium bovis subsp bovis AF2122/97
cgagccgcggucggcgu

SEQ ID NO: 3051056 - RNA, 20 nt, Mycobacterium bovis subsp bovis AF2122/97
cgagccgcgugggccgcugc

SEQ ID NO: 3051057 - RNA, 21 nt, Mycobacterium bovis subsp bovis AF2122/97
cgagccgcgugggccgcugca

SEQ ID NO: 3051058 - RNA, 15 nt, Mycobacterium bovis subsp bovis AF2122/97
cgagccgcuaggacg

SEQ ID NO: 3051059 - RNA, 20 nt, Mycobacterium bovis subsp bovis AF2122/97
cgagccgcuaggacggcgcg

SEQ ID NO: 3051060 - RNA, 21 nt, Mycobacterium bovis subsp bovis AF2122/97
cgagccgcuaggacggcgcga

SEQ ID NO: 3051061 - RNA, 14 nt, Mycobacterium bovis subsp bovis AF2122/97
cgagccgcugcgac

SEQ ID NO: 3051062 - RNA, 19 nt, Mycobacterium bovis subsp bovis AF2122/97
cgagccggauucggcugcc

SEQ ID NO: 3051063 - RNA, 13 nt, Mycobacterium bovis subsp bovis AF2122/97
cgagccggcacgc

SEQ ID NO: 3051064 - RNA, 12 nt, Mycobacterium bovis subsp bovis AF2122/97
cgagccggcgcc

SEQ ID NO: 3051065 - RNA, 16 nt, Mycobacterium bovis subsp bovis AF2122/97
cgagccggcgccgggu

SEQ ID NO: 3051066 - RNA, 13 nt, Mycobacterium bovis subsp bovis AF2122/97
cgagccggcgcgc

SEQ ID NO: 3051067 - RNA, 13 nt, Mycobacterium bovis subsp bovis AF2122/97
cgagccggcggcc

SEQ ID NO: 3051068 - RNA, 22 nt, Mycobacterium bovis subsp bovis AF2122/97
cgagccggcucagacgacgauc

SEQ ID NO: 3051069 - RNA, 23 nt, Mycobacterium bovis subsp bovis AF2122/97
cgagccggggaacgugaccccca

SEQ ID NO: 3051070 - RNA, 13 nt, Mycobacterium bovis subsp bovis AF2122/97
cgagccgguaacc

SEQ ID NO: 3051071 - RNA, 19 nt, Mycobacterium bovis subsp bovis AF2122/97
cgagccggugccgcgguag

SEQ ID NO: 3051072 - RNA, 20 nt, Mycobacterium bovis subsp bovis AF2122/97
cgagccggugcgcgcggucg

SEQ ID NO: 3051073 - RNA, 18 nt, Mycobacterium bovis subsp bovis AF2122/97
cgagccgguggcgugggc

SEQ ID NO: 3051074 - RNA, 21 nt, Mycobacterium bovis subsp bovis AF2122/97
cgagccguccaagccagcguu

SEQ ID NO: 3051075 - RNA, 15 nt, Mycobacterium bovis subsp bovis AF2122/97
cgagccgugccagca

SEQ ID NO: 3051076 - RNA, 20 nt, Mycobacterium bovis subsp bovis AF2122/97
cgagccucgcucuccauggc

SEQ ID NO: 3051077 - RNA, 21 nt, Mycobacterium bovis subsp bovis AF2122/97
cgagccucgcucuccauggcc

SEQ ID NO: 3051078 - RNA, 16 nt, Mycobacterium bovis subsp bovis AF2122/97
cgagcgaaggugaacg

SEQ ID NO: 3051079 - RNA, 17 nt, Mycobacterium bovis subsp bovis AF2122/97
cgagcgacccccagcgc

SEQ ID NO: 3051080 - RNA, 20 nt, Mycobacterium bovis subsp bovis AF2122/97
cgagcgacccccagcgcccg

SEQ ID NO: 3051081 - RNA, 23 nt, Mycobacterium bovis subsp bovis AF2122/97
cgagcgacccccagcgcccgccg

SEQ ID NO: 3051082 - RNA, 17 nt, Mycobacterium bovis subsp bovis AF2122/97
cgagcgaccgucccagc

SEQ ID NO: 3051083 - RNA, 21 nt, Mycobacterium bovis subsp bovis AF2122/97
cgagcgaccgucccagcgccg

SEQ ID NO: 3051084 - RNA, 20 nt, Mycobacterium bovis subsp bovis AF2122/97
cgagcgacguuaaugacgcc

SEQ ID NO: 3051085 - RNA, 22 nt, Mycobacterium bovis subsp bovis AF2122/97
cgagcgacguuaaugacgccau

SEQ ID NO: 3051086 - RNA, 14 nt, Mycobacterium bovis subsp bovis AF2122/97
cgagcgacguuguu

SEQ ID NO: 3051087 - RNA, 17 nt, Mycobacterium bovis subsp bovis AF2122/97
cgagcgauacgucguca

SEQ ID NO: 3051088 - RNA, 18 nt, Mycobacterium bovis subsp bovis AF2122/97
cgagcgauacgucgucag

SEQ ID NO: 3051089 - RNA, 12 nt, Mycobacterium bovis subsp bovis AF2122/97
cgagcgaugcga

SEQ ID NO: 3051090 - RNA, 19 nt, Mycobacterium bovis subsp bovis AF2122/97
cgagcgcaagagccguccg

SEQ ID NO: 3051091 - RNA, 20 nt, Mycobacterium bovis subsp bovis AF2122/97
cgagcgcaagagccguccga

SEQ ID NO: 3051092 - RNA, 14 nt, Mycobacterium bovis subsp bovis AF2122/97
cgagcgcacaccgg

SEQ ID NO: 3051093 - RNA, 16 nt, Mycobacterium bovis subsp bovis AF2122/97
cgagcgcacaccggcu

SEQ ID NO: 3051094 - RNA, 12 nt, Mycobacterium bovis subsp bovis AF2122/97
cgagcgcaccac

SEQ ID NO: 3051095 - RNA, 12 nt, Mycobacterium bovis subsp bovis AF2122/97
cgagcgcaccgc

SEQ ID NO: 3051096 - RNA, 17 nt, Mycobacterium bovis subsp bovis AF2122/97
cgagcgcaccgcugacc

SEQ ID NO: 3051097 - RNA, 12 nt, Mycobacterium bovis subsp bovis AF2122/97
cgagcgcacugg

SEQ ID NO: 3051098 - RNA, 13 nt, Mycobacterium bovis subsp bovis AF2122/97
cgagcgcacuggg

SEQ ID NO: 3051099 - RNA, 18 nt, Mycobacterium bovis subsp bovis AF2122/97
cgagcucgccgcagcguc

SEQ ID NO: 3051100 - RNA, 11 nt, Mycobacterium bovis subsp bovis AF2122/97
cgagcucggcc

SEQ ID NO: 3051101 - RNA, 15 nt, Mycobacterium bovis subsp bovis AF2122/97
cgagcucggccccgc

SEQ ID NO: 3051102 - RNA, 18 nt, Mycobacterium bovis subsp bovis AF2122/97
cgagcucggccccgccgc

SEQ ID NO: 3051103 - RNA, 22 nt, Mycobacterium bovis subsp bovis AF2122/97
cgagcucggccccgccgccggu

SEQ ID NO: 3051104 - RNA, 21 nt, Mycobacterium bovis subsp bovis AF2122/97
cgagcucggcgaacggcacca

SEQ ID NO: 3051105 - RNA, 12 nt, Mycobacterium bovis subsp bovis AF2122/97
cgagcucggcgc

SEQ ID NO: 3051106 - RNA, 13 nt, Mycobacterium bovis subsp bovis AF2122/97
cgagcucggcgcc

SEQ ID NO: 3051107 - RNA, 13 nt, Mycobacterium bovis subsp bovis AF2122/97
cgagcucggucac

SEQ ID NO: 3051108 - RNA, 17 nt, Mycobacterium bovis subsp bovis AF2122/97
cgagcucggucaccacg

SEQ ID NO: 3051109 - RNA, 14 nt, Mycobacterium bovis subsp bovis AF2122/97
cgagcucguccucg

SEQ ID NO: 3051110 - RNA, 16 nt, Mycobacterium bovis subsp bovis AF2122/97
cgagcucguccucguc

SEQ ID NO: 3051111 - RNA, 18 nt, Mycobacterium bovis subsp bovis AF2122/97
cgagcucguugcuggcgg

SEQ ID NO: 3051112 - RNA, 22 nt, Mycobacterium bovis subsp bovis AF2122/97
cgagcucguugcuggcggccag

SEQ ID NO: 3051113 - RNA, 23 nt, Mycobacterium bovis subsp bovis AF2122/97
cgagcucguugcuggcggccagc

SEQ ID NO: 3051114 - RNA, 24 nt, Mycobacterium bovis subsp bovis AF2122/97
cgagcucguugcuggcggccagca

SEQ ID NO: 3051115 - RNA, 19 nt, Mycobacterium bovis subsp bovis AF2122/97
cgagcugacgauggccagg

SEQ ID NO: 3051116 - RNA, 13 nt, Mycobacterium bovis subsp bovis AF2122/97
cgagcugacgccg

SEQ ID NO: 3051117 - RNA, 14 nt, Mycobacterium bovis subsp bovis AF2122/97
cgagcugacgccga

SEQ ID NO: 3051118 - RNA, 17 nt, Mycobacterium bovis subsp bovis AF2122/97
cgagcugacgccgagcu

SEQ ID NO: 3051119 - RNA, 21 nt, Mycobacterium bovis subsp bovis AF2122/97
cgagcugagcggccagcaucg

SEQ ID NO: 3051120 - RNA, 19 nt, Mycobacterium bovis subsp bovis AF2122/97
cgagcugauacgcaugcga

SEQ ID NO: 3051121 - RNA, 14 nt, Mycobacterium bovis subsp bovis AF2122/97
cgagcugauccggg

SEQ ID NO: 3051122 - RNA, 18 nt, Mycobacterium bovis subsp bovis AF2122/97
cgagcugauccggguggc

SEQ ID NO: 3051123 - RNA, 14 nt, Mycobacterium bovis subsp bovis AF2122/97
cgagcugccaacgc

SEQ ID NO: 3051124 - RNA, 12 nt, Mycobacterium bovis subsp bovis AF2122/97
cgagcugccagg

SEQ ID NO: 3051125 - RNA, 13 nt, Mycobacterium bovis subsp bovis AF2122/97
cgagcugccaggc

SEQ ID NO: 3051126 - RNA, 17 nt, Mycobacterium bovis subsp bovis AF2122/97
cgagcugcgacgaugcc

SEQ ID NO: 3051127 - RNA, 19 nt, Mycobacterium bovis subsp bovis AF2122/97
cgagcugcgacgaugccgc

SEQ ID NO: 3051128 - RNA, 20 nt, Mycobacterium bovis subsp bovis AF2122/97
cgagcugcgacgaugccgcc

SEQ ID NO: 3051129 - RNA, 13 nt, Mycobacterium bovis subsp bovis AF2122/97
cgagcugcggguc

SEQ ID NO: 3051130 - RNA, 17 nt, Mycobacterium bovis subsp bovis AF2122/97
cgagcuggcaacgccgc

SEQ ID NO: 3051131 - RNA, 19 nt, Mycobacterium bovis subsp bovis AF2122/97
cgagcuggcaacgccgcgc

SEQ ID NO: 3051132 - RNA, 14 nt, Mycobacterium bovis subsp bovis AF2122/97
cgagcuggcgaccu

SEQ ID NO: 3051133 - RNA, 16 nt, Mycobacterium bovis subsp bovis AF2122/97
cgagcuggcgaccugg

SEQ ID NO: 3051134 - RNA, 18 nt, Mycobacterium bovis subsp bovis AF2122/97
cgagcuggcgcgcggggu

SEQ ID NO: 3051135 - RNA, 21 nt, Mycobacterium bovis subsp bovis AF2122/97
cgagcuggcgcgcgggguggc

SEQ ID NO: 3051136 - RNA, 17 nt, Mycobacterium bovis subsp bovis AF2122/97
cgagcuguaggucagcg

SEQ ID NO: 3051137 - RNA, 23 nt, Mycobacterium bovis subsp bovis AF2122/97
cgagcugucggcuuccuccucgg

SEQ ID NO: 3051138 - RNA, 15 nt, Mycobacterium bovis subsp bovis AF2122/97
cgagcuguggucacc

SEQ ID NO: 3051139 - RNA, 14 nt, Mycobacterium bovis subsp bovis AF2122/97
cgagcuucagcgcg

SEQ ID NO: 3051140 - RNA, 15 nt, Mycobacterium bovis subsp bovis AF2122/97
cgagcuucagcgcgc

SEQ ID NO: 3051141 - RNA, 15 nt, Mycobacterium bovis subsp bovis AF2122/97
cgagcuucaucccgg

SEQ ID NO: 3051142 - RNA, 17 nt, Mycobacterium bovis subsp bovis AF2122/97
cgagcuuccacgccgga

SEQ ID NO: 3051143 - RNA, 23 nt, Mycobacterium bovis subsp bovis AF2122/97
cgagcuugagcgugagcgccgcg

SEQ ID NO: 3051144 - RNA, 15 nt, Mycobacterium bovis subsp bovis AF2122/97
cgagcuugccgucgc

SEQ ID NO: 3051145 - RNA, 18 nt, Mycobacterium bovis subsp bovis AF2122/97
cgagcuugccgucgcuga

SEQ ID NO: 3051146 - RNA, 14 nt, Mycobacterium bovis subsp bovis AF2122/97
cgagcuuggccgcc

SEQ ID NO: 3051147 - RNA, 16 nt, Mycobacterium bovis subsp bovis AF2122/97
cgagcuuggccgccgc

SEQ ID NO: 3051148 - RNA, 16 nt, Mycobacterium bovis subsp bovis AF2122/97
cgagcuuggccggcag

SEQ ID NO: 3051149 - RNA, 15 nt, Mycobacterium bovis subsp bovis AF2122/97
cgagcuuggcuuggc

SEQ ID NO: 3051150 - RNA, 17 nt, Mycobacterium bovis subsp bovis AF2122/97
cgagcuugggccggugc

SEQ ID NO: 3051151 - RNA, 19 nt, Mycobacterium bovis subsp bovis AF2122/97
cgagcuugucgagcaggcc

SEQ ID NO: 3051152 - RNA, 23 nt, Mycobacterium bovis subsp bovis AF2122/97
cgaggaaaucgcccucgucgcgg

SEQ ID NO: 3051153 - RNA, 16 nt, Mycobacterium bovis subsp bovis AF2122/97
cgaggaacucggaccc

SEQ ID NO: 3051154 - RNA, 22 nt, Mycobacterium bovis subsp bovis AF2122/97
cgaggaauacucucgcgacauc

SEQ ID NO: 3051155 - RNA, 21 nt, Mycobacterium bovis subsp bovis AF2122/97
cgaggaauuccgcuaccgcac

SEQ ID NO: 3051156 - RNA, 17 nt, Mycobacterium bovis subsp bovis AF2122/97
cgaggacaagcccgcug

SEQ ID NO: 3051157 - RNA, 22 nt, Mycobacterium bovis subsp bovis AF2122/97
cgaggacaagcccgcugccauc

SEQ ID NO: 3051158 - RNA, 21 nt, Mycobacterium bovis subsp bovis AF2122/97
cgaggacacauugaccaggug

SEQ ID NO: 3051159 - RNA, 22 nt, Mycobacterium bovis subsp bovis AF2122/97
cgaggaccaccacuaggucgcc

SEQ ID NO: 3051160 - RNA, 17 nt, Mycobacterium bovis subsp bovis AF2122/97
cgaggaccagaggcgcu

SEQ ID NO: 3051161 - RNA, 17 nt, Mycobacterium bovis subsp bovis AF2122/97
cgaggaccugcucgggc

SEQ ID NO: 3051162 - RNA, 19 nt, Mycobacterium bovis subsp bovis AF2122/97
cgaggaccugcucgggcgu

SEQ ID NO: 3051163 - RNA, 12 nt, Mycobacterium bovis subsp bovis AF2122/97
cgaggacgacga

SEQ ID NO: 3051164 - RNA, 14 nt, Mycobacterium bovis subsp bovis AF2122/97
cgaggacgccggcg

SEQ ID NO: 3051165 - RNA, 15 nt, Mycobacterium bovis subsp bovis AF2122/97
cgaggacgccggcgc

SEQ ID NO: 3051166 - RNA, 16 nt, Mycobacterium bovis subsp bovis AF2122/97
cgaggacgccggcgcc

SEQ ID NO: 3051167 - RNA, 18 nt, Mycobacterium bovis subsp bovis AF2122/97
cgaggacgccggcgccgc

SEQ ID NO: 3051168 - RNA, 20 nt, Mycobacterium bovis subsp bovis AF2122/97
cgaggacgccggcgccgcca

SEQ ID NO: 3051169 - RNA, 16 nt, Mycobacterium bovis subsp bovis AF2122/97
cgaggacggcguagac

SEQ ID NO: 3051170 - RNA, 23 nt, Mycobacterium bovis subsp bovis AF2122/97
cgaggacggcuugagccgcagca

SEQ ID NO: 3051171 - RNA, 22 nt, Mycobacterium bovis subsp bovis AF2122/97
cgaggacuggaaagcagcagcg

SEQ ID NO: 3051172 - RNA, 19 nt, Mycobacterium bovis subsp bovis AF2122/97
cgaggagaugccgacgaac

SEQ ID NO: 3051173 - RNA, 18 nt, Mycobacterium bovis subsp bovis AF2122/97
cgaggaggcggucgauca

SEQ ID NO: 3051174 - RNA, 18 nt, Mycobacterium bovis subsp bovis AF2122/97
cgaggaguuggugcagcg

SEQ ID NO: 3051175 - RNA, 20 nt, Mycobacterium bovis subsp bovis AF2122/97
cgaggaugcugagcgccagg

SEQ ID NO: 3051176 - RNA, 21 nt, Mycobacterium bovis subsp bovis AF2122/97
cgaggauguaguuggugaugc

SEQ ID NO: 3051177 - RNA, 14 nt, Mycobacterium bovis subsp bovis AF2122/97
cgaggaugucgaug

SEQ ID NO: 3051178 - RNA, 17 nt, Mycobacterium bovis subsp bovis AF2122/97
cgaggaugucgaugacc

SEQ ID NO: 3051179 - RNA, 15 nt, Mycobacterium bovis subsp bovis AF2122/97
cgaggaugugguugg

SEQ ID NO: 3051180 - RNA, 15 nt, Mycobacterium bovis subsp bovis AF2122/97
cgaggauguugugcc

SEQ ID NO: 3051181 - RNA, 22 nt, Mycobacterium bovis subsp bovis AF2122/97
cgaggauguugugccgaucggc

SEQ ID NO: 3051182 - RNA, 23 nt, Mycobacterium bovis subsp bovis AF2122/97
cgaggauguugugccgaucggcc

SEQ ID NO: 3051183 - RNA, 20 nt, Mycobacterium bovis subsp bovis AF2122/97
cgaggauucauggcggcaua

SEQ ID NO: 3051184 - RNA, 14 nt, Mycobacterium bovis subsp bovis AF2122/97
cgaggcaacaagca

SEQ ID NO: 3051185 - RNA, 22 nt, Mycobacterium bovis subsp bovis AF2122/97
cgagggcuaccggcgccgcgcg

SEQ ID NO: 3051186 - RNA, 16 nt, Mycobacterium bovis subsp bovis AF2122/97
cgagggcuugcaccug

SEQ ID NO: 3051187 - RNA, 17 nt, Mycobacterium bovis subsp bovis AF2122/97
cgagggcuugcaccugc

SEQ ID NO: 3051188 - RNA, 17 nt, Mycobacterium bovis subsp bovis AF2122/97
cgagggcuuuagugucu

SEQ ID NO: 3051189 - RNA, 20 nt, Mycobacterium bovis subsp bovis AF2122/97
cgaggggagugucagcgcca

SEQ ID NO: 3051190 - RNA, 13 nt, Mycobacterium bovis subsp bovis AF2122/97
cgaggggcggcaa

SEQ ID NO: 3051191 - RNA, 19 nt, Mycobacterium bovis subsp bovis AF2122/97
cgagggggguguugaggcc

SEQ ID NO: 3051192 - RNA, 20 nt, Mycobacterium bovis subsp bovis AF2122/97
cgagggggguguugaggccg

SEQ ID NO: 3051193 - RNA, 20 nt, Mycobacterium bovis subsp bovis AF2122/97
cgaggguaccaggcgccgug

SEQ ID NO: 3051194 - RNA, 21 nt, Mycobacterium bovis subsp bovis AF2122/97
cgagggugaaguggcgcagca

SEQ ID NO: 3051195 - RNA, 23 nt, Mycobacterium bovis subsp bovis AF2122/97
cgagggugagcauggcuagggcg

SEQ ID NO: 3051196 - RNA, 22 nt, Mycobacterium bovis subsp bovis AF2122/97
cgaggguuuucgcauagugcgg

SEQ ID NO: 3051197 - RNA, 18 nt, Mycobacterium bovis subsp bovis AF2122/97
cgagguaacgcagcggca

SEQ ID NO: 3051198 - RNA, 19 nt, Mycobacterium bovis subsp bovis AF2122/97
cgagguacagcgggcacgc

SEQ ID NO: 3051199 - RNA, 20 nt, Mycobacterium bovis subsp bovis AF2122/97
cgagguauaaacgcggcgcg

SEQ ID NO: 3051200 - RNA, 22 nt, Mycobacterium bovis subsp bovis AF2122/97
cgagguauaaacgcggcgcgcu

SEQ ID NO: 3051201 - RNA, 23 nt, Mycobacterium bovis subsp bovis AF2122/97
cgagguauaaacgcggcgcgcug

SEQ ID NO: 3051202 - RNA, 17 nt, Mycobacterium bovis subsp bovis AF2122/97
cgagguauucgcgcagc

SEQ ID NO: 3051203 - RNA, 18 nt, Mycobacterium bovis subsp bovis AF2122/97
cgagguauucgcgcagca

SEQ ID NO: 3051204 - RNA, 14 nt, Mycobacterium bovis subsp bovis AF2122/97
cgaggucacccggu

SEQ ID NO: 3051205 - RNA, 14 nt, Mycobacterium bovis subsp bovis AF2122/97
cgaggucagcgguu

SEQ ID NO: 3051206 - RNA, 15 nt, Mycobacterium bovis subsp bovis AF2122/97
cgaggucagcucccg

SEQ ID NO: 3051207 - RNA, 12 nt, Mycobacterium bovis subsp bovis AF2122/97
cgagguccacca

SEQ ID NO: 3051208 - RNA, 15 nt, Mycobacterium bovis subsp bovis AF2122/97
cgagguccaccaccc

SEQ ID NO: 3051209 - RNA, 12 nt, Mycobacterium bovis subsp bovis AF2122/97
cgaggucccggc

SEQ ID NO: 3051210 - RNA, 22 nt, Mycobacterium bovis subsp bovis AF2122/97
cgaggucccggccgagcguggc

SEQ ID NO: 3051211 - RNA, 24 nt, Mycobacterium bovis subsp bovis AF2122/97
cgaggucccggccgagcguggcca

SEQ ID NO: 3051212 - RNA, 15 nt, Mycobacterium bovis subsp bovis AF2122/97
cgagguccucagcga

SEQ ID NO: 3051213 - RNA, 22 nt, Mycobacterium bovis subsp bovis AF2122/97
cgagguccucgagguccucguc

SEQ ID NO: 3051214 - RNA, 15 nt, Mycobacterium bovis subsp bovis AF2122/97
cgagguccucgucgg

SEQ ID NO: 3051215 - RNA, 21 nt, Mycobacterium bovis subsp bovis AF2122/97
cgagguccucgucggcgucga

SEQ ID NO: 3051216 - RNA, 17 nt, Mycobacterium bovis subsp bovis AF2122/97
cgagguccucgucgucg

SEQ ID NO: 3051217 - RNA, 16 nt, Mycobacterium bovis subsp bovis AF2122/97
cgaggucgaaccgccg

SEQ ID NO: 3051218 - RNA, 15 nt, Mycobacterium bovis subsp bovis AF2122/97
cgaggucgagcgccg

SEQ ID NO: 3051219 - RNA, 16 nt, Mycobacterium bovis subsp bovis AF2122/97
cgaggucgagcgccgc

SEQ ID NO: 3051220 - RNA, 17 nt, Mycobacterium bovis subsp bovis AF2122/97
cgaggucgagcgccgcg

SEQ ID NO: 3051221 - RNA, 14 nt, Mycobacterium bovis subsp bovis AF2122/97
cgaggucgccaacc

SEQ ID NO: 3051222 - RNA, 15 nt, Mycobacterium bovis subsp bovis AF2122/97
cgaggucgccaaccc

SEQ ID NO: 3051223 - RNA, 23 nt, Mycobacterium bovis subsp bovis AF2122/97
cgaggucgcggucuuugagccgg

SEQ ID NO: 3051224 - RNA, 12 nt, Mycobacterium bovis subsp bovis AF2122/97
cgaggucggaga

SEQ ID NO: 3051225 - RNA, 13 nt, Mycobacterium bovis subsp bovis AF2122/97
cgaggucggccag

SEQ ID NO: 3051226 - RNA, 17 nt, Mycobacterium bovis subsp bovis AF2122/97
cgaggucggcgaucugc

SEQ ID NO: 3051227 - RNA, 15 nt, Mycobacterium bovis subsp bovis AF2122/97
cgaggucggcggcgc

SEQ ID NO: 3051228 - RNA, 22 nt, Mycobacterium bovis subsp bovis AF2122/97
cgaggucuccggugcgcagcca

SEQ ID NO: 3051229 - RNA, 14 nt, Mycobacterium bovis subsp bovis AF2122/97
cgaggucugcggcc

SEQ ID NO: 3051230 - RNA, 15 nt, Mycobacterium bovis subsp bovis AF2122/97
cgaggucugguagag

SEQ ID NO: 3051231 - RNA, 16 nt, Mycobacterium bovis subsp bovis AF2122/97
cgaggugagguugacc

SEQ ID NO: 3051232 - RNA, 19 nt, Mycobacterium bovis subsp bovis AF2122/97
cgaggugagguugaccccc

SEQ ID NO: 3051233 - RNA, 20 nt, Mycobacterium bovis subsp bovis AF2122/97
cgaggugagguugacccccg

SEQ ID NO: 3051234 - RNA, 20 nt, Mycobacterium bovis subsp bovis AF2122/97
cgaggugauguuggccgcca

SEQ ID NO: 3051235 - RNA, 20 nt, Mycobacterium bovis subsp bovis AF2122/97
cgaggugcccaaggccagga

SEQ ID NO: 3051236 - RNA, 20 nt, Mycobacterium bovis subsp bovis AF2122/97
cgaggugccgcgcagcugcc

SEQ ID NO: 3051237 - RNA, 20 nt, Mycobacterium bovis subsp bovis AF2122/97
cgaggugccuguugcgacca

SEQ ID NO: 3051238 - RNA, 14 nt, Mycobacterium bovis subsp bovis AF2122/97
cgaggugcucggau

SEQ ID NO: 3051239 - RNA, 22 nt, Mycobacterium bovis subsp bovis AF2122/97
cgaggugcucggaucggcucgc

SEQ ID NO: 3051240 - RNA, 20 nt, Mycobacterium bovis subsp bovis AF2122/97
cgaggugcuuggggucaccc

SEQ ID NO: 3051241 - RNA, 17 nt, Mycobacterium bovis subsp bovis AF2122/97
cgagguggacaaaucga

SEQ ID NO: 3051242 - RNA, 14 nt, Mycobacterium bovis subsp bovis AF2122/97
cgagguggcgcaca

SEQ ID NO: 3051243 - RNA, 20 nt, Mycobacterium bovis subsp bovis AF2122/97
cgagguggcgcacaucgcga

SEQ ID NO: 3051244 - RNA, 14 nt, Mycobacterium bovis subsp bovis AF2122/97
cgagguggcugcgc

SEQ ID NO: 3051245 - RNA, 15 nt, Mycobacterium bovis subsp bovis AF2122/97
cgaggugggcgucau

SEQ ID NO: 3051246 - RNA, 17 nt, Mycobacterium bovis subsp bovis AF2122/97
cgagguggggugguggu

SEQ ID NO: 3051247 - RNA, 23 nt, Mycobacterium bovis subsp bovis AF2122/97
cgagguggucacgcagucgggca

SEQ ID NO: 3051248 - RNA, 14 nt, Mycobacterium bovis subsp bovis AF2122/97
cgagguggucgacc

SEQ ID NO: 3051249 - RNA, 17 nt, Mycobacterium bovis subsp bovis AF2122/97
cgagguggucgacccgg

SEQ ID NO: 3051250 - RNA, 18 nt, Mycobacterium bovis subsp bovis AF2122/97
cgagguguagcccuccga

SEQ ID NO: 3051251 - RNA, 14 nt, Mycobacterium bovis subsp bovis AF2122/97
cgagguucagccug

SEQ ID NO: 3051252 - RNA, 20 nt, Mycobacterium bovis subsp bovis AF2122/97
cgagguuccacuuggucacc

SEQ ID NO: 3051253 - RNA, 16 nt, Mycobacterium bovis subsp bovis AF2122/97
cgagguugaccaccag

SEQ ID NO: 3051254 - RNA, 18 nt, Mycobacterium bovis subsp bovis AF2122/97
cgagguugaccaccagcg

SEQ ID NO: 3051255 - RNA, 19 nt, Mycobacterium bovis subsp bovis AF2122/97
cgagguugacgucaggcug

SEQ ID NO: 3051256 - RNA, 15 nt, Mycobacterium bovis subsp bovis AF2122/97
cgagguugccgcacc

SEQ ID NO: 3051257 - RNA, 13 nt, Mycobacterium bovis subsp bovis AF2122/97
cgagguugcgccg

SEQ ID NO: 3051258 - RNA, 18 nt, Mycobacterium bovis subsp bovis AF2122/97
cgagguugcgccgaccgg

SEQ ID NO: 3051259 - RNA, 17 nt, Mycobacterium bovis subsp bovis AF2122/97
cgaguacaggcgcagcg

SEQ ID NO: 3051260 - RNA, 17 nt, Mycobacterium bovis subsp bovis AF2122/97
cgaguaccagcccaccg

SEQ ID NO: 3051261 - RNA, 18 nt, Mycobacterium bovis subsp bovis AF2122/97
cgaguaccagcccaccgg

SEQ ID NO: 3051262 - RNA, 22 nt, Mycobacterium bovis subsp bovis AF2122/97
cgaguaccagcccaccggcgcc

SEQ ID NO: 3051263 - RNA, 14 nt, Mycobacterium bovis subsp bovis AF2122/97
cgaguaccaggacg

SEQ ID NO: 3051264 - RNA, 15 nt, Mycobacterium bovis subsp bovis AF2122/97
cgaguacccaaccgg

SEQ ID NO: 3051265 - RNA, 17 nt, Mycobacterium bovis subsp bovis AF2122/97
cgaguacccaaccggua

SEQ ID NO: 3051266 - RNA, 19 nt, Mycobacterium bovis subsp bovis AF2122/97
cgaguaccgauagccugcg

SEQ ID NO: 3051267 - RNA, 16 nt, Mycobacterium bovis subsp bovis AF2122/97
cgaguaccggccagcc

SEQ ID NO: 3051268 - RNA, 19 nt, Mycobacterium bovis subsp bovis AF2122/97
cgaguaccggccagccgcg

SEQ ID NO: 3051269 - RNA, 16 nt, Mycobacterium bovis subsp bovis AF2122/97
cgaguacggccugccg

SEQ ID NO: 3051270 - RNA, 20 nt, Mycobacterium bovis subsp bovis AF2122/97
cgaguagaagauggcaccgc

SEQ ID NO: 3051271 - RNA, 19 nt, Mycobacterium bovis subsp bovis AF2122/97
cgauaaccgaaacucgacg

SEQ ID NO: 3051272 - RNA, 22 nt, Mycobacterium bovis subsp bovis AF2122/97
cgauaaccuggcggucccgcau

SEQ ID NO: 3051273 - RNA, 16 nt, Mycobacterium bovis subsp bovis AF2122/97
cgauaacuccgcggcg

SEQ ID NO: 3051274 - RNA, 15 nt, Mycobacterium bovis subsp bovis AF2122/97
cgauaaggaccgcgc

SEQ ID NO: 3051275 - RNA, 18 nt, Mycobacterium bovis subsp bovis AF2122/97
cgauaaggaccgcgccca

SEQ ID NO: 3051276 - RNA, 19 nt, Mycobacterium bovis subsp bovis AF2122/97
cgauaagguucgugcguug

SEQ ID NO: 3051277 - RNA, 14 nt, Mycobacterium bovis subsp bovis AF2122/97
cgauacaccgacgg

SEQ ID NO: 3051278 - RNA, 20 nt, Mycobacterium bovis subsp bovis AF2122/97
cgauacacggcggcgauguc

SEQ ID NO: 3051279 - RNA, 13 nt, Mycobacterium bovis subsp bovis AF2122/97
cgauacccaccgu

SEQ ID NO: 3051280 - RNA, 14 nt, Mycobacterium bovis subsp bovis AF2122/97
cgauaccgaccgaa

SEQ ID NO: 3051281 - RNA, 14 nt, Mycobacterium bovis subsp bovis AF2122/97
cgauaccgcaccaa

SEQ ID NO: 3051282 - RNA, 15 nt, Mycobacterium bovis subsp bovis AF2122/97
cgauaccgccggccc

SEQ ID NO: 3051283 - RNA, 16 nt, Mycobacterium bovis subsp bovis AF2122/97
cgauaccgccggcccc

SEQ ID NO: 3051284 - RNA, 23 nt, Mycobacterium bovis subsp bovis AF2122/97
cgauaccgccggccccaccggug

SEQ ID NO: 3051285 - RNA, 16 nt, Mycobacterium bovis subsp bovis AF2122/97
cgauaccggcggcgag

SEQ ID NO: 3051286 - RNA, 13 nt, Mycobacterium bovis subsp bovis AF2122/97
cgauaccggcgug

SEQ ID NO: 3051287 - RNA, 14 nt, Mycobacterium bovis subsp bovis AF2122/97
cgauaccggcgugc

SEQ ID NO: 3051288 - RNA, 19 nt, Mycobacterium bovis subsp bovis AF2122/97
cgauaccgguugcggucau

SEQ ID NO: 3051289 - RNA, 16 nt, Mycobacterium bovis subsp bovis AF2122/97
cgauaccgucgugcgu

SEQ ID NO: 3051290 - RNA, 20 nt, Mycobacterium bovis subsp bovis AF2122/97
cgauaccuagccccugaagg

SEQ ID NO: 3051291 - RNA, 16 nt, Mycobacterium bovis subsp bovis AF2122/97
cgauacgaagccgccg

SEQ ID NO: 3051292 - RNA, 18 nt, Mycobacterium bovis subsp bovis AF2122/97
cgauacgaagccgccgcg

SEQ ID NO: 3051293 - RNA, 22 nt, Mycobacterium bovis subsp bovis AF2122/97
cgauacgaagccgccgcgacca

SEQ ID NO: 3051294 - RNA, 14 nt, Mycobacterium bovis subsp bovis AF2122/97
cgauacgccaccgg

SEQ ID NO: 3051295 - RNA, 16 nt, Mycobacterium bovis subsp bovis AF2122/97
cgauacgccaccggca

SEQ ID NO: 3051296 - RNA, 21 nt, Mycobacterium bovis subsp bovis AF2122/97
cgauacgccaccggcaaucgg

SEQ ID NO: 3051297 - RNA, 15 nt, Mycobacterium bovis subsp bovis AF2122/97
cgauacgcgcaccgu

SEQ ID NO: 3051298 - RNA, 15 nt, Mycobacterium bovis subsp bovis AF2122/97
cgauacggccggccg

SEQ ID NO: 3051299 - RNA, 18 nt, Mycobacterium bovis subsp bovis AF2122/97
cgauacggccggccguug

SEQ ID NO: 3051300 - RNA, 15 nt, Mycobacterium bovis subsp bovis AF2122/97
cgauacggguguggc

SEQ ID NO: 3051301 - RNA, 20 nt, Mycobacterium bovis subsp bovis AF2122/97
cgauacggguguggccguug

SEQ ID NO: 3051302 - RNA, 19 nt, Mycobacterium bovis subsp bovis AF2122/97
cgauacuaaacaggccgcc

SEQ ID NO: 3051303 - RNA, 20 nt, Mycobacterium bovis subsp bovis AF2122/97
cgauagaacguagcgcccac

SEQ ID NO: 3051304 - RNA, 19 nt, Mycobacterium bovis subsp bovis AF2122/97
cgauagauacccgcggcag

SEQ ID NO: 3051305 - RNA, 15 nt, Mycobacterium bovis subsp bovis AF2122/97
cgauagaucgcgugg

SEQ ID NO: 3051306 - RNA, 15 nt, Mycobacterium bovis subsp bovis AF2122/97
cgauagccaccgacg

SEQ ID NO: 3051307 - RNA, 12 nt, Mycobacterium bovis subsp bovis AF2122/97
cgauagcccgcc

SEQ ID NO: 3051308 - RNA, 16 nt, Mycobacterium bovis subsp bovis AF2122/97
cgauagcccgccaccc

SEQ ID NO: 3051309 - RNA, 18 nt, Mycobacterium bovis subsp bovis AF2122/97
cgauagccgaaaaagacc

SEQ ID NO: 3051310 - RNA, 12 nt, Mycobacterium bovis subsp bovis AF2122/97
cgauagccgccg

SEQ ID NO: 3051311 - RNA, 17 nt, Mycobacterium bovis subsp bovis AF2122/97
cgauagccgccgcgguc

SEQ ID NO: 3051312 - RNA, 14 nt, Mycobacterium bovis subsp bovis AF2122/97
cgauagcgcggcac

SEQ ID NO: 3051313 - RNA, 17 nt, Mycobacterium bovis subsp bovis AF2122/97
cgauagcggauucacgc

SEQ ID NO: 3051314 - RNA, 13 nt, Mycobacterium bovis subsp bovis AF2122/97
cgauagcggcggc

SEQ ID NO: 3051315 - RNA, 13 nt, Mycobacterium bovis subsp bovis AF2122/97
cgauaggcccggu

SEQ ID NO: 3051316 - RNA, 15 nt, Mycobacterium bovis subsp bovis AF2122/97
cgauaggugaacgcu

SEQ ID NO: 3051317 - RNA, 20 nt, Mycobacterium bovis subsp bovis AF2122/97
cgauagucauucgcuccggu

SEQ ID NO: 3051318 - RNA, 19 nt, Mycobacterium bovis subsp bovis AF2122/97
cgauaguucuggcccgcag

SEQ ID NO: 3051319 - RNA, 23 nt, Mycobacterium bovis subsp bovis AF2122/97
cgauauaacccggcuccagcacc

SEQ ID NO: 3051320 - RNA, 15 nt, Mycobacterium bovis subsp bovis AF2122/97
cgauauaccagggca

SEQ ID NO: 3051321 - RNA, 14 nt, Mycobacterium bovis subsp bovis AF2122/97
cgauauagccgccg

SEQ ID NO: 3051322 - RNA, 19 nt, Mycobacterium bovis subsp bovis AF2122/97
cgauauaggacgccgcgcc

SEQ ID NO: 3051323 - RNA, 22 nt, Mycobacterium bovis subsp bovis AF2122/97
cgauauaggacgccgcgccgca

SEQ ID NO: 3051324 - RNA, 20 nt, Mycobacterium bovis subsp bovis AF2122/97
cgauaucgaugcggcgacca

SEQ ID NO: 3051325 - RNA, 16 nt, Mycobacterium bovis subsp bovis AF2122/97
cgauaucggcccccaa

SEQ ID NO: 3051326 - RNA, 16 nt, Mycobacterium bovis subsp bovis AF2122/97
cgauaucggcggcuug

SEQ ID NO: 3051327 - RNA, 18 nt, Mycobacterium bovis subsp bovis AF2122/97
cgauaucggcggcuuggc

SEQ ID NO: 3051328 - RNA, 15 nt, Mycobacterium bovis subsp bovis AF2122/97
cgauaucgggcucag

SEQ ID NO: 3051329 - RNA, 19 nt, Mycobacterium bovis subsp bovis AF2122/97
cgauaucggugaccguggc

SEQ ID NO: 3051330 - RNA, 21 nt, Mycobacterium bovis subsp bovis AF2122/97
cgauaucguuggcgaccaccg

SEQ ID NO: 3051331 - RNA, 12 nt, Mycobacterium bovis subsp bovis AF2122/97
cgauaucugcca

SEQ ID NO: 3051332 - RNA, 13 nt, Mycobacterium bovis subsp bovis AF2122/97
cgauaucugccac

SEQ ID NO: 3051333 - RNA, 22 nt, Mycobacterium bovis subsp bovis AF2122/97
cgauaugcgugagcugcucgag

SEQ ID NO: 3051334 - RNA, 21 nt, Mycobacterium bovis subsp bovis AF2122/97
cgauauggccuugcugcgcga

SEQ ID NO: 3051335 - RNA, 14 nt, Mycobacterium bovis subsp bovis AF2122/97
cgauauucggccau

SEQ ID NO: 3051336 - RNA, 20 nt, Mycobacterium bovis subsp bovis AF2122/97
cgauauuggacgcgcaugcc

SEQ ID NO: 3051337 - RNA, 13 nt, Mycobacterium bovis subsp bovis AF2122/97
cgauauugggaua

SEQ ID NO: 3051338 - RNA, 18 nt, Mycobacterium bovis subsp bovis AF2122/97
cgaucaaagccagcaccu

SEQ ID NO: 3051339 - RNA, 19 nt, Mycobacterium bovis subsp bovis AF2122/97
cgaucaacaacagccgcag

SEQ ID NO: 3051340 - RNA, 21 nt, Mycobacterium bovis subsp bovis AF2122/97
cgaucaacaccaacgacagcg

SEQ ID NO: 3051341 - RNA, 16 nt, Mycobacterium bovis subsp bovis AF2122/97
cgaucaacaccaaucg

SEQ ID NO: 3051342 - RNA, 18 nt, Mycobacterium bovis subsp bovis AF2122/97
cgaucaaccgcugucacc

SEQ ID NO: 3051343 - RNA, 21 nt, Mycobacterium bovis subsp bovis AF2122/97
cgaucaaccgggucagcccag

SEQ ID NO: 3051344 - RNA, 15 nt, Mycobacterium bovis subsp bovis AF2122/97
cgaucaacgcgcacc

SEQ ID NO: 3051345 - RNA, 14 nt, Mycobacterium bovis subsp bovis AF2122/97
cgaucaacgcguug

SEQ ID NO: 3051346 - RNA, 15 nt, Mycobacterium bovis subsp bovis AF2122/97
cgaucaacggaucga

SEQ ID NO: 3051347 - RNA, 18 nt, Mycobacterium bovis subsp bovis AF2122/97
cgaucaacucgugcgggc

SEQ ID NO: 3051348 - RNA, 13 nt, Mycobacterium bovis subsp bovis AF2122/97
cgaucaagccuuc

SEQ ID NO: 3051349 - RNA, 15 nt, Mycobacterium bovis subsp bovis AF2122/97
cgaucaauugcccgg

SEQ ID NO: 3051350 - RNA, 19 nt, Mycobacterium bovis subsp bovis AF2122/97
cgaucaauugcccggcacg

SEQ ID NO: 3051351 - RNA, 13 nt, Mycobacterium bovis subsp bovis AF2122/97
cgaucacaccacg

SEQ ID NO: 3051352 - RNA, 17 nt, Mycobacterium bovis subsp bovis AF2122/97
cgaucacacgguccgcc

SEQ ID NO: 3051353 - RNA, 22 nt, Mycobacterium bovis subsp bovis AF2122/97
cgaucaccaccggaucgcuccc

SEQ ID NO: 3051354 - RNA, 15 nt, Mycobacterium bovis subsp bovis AF2122/97
cgaucaccacggcgu

SEQ ID NO: 3051355 - RNA, 17 nt, Mycobacterium bovis subsp bovis AF2122/97
cgaucaccacggcguug

SEQ ID NO: 3051356 - RNA, 15 nt, Mycobacterium bovis subsp bovis AF2122/97
cgaucaccauccagc

SEQ ID NO: 3051357 - RNA, 15 nt, Mycobacterium bovis subsp bovis AF2122/97
cgaucacccccugga

SEQ ID NO: 3051358 - RNA, 21 nt, Mycobacterium bovis subsp bovis AF2122/97
cgauccaccaagcucgcaacc

SEQ ID NO: 3051359 - RNA, 13 nt, Mycobacterium bovis subsp bovis AF2122/97
cgauccacccggc

SEQ ID NO: 3051360 - RNA, 14 nt, Mycobacterium bovis subsp bovis AF2122/97
cgauccacccggca

SEQ ID NO: 3051361 - RNA, 16 nt, Mycobacterium bovis subsp bovis AF2122/97
cgauccacggcgaugc

SEQ ID NO: 3051362 - RNA, 20 nt, Mycobacterium bovis subsp bovis AF2122/97
cgauccacggcgaugcagcc

SEQ ID NO: 3051363 - RNA, 14 nt, Mycobacterium bovis subsp bovis AF2122/97
cgauccacuccggc

SEQ ID NO: 3051364 - RNA, 22 nt, Mycobacterium bovis subsp bovis AF2122/97
cgauccacuguagggccgguga

SEQ ID NO: 3051365 - RNA, 13 nt, Mycobacterium bovis subsp bovis AF2122/97
cgauccagacggu

SEQ ID NO: 3051366 - RNA, 15 nt, Mycobacterium bovis subsp bovis AF2122/97
cgauccagcaggccg

SEQ ID NO: 3051367 - RNA, 22 nt, Mycobacterium bovis subsp bovis AF2122/97
cgauccagcaggccgucgauca

SEQ ID NO: 3051368 - RNA, 23 nt, Mycobacterium bovis subsp bovis AF2122/97
cgauccagcccaacucggccagc

SEQ ID NO: 3051369 - RNA, 12 nt, Mycobacterium bovis subsp bovis AF2122/97
cgauccagcgcu

SEQ ID NO: 3051370 - RNA, 14 nt, Mycobacterium bovis subsp bovis AF2122/97
cgauccagcgggua

SEQ ID NO: 3051371 - RNA, 13 nt, Mycobacterium bovis subsp bovis AF2122/97
cgauccagggccg

SEQ ID NO: 3051372 - RNA, 17 nt, Mycobacterium bovis subsp bovis AF2122/97
cgauccagggccgacgc

SEQ ID NO: 3051373 - RNA, 18 nt, Mycobacterium bovis subsp bovis AF2122/97
cgauccagggccgacgcg

SEQ ID NO: 3051374 - RNA, 22 nt, Mycobacterium bovis subsp bovis AF2122/97
cgauccagggucaccucgucgc

SEQ ID NO: 3051375 - RNA, 21 nt, Mycobacterium bovis subsp bovis AF2122/97
cgauccagugguaggccgccg

SEQ ID NO: 3051376 - RNA, 19 nt, Mycobacterium bovis subsp bovis AF2122/97
cgauccaguucaccgcgcu

SEQ ID NO: 3051377 - RNA, 16 nt, Mycobacterium bovis subsp bovis AF2122/97
cgaucccaacgcccgg

SEQ ID NO: 3051378 - RNA, 17 nt, Mycobacterium bovis subsp bovis AF2122/97
cgaucccaacgcccggg

SEQ ID NO: 3051379 - RNA, 18 nt, Mycobacterium bovis subsp bovis AF2122/97
cgaucccaacgcccgggc

SEQ ID NO: 3051380 - RNA, 20 nt, Mycobacterium bovis subsp bovis AF2122/97
cgaucccaacgcccgggcga

SEQ ID NO: 3051381 - RNA, 15 nt, Mycobacterium bovis subsp bovis AF2122/97
cgaucccaccggcua

SEQ ID NO: 3051382 - RNA, 19 nt, Mycobacterium bovis subsp bovis AF2122/97
cgauccccacaaucagccc

SEQ ID NO: 3051383 - RNA, 20 nt, Mycobacterium bovis subsp bovis AF2122/97
cgauccccacaaucagcccg

SEQ ID NO: 3051384 - RNA, 14 nt, Mycobacterium bovis subsp bovis AF2122/97
cgauccccagcacc

SEQ ID NO: 3051385 - RNA, 15 nt, Mycobacterium bovis subsp bovis AF2122/97
cgauccccagcacca

SEQ ID NO: 3051386 - RNA, 16 nt, Mycobacterium bovis subsp bovis AF2122/97
cgauccccagcaccac

SEQ ID NO: 3051387 - RNA, 17 nt, Mycobacterium bovis subsp bovis AF2122/97
cgauccccagcaccacg

SEQ ID NO: 3051388 - RNA, 19 nt, Mycobacterium bovis subsp bovis AF2122/97
cgauccccagcaccacggu

SEQ ID NO: 3051389 - RNA, 15 nt, Mycobacterium bovis subsp bovis AF2122/97
cgauccccgcgcuga

SEQ ID NO: 3051390 - RNA, 14 nt, Mycobacterium bovis subsp bovis AF2122/97
cgaucccgcggccg

SEQ ID NO: 3051391 - RNA, 18 nt, Mycobacterium bovis subsp bovis AF2122/97
cgaucccgcggccgggcc

SEQ ID NO: 3051392 - RNA, 14 nt, Mycobacterium bovis subsp bovis AF2122/97
cgaucccggccagc

SEQ ID NO: 3051393 - RNA, 12 nt, Mycobacterium bovis subsp bovis AF2122/97
cgaucccggccg

SEQ ID NO: 3051394 - RNA, 13 nt, Mycobacterium bovis subsp bovis AF2122/97
cgaucccggccgu

SEQ ID NO: 3051395 - RNA, 22 nt, Mycobacterium bovis subsp bovis AF2122/97
cgaucccggcgagcacccgcug

SEQ ID NO: 3051396 - RNA, 12 nt, Mycobacterium bovis subsp bovis AF2122/97
cgaucccggcgg

SEQ ID NO: 3051397 - RNA, 18 nt, Mycobacterium bovis subsp bovis AF2122/97
cgaucccguccgcgccca

SEQ ID NO: 3051398 - RNA, 21 nt, Mycobacterium bovis subsp bovis AF2122/97
cgaucccguccgcgcccaccg

SEQ ID NO: 3051399 - RNA, 23 nt, Mycobacterium bovis subsp bovis AF2122/97
cgaucccgucgggcacaccgacg

SEQ ID NO: 3051400 - RNA, 19 nt, Mycobacterium bovis subsp bovis AF2122/97
cgaucccgugguggcgcca

SEQ ID NO: 3051401 - RNA, 13 nt, Mycobacterium bovis subsp bovis AF2122/97
cgauccgacgacc

SEQ ID NO: 3051402 - RNA, 14 nt, Mycobacterium bovis subsp bovis AF2122/97
cgauccgagaccgc

SEQ ID NO: 3051403 - RNA, 18 nt, Mycobacterium bovis subsp bovis AF2122/97
cgauccgauaaauggccg

SEQ ID NO: 3051404 - RNA, 12 nt, Mycobacterium bovis subsp bovis AF2122/97
cgauccgauaca

SEQ ID NO: 3051405 - RNA, 14 nt, Mycobacterium bovis subsp bovis AF2122/97
cgauccgauccgcu

SEQ ID NO: 3051406 - RNA, 21 nt, Mycobacterium bovis subsp bovis AF2122/97
cgauccgcaacaacgccgcga

SEQ ID NO: 3051407 - RNA, 14 nt, Mycobacterium bovis subsp bovis AF2122/97
cgauccgcacagca

SEQ ID NO: 3051408 - RNA, 14 nt, Mycobacterium bovis subsp bovis AF2122/97
cgauccgccacgaa

SEQ ID NO: 3051409 - RNA, 22 nt, Mycobacterium bovis subsp bovis AF2122/97
cgauccgcgcgcauauccgcag

SEQ ID NO: 3051410 - RNA, 15 nt, Mycobacterium bovis subsp bovis AF2122/97
cgauccgcggcguuc

SEQ ID NO: 3051411 - RNA, 20 nt, Mycobacterium bovis subsp bovis AF2122/97
cgauccgcggcguuccccga

SEQ ID NO: 3051412 - RNA, 13 nt, Mycobacterium bovis subsp bovis AF2122/97
cgauccgcugcgc

SEQ ID NO: 3051413 - RNA, 15 nt, Mycobacterium bovis subsp bovis AF2122/97
cgauccggcgcacga

SEQ ID NO: 3051414 - RNA, 17 nt, Mycobacterium bovis subsp bovis AF2122/97
cgauccggcugcgggaa

SEQ ID NO: 3051415 - RNA, 16 nt, Mycobacterium bovis subsp bovis AF2122/97
cgauccggucggccag

SEQ ID NO: 3051416 - RNA, 17 nt, Mycobacterium bovis subsp bovis AF2122/97
cgauccggucggccagg

SEQ ID NO: 3051417 - RNA, 16 nt, Mycobacterium bovis subsp bovis AF2122/97
cgauccggucggcggg

SEQ ID NO: 3051418 - RNA, 12 nt, Mycobacterium bovis subsp bovis AF2122/97
cgauccggugcc

SEQ ID NO: 3051419 - RNA, 13 nt, Mycobacterium bovis subsp bovis AF2122/97
cgauccggugccg

SEQ ID NO: 3051420 - RNA, 19 nt, Mycobacterium bovis subsp bovis AF2122/97
cgauccgguuaugcgguac

SEQ ID NO: 3051421 - RNA, 12 nt, Mycobacterium bovis subsp bovis AF2122/97
cgauccgucggc

SEQ ID NO: 3051422 - RNA, 15 nt, Mycobacterium bovis subsp bovis AF2122/97
cgauccucgcccgca

SEQ ID NO: 3051423 - RNA, 18 nt, Mycobacterium bovis subsp bovis AF2122/97
cgauccucgcccgcacca

SEQ ID NO: 3051424 - RNA, 15 nt, Mycobacterium bovis subsp bovis AF2122/97
cgauccugaccagcc

SEQ ID NO: 3051425 - RNA, 17 nt, Mycobacterium bovis subsp bovis AF2122/97
cgauccugcccaccauc

SEQ ID NO: 3051426 - RNA, 19 nt, Mycobacterium bovis subsp bovis AF2122/97
cgaucgaauuaaagccacc

SEQ ID NO: 3051427 - RNA, 20 nt, Mycobacterium bovis subsp bovis AF2122/97
cgaucgaauuaaagccacca

SEQ ID NO: 3051428 - RNA, 18 nt, Mycobacterium bovis subsp bovis AF2122/97
cgaucgacaccagggcgu

SEQ ID NO: 3051429 - RNA, 13 nt, Mycobacterium bovis subsp bovis AF2122/97
cgaucgacagccc

SEQ ID NO: 3051430 - RNA, 18 nt, Mycobacterium bovis subsp bovis AF2122/97
cgaucgacccggucgacg

SEQ ID NO: 3051431 - RNA, 13 nt, Mycobacterium bovis subsp bovis AF2122/97
cgaucgacgccgc

SEQ ID NO: 3051432 - RNA, 18 nt, Mycobacterium bovis subsp bovis AF2122/97
cgaucgacgccgccaccc

SEQ ID NO: 3051433 - RNA, 20 nt, Mycobacterium bovis subsp bovis AF2122/97
cgaucgacgccgccacccgg

SEQ ID NO: 3051434 - RNA, 22 nt, Mycobacterium bovis subsp bovis AF2122/97
cgaucgacgccgccacccggcg

SEQ ID NO: 3051435 - RNA, 16 nt, Mycobacterium bovis subsp bovis AF2122/97
cgaucgacgcucggcu

SEQ ID NO: 3051436 - RNA, 23 nt, Mycobacterium bovis subsp bovis AF2122/97
cgaucgacggugucaugaacgac

SEQ ID NO: 3051437 - RNA, 16 nt, Mycobacterium bovis subsp bovis AF2122/97
cgaucgacugcagccc

SEQ ID NO: 3051438 - RNA, 21 nt, Mycobacterium bovis subsp bovis AF2122/97
cgaucgagcccggagcgguca

SEQ ID NO: 3051439 - RNA, 22 nt, Mycobacterium bovis subsp bovis AF2122/97
cgaucgaggaguuggugcagcg

SEQ ID NO: 3051440 - RNA, 23 nt, Mycobacterium bovis subsp bovis AF2122/97
cgaucgaggugauguuggccgcc

SEQ ID NO: 3051441 - RNA, 13 nt, Mycobacterium bovis subsp bovis AF2122/97
cgaucgauaucgg

SEQ ID NO: 3051442 - RNA, 20 nt, Mycobacterium bovis subsp bovis AF2122/97
cgaucgauaucggcaaucag

SEQ ID NO: 3051443 - RNA, 15 nt, Mycobacterium bovis subsp bovis AF2122/97
cgaucgauuccgcuc

SEQ ID NO: 3051444 - RNA, 21 nt, Mycobacterium bovis subsp bovis AF2122/97
cgaucgcagacacugcugcgg

SEQ ID NO: 3051445 - RNA, 16 nt, Mycobacterium bovis subsp bovis AF2122/97
cgaucggugaaucguc

SEQ ID NO: 3051446 - RNA, 21 nt, Mycobacterium bovis subsp bovis AF2122/97
cgaucggugccgaagcugccc

SEQ ID NO: 3051447 - RNA, 22 nt, Mycobacterium bovis subsp bovis AF2122/97
cgaucggugccgaagcugccca

SEQ ID NO: 3051448 - RNA, 14 nt, Mycobacterium bovis subsp bovis AF2122/97
cgaucggugccggc

SEQ ID NO: 3051449 - RNA, 17 nt, Mycobacterium bovis subsp bovis AF2122/97
cgaucggugcgggcgcc

SEQ ID NO: 3051450 - RNA, 21 nt, Mycobacterium bovis subsp bovis AF2122/97
cgaucggugcgggcgccgcua

SEQ ID NO: 3051451 - RNA, 24 nt, Mycobacterium bovis subsp bovis AF2122/97
cgaucguagguacgcagggucugu

SEQ ID NO: 3051452 - RNA, 19 nt, Mycobacterium bovis subsp bovis AF2122/97
cgaucgucaacgacgacga

SEQ ID NO: 3051453 - RNA, 15 nt, Mycobacterium bovis subsp bovis AF2122/97
cgaucgucaagccgg

SEQ ID NO: 3051454 - RNA, 18 nt, Mycobacterium bovis subsp bovis AF2122/97
cgaucgucacgcggguug

SEQ ID NO: 3051455 - RNA, 19 nt, Mycobacterium bovis subsp bovis AF2122/97
cgaucgucagccagcguug

SEQ ID NO: 3051456 - RNA, 15 nt, Mycobacterium bovis subsp bovis AF2122/97
cgaucgucgacgcgu

SEQ ID NO: 3051457 - RNA, 23 nt, Mycobacterium bovis subsp bovis AF2122/97
cgaucgucgacucggcggcgcgg

SEQ ID NO: 3051458 - RNA, 21 nt, Mycobacterium bovis subsp bovis AF2122/97
cgaucgucgcggccaaggcga

SEQ ID NO: 3051459 - RNA, 17 nt, Mycobacterium bovis subsp bovis AF2122/97
cgaucgucuugucgccg

SEQ ID NO: 3051460 - RNA, 19 nt, Mycobacterium bovis subsp bovis AF2122/97
cgaucgugccccuagaguu

SEQ ID NO: 3051461 - RNA, 17 nt, Mycobacterium bovis subsp bovis AF2122/97
cgaucgugccgggaccg

SEQ ID NO: 3051462 - RNA, 14 nt, Mycobacterium bovis subsp bovis AF2122/97
cgaucgugcgaucg

SEQ ID NO: 3051463 - RNA, 13 nt, Mycobacterium bovis subsp bovis AF2122/97
cgaucgugcugcc

SEQ ID NO: 3051464 - RNA, 16 nt, Mycobacterium bovis subsp bovis AF2122/97
cgaucgugcugcccgc

SEQ ID NO: 3051465 - RNA, 19 nt, Mycobacterium bovis subsp bovis AF2122/97
cgaucguuucagcuagacc

SEQ ID NO: 3051466 - RNA, 16 nt, Mycobacterium bovis subsp bovis AF2122/97
cgaucuccaggcccgg

SEQ ID NO: 3051467 - RNA, 19 nt, Mycobacterium bovis subsp bovis AF2122/97
cgaucuccaggcccggcgg

SEQ ID NO: 3051468 - RNA, 16 nt, Mycobacterium bovis subsp bovis AF2122/97
cgaucuccgccaaccg

SEQ ID NO: 3051469 - RNA, 13 nt, Mycobacterium bovis subsp bovis AF2122/97
cgaucuccggcgg

SEQ ID NO: 3051470 - RNA, 16 nt, Mycobacterium bovis subsp bovis AF2122/97
cgaucuccggcggauc

SEQ ID NO: 3051471 - RNA, 21 nt, Mycobacterium bovis subsp bovis AF2122/97
cgaucuccgugagccggaccg

SEQ ID NO: 3051472 - RNA, 13 nt, Mycobacterium bovis subsp bovis AF2122/97
cgaucucgaccag

SEQ ID NO: 3051473 - RNA, 15 nt, Mycobacterium bovis subsp bovis AF2122/97
cgaucucgaccagcg

SEQ ID NO: 3051474 - RNA, 13 nt, Mycobacterium bovis subsp bovis AF2122/97
cgaucucgaccgu

SEQ ID NO: 3051475 - RNA, 23 nt, Mycobacterium bovis subsp bovis AF2122/97
cgaucucgaccguauugaccagc

SEQ ID NO: 3051476 - RNA, 21 nt, Mycobacterium bovis subsp bovis AF2122/97
cgaucucgagcaggcgcacca

SEQ ID NO: 3051477 - RNA, 18 nt, Mycobacterium bovis subsp bovis AF2122/97
cgaucucgaucgacccgg

SEQ ID NO: 3051478 - RNA, 23 nt, Mycobacterium bovis subsp bovis AF2122/97
cgaucucgcccagcgagcgccag

SEQ ID NO: 3051479 - RNA, 16 nt, Mycobacterium bovis subsp bovis AF2122/97
cgaucucgccgccagc

SEQ ID NO: 3051480 - RNA, 22 nt, Mycobacterium bovis subsp bovis AF2122/97
cgaucucgccggcgaagaccgc

SEQ ID NO: 3051481 - RNA, 19 nt, Mycobacterium bovis subsp bovis AF2122/97
cgaucucggagcgcacgaa

SEQ ID NO: 3051482 - RNA, 13 nt, Mycobacterium bovis subsp bovis AF2122/97
cgaucucggccag

SEQ ID NO: 3051483 - RNA, 12 nt, Mycobacterium bovis subsp bovis AF2122/97
cgaucucggcgg

SEQ ID NO: 3051484 - RNA, 17 nt, Mycobacterium bovis subsp bovis AF2122/97
cgaucucggcggccgcg

SEQ ID NO: 3051485 - RNA, 20 nt, Mycobacterium bovis subsp bovis AF2122/97
cgaucucgucgcggucgauc

SEQ ID NO: 3051486 - RNA, 22 nt, Mycobacterium bovis subsp bovis AF2122/97
cgaucucgucgcggucgaucac

SEQ ID NO: 3051487 - RNA, 23 nt, Mycobacterium bovis subsp bovis AF2122/97
cgaucucgucgcggucgaucaca

SEQ ID NO: 3051488 - RNA, 21 nt, Mycobacterium bovis subsp bovis AF2122/97
cgaucucguggaucugccucu

SEQ ID NO: 3051489 - RNA, 19 nt, Mycobacterium bovis subsp bovis AF2122/97
cgaucucuaccagccgccc

SEQ ID NO: 3051490 - RNA, 15 nt, Mycobacterium bovis subsp bovis AF2122/97
cgaucucuccggcgg

SEQ ID NO: 3051491 - RNA, 19 nt, Mycobacterium bovis subsp bovis AF2122/97
cgaucucuccggcggcgaa

SEQ ID NO: 3051492 - RNA, 23 nt, Mycobacterium bovis subsp bovis AF2122/97
cgaucucuugguagugacugcga

SEQ ID NO: 3051493 - RNA, 19 nt, Mycobacterium bovis subsp bovis AF2122/97
cgaucugcacgagugcggc

SEQ ID NO: 3051494 - RNA, 20 nt, Mycobacterium bovis subsp bovis AF2122/97
cgaucugcagcacucggugu

SEQ ID NO: 3051495 - RNA, 14 nt, Mycobacterium bovis subsp bovis AF2122/97
cgaucugcagcgcg

SEQ ID NO: 3051496 - RNA, 15 nt, Mycobacterium bovis subsp bovis AF2122/97
cgaucugcagcgcgg

SEQ ID NO: 3051497 - RNA, 18 nt, Mycobacterium bovis subsp bovis AF2122/97
cgaucugcaggcccaggc

SEQ ID NO: 3051498 - RNA, 19 nt, Mycobacterium bovis subsp bovis AF2122/97
cgaucugcccccgccggcc

SEQ ID NO: 3051499 - RNA, 20 nt, Mycobacterium bovis subsp bovis AF2122/97
cgaucugcccccgccggccg

SEQ ID NO: 3051500 - RNA, 22 nt, Mycobacterium bovis subsp bovis AF2122/97
cgaucugcccggugauccacgc

SEQ ID NO: 3051501 - RNA, 12 nt, Mycobacterium bovis subsp bovis AF2122/97
cgaucugcgcca

SEQ ID NO: 3051502 - RNA, 16 nt, Mycobacterium bovis subsp bovis AF2122/97
cgaucugcgccaucac

SEQ ID NO: 3051503 - RNA, 15 nt, Mycobacterium bovis subsp bovis AF2122/97
cgaucugcgcgucag

SEQ ID NO: 3051504 - RNA, 23 nt, Mycobacterium bovis subsp bovis AF2122/97
cgaucugcgcgucaggccagcgc

SEQ ID NO: 3051505 - RNA, 18 nt, Mycobacterium bovis subsp bovis AF2122/97
cgaucugcggaggcgggu

SEQ ID NO: 3051506 - RNA, 14 nt, Mycobacterium bovis subsp bovis AF2122/97
cgaucugcggcgcc

SEQ ID NO: 3051507 - RNA, 16 nt, Mycobacterium bovis subsp bovis AF2122/97
cgaucugcggcgcccg

SEQ ID NO: 3051508 - RNA, 17 nt, Mycobacterium bovis subsp bovis AF2122/97
cgaucugcggcgcccgg

SEQ ID NO: 3051509 - RNA, 16 nt, Mycobacterium bovis subsp bovis AF2122/97
cgaucugcgggcgggu

SEQ ID NO: 3051510 - RNA, 22 nt, Mycobacterium bovis subsp bovis AF2122/97
cgaucugcguuugggucaucga

SEQ ID NO: 3051511 - RNA, 13 nt, Mycobacterium bovis subsp bovis AF2122/97
cgaucugcuacca

SEQ ID NO: 3051512 - RNA, 20 nt, Mycobacterium bovis subsp bovis AF2122/97
cgaucugcucgagagcaugg

SEQ ID NO: 3051513 - RNA, 14 nt, Mycobacterium bovis subsp bovis AF2122/97
cgaucugcucgccc

SEQ ID NO: 3051514 - RNA, 20 nt, Mycobacterium bovis subsp bovis AF2122/97
cgaucugcugcucgaucauc

SEQ ID NO: 3051515 - RNA, 23 nt, Mycobacterium bovis subsp bovis AF2122/97
cgaucugcugugucguacccggc

SEQ ID NO: 3051516 - RNA, 15 nt, Mycobacterium bovis subsp bovis AF2122/97
cgaucuggcagccga

SEQ ID NO: 3051517 - RNA, 16 nt, Mycobacterium bovis subsp bovis AF2122/97
cgaucuggcagccgaa

SEQ ID NO: 3051518 - RNA, 21 nt, Mycobacterium bovis subsp bovis AF2122/97
cgaucuggcguagugcucgcc

SEQ ID NO: 3051519 - RNA, 17 nt, Mycobacterium bovis subsp bovis AF2122/97
cgaucugggugccggug

SEQ ID NO: 3051520 - RNA, 17 nt, Mycobacterium bovis subsp bovis AF2122/97
cgaucuggucaagaccc

SEQ ID NO: 3051521 - RNA, 19 nt, Mycobacterium bovis subsp bovis AF2122/97
cgaucuggucaagacccgc

SEQ ID NO: 3051522 - RNA, 13 nt, Mycobacterium bovis subsp bovis AF2122/97
cgaucuggucgcc

SEQ ID NO: 3051523 - RNA, 16 nt, Mycobacterium bovis subsp bovis AF2122/97
cgaucugucgcgccgg

SEQ ID NO: 3051524 - RNA, 13 nt, Mycobacterium bovis subsp bovis AF2122/97
cgaucuucucgcg

SEQ ID NO: 3051525 - RNA, 16 nt, Mycobacterium bovis subsp bovis AF2122/97
cgaucuugcgacgccc

SEQ ID NO: 3051526 - RNA, 12 nt, Mycobacterium bovis subsp bovis AF2122/97
cgaucuugcgga

SEQ ID NO: 3051527 - RNA, 17 nt, Mycobacterium bovis subsp bovis AF2122/97
cgaucuuggaucgguug

SEQ ID NO: 3051528 - RNA, 14 nt, Mycobacterium bovis subsp bovis AF2122/97
cgaucuuggccacc

SEQ ID NO: 3051529 - RNA, 15 nt, Mycobacterium bovis subsp bovis AF2122/97
cgaucuuggccaccg

SEQ ID NO: 3051530 - RNA, 16 nt, Mycobacterium bovis subsp bovis AF2122/97
cgaucuuggccaccgc

SEQ ID NO: 3051531 - RNA, 15 nt, Mycobacterium bovis subsp bovis AF2122/97
cgaugaugccgucgu

SEQ ID NO: 3051532 - RNA, 17 nt, Mycobacterium bovis subsp bovis AF2122/97
cgaugaugccgucgucg

SEQ ID NO: 3051533 - RNA, 18 nt, Mycobacterium bovis subsp bovis AF2122/97
cgaugaugccgucgucgu

SEQ ID NO: 3051534 - RNA, 14 nt, Mycobacterium bovis subsp bovis AF2122/97
cgaugaugcggcgc

SEQ ID NO: 3051535 - RNA, 18 nt, Mycobacterium bovis subsp bovis AF2122/97
cgaugaugcggcgcagcg

SEQ ID NO: 3051536 - RNA, 19 nt, Mycobacterium bovis subsp bovis AF2122/97
cgaugaugcggcgcagcga

SEQ ID NO: 3051537 - RNA, 20 nt, Mycobacterium bovis subsp bovis AF2122/97
cgaugaugcucgacaaccac

SEQ ID NO: 3051538 - RNA, 18 nt, Mycobacterium bovis subsp bovis AF2122/97
cgaugauggacaccagcc

SEQ ID NO: 3051539 - RNA, 20 nt, Mycobacterium bovis subsp bovis AF2122/97
cgaugauggacaccagccag

SEQ ID NO: 3051540 - RNA, 13 nt, Mycobacterium bovis subsp bovis AF2122/97
cgaugauggcggu

SEQ ID NO: 3051541 - RNA, 14 nt, Mycobacterium bovis subsp bovis AF2122/97
cgaugaugucggcc

SEQ ID NO: 3051542 - RNA, 16 nt, Mycobacterium bovis subsp bovis AF2122/97
cgaugaugucggccgc

SEQ ID NO: 3051543 - RNA, 18 nt, Mycobacterium bovis subsp bovis AF2122/97
cgaugaugugcgaccaca

SEQ ID NO: 3051544 - RNA, 17 nt, Mycobacterium bovis subsp bovis AF2122/97
cgaugaugugcggugac

SEQ ID NO: 3051545 - RNA, 20 nt, Mycobacterium bovis subsp bovis AF2122/97
cgaugauuucgucgaucggc

SEQ ID NO: 3051546 - RNA, 22 nt, Mycobacterium bovis subsp bovis AF2122/97
cgaugcaacucgaauccggccc

SEQ ID NO: 3051547 - RNA, 14 nt, Mycobacterium bovis subsp bovis AF2122/97
cgaugcacaaccgc

SEQ ID NO: 3051548 - RNA, 22 nt, Mycobacterium bovis subsp bovis AF2122/97
cgaugcacaaccgcugcugcug

SEQ ID NO: 3051549 - RNA, 21 nt, Mycobacterium bovis subsp bovis AF2122/97
cgaugcaccccaugaccggga

SEQ ID NO: 3051550 - RNA, 20 nt, Mycobacterium bovis subsp bovis AF2122/97
cgaugcacuccaugaaucgc

SEQ ID NO: 3051551 - RNA, 16 nt, Mycobacterium bovis subsp bovis AF2122/97
cgaugcagccacauac

SEQ ID NO: 3051552 - RNA, 22 nt, Mycobacterium bovis subsp bovis AF2122/97
cgaugcagugcgacccgggcgu

SEQ ID NO: 3051553 - RNA, 20 nt, Mycobacterium bovis subsp bovis AF2122/97
cgaugcaucggugcagcccg

SEQ ID NO: 3051554 - RNA, 11 nt, Mycobacterium bovis subsp bovis AF2122/97
cgaugccaaug

SEQ ID NO: 3051555 - RNA, 13 nt, Mycobacterium bovis subsp bovis AF2122/97
cgaugccacccaa

SEQ ID NO: 3051556 - RNA, 17 nt, Mycobacterium bovis subsp bovis AF2122/97
cgaugccacccaacagc

SEQ ID NO: 3051557 - RNA, 22 nt, Mycobacterium bovis subsp bovis AF2122/97
cgaugccagugcaucggucagc

SEQ ID NO: 3051558 - RNA, 18 nt, Mycobacterium bovis subsp bovis AF2122/97
cgaugcccacgcacagca

SEQ ID NO: 3051559 - RNA, 12 nt, Mycobacterium bovis subsp bovis AF2122/97
cgaugcccagga

SEQ ID NO: 3051560 - RNA, 13 nt, Mycobacterium bovis subsp bovis AF2122/97
cgaugcccaucac

SEQ ID NO: 3051561 - RNA, 21 nt, Mycobacterium bovis subsp bovis AF2122/97
cgaugcccucgauggccaggc

SEQ ID NO: 3051562 - RNA, 17 nt, Mycobacterium bovis subsp bovis AF2122/97
cgaugccgaagcccccg

SEQ ID NO: 3051563 - RNA, 22 nt, Mycobacterium bovis subsp bovis AF2122/97
cgaugccgaggaucgcgccuau

SEQ ID NO: 3051564 - RNA, 14 nt, Mycobacterium bovis subsp bovis AF2122/97
cgaugccgaugccc

SEQ ID NO: 3051565 - RNA, 24 nt, Mycobacterium bovis subsp bovis AF2122/97
cgaugccgauuacggugaucgccg

SEQ ID NO: 3051566 - RNA, 15 nt, Mycobacterium bovis subsp bovis AF2122/97
cgaugccgccggccc

SEQ ID NO: 3051567 - RNA, 16 nt, Mycobacterium bovis subsp bovis AF2122/97
cgaugccgccggcccc

SEQ ID NO: 3051568 - RNA, 15 nt, Mycobacterium bovis subsp bovis AF2122/97
cgaugccgccggcgg

SEQ ID NO: 3051569 - RNA, 17 nt, Mycobacterium bovis subsp bovis AF2122/97
cgaugccgccggcgggc

SEQ ID NO: 3051570 - RNA, 12 nt, Mycobacterium bovis subsp bovis AF2122/97
cgaugccggcca

SEQ ID NO: 3051571 - RNA, 12 nt, Mycobacterium bovis subsp bovis AF2122/97
cgaugccggccc

SEQ ID NO: 3051572 - RNA, 13 nt, Mycobacterium bovis subsp bovis AF2122/97
cgaugccggcgag

SEQ ID NO: 3051573 - RNA, 18 nt, Mycobacterium bovis subsp bovis AF2122/97
cgaugccggcgagggcca

SEQ ID NO: 3051574 - RNA, 14 nt, Mycobacterium bovis subsp bovis AF2122/97
cgaugccggcugcc

SEQ ID NO: 3051575 - RNA, 16 nt, Mycobacterium bovis subsp bovis AF2122/97
cgaugccggguguguu

SEQ ID NO: 3051576 - RNA, 20 nt, Mycobacterium bovis subsp bovis AF2122/97
cgaugccguaggcggccagu

SEQ ID NO: 3051577 - RNA, 22 nt, Mycobacterium bovis subsp bovis AF2122/97
cgaugccguaggcggccaguug

SEQ ID NO: 3051578 - RNA, 17 nt, Mycobacterium bovis subsp bovis AF2122/97
cgaugccgugccgggcc

SEQ ID NO: 3051579 - RNA, 18 nt, Mycobacterium bovis subsp bovis AF2122/97
cgaugccgugccgggcca

SEQ ID NO: 3051580 - RNA, 17 nt, Mycobacterium bovis subsp bovis AF2122/97
cgaugccgugcugggcc

SEQ ID NO: 3051581 - RNA, 19 nt, Mycobacterium bovis subsp bovis AF2122/97
cgaugccuuccucggcaaa

SEQ ID NO: 3051582 - RNA, 20 nt, Mycobacterium bovis subsp bovis AF2122/97
cgaugccuucguagcggccg

SEQ ID NO: 3051583 - RNA, 21 nt, Mycobacterium bovis subsp bovis AF2122/97
cgaugccuucguagcggccgc

SEQ ID NO: 3051584 - RNA, 13 nt, Mycobacterium bovis subsp bovis AF2122/97
cgaugcgacgaac

SEQ ID NO: 3051585 - RNA, 12 nt, Mycobacterium bovis subsp bovis AF2122/97
cgaugcgaucga

SEQ ID NO: 3051586 - RNA, 20 nt, Mycobacterium bovis subsp bovis AF2122/97
cgaugcgauucugcgucugc

SEQ ID NO: 3051587 - RNA, 23 nt, Mycobacterium bovis subsp bovis AF2122/97
cgaugcgcaacuucuucagcagc

SEQ ID NO: 3051588 - RNA, 12 nt, Mycobacterium bovis subsp bovis AF2122/97
cgaugcgcacca

SEQ ID NO: 3051589 - RNA, 14 nt, Mycobacterium bovis subsp bovis AF2122/97
cgaugcgcaccagc

SEQ ID NO: 3051590 - RNA, 18 nt, Mycobacterium bovis subsp bovis AF2122/97
cgaugcgcaccagcggcu

SEQ ID NO: 3051591 - RNA, 20 nt, Mycobacterium bovis subsp bovis AF2122/97
cgaugcgcacucccggcucg

SEQ ID NO: 3051592 - RNA, 14 nt, Mycobacterium bovis subsp bovis AF2122/97
cgaugcgcagcccg

SEQ ID NO: 3051593 - RNA, 16 nt, Mycobacterium bovis subsp bovis AF2122/97
cgaugcgcagcccguc

SEQ ID NO: 3051594 - RNA, 16 nt, Mycobacterium bovis subsp bovis AF2122/97
cgaugcgcgcggcgcg

SEQ ID NO: 3051595 - RNA, 22 nt, Mycobacterium bovis subsp bovis AF2122/97
cgaugcgcgcggcgcgaucguc

SEQ ID NO: 3051596 - RNA, 21 nt, Mycobacterium bovis subsp bovis AF2122/97
cgaugcgcgucucgagcgcgc

SEQ ID NO: 3051597 - RNA, 19 nt, Mycobacterium bovis subsp bovis AF2122/97
cgaugcgcucacugcagcg

SEQ ID NO: 3051598 - RNA, 21 nt, Mycobacterium bovis subsp bovis AF2122/97
cgaugcgcugcucacgcagca

SEQ ID NO: 3051599 - RNA, 22 nt, Mycobacterium bovis subsp bovis AF2122/97
cgaugcgcugcucacgcagcag

SEQ ID NO: 3051600 - RNA, 19 nt, Mycobacterium bovis subsp bovis AF2122/97
cgaugcggcgucgaacugc

SEQ ID NO: 3051601 - RNA, 13 nt, Mycobacterium bovis subsp bovis AF2122/97
cgaugcggcguug

SEQ ID NO: 3051602 - RNA, 21 nt, Mycobacterium bovis subsp bovis AF2122/97
cgaugcgggccaucaagcgau

SEQ ID NO: 3051603 - RNA, 21 nt, Mycobacterium bovis subsp bovis AF2122/97
cgaugcgggcgccccaccggc

SEQ ID NO: 3051604 - RNA, 22 nt, Mycobacterium bovis subsp bovis AF2122/97
cgaugcgggcgccccaccggcc

SEQ ID NO: 3051605 - RNA, 17 nt, Mycobacterium bovis subsp bovis AF2122/97
cgaugcggguggcgccg

SEQ ID NO: 3051606 - RNA, 21 nt, Mycobacterium bovis subsp bovis AF2122/97
cgaugcggguggcgccggugc

SEQ ID NO: 3051607 - RNA, 14 nt, Mycobacterium bovis subsp bovis AF2122/97
cgaugcgguaucgg

SEQ ID NO: 3051608 - RNA, 15 nt, Mycobacterium bovis subsp bovis AF2122/97
cgaugcggucgacgg

SEQ ID NO: 3051609 - RNA, 16 nt, Mycobacterium bovis subsp bovis AF2122/97
cgaugcggucgacggg

SEQ ID NO: 3051610 - RNA, 23 nt, Mycobacterium bovis subsp bovis AF2122/97
cgaugcggugaauccgugcaggg

SEQ ID NO: 3051611 - RNA, 20 nt, Mycobacterium bovis subsp bovis AF2122/97
cgaugcgguucucgagcucg

SEQ ID NO: 3051612 - RNA, 19 nt, Mycobacterium bovis subsp bovis AF2122/97
cgaugcguccgcccagccg

SEQ ID NO: 3051613 - RNA, 22 nt, Mycobacterium bovis subsp bovis AF2122/97
cgaugcguccgcccagccgcag

SEQ ID NO: 3051614 - RNA, 20 nt, Mycobacterium bovis subsp bovis AF2122/97
cgaugcucaaugugccgccg

SEQ ID NO: 3051615 - RNA, 23 nt, Mycobacterium bovis subsp bovis AF2122/97
cgaugcucacuacccgcaacgag

SEQ ID NO: 3051616 - RNA, 15 nt, Mycobacterium bovis subsp bovis AF2122/97
cgaugcucagcuggu

SEQ ID NO: 3051617 - RNA, 17 nt, Mycobacterium bovis subsp bovis AF2122/97
cgauggugccgacccgc

SEQ ID NO: 3051618 - RNA, 18 nt, Mycobacterium bovis subsp bovis AF2122/97
cgauggugccgacccgcc

SEQ ID NO: 3051619 - RNA, 20 nt, Mycobacterium bovis subsp bovis AF2122/97
cgauggugccgacccgccgc

SEQ ID NO: 3051620 - RNA, 22 nt, Mycobacterium bovis subsp bovis AF2122/97
cgauggugccgacccgccgcgc

SEQ ID NO: 3051621 - RNA, 20 nt, Mycobacterium bovis subsp bovis AF2122/97
cgauggugcucaaggcuucg

SEQ ID NO: 3051622 - RNA, 16 nt, Mycobacterium bovis subsp bovis AF2122/97
cgaugguggccgcgcg

SEQ ID NO: 3051623 - RNA, 18 nt, Mycobacterium bovis subsp bovis AF2122/97
cgaugguggugccaaccu

SEQ ID NO: 3051624 - RNA, 22 nt, Mycobacterium bovis subsp bovis AF2122/97
cgaugguggugccaaccugggc

SEQ ID NO: 3051625 - RNA, 23 nt, Mycobacterium bovis subsp bovis AF2122/97
cgaugguggugccaaccugggcc

SEQ ID NO: 3051626 - RNA, 20 nt, Mycobacterium bovis subsp bovis AF2122/97
cgaugguggugccgaccugu

SEQ ID NO: 3051627 - RNA, 19 nt, Mycobacterium bovis subsp bovis AF2122/97
cgaugguguaacggcggcu

SEQ ID NO: 3051628 - RNA, 15 nt, Mycobacterium bovis subsp bovis AF2122/97
cgauggugugcagca

SEQ ID NO: 3051629 - RNA, 20 nt, Mycobacterium bovis subsp bovis AF2122/97
cgaugguugccuuguucgcc

SEQ ID NO: 3051630 - RNA, 23 nt, Mycobacterium bovis subsp bovis AF2122/97
cgaugguugccuuguucgcccac

SEQ ID NO: 3051631 - RNA, 14 nt, Mycobacterium bovis subsp bovis AF2122/97
cgauguacaccggc

SEQ ID NO: 3051632 - RNA, 20 nt, Mycobacterium bovis subsp bovis AF2122/97
cgauguacaccgugcgccga

SEQ ID NO: 3051633 - RNA, 15 nt, Mycobacterium bovis subsp bovis AF2122/97
cgauguacagcggga

SEQ ID NO: 3051634 - RNA, 16 nt, Mycobacterium bovis subsp bovis AF2122/97
cgauguaccccagcgc

SEQ ID NO: 3051635 - RNA, 17 nt, Mycobacterium bovis subsp bovis AF2122/97
cgauguauccgaugcga

SEQ ID NO: 3051636 - RNA, 11 nt, Mycobacterium bovis subsp bovis AF2122/97
cgaugucagcc

SEQ ID NO: 3051637 - RNA, 16 nt, Mycobacterium bovis subsp bovis AF2122/97
cgaugucagcggccgc

SEQ ID NO: 3051638 - RNA, 19 nt, Mycobacterium bovis subsp bovis AF2122/97
cgaugucagugaucaccaa

SEQ ID NO: 3051639 - RNA, 21 nt, Mycobacterium bovis subsp bovis AF2122/97
cgaugucagugaucaccaacc

SEQ ID NO: 3051640 - RNA, 20 nt, Mycobacterium bovis subsp bovis AF2122/97
cgauguccaaugcaccguug

SEQ ID NO: 3051641 - RNA, 15 nt, Mycobacterium bovis subsp bovis AF2122/97
cgauguccagguggc

SEQ ID NO: 3051642 - RNA, 19 nt, Mycobacterium bovis subsp bovis AF2122/97
cgaugucccaucgcgucgg

SEQ ID NO: 3051643 - RNA, 18 nt, Mycobacterium bovis subsp bovis AF2122/97
cgaugucccgagcccgcu

SEQ ID NO: 3051644 - RNA, 19 nt, Mycobacterium bovis subsp bovis AF2122/97
cgaugucccgagcccgcug

SEQ ID NO: 3051645 - RNA, 19 nt, Mycobacterium bovis subsp bovis AF2122/97
cgauguccgacgccaccgc

SEQ ID NO: 3051646 - RNA, 13 nt, Mycobacterium bovis subsp bovis AF2122/97
cgauguccgcgcg

SEQ ID NO: 3051647 - RNA, 14 nt, Mycobacterium bovis subsp bovis AF2122/97
cgauguccgcgcga

SEQ ID NO: 3051648 - RNA, 17 nt, Mycobacterium bovis subsp bovis AF2122/97
cgauguccucgacaccc

SEQ ID NO: 3051649 - RNA, 21 nt, Mycobacterium bovis subsp bovis AF2122/97
cgauguccucgagcaccgcga

SEQ ID NO: 3051650 - RNA, 16 nt, Mycobacterium bovis subsp bovis AF2122/97
cgauguccucgauccg

SEQ ID NO: 3051651 - RNA, 19 nt, Mycobacterium bovis subsp bovis AF2122/97
cgauguccucgaugcgggc

SEQ ID NO: 3051652 - RNA, 14 nt, Mycobacterium bovis subsp bovis AF2122/97
cgauguccuggaag

SEQ ID NO: 3051653 - RNA, 15 nt, Mycobacterium bovis subsp bovis AF2122/97
cgauguccuggaagc

SEQ ID NO: 3051654 - RNA, 16 nt, Mycobacterium bovis subsp bovis AF2122/97
cgaugucgaagaucga

SEQ ID NO: 3051655 - RNA, 14 nt, Mycobacterium bovis subsp bovis AF2122/97
cgaugucgacgucg

SEQ ID NO: 3051656 - RNA, 15 nt, Mycobacterium bovis subsp bovis AF2122/97
cgaugucgagcgcga

SEQ ID NO: 3051657 - RNA, 18 nt, Mycobacterium bovis subsp bovis AF2122/97
cgaugucgagcgcgaucg

SEQ ID NO: 3051658 - RNA, 12 nt, Mycobacterium bovis subsp bovis AF2122/97
cgaugucgaggu

SEQ ID NO: 3051659 - RNA, 13 nt, Mycobacterium bovis subsp bovis AF2122/97
cgaugucgaugcc

SEQ ID NO: 3051660 - RNA, 18 nt, Mycobacterium bovis subsp bovis AF2122/97
cgaugucggcucggcccc

SEQ ID NO: 3051661 - RNA, 20 nt, Mycobacterium bovis subsp bovis AF2122/97
cgaugucggcucggcccccg

SEQ ID NO: 3051662 - RNA, 22 nt, Mycobacterium bovis subsp bovis AF2122/97
cgaugucggcucggcccccgag

SEQ ID NO: 3051663 - RNA, 18 nt, Mycobacterium bovis subsp bovis AF2122/97
cgaugucguaccgggcga

SEQ ID NO: 3051664 - RNA, 15 nt, Mycobacterium bovis subsp bovis AF2122/97
cgaugucgucgacga

SEQ ID NO: 3051665 - RNA, 14 nt, Mycobacterium bovis subsp bovis AF2122/97
cgaugucgucguug

SEQ ID NO: 3051666 - RNA, 15 nt, Mycobacterium bovis subsp bovis AF2122/97
cgaugucgucguugu

SEQ ID NO: 3051667 - RNA, 21 nt, Mycobacterium bovis subsp bovis AF2122/97
cgaugucguuggccaccucgg

SEQ ID NO: 3051668 - RNA, 20 nt, Mycobacterium bovis subsp bovis AF2122/97
cgaugugaaccgggcaccac

SEQ ID NO: 3051669 - RNA, 21 nt, Mycobacterium bovis subsp bovis AF2122/97
cgaugugcacggugugcacgg

SEQ ID NO: 3051670 - RNA, 21 nt, Mycobacterium bovis subsp bovis AF2122/97
cgaugugccgauuggccugcc

SEQ ID NO: 3051671 - RNA, 13 nt, Mycobacterium bovis subsp bovis AF2122/97
cgaugugcgccca

SEQ ID NO: 3051672 - RNA, 22 nt, Mycobacterium bovis subsp bovis AF2122/97
cgaugugcgcccaauccaccga

SEQ ID NO: 3051673 - RNA, 17 nt, Mycobacterium bovis subsp bovis AF2122/97
cgauguggccggcgaug

SEQ ID NO: 3051674 - RNA, 17 nt, Mycobacterium bovis subsp bovis AF2122/97
cgauguggcgcuccggc

SEQ ID NO: 3051675 - RNA, 20 nt, Mycobacterium bovis subsp bovis AF2122/97
cgauguggcgcuccggcgug

SEQ ID NO: 3051676 - RNA, 21 nt, Mycobacterium bovis subsp bovis AF2122/97
cgaugugggcggagccgauga

SEQ ID NO: 3051677 - RNA, 20 nt, Mycobacterium bovis subsp bovis AF2122/97
cgauguggguuaccuggacc

SEQ ID NO: 3051678 - RNA, 20 nt, Mycobacterium bovis subsp bovis AF2122/97
cgaugugguggacgccaugg

SEQ ID NO: 3051679 - RNA, 20 nt, Mycobacterium bovis subsp bovis AF2122/97
cgauuaccagcggcaccgcg

SEQ ID NO: 3051680 - RNA, 16 nt, Mycobacterium bovis subsp bovis AF2122/97
cgauuaccggcacgcc

SEQ ID NO: 3051681 - RNA, 20 nt, Mycobacterium bovis subsp bovis AF2122/97
cgauucagcgccccaugcaa

SEQ ID NO: 3051682 - RNA, 17 nt, Mycobacterium bovis subsp bovis AF2122/97
cgauuccaccgccgacg

SEQ ID NO: 3051683 - RNA, 19 nt, Mycobacterium bovis subsp bovis AF2122/97
cgauuccgaacuggucgac

SEQ ID NO: 3051684 - RNA, 17 nt, Mycobacterium bovis subsp bovis AF2122/97
cgauuccgcgcgggaaa

SEQ ID NO: 3051685 - RNA, 19 nt, Mycobacterium bovis subsp bovis AF2122/97
cgauuccgcgucugcucgg

SEQ ID NO: 3051686 - RNA, 22 nt, Mycobacterium bovis subsp bovis AF2122/97
cgauuccgcgucugcucggcgg

SEQ ID NO: 3051687 - RNA, 16 nt, Mycobacterium bovis subsp bovis AF2122/97
cgauuccgcucguucg

SEQ ID NO: 3051688 - RNA, 19 nt, Mycobacterium bovis subsp bovis AF2122/97
cgauuccggcggccacgcc

SEQ ID NO: 3051689 - RNA, 20 nt, Mycobacterium bovis subsp bovis AF2122/97
cgauuccggcggccacgccg

SEQ ID NO: 3051690 - RNA, 18 nt, Mycobacterium bovis subsp bovis AF2122/97
cgauuccgggugcgaucg

SEQ ID NO: 3051691 - RNA, 19 nt, Mycobacterium bovis subsp bovis AF2122/97
cgauuccgggugcgaucgc

SEQ ID NO: 3051692 - RNA, 19 nt, Mycobacterium bovis subsp bovis AF2122/97
cgauucgauguccucgaca

SEQ ID NO: 3051693 - RNA, 16 nt, Mycobacterium bovis subsp bovis AF2122/97
cgauucgcggcagccg

SEQ ID NO: 3051694 - RNA, 18 nt, Mycobacterium bovis subsp bovis AF2122/97
cgauucgcggcagccggc

SEQ ID NO: 3051695 - RNA, 19 nt, Mycobacterium bovis subsp bovis AF2122/97
cgauucgcggcagccggcg

SEQ ID NO: 3051696 - RNA, 20 nt, Mycobacterium bovis subsp bovis AF2122/97
cgauucgcggcagccggcgg

SEQ ID NO: 3051697 - RNA, 20 nt, Mycobacterium bovis subsp bovis AF2122/97
cgauucggccagcgcccgca

SEQ ID NO: 3051698 - RNA, 12 nt, Mycobacterium bovis subsp bovis AF2122/97
cgauucggccca

SEQ ID NO: 3051699 - RNA, 16 nt, Mycobacterium bovis subsp bovis AF2122/97
cgauucggcgacgaac

SEQ ID NO: 3051700 - RNA, 14 nt, Mycobacterium bovis subsp bovis AF2122/97
cgauucggcggccg

SEQ ID NO: 3051701 - RNA, 17 nt, Mycobacterium bovis subsp bovis AF2122/97
cgauucggcggccgugu

SEQ ID NO: 3051702 - RNA, 16 nt, Mycobacterium bovis subsp bovis AF2122/97
cgauucgggcgucggg

SEQ ID NO: 3051703 - RNA, 20 nt, Mycobacterium bovis subsp bovis AF2122/97
cgcaacggauaacccguggc

SEQ ID NO: 3051704 - RNA, 18 nt, Mycobacterium bovis subsp bovis AF2122/97
cgcaacgggucggguccc

SEQ ID NO: 3051705 - RNA, 22 nt, Mycobacterium bovis subsp bovis AF2122/97
cgcaacuacggcguccccgaca

SEQ ID NO: 3051706 - RNA, 23 nt, Mycobacterium bovis subsp bovis AF2122/97
cgcaacuaucgcaccuccggcgu

SEQ ID NO: 3051707 - RNA, 16 nt, Mycobacterium bovis subsp bovis AF2122/97
cgcaacucccagcacg

SEQ ID NO: 3051708 - RNA, 21 nt, Mycobacterium bovis subsp bovis AF2122/97
cgcaacucccagcacgguggc

SEQ ID NO: 3051709 - RNA, 14 nt, Mycobacterium bovis subsp bovis AF2122/97
cgcaagaaugccgc

SEQ ID NO: 3051710 - RNA, 15 nt, Mycobacterium bovis subsp bovis AF2122/97
cgcaagaaugccgcc

SEQ ID NO: 3051711 - RNA, 16 nt, Mycobacterium bovis subsp bovis AF2122/97
cgcaagaaugccgccg

SEQ ID NO: 3051712 - RNA, 17 nt, Mycobacterium bovis subsp bovis AF2122/97
cgcaagaaugccgccga

SEQ ID NO: 3051713 - RNA, 14 nt, Mycobacterium bovis subsp bovis AF2122/97
cgcaagcagcgcga

SEQ ID NO: 3051714 - RNA, 16 nt, Mycobacterium bovis subsp bovis AF2122/97
cgcaagccauccccgg

SEQ ID NO: 3051715 - RNA, 17 nt, Mycobacterium bovis subsp bovis AF2122/97
cgcaagccucgugguga

SEQ ID NO: 3051716 - RNA, 22 nt, Mycobacterium bovis subsp bovis AF2122/97
cgcaagccucguggugagauca

SEQ ID NO: 3051717 - RNA, 15 nt, Mycobacterium bovis subsp bovis AF2122/97
cgcaagcgccgcgcu

SEQ ID NO: 3051718 - RNA, 19 nt, Mycobacterium bovis subsp bovis AF2122/97
cgcaagcgccgcgcuugcg

SEQ ID NO: 3051719 - RNA, 14 nt, Mycobacterium bovis subsp bovis AF2122/97
cgcaagcgcggcga

SEQ ID NO: 3051720 - RNA, 23 nt, Mycobacterium bovis subsp bovis AF2122/97
cgcaagcugguagguggagagcc

SEQ ID NO: 3051721 - RNA, 20 nt, Mycobacterium bovis subsp bovis AF2122/97
cgcaaggaccugugcggccg

SEQ ID NO: 3051722 - RNA, 14 nt, Mycobacterium bovis subsp bovis AF2122/97
cgcaaggggcgucg

SEQ ID NO: 3051723 - RNA, 23 nt, Mycobacterium bovis subsp bovis AF2122/97
cgcaaggucgacggaaucgucgg

SEQ ID NO: 3051724 - RNA, 17 nt, Mycobacterium bovis subsp bovis AF2122/97
cgcaagguugccaacgc

SEQ ID NO: 3051725 - RNA, 18 nt, Mycobacterium bovis subsp bovis AF2122/97
cgcaagguugccaacgcc

SEQ ID NO: 3051726 - RNA, 21 nt, Mycobacterium bovis subsp bovis AF2122/97
cgcaagucauccaggucgccu

SEQ ID NO: 3051727 - RNA, 17 nt, Mycobacterium bovis subsp bovis AF2122/97
cgcaagugucuccggca

SEQ ID NO: 3051728 - RNA, 19 nt, Mycobacterium bovis subsp bovis AF2122/97
cgcaaguugagcagcuugg

SEQ ID NO: 3051729 - RNA, 23 nt, Mycobacterium bovis subsp bovis AF2122/97
cgcaauacccgagcguccggugg

SEQ ID NO: 3051730 - RNA, 21 nt, Mycobacterium bovis subsp bovis AF2122/97
cgcaauagaccgcagucgcug

SEQ ID NO: 3051731 - RNA, 22 nt, Mycobacterium bovis subsp bovis AF2122/97
cgcaauagcgacagcagcgcca

SEQ ID NO: 3051732 - RNA, 19 nt, Mycobacterium bovis subsp bovis AF2122/97
cgcaauauccggccgagcc

SEQ ID NO: 3051733 - RNA, 21 nt, Mycobacterium bovis subsp bovis AF2122/97
cgcaauaugccacagaccgaa

SEQ ID NO: 3051734 - RNA, 23 nt, Mycobacterium bovis subsp bovis AF2122/97
cgcaaucaggaaccgcucgucac

SEQ ID NO: 3051735 - RNA, 18 nt, Mycobacterium bovis subsp bovis AF2122/97
cgcaaucauccgaucgcc

SEQ ID NO: 3051736 - RNA, 13 nt, Mycobacterium bovis subsp bovis AF2122/97
cgcaaucgaccac

SEQ ID NO: 3051737 - RNA, 18 nt, Mycobacterium bovis subsp bovis AF2122/97
cgcaaucgacugaucgaa

SEQ ID NO: 3051738 - RNA, 23 nt, Mycobacterium bovis subsp bovis AF2122/97
cgcaaucggcguuaucgaaggcg

SEQ ID NO: 3051739 - RNA, 22 nt, Mycobacterium bovis subsp bovis AF2122/97
cgcaaugaccgcggauuccggc

SEQ ID NO: 3051740 - RNA, 20 nt, Mycobacterium bovis subsp bovis AF2122/97
cgcaaugacgucgucggcca

SEQ ID NO: 3051741 - RNA, 15 nt, Mycobacterium bovis subsp bovis AF2122/97
cgcaaugccgugcgc

SEQ ID NO: 3051742 - RNA, 21 nt, Mycobacterium bovis subsp bovis AF2122/97
cgcaaugcggcccggguggcc

SEQ ID NO: 3051743 - RNA, 13 nt, Mycobacterium bovis subsp bovis AF2122/97
cgcaaugcgggcc

SEQ ID NO: 3051744 - RNA, 14 nt, Mycobacterium bovis subsp bovis AF2122/97
cgcaauggcggccu

SEQ ID NO: 3051745 - RNA, 16 nt, Mycobacterium bovis subsp bovis AF2122/97
cgcaaugucggcaggg

SEQ ID NO: 3051746 - RNA, 15 nt, Mycobacterium bovis subsp bovis AF2122/97
cgcaauuccggugau

SEQ ID NO: 3051747 - RNA, 23 nt, Mycobacterium bovis subsp bovis AF2122/97
cgcaauuccggugaucgcggugg

SEQ ID NO: 3051748 - RNA, 20 nt, Mycobacterium bovis subsp bovis AF2122/97
cgcacaaacauacgccaccc

SEQ ID NO: 3051749 - RNA, 21 nt, Mycobacterium bovis subsp bovis AF2122/97
cgcacaaacgacucgcggugg

SEQ ID NO: 3051750 - RNA, 14 nt, Mycobacterium bovis subsp bovis AF2122/97
cgcacaaacgggcg

SEQ ID NO: 3051751 - RNA, 20 nt, Mycobacterium bovis subsp bovis AF2122/97
cgcacaaacgggcgugggcc

SEQ ID NO: 3051752 - RNA, 17 nt, Mycobacterium bovis subsp bovis AF2122/97
cgcacaauggcggcgcc

SEQ ID NO: 3051753 - RNA, 17 nt, Mycobacterium bovis subsp bovis AF2122/97
cgcacacagaccgugac

SEQ ID NO: 3051754 - RNA, 19 nt, Mycobacterium bovis subsp bovis AF2122/97
cgcacaccaacaccgcggc

SEQ ID NO: 3051755 - RNA, 13 nt, Mycobacterium bovis subsp bovis AF2122/97
cgcacacccugca

SEQ ID NO: 3051756 - RNA, 16 nt, Mycobacterium bovis subsp bovis AF2122/97
cgcacaccugcgcggc

SEQ ID NO: 3051757 - RNA, 14 nt, Mycobacterium bovis subsp bovis AF2122/97
cgcacacgcgugca

SEQ ID NO: 3051758 - RNA, 13 nt, Mycobacterium bovis subsp bovis AF2122/97
cgcacacuaccgc

SEQ ID NO: 3051759 - RNA, 17 nt, Mycobacterium bovis subsp bovis AF2122/97
cgcacacuaccgccgcg

SEQ ID NO: 3051760 - RNA, 18 nt, Mycobacterium bovis subsp bovis AF2122/97
cgcacagagugaggcgcu

SEQ ID NO: 3051761 - RNA, 22 nt, Mycobacterium bovis subsp bovis AF2122/97
cgcacagcaacgcccaacgucg

SEQ ID NO: 3051762 - RNA, 17 nt, Mycobacterium bovis subsp bovis AF2122/97
cgcacagcaccacaucg

SEQ ID NO: 3051763 - RNA, 15 nt, Mycobacterium bovis subsp bovis AF2122/97
cgcacagcagcaccg

SEQ ID NO: 3051764 - RNA, 19 nt, Mycobacterium bovis subsp bovis AF2122/97
cgcacagcagcaccgcgac

SEQ ID NO: 3051765 - RNA, 16 nt, Mycobacterium bovis subsp bovis AF2122/97
cgcacagcccgaugcc

SEQ ID NO: 3051766 - RNA, 17 nt, Mycobacterium bovis subsp bovis AF2122/97
cgcacagccgcuuggcg

SEQ ID NO: 3051767 - RNA, 21 nt, Mycobacterium bovis subsp bovis AF2122/97
cgcacagccgcuuggcgcggc

SEQ ID NO: 3051768 - RNA, 22 nt, Mycobacterium bovis subsp bovis AF2122/97
cgcacaggaagcccauccccgc

SEQ ID NO: 3051769 - RNA, 23 nt, Mycobacterium bovis subsp bovis AF2122/97
cgcacaggauuuucucggggugg

SEQ ID NO: 3051770 - RNA, 13 nt, Mycobacterium bovis subsp bovis AF2122/97
cgcacaggugcca

SEQ ID NO: 3051771 - RNA, 22 nt, Mycobacterium bovis subsp bovis AF2122/97
cgcacaggugccaaacgccgcc

SEQ ID NO: 3051772 - RNA, 23 nt, Mycobacterium bovis subsp bovis AF2122/97
cgcacaggugccaaacgccgccc

SEQ ID NO: 3051773 - RNA, 20 nt, Mycobacterium bovis subsp bovis AF2122/97
cgcacauggugggucgacga

SEQ ID NO: 3051774 - RNA, 12 nt, Mycobacterium bovis subsp bovis AF2122/97
cgcaccaacacc

SEQ ID NO: 3051775 - RNA, 20 nt, Mycobacterium bovis subsp bovis AF2122/97
cgcaccaacguugugccgcu

SEQ ID NO: 3051776 - RNA, 14 nt, Mycobacterium bovis subsp bovis AF2122/97
cgcaccaagacgcc

SEQ ID NO: 3051777 - RNA, 19 nt, Mycobacterium bovis subsp bovis AF2122/97
cgcaccaagacgccaccca

SEQ ID NO: 3051778 - RNA, 15 nt, Mycobacterium bovis subsp bovis AF2122/97
cgcaccaaggccgcc

SEQ ID NO: 3051779 - RNA, 21 nt, Mycobacterium bovis subsp bovis AF2122/97
cgcaccaaggccgccugcaac

SEQ ID NO: 3051780 - RNA, 18 nt, Mycobacterium bovis subsp bovis AF2122/97
cgcaccacaauccacgca

SEQ ID NO: 3051781 - RNA, 12 nt, Mycobacterium bovis subsp bovis AF2122/97
cgcaccacacca

SEQ ID NO: 3051782 - RNA, 14 nt, Mycobacterium bovis subsp bovis AF2122/97
cgcaccacaccacg

SEQ ID NO: 3051783 - RNA, 22 nt, Mycobacterium bovis subsp bovis AF2122/97
cgcaccacaccgugggcgacgg

SEQ ID NO: 3051784 - RNA, 21 nt, Mycobacterium bovis subsp bovis AF2122/97
cgcaccacacuggcagugugg

SEQ ID NO: 3051785 - RNA, 12 nt, Mycobacterium bovis subsp bovis AF2122/97
cgcaccaccacg

SEQ ID NO: 3051786 - RNA, 10 nt, Mycobacterium bovis subsp bovis AF2122/97
cgcaccaccg

SEQ ID NO: 3051787 - RNA, 16 nt, Mycobacterium bovis subsp bovis AF2122/97
cgcaccaccgccccgc

SEQ ID NO: 3051788 - RNA, 22 nt, Mycobacterium bovis subsp bovis AF2122/97
cgcaccaccgccccgcgcccaa

SEQ ID NO: 3051789 - RNA, 20 nt, Mycobacterium bovis subsp bovis AF2122/97
cgcaccgcugaccgcaacgc

SEQ ID NO: 3051790 - RNA, 14 nt, Mycobacterium bovis subsp bovis AF2122/97
cgcaccggagucgc

SEQ ID NO: 3051791 - RNA, 17 nt, Mycobacterium bovis subsp bovis AF2122/97
cgcaccggagucggcgu

SEQ ID NO: 3051792 - RNA, 18 nt, Mycobacterium bovis subsp bovis AF2122/97
cgcaccggaucaccgcgc

SEQ ID NO: 3051793 - RNA, 23 nt, Mycobacterium bovis subsp bovis AF2122/97
cgcaccggaucaccgcgcccgcc

SEQ ID NO: 3051794 - RNA, 19 nt, Mycobacterium bovis subsp bovis AF2122/97
cgcaccggaucggcuaccu

SEQ ID NO: 3051795 - RNA, 13 nt, Mycobacterium bovis subsp bovis AF2122/97
cgcaccggccgcu

SEQ ID NO: 3051796 - RNA, 19 nt, Mycobacterium bovis subsp bovis AF2122/97
cgcaccggccgcuauggcc

SEQ ID NO: 3051797 - RNA, 14 nt, Mycobacterium bovis subsp bovis AF2122/97
cgcaccggcgucgg

SEQ ID NO: 3051798 - RNA, 15 nt, Mycobacterium bovis subsp bovis AF2122/97
cgcaccggcgucggc

SEQ ID NO: 3051799 - RNA, 18 nt, Mycobacterium bovis subsp bovis AF2122/97
cgcaccggcgucggcgcg

SEQ ID NO: 3051800 - RNA, 20 nt, Mycobacterium bovis subsp bovis AF2122/97
cgcaccggcgucggcgcggc

SEQ ID NO: 3051801 - RNA, 22 nt, Mycobacterium bovis subsp bovis AF2122/97
cgcaccggcgucggcgcggccg

SEQ ID NO: 3051802 - RNA, 17 nt, Mycobacterium bovis subsp bovis AF2122/97
cgcaccggcuggcccag

SEQ ID NO: 3051803 - RNA, 19 nt, Mycobacterium bovis subsp bovis AF2122/97
cgcaccggggugugcgggc

SEQ ID NO: 3051804 - RNA, 19 nt, Mycobacterium bovis subsp bovis AF2122/97
cgcaccggguugagccgcc

SEQ ID NO: 3051805 - RNA, 21 nt, Mycobacterium bovis subsp bovis AF2122/97
cgcaccgguauguucggcaau

SEQ ID NO: 3051806 - RNA, 19 nt, Mycobacterium bovis subsp bovis AF2122/97
cgcaccggugacgcacagc

SEQ ID NO: 3051807 - RNA, 13 nt, Mycobacterium bovis subsp bovis AF2122/97
cgcaccgucgcgg

SEQ ID NO: 3051808 - RNA, 21 nt, Mycobacterium bovis subsp bovis AF2122/97
cgcaccgucgcuaugcgccgc

SEQ ID NO: 3051809 - RNA, 16 nt, Mycobacterium bovis subsp bovis AF2122/97
cgcaccgugccgacgc

SEQ ID NO: 3051810 - RNA, 21 nt, Mycobacterium bovis subsp bovis AF2122/97
cgcaccgugccgacgccccga

SEQ ID NO: 3051811 - RNA, 22 nt, Mycobacterium bovis subsp bovis AF2122/97
cgcaccgugggcccuucacugu

SEQ ID NO: 3051812 - RNA, 20 nt, Mycobacterium bovis subsp bovis AF2122/97
cgcaccgugucuacgccggg

SEQ ID NO: 3051813 - RNA, 19 nt, Mycobacterium bovis subsp bovis AF2122/97
cgcaccgugugggccccgc

SEQ ID NO: 3051814 - RNA, 20 nt, Mycobacterium bovis subsp bovis AF2122/97
cgcaccgugugggccccgcc

SEQ ID NO: 3051815 - RNA, 15 nt, Mycobacterium bovis subsp bovis AF2122/97
cgcaccuacccugcg

SEQ ID NO: 3051816 - RNA, 18 nt, Mycobacterium bovis subsp bovis AF2122/97
cgcaccuacccugcgcgu

SEQ ID NO: 3051817 - RNA, 13 nt, Mycobacterium bovis subsp bovis AF2122/97
cgcaccuaugguc

SEQ ID NO: 3051818 - RNA, 21 nt, Mycobacterium bovis subsp bovis AF2122/97
cgcaccucggcgaagucacgc

SEQ ID NO: 3051819 - RNA, 13 nt, Mycobacterium bovis subsp bovis AF2122/97
cgcaccucggugg

SEQ ID NO: 3051820 - RNA, 14 nt, Mycobacterium bovis subsp bovis AF2122/97
cgcaccugcgauga

SEQ ID NO: 3051821 - RNA, 17 nt, Mycobacterium bovis subsp bovis AF2122/97
cgcaccugcgcgcggcc

SEQ ID NO: 3051822 - RNA, 19 nt, Mycobacterium bovis subsp bovis AF2122/97
cgcaccugcgcgcggccgc

SEQ ID NO: 3051823 - RNA, 13 nt, Mycobacterium bovis subsp bovis AF2122/97
cgcaccuggcgcg

SEQ ID NO: 3051824 - RNA, 18 nt, Mycobacterium bovis subsp bovis AF2122/97
cgcaccugggcugccggc

SEQ ID NO: 3051825 - RNA, 17 nt, Mycobacterium bovis subsp bovis AF2122/97
cgcaccugggucgacga

SEQ ID NO: 3051826 - RNA, 19 nt, Mycobacterium bovis subsp bovis AF2122/97
cgcaccugggucgacgaga

SEQ ID NO: 3051827 - RNA, 19 nt, Mycobacterium bovis subsp bovis AF2122/97
cgcaccuugaccgucgcgc

SEQ ID NO: 3051828 - RNA, 16 nt, Mycobacterium bovis subsp bovis AF2122/97
cgcacgaaaucagccc

SEQ ID NO: 3051829 - RNA, 20 nt, Mycobacterium bovis subsp bovis AF2122/97
cgcacgaaaucagcccgccc

SEQ ID NO: 3051830 - RNA, 15 nt, Mycobacterium bovis subsp bovis AF2122/97
cgcacgaaccggucg

SEQ ID NO: 3051831 - RNA, 12 nt, Mycobacterium bovis subsp bovis AF2122/97
cgcacgacaccu

SEQ ID NO: 3051832 - RNA, 14 nt, Mycobacterium bovis subsp bovis AF2122/97
cgcacgaccagcug

SEQ ID NO: 3051833 - RNA, 21 nt, Mycobacterium bovis subsp bovis AF2122/97
cgcacgaccagcugagcuggc

SEQ ID NO: 3051834 - RNA, 19 nt, Mycobacterium bovis subsp bovis AF2122/97
cgcacgacgaauccccgac

SEQ ID NO: 3051835 - RNA, 20 nt, Mycobacterium bovis subsp bovis AF2122/97
cgcacgacgcgacacgccgg

SEQ ID NO: 3051836 - RNA, 23 nt, Mycobacterium bovis subsp bovis AF2122/97
cgcacgacgucaaucucggucgg

SEQ ID NO: 3051837 - RNA, 20 nt, Mycobacterium bovis subsp bovis AF2122/97
cgcacgacugugcgccgcag

SEQ ID NO: 3051838 - RNA, 22 nt, Mycobacterium bovis subsp bovis AF2122/97
cgcacgacugugcgccgcagcc

SEQ ID NO: 3051839 - RNA, 18 nt, Mycobacterium bovis subsp bovis AF2122/97
cgcacgauccgcacccgg

SEQ ID NO: 3051840 - RNA, 21 nt, Mycobacterium bovis subsp bovis AF2122/97
cgcacgauccgcacccggccg

SEQ ID NO: 3051841 - RNA, 22 nt, Mycobacterium bovis subsp bovis AF2122/97
cgcacgaucggggaagccugcg

SEQ ID NO: 3051842 - RNA, 18 nt, Mycobacterium bovis subsp bovis AF2122/97
cgcacgaucugcaggccc

SEQ ID NO: 3051843 - RNA, 16 nt, Mycobacterium bovis subsp bovis AF2122/97
cgcacgauggccgucg

SEQ ID NO: 3051844 - RNA, 19 nt, Mycobacterium bovis subsp bovis AF2122/97
cgcacgauggugugcagca

SEQ ID NO: 3051845 - RNA, 18 nt, Mycobacterium bovis subsp bovis AF2122/97
cgcacgauuucgagcgcu

SEQ ID NO: 3051846 - RNA, 18 nt, Mycobacterium bovis subsp bovis AF2122/97
cgcacgcaaugcgggccc

SEQ ID NO: 3051847 - RNA, 13 nt, Mycobacterium bovis subsp bovis AF2122/97
cgcacgcacggcg

SEQ ID NO: 3051848 - RNA, 20 nt, Mycobacterium bovis subsp bovis AF2122/97
cgcacgcagccccucgucgu

SEQ ID NO: 3051849 - RNA, 18 nt, Mycobacterium bovis subsp bovis AF2122/97
cgcacgcagccgauacag

SEQ ID NO: 3051850 - RNA, 14 nt, Mycobacterium bovis subsp bovis AF2122/97
cgcacgcaguucgg

SEQ ID NO: 3051851 - RNA, 23 nt, Mycobacterium bovis subsp bovis AF2122/97
cgcacgcaguucggucagcgccu

SEQ ID NO: 3051852 - RNA, 15 nt, Mycobacterium bovis subsp bovis AF2122/97
cgcacgccaccggga

SEQ ID NO: 3051853 - RNA, 15 nt, Mycobacterium bovis subsp bovis AF2122/97
cgcacgccagcuugg

SEQ ID NO: 3051854 - RNA, 21 nt, Mycobacterium bovis subsp bovis AF2122/97
cgcacgccagcuuggcaaccu

SEQ ID NO: 3051855 - RNA, 21 nt, Mycobacterium bovis subsp bovis AF2122/97
cgcacgcccugaagggccgcc

SEQ ID NO: 3051856 - RNA, 15 nt, Mycobacterium bovis subsp bovis AF2122/97
cgcacgccgaccagc

SEQ ID NO: 3051857 - RNA, 16 nt, Mycobacterium bovis subsp bovis AF2122/97
cgcacgccgaccagca

SEQ ID NO: 3051858 - RNA, 19 nt, Mycobacterium bovis subsp bovis AF2122/97
cgcacgccgaccagcaccc

SEQ ID NO: 3051859 - RNA, 17 nt, Mycobacterium bovis subsp bovis AF2122/97
cgcacgccgcgugccgc

SEQ ID NO: 3051860 - RNA, 13 nt, Mycobacterium bovis subsp bovis AF2122/97
cgcacgccggcau

SEQ ID NO: 3051861 - RNA, 14 nt, Mycobacterium bovis subsp bovis AF2122/97
cgcacgccggcaug

SEQ ID NO: 3051862 - RNA, 18 nt, Mycobacterium bovis subsp bovis AF2122/97
cgcacgccggcaugccag

SEQ ID NO: 3051863 - RNA, 21 nt, Mycobacterium bovis subsp bovis AF2122/97
cgcacgcgaaaugccugcgcg

SEQ ID NO: 3051864 - RNA, 13 nt, Mycobacterium bovis subsp bovis AF2122/97
cgcacgcgcgcag

SEQ ID NO: 3051865 - RNA, 18 nt, Mycobacterium bovis subsp bovis AF2122/97
cgcacgcgcgcaggccgc

SEQ ID NO: 3051866 - RNA, 20 nt, Mycobacterium bovis subsp bovis AF2122/97
cgcacgcgcgcaggccgccg

SEQ ID NO: 3051867 - RNA, 21 nt, Mycobacterium bovis subsp bovis AF2122/97
cgcacgcggaaaggcuuccgc

SEQ ID NO: 3051868 - RNA, 23 nt, Mycobacterium bovis subsp bovis AF2122/97
cgcacgcggaaaggcuuccgcgu

SEQ ID NO: 3051869 - RNA, 21 nt, Mycobacterium bovis subsp bovis AF2122/97
cgcacgcgggagguaccccca

SEQ ID NO: 3051870 - RNA, 22 nt, Mycobacterium bovis subsp bovis AF2122/97
cgcacgcgguucaccacgucgu

SEQ ID NO: 3051871 - RNA, 18 nt, Mycobacterium bovis subsp bovis AF2122/97
cgcacgcuagccgacagc

SEQ ID NO: 3051872 - RNA, 21 nt, Mycobacterium bovis subsp bovis AF2122/97
cgcacgcucaugaccgcucgg

SEQ ID NO: 3051873 - RNA, 13 nt, Mycobacterium bovis subsp bovis AF2122/97
cgcacgcucgccc

SEQ ID NO: 3051874 - RNA, 14 nt, Mycobacterium bovis subsp bovis AF2122/97
cgcacgcucgcccu

SEQ ID NO: 3051875 - RNA, 15 nt, Mycobacterium bovis subsp bovis AF2122/97
cgcagaacgaucgcg

SEQ ID NO: 3051876 - RNA, 17 nt, Mycobacterium bovis subsp bovis AF2122/97
cgcagaacggaccucgg

SEQ ID NO: 3051877 - RNA, 18 nt, Mycobacterium bovis subsp bovis AF2122/97
cgcagaacggcguugcgg

SEQ ID NO: 3051878 - RNA, 19 nt, Mycobacterium bovis subsp bovis AF2122/97
cgcagaacggcguugcgga

SEQ ID NO: 3051879 - RNA, 15 nt, Mycobacterium bovis subsp bovis AF2122/97
cgcagaauccggcaa

SEQ ID NO: 3051880 - RNA, 16 nt, Mycobacterium bovis subsp bovis AF2122/97
cgcagaaucgcaugau

SEQ ID NO: 3051881 - RNA, 15 nt, Mycobacterium bovis subsp bovis AF2122/97
cgcagaaucgcccaa

SEQ ID NO: 3051882 - RNA, 20 nt, Mycobacterium bovis subsp bovis AF2122/97
cgcagacacugcugcggcag

SEQ ID NO: 3051883 - RNA, 21 nt, Mycobacterium bovis subsp bovis AF2122/97
cgcagacacugcugcggcagc

SEQ ID NO: 3051884 - RNA, 18 nt, Mycobacterium bovis subsp bovis AF2122/97
cgcagacaucggagauca

SEQ ID NO: 3051885 - RNA, 12 nt, Mycobacterium bovis subsp bovis AF2122/97
cgcagaccagac

SEQ ID NO: 3051886 - RNA, 19 nt, Mycobacterium bovis subsp bovis AF2122/97
cgcagaccagacugcagug

SEQ ID NO: 3051887 - RNA, 16 nt, Mycobacterium bovis subsp bovis AF2122/97
cgcagaccgccaccgg

SEQ ID NO: 3051888 - RNA, 17 nt, Mycobacterium bovis subsp bovis AF2122/97
cgcagaccgccaccggc

SEQ ID NO: 3051889 - RNA, 19 nt, Mycobacterium bovis subsp bovis AF2122/97
cgcagaccgccaccggcug

SEQ ID NO: 3051890 - RNA, 18 nt, Mycobacterium bovis subsp bovis AF2122/97
cgcagaccguccagcaac

SEQ ID NO: 3051891 - RNA, 15 nt, Mycobacterium bovis subsp bovis AF2122/97
cgcagaccugcauca

SEQ ID NO: 3051892 - RNA, 16 nt, Mycobacterium bovis subsp bovis AF2122/97
cgcagaccugcaucac

SEQ ID NO: 3051893 - RNA, 18 nt, Mycobacterium bovis subsp bovis AF2122/97
cgcagaccugcaucacaa

SEQ ID NO: 3051894 - RNA, 17 nt, Mycobacterium bovis subsp bovis AF2122/97
cgcagacggcugccacg

SEQ ID NO: 3051895 - RNA, 20 nt, Mycobacterium bovis subsp bovis AF2122/97
cgcagacgugguagccggcg

SEQ ID NO: 3051896 - RNA, 19 nt, Mycobacterium bovis subsp bovis AF2122/97
cgcagacucgccaccgcgg

SEQ ID NO: 3051897 - RNA, 17 nt, Mycobacterium bovis subsp bovis AF2122/97
cgcagagcaccgcgaac

SEQ ID NO: 3051898 - RNA, 13 nt, Mycobacterium bovis subsp bovis AF2122/97
cgcagaggcggcu

SEQ ID NO: 3051899 - RNA, 19 nt, Mycobacterium bovis subsp bovis AF2122/97
cgcagauauuccucgucgg

SEQ ID NO: 3051900 - RNA, 16 nt, Mycobacterium bovis subsp bovis AF2122/97
cgcagaucaccgccag

SEQ ID NO: 3051901 - RNA, 17 nt, Mycobacterium bovis subsp bovis AF2122/97
cgcagaucaccgccagc

SEQ ID NO: 3051902 - RNA, 17 nt, Mycobacterium bovis subsp bovis AF2122/97
cgcagaucaggacgcga

SEQ ID NO: 3051903 - RNA, 19 nt, Mycobacterium bovis subsp bovis AF2122/97
cgcagaucaggguggcgcg

SEQ ID NO: 3051904 - RNA, 18 nt, Mycobacterium bovis subsp bovis AF2122/97
cgcagauccccgccaccg

SEQ ID NO: 3051905 - RNA, 22 nt, Mycobacterium bovis subsp bovis AF2122/97
cgcagaucgaaaucagcccgcg

SEQ ID NO: 3051906 - RNA, 19 nt, Mycobacterium bovis subsp bovis AF2122/97
cgcagaucguccaccgccg

SEQ ID NO: 3051907 - RNA, 21 nt, Mycobacterium bovis subsp bovis AF2122/97
cgcagaucguccaccgccgac

SEQ ID NO: 3051908 - RNA, 22 nt, Mycobacterium bovis subsp bovis AF2122/97
cgcagaucguccaccgccgaca

SEQ ID NO: 3051909 - RNA, 19 nt, Mycobacterium bovis subsp bovis AF2122/97
cgcagaucgugcacaaucg

SEQ ID NO: 3051910 - RNA, 14 nt, Mycobacterium bovis subsp bovis AF2122/97
cgcagauuccugau

SEQ ID NO: 3051911 - RNA, 15 nt, Mycobacterium bovis subsp bovis AF2122/97
cgcagauuccugaug

SEQ ID NO: 3051912 - RNA, 18 nt, Mycobacterium bovis subsp bovis AF2122/97
cgcagauuugcuccagcg

SEQ ID NO: 3051913 - RNA, 23 nt, Mycobacterium bovis subsp bovis AF2122/97
cgcagcaacaccucgucacccgg

SEQ ID NO: 3051914 - RNA, 16 nt, Mycobacterium bovis subsp bovis AF2122/97
cgcagcaacggcggcg

SEQ ID NO: 3051915 - RNA, 22 nt, Mycobacterium bovis subsp bovis AF2122/97
cgcagcaacggcggcgucgcgg

SEQ ID NO: 3051916 - RNA, 14 nt, Mycobacterium bovis subsp bovis AF2122/97
cgcagcaacucgac

SEQ ID NO: 3051917 - RNA, 17 nt, Mycobacterium bovis subsp bovis AF2122/97
cgcagcaacugggcggc

SEQ ID NO: 3051918 - RNA, 18 nt, Mycobacterium bovis subsp bovis AF2122/97
cgcagcaacugggcggcc

SEQ ID NO: 3051919 - RNA, 19 nt, Mycobacterium bovis subsp bovis AF2122/97
cgcagcaacugggcggccu

SEQ ID NO: 3051920 - RNA, 19 nt, Mycobacterium bovis subsp bovis AF2122/97
cgcagcacauccugcagcu

SEQ ID NO: 3051921 - RNA, 15 nt, Mycobacterium bovis subsp bovis AF2122/97
cgcagcaccacaucc

SEQ ID NO: 3051922 - RNA, 21 nt, Mycobacterium bovis subsp bovis AF2122/97
cgcagcaccacauccaucucc

SEQ ID NO: 3051923 - RNA, 19 nt, Mycobacterium bovis subsp bovis AF2122/97
cgcagcaccaggguggccc

SEQ ID NO: 3051924 - RNA, 19 nt, Mycobacterium bovis subsp bovis AF2122/97
cgcagcacccugcgggccg

SEQ ID NO: 3051925 - RNA, 16 nt, Mycobacterium bovis subsp bovis AF2122/97
cgcagcaccggcucga

SEQ ID NO: 3051926 - RNA, 14 nt, Mycobacterium bovis subsp bovis AF2122/97
cgcagcaccgucgg

SEQ ID NO: 3051927 - RNA, 19 nt, Mycobacterium bovis subsp bovis AF2122/97
cgcagcaccgucggcacca

SEQ ID NO: 3051928 - RNA, 21 nt, Mycobacterium bovis subsp bovis AF2122/97
cgcagcaccgucgggcccagc

SEQ ID NO: 3051929 - RNA, 12 nt, Mycobacterium bovis subsp bovis AF2122/97
cgcagcaccguu

SEQ ID NO: 3051930 - RNA, 18 nt, Mycobacterium bovis subsp bovis AF2122/97
cgcagcaccguucgcagc

SEQ ID NO: 3051931 - RNA, 20 nt, Mycobacterium bovis subsp bovis AF2122/97
cgcagcaccguucgcagcac

SEQ ID NO: 3051932 - RNA, 15 nt, Mycobacterium bovis subsp bovis AF2122/97
cgcagcaccucgucg

SEQ ID NO: 3051933 - RNA, 19 nt, Mycobacterium bovis subsp bovis AF2122/97
cgcagcaccucgucgaucg

SEQ ID NO: 3051934 - RNA, 22 nt, Mycobacterium bovis subsp bovis AF2122/97
cgcagcaccucgucgaucgccg

SEQ ID NO: 3051935 - RNA, 13 nt, Mycobacterium bovis subsp bovis AF2122/97
cgcagcacggcgg

SEQ ID NO: 3051936 - RNA, 17 nt, Mycobacterium bovis subsp bovis AF2122/97
cgcagcacggcggccac

SEQ ID NO: 3051937 - RNA, 18 nt, Mycobacterium bovis subsp bovis AF2122/97
cgcagcacggcggccacg

SEQ ID NO: 3051938 - RNA, 14 nt, Mycobacterium bovis subsp bovis AF2122/97
cgcagcacucgccc

SEQ ID NO: 3051939 - RNA, 16 nt, Mycobacterium bovis subsp bovis AF2122/97
cgcagcacucgcccaa

SEQ ID NO: 3051940 - RNA, 22 nt, Mycobacterium bovis subsp bovis AF2122/97
cgcagcacucgcccaagcgcag

SEQ ID NO: 3051941 - RNA, 18 nt, Mycobacterium bovis subsp bovis AF2122/97
cgcagcacugcggcagcg

SEQ ID NO: 3051942 - RNA, 19 nt, Mycobacterium bovis subsp bovis AF2122/97
cgcagcacugcggcagcga

SEQ ID NO: 3051943 - RNA, 12 nt, Mycobacterium bovis subsp bovis AF2122/97
cgcagcagacca

SEQ ID NO: 3051944 - RNA, 17 nt, Mycobacterium bovis subsp bovis AF2122/97
cgcagcagaccacaacg

SEQ ID NO: 3051945 - RNA, 23 nt, Mycobacterium bovis subsp bovis AF2122/97
cgcagcagacuccguugccaccu

SEQ ID NO: 3051946 - RNA, 21 nt, Mycobacterium bovis subsp bovis AF2122/97
cgcagcagcaucggcacgucg

SEQ ID NO: 3051947 - RNA, 19 nt, Mycobacterium bovis subsp bovis AF2122/97
cgcagcaggggacgaccau

SEQ ID NO: 3051948 - RNA, 17 nt, Mycobacterium bovis subsp bovis AF2122/97
cgcagcaggugagccag

SEQ ID NO: 3051949 - RNA, 21 nt, Mycobacterium bovis subsp bovis AF2122/97
cgcagcaggugagccaguugg

SEQ ID NO: 3051950 - RNA, 21 nt, Mycobacterium bovis subsp bovis AF2122/97
cgcagcauaaagaggucgggc

SEQ ID NO: 3051951 - RNA, 17 nt, Mycobacterium bovis subsp bovis AF2122/97
cgcagcauccccgcagc

SEQ ID NO: 3051952 - RNA, 18 nt, Mycobacterium bovis subsp bovis AF2122/97
cgcagcauccccgcagcg

SEQ ID NO: 3051953 - RNA, 19 nt, Mycobacterium bovis subsp bovis AF2122/97
cgcagcauccccgcagcgu

SEQ ID NO: 3051954 - RNA, 13 nt, Mycobacterium bovis subsp bovis AF2122/97
cgcagcaucggcg

SEQ ID NO: 3051955 - RNA, 14 nt, Mycobacterium bovis subsp bovis AF2122/97
cgcagcaucggcga

SEQ ID NO: 3051956 - RNA, 15 nt, Mycobacterium bovis subsp bovis AF2122/97
cgcagcaucgucgcc

SEQ ID NO: 3051957 - RNA, 20 nt, Mycobacterium bovis subsp bovis AF2122/97
cgcagcaucgucgccacgau

SEQ ID NO: 3051958 - RNA, 19 nt, Mycobacterium bovis subsp bovis AF2122/97
cgcagcaucuccgccgguc

SEQ ID NO: 3051959 - RNA, 19 nt, Mycobacterium bovis subsp bovis AF2122/97
cgcagcaucucgucgaucu

SEQ ID NO: 3051960 - RNA, 17 nt, Mycobacterium bovis subsp bovis AF2122/97
cgcagcaucugcggguc

SEQ ID NO: 3051961 - RNA, 15 nt, Mycobacterium bovis subsp bovis AF2122/97
cgcagcuccucgccc

SEQ ID NO: 3051962 - RNA, 17 nt, Mycobacterium bovis subsp bovis AF2122/97
cgcagcuccucgcccag

SEQ ID NO: 3051963 - RNA, 14 nt, Mycobacterium bovis subsp bovis AF2122/97
cgcagcucgccgag

SEQ ID NO: 3051964 - RNA, 22 nt, Mycobacterium bovis subsp bovis AF2122/97
cgcagcucgcugauaguggcgc

SEQ ID NO: 3051965 - RNA, 16 nt, Mycobacterium bovis subsp bovis AF2122/97
cgcagcucgugaccgc

SEQ ID NO: 3051966 - RNA, 14 nt, Mycobacterium bovis subsp bovis AF2122/97
cgcagcugacguca

SEQ ID NO: 3051967 - RNA, 16 nt, Mycobacterium bovis subsp bovis AF2122/97
cgcagcugacgucacc

SEQ ID NO: 3051968 - RNA, 17 nt, Mycobacterium bovis subsp bovis AF2122/97
cgcagcugacgucacca

SEQ ID NO: 3051969 - RNA, 23 nt, Mycobacterium bovis subsp bovis AF2122/97
cgcagcugacgucaccacgaucg

SEQ ID NO: 3051970 - RNA, 15 nt, Mycobacterium bovis subsp bovis AF2122/97
cgcagcugagccgug

SEQ ID NO: 3051971 - RNA, 23 nt, Mycobacterium bovis subsp bovis AF2122/97
cgcagcugaucuuggcaagccaa

SEQ ID NO: 3051972 - RNA, 15 nt, Mycobacterium bovis subsp bovis AF2122/97
cgcagcugccgcacc

SEQ ID NO: 3051973 - RNA, 15 nt, Mycobacterium bovis subsp bovis AF2122/97
cgcagcugcggaucc

SEQ ID NO: 3051974 - RNA, 18 nt, Mycobacterium bovis subsp bovis AF2122/97
cgcagcugguagcgcacc

SEQ ID NO: 3051975 - RNA, 20 nt, Mycobacterium bovis subsp bovis AF2122/97
cgcagcugucccucgggauc

SEQ ID NO: 3051976 - RNA, 22 nt, Mycobacterium bovis subsp bovis AF2122/97
cgcagcuuggccagccacuccu

SEQ ID NO: 3051977 - RNA, 19 nt, Mycobacterium bovis subsp bovis AF2122/97
cgcagcuuguccggugagu

SEQ ID NO: 3051978 - RNA, 21 nt, Mycobacterium bovis subsp bovis AF2122/97
cgcaggaaaaccccggccacc

SEQ ID NO: 3051979 - RNA, 19 nt, Mycobacterium bovis subsp bovis AF2122/97
cgcaggaagccggcgugcu

SEQ ID NO: 3051980 - RNA, 22 nt, Mycobacterium bovis subsp bovis AF2122/97
cgcaggaauguugagggugagc

SEQ ID NO: 3051981 - RNA, 22 nt, Mycobacterium bovis subsp bovis AF2122/97
cgcaggaauucgccauagcggg

SEQ ID NO: 3051982 - RNA, 20 nt, Mycobacterium bovis subsp bovis AF2122/97
cgcaggaccugcgucaucgc

SEQ ID NO: 3051983 - RNA, 22 nt, Mycobacterium bovis subsp bovis AF2122/97
cgcaggaccugcgucaucgcgg

SEQ ID NO: 3051984 - RNA, 15 nt, Mycobacterium bovis subsp bovis AF2122/97
cgcaggacgcugccg

SEQ ID NO: 3051985 - RNA, 18 nt, Mycobacterium bovis subsp bovis AF2122/97
cgcaggagcgcgaugacc

SEQ ID NO: 3051986 - RNA, 19 nt, Mycobacterium bovis subsp bovis AF2122/97
cgcaggaucacacuggccu

SEQ ID NO: 3051987 - RNA, 15 nt, Mycobacterium bovis subsp bovis AF2122/97
cgcaggaucggcgga

SEQ ID NO: 3051988 - RNA, 18 nt, Mycobacterium bovis subsp bovis AF2122/97
cgcaggauucccagucca

SEQ ID NO: 3051989 - RNA, 19 nt, Mycobacterium bovis subsp bovis AF2122/97
cgcaggauucccagucgcg

SEQ ID NO: 3051990 - RNA, 23 nt, Mycobacterium bovis subsp bovis AF2122/97
cgcaggauucugcugaccaugac

SEQ ID NO: 3051991 - RNA, 15 nt, Mycobacterium bovis subsp bovis AF2122/97
cgcaggcacaucgcg

SEQ ID NO: 3051992 - RNA, 16 nt, Mycobacterium bovis subsp bovis AF2122/97
cgcaggcacaucgcga

SEQ ID NO: 3051993 - RNA, 18 nt, Mycobacterium bovis subsp bovis AF2122/97
cgcaggcaccccgaucac

SEQ ID NO: 3051994 - RNA, 21 nt, Mycobacterium bovis subsp bovis AF2122/97
cgcaggccagggucagcucgg

SEQ ID NO: 3051995 - RNA, 20 nt, Mycobacterium bovis subsp bovis AF2122/97
cgcaggccaugggaaccgac

SEQ ID NO: 3051996 - RNA, 21 nt, Mycobacterium bovis subsp bovis AF2122/97
cgcaggccccggugccgaccg

SEQ ID NO: 3051997 - RNA, 15 nt, Mycobacterium bovis subsp bovis AF2122/97
cgcaggccgccgcca

SEQ ID NO: 3051998 - RNA, 15 nt, Mycobacterium bovis subsp bovis AF2122/97
cgcaggccggcggcg

SEQ ID NO: 3051999 - RNA, 20 nt, Mycobacterium bovis subsp bovis AF2122/97
cgcaggcgugcuugaccgcc

SEQ ID NO: 3052000 - RNA, 17 nt, Mycobacterium bovis subsp bovis AF2122/97
cgcaggcucaccgagcc

SEQ ID NO: 3052001 - RNA, 18 nt, Mycobacterium bovis subsp bovis AF2122/97
cgcaggcucaccgagccg

SEQ ID NO: 3052002 - RNA, 22 nt, Mycobacterium bovis subsp bovis AF2122/97
cgcaggcucagcugguggcggc

SEQ ID NO: 3052003 - RNA, 13 nt, Mycobacterium bovis subsp bovis AF2122/97
cgcaggcuucccc

SEQ ID NO: 3052004 - RNA, 14 nt, Mycobacterium bovis subsp bovis AF2122/97
cgcaggcuugccga

SEQ ID NO: 3052005 - RNA, 18 nt, Mycobacterium bovis subsp bovis AF2122/97
cgcagggacugugggggc

SEQ ID NO: 3052006 - RNA, 14 nt, Mycobacterium bovis subsp bovis AF2122/97
cgcagggaucgcag

SEQ ID NO: 3052007 - RNA, 15 nt, Mycobacterium bovis subsp bovis AF2122/97
cgcagggccgccgcg

SEQ ID NO: 3052008 - RNA, 15 nt, Mycobacterium bovis subsp bovis AF2122/97
cgcagggccuggaag

SEQ ID NO: 3052009 - RNA, 14 nt, Mycobacterium bovis subsp bovis AF2122/97
cgcaggggguggug

SEQ ID NO: 3052010 - RNA, 23 nt, Mycobacterium bovis subsp bovis AF2122/97
cgcaggggguggugucgcggccg

SEQ ID NO: 3052011 - RNA, 15 nt, Mycobacterium bovis subsp bovis AF2122/97
cgcaggguccacacc

SEQ ID NO: 3052012 - RNA, 16 nt, Mycobacterium bovis subsp bovis AF2122/97
cgcaggguccacacca

SEQ ID NO: 3052013 - RNA, 21 nt, Mycobacterium bovis subsp bovis AF2122/97
cgcagguacgccucgacagcg

SEQ ID NO: 3052014 - RNA, 17 nt, Mycobacterium bovis subsp bovis AF2122/97
cgcagguagucgacgac

SEQ ID NO: 3052015 - RNA, 18 nt, Mycobacterium bovis subsp bovis AF2122/97
cgcagguagucgacgacg

SEQ ID NO: 3052016 - RNA, 15 nt, Mycobacterium bovis subsp bovis AF2122/97
cgcaggucgaucugc

SEQ ID NO: 3052017 - RNA, 16 nt, Mycobacterium bovis subsp bovis AF2122/97
cgcaggucgaucugcg

SEQ ID NO: 3052018 - RNA, 12 nt, Mycobacterium bovis subsp bovis AF2122/97
cgcaggucgcgc

SEQ ID NO: 3052019 - RNA, 13 nt, Mycobacterium bovis subsp bovis AF2122/97
cgcaggucgcgca

SEQ ID NO: 3052020 - RNA, 15 nt, Mycobacterium bovis subsp bovis AF2122/97
cgcaggucgcuggcc

SEQ ID NO: 3052021 - RNA, 16 nt, Mycobacterium bovis subsp bovis AF2122/97
cgcaggucgcuggccg

SEQ ID NO: 3052022 - RNA, 13 nt, Mycobacterium bovis subsp bovis AF2122/97
cgcaggucggcca

SEQ ID NO: 3052023 - RNA, 18 nt, Mycobacterium bovis subsp bovis AF2122/97
cgcaggucggccaccugc

SEQ ID NO: 3052024 - RNA, 20 nt, Mycobacterium bovis subsp bovis AF2122/97
cgcaggugccuuucggcaga

SEQ ID NO: 3052025 - RNA, 16 nt, Mycobacterium bovis subsp bovis AF2122/97
cgcaggugcugggcga

SEQ ID NO: 3052026 - RNA, 19 nt, Mycobacterium bovis subsp bovis AF2122/97
cgcaggugcugggcgaggu

SEQ ID NO: 3052027 - RNA, 17 nt, Mycobacterium bovis subsp bovis AF2122/97
cgcagguggcuguucac

SEQ ID NO: 3052028 - RNA, 15 nt, Mycobacterium bovis subsp bovis AF2122/97
cgcaggugggcguug

SEQ ID NO: 3052029 - RNA, 19 nt, Mycobacterium bovis subsp bovis AF2122/97
cgcaggugggcguuggcga

SEQ ID NO: 3052030 - RNA, 22 nt, Mycobacterium bovis subsp bovis AF2122/97
cgcagguggucgaucagguacu

SEQ ID NO: 3052031 - RNA, 14 nt, Mycobacterium bovis subsp bovis AF2122/97
cgcagguggugaca

SEQ ID NO: 3052032 - RNA, 24 nt, Mycobacterium bovis subsp bovis AF2122/97
cgcaguaacgucgucgcgucgcca

SEQ ID NO: 3052033 - RNA, 22 nt, Mycobacterium bovis subsp bovis AF2122/97
cgcaguacuugaccguccaccg

SEQ ID NO: 3052034 - RNA, 15 nt, Mycobacterium bovis subsp bovis AF2122/97
cgcaguagccgacca

SEQ ID NO: 3052035 - RNA, 14 nt, Mycobacterium bovis subsp bovis AF2122/97
cgcagucccagcac

SEQ ID NO: 3052036 - RNA, 18 nt, Mycobacterium bovis subsp bovis AF2122/97
cgcaguccggggcgcagg

SEQ ID NO: 3052037 - RNA, 13 nt, Mycobacterium bovis subsp bovis AF2122/97
cgcaguccgggug

SEQ ID NO: 3052038 - RNA, 12 nt, Mycobacterium bovis subsp bovis AF2122/97
cgcagucgauga

SEQ ID NO: 3052039 - RNA, 17 nt, Mycobacterium bovis subsp bovis AF2122/97
cgcagucgcggcagacg

SEQ ID NO: 3052040 - RNA, 17 nt, Mycobacterium bovis subsp bovis AF2122/97
cgcagucgcuggguggc

SEQ ID NO: 3052041 - RNA, 14 nt, Mycobacterium bovis subsp bovis AF2122/97
cgcagucgggcagc

SEQ ID NO: 3052042 - RNA, 12 nt, Mycobacterium bovis subsp bovis AF2122/97
cgcagucugacg

SEQ ID NO: 3052043 - RNA, 19 nt, Mycobacterium bovis subsp bovis AF2122/97
cgcagucugauuccacauc

SEQ ID NO: 3052044 - RNA, 15 nt, Mycobacterium bovis subsp bovis AF2122/97
cgcagugacguuccg

SEQ ID NO: 3052045 - RNA, 20 nt, Mycobacterium bovis subsp bovis AF2122/97
cgcagugacguuccgcucgc

SEQ ID NO: 3052046 - RNA, 15 nt, Mycobacterium bovis subsp bovis AF2122/97
cgcagugagcagccg

SEQ ID NO: 3052047 - RNA, 20 nt, Mycobacterium bovis subsp bovis AF2122/97
cgcagugagcagccggaccg

SEQ ID NO: 3052048 - RNA, 14 nt, Mycobacterium bovis subsp bovis AF2122/97
cgcauggacaacag

SEQ ID NO: 3052049 - RNA, 13 nt, Mycobacterium bovis subsp bovis AF2122/97
cgcauggacgcga

SEQ ID NO: 3052050 - RNA, 23 nt, Mycobacterium bovis subsp bovis AF2122/97
cgcauggacgcgaugaccgcacc

SEQ ID NO: 3052051 - RNA, 13 nt, Mycobacterium bovis subsp bovis AF2122/97
cgcauggcggcug

SEQ ID NO: 3052052 - RNA, 13 nt, Mycobacterium bovis subsp bovis AF2122/97
cgcaugggccagg

SEQ ID NO: 3052053 - RNA, 20 nt, Mycobacterium bovis subsp bovis AF2122/97
cgcaugggccaggucagccg

SEQ ID NO: 3052054 - RNA, 19 nt, Mycobacterium bovis subsp bovis AF2122/97
cgcaugggucauggcgcug

SEQ ID NO: 3052055 - RNA, 22 nt, Mycobacterium bovis subsp bovis AF2122/97
cgcauggugggugccggcgucg

SEQ ID NO: 3052056 - RNA, 13 nt, Mycobacterium bovis subsp bovis AF2122/97
cgcaugucgaucc

SEQ ID NO: 3052057 - RNA, 20 nt, Mycobacterium bovis subsp bovis AF2122/97
cgcaugucgauccggcgcca

SEQ ID NO: 3052058 - RNA, 18 nt, Mycobacterium bovis subsp bovis AF2122/97
cgcaugucggacacgugg

SEQ ID NO: 3052059 - RNA, 16 nt, Mycobacterium bovis subsp bovis AF2122/97
cgcaugucgggccagg

SEQ ID NO: 3052060 - RNA, 17 nt, Mycobacterium bovis subsp bovis AF2122/97
cgcaugucgggccaggc

SEQ ID NO: 3052061 - RNA, 19 nt, Mycobacterium bovis subsp bovis AF2122/97
cgcaugucgggccaggcga

SEQ ID NO: 3052062 - RNA, 21 nt, Mycobacterium bovis subsp bovis AF2122/97
cgcaugugaaagacaacccgc

SEQ ID NO: 3052063 - RNA, 23 nt, Mycobacterium bovis subsp bovis AF2122/97
cgcauuagccugcguggagcgcu

SEQ ID NO: 3052064 - RNA, 22 nt, Mycobacterium bovis subsp bovis AF2122/97
cgcauuccagcaggccacugcg

SEQ ID NO: 3052065 - RNA, 15 nt, Mycobacterium bovis subsp bovis AF2122/97
cgcauuccggcgcca

SEQ ID NO: 3052066 - RNA, 16 nt, Mycobacterium bovis subsp bovis AF2122/97
cgcauucggacgccac

SEQ ID NO: 3052067 - RNA, 16 nt, Mycobacterium bovis subsp bovis AF2122/97
cgcauucggcgagccg

SEQ ID NO: 3052068 - RNA, 18 nt, Mycobacterium bovis subsp bovis AF2122/97
cgcauucggcgagccgcg

SEQ ID NO: 3052069 - RNA, 13 nt, Mycobacterium bovis subsp bovis AF2122/97
cgcauugaacagc

SEQ ID NO: 3052070 - RNA, 14 nt, Mycobacterium bovis subsp bovis AF2122/97
cgcauugaacagcg

SEQ ID NO: 3052071 - RNA, 19 nt, Mycobacterium bovis subsp bovis AF2122/97
cgcauugacgaaacccgaa

SEQ ID NO: 3052072 - RNA, 14 nt, Mycobacterium bovis subsp bovis AF2122/97
cgcauugagcuggc

SEQ ID NO: 3052073 - RNA, 19 nt, Mycobacterium bovis subsp bovis AF2122/97
cgcauugccaacgcccacg

SEQ ID NO: 3052074 - RNA, 22 nt, Mycobacterium bovis subsp bovis AF2122/97
cgcauuguccugaaaacaccgc

SEQ ID NO: 3052075 - RNA, 19 nt, Mycobacterium bovis subsp bovis AF2122/97
cgcauuucguggcgcgccg

SEQ ID NO: 3052076 - RNA, 22 nt, Mycobacterium bovis subsp bovis AF2122/97
cgcauuucguugagaacaucgg

SEQ ID NO: 3052077 - RNA, 19 nt, Mycobacterium bovis subsp bovis AF2122/97
cgcauuuguugcugcugcc

SEQ ID NO: 3052078 - RNA, 21 nt, Mycobacterium bovis subsp bovis AF2122/97
cgcauuuuucgccagcugaca

SEQ ID NO: 3052079 - RNA, 23 nt, Mycobacterium bovis subsp bovis AF2122/97
cgccaaaaaggaucccgccgcug

SEQ ID NO: 3052080 - RNA, 22 nt, Mycobacterium bovis subsp bovis AF2122/97
cgccaaaauccgcccaccgguc

SEQ ID NO: 3052081 - RNA, 21 nt, Mycobacterium bovis subsp bovis AF2122/97
cgccaaacaccccggccuugc

SEQ ID NO: 3052082 - RNA, 15 nt, Mycobacterium bovis subsp bovis AF2122/97
cgccaaacccggcgg

SEQ ID NO: 3052083 - RNA, 16 nt, Mycobacterium bovis subsp bovis AF2122/97
cgccaaacgcugcgcc

SEQ ID NO: 3052084 - RNA, 22 nt, Mycobacterium bovis subsp bovis AF2122/97
cgccaaagccgggauugccgcc

SEQ ID NO: 3052085 - RNA, 15 nt, Mycobacterium bovis subsp bovis AF2122/97
cgccaaauccggugc

SEQ ID NO: 3052086 - RNA, 22 nt, Mycobacterium bovis subsp bovis AF2122/97
cgccaaauccggugcccgcacc

SEQ ID NO: 3052087 - RNA, 23 nt, Mycobacterium bovis subsp bovis AF2122/97
cgccaaauccggugcccgcacca

SEQ ID NO: 3052088 - RNA, 23 nt, Mycobacterium bovis subsp bovis AF2122/97
cgccaacaacccaacaaaaggcc

SEQ ID NO: 3052089 - RNA, 15 nt, Mycobacterium bovis subsp bovis AF2122/97
cgccaacaccaacca

SEQ ID NO: 3052090 - RNA, 13 nt, Mycobacterium bovis subsp bovis AF2122/97
cgccaacaccggc

SEQ ID NO: 3052091 - RNA, 20 nt, Mycobacterium bovis subsp bovis AF2122/97
cgccaacaccggcaucgcga

SEQ ID NO: 3052092 - RNA, 21 nt, Mycobacterium bovis subsp bovis AF2122/97
cgccaaccacuuuccggccga

SEQ ID NO: 3052093 - RNA, 16 nt, Mycobacterium bovis subsp bovis AF2122/97
cgccaaccagucgcac

SEQ ID NO: 3052094 - RNA, 15 nt, Mycobacterium bovis subsp bovis AF2122/97
cgccaaccccaacau

SEQ ID NO: 3052095 - RNA, 20 nt, Mycobacterium bovis subsp bovis AF2122/97
cgccaaccccaacaucccgg

SEQ ID NO: 3052096 - RNA, 15 nt, Mycobacterium bovis subsp bovis AF2122/97
cgccaacccggccaa

SEQ ID NO: 3052097 - RNA, 16 nt, Mycobacterium bovis subsp bovis AF2122/97
cgccaaccgcgugcgu

SEQ ID NO: 3052098 - RNA, 20 nt, Mycobacterium bovis subsp bovis AF2122/97
cgccaaccguucccggcaga

SEQ ID NO: 3052099 - RNA, 18 nt, Mycobacterium bovis subsp bovis AF2122/97
cgccaaccuuugcguugc

SEQ ID NO: 3052100 - RNA, 22 nt, Mycobacterium bovis subsp bovis AF2122/97
cgccaacgacucacccacccgc

SEQ ID NO: 3052101 - RNA, 12 nt, Mycobacterium bovis subsp bovis AF2122/97
cgccaacgccaa

SEQ ID NO: 3052102 - RNA, 13 nt, Mycobacterium bovis subsp bovis AF2122/97
cgccaacgccacg

SEQ ID NO: 3052103 - RNA, 16 nt, Mycobacterium bovis subsp bovis AF2122/97
cgccaacgccacggca

SEQ ID NO: 3052104 - RNA, 17 nt, Mycobacterium bovis subsp bovis AF2122/97
cgccaacgccacggcaa

SEQ ID NO: 3052105 - RNA, 13 nt, Mycobacterium bovis subsp bovis AF2122/97
cgccaacgccagc

SEQ ID NO: 3052106 - RNA, 14 nt, Mycobacterium bovis subsp bovis AF2122/97
cgccaacgccagca

SEQ ID NO: 3052107 - RNA, 17 nt, Mycobacterium bovis subsp bovis AF2122/97
cgccaacgccagcacca

SEQ ID NO: 3052108 - RNA, 21 nt, Mycobacterium bovis subsp bovis AF2122/97
cgccaacgccagcaccagcgu

SEQ ID NO: 3052109 - RNA, 16 nt, Mycobacterium bovis subsp bovis AF2122/97
cgccaacgccagcggg

SEQ ID NO: 3052110 - RNA, 18 nt, Mycobacterium bovis subsp bovis AF2122/97
cgccaacgggcugccccu

SEQ ID NO: 3052111 - RNA, 19 nt, Mycobacterium bovis subsp bovis AF2122/97
cgccaacgggcugccccuc

SEQ ID NO: 3052112 - RNA, 18 nt, Mycobacterium bovis subsp bovis AF2122/97
cgccaacguugcgccagc

SEQ ID NO: 3052113 - RNA, 17 nt, Mycobacterium bovis subsp bovis AF2122/97
cgccaacuccagcaccc

SEQ ID NO: 3052114 - RNA, 21 nt, Mycobacterium bovis subsp bovis AF2122/97
cgccaacuccucagccgccug

SEQ ID NO: 3052115 - RNA, 19 nt, Mycobacterium bovis subsp bovis AF2122/97
cgccaacucgagaguggcc

SEQ ID NO: 3052116 - RNA, 22 nt, Mycobacterium bovis subsp bovis AF2122/97
cgccaacucgagaguggccucg

SEQ ID NO: 3052117 - RNA, 13 nt, Mycobacterium bovis subsp bovis AF2122/97
cgccaacugcggc

SEQ ID NO: 3052118 - RNA, 15 nt, Mycobacterium bovis subsp bovis AF2122/97
cgccaacugcggcag

SEQ ID NO: 3052119 - RNA, 19 nt, Mycobacterium bovis subsp bovis AF2122/97
cgccaacugcggcaggucu

SEQ ID NO: 3052120 - RNA, 17 nt, Mycobacterium bovis subsp bovis AF2122/97
cgccaagacgucggcgu

SEQ ID NO: 3052121 - RNA, 18 nt, Mycobacterium bovis subsp bovis AF2122/97
cgccaagacgucggcgug

SEQ ID NO: 3052122 - RNA, 19 nt, Mycobacterium bovis subsp bovis AF2122/97
cgccaagacgucggcgugg

SEQ ID NO: 3052123 - RNA, 22 nt, Mycobacterium bovis subsp bovis AF2122/97
cgccaagaucggguggcggguc

SEQ ID NO: 3052124 - RNA, 21 nt, Mycobacterium bovis subsp bovis AF2122/97
cgccaagcccaggcgaucgcc

SEQ ID NO: 3052125 - RNA, 13 nt, Mycobacterium bovis subsp bovis AF2122/97
cgccaagcucggc

SEQ ID NO: 3052126 - RNA, 15 nt, Mycobacterium bovis subsp bovis AF2122/97
cgccaagcucggcca

SEQ ID NO: 3052127 - RNA, 18 nt, Mycobacterium bovis subsp bovis AF2122/97
cgccaagcucggccacca

SEQ ID NO: 3052128 - RNA, 20 nt, Mycobacterium bovis subsp bovis AF2122/97
cgccaagcucggccaccagc

SEQ ID NO: 3052129 - RNA, 23 nt, Mycobacterium bovis subsp bovis AF2122/97
cgccaagcucggccaccagcgcc

SEQ ID NO: 3052130 - RNA, 13 nt, Mycobacterium bovis subsp bovis AF2122/97
cgccaaggaggcc

SEQ ID NO: 3052131 - RNA, 16 nt, Mycobacterium bovis subsp bovis AF2122/97
cgccaaggcgaugguc

SEQ ID NO: 3052132 - RNA, 20 nt, Mycobacterium bovis subsp bovis AF2122/97
cgccaagggccccuccggcc

SEQ ID NO: 3052133 - RNA, 18 nt, Mycobacterium bovis subsp bovis AF2122/97
cgccaaguacgcgaccgc

SEQ ID NO: 3052134 - RNA, 13 nt, Mycobacterium bovis subsp bovis AF2122/97
cgccaccgcgacg

SEQ ID NO: 3052135 - RNA, 14 nt, Mycobacterium bovis subsp bovis AF2122/97
cgccaccgcggccu

SEQ ID NO: 3052136 - RNA, 14 nt, Mycobacterium bovis subsp bovis AF2122/97
cgccaccgcggcga

SEQ ID NO: 3052137 - RNA, 14 nt, Mycobacterium bovis subsp bovis AF2122/97
cgccaccgcgguca

SEQ ID NO: 3052138 - RNA, 20 nt, Mycobacterium bovis subsp bovis AF2122/97
cgccaccgcgucacuucccg

SEQ ID NO: 3052139 - RNA, 20 nt, Mycobacterium bovis subsp bovis AF2122/97
cgccaccgcugucgauggac

SEQ ID NO: 3052140 - RNA, 22 nt, Mycobacterium bovis subsp bovis AF2122/97
cgccaccggaggugcgccgcgg

SEQ ID NO: 3052141 - RNA, 20 nt, Mycobacterium bovis subsp bovis AF2122/97
cgccaccggcaaucggcggc

SEQ ID NO: 3052142 - RNA, 12 nt, Mycobacterium bovis subsp bovis AF2122/97
cgccaccggcac

SEQ ID NO: 3052143 - RNA, 16 nt, Mycobacterium bovis subsp bovis AF2122/97
cgccaccggcaccgcc

SEQ ID NO: 3052144 - RNA, 19 nt, Mycobacterium bovis subsp bovis AF2122/97
cgccaccggcaccgccugc

SEQ ID NO: 3052145 - RNA, 13 nt, Mycobacterium bovis subsp bovis AF2122/97
cgccaccggccgc

SEQ ID NO: 3052146 - RNA, 11 nt, Mycobacterium bovis subsp bovis AF2122/97
cgccaccggcg

SEQ ID NO: 3052147 - RNA, 13 nt, Mycobacterium bovis subsp bovis AF2122/97
cgccaccggcgac

SEQ ID NO: 3052148 - RNA, 12 nt, Mycobacterium bovis subsp bovis AF2122/97
cgccaccggcgc

SEQ ID NO: 3052149 - RNA, 13 nt, Mycobacterium bovis subsp bovis AF2122/97
cgccaccggcgcc

SEQ ID NO: 3052150 - RNA, 17 nt, Mycobacterium bovis subsp bovis AF2122/97
cgccaccggcgccaccg

SEQ ID NO: 3052151 - RNA, 17 nt, Mycobacterium bovis subsp bovis AF2122/97
cgccaccggcgccgccc

SEQ ID NO: 3052152 - RNA, 18 nt, Mycobacterium bovis subsp bovis AF2122/97
cgccaccggcgccgcccg

SEQ ID NO: 3052153 - RNA, 20 nt, Mycobacterium bovis subsp bovis AF2122/97
cgccaccggcgccgcccgcg

SEQ ID NO: 3052154 - RNA, 18 nt, Mycobacterium bovis subsp bovis AF2122/97
cgccaccggcgccgccgu

SEQ ID NO: 3052155 - RNA, 16 nt, Mycobacterium bovis subsp bovis AF2122/97
cgccaccggcgcgacc

SEQ ID NO: 3052156 - RNA, 14 nt, Mycobacterium bovis subsp bovis AF2122/97
cgccaccgggacga

SEQ ID NO: 3052157 - RNA, 17 nt, Mycobacterium bovis subsp bovis AF2122/97
cgccaccgguaccggcg

SEQ ID NO: 3052158 - RNA, 18 nt, Mycobacterium bovis subsp bovis AF2122/97
cgccaccgguaccggcga

SEQ ID NO: 3052159 - RNA, 13 nt, Mycobacterium bovis subsp bovis AF2122/97
cgccaccggugag

SEQ ID NO: 3052160 - RNA, 22 nt, Mycobacterium bovis subsp bovis AF2122/97
cgccaccguacgacagucgcag

SEQ ID NO: 3052161 - RNA, 19 nt, Mycobacterium bovis subsp bovis AF2122/97
cgccaccguaggucgugga

SEQ ID NO: 3052162 - RNA, 16 nt, Mycobacterium bovis subsp bovis AF2122/97
cgccaccgucaccgcc

SEQ ID NO: 3052163 - RNA, 17 nt, Mycobacterium bovis subsp bovis AF2122/97
cgccaccgucaccgccg

SEQ ID NO: 3052164 - RNA, 20 nt, Mycobacterium bovis subsp bovis AF2122/97
cgccaccgucauggcgggug

SEQ ID NO: 3052165 - RNA, 23 nt, Mycobacterium bovis subsp bovis AF2122/97
cgccaccgugguggacgaccgcg

SEQ ID NO: 3052166 - RNA, 16 nt, Mycobacterium bovis subsp bovis AF2122/97
cgccaccgugucacgc

SEQ ID NO: 3052167 - RNA, 18 nt, Mycobacterium bovis subsp bovis AF2122/97
cgccaccgugucacgcga

SEQ ID NO: 3052168 - RNA, 19 nt, Mycobacterium bovis subsp bovis AF2122/97
cgccaccgugucacgcgac

SEQ ID NO: 3052169 - RNA, 14 nt, Mycobacterium bovis subsp bovis AF2122/97
cgccaccguuugcg

SEQ ID NO: 3052170 - RNA, 22 nt, Mycobacterium bovis subsp bovis AF2122/97
cgccaccguuugcgcaccgguc

SEQ ID NO: 3052171 - RNA, 17 nt, Mycobacterium bovis subsp bovis AF2122/97
cgccaccucccacgccg

SEQ ID NO: 3052172 - RNA, 19 nt, Mycobacterium bovis subsp bovis AF2122/97
cgccaccucccacgccgcc

SEQ ID NO: 3052173 - RNA, 18 nt, Mycobacterium bovis subsp bovis AF2122/97
cgccaccucccagggcuc

SEQ ID NO: 3052174 - RNA, 14 nt, Mycobacterium bovis subsp bovis AF2122/97
cgccaccuccgacg

SEQ ID NO: 3052175 - RNA, 17 nt, Mycobacterium bovis subsp bovis AF2122/97
cgccaccucgccggccg

SEQ ID NO: 3052176 - RNA, 18 nt, Mycobacterium bovis subsp bovis AF2122/97
cgccaccucgccggccgu

SEQ ID NO: 3052177 - RNA, 20 nt, Mycobacterium bovis subsp bovis AF2122/97
cgccaccugacgugcggcgc

SEQ ID NO: 3052178 - RNA, 22 nt, Mycobacterium bovis subsp bovis AF2122/97
cgccaccugacgugcggcgcgg

SEQ ID NO: 3052179 - RNA, 21 nt, Mycobacterium bovis subsp bovis AF2122/97
cgccaccuuggcugggcccgc

SEQ ID NO: 3052180 - RNA, 13 nt, Mycobacterium bovis subsp bovis AF2122/97
cgccacgacaggu

SEQ ID NO: 3052181 - RNA, 15 nt, Mycobacterium bovis subsp bovis AF2122/97
cgccacgaccgccga

SEQ ID NO: 3052182 - RNA, 12 nt, Mycobacterium bovis subsp bovis AF2122/97
cgccacgacgcc

SEQ ID NO: 3052183 - RNA, 14 nt, Mycobacterium bovis subsp bovis AF2122/97
cgccacgacgccca

SEQ ID NO: 3052184 - RNA, 19 nt, Mycobacterium bovis subsp bovis AF2122/97
cgccacgagcaacgggcga

SEQ ID NO: 3052185 - RNA, 13 nt, Mycobacterium bovis subsp bovis AF2122/97
cgccacgaugacc

SEQ ID NO: 3052186 - RNA, 17 nt, Mycobacterium bovis subsp bovis AF2122/97
cgccacgaugucgucga

SEQ ID NO: 3052187 - RNA, 14 nt, Mycobacterium bovis subsp bovis AF2122/97
cgccacgcacccgg

SEQ ID NO: 3052188 - RNA, 15 nt, Mycobacterium bovis subsp bovis AF2122/97
cgccacgcacccggc

SEQ ID NO: 3052189 - RNA, 14 nt, Mycobacterium bovis subsp bovis AF2122/97
cgccacgccaccgc

SEQ ID NO: 3052190 - RNA, 16 nt, Mycobacterium bovis subsp bovis AF2122/97
cgccacgccaccgcgg

SEQ ID NO: 3052191 - RNA, 23 nt, Mycobacterium bovis subsp bovis AF2122/97
cgccacgcccagcgcccgcgcgg

SEQ ID NO: 3052192 - RNA, 15 nt, Mycobacterium bovis subsp bovis AF2122/97
cgccacgcccgacgc

SEQ ID NO: 3052193 - RNA, 17 nt, Mycobacterium bovis subsp bovis AF2122/97
cgccacgccgaugaugg

SEQ ID NO: 3052194 - RNA, 15 nt, Mycobacterium bovis subsp bovis AF2122/97
cgccacgcgucuucg

SEQ ID NO: 3052195 - RNA, 21 nt, Mycobacterium bovis subsp bovis AF2122/97
cgccacgcgucuucggucgcg

SEQ ID NO: 3052196 - RNA, 22 nt, Mycobacterium bovis subsp bovis AF2122/97
cgccacgcgucuucggucgcgg

SEQ ID NO: 3052197 - RNA, 19 nt, Mycobacterium bovis subsp bovis AF2122/97
cgccacggacgugacgucg

SEQ ID NO: 3052198 - RNA, 15 nt, Mycobacterium bovis subsp bovis AF2122/97
cgccacggaucgcgg

SEQ ID NO: 3052199 - RNA, 19 nt, Mycobacterium bovis subsp bovis AF2122/97
cgccacggaucgcggcggc

SEQ ID NO: 3052200 - RNA, 22 nt, Mycobacterium bovis subsp bovis AF2122/97
cgccacggaucgcggcggcgug

SEQ ID NO: 3052201 - RNA, 13 nt, Mycobacterium bovis subsp bovis AF2122/97
cgccacggcagcg

SEQ ID NO: 3052202 - RNA, 17 nt, Mycobacterium bovis subsp bovis AF2122/97
cgccacggcagcgccca

SEQ ID NO: 3052203 - RNA, 16 nt, Mycobacterium bovis subsp bovis AF2122/97
cgccacggcaucggcc

SEQ ID NO: 3052204 - RNA, 19 nt, Mycobacterium bovis subsp bovis AF2122/97
cgccacggcggcuuccggc

SEQ ID NO: 3052205 - RNA, 17 nt, Mycobacterium bovis subsp bovis AF2122/97
cgccacggcuguggccg

SEQ ID NO: 3052206 - RNA, 14 nt, Mycobacterium bovis subsp bovis AF2122/97
cgccacgggcggcc

SEQ ID NO: 3052207 - RNA, 15 nt, Mycobacterium bovis subsp bovis AF2122/97
cgccacgggcggcca

SEQ ID NO: 3052208 - RNA, 18 nt, Mycobacterium bovis subsp bovis AF2122/97
cgccacgggcggccaccg

SEQ ID NO: 3052209 - RNA, 22 nt, Mycobacterium bovis subsp bovis AF2122/97
cgccacggugguggugggaguu

SEQ ID NO: 3052210 - RNA, 20 nt, Mycobacterium bovis subsp bovis AF2122/97
cgccacggugucgcgaugcu

SEQ ID NO: 3052211 - RNA, 20 nt, Mycobacterium bovis subsp bovis AF2122/97
cgccacgguucgggcagcac

SEQ ID NO: 3052212 - RNA, 24 nt, Mycobacterium bovis subsp bovis AF2122/97
cgccacgguucgggcagcacccgc

SEQ ID NO: 3052213 - RNA, 20 nt, Mycobacterium bovis subsp bovis AF2122/97
cgccacguacuccaccgcgc

SEQ ID NO: 3052214 - RNA, 20 nt, Mycobacterium bovis subsp bovis AF2122/97
cgccacguacuuggacgacc

SEQ ID NO: 3052215 - RNA, 23 nt, Mycobacterium bovis subsp bovis AF2122/97
cgccacguacuuggacgacccgg

SEQ ID NO: 3052216 - RNA, 22 nt, Mycobacterium bovis subsp bovis AF2122/97
cgccacguccaacucggcccgg

SEQ ID NO: 3052217 - RNA, 21 nt, Mycobacterium bovis subsp bovis AF2122/97
cgccacguccaucaccggcgg

SEQ ID NO: 3052218 - RNA, 22 nt, Mycobacterium bovis subsp bovis AF2122/97
cgccacguccaucaccggcggc

SEQ ID NO: 3052219 - RNA, 15 nt, Mycobacterium bovis subsp bovis AF2122/97
cgccacgucgacggu

SEQ ID NO: 3052220 - RNA, 18 nt, Mycobacterium bovis subsp bovis AF2122/97
cgccacuagcccugagcg

SEQ ID NO: 3052221 - RNA, 16 nt, Mycobacterium bovis subsp bovis AF2122/97
cgccagcgccgccgcg

SEQ ID NO: 3052222 - RNA, 16 nt, Mycobacterium bovis subsp bovis AF2122/97
cgccagcgccgccggc

SEQ ID NO: 3052223 - RNA, 17 nt, Mycobacterium bovis subsp bovis AF2122/97
cgccagcgccgccggcg

SEQ ID NO: 3052224 - RNA, 18 nt, Mycobacterium bovis subsp bovis AF2122/97
cgccagcgccgccggcgc

SEQ ID NO: 3052225 - RNA, 13 nt, Mycobacterium bovis subsp bovis AF2122/97
cgccagcgccgga

SEQ ID NO: 3052226 - RNA, 14 nt, Mycobacterium bovis subsp bovis AF2122/97
cgccagcgccggcc

SEQ ID NO: 3052227 - RNA, 18 nt, Mycobacterium bovis subsp bovis AF2122/97
cgccagcgccggccaggc

SEQ ID NO: 3052228 - RNA, 13 nt, Mycobacterium bovis subsp bovis AF2122/97
cgccagcgccggu

SEQ ID NO: 3052229 - RNA, 14 nt, Mycobacterium bovis subsp bovis AF2122/97
cgccagcgccgguc

SEQ ID NO: 3052230 - RNA, 22 nt, Mycobacterium bovis subsp bovis AF2122/97
cgccagcgcgaaccugcucggc

SEQ ID NO: 3052231 - RNA, 23 nt, Mycobacterium bovis subsp bovis AF2122/97
cgccagcgcgaaccugcucggcg

SEQ ID NO: 3052232 - RNA, 14 nt, Mycobacterium bovis subsp bovis AF2122/97
cgccagcgcggugu

SEQ ID NO: 3052233 - RNA, 12 nt, Mycobacterium bovis subsp bovis AF2122/97
cgccagcggcaa

SEQ ID NO: 3052234 - RNA, 22 nt, Mycobacterium bovis subsp bovis AF2122/97
cgccagcggcaauggccagcac

SEQ ID NO: 3052235 - RNA, 23 nt, Mycobacterium bovis subsp bovis AF2122/97
cgccagcggcaauggccagcacc

SEQ ID NO: 3052236 - RNA, 13 nt, Mycobacterium bovis subsp bovis AF2122/97
cgccagcggccgc

SEQ ID NO: 3052237 - RNA, 17 nt, Mycobacterium bovis subsp bovis AF2122/97
cgccagcggccgcucca

SEQ ID NO: 3052238 - RNA, 23 nt, Mycobacterium bovis subsp bovis AF2122/97
cgccagcggccgcuccaccucgg

SEQ ID NO: 3052239 - RNA, 13 nt, Mycobacterium bovis subsp bovis AF2122/97
cgccagcggcgag

SEQ ID NO: 3052240 - RNA, 12 nt, Mycobacterium bovis subsp bovis AF2122/97
cgccagcggggc

SEQ ID NO: 3052241 - RNA, 17 nt, Mycobacterium bovis subsp bovis AF2122/97
cgccagcgguggaccac

SEQ ID NO: 3052242 - RNA, 20 nt, Mycobacterium bovis subsp bovis AF2122/97
cgccagcguaaauagcgccc

SEQ ID NO: 3052243 - RNA, 14 nt, Mycobacterium bovis subsp bovis AF2122/97
cgccagcgucgaca

SEQ ID NO: 3052244 - RNA, 18 nt, Mycobacterium bovis subsp bovis AF2122/97
cgccagcucacggacgcu

SEQ ID NO: 3052245 - RNA, 13 nt, Mycobacterium bovis subsp bovis AF2122/97
cgccagcucgccg

SEQ ID NO: 3052246 - RNA, 14 nt, Mycobacterium bovis subsp bovis AF2122/97
cgccagcucgccgg

SEQ ID NO: 3052247 - RNA, 18 nt, Mycobacterium bovis subsp bovis AF2122/97
cgccagcucgccggccgg

SEQ ID NO: 3052248 - RNA, 13 nt, Mycobacterium bovis subsp bovis AF2122/97
cgccagcucggca

SEQ ID NO: 3052249 - RNA, 15 nt, Mycobacterium bovis subsp bovis AF2122/97
cgccagcucggcacc

SEQ ID NO: 3052250 - RNA, 19 nt, Mycobacterium bovis subsp bovis AF2122/97
cgccagcucggcacccgcc

SEQ ID NO: 3052251 - RNA, 18 nt, Mycobacterium bovis subsp bovis AF2122/97
cgccagcucggcggcagc

SEQ ID NO: 3052252 - RNA, 21 nt, Mycobacterium bovis subsp bovis AF2122/97
cgccagcucggcggcagcggc

SEQ ID NO: 3052253 - RNA, 22 nt, Mycobacterium bovis subsp bovis AF2122/97
cgccagcucggcggcagcggcg

SEQ ID NO: 3052254 - RNA, 14 nt, Mycobacterium bovis subsp bovis AF2122/97
cgccagcugcccga

SEQ ID NO: 3052255 - RNA, 14 nt, Mycobacterium bovis subsp bovis AF2122/97
cgccagcugcgcag

SEQ ID NO: 3052256 - RNA, 16 nt, Mycobacterium bovis subsp bovis AF2122/97
cgccagcugcgcagcg

SEQ ID NO: 3052257 - RNA, 19 nt, Mycobacterium bovis subsp bovis AF2122/97
cgccagcugggcagccaga

SEQ ID NO: 3052258 - RNA, 17 nt, Mycobacterium bovis subsp bovis AF2122/97
cgccagcuuggcaaccu

SEQ ID NO: 3052259 - RNA, 16 nt, Mycobacterium bovis subsp bovis AF2122/97
cgccagcuugucgggc

SEQ ID NO: 3052260 - RNA, 17 nt, Mycobacterium bovis subsp bovis AF2122/97
cgccagcuugucgggca

SEQ ID NO: 3052261 - RNA, 11 nt, Mycobacterium bovis subsp bovis AF2122/97
cgccaggaacc

SEQ ID NO: 3052262 - RNA, 14 nt, Mycobacterium bovis subsp bovis AF2122/97
cgccaggaacccgu

SEQ ID NO: 3052263 - RNA, 18 nt, Mycobacterium bovis subsp bovis AF2122/97
cgccaggaacucggccca

SEQ ID NO: 3052264 - RNA, 20 nt, Mycobacterium bovis subsp bovis AF2122/97
cgccaggaaucccucggccg

SEQ ID NO: 3052265 - RNA, 23 nt, Mycobacterium bovis subsp bovis AF2122/97
cgccaggaaucccucggccgcag

SEQ ID NO: 3052266 - RNA, 16 nt, Mycobacterium bovis subsp bovis AF2122/97
cgccaggagcgcggcc

SEQ ID NO: 3052267 - RNA, 19 nt, Mycobacterium bovis subsp bovis AF2122/97
cgccaggagcgcggcccgc

SEQ ID NO: 3052268 - RNA, 21 nt, Mycobacterium bovis subsp bovis AF2122/97
cgccaggagcgcggcccgccu

SEQ ID NO: 3052269 - RNA, 23 nt, Mycobacterium bovis subsp bovis AF2122/97
cgccaggagcgcggcccgccucg

SEQ ID NO: 3052270 - RNA, 14 nt, Mycobacterium bovis subsp bovis AF2122/97
cgccaggaguggcc

SEQ ID NO: 3052271 - RNA, 23 nt, Mycobacterium bovis subsp bovis AF2122/97
cgccaggaucugguugaaccggu

SEQ ID NO: 3052272 - RNA, 22 nt, Mycobacterium bovis subsp bovis AF2122/97
cgccaggcaccacgaccgacac

SEQ ID NO: 3052273 - RNA, 13 nt, Mycobacterium bovis subsp bovis AF2122/97
cgccaggcccccu

SEQ ID NO: 3052274 - RNA, 15 nt, Mycobacterium bovis subsp bovis AF2122/97
cgccaggccgaccgc

SEQ ID NO: 3052275 - RNA, 16 nt, Mycobacterium bovis subsp bovis AF2122/97
cgccaggccgaccgcg

SEQ ID NO: 3052276 - RNA, 21 nt, Mycobacterium bovis subsp bovis AF2122/97
cgccaggccgaccgcgcacau

SEQ ID NO: 3052277 - RNA, 15 nt, Mycobacterium bovis subsp bovis AF2122/97
cgccaggccgagccc

SEQ ID NO: 3052278 - RNA, 15 nt, Mycobacterium bovis subsp bovis AF2122/97
cgccaggccgucggg

SEQ ID NO: 3052279 - RNA, 14 nt, Mycobacterium bovis subsp bovis AF2122/97
cgccaggccguugc

SEQ ID NO: 3052280 - RNA, 19 nt, Mycobacterium bovis subsp bovis AF2122/97
cgccaggcgcgaucgcgcc

SEQ ID NO: 3052281 - RNA, 18 nt, Mycobacterium bovis subsp bovis AF2122/97
cgccaggcgcuuggccgg

SEQ ID NO: 3052282 - RNA, 20 nt, Mycobacterium bovis subsp bovis AF2122/97
cgccaggcggcaauucgggc

SEQ ID NO: 3052283 - RNA, 13 nt, Mycobacterium bovis subsp bovis AF2122/97
cgccaggcggccg

SEQ ID NO: 3052284 - RNA, 14 nt, Mycobacterium bovis subsp bovis AF2122/97
cgccaggcggccgg

SEQ ID NO: 3052285 - RNA, 16 nt, Mycobacterium bovis subsp bovis AF2122/97
cgccaggcggccgggu

SEQ ID NO: 3052286 - RNA, 13 nt, Mycobacterium bovis subsp bovis AF2122/97
cgccaggcuugcg

SEQ ID NO: 3052287 - RNA, 20 nt, Mycobacterium bovis subsp bovis AF2122/97
cgccaggcuugcggcaccca

SEQ ID NO: 3052288 - RNA, 21 nt, Mycobacterium bovis subsp bovis AF2122/97
cgccagggaucuagaggcggc

SEQ ID NO: 3052289 - RNA, 15 nt, Mycobacterium bovis subsp bovis AF2122/97
cgccagggcacgugg

SEQ ID NO: 3052290 - RNA, 14 nt, Mycobacterium bovis subsp bovis AF2122/97
cgccagggccaucu

SEQ ID NO: 3052291 - RNA, 22 nt, Mycobacterium bovis subsp bovis AF2122/97
cgccagggcccuagccggcgcg

SEQ ID NO: 3052292 - RNA, 14 nt, Mycobacterium bovis subsp bovis AF2122/97
cgccagggccgccg

SEQ ID NO: 3052293 - RNA, 15 nt, Mycobacterium bovis subsp bovis AF2122/97
cgccagggccgccga

SEQ ID NO: 3052294 - RNA, 20 nt, Mycobacterium bovis subsp bovis AF2122/97
cgccaggggugugccguggu

SEQ ID NO: 3052295 - RNA, 21 nt, Mycobacterium bovis subsp bovis AF2122/97
cgccagguacucggugcacag

SEQ ID NO: 3052296 - RNA, 16 nt, Mycobacterium bovis subsp bovis AF2122/97
cgccaggucagcucga

SEQ ID NO: 3052297 - RNA, 18 nt, Mycobacterium bovis subsp bovis AF2122/97
cgccagguccccgacaac

SEQ ID NO: 3052298 - RNA, 22 nt, Mycobacterium bovis subsp bovis AF2122/97
cgccagguccgccggugccgcc

SEQ ID NO: 3052299 - RNA, 23 nt, Mycobacterium bovis subsp bovis AF2122/97
cgccagguccgccggugccgccg

SEQ ID NO: 3052300 - RNA, 19 nt, Mycobacterium bovis subsp bovis AF2122/97
cgccaggucgaggcaggcc

SEQ ID NO: 3052301 - RNA, 21 nt, Mycobacterium bovis subsp bovis AF2122/97
cgccaggugaugccgccgugg

SEQ ID NO: 3052302 - RNA, 19 nt, Mycobacterium bovis subsp bovis AF2122/97
cgccaggugcagcaccagc

SEQ ID NO: 3052303 - RNA, 16 nt, Mycobacterium bovis subsp bovis AF2122/97
cgccagguggccgcuc

SEQ ID NO: 3052304 - RNA, 22 nt, Mycobacterium bovis subsp bovis AF2122/97
cgccagguuaggcaauagccgg

SEQ ID NO: 3052305 - RNA, 14 nt, Mycobacterium bovis subsp bovis AF2122/97
cgccagguugcccg

SEQ ID NO: 3052306 - RNA, 17 nt, Mycobacterium bovis subsp bovis AF2122/97
cgccaguauggccgcca

SEQ ID NO: 3052307 - RNA, 18 nt, Mycobacterium bovis subsp bovis AF2122/97
cgccagucccacugggcc

SEQ ID NO: 3052308 - RNA, 14 nt, Mycobacterium bovis subsp bovis AF2122/97
cgcccaaagaaaug

SEQ ID NO: 3052309 - RNA, 18 nt, Mycobacterium bovis subsp bovis AF2122/97
cgcccaacaacgcuucgg

SEQ ID NO: 3052310 - RNA, 13 nt, Mycobacterium bovis subsp bovis AF2122/97
cgcccaacaccgc

SEQ ID NO: 3052311 - RNA, 15 nt, Mycobacterium bovis subsp bovis AF2122/97
cgcccaacaccgcgc

SEQ ID NO: 3052312 - RNA, 17 nt, Mycobacterium bovis subsp bovis AF2122/97
cgcccaacaccgcgccg

SEQ ID NO: 3052313 - RNA, 18 nt, Mycobacterium bovis subsp bovis AF2122/97
cgcccaacaccgcgccga

SEQ ID NO: 3052314 - RNA, 23 nt, Mycobacterium bovis subsp bovis AF2122/97
cgcccaacaggcgggacaaccgg

SEQ ID NO: 3052315 - RNA, 14 nt, Mycobacterium bovis subsp bovis AF2122/97
cgcccaacgcgggu

SEQ ID NO: 3052316 - RNA, 16 nt, Mycobacterium bovis subsp bovis AF2122/97
cgcccaacgucgccag

SEQ ID NO: 3052317 - RNA, 20 nt, Mycobacterium bovis subsp bovis AF2122/97
cgcccaacgucgccagguca

SEQ ID NO: 3052318 - RNA, 16 nt, Mycobacterium bovis subsp bovis AF2122/97
cgcccaagccgccggc

SEQ ID NO: 3052319 - RNA, 14 nt, Mycobacterium bovis subsp bovis AF2122/97
cgcccaagcgcagc

SEQ ID NO: 3052320 - RNA, 17 nt, Mycobacterium bovis subsp bovis AF2122/97
cgcccaagcgcagccug

SEQ ID NO: 3052321 - RNA, 20 nt, Mycobacterium bovis subsp bovis AF2122/97
cgcccaagguggcggccagu

SEQ ID NO: 3052322 - RNA, 17 nt, Mycobacterium bovis subsp bovis AF2122/97
cgcccaauuucgucucg

SEQ ID NO: 3052323 - RNA, 18 nt, Mycobacterium bovis subsp bovis AF2122/97
cgcccaauuucgugccga

SEQ ID NO: 3052324 - RNA, 20 nt, Mycobacterium bovis subsp bovis AF2122/97
cgcccaauuucgugccgaaa

SEQ ID NO: 3052325 - RNA, 20 nt, Mycobacterium bovis subsp bovis AF2122/97
cgcccaauuucgugccgaau

SEQ ID NO: 3052326 - RNA, 22 nt, Mycobacterium bovis subsp bovis AF2122/97
cgcccacaaugacucggccgca

SEQ ID NO: 3052327 - RNA, 14 nt, Mycobacterium bovis subsp bovis AF2122/97
cgcccacagcccgg

SEQ ID NO: 3052328 - RNA, 16 nt, Mycobacterium bovis subsp bovis AF2122/97
cgcccacagcuugccc

SEQ ID NO: 3052329 - RNA, 20 nt, Mycobacterium bovis subsp bovis AF2122/97
cgcccacagcuugcccgagc

SEQ ID NO: 3052330 - RNA, 18 nt, Mycobacterium bovis subsp bovis AF2122/97
cgcccacauacagcggag

SEQ ID NO: 3052331 - RNA, 21 nt, Mycobacterium bovis subsp bovis AF2122/97
cgcccacaucgucggcgggcg

SEQ ID NO: 3052332 - RNA, 22 nt, Mycobacterium bovis subsp bovis AF2122/97
cgcccacaucgucggcgggcgg

SEQ ID NO: 3052333 - RNA, 14 nt, Mycobacterium bovis subsp bovis AF2122/97
cgcccaccacacag

SEQ ID NO: 3052334 - RNA, 17 nt, Mycobacterium bovis subsp bovis AF2122/97
cgcccaccacacagccg

SEQ ID NO: 3052335 - RNA, 19 nt, Mycobacterium bovis subsp bovis AF2122/97
cgcccaccacacagccgcg

SEQ ID NO: 3052336 - RNA, 18 nt, Mycobacterium bovis subsp bovis AF2122/97
cgcccaccacgaacacgu

SEQ ID NO: 3052337 - RNA, 22 nt, Mycobacterium bovis subsp bovis AF2122/97
cgcccaccacgaacacguucgg

SEQ ID NO: 3052338 - RNA, 14 nt, Mycobacterium bovis subsp bovis AF2122/97
cgcccaccagcggc

SEQ ID NO: 3052339 - RNA, 22 nt, Mycobacterium bovis subsp bovis AF2122/97
cgcccaccagcggcggcaacgg

SEQ ID NO: 3052340 - RNA, 13 nt, Mycobacterium bovis subsp bovis AF2122/97
cgcccaccccggc

SEQ ID NO: 3052341 - RNA, 13 nt, Mycobacterium bovis subsp bovis AF2122/97
cgcccacccgcgc

SEQ ID NO: 3052342 - RNA, 14 nt, Mycobacterium bovis subsp bovis AF2122/97
cgcccacccgcgcc

SEQ ID NO: 3052343 - RNA, 14 nt, Mycobacterium bovis subsp bovis AF2122/97
cgcccaccgaugcg

SEQ ID NO: 3052344 - RNA, 13 nt, Mycobacterium bovis subsp bovis AF2122/97
cgcccaccgcaac

SEQ ID NO: 3052345 - RNA, 14 nt, Mycobacterium bovis subsp bovis AF2122/97
cgcccaccgcaacg

SEQ ID NO: 3052346 - RNA, 14 nt, Mycobacterium bovis subsp bovis AF2122/97
cgcccaccgggcgg

SEQ ID NO: 3052347 - RNA, 16 nt, Mycobacterium bovis subsp bovis AF2122/97
cgcccaccgggcggcg

SEQ ID NO: 3052348 - RNA, 19 nt, Mycobacterium bovis subsp bovis AF2122/97
cgcccaccgggcggcggcg

SEQ ID NO: 3052349 - RNA, 13 nt, Mycobacterium bovis subsp bovis AF2122/97
cgcccaccggucg

SEQ ID NO: 3052350 - RNA, 15 nt, Mycobacterium bovis subsp bovis AF2122/97
cgcccaccggucgcc

SEQ ID NO: 3052351 - RNA, 18 nt, Mycobacterium bovis subsp bovis AF2122/97
cgcccaccggucgccgcg

SEQ ID NO: 3052352 - RNA, 23 nt, Mycobacterium bovis subsp bovis AF2122/97
cgcccaccguugcgaagaagaag

SEQ ID NO: 3052353 - RNA, 16 nt, Mycobacterium bovis subsp bovis AF2122/97
cgcccaccucgaucgc

SEQ ID NO: 3052354 - RNA, 20 nt, Mycobacterium bovis subsp bovis AF2122/97
cgcccaccucgaucgcgccg

SEQ ID NO: 3052355 - RNA, 13 nt, Mycobacterium bovis subsp bovis AF2122/97
cgcccacgcugcc

SEQ ID NO: 3052356 - RNA, 19 nt, Mycobacterium bovis subsp bovis AF2122/97
cgcccacggcaccaccaag

SEQ ID NO: 3052357 - RNA, 23 nt, Mycobacterium bovis subsp bovis AF2122/97
cgcccacggcaccaccaagcucg

SEQ ID NO: 3052358 - RNA, 14 nt, Mycobacterium bovis subsp bovis AF2122/97
cgcccacggggcgu

SEQ ID NO: 3052359 - RNA, 16 nt, Mycobacterium bovis subsp bovis AF2122/97
cgcccacuccagcagc

SEQ ID NO: 3052360 - RNA, 15 nt, Mycobacterium bovis subsp bovis AF2122/97
cgcccagaccgccga

SEQ ID NO: 3052361 - RNA, 16 nt, Mycobacterium bovis subsp bovis AF2122/97
cgcccagaccgccgac

SEQ ID NO: 3052362 - RNA, 16 nt, Mycobacterium bovis subsp bovis AF2122/97
cgcccagagccgcugc

SEQ ID NO: 3052363 - RNA, 23 nt, Mycobacterium bovis subsp bovis AF2122/97
cgcccagagccgcugcggcaccg

SEQ ID NO: 3052364 - RNA, 23 nt, Mycobacterium bovis subsp bovis AF2122/97
cgcccagagugaauccggcauac

SEQ ID NO: 3052365 - RNA, 14 nt, Mycobacterium bovis subsp bovis AF2122/97
cgcccagaucgccg

SEQ ID NO: 3052366 - RNA, 22 nt, Mycobacterium bovis subsp bovis AF2122/97
cgcccagauguuuagcguccga

SEQ ID NO: 3052367 - RNA, 13 nt, Mycobacterium bovis subsp bovis AF2122/97
cgcccagcagcac

SEQ ID NO: 3052368 - RNA, 15 nt, Mycobacterium bovis subsp bovis AF2122/97
cgcccagcagcaccu

SEQ ID NO: 3052369 - RNA, 21 nt, Mycobacterium bovis subsp bovis AF2122/97
cgcccagcagcaccugcaccg

SEQ ID NO: 3052370 - RNA, 19 nt, Mycobacterium bovis subsp bovis AF2122/97
cgcccagcaucucggcggc

SEQ ID NO: 3052371 - RNA, 20 nt, Mycobacterium bovis subsp bovis AF2122/97
cgcccagcaucucggcggcc

SEQ ID NO: 3052372 - RNA, 22 nt, Mycobacterium bovis subsp bovis AF2122/97
cgcccagcaucucggcggccaa

SEQ ID NO: 3052373 - RNA, 14 nt, Mycobacterium bovis subsp bovis AF2122/97
cgcccagccgagcg

SEQ ID NO: 3052374 - RNA, 19 nt, Mycobacterium bovis subsp bovis AF2122/97
cgcccagccguucccggug

SEQ ID NO: 3052375 - RNA, 18 nt, Mycobacterium bovis subsp bovis AF2122/97
cgcccagcgacaacacca

SEQ ID NO: 3052376 - RNA, 16 nt, Mycobacterium bovis subsp bovis AF2122/97
cgcccagcgacccggc

SEQ ID NO: 3052377 - RNA, 18 nt, Mycobacterium bovis subsp bovis AF2122/97
cgcccagcgacccggcca

SEQ ID NO: 3052378 - RNA, 20 nt, Mycobacterium bovis subsp bovis AF2122/97
cgcccagcgacccggccagc

SEQ ID NO: 3052379 - RNA, 15 nt, Mycobacterium bovis subsp bovis AF2122/97
cgcccagcgagcgcc

SEQ ID NO: 3052380 - RNA, 17 nt, Mycobacterium bovis subsp bovis AF2122/97
cgcccagcgagcgccag

SEQ ID NO: 3052381 - RNA, 20 nt, Mycobacterium bovis subsp bovis AF2122/97
cgcccagcgagcgccagguc

SEQ ID NO: 3052382 - RNA, 15 nt, Mycobacterium bovis subsp bovis AF2122/97
cgcccagcgaggugg

SEQ ID NO: 3052383 - RNA, 14 nt, Mycobacterium bovis subsp bovis AF2122/97
cgcccagcgcccgc

SEQ ID NO: 3052384 - RNA, 16 nt, Mycobacterium bovis subsp bovis AF2122/97
cgcccagcgcuagccg

SEQ ID NO: 3052385 - RNA, 18 nt, Mycobacterium bovis subsp bovis AF2122/97
cgcccagcgcuagccggg

SEQ ID NO: 3052386 - RNA, 20 nt, Mycobacterium bovis subsp bovis AF2122/97
cgcccagcguugucgggugg

SEQ ID NO: 3052387 - RNA, 16 nt, Mycobacterium bovis subsp bovis AF2122/97
cgcccagcucgauacc

SEQ ID NO: 3052388 - RNA, 16 nt, Mycobacterium bovis subsp bovis AF2122/97
cgcccaggaagccgag

SEQ ID NO: 3052389 - RNA, 17 nt, Mycobacterium bovis subsp bovis AF2122/97
cgcccaggaagccgaga

SEQ ID NO: 3052390 - RNA, 20 nt, Mycobacterium bovis subsp bovis AF2122/97
cgcccaggaagccgagacca

SEQ ID NO: 3052391 - RNA, 17 nt, Mycobacterium bovis subsp bovis AF2122/97
cgcccaggagcaccucg

SEQ ID NO: 3052392 - RNA, 19 nt, Mycobacterium bovis subsp bovis AF2122/97
cgcccaggcauggccuggg

SEQ ID NO: 3052393 - RNA, 17 nt, Mycobacterium bovis subsp bovis AF2122/97
cgcccaggccgaucagc

SEQ ID NO: 3052394 - RNA, 14 nt, Mycobacterium bovis subsp bovis AF2122/97
cgcccaggcgaccg

SEQ ID NO: 3052395 - RNA, 22 nt, Mycobacterium bovis subsp bovis AF2122/97
cgcccgacgagauugccgggcc

SEQ ID NO: 3052396 - RNA, 23 nt, Mycobacterium bovis subsp bovis AF2122/97
cgcccgacgaugugcacggugug

SEQ ID NO: 3052397 - RNA, 16 nt, Mycobacterium bovis subsp bovis AF2122/97
cgcccgacgccagcug

SEQ ID NO: 3052398 - RNA, 20 nt, Mycobacterium bovis subsp bovis AF2122/97
cgcccgacggaguucgacgu

SEQ ID NO: 3052399 - RNA, 19 nt, Mycobacterium bovis subsp bovis AF2122/97
cgcccgacgugaagccaag

SEQ ID NO: 3052400 - RNA, 16 nt, Mycobacterium bovis subsp bovis AF2122/97
cgcccgagccgcugcg

SEQ ID NO: 3052401 - RNA, 15 nt, Mycobacterium bovis subsp bovis AF2122/97
cgcccgagccggugc

SEQ ID NO: 3052402 - RNA, 21 nt, Mycobacterium bovis subsp bovis AF2122/97
cgcccgagccggugccacugc

SEQ ID NO: 3052403 - RNA, 19 nt, Mycobacterium bovis subsp bovis AF2122/97
cgcccgaggcgagacgcuc

SEQ ID NO: 3052404 - RNA, 21 nt, Mycobacterium bovis subsp bovis AF2122/97
cgcccgagucgugcguugccg

SEQ ID NO: 3052405 - RNA, 19 nt, Mycobacterium bovis subsp bovis AF2122/97
cgcccgagucucgucgggu

SEQ ID NO: 3052406 - RNA, 19 nt, Mycobacterium bovis subsp bovis AF2122/97
cgcccgaguuaaacgcagc

SEQ ID NO: 3052407 - RNA, 21 nt, Mycobacterium bovis subsp bovis AF2122/97
cgcccgaguuaaacgcagcgg

SEQ ID NO: 3052408 - RNA, 13 nt, Mycobacterium bovis subsp bovis AF2122/97
cgcccgaguugaa

SEQ ID NO: 3052409 - RNA, 20 nt, Mycobacterium bovis subsp bovis AF2122/97
cgcccgaguuguggacgccc

SEQ ID NO: 3052410 - RNA, 15 nt, Mycobacterium bovis subsp bovis AF2122/97
cgcccgauacgccac

SEQ ID NO: 3052411 - RNA, 20 nt, Mycobacterium bovis subsp bovis AF2122/97
cgcccgauacgccaccggca

SEQ ID NO: 3052412 - RNA, 13 nt, Mycobacterium bovis subsp bovis AF2122/97
cgcccgaucggcg

SEQ ID NO: 3052413 - RNA, 14 nt, Mycobacterium bovis subsp bovis AF2122/97
cgcccgaucggcgg

SEQ ID NO: 3052414 - RNA, 15 nt, Mycobacterium bovis subsp bovis AF2122/97
cgcccgaucggcgga

SEQ ID NO: 3052415 - RNA, 18 nt, Mycobacterium bovis subsp bovis AF2122/97
cgcccgaucggcggaucg

SEQ ID NO: 3052416 - RNA, 16 nt, Mycobacterium bovis subsp bovis AF2122/97
cgcccgaugcgccagc

SEQ ID NO: 3052417 - RNA, 17 nt, Mycobacterium bovis subsp bovis AF2122/97
cgcccgaugcgccagcg

SEQ ID NO: 3052418 - RNA, 20 nt, Mycobacterium bovis subsp bovis AF2122/97
cgcccgcaagucggacgggu

SEQ ID NO: 3052419 - RNA, 22 nt, Mycobacterium bovis subsp bovis AF2122/97
cgcccgcaagucggacgggucu

SEQ ID NO: 3052420 - RNA, 20 nt, Mycobacterium bovis subsp bovis AF2122/97
cgcccgcaauuguucgcggc

SEQ ID NO: 3052421 - RNA, 13 nt, Mycobacterium bovis subsp bovis AF2122/97
cgcccgcaccacc

SEQ ID NO: 3052422 - RNA, 14 nt, Mycobacterium bovis subsp bovis AF2122/97
cgcccgcaccaccg

SEQ ID NO: 3052423 - RNA, 16 nt, Mycobacterium bovis subsp bovis AF2122/97
cgcccgcaccaccggc

SEQ ID NO: 3052424 - RNA, 17 nt, Mycobacterium bovis subsp bovis AF2122/97
cgcccgcaccaccggcc

SEQ ID NO: 3052425 - RNA, 14 nt, Mycobacterium bovis subsp bovis AF2122/97
cgcccgcaccagcu

SEQ ID NO: 3052426 - RNA, 19 nt, Mycobacterium bovis subsp bovis AF2122/97
cgcccgcaccagcugucgg

SEQ ID NO: 3052427 - RNA, 15 nt, Mycobacterium bovis subsp bovis AF2122/97
cgcccgcacccauga

SEQ ID NO: 3052428 - RNA, 16 nt, Mycobacterium bovis subsp bovis AF2122/97
cgcccgcacccaugau

SEQ ID NO: 3052429 - RNA, 20 nt, Mycobacterium bovis subsp bovis AF2122/97
cgcccgcacguucacgcgcg

SEQ ID NO: 3052430 - RNA, 23 nt, Mycobacterium bovis subsp bovis AF2122/97
cgcccgcaggacgcugccggugu

SEQ ID NO: 3052431 - RNA, 17 nt, Mycobacterium bovis subsp bovis AF2122/97
cgcccgcagggccgccg

SEQ ID NO: 3052432 - RNA, 22 nt, Mycobacterium bovis subsp bovis AF2122/97
cgcccgcagguggcuguucacc

SEQ ID NO: 3052433 - RNA, 23 nt, Mycobacterium bovis subsp bovis AF2122/97
cgcccgcauugaucucgaccggc

SEQ ID NO: 3052434 - RNA, 12 nt, Mycobacterium bovis subsp bovis AF2122/97
cgcccgccaccg

SEQ ID NO: 3052435 - RNA, 13 nt, Mycobacterium bovis subsp bovis AF2122/97
cgcccgccaccgg

SEQ ID NO: 3052436 - RNA, 14 nt, Mycobacterium bovis subsp bovis AF2122/97
cgcccgccaccggg

SEQ ID NO: 3052437 - RNA, 16 nt, Mycobacterium bovis subsp bovis AF2122/97
cgcccgccaucagccc

SEQ ID NO: 3052438 - RNA, 18 nt, Mycobacterium bovis subsp bovis AF2122/97
cgcccgccaucagcccgg

SEQ ID NO: 3052439 - RNA, 18 nt, Mycobacterium bovis subsp bovis AF2122/97
cgcccgcccaccucgauc

SEQ ID NO: 3052440 - RNA, 14 nt, Mycobacterium bovis subsp bovis AF2122/97
cgcccgccccgcgc

SEQ ID NO: 3052441 - RNA, 15 nt, Mycobacterium bovis subsp bovis AF2122/97
cgcccgccccgcgcc

SEQ ID NO: 3052442 - RNA, 14 nt, Mycobacterium bovis subsp bovis AF2122/97
cgcccgcccgcacg

SEQ ID NO: 3052443 - RNA, 13 nt, Mycobacterium bovis subsp bovis AF2122/97
cgcccgccgccac

SEQ ID NO: 3052444 - RNA, 13 nt, Mycobacterium bovis subsp bovis AF2122/97
cgcccgccggcaa

SEQ ID NO: 3052445 - RNA, 14 nt, Mycobacterium bovis subsp bovis AF2122/97
cgcccgccggcaac

SEQ ID NO: 3052446 - RNA, 14 nt, Mycobacterium bovis subsp bovis AF2122/97
cgcccgccucgacc

SEQ ID NO: 3052447 - RNA, 17 nt, Mycobacterium bovis subsp bovis AF2122/97
cgcccgccucgaccgcc

SEQ ID NO: 3052448 - RNA, 19 nt, Mycobacterium bovis subsp bovis AF2122/97
cgcccgccucgaccgccag

SEQ ID NO: 3052449 - RNA, 20 nt, Mycobacterium bovis subsp bovis AF2122/97
cgcccgccucgaccgccagc

SEQ ID NO: 3052450 - RNA, 21 nt, Mycobacterium bovis subsp bovis AF2122/97
cgcccgccuucauuacccguu

SEQ ID NO: 3052451 - RNA, 13 nt, Mycobacterium bovis subsp bovis AF2122/97
cgcccgcgagcug

SEQ ID NO: 3052452 - RNA, 22 nt, Mycobacterium bovis subsp bovis AF2122/97
cgcccgcgagcuguaggucagc

SEQ ID NO: 3052453 - RNA, 13 nt, Mycobacterium bovis subsp bovis AF2122/97
cgcccgcgccacc

SEQ ID NO: 3052454 - RNA, 16 nt, Mycobacterium bovis subsp bovis AF2122/97
cgcccgcgccaccagc

SEQ ID NO: 3052455 - RNA, 15 nt, Mycobacterium bovis subsp bovis AF2122/97
cgcccgcgccaccga

SEQ ID NO: 3052456 - RNA, 15 nt, Mycobacterium bovis subsp bovis AF2122/97
cgcccgcgccaccgg

SEQ ID NO: 3052457 - RNA, 16 nt, Mycobacterium bovis subsp bovis AF2122/97
cgcccgcgccaccggc

SEQ ID NO: 3052458 - RNA, 22 nt, Mycobacterium bovis subsp bovis AF2122/97
cgcccgcgccaccggcaccgcc

SEQ ID NO: 3052459 - RNA, 15 nt, Mycobacterium bovis subsp bovis AF2122/97
cgcccgcgcccccgg

SEQ ID NO: 3052460 - RNA, 19 nt, Mycobacterium bovis subsp bovis AF2122/97
cgcccgcgcccccggugcc

SEQ ID NO: 3052461 - RNA, 12 nt, Mycobacterium bovis subsp bovis AF2122/97
cgcccgcgccgc

SEQ ID NO: 3052462 - RNA, 13 nt, Mycobacterium bovis subsp bovis AF2122/97
cgcccgcgccgcc

SEQ ID NO: 3052463 - RNA, 19 nt, Mycobacterium bovis subsp bovis AF2122/97
cgcccgcgccgccgccacc

SEQ ID NO: 3052464 - RNA, 15 nt, Mycobacterium bovis subsp bovis AF2122/97
cgcccgcgccgccgg

SEQ ID NO: 3052465 - RNA, 14 nt, Mycobacterium bovis subsp bovis AF2122/97
cgcccgcgcggcca

SEQ ID NO: 3052466 - RNA, 15 nt, Mycobacterium bovis subsp bovis AF2122/97
cgcccgcgcgguggc

SEQ ID NO: 3052467 - RNA, 12 nt, Mycobacterium bovis subsp bovis AF2122/97
cgcccgcgcuga

SEQ ID NO: 3052468 - RNA, 18 nt, Mycobacterium bovis subsp bovis AF2122/97
cgcccgcgcugccgacuc

SEQ ID NO: 3052469 - RNA, 14 nt, Mycobacterium bovis subsp bovis AF2122/97
cgcccgcggccgcc

SEQ ID NO: 3052470 - RNA, 17 nt, Mycobacterium bovis subsp bovis AF2122/97
cgcccgcggccgccagc

SEQ ID NO: 3052471 - RNA, 14 nt, Mycobacterium bovis subsp bovis AF2122/97
cgcccgcgugacgc

SEQ ID NO: 3052472 - RNA, 15 nt, Mycobacterium bovis subsp bovis AF2122/97
cgcccgcgugacgcu

SEQ ID NO: 3052473 - RNA, 23 nt, Mycobacterium bovis subsp bovis AF2122/97
cgcccgcgugacgcuuggccaau

SEQ ID NO: 3052474 - RNA, 22 nt, Mycobacterium bovis subsp bovis AF2122/97
cgcccgcuaacuggcccggaca

SEQ ID NO: 3052475 - RNA, 20 nt, Mycobacterium bovis subsp bovis AF2122/97
cgcccgcuacggcagcccgu

SEQ ID NO: 3052476 - RNA, 14 nt, Mycobacterium bovis subsp bovis AF2122/97
cgcccgcuccaaca

SEQ ID NO: 3052477 - RNA, 15 nt, Mycobacterium bovis subsp bovis AF2122/97
cgcccgcuccaacac

SEQ ID NO: 3052478 - RNA, 23 nt, Mycobacterium bovis subsp bovis AF2122/97
cgcccgcuccaacacccgccggu

SEQ ID NO: 3052479 - RNA, 18 nt, Mycobacterium bovis subsp bovis AF2122/97
cgcccgcuccgccgucgc

SEQ ID NO: 3052480 - RNA, 18 nt, Mycobacterium bovis subsp bovis AF2122/97
cgcccgcuccuccggcac

SEQ ID NO: 3052481 - RNA, 17 nt, Mycobacterium bovis subsp bovis AF2122/97
cgcccgcucggccgcag

SEQ ID NO: 3052482 - RNA, 19 nt, Mycobacterium bovis subsp bovis AF2122/97
cgcccucaguucacguucg

SEQ ID NO: 3052483 - RNA, 21 nt, Mycobacterium bovis subsp bovis AF2122/97
cgcccucaguucacguucggc

SEQ ID NO: 3052484 - RNA, 18 nt, Mycobacterium bovis subsp bovis AF2122/97
cgcccucauaggccugca

SEQ ID NO: 3052485 - RNA, 16 nt, Mycobacterium bovis subsp bovis AF2122/97
cgcccucaugucgggc

SEQ ID NO: 3052486 - RNA, 15 nt, Mycobacterium bovis subsp bovis AF2122/97
cgcccucccuggggc

SEQ ID NO: 3052487 - RNA, 16 nt, Mycobacterium bovis subsp bovis AF2122/97
cgcccucccuggggcc

SEQ ID NO: 3052488 - RNA, 17 nt, Mycobacterium bovis subsp bovis AF2122/97
cgcccuccuggcgggug

SEQ ID NO: 3052489 - RNA, 16 nt, Mycobacterium bovis subsp bovis AF2122/97
cgcccucgacgccgcg

SEQ ID NO: 3052490 - RNA, 18 nt, Mycobacterium bovis subsp bovis AF2122/97
cgcccucgacgccgcgca

SEQ ID NO: 3052491 - RNA, 16 nt, Mycobacterium bovis subsp bovis AF2122/97
cgcccucgaucgccac

SEQ ID NO: 3052492 - RNA, 18 nt, Mycobacterium bovis subsp bovis AF2122/97
cgcccucgaucgccacga

SEQ ID NO: 3052493 - RNA, 20 nt, Mycobacterium bovis subsp bovis AF2122/97
cgcccucggcgaccuggcuc

SEQ ID NO: 3052494 - RNA, 19 nt, Mycobacterium bovis subsp bovis AF2122/97
cgcccugaagggccgccuc

SEQ ID NO: 3052495 - RNA, 20 nt, Mycobacterium bovis subsp bovis AF2122/97
cgcccugaagggccgccucg

SEQ ID NO: 3052496 - RNA, 21 nt, Mycobacterium bovis subsp bovis AF2122/97
cgcccugaagggccgccucgc

SEQ ID NO: 3052497 - RNA, 21 nt, Mycobacterium bovis subsp bovis AF2122/97
cgcccugacacaacaccggcg

SEQ ID NO: 3052498 - RNA, 23 nt, Mycobacterium bovis subsp bovis AF2122/97
cgcccugacacaacaccggcgug

SEQ ID NO: 3052499 - RNA, 14 nt, Mycobacterium bovis subsp bovis AF2122/97
cgcccugagaacac

SEQ ID NO: 3052500 - RNA, 20 nt, Mycobacterium bovis subsp bovis AF2122/97
cgcccugagaacacguucgg

SEQ ID NO: 3052501 - RNA, 21 nt, Mycobacterium bovis subsp bovis AF2122/97
cgcccugcagacggguggccc

SEQ ID NO: 3052502 - RNA, 15 nt, Mycobacterium bovis subsp bovis AF2122/97
cgcccugccauggga

SEQ ID NO: 3052503 - RNA, 15 nt, Mycobacterium bovis subsp bovis AF2122/97
cgcccuggacgucgg

SEQ ID NO: 3052504 - RNA, 14 nt, Mycobacterium bovis subsp bovis AF2122/97
cgcccuggcaacga

SEQ ID NO: 3052505 - RNA, 13 nt, Mycobacterium bovis subsp bovis AF2122/97
cgcccuggccgcc

SEQ ID NO: 3052506 - RNA, 14 nt, Mycobacterium bovis subsp bovis AF2122/97
cgcccuggccgccc

SEQ ID NO: 3052507 - RNA, 22 nt, Mycobacterium bovis subsp bovis AF2122/97
cgcccuggccgcccagaccgcc

SEQ ID NO: 3052508 - RNA, 17 nt, Mycobacterium bovis subsp bovis AF2122/97
cgcccuggccgccggcc

SEQ ID NO: 3052509 - RNA, 20 nt, Mycobacterium bovis subsp bovis AF2122/97
cgcccuggccgccggccccg

SEQ ID NO: 3052510 - RNA, 21 nt, Mycobacterium bovis subsp bovis AF2122/97
cgcccuggccgccggccccgc

SEQ ID NO: 3052511 - RNA, 15 nt, Mycobacterium bovis subsp bovis AF2122/97
cgcccugggcgccgg

SEQ ID NO: 3052512 - RNA, 16 nt, Mycobacterium bovis subsp bovis AF2122/97
cgcccugggcgccggc

SEQ ID NO: 3052513 - RNA, 17 nt, Mycobacterium bovis subsp bovis AF2122/97
cgcccugggcgccggcg

SEQ ID NO: 3052514 - RNA, 16 nt, Mycobacterium bovis subsp bovis AF2122/97
cgcccugguccaggcc

SEQ ID NO: 3052515 - RNA, 23 nt, Mycobacterium bovis subsp bovis AF2122/97
cgcccuggugucgaucguugccg

SEQ ID NO: 3052516 - RNA, 13 nt, Mycobacterium bovis subsp bovis AF2122/97
cgcccuguucggc

SEQ ID NO: 3052517 - RNA, 20 nt, Mycobacterium bovis subsp bovis AF2122/97
cgcccuguucuccgugaucg

SEQ ID NO: 3052518 - RNA, 17 nt, Mycobacterium bovis subsp bovis AF2122/97
cgcccuuaagccggcgc

SEQ ID NO: 3052519 - RNA, 23 nt, Mycobacterium bovis subsp bovis AF2122/97
cgcccuuaagccggcgcggcggc

SEQ ID NO: 3052520 - RNA, 16 nt, Mycobacterium bovis subsp bovis AF2122/97
cgcccuugagccgccg

SEQ ID NO: 3052521 - RNA, 14 nt, Mycobacterium bovis subsp bovis AF2122/97
cgcccuugaucagc

SEQ ID NO: 3052522 - RNA, 15 nt, Mycobacterium bovis subsp bovis AF2122/97
cgcccuugccgccag

SEQ ID NO: 3052523 - RNA, 17 nt, Mycobacterium bovis subsp bovis AF2122/97
cgcccuugccgccagcc

SEQ ID NO: 3052524 - RNA, 22 nt, Mycobacterium bovis subsp bovis AF2122/97
cgcccuugccgccagccccagc

SEQ ID NO: 3052525 - RNA, 15 nt, Mycobacterium bovis subsp bovis AF2122/97
cgcccuugccgcccg

SEQ ID NO: 3052526 - RNA, 16 nt, Mycobacterium bovis subsp bovis AF2122/97
cgcccuugccgcccgc

SEQ ID NO: 3052527 - RNA, 17 nt, Mycobacterium bovis subsp bovis AF2122/97
cgcccuugccgccggcc

SEQ ID NO: 3052528 - RNA, 18 nt, Mycobacterium bovis subsp bovis AF2122/97
cgcccuugccgccggccc

SEQ ID NO: 3052529 - RNA, 15 nt, Mycobacterium bovis subsp bovis AF2122/97
cgcccuugccggcga

SEQ ID NO: 3052530 - RNA, 13 nt, Mycobacterium bovis subsp bovis AF2122/97
cgcccuugugaac

SEQ ID NO: 3052531 - RNA, 20 nt, Mycobacterium bovis subsp bovis AF2122/97
cgccgaaaagggcgacagcg

SEQ ID NO: 3052532 - RNA, 18 nt, Mycobacterium bovis subsp bovis AF2122/97
cgccgaaaaggucgggga

SEQ ID NO: 3052533 - RNA, 18 nt, Mycobacterium bovis subsp bovis AF2122/97
cgccgaaaaugccgccca

SEQ ID NO: 3052534 - RNA, 16 nt, Mycobacterium bovis subsp bovis AF2122/97
cgccgaaacagcaccc

SEQ ID NO: 3052535 - RNA, 22 nt, Mycobacterium bovis subsp bovis AF2122/97
cgccgaaaccacuuccggcgug

SEQ ID NO: 3052536 - RNA, 22 nt, Mycobacterium bovis subsp bovis AF2122/97
cgccgaaaccgggacaaucucg

SEQ ID NO: 3052537 - RNA, 23 nt, Mycobacterium bovis subsp bovis AF2122/97
cgccgaaaccgggacaaucucgg

SEQ ID NO: 3052538 - RNA, 22 nt, Mycobacterium bovis subsp bovis AF2122/97
cgccgaaacucaagccacgucg

SEQ ID NO: 3052539 - RNA, 17 nt, Mycobacterium bovis subsp bovis AF2122/97
cgccgaaacucaccagc

SEQ ID NO: 3052540 - RNA, 18 nt, Mycobacterium bovis subsp bovis AF2122/97
cgccgaaacucaccagca

SEQ ID NO: 3052541 - RNA, 21 nt, Mycobacterium bovis subsp bovis AF2122/97
cgccgaaacucaccagcaccc

SEQ ID NO: 3052542 - RNA, 14 nt, Mycobacterium bovis subsp bovis AF2122/97
cgccgaaagccuug

SEQ ID NO: 3052543 - RNA, 17 nt, Mycobacterium bovis subsp bovis AF2122/97
cgccgaaagggucgacg

SEQ ID NO: 3052544 - RNA, 18 nt, Mycobacterium bovis subsp bovis AF2122/97
cgccgaaagggucgacgu

SEQ ID NO: 3052545 - RNA, 22 nt, Mycobacterium bovis subsp bovis AF2122/97
cgccgaaaucaguugcgcucca

SEQ ID NO: 3052546 - RNA, 15 nt, Mycobacterium bovis subsp bovis AF2122/97
cgccgaaaucggcca

SEQ ID NO: 3052547 - RNA, 16 nt, Mycobacterium bovis subsp bovis AF2122/97
cgccgaaaucggccag

SEQ ID NO: 3052548 - RNA, 18 nt, Mycobacterium bovis subsp bovis AF2122/97
cgccgaaaucggccagcu

SEQ ID NO: 3052549 - RNA, 16 nt, Mycobacterium bovis subsp bovis AF2122/97
cgccgaacaccacacc

SEQ ID NO: 3052550 - RNA, 13 nt, Mycobacterium bovis subsp bovis AF2122/97
cgccgaacaccga

SEQ ID NO: 3052551 - RNA, 17 nt, Mycobacterium bovis subsp bovis AF2122/97
cgccgaacaccgccgcg

SEQ ID NO: 3052552 - RNA, 20 nt, Mycobacterium bovis subsp bovis AF2122/97
cgccgaacaccgccgcgucg

SEQ ID NO: 3052553 - RNA, 23 nt, Mycobacterium bovis subsp bovis AF2122/97
cgccgaacaccggcuccagcaug

SEQ ID NO: 3052554 - RNA, 17 nt, Mycobacterium bovis subsp bovis AF2122/97
cgccgaacaccucggca

SEQ ID NO: 3052555 - RNA, 19 nt, Mycobacterium bovis subsp bovis AF2122/97
cgccgaacaccucggcacg

SEQ ID NO: 3052556 - RNA, 16 nt, Mycobacterium bovis subsp bovis AF2122/97
cgccgaacagcgacgc

SEQ ID NO: 3052557 - RNA, 15 nt, Mycobacterium bovis subsp bovis AF2122/97
cgccgaacagugcgg

SEQ ID NO: 3052558 - RNA, 20 nt, Mycobacterium bovis subsp bovis AF2122/97
cgccgaacagugcggucccg

SEQ ID NO: 3052559 - RNA, 17 nt, Mycobacterium bovis subsp bovis AF2122/97
cgccgaaccaguaauac

SEQ ID NO: 3052560 - RNA, 18 nt, Mycobacterium bovis subsp bovis AF2122/97
cgccgaacccgguguuga

SEQ ID NO: 3052561 - RNA, 15 nt, Mycobacterium bovis subsp bovis AF2122/97
cgccgaacgccacca

SEQ ID NO: 3052562 - RNA, 16 nt, Mycobacterium bovis subsp bovis AF2122/97
cgccgaacgccaccac

SEQ ID NO: 3052563 - RNA, 16 nt, Mycobacterium bovis subsp bovis AF2122/97
cgccgaacgccagcag

SEQ ID NO: 3052564 - RNA, 17 nt, Mycobacterium bovis subsp bovis AF2122/97
cgccgaacgccagcagc

SEQ ID NO: 3052565 - RNA, 13 nt, Mycobacterium bovis subsp bovis AF2122/97
cgccgaacgcucc

SEQ ID NO: 3052566 - RNA, 18 nt, Mycobacterium bovis subsp bovis AF2122/97
cgccgaacgcuccaggcc

SEQ ID NO: 3052567 - RNA, 22 nt, Mycobacterium bovis subsp bovis AF2122/97
cgccgaacgugaacucacggcg

SEQ ID NO: 3052568 - RNA, 14 nt, Mycobacterium bovis subsp bovis AF2122/97
cgccgacgccagaa

SEQ ID NO: 3052569 - RNA, 17 nt, Mycobacterium bovis subsp bovis AF2122/97
cgccgacgccagaacgu

SEQ ID NO: 3052570 - RNA, 14 nt, Mycobacterium bovis subsp bovis AF2122/97
cgccgacgccgccg

SEQ ID NO: 3052571 - RNA, 16 nt, Mycobacterium bovis subsp bovis AF2122/97
cgccgacgccgccggc

SEQ ID NO: 3052572 - RNA, 17 nt, Mycobacterium bovis subsp bovis AF2122/97
cgccgacgccgccggca

SEQ ID NO: 3052573 - RNA, 21 nt, Mycobacterium bovis subsp bovis AF2122/97
cgccgacgccgccggccccgc

SEQ ID NO: 3052574 - RNA, 13 nt, Mycobacterium bovis subsp bovis AF2122/97
cgccgacgccguu

SEQ ID NO: 3052575 - RNA, 17 nt, Mycobacterium bovis subsp bovis AF2122/97
cgccgacgccguugccc

SEQ ID NO: 3052576 - RNA, 14 nt, Mycobacterium bovis subsp bovis AF2122/97
cgccgacggcaagg

SEQ ID NO: 3052577 - RNA, 14 nt, Mycobacterium bovis subsp bovis AF2122/97
cgccgacggcaccg

SEQ ID NO: 3052578 - RNA, 15 nt, Mycobacterium bovis subsp bovis AF2122/97
cgccgacggccagca

SEQ ID NO: 3052579 - RNA, 18 nt, Mycobacterium bovis subsp bovis AF2122/97
cgccgacggcgaccaccg

SEQ ID NO: 3052580 - RNA, 16 nt, Mycobacterium bovis subsp bovis AF2122/97
cgccgacggcgccccg

SEQ ID NO: 3052581 - RNA, 21 nt, Mycobacterium bovis subsp bovis AF2122/97
cgccgacguauagaccaggua

SEQ ID NO: 3052582 - RNA, 14 nt, Mycobacterium bovis subsp bovis AF2122/97
cgccgacgucgacg

SEQ ID NO: 3052583 - RNA, 24 nt, Mycobacterium bovis subsp bovis AF2122/97
cgccgacgucgacgccggccagcg

SEQ ID NO: 3052584 - RNA, 15 nt, Mycobacterium bovis subsp bovis AF2122/97
cgccgacuccaguuc

SEQ ID NO: 3052585 - RNA, 16 nt, Mycobacterium bovis subsp bovis AF2122/97
cgccgacuccgcguag

SEQ ID NO: 3052586 - RNA, 19 nt, Mycobacterium bovis subsp bovis AF2122/97
cgccgacucggcaccgcgg

SEQ ID NO: 3052587 - RNA, 22 nt, Mycobacterium bovis subsp bovis AF2122/97
cgccgacucggcaccgcggccg

SEQ ID NO: 3052588 - RNA, 23 nt, Mycobacterium bovis subsp bovis AF2122/97
cgccgacucggcaccgcggccgc

SEQ ID NO: 3052589 - RNA, 16 nt, Mycobacterium bovis subsp bovis AF2122/97
cgccgacuuccgcguc

SEQ ID NO: 3052590 - RNA, 22 nt, Mycobacterium bovis subsp bovis AF2122/97
cgccgacuugauuucgaucgcg

SEQ ID NO: 3052591 - RNA, 17 nt, Mycobacterium bovis subsp bovis AF2122/97
cgccgacuuugucgcgg

SEQ ID NO: 3052592 - RNA, 16 nt, Mycobacterium bovis subsp bovis AF2122/97
cgccgagaacgauguc

SEQ ID NO: 3052593 - RNA, 23 nt, Mycobacterium bovis subsp bovis AF2122/97
cgccgagaacgauguccgcgcga

SEQ ID NO: 3052594 - RNA, 13 nt, Mycobacterium bovis subsp bovis AF2122/97
cgccgagaccgcc

SEQ ID NO: 3052595 - RNA, 14 nt, Mycobacterium bovis subsp bovis AF2122/97
cgccgagaccgccg

SEQ ID NO: 3052596 - RNA, 15 nt, Mycobacterium bovis subsp bovis AF2122/97
cgccgagaccgccgc

SEQ ID NO: 3052597 - RNA, 16 nt, Mycobacterium bovis subsp bovis AF2122/97
cgccgagaccgccgcu

SEQ ID NO: 3052598 - RNA, 23 nt, Mycobacterium bovis subsp bovis AF2122/97
cgccgagaccgccgcugccgccg

SEQ ID NO: 3052599 - RNA, 12 nt, Mycobacterium bovis subsp bovis AF2122/97
cgccgagaccgg

SEQ ID NO: 3052600 - RNA, 16 nt, Mycobacterium bovis subsp bovis AF2122/97
cgccgagagcaccgcu

SEQ ID NO: 3052601 - RNA, 20 nt, Mycobacterium bovis subsp bovis AF2122/97
cgccgagagcaccgcucggu

SEQ ID NO: 3052602 - RNA, 21 nt, Mycobacterium bovis subsp bovis AF2122/97
cgccgagagcaccgcucgguc

SEQ ID NO: 3052603 - RNA, 14 nt, Mycobacterium bovis subsp bovis AF2122/97
cgccgagauccgcg

SEQ ID NO: 3052604 - RNA, 15 nt, Mycobacterium bovis subsp bovis AF2122/97
cgccgagaucgacau

SEQ ID NO: 3052605 - RNA, 19 nt, Mycobacterium bovis subsp bovis AF2122/97
cgccgagaugaugcugccg

SEQ ID NO: 3052606 - RNA, 22 nt, Mycobacterium bovis subsp bovis AF2122/97
cgccgagaugaugcugccggca

SEQ ID NO: 3052607 - RNA, 20 nt, Mycobacterium bovis subsp bovis AF2122/97
cgccgagaugcugcacccgg

SEQ ID NO: 3052608 - RNA, 16 nt, Mycobacterium bovis subsp bovis AF2122/97
cgccgagaugcugguc

SEQ ID NO: 3052609 - RNA, 20 nt, Mycobacterium bovis subsp bovis AF2122/97
cgccgagaugcuggucggcg

SEQ ID NO: 3052610 - RNA, 23 nt, Mycobacterium bovis subsp bovis AF2122/97
cgccgagaugcuggucggcgaug

SEQ ID NO: 3052611 - RNA, 21 nt, Mycobacterium bovis subsp bovis AF2122/97
cgccgagcaaggggaucugag

SEQ ID NO: 3052612 - RNA, 16 nt, Mycobacterium bovis subsp bovis AF2122/97
cgccgagcacacgucg

SEQ ID NO: 3052613 - RNA, 14 nt, Mycobacterium bovis subsp bovis AF2122/97
cgccgagcaccggg

SEQ ID NO: 3052614 - RNA, 22 nt, Mycobacterium bovis subsp bovis AF2122/97
cgccgagccagcacccgcagcc

SEQ ID NO: 3052615 - RNA, 14 nt, Mycobacterium bovis subsp bovis AF2122/97
cgccgagcccgccg

SEQ ID NO: 3052616 - RNA, 16 nt, Mycobacterium bovis subsp bovis AF2122/97
cgccgagcccgccggg

SEQ ID NO: 3052617 - RNA, 20 nt, Mycobacterium bovis subsp bovis AF2122/97
cgccgagcgccaguucgcgg

SEQ ID NO: 3052618 - RNA, 16 nt, Mycobacterium bovis subsp bovis AF2122/97
cgccgagcgcgccgaa

SEQ ID NO: 3052619 - RNA, 14 nt, Mycobacterium bovis subsp bovis AF2122/97
cgccgagcggacca

SEQ ID NO: 3052620 - RNA, 17 nt, Mycobacterium bovis subsp bovis AF2122/97
cgccgagcggaccaccg

SEQ ID NO: 3052621 - RNA, 14 nt, Mycobacterium bovis subsp bovis AF2122/97
cgccgagcggaucg

SEQ ID NO: 3052622 - RNA, 18 nt, Mycobacterium bovis subsp bovis AF2122/97
cgccgagcggaucgucgu

SEQ ID NO: 3052623 - RNA, 14 nt, Mycobacterium bovis subsp bovis AF2122/97
cgccgagcggugcc

SEQ ID NO: 3052624 - RNA, 16 nt, Mycobacterium bovis subsp bovis AF2122/97
cgccgagcgguugccu

SEQ ID NO: 3052625 - RNA, 21 nt, Mycobacterium bovis subsp bovis AF2122/97
cgccgagcgugaaccuggcga

SEQ ID NO: 3052626 - RNA, 22 nt, Mycobacterium bovis subsp bovis AF2122/97
cgccgagcgugaagucacggcg

SEQ ID NO: 3052627 - RNA, 14 nt, Mycobacterium bovis subsp bovis AF2122/97
cgccgagcuagauc

SEQ ID NO: 3052628 - RNA, 14 nt, Mycobacterium bovis subsp bovis AF2122/97
cgccgagcucggcg

SEQ ID NO: 3052629 - RNA, 16 nt, Mycobacterium bovis subsp bovis AF2122/97
cgccgagcucggcgcc

SEQ ID NO: 3052630 - RNA, 14 nt, Mycobacterium bovis subsp bovis AF2122/97
cgccgagcucgguc

SEQ ID NO: 3052631 - RNA, 16 nt, Mycobacterium bovis subsp bovis AF2122/97
cgccgagcucggucac

SEQ ID NO: 3052632 - RNA, 19 nt, Mycobacterium bovis subsp bovis AF2122/97
cgccgagcucggucaccac

SEQ ID NO: 3052633 - RNA, 21 nt, Mycobacterium bovis subsp bovis AF2122/97
cgccgagcucggucaccacgg

SEQ ID NO: 3052634 - RNA, 22 nt, Mycobacterium bovis subsp bovis AF2122/97
cgccgagcucggucaccacggc

SEQ ID NO: 3052635 - RNA, 23 nt, Mycobacterium bovis subsp bovis AF2122/97
cgccgagcucggucaccacggcg

SEQ ID NO: 3052636 - RNA, 19 nt, Mycobacterium bovis subsp bovis AF2122/97
cgccgagcuggcaacgccg

SEQ ID NO: 3052637 - RNA, 20 nt, Mycobacterium bovis subsp bovis AF2122/97
cgccgagcuggcaacgccgc

SEQ ID NO: 3052638 - RNA, 21 nt, Mycobacterium bovis subsp bovis AF2122/97
cgccgagcuggcaacgccgcg

SEQ ID NO: 3052639 - RNA, 14 nt, Mycobacterium bovis subsp bovis AF2122/97
cgccgagcuggcgc

SEQ ID NO: 3052640 - RNA, 19 nt, Mycobacterium bovis subsp bovis AF2122/97
cgccgagcugguugacggc

SEQ ID NO: 3052641 - RNA, 22 nt, Mycobacterium bovis subsp bovis AF2122/97
cgccgagcugguugacggcgaa

SEQ ID NO: 3052642 - RNA, 15 nt, Mycobacterium bovis subsp bovis AF2122/97
cgccgagcugugcgc

SEQ ID NO: 3052643 - RNA, 22 nt, Mycobacterium bovis subsp bovis AF2122/97
cgccgaggaaaccaccaguggc

SEQ ID NO: 3052644 - RNA, 14 nt, Mycobacterium bovis subsp bovis AF2122/97
cgccgaggacgccg

SEQ ID NO: 3052645 - RNA, 17 nt, Mycobacterium bovis subsp bovis AF2122/97
cgccgaggacgccggcg

SEQ ID NO: 3052646 - RNA, 20 nt, Mycobacterium bovis subsp bovis AF2122/97
cgccgaggacgccggcgccg

SEQ ID NO: 3052647 - RNA, 20 nt, Mycobacterium bovis subsp bovis AF2122/97
cgccgaggcagcgucgucga

SEQ ID NO: 3052648 - RNA, 17 nt, Mycobacterium bovis subsp bovis AF2122/97
cgccgaggcauugcugu

SEQ ID NO: 3052649 - RNA, 13 nt, Mycobacterium bovis subsp bovis AF2122/97
cgccgaggccgcc

SEQ ID NO: 3052650 - RNA, 19 nt, Mycobacterium bovis subsp bovis AF2122/97
cgccgaggccuaccaggcg

SEQ ID NO: 3052651 - RNA, 22 nt, Mycobacterium bovis subsp bovis AF2122/97
cgccgaggccuaccaggcgcgg

SEQ ID NO: 3052652 - RNA, 17 nt, Mycobacterium bovis subsp bovis AF2122/97
cgccgaggccucggcca

SEQ ID NO: 3052653 - RNA, 18 nt, Mycobacterium bovis subsp bovis AF2122/97
cgccgaggccucggccag

SEQ ID NO: 3052654 - RNA, 16 nt, Mycobacterium bovis subsp bovis AF2122/97
cgccgcaaccgccgcg

SEQ ID NO: 3052655 - RNA, 17 nt, Mycobacterium bovis subsp bovis AF2122/97
cgccgcaaccgccgcgu

SEQ ID NO: 3052656 - RNA, 21 nt, Mycobacterium bovis subsp bovis AF2122/97
cgccgcaagugucuccggcaa

SEQ ID NO: 3052657 - RNA, 16 nt, Mycobacterium bovis subsp bovis AF2122/97
cgccgcaaucagacgg

SEQ ID NO: 3052658 - RNA, 23 nt, Mycobacterium bovis subsp bovis AF2122/97
cgccgcaaugacgucgucggcca

SEQ ID NO: 3052659 - RNA, 16 nt, Mycobacterium bovis subsp bovis AF2122/97
cgccgcaauggaccga

SEQ ID NO: 3052660 - RNA, 15 nt, Mycobacterium bovis subsp bovis AF2122/97
cgccgcacacucucg

SEQ ID NO: 3052661 - RNA, 19 nt, Mycobacterium bovis subsp bovis AF2122/97
cgccgcacacucucgguga

SEQ ID NO: 3052662 - RNA, 23 nt, Mycobacterium bovis subsp bovis AF2122/97
cgccgcacauugguguccaccac

SEQ ID NO: 3052663 - RNA, 20 nt, Mycobacterium bovis subsp bovis AF2122/97
cgccgcaccaagcagcgacc

SEQ ID NO: 3052664 - RNA, 23 nt, Mycobacterium bovis subsp bovis AF2122/97
cgccgcaccaagcagcgaccagc

SEQ ID NO: 3052665 - RNA, 23 nt, Mycobacterium bovis subsp bovis AF2122/97
cgccgcacccacauaccggcgca

SEQ ID NO: 3052666 - RNA, 13 nt, Mycobacterium bovis subsp bovis AF2122/97
cgccgcacccggg

SEQ ID NO: 3052667 - RNA, 14 nt, Mycobacterium bovis subsp bovis AF2122/97
cgccgcaccgccgc

SEQ ID NO: 3052668 - RNA, 18 nt, Mycobacterium bovis subsp bovis AF2122/97
cgccgcaccgccgcaucg

SEQ ID NO: 3052669 - RNA, 13 nt, Mycobacterium bovis subsp bovis AF2122/97
cgccgcaccggau

SEQ ID NO: 3052670 - RNA, 15 nt, Mycobacterium bovis subsp bovis AF2122/97
cgccgcaccggauca

SEQ ID NO: 3052671 - RNA, 13 nt, Mycobacterium bovis subsp bovis AF2122/97
cgccgcacgcacu

SEQ ID NO: 3052672 - RNA, 12 nt, Mycobacterium bovis subsp bovis AF2122/97
cgccgcacgccg

SEQ ID NO: 3052673 - RNA, 15 nt, Mycobacterium bovis subsp bovis AF2122/97
cgccgcacgccgacc

SEQ ID NO: 3052674 - RNA, 21 nt, Mycobacterium bovis subsp bovis AF2122/97
cgccgcacgccgaccggcccg

SEQ ID NO: 3052675 - RNA, 15 nt, Mycobacterium bovis subsp bovis AF2122/97
cgccgcacgccggca

SEQ ID NO: 3052676 - RNA, 15 nt, Mycobacterium bovis subsp bovis AF2122/97
cgccgcacggcgacg

SEQ ID NO: 3052677 - RNA, 18 nt, Mycobacterium bovis subsp bovis AF2122/97
cgccgcacggcgacgcca

SEQ ID NO: 3052678 - RNA, 15 nt, Mycobacterium bovis subsp bovis AF2122/97
cgccgcagacgccga

SEQ ID NO: 3052679 - RNA, 17 nt, Mycobacterium bovis subsp bovis AF2122/97
cgccgcagacgccgacu

SEQ ID NO: 3052680 - RNA, 20 nt, Mycobacterium bovis subsp bovis AF2122/97
cgccgcagaucaccgccagc

SEQ ID NO: 3052681 - RNA, 22 nt, Mycobacterium bovis subsp bovis AF2122/97
cgccgcagaucaccgccagcug

SEQ ID NO: 3052682 - RNA, 23 nt, Mycobacterium bovis subsp bovis AF2122/97
cgccgcagaugggccuccaccgc

SEQ ID NO: 3052683 - RNA, 15 nt, Mycobacterium bovis subsp bovis AF2122/97
cgccgcagcaggugc

SEQ ID NO: 3052684 - RNA, 21 nt, Mycobacterium bovis subsp bovis AF2122/97
cgccgcagcaggugcaucgcc

SEQ ID NO: 3052685 - RNA, 20 nt, Mycobacterium bovis subsp bovis AF2122/97
cgccgcagccugcaacgucu

SEQ ID NO: 3052686 - RNA, 15 nt, Mycobacterium bovis subsp bovis AF2122/97
cgccgcagcgcguac

SEQ ID NO: 3052687 - RNA, 19 nt, Mycobacterium bovis subsp bovis AF2122/97
cgccgcagcgcucgcguca

SEQ ID NO: 3052688 - RNA, 16 nt, Mycobacterium bovis subsp bovis AF2122/97
cgccgcagcguccgcg

SEQ ID NO: 3052689 - RNA, 17 nt, Mycobacterium bovis subsp bovis AF2122/97
cgccgcagcuccccgac

SEQ ID NO: 3052690 - RNA, 19 nt, Mycobacterium bovis subsp bovis AF2122/97
cgccgcagcuuguccggug

SEQ ID NO: 3052691 - RNA, 15 nt, Mycobacterium bovis subsp bovis AF2122/97
cgccgcagggccgcg

SEQ ID NO: 3052692 - RNA, 23 nt, Mycobacterium bovis subsp bovis AF2122/97
cgccgcauaccaguaccgucauc

SEQ ID NO: 3052693 - RNA, 13 nt, Mycobacterium bovis subsp bovis AF2122/97
cgccgcaucggcg

SEQ ID NO: 3052694 - RNA, 18 nt, Mycobacterium bovis subsp bovis AF2122/97
cgccgcaucggcgggucu

SEQ ID NO: 3052695 - RNA, 15 nt, Mycobacterium bovis subsp bovis AF2122/97
cgccgcaucggcggu

SEQ ID NO: 3052696 - RNA, 16 nt, Mycobacterium bovis subsp bovis AF2122/97
cgccgcaucggcggug

SEQ ID NO: 3052697 - RNA, 15 nt, Mycobacterium bovis subsp bovis AF2122/97
cgccgcaucgggcgu

SEQ ID NO: 3052698 - RNA, 16 nt, Mycobacterium bovis subsp bovis AF2122/97
cgccgcauugcagaac

SEQ ID NO: 3052699 - RNA, 22 nt, Mycobacterium bovis subsp bovis AF2122/97
cgccgcauugcagaaccgccaa

SEQ ID NO: 3052700 - RNA, 16 nt, Mycobacterium bovis subsp bovis AF2122/97
cgccgccaaagccggg

SEQ ID NO: 3052701 - RNA, 13 nt, Mycobacterium bovis subsp bovis AF2122/97
cgccgccaacucc

SEQ ID NO: 3052702 - RNA, 16 nt, Mycobacterium bovis subsp bovis AF2122/97
cgccgccacagcaccc

SEQ ID NO: 3052703 - RNA, 22 nt, Mycobacterium bovis subsp bovis AF2122/97
cgccgccacagcacccacgccg

SEQ ID NO: 3052704 - RNA, 18 nt, Mycobacterium bovis subsp bovis AF2122/97
cgccgccaccacccaaca

SEQ ID NO: 3052705 - RNA, 14 nt, Mycobacterium bovis subsp bovis AF2122/97
cgccgccaccaccg

SEQ ID NO: 3052706 - RNA, 20 nt, Mycobacterium bovis subsp bovis AF2122/97
cgccgccaccagcgcacgcu

SEQ ID NO: 3052707 - RNA, 14 nt, Mycobacterium bovis subsp bovis AF2122/97
cgccgccaccagcu

SEQ ID NO: 3052708 - RNA, 16 nt, Mycobacterium bovis subsp bovis AF2122/97
cgccgccaccagcugc

SEQ ID NO: 3052709 - RNA, 13 nt, Mycobacterium bovis subsp bovis AF2122/97
cgccgccaccagg

SEQ ID NO: 3052710 - RNA, 15 nt, Mycobacterium bovis subsp bovis AF2122/97
cgccgccaccagggc

SEQ ID NO: 3052711 - RNA, 18 nt, Mycobacterium bovis subsp bovis AF2122/97
cgccgccaccagggcggc

SEQ ID NO: 3052712 - RNA, 13 nt, Mycobacterium bovis subsp bovis AF2122/97
cgccgccaccccg

SEQ ID NO: 3052713 - RNA, 18 nt, Mycobacterium bovis subsp bovis AF2122/97
cgccgccaccccgcgcgc

SEQ ID NO: 3052714 - RNA, 20 nt, Mycobacterium bovis subsp bovis AF2122/97
cgccgccaccccgcgcgcca

SEQ ID NO: 3052715 - RNA, 14 nt, Mycobacterium bovis subsp bovis AF2122/97
cgccgccacccggc

SEQ ID NO: 3052716 - RNA, 16 nt, Mycobacterium bovis subsp bovis AF2122/97
cgccgccacccggcgg

SEQ ID NO: 3052717 - RNA, 13 nt, Mycobacterium bovis subsp bovis AF2122/97
cgccgccaccgaa

SEQ ID NO: 3052718 - RNA, 22 nt, Mycobacterium bovis subsp bovis AF2122/97
cgccgccaccgaagccgccggg

SEQ ID NO: 3052719 - RNA, 18 nt, Mycobacterium bovis subsp bovis AF2122/97
cgccgccaccggcgccgc

SEQ ID NO: 3052720 - RNA, 21 nt, Mycobacterium bovis subsp bovis AF2122/97
cgccgccacggaucgcggcgg

SEQ ID NO: 3052721 - RNA, 17 nt, Mycobacterium bovis subsp bovis AF2122/97
cgccgccacgggugacg

SEQ ID NO: 3052722 - RNA, 14 nt, Mycobacterium bovis subsp bovis AF2122/97
cgccgccacugccg

SEQ ID NO: 3052723 - RNA, 15 nt, Mycobacterium bovis subsp bovis AF2122/97
cgccgccacugccgg

SEQ ID NO: 3052724 - RNA, 16 nt, Mycobacterium bovis subsp bovis AF2122/97
cgccgccacugccggc

SEQ ID NO: 3052725 - RNA, 13 nt, Mycobacterium bovis subsp bovis AF2122/97
cgccgccagcacc

SEQ ID NO: 3052726 - RNA, 15 nt, Mycobacterium bovis subsp bovis AF2122/97
cgccgccagcaccac

SEQ ID NO: 3052727 - RNA, 17 nt, Mycobacterium bovis subsp bovis AF2122/97
cgccgccagcaccaccg

SEQ ID NO: 3052728 - RNA, 19 nt, Mycobacterium bovis subsp bovis AF2122/97
cgccgccagcaccucggcc

SEQ ID NO: 3052729 - RNA, 13 nt, Mycobacterium bovis subsp bovis AF2122/97
cgccgccagcaga

SEQ ID NO: 3052730 - RNA, 12 nt, Mycobacterium bovis subsp bovis AF2122/97
cgccgccagccu

SEQ ID NO: 3052731 - RNA, 13 nt, Mycobacterium bovis subsp bovis AF2122/97
cgccgccagcgcc

SEQ ID NO: 3052732 - RNA, 14 nt, Mycobacterium bovis subsp bovis AF2122/97
cgccgccagcgccg

SEQ ID NO: 3052733 - RNA, 16 nt, Mycobacterium bovis subsp bovis AF2122/97
cgccgccagcgccgcc

SEQ ID NO: 3052734 - RNA, 17 nt, Mycobacterium bovis subsp bovis AF2122/97
cgccgccagcgccgccg

SEQ ID NO: 3052735 - RNA, 18 nt, Mycobacterium bovis subsp bovis AF2122/97
cgccgccagcgccgccgg

SEQ ID NO: 3052736 - RNA, 14 nt, Mycobacterium bovis subsp bovis AF2122/97
cgccgccagcgcgg

SEQ ID NO: 3052737 - RNA, 18 nt, Mycobacterium bovis subsp bovis AF2122/97
cgccgccagcgcgguguc

SEQ ID NO: 3052738 - RNA, 16 nt, Mycobacterium bovis subsp bovis AF2122/97
cgccgccagguccgcc

SEQ ID NO: 3052739 - RNA, 21 nt, Mycobacterium bovis subsp bovis AF2122/97
cgccgccagguccgccggugc

SEQ ID NO: 3052740 - RNA, 22 nt, Mycobacterium bovis subsp bovis AF2122/97
cgccgccagguccgccggugcc

SEQ ID NO: 3052741 - RNA, 15 nt, Mycobacterium bovis subsp bovis AF2122/97
cgccgccggccccgc

SEQ ID NO: 3052742 - RNA, 18 nt, Mycobacterium bovis subsp bovis AF2122/97
cgccgccggccccgccga

SEQ ID NO: 3052743 - RNA, 21 nt, Mycobacterium bovis subsp bovis AF2122/97
cgccgccggccccgccgaugc

SEQ ID NO: 3052744 - RNA, 14 nt, Mycobacterium bovis subsp bovis AF2122/97
cgccgccggccgcc

SEQ ID NO: 3052745 - RNA, 15 nt, Mycobacterium bovis subsp bovis AF2122/97
cgccgccggccgcca

SEQ ID NO: 3052746 - RNA, 17 nt, Mycobacterium bovis subsp bovis AF2122/97
cgccgccggccgccagc

SEQ ID NO: 3052747 - RNA, 12 nt, Mycobacterium bovis subsp bovis AF2122/97
cgccgccggcgc

SEQ ID NO: 3052748 - RNA, 13 nt, Mycobacterium bovis subsp bovis AF2122/97
cgccgccggcgcc

SEQ ID NO: 3052749 - RNA, 14 nt, Mycobacterium bovis subsp bovis AF2122/97
cgccgccggcgcca

SEQ ID NO: 3052750 - RNA, 14 nt, Mycobacterium bovis subsp bovis AF2122/97
cgccgccggcgccc

SEQ ID NO: 3052751 - RNA, 15 nt, Mycobacterium bovis subsp bovis AF2122/97
cgccgccggcgccca

SEQ ID NO: 3052752 - RNA, 19 nt, Mycobacterium bovis subsp bovis AF2122/97
cgccgccggcgcccaggcc

SEQ ID NO: 3052753 - RNA, 19 nt, Mycobacterium bovis subsp bovis AF2122/97
cgccgccggcgccgcccgc

SEQ ID NO: 3052754 - RNA, 18 nt, Mycobacterium bovis subsp bovis AF2122/97
cgccgccggcgccgccgg

SEQ ID NO: 3052755 - RNA, 13 nt, Mycobacterium bovis subsp bovis AF2122/97
cgccgccggcggc

SEQ ID NO: 3052756 - RNA, 14 nt, Mycobacterium bovis subsp bovis AF2122/97
cgccgccggcggcg

SEQ ID NO: 3052757 - RNA, 15 nt, Mycobacterium bovis subsp bovis AF2122/97
cgccgccggcggcgg

SEQ ID NO: 3052758 - RNA, 19 nt, Mycobacterium bovis subsp bovis AF2122/97
cgccgccggcggcgguacc

SEQ ID NO: 3052759 - RNA, 15 nt, Mycobacterium bovis subsp bovis AF2122/97
cgccgccggcggucg

SEQ ID NO: 3052760 - RNA, 18 nt, Mycobacterium bovis subsp bovis AF2122/97
cgccgccggcuccggcgg

SEQ ID NO: 3052761 - RNA, 22 nt, Mycobacterium bovis subsp bovis AF2122/97
cgccgccggcuccggcggugcc

SEQ ID NO: 3052762 - RNA, 17 nt, Mycobacterium bovis subsp bovis AF2122/97
cgccgccggcucgccgg

SEQ ID NO: 3052763 - RNA, 23 nt, Mycobacterium bovis subsp bovis AF2122/97
cgccgccgggauaacccagcacc

SEQ ID NO: 3052764 - RNA, 14 nt, Mycobacterium bovis subsp bovis AF2122/97
cgccgccgggucga

SEQ ID NO: 3052765 - RNA, 16 nt, Mycobacterium bovis subsp bovis AF2122/97
cgccgccgguccccuc

SEQ ID NO: 3052766 - RNA, 12 nt, Mycobacterium bovis subsp bovis AF2122/97
cgccgccggugc

SEQ ID NO: 3052767 - RNA, 14 nt, Mycobacterium bovis subsp bovis AF2122/97
cgccgccggugcca

SEQ ID NO: 3052768 - RNA, 16 nt, Mycobacterium bovis subsp bovis AF2122/97
cgccgccggugccacc

SEQ ID NO: 3052769 - RNA, 18 nt, Mycobacterium bovis subsp bovis AF2122/97
cgccgccggugccaccga

SEQ ID NO: 3052770 - RNA, 19 nt, Mycobacterium bovis subsp bovis AF2122/97
cgccgccggugccaccgac

SEQ ID NO: 3052771 - RNA, 20 nt, Mycobacterium bovis subsp bovis AF2122/97
cgccgccggugccaccgacg

SEQ ID NO: 3052772 - RNA, 18 nt, Mycobacterium bovis subsp bovis AF2122/97
cgccgccggugccaccgg

SEQ ID NO: 3052773 - RNA, 16 nt, Mycobacterium bovis subsp bovis AF2122/97
cgccgccggugccgcc

SEQ ID NO: 3052774 - RNA, 19 nt, Mycobacterium bovis subsp bovis AF2122/97
cgccgccggugccgcccga

SEQ ID NO: 3052775 - RNA, 22 nt, Mycobacterium bovis subsp bovis AF2122/97
cgccgccggugucgggcuguca

SEQ ID NO: 3052776 - RNA, 19 nt, Mycobacterium bovis subsp bovis AF2122/97
cgccgccgucaccgcccuu

SEQ ID NO: 3052777 - RNA, 14 nt, Mycobacterium bovis subsp bovis AF2122/97
cgccgccguccagc

SEQ ID NO: 3052778 - RNA, 21 nt, Mycobacterium bovis subsp bovis AF2122/97
cgccgccguccagcgccgcgg

SEQ ID NO: 3052779 - RNA, 22 nt, Mycobacterium bovis subsp bovis AF2122/97
cgccgccguccagcgccgcggc

SEQ ID NO: 3052780 - RNA, 15 nt, Mycobacterium bovis subsp bovis AF2122/97
cgccgccgucggcga

SEQ ID NO: 3052781 - RNA, 20 nt, Mycobacterium bovis subsp bovis AF2122/97
cgccgccguuaccgccggcg

SEQ ID NO: 3052782 - RNA, 21 nt, Mycobacterium bovis subsp bovis AF2122/97
cgccgccguuaccgccggcgc

SEQ ID NO: 3052783 - RNA, 18 nt, Mycobacterium bovis subsp bovis AF2122/97
cgccgccguucccgccgg

SEQ ID NO: 3052784 - RNA, 17 nt, Mycobacterium bovis subsp bovis AF2122/97
cgccgccguugccgauc

SEQ ID NO: 3052785 - RNA, 15 nt, Mycobacterium bovis subsp bovis AF2122/97
cgccgccguugccgc

SEQ ID NO: 3052786 - RNA, 17 nt, Mycobacterium bovis subsp bovis AF2122/97
cgccgccguugccgcca

SEQ ID NO: 3052787 - RNA, 19 nt, Mycobacterium bovis subsp bovis AF2122/97
cgccgccguugccgccauc

SEQ ID NO: 3052788 - RNA, 19 nt, Mycobacterium bovis subsp bovis AF2122/97
cgccgccguugccgccggc

SEQ ID NO: 3052789 - RNA, 24 nt, Mycobacterium bovis subsp bovis AF2122/97
cgccgccguugccgccggcgccgc

SEQ ID NO: 3052790 - RNA, 21 nt, Mycobacterium bovis subsp bovis AF2122/97
cgccgccguugccgccguugc

SEQ ID NO: 3052791 - RNA, 14 nt, Mycobacterium bovis subsp bovis AF2122/97
cgccgccucgggca

SEQ ID NO: 3052792 - RNA, 16 nt, Mycobacterium bovis subsp bovis AF2122/97
cgccgccucgggcacc

SEQ ID NO: 3052793 - RNA, 12 nt, Mycobacterium bovis subsp bovis AF2122/97
cgccgccucguc

SEQ ID NO: 3052794 - RNA, 16 nt, Mycobacterium bovis subsp bovis AF2122/97
cgccgccugcccggcc

SEQ ID NO: 3052795 - RNA, 18 nt, Mycobacterium bovis subsp bovis AF2122/97
cgccgccugcccggcccg

SEQ ID NO: 3052796 - RNA, 21 nt, Mycobacterium bovis subsp bovis AF2122/97
cgccgccugcccggcccgcuc

SEQ ID NO: 3052797 - RNA, 15 nt, Mycobacterium bovis subsp bovis AF2122/97
cgccgccugcuccuc

SEQ ID NO: 3052798 - RNA, 13 nt, Mycobacterium bovis subsp bovis AF2122/97
cgccgccuggacg

SEQ ID NO: 3052799 - RNA, 15 nt, Mycobacterium bovis subsp bovis AF2122/97
cgccgccuggacgcc

SEQ ID NO: 3052800 - RNA, 21 nt, Mycobacterium bovis subsp bovis AF2122/97
cgccgccuggacgccgccgga

SEQ ID NO: 3052801 - RNA, 21 nt, Mycobacterium bovis subsp bovis AF2122/97
cgccgccugugcgcggugacg

SEQ ID NO: 3052802 - RNA, 19 nt, Mycobacterium bovis subsp bovis AF2122/97
cgccgccuuacgcaccgau

SEQ ID NO: 3052803 - RNA, 20 nt, Mycobacterium bovis subsp bovis AF2122/97
cgccgccuuccuggcgggcg

SEQ ID NO: 3052804 - RNA, 18 nt, Mycobacterium bovis subsp bovis AF2122/97
cgccgccuucuuggcggc

SEQ ID NO: 3052805 - RNA, 20 nt, Mycobacterium bovis subsp bovis AF2122/97
cgccgccuucuuggcggccu

SEQ ID NO: 3052806 - RNA, 19 nt, Mycobacterium bovis subsp bovis AF2122/97
cgccgcgaacuccagcagc

SEQ ID NO: 3052807 - RNA, 22 nt, Mycobacterium bovis subsp bovis AF2122/97
cgccgcgaacuccagcagcccg

SEQ ID NO: 3052808 - RNA, 18 nt, Mycobacterium bovis subsp bovis AF2122/97
cgccgcgaagcgcucggc

SEQ ID NO: 3052809 - RNA, 20 nt, Mycobacterium bovis subsp bovis AF2122/97
cgccgcgaagcgcucggcag

SEQ ID NO: 3052810 - RNA, 22 nt, Mycobacterium bovis subsp bovis AF2122/97
cgccgcgaagcgcucggcagcc

SEQ ID NO: 3052811 - RNA, 20 nt, Mycobacterium bovis subsp bovis AF2122/97
cgccgcgaaggggugcccgg

SEQ ID NO: 3052812 - RNA, 22 nt, Mycobacterium bovis subsp bovis AF2122/97
cgccgcgaaggggugcccggcg

SEQ ID NO: 3052813 - RNA, 14 nt, Mycobacterium bovis subsp bovis AF2122/97
cgccgcgaaugucg

SEQ ID NO: 3052814 - RNA, 21 nt, Mycobacterium bovis subsp bovis AF2122/97
cgccgcgaaugucgccgccug

SEQ ID NO: 3052815 - RNA, 18 nt, Mycobacterium bovis subsp bovis AF2122/97
cgccgcgaccacgcaccg

SEQ ID NO: 3052816 - RNA, 16 nt, Mycobacterium bovis subsp bovis AF2122/97
cgccgcgaccgcgagc

SEQ ID NO: 3052817 - RNA, 15 nt, Mycobacterium bovis subsp bovis AF2122/97
cgccgcgacggcacg

SEQ ID NO: 3052818 - RNA, 23 nt, Mycobacterium bovis subsp bovis AF2122/97
cgccgcgacugcaccuggccgcc

SEQ ID NO: 3052819 - RNA, 17 nt, Mycobacterium bovis subsp bovis AF2122/97
cgccgcgagagccggcg

SEQ ID NO: 3052820 - RNA, 21 nt, Mycobacterium bovis subsp bovis AF2122/97
cgccgcgagagccggcggcga

SEQ ID NO: 3052821 - RNA, 16 nt, Mycobacterium bovis subsp bovis AF2122/97
cgccgcgagcgccggc

SEQ ID NO: 3052822 - RNA, 18 nt, Mycobacterium bovis subsp bovis AF2122/97
cgccgcgagcgccggccg

SEQ ID NO: 3052823 - RNA, 19 nt, Mycobacterium bovis subsp bovis AF2122/97
cgccgcgagcgccggccgc

SEQ ID NO: 3052824 - RNA, 20 nt, Mycobacterium bovis subsp bovis AF2122/97
cgccgcgagcgccggccgcg

SEQ ID NO: 3052825 - RNA, 13 nt, Mycobacterium bovis subsp bovis AF2122/97
cgccgcgaggaug

SEQ ID NO: 3052826 - RNA, 21 nt, Mycobacterium bovis subsp bovis AF2122/97
cgccgcgaucuccuuggccgu

SEQ ID NO: 3052827 - RNA, 17 nt, Mycobacterium bovis subsp bovis AF2122/97
cgccgcgaugacggugc

SEQ ID NO: 3052828 - RNA, 22 nt, Mycobacterium bovis subsp bovis AF2122/97
cgccgcgaugacggugccgacc

SEQ ID NO: 3052829 - RNA, 13 nt, Mycobacterium bovis subsp bovis AF2122/97
cgccgcgaugcca

SEQ ID NO: 3052830 - RNA, 22 nt, Mycobacterium bovis subsp bovis AF2122/97
cgccgcgaugccacccaacagc

SEQ ID NO: 3052831 - RNA, 23 nt, Mycobacterium bovis subsp bovis AF2122/97
cgccgcgaugccacccaacagcg

SEQ ID NO: 3052832 - RNA, 13 nt, Mycobacterium bovis subsp bovis AF2122/97
cgccgcgauggcc

SEQ ID NO: 3052833 - RNA, 16 nt, Mycobacterium bovis subsp bovis AF2122/97
cgccgcgauggccccu

SEQ ID NO: 3052834 - RNA, 19 nt, Mycobacterium bovis subsp bovis AF2122/97
cgccgcgcaccgaccgcac

SEQ ID NO: 3052835 - RNA, 13 nt, Mycobacterium bovis subsp bovis AF2122/97
cgccgcgcaccgc

SEQ ID NO: 3052836 - RNA, 14 nt, Mycobacterium bovis subsp bovis AF2122/97
cgccgcgcaccgcg

SEQ ID NO: 3052837 - RNA, 16 nt, Mycobacterium bovis subsp bovis AF2122/97
cgccgcgcaccgcggg

SEQ ID NO: 3052838 - RNA, 12 nt, Mycobacterium bovis subsp bovis AF2122/97
cgccgcgcagcc

SEQ ID NO: 3052839 - RNA, 15 nt, Mycobacterium bovis subsp bovis AF2122/97
cgccgcgcagccgcu

SEQ ID NO: 3052840 - RNA, 16 nt, Mycobacterium bovis subsp bovis AF2122/97
cgccgcgcagccgcuc

SEQ ID NO: 3052841 - RNA, 21 nt, Mycobacterium bovis subsp bovis AF2122/97
cgccgcgcagccgcucgacgg

SEQ ID NO: 3052842 - RNA, 14 nt, Mycobacterium bovis subsp bovis AF2122/97
cgccgcgcagccgg

SEQ ID NO: 3052843 - RNA, 17 nt, Mycobacterium bovis subsp bovis AF2122/97
cgccgcgcagccggccc

SEQ ID NO: 3052844 - RNA, 19 nt, Mycobacterium bovis subsp bovis AF2122/97
cgccgcgcagccggcccgu

SEQ ID NO: 3052845 - RNA, 21 nt, Mycobacterium bovis subsp bovis AF2122/97
cgccgcgcagccggcccgucg

SEQ ID NO: 3052846 - RNA, 13 nt, Mycobacterium bovis subsp bovis AF2122/97
cgccgcgcagcga

SEQ ID NO: 3052847 - RNA, 15 nt, Mycobacterium bovis subsp bovis AF2122/97
cgccgcgcagcgagg

SEQ ID NO: 3052848 - RNA, 18 nt, Mycobacterium bovis subsp bovis AF2122/97
cgccgcgcauccgcagcc

SEQ ID NO: 3052849 - RNA, 20 nt, Mycobacterium bovis subsp bovis AF2122/97
cgccgcgcauccgcagccca

SEQ ID NO: 3052850 - RNA, 18 nt, Mycobacterium bovis subsp bovis AF2122/97
cgccgcgcaucgcggccg

SEQ ID NO: 3052851 - RNA, 17 nt, Mycobacterium bovis subsp bovis AF2122/97
cgccgcgcccaccauga

SEQ ID NO: 3052852 - RNA, 22 nt, Mycobacterium bovis subsp bovis AF2122/97
cgccgcgcccaccaugaucaca

SEQ ID NO: 3052853 - RNA, 21 nt, Mycobacterium bovis subsp bovis AF2122/97
cgccgcgccccagacgcgcag

SEQ ID NO: 3052854 - RNA, 13 nt, Mycobacterium bovis subsp bovis AF2122/97
cgccgcgccccgc

SEQ ID NO: 3052855 - RNA, 12 nt, Mycobacterium bovis subsp bovis AF2122/97
cgccgcgcccgg

SEQ ID NO: 3052856 - RNA, 14 nt, Mycobacterium bovis subsp bovis AF2122/97
cgccgcgcccggcg

SEQ ID NO: 3052857 - RNA, 19 nt, Mycobacterium bovis subsp bovis AF2122/97
cgccgcgcccggcgcaagc

SEQ ID NO: 3052858 - RNA, 13 nt, Mycobacterium bovis subsp bovis AF2122/97
cgccgcgccgaau

SEQ ID NO: 3052859 - RNA, 21 nt, Mycobacterium bovis subsp bovis AF2122/97
cgccgcgccgaaucgcgggcu

SEQ ID NO: 3052860 - RNA, 12 nt, Mycobacterium bovis subsp bovis AF2122/97
cgccgcgccgca

SEQ ID NO: 3052861 - RNA, 13 nt, Mycobacterium bovis subsp bovis AF2122/97
cgccgcgccgccu

SEQ ID NO: 3052862 - RNA, 12 nt, Mycobacterium bovis subsp bovis AF2122/97
cgccgcgccggc

SEQ ID NO: 3052863 - RNA, 13 nt, Mycobacterium bovis subsp bovis AF2122/97
cgccgcgccggca

SEQ ID NO: 3052864 - RNA, 15 nt, Mycobacterium bovis subsp bovis AF2122/97
cgccgcgccggcacg

SEQ ID NO: 3052865 - RNA, 13 nt, Mycobacterium bovis subsp bovis AF2122/97
cgccgcgccggcg

SEQ ID NO: 3052866 - RNA, 14 nt, Mycobacterium bovis subsp bovis AF2122/97
cgccgcgccggcgg

SEQ ID NO: 3052867 - RNA, 15 nt, Mycobacterium bovis subsp bovis AF2122/97
cgccgcgccggcggc

SEQ ID NO: 3052868 - RNA, 16 nt, Mycobacterium bovis subsp bovis AF2122/97
cgccgcgccggcggcc

SEQ ID NO: 3052869 - RNA, 17 nt, Mycobacterium bovis subsp bovis AF2122/97
cgccgcgccggcggcca

SEQ ID NO: 3052870 - RNA, 18 nt, Mycobacterium bovis subsp bovis AF2122/97
cgccgcgccggcggccac

SEQ ID NO: 3052871 - RNA, 20 nt, Mycobacterium bovis subsp bovis AF2122/97
cgccgcgccggcggccaccu

SEQ ID NO: 3052872 - RNA, 17 nt, Mycobacterium bovis subsp bovis AF2122/97
cgccgcgccggcgggcg

SEQ ID NO: 3052873 - RNA, 20 nt, Mycobacterium bovis subsp bovis AF2122/97
cgccgcgccggugugcgcac

SEQ ID NO: 3052874 - RNA, 12 nt, Mycobacterium bovis subsp bovis AF2122/97
cgccgcgcgaca

SEQ ID NO: 3052875 - RNA, 18 nt, Mycobacterium bovis subsp bovis AF2122/97
cgccgcgcgacaggcccu

SEQ ID NO: 3052876 - RNA, 21 nt, Mycobacterium bovis subsp bovis AF2122/97
cgccgcgcgcauuuuucgcca

SEQ ID NO: 3052877 - RNA, 20 nt, Mycobacterium bovis subsp bovis AF2122/97
cgccgcgcggaacaccgagg

SEQ ID NO: 3052878 - RNA, 14 nt, Mycobacterium bovis subsp bovis AF2122/97
cgccgcgcguucca

SEQ ID NO: 3052879 - RNA, 17 nt, Mycobacterium bovis subsp bovis AF2122/97
cgccgcgcguucggcgc

SEQ ID NO: 3052880 - RNA, 14 nt, Mycobacterium bovis subsp bovis AF2122/97
cgccgcgcuggucg

SEQ ID NO: 3052881 - RNA, 18 nt, Mycobacterium bovis subsp bovis AF2122/97
cgccgcgcuggucggaga

SEQ ID NO: 3052882 - RNA, 20 nt, Mycobacterium bovis subsp bovis AF2122/97
cgccgcgcuugcgaucggca

SEQ ID NO: 3052883 - RNA, 16 nt, Mycobacterium bovis subsp bovis AF2122/97
cgccgcggacaccagg

SEQ ID NO: 3052884 - RNA, 20 nt, Mycobacterium bovis subsp bovis AF2122/97
cgccgcggaccagaggucga

SEQ ID NO: 3052885 - RNA, 22 nt, Mycobacterium bovis subsp bovis AF2122/97
cgccgcggaccagaggucgagg

SEQ ID NO: 3052886 - RNA, 22 nt, Mycobacterium bovis subsp bovis AF2122/97
cgccgcggacucgggcaggccc

SEQ ID NO: 3052887 - RNA, 13 nt, Mycobacterium bovis subsp bovis AF2122/97
cgccgcggccaca

SEQ ID NO: 3052888 - RNA, 17 nt, Mycobacterium bovis subsp bovis AF2122/97
cgccgcggccacaaccu

SEQ ID NO: 3052889 - RNA, 14 nt, Mycobacterium bovis subsp bovis AF2122/97
cgccgcggccacca

SEQ ID NO: 3052890 - RNA, 19 nt, Mycobacterium bovis subsp bovis AF2122/97
cgccgcggccaccaccgcc

SEQ ID NO: 3052891 - RNA, 14 nt, Mycobacterium bovis subsp bovis AF2122/97
cgccgcggccaggu

SEQ ID NO: 3052892 - RNA, 13 nt, Mycobacterium bovis subsp bovis AF2122/97
cgccgcggcccgc

SEQ ID NO: 3052893 - RNA, 14 nt, Mycobacterium bovis subsp bovis AF2122/97
cgccgcggcccgcu

SEQ ID NO: 3052894 - RNA, 14 nt, Mycobacterium bovis subsp bovis AF2122/97
cgccgcggccgccg

SEQ ID NO: 3052895 - RNA, 16 nt, Mycobacterium bovis subsp bovis AF2122/97
cgccgcggccggcgcu

SEQ ID NO: 3052896 - RNA, 13 nt, Mycobacterium bovis subsp bovis AF2122/97
cgccgcggcgacg

SEQ ID NO: 3052897 - RNA, 13 nt, Mycobacterium bovis subsp bovis AF2122/97
cgccgcggcgccc

SEQ ID NO: 3052898 - RNA, 15 nt, Mycobacterium bovis subsp bovis AF2122/97
cgccgcggcgcccgg

SEQ ID NO: 3052899 - RNA, 16 nt, Mycobacterium bovis subsp bovis AF2122/97
cgccgcggcgcccggc

SEQ ID NO: 3052900 - RNA, 14 nt, Mycobacterium bovis subsp bovis AF2122/97
cgccgcggcgccgg

SEQ ID NO: 3052901 - RNA, 14 nt, Mycobacterium bovis subsp bovis AF2122/97
cgccgcggcggaug

SEQ ID NO: 3052902 - RNA, 15 nt, Mycobacterium bovis subsp bovis AF2122/97
cgccgcggcggcagc

SEQ ID NO: 3052903 - RNA, 21 nt, Mycobacterium bovis subsp bovis AF2122/97
cgccgcggcuugucgccccau

SEQ ID NO: 3052904 - RNA, 19 nt, Mycobacterium bovis subsp bovis AF2122/97
cgccgcgggacaccaccgc

SEQ ID NO: 3052905 - RNA, 13 nt, Mycobacterium bovis subsp bovis AF2122/97
cgccgcgggcgcc

SEQ ID NO: 3052906 - RNA, 14 nt, Mycobacterium bovis subsp bovis AF2122/97
cgccgcgggcgccg

SEQ ID NO: 3052907 - RNA, 18 nt, Mycobacterium bovis subsp bovis AF2122/97
cgccgcgggcuccccggc

SEQ ID NO: 3052908 - RNA, 22 nt, Mycobacterium bovis subsp bovis AF2122/97
cgccgcgggcugaccaacccaa

SEQ ID NO: 3052909 - RNA, 19 nt, Mycobacterium bovis subsp bovis AF2122/97
cgccgcgguagacgccgcc

SEQ ID NO: 3052910 - RNA, 20 nt, Mycobacterium bovis subsp bovis AF2122/97
cgccgcgguagacgccgccg

SEQ ID NO: 3052911 - RNA, 17 nt, Mycobacterium bovis subsp bovis AF2122/97
cgccgcggucagaucca

SEQ ID NO: 3052912 - RNA, 15 nt, Mycobacterium bovis subsp bovis AF2122/97
cgccgcggucggacc

SEQ ID NO: 3052913 - RNA, 16 nt, Mycobacterium bovis subsp bovis AF2122/97
cgccgcggucggacca

SEQ ID NO: 3052914 - RNA, 13 nt, Mycobacterium bovis subsp bovis AF2122/97
cgccggagucgac

SEQ ID NO: 3052915 - RNA, 14 nt, Mycobacterium bovis subsp bovis AF2122/97
cgccggagucgacc

SEQ ID NO: 3052916 - RNA, 15 nt, Mycobacterium bovis subsp bovis AF2122/97
cgccggagucgauca

SEQ ID NO: 3052917 - RNA, 20 nt, Mycobacterium bovis subsp bovis AF2122/97
cgccggaguucugcgaucac

SEQ ID NO: 3052918 - RNA, 19 nt, Mycobacterium bovis subsp bovis AF2122/97
cgccggaguugaagaagcc

SEQ ID NO: 3052919 - RNA, 21 nt, Mycobacterium bovis subsp bovis AF2122/97
cgccggaguuucccuuaccag

SEQ ID NO: 3052920 - RNA, 18 nt, Mycobacterium bovis subsp bovis AF2122/97
cgccggauagcaccggca

SEQ ID NO: 3052921 - RNA, 23 nt, Mycobacterium bovis subsp bovis AF2122/97
cgccggauagcaccggcacccgc

SEQ ID NO: 3052922 - RNA, 18 nt, Mycobacterium bovis subsp bovis AF2122/97
cgccggauagcgcagcuc

SEQ ID NO: 3052923 - RNA, 22 nt, Mycobacterium bovis subsp bovis AF2122/97
cgccggauauggcagugucgug

SEQ ID NO: 3052924 - RNA, 19 nt, Mycobacterium bovis subsp bovis AF2122/97
cgccggauccgauccgcac

SEQ ID NO: 3052925 - RNA, 22 nt, Mycobacterium bovis subsp bovis AF2122/97
cgccggauccgauccgcacagc

SEQ ID NO: 3052926 - RNA, 15 nt, Mycobacterium bovis subsp bovis AF2122/97
cgccggauccgccag

SEQ ID NO: 3052927 - RNA, 16 nt, Mycobacterium bovis subsp bovis AF2122/97
cgccggauccgccaga

SEQ ID NO: 3052928 - RNA, 19 nt, Mycobacterium bovis subsp bovis AF2122/97
cgccggauccgccagaccg

SEQ ID NO: 3052929 - RNA, 14 nt, Mycobacterium bovis subsp bovis AF2122/97
cgccggaucgccgg

SEQ ID NO: 3052930 - RNA, 13 nt, Mycobacterium bovis subsp bovis AF2122/97
cgccggaucguug

SEQ ID NO: 3052931 - RNA, 15 nt, Mycobacterium bovis subsp bovis AF2122/97
cgccggaucuugccg

SEQ ID NO: 3052932 - RNA, 19 nt, Mycobacterium bovis subsp bovis AF2122/97
cgccggaugacaccgaccg

SEQ ID NO: 3052933 - RNA, 14 nt, Mycobacterium bovis subsp bovis AF2122/97
cgccggaugcuguc

SEQ ID NO: 3052934 - RNA, 15 nt, Mycobacterium bovis subsp bovis AF2122/97
cgccggaugcuguca

SEQ ID NO: 3052935 - RNA, 20 nt, Mycobacterium bovis subsp bovis AF2122/97
cgccggaugcugucagcagc

SEQ ID NO: 3052936 - RNA, 19 nt, Mycobacterium bovis subsp bovis AF2122/97
cgccggauggucggccacg

SEQ ID NO: 3052937 - RNA, 16 nt, Mycobacterium bovis subsp bovis AF2122/97
cgccggauucgaugac

SEQ ID NO: 3052938 - RNA, 20 nt, Mycobacterium bovis subsp bovis AF2122/97
cgccggauucgcccgggcgu

SEQ ID NO: 3052939 - RNA, 22 nt, Mycobacterium bovis subsp bovis AF2122/97
cgccggauucgcccgggcguug

SEQ ID NO: 3052940 - RNA, 23 nt, Mycobacterium bovis subsp bovis AF2122/97
cgccggauugcuugggugccucg

SEQ ID NO: 3052941 - RNA, 17 nt, Mycobacterium bovis subsp bovis AF2122/97
cgccggcaacccagugu

SEQ ID NO: 3052942 - RNA, 21 nt, Mycobacterium bovis subsp bovis AF2122/97
cgccggcaacccagugucagc

SEQ ID NO: 3052943 - RNA, 15 nt, Mycobacterium bovis subsp bovis AF2122/97
cgccggcaaccggga

SEQ ID NO: 3052944 - RNA, 14 nt, Mycobacterium bovis subsp bovis AF2122/97
cgccggcaacgcgg

SEQ ID NO: 3052945 - RNA, 16 nt, Mycobacterium bovis subsp bovis AF2122/97
cgccggcaauaccgcc

SEQ ID NO: 3052946 - RNA, 19 nt, Mycobacterium bovis subsp bovis AF2122/97
cgccggcaauaccgccagc

SEQ ID NO: 3052947 - RNA, 21 nt, Mycobacterium bovis subsp bovis AF2122/97
cgccggcaauaccgccagcgc

SEQ ID NO: 3052948 - RNA, 23 nt, Mycobacterium bovis subsp bovis AF2122/97
cgccggcaauaccgccagcgcca

SEQ ID NO: 3052949 - RNA, 15 nt, Mycobacterium bovis subsp bovis AF2122/97
cgccggcacccgccg

SEQ ID NO: 3052950 - RNA, 11 nt, Mycobacterium bovis subsp bovis AF2122/97
cgccggcaccg

SEQ ID NO: 3052951 - RNA, 13 nt, Mycobacterium bovis subsp bovis AF2122/97
cgccggcaccgac

SEQ ID NO: 3052952 - RNA, 15 nt, Mycobacterium bovis subsp bovis AF2122/97
cgccggcaccgacac

SEQ ID NO: 3052953 - RNA, 14 nt, Mycobacterium bovis subsp bovis AF2122/97
cgccggcaccgacg

SEQ ID NO: 3052954 - RNA, 17 nt, Mycobacterium bovis subsp bovis AF2122/97
cgccggcaccgacgucg

SEQ ID NO: 3052955 - RNA, 15 nt, Mycobacterium bovis subsp bovis AF2122/97
cgccggcaccgccag

SEQ ID NO: 3052956 - RNA, 16 nt, Mycobacterium bovis subsp bovis AF2122/97
cgccggcaccgccagu

SEQ ID NO: 3052957 - RNA, 17 nt, Mycobacterium bovis subsp bovis AF2122/97
cgccggcaccgccgccc

SEQ ID NO: 3052958 - RNA, 23 nt, Mycobacterium bovis subsp bovis AF2122/97
cgccggcaccgccggcaccgccg

SEQ ID NO: 3052959 - RNA, 18 nt, Mycobacterium bovis subsp bovis AF2122/97
cgccggcaccggggcugc

SEQ ID NO: 3052960 - RNA, 19 nt, Mycobacterium bovis subsp bovis AF2122/97
cgccggcacgaaucccccg

SEQ ID NO: 3052961 - RNA, 13 nt, Mycobacterium bovis subsp bovis AF2122/97
cgccggcacgggc

SEQ ID NO: 3052962 - RNA, 14 nt, Mycobacterium bovis subsp bovis AF2122/97
cgccggcacgggcg

SEQ ID NO: 3052963 - RNA, 17 nt, Mycobacterium bovis subsp bovis AF2122/97
cgccggcacgggcgucg

SEQ ID NO: 3052964 - RNA, 23 nt, Mycobacterium bovis subsp bovis AF2122/97
cgccggcagcaucggcaccccgg

SEQ ID NO: 3052965 - RNA, 16 nt, Mycobacterium bovis subsp bovis AF2122/97
cgccggcagugggggu

SEQ ID NO: 3052966 - RNA, 15 nt, Mycobacterium bovis subsp bovis AF2122/97
cgccggcaucgcgca

SEQ ID NO: 3052967 - RNA, 16 nt, Mycobacterium bovis subsp bovis AF2122/97
cgccggcaucgcgcaa

SEQ ID NO: 3052968 - RNA, 16 nt, Mycobacterium bovis subsp bovis AF2122/97
cgccggcaucgcgcgc

SEQ ID NO: 3052969 - RNA, 14 nt, Mycobacterium bovis subsp bovis AF2122/97
cgccggcaucgguc

SEQ ID NO: 3052970 - RNA, 15 nt, Mycobacterium bovis subsp bovis AF2122/97
cgccggcaucgguca

SEQ ID NO: 3052971 - RNA, 17 nt, Mycobacterium bovis subsp bovis AF2122/97
cgccggcaucgucgacg

SEQ ID NO: 3052972 - RNA, 22 nt, Mycobacterium bovis subsp bovis AF2122/97
cgccggcaucgucgacgcccga

SEQ ID NO: 3052973 - RNA, 14 nt, Mycobacterium bovis subsp bovis AF2122/97
cgccggccaccagc

SEQ ID NO: 3052974 - RNA, 15 nt, Mycobacterium bovis subsp bovis AF2122/97
cgccggccaccagcc

SEQ ID NO: 3052975 - RNA, 16 nt, Mycobacterium bovis subsp bovis AF2122/97
cgccggccaccagccg

SEQ ID NO: 3052976 - RNA, 21 nt, Mycobacterium bovis subsp bovis AF2122/97
cgccggccaccagccggucca

SEQ ID NO: 3052977 - RNA, 12 nt, Mycobacterium bovis subsp bovis AF2122/97
cgccggccaccc

SEQ ID NO: 3052978 - RNA, 13 nt, Mycobacterium bovis subsp bovis AF2122/97
cgccggccacccg

SEQ ID NO: 3052979 - RNA, 15 nt, Mycobacterium bovis subsp bovis AF2122/97
cgccggccacccgcg

SEQ ID NO: 3052980 - RNA, 16 nt, Mycobacterium bovis subsp bovis AF2122/97
cgccggccacccgcgc

SEQ ID NO: 3052981 - RNA, 18 nt, Mycobacterium bovis subsp bovis AF2122/97
cgccggccacccgcgcga

SEQ ID NO: 3052982 - RNA, 15 nt, Mycobacterium bovis subsp bovis AF2122/97
cgccggccagccagc

SEQ ID NO: 3052983 - RNA, 16 nt, Mycobacterium bovis subsp bovis AF2122/97
cgccggccagccagcg

SEQ ID NO: 3052984 - RNA, 12 nt, Mycobacterium bovis subsp bovis AF2122/97
cgccggccagcg

SEQ ID NO: 3052985 - RNA, 16 nt, Mycobacterium bovis subsp bovis AF2122/97
cgccggccagcggcca

SEQ ID NO: 3052986 - RNA, 23 nt, Mycobacterium bovis subsp bovis AF2122/97
cgccggccagcggccauccggcg

SEQ ID NO: 3052987 - RNA, 15 nt, Mycobacterium bovis subsp bovis AF2122/97
cgccggccagcgucg

SEQ ID NO: 3052988 - RNA, 14 nt, Mycobacterium bovis subsp bovis AF2122/97
cgccggccaguccg

SEQ ID NO: 3052989 - RNA, 15 nt, Mycobacterium bovis subsp bovis AF2122/97
cgccggccaguucgg

SEQ ID NO: 3052990 - RNA, 16 nt, Mycobacterium bovis subsp bovis AF2122/97
cgccggccaugccuuc

SEQ ID NO: 3052991 - RNA, 20 nt, Mycobacterium bovis subsp bovis AF2122/97
cgccggccaugccuucggug

SEQ ID NO: 3052992 - RNA, 20 nt, Mycobacterium bovis subsp bovis AF2122/97
cgccggcccaguucugcagg

SEQ ID NO: 3052993 - RNA, 20 nt, Mycobacterium bovis subsp bovis AF2122/97
cgccggcccaucuucggacg

SEQ ID NO: 3052994 - RNA, 17 nt, Mycobacterium bovis subsp bovis AF2122/97
cgccggccccaccggua

SEQ ID NO: 3052995 - RNA, 20 nt, Mycobacterium bovis subsp bovis AF2122/97
cgccggccccaccgguaccg

SEQ ID NO: 3052996 - RNA, 17 nt, Mycobacterium bovis subsp bovis AF2122/97
cgccggccccaccggug

SEQ ID NO: 3052997 - RNA, 13 nt, Mycobacterium bovis subsp bovis AF2122/97
cgccggccccgcc

SEQ ID NO: 3052998 - RNA, 15 nt, Mycobacterium bovis subsp bovis AF2122/97
cgccggccccgccag

SEQ ID NO: 3052999 - RNA, 17 nt, Mycobacterium bovis subsp bovis AF2122/97
cgccggccccgccagcg

SEQ ID NO: 3053000 - RNA, 18 nt, Mycobacterium bovis subsp bovis AF2122/97
cgccggccccgccagcgc

SEQ ID NO: 3053001 - RNA, 13 nt, Mycobacterium bovis subsp bovis AF2122/97
cgccggcgccgga

SEQ ID NO: 3053002 - RNA, 16 nt, Mycobacterium bovis subsp bovis AF2122/97
cgccggcgccggugcc

SEQ ID NO: 3053003 - RNA, 18 nt, Mycobacterium bovis subsp bovis AF2122/97
cgccggcgccggugccgc

SEQ ID NO: 3053004 - RNA, 13 nt, Mycobacterium bovis subsp bovis AF2122/97
cgccggcgcgcag

SEQ ID NO: 3053005 - RNA, 17 nt, Mycobacterium bovis subsp bovis AF2122/97
cgccggcgcgccgauga

SEQ ID NO: 3053006 - RNA, 18 nt, Mycobacterium bovis subsp bovis AF2122/97
cgccggcgcgccgggcgg

SEQ ID NO: 3053007 - RNA, 14 nt, Mycobacterium bovis subsp bovis AF2122/97
cgccggcgcugcca

SEQ ID NO: 3053008 - RNA, 23 nt, Mycobacterium bovis subsp bovis AF2122/97
cgccggcgcugcugccauugccg

SEQ ID NO: 3053009 - RNA, 15 nt, Mycobacterium bovis subsp bovis AF2122/97
cgccggcggacgccc

SEQ ID NO: 3053010 - RNA, 18 nt, Mycobacterium bovis subsp bovis AF2122/97
cgccggcggacgcccggc

SEQ ID NO: 3053011 - RNA, 19 nt, Mycobacterium bovis subsp bovis AF2122/97
cgccggcggacgcccggcg

SEQ ID NO: 3053012 - RNA, 24 nt, Mycobacterium bovis subsp bovis AF2122/97
cgccggcggacgcccggcgcacca

SEQ ID NO: 3053013 - RNA, 12 nt, Mycobacterium bovis subsp bovis AF2122/97
cgccggcggccc

SEQ ID NO: 3053014 - RNA, 15 nt, Mycobacterium bovis subsp bovis AF2122/97
cgccggcggcccgcu

SEQ ID NO: 3053015 - RNA, 13 nt, Mycobacterium bovis subsp bovis AF2122/97
cgccggcggccgc

SEQ ID NO: 3053016 - RNA, 14 nt, Mycobacterium bovis subsp bovis AF2122/97
cgccggcggccgcg

SEQ ID NO: 3053017 - RNA, 13 nt, Mycobacterium bovis subsp bovis AF2122/97
cgccggcggcgga

SEQ ID NO: 3053018 - RNA, 15 nt, Mycobacterium bovis subsp bovis AF2122/97
cgccggcggcggccg

SEQ ID NO: 3053019 - RNA, 19 nt, Mycobacterium bovis subsp bovis AF2122/97
cgccggcggcggccgcagc

SEQ ID NO: 3053020 - RNA, 15 nt, Mycobacterium bovis subsp bovis AF2122/97
cgccggcggcggugc

SEQ ID NO: 3053021 - RNA, 16 nt, Mycobacterium bovis subsp bovis AF2122/97
cgccggcggcggugcg

SEQ ID NO: 3053022 - RNA, 20 nt, Mycobacterium bovis subsp bovis AF2122/97
cgccggcgggacgggggcug

SEQ ID NO: 3053023 - RNA, 16 nt, Mycobacterium bovis subsp bovis AF2122/97
cgccggcgggcugucg

SEQ ID NO: 3053024 - RNA, 18 nt, Mycobacterium bovis subsp bovis AF2122/97
cgccggcggguggccccc

SEQ ID NO: 3053025 - RNA, 22 nt, Mycobacterium bovis subsp bovis AF2122/97
cgccggcggguggcccccgccg

SEQ ID NO: 3053026 - RNA, 15 nt, Mycobacterium bovis subsp bovis AF2122/97
cgccggcggugaugu

SEQ ID NO: 3053027 - RNA, 21 nt, Mycobacterium bovis subsp bovis AF2122/97
cgccggcggugauguggaugc

SEQ ID NO: 3053028 - RNA, 13 nt, Mycobacterium bovis subsp bovis AF2122/97
cgccggcgguggc

SEQ ID NO: 3053029 - RNA, 14 nt, Mycobacterium bovis subsp bovis AF2122/97
cgccggcguccgga

SEQ ID NO: 3053030 - RNA, 15 nt, Mycobacterium bovis subsp bovis AF2122/97
cgccggcgucggcgc

SEQ ID NO: 3053031 - RNA, 18 nt, Mycobacterium bovis subsp bovis AF2122/97
cgccggcgucggcgccca

SEQ ID NO: 3053032 - RNA, 19 nt, Mycobacterium bovis subsp bovis AF2122/97
cgccggcgugcaugagccg

SEQ ID NO: 3053033 - RNA, 20 nt, Mycobacterium bovis subsp bovis AF2122/97
cgccggcguuugggcaucau

SEQ ID NO: 3053034 - RNA, 15 nt, Mycobacterium bovis subsp bovis AF2122/97
cgccggcuccgcagc

SEQ ID NO: 3053035 - RNA, 14 nt, Mycobacterium bovis subsp bovis AF2122/97
cgccggcuccgcca

SEQ ID NO: 3053036 - RNA, 15 nt, Mycobacterium bovis subsp bovis AF2122/97
cgccggcuccgccac

SEQ ID NO: 3053037 - RNA, 21 nt, Mycobacterium bovis subsp bovis AF2122/97
cgccggcuccgccacuggcgc

SEQ ID NO: 3053038 - RNA, 23 nt, Mycobacterium bovis subsp bovis AF2122/97
cgccggcuccgccacuggcgccg

SEQ ID NO: 3053039 - RNA, 22 nt, Mycobacterium bovis subsp bovis AF2122/97
cgccggcuccgccguugccgcc

SEQ ID NO: 3053040 - RNA, 13 nt, Mycobacterium bovis subsp bovis AF2122/97
cgccggcuccggc

SEQ ID NO: 3053041 - RNA, 16 nt, Mycobacterium bovis subsp bovis AF2122/97
cgccggcucgccggcg

SEQ ID NO: 3053042 - RNA, 22 nt, Mycobacterium bovis subsp bovis AF2122/97
cgccggcucgucgauccccgca

SEQ ID NO: 3053043 - RNA, 20 nt, Mycobacterium bovis subsp bovis AF2122/97
cgccggcucuccggugauca

SEQ ID NO: 3053044 - RNA, 13 nt, Mycobacterium bovis subsp bovis AF2122/97
cgccggcugccac

SEQ ID NO: 3053045 - RNA, 20 nt, Mycobacterium bovis subsp bovis AF2122/97
cgccggcugccacacaggcg

SEQ ID NO: 3053046 - RNA, 15 nt, Mycobacterium bovis subsp bovis AF2122/97
cgccggcugcgccag

SEQ ID NO: 3053047 - RNA, 16 nt, Mycobacterium bovis subsp bovis AF2122/97
cgccggcuggcggccu

SEQ ID NO: 3053048 - RNA, 17 nt, Mycobacterium bovis subsp bovis AF2122/97
cgccggcuucgcccaga

SEQ ID NO: 3053049 - RNA, 19 nt, Mycobacterium bovis subsp bovis AF2122/97
cgccggcuucgcccagagc

SEQ ID NO: 3053050 - RNA, 20 nt, Mycobacterium bovis subsp bovis AF2122/97
cgccggcuucggguguucgc

SEQ ID NO: 3053051 - RNA, 22 nt, Mycobacterium bovis subsp bovis AF2122/97
cgccggcuucggguguucgcgc

SEQ ID NO: 3053052 - RNA, 20 nt, Mycobacterium bovis subsp bovis AF2122/97
cgccggcuuggauaccguca

SEQ ID NO: 3053053 - RNA, 18 nt, Mycobacterium bovis subsp bovis AF2122/97
cgccgggaaacaccggcu

SEQ ID NO: 3053054 - RNA, 16 nt, Mycobacterium bovis subsp bovis AF2122/97
cgccgggaacauccca

SEQ ID NO: 3053055 - RNA, 16 nt, Mycobacterium bovis subsp bovis AF2122/97
cgccgggaagccgcau

SEQ ID NO: 3053056 - RNA, 17 nt, Mycobacterium bovis subsp bovis AF2122/97
cgccgggauaucgucga

SEQ ID NO: 3053057 - RNA, 20 nt, Mycobacterium bovis subsp bovis AF2122/97
cgccgggauaucgucgacgc

SEQ ID NO: 3053058 - RNA, 18 nt, Mycobacterium bovis subsp bovis AF2122/97
cgccgggauuaugccggc

SEQ ID NO: 3053059 - RNA, 22 nt, Mycobacterium bovis subsp bovis AF2122/97
cgccgggauuaugccggcaacc

SEQ ID NO: 3053060 - RNA, 17 nt, Mycobacterium bovis subsp bovis AF2122/97
cgccgggcaacgcgaac

SEQ ID NO: 3053061 - RNA, 22 nt, Mycobacterium bovis subsp bovis AF2122/97
cgccgggcaaggccaccgucgc

SEQ ID NO: 3053062 - RNA, 20 nt, Mycobacterium bovis subsp bovis AF2122/97
cgccgggcaauacguagucg

SEQ ID NO: 3053063 - RNA, 23 nt, Mycobacterium bovis subsp bovis AF2122/97
cgccgggcaauacguagucgccg

SEQ ID NO: 3053064 - RNA, 14 nt, Mycobacterium bovis subsp bovis AF2122/97
cgccgggcacgaac

SEQ ID NO: 3053065 - RNA, 22 nt, Mycobacterium bovis subsp bovis AF2122/97
cgccgggcagcuacggggcggu

SEQ ID NO: 3053066 - RNA, 20 nt, Mycobacterium bovis subsp bovis AF2122/97
cgccgggcaguuuggcggca

SEQ ID NO: 3053067 - RNA, 15 nt, Mycobacterium bovis subsp bovis AF2122/97
cgccgggcaucggcg

SEQ ID NO: 3053068 - RNA, 16 nt, Mycobacterium bovis subsp bovis AF2122/97
cgccgggcaucggcgg

SEQ ID NO: 3053069 - RNA, 14 nt, Mycobacterium bovis subsp bovis AF2122/97
cgccgggccaggcc

SEQ ID NO: 3053070 - RNA, 15 nt, Mycobacterium bovis subsp bovis AF2122/97
cgccgggccaggccg

SEQ ID NO: 3053071 - RNA, 21 nt, Mycobacterium bovis subsp bovis AF2122/97
cgccgggccaggccgaugccg

SEQ ID NO: 3053072 - RNA, 19 nt, Mycobacterium bovis subsp bovis AF2122/97
cgccgggccccggggugcc

SEQ ID NO: 3053073 - RNA, 15 nt, Mycobacterium bovis subsp bovis AF2122/97
cgccgggcccgucgg

SEQ ID NO: 3053074 - RNA, 20 nt, Mycobacterium bovis subsp bovis AF2122/97
cgccgggcgaguacaggcgc

SEQ ID NO: 3053075 - RNA, 15 nt, Mycobacterium bovis subsp bovis AF2122/97
cgccgggcggcaucc

SEQ ID NO: 3053076 - RNA, 13 nt, Mycobacterium bovis subsp bovis AF2122/97
cgccgggcguccg

SEQ ID NO: 3053077 - RNA, 17 nt, Mycobacterium bovis subsp bovis AF2122/97
cgccgggcuccacguca

SEQ ID NO: 3053078 - RNA, 12 nt, Mycobacterium bovis subsp bovis AF2122/97
cgccgggcugca

SEQ ID NO: 3053079 - RNA, 22 nt, Mycobacterium bovis subsp bovis AF2122/97
cgccgggcuuacuugaucucgg

SEQ ID NO: 3053080 - RNA, 22 nt, Mycobacterium bovis subsp bovis AF2122/97
cgccgggcuuggccgcgccggu

SEQ ID NO: 3053081 - RNA, 23 nt, Mycobacterium bovis subsp bovis AF2122/97
cgccgggcuuggccgcgccgguc

SEQ ID NO: 3053082 - RNA, 18 nt, Mycobacterium bovis subsp bovis AF2122/97
cgccggggaccacgguga

SEQ ID NO: 3053083 - RNA, 14 nt, Mycobacterium bovis subsp bovis AF2122/97
cgccggggacgccg

SEQ ID NO: 3053084 - RNA, 19 nt, Mycobacterium bovis subsp bovis AF2122/97
cgccggggacgccgcggcg

SEQ ID NO: 3053085 - RNA, 20 nt, Mycobacterium bovis subsp bovis AF2122/97
cgccggggacgccgcggcgc

SEQ ID NO: 3053086 - RNA, 17 nt, Mycobacterium bovis subsp bovis AF2122/97
cgccggggauaccgguc

SEQ ID NO: 3053087 - RNA, 20 nt, Mycobacterium bovis subsp bovis AF2122/97
cgccgguggccgcgcugguc

SEQ ID NO: 3053088 - RNA, 14 nt, Mycobacterium bovis subsp bovis AF2122/97
cgccgguggcgccg

SEQ ID NO: 3053089 - RNA, 16 nt, Mycobacterium bovis subsp bovis AF2122/97
cgccgguggcgccggg

SEQ ID NO: 3053090 - RNA, 18 nt, Mycobacterium bovis subsp bovis AF2122/97
cgccgguggcgccggggc

SEQ ID NO: 3053091 - RNA, 22 nt, Mycobacterium bovis subsp bovis AF2122/97
cgccgguggcgccggggccgcc

SEQ ID NO: 3053092 - RNA, 14 nt, Mycobacterium bovis subsp bovis AF2122/97
cgccggugggcggu

SEQ ID NO: 3053093 - RNA, 21 nt, Mycobacterium bovis subsp bovis AF2122/97
cgccggugggcgguccgcguc

SEQ ID NO: 3053094 - RNA, 19 nt, Mycobacterium bovis subsp bovis AF2122/97
cgccggugguaccggcggc

SEQ ID NO: 3053095 - RNA, 23 nt, Mycobacterium bovis subsp bovis AF2122/97
cgccggugguaccggcggcgccg

SEQ ID NO: 3053096 - RNA, 19 nt, Mycobacterium bovis subsp bovis AF2122/97
cgccgguggugccggcgcc

SEQ ID NO: 3053097 - RNA, 20 nt, Mycobacterium bovis subsp bovis AF2122/97
cgccgguggugccggcgccg

SEQ ID NO: 3053098 - RNA, 23 nt, Mycobacterium bovis subsp bovis AF2122/97
cgccgguggugccggcgccgcca

SEQ ID NO: 3053099 - RNA, 22 nt, Mycobacterium bovis subsp bovis AF2122/97
cgccgguguccuuggccgccac

SEQ ID NO: 3053100 - RNA, 19 nt, Mycobacterium bovis subsp bovis AF2122/97
cgccggugucggcuggucg

SEQ ID NO: 3053101 - RNA, 23 nt, Mycobacterium bovis subsp bovis AF2122/97
cgccggugucggcuggucgcugc

SEQ ID NO: 3053102 - RNA, 14 nt, Mycobacterium bovis subsp bovis AF2122/97
cgccggugucgggc

SEQ ID NO: 3053103 - RNA, 15 nt, Mycobacterium bovis subsp bovis AF2122/97
cgccggugugcccgc

SEQ ID NO: 3053104 - RNA, 16 nt, Mycobacterium bovis subsp bovis AF2122/97
cgccggugugcgcacc

SEQ ID NO: 3053105 - RNA, 19 nt, Mycobacterium bovis subsp bovis AF2122/97
cgccggugugcgcaccccg

SEQ ID NO: 3053106 - RNA, 14 nt, Mycobacterium bovis subsp bovis AF2122/97
cgccgguguugccg

SEQ ID NO: 3053107 - RNA, 18 nt, Mycobacterium bovis subsp bovis AF2122/97
cgccgguuacccggaccg

SEQ ID NO: 3053108 - RNA, 19 nt, Mycobacterium bovis subsp bovis AF2122/97
cgccgguuacccggaccgu

SEQ ID NO: 3053109 - RNA, 20 nt, Mycobacterium bovis subsp bovis AF2122/97
cgccgguuccgccggcccca

SEQ ID NO: 3053110 - RNA, 23 nt, Mycobacterium bovis subsp bovis AF2122/97
cgccgguuccgccggccccaccg

SEQ ID NO: 3053111 - RNA, 15 nt, Mycobacterium bovis subsp bovis AF2122/97
cgccgguuugucgug

SEQ ID NO: 3053112 - RNA, 21 nt, Mycobacterium bovis subsp bovis AF2122/97
cgccguaaagccaacuggucg

SEQ ID NO: 3053113 - RNA, 16 nt, Mycobacterium bovis subsp bovis AF2122/97
cgccguaacagccggc

SEQ ID NO: 3053114 - RNA, 18 nt, Mycobacterium bovis subsp bovis AF2122/97
cgccguaacagccggccg

SEQ ID NO: 3053115 - RNA, 19 nt, Mycobacterium bovis subsp bovis AF2122/97
cgccguaacagccggccgg

SEQ ID NO: 3053116 - RNA, 15 nt, Mycobacterium bovis subsp bovis AF2122/97
cgccguaacggucgc

SEQ ID NO: 3053117 - RNA, 16 nt, Mycobacterium bovis subsp bovis AF2122/97
cgccguaacggucgcu

SEQ ID NO: 3053118 - RNA, 17 nt, Mycobacterium bovis subsp bovis AF2122/97
cgccguaagcaccagcc

SEQ ID NO: 3053119 - RNA, 19 nt, Mycobacterium bovis subsp bovis AF2122/97
cgccguaagcaccagccag

SEQ ID NO: 3053120 - RNA, 21 nt, Mycobacterium bovis subsp bovis AF2122/97
cgccguaagcaccagccagcc

SEQ ID NO: 3053121 - RNA, 22 nt, Mycobacterium bovis subsp bovis AF2122/97
cgccguaagcaccagccagccu

SEQ ID NO: 3053122 - RNA, 23 nt, Mycobacterium bovis subsp bovis AF2122/97
cgccguacaaccacccacccgca

SEQ ID NO: 3053123 - RNA, 14 nt, Mycobacterium bovis subsp bovis AF2122/97
cgccguacagcggc

SEQ ID NO: 3053124 - RNA, 17 nt, Mycobacterium bovis subsp bovis AF2122/97
cgccguacagcggcggc

SEQ ID NO: 3053125 - RNA, 18 nt, Mycobacterium bovis subsp bovis AF2122/97
cgccguacagcggcggcg

SEQ ID NO: 3053126 - RNA, 21 nt, Mycobacterium bovis subsp bovis AF2122/97
cgccguacagcggcggcgucg

SEQ ID NO: 3053127 - RNA, 15 nt, Mycobacterium bovis subsp bovis AF2122/97
cgccguacaucagcg

SEQ ID NO: 3053128 - RNA, 19 nt, Mycobacterium bovis subsp bovis AF2122/97
cgccguacaucagcgcgaa

SEQ ID NO: 3053129 - RNA, 22 nt, Mycobacterium bovis subsp bovis AF2122/97
cgccguacaucagcgcgaacgc

SEQ ID NO: 3053130 - RNA, 14 nt, Mycobacterium bovis subsp bovis AF2122/97
cgccguagaccagc

SEQ ID NO: 3053131 - RNA, 15 nt, Mycobacterium bovis subsp bovis AF2122/97
cgccguagaccagca

SEQ ID NO: 3053132 - RNA, 18 nt, Mycobacterium bovis subsp bovis AF2122/97
cgccguagaccagcaggc

SEQ ID NO: 3053133 - RNA, 16 nt, Mycobacterium bovis subsp bovis AF2122/97
cgccguagaccagccg

SEQ ID NO: 3053134 - RNA, 16 nt, Mycobacterium bovis subsp bovis AF2122/97
cgccguagagcuggug

SEQ ID NO: 3053135 - RNA, 15 nt, Mycobacterium bovis subsp bovis AF2122/97
cgccguagccggccg

SEQ ID NO: 3053136 - RNA, 13 nt, Mycobacterium bovis subsp bovis AF2122/97
cgccguaucgggg

SEQ ID NO: 3053137 - RNA, 17 nt, Mycobacterium bovis subsp bovis AF2122/97
cgccgucacccccgaua

SEQ ID NO: 3053138 - RNA, 13 nt, Mycobacterium bovis subsp bovis AF2122/97
cgccgucaccccg

SEQ ID NO: 3053139 - RNA, 23 nt, Mycobacterium bovis subsp bovis AF2122/97
cgccgucaccgaucgaacagugc

SEQ ID NO: 3053140 - RNA, 18 nt, Mycobacterium bovis subsp bovis AF2122/97
cgccgucaccgcccuugc

SEQ ID NO: 3053141 - RNA, 23 nt, Mycobacterium bovis subsp bovis AF2122/97
cgccgucaccgcccuugccgccg

SEQ ID NO: 3053142 - RNA, 14 nt, Mycobacterium bovis subsp bovis AF2122/97
cgccgucaccgccg

SEQ ID NO: 3053143 - RNA, 18 nt, Mycobacterium bovis subsp bovis AF2122/97
cgccgucaccgccguugc

SEQ ID NO: 3053144 - RNA, 16 nt, Mycobacterium bovis subsp bovis AF2122/97
cgccgucacgcacgcc

SEQ ID NO: 3053145 - RNA, 14 nt, Mycobacterium bovis subsp bovis AF2122/97
cgccgucacggcag

SEQ ID NO: 3053146 - RNA, 19 nt, Mycobacterium bovis subsp bovis AF2122/97
cgccgucagaacaccggcc

SEQ ID NO: 3053147 - RNA, 20 nt, Mycobacterium bovis subsp bovis AF2122/97
cgccgucagaacaccggcca

SEQ ID NO: 3053148 - RNA, 15 nt, Mycobacterium bovis subsp bovis AF2122/97
cgccgucagcccagg

SEQ ID NO: 3053149 - RNA, 17 nt, Mycobacterium bovis subsp bovis AF2122/97
cgccgucagcccaggug

SEQ ID NO: 3053150 - RNA, 17 nt, Mycobacterium bovis subsp bovis AF2122/97
cgccgucagcggccaag

SEQ ID NO: 3053151 - RNA, 18 nt, Mycobacterium bovis subsp bovis AF2122/97
cgccgucaucgugcccgc

SEQ ID NO: 3053152 - RNA, 19 nt, Mycobacterium bovis subsp bovis AF2122/97
cgccgucaucgugcccgcg

SEQ ID NO: 3053153 - RNA, 12 nt, Mycobacterium bovis subsp bovis AF2122/97
cgccguccacgc

SEQ ID NO: 3053154 - RNA, 23 nt, Mycobacterium bovis subsp bovis AF2122/97
cgccguccacgccgacggcaccg

SEQ ID NO: 3053155 - RNA, 15 nt, Mycobacterium bovis subsp bovis AF2122/97
cgccguccagcaaua

SEQ ID NO: 3053156 - RNA, 13 nt, Mycobacterium bovis subsp bovis AF2122/97
cgccguccagcgc

SEQ ID NO: 3053157 - RNA, 17 nt, Mycobacterium bovis subsp bovis AF2122/97
cgccguccagcgccgcg

SEQ ID NO: 3053158 - RNA, 13 nt, Mycobacterium bovis subsp bovis AF2122/97
cgccguccagucg

SEQ ID NO: 3053159 - RNA, 18 nt, Mycobacterium bovis subsp bovis AF2122/97
cgccguccagucggucgg

SEQ ID NO: 3053160 - RNA, 14 nt, Mycobacterium bovis subsp bovis AF2122/97
cgccguccccgccg

SEQ ID NO: 3053161 - RNA, 17 nt, Mycobacterium bovis subsp bovis AF2122/97
cgccguccccgccgacg

SEQ ID NO: 3053162 - RNA, 15 nt, Mycobacterium bovis subsp bovis AF2122/97
cgccguccccgccgu

SEQ ID NO: 3053163 - RNA, 20 nt, Mycobacterium bovis subsp bovis AF2122/97
cgccguccccgccgucgcca

SEQ ID NO: 3053164 - RNA, 22 nt, Mycobacterium bovis subsp bovis AF2122/97
cgccguccccgccgucgccacc

SEQ ID NO: 3053165 - RNA, 20 nt, Mycobacterium bovis subsp bovis AF2122/97
cgccgucccgaaacgccggg

SEQ ID NO: 3053166 - RNA, 21 nt, Mycobacterium bovis subsp bovis AF2122/97
cgccgucccgauacggccggc

SEQ ID NO: 3053167 - RNA, 16 nt, Mycobacterium bovis subsp bovis AF2122/97
cgccgucccggcucga

SEQ ID NO: 3053168 - RNA, 12 nt, Mycobacterium bovis subsp bovis AF2122/97
cgccgucgaacc

SEQ ID NO: 3053169 - RNA, 20 nt, Mycobacterium bovis subsp bovis AF2122/97
cgccgucgaagcggaccagc

SEQ ID NO: 3053170 - RNA, 21 nt, Mycobacterium bovis subsp bovis AF2122/97
cgccgucgacaacaaacccgg

SEQ ID NO: 3053171 - RNA, 17 nt, Mycobacterium bovis subsp bovis AF2122/97
cgccgucgacgcggccg

SEQ ID NO: 3053172 - RNA, 12 nt, Mycobacterium bovis subsp bovis AF2122/97
cgccgucgacgu

SEQ ID NO: 3053173 - RNA, 15 nt, Mycobacterium bovis subsp bovis AF2122/97
cgccguucucgcgca

SEQ ID NO: 3053174 - RNA, 19 nt, Mycobacterium bovis subsp bovis AF2122/97
cgccguucucgcgcagguc

SEQ ID NO: 3053175 - RNA, 22 nt, Mycobacterium bovis subsp bovis AF2122/97
cgccguucucgcgcaggucgcc

SEQ ID NO: 3053176 - RNA, 15 nt, Mycobacterium bovis subsp bovis AF2122/97
cgccguugaacggca

SEQ ID NO: 3053177 - RNA, 18 nt, Mycobacterium bovis subsp bovis AF2122/97
cgccguugaacggcacca

SEQ ID NO: 3053178 - RNA, 21 nt, Mycobacterium bovis subsp bovis AF2122/97
cgccguugaacggcaccagcg

SEQ ID NO: 3053179 - RNA, 23 nt, Mycobacterium bovis subsp bovis AF2122/97
cgccguugaacggcaccagcggg

SEQ ID NO: 3053180 - RNA, 15 nt, Mycobacterium bovis subsp bovis AF2122/97
cgccguugacgccgu

SEQ ID NO: 3053181 - RNA, 22 nt, Mycobacterium bovis subsp bovis AF2122/97
cgccguugacgccguugccacc

SEQ ID NO: 3053182 - RNA, 17 nt, Mycobacterium bovis subsp bovis AF2122/97
cgccguugaugucggca

SEQ ID NO: 3053183 - RNA, 19 nt, Mycobacterium bovis subsp bovis AF2122/97
cgccguugaugucggcagg

SEQ ID NO: 3053184 - RNA, 13 nt, Mycobacterium bovis subsp bovis AF2122/97
cgccguugccacc

SEQ ID NO: 3053185 - RNA, 14 nt, Mycobacterium bovis subsp bovis AF2122/97
cgccguugccaccg

SEQ ID NO: 3053186 - RNA, 15 nt, Mycobacterium bovis subsp bovis AF2122/97
cgccguugccaccgg

SEQ ID NO: 3053187 - RNA, 23 nt, Mycobacterium bovis subsp bovis AF2122/97
cgccguugccaccguagccgagg

SEQ ID NO: 3053188 - RNA, 22 nt, Mycobacterium bovis subsp bovis AF2122/97
cgccguugccauugccucccgc

SEQ ID NO: 3053189 - RNA, 18 nt, Mycobacterium bovis subsp bovis AF2122/97
cgccguugcccccguugc

SEQ ID NO: 3053190 - RNA, 21 nt, Mycobacterium bovis subsp bovis AF2122/97
cgccguugcccccguugccgc

SEQ ID NO: 3053191 - RNA, 13 nt, Mycobacterium bovis subsp bovis AF2122/97
cgccguugccgau

SEQ ID NO: 3053192 - RNA, 20 nt, Mycobacterium bovis subsp bovis AF2122/97
cgccguugccgaucaccacg

SEQ ID NO: 3053193 - RNA, 22 nt, Mycobacterium bovis subsp bovis AF2122/97
cgccguugccgaucaccacggc

SEQ ID NO: 3053194 - RNA, 22 nt, Mycobacterium bovis subsp bovis AF2122/97
cgccguugccgaucagcccggc

SEQ ID NO: 3053195 - RNA, 20 nt, Mycobacterium bovis subsp bovis AF2122/97
cgccguugccgauccccagg

SEQ ID NO: 3053196 - RNA, 13 nt, Mycobacterium bovis subsp bovis AF2122/97
cgccguugccgcc

SEQ ID NO: 3053197 - RNA, 14 nt, Mycobacterium bovis subsp bovis AF2122/97
cgccguugccgcca

SEQ ID NO: 3053198 - RNA, 14 nt, Mycobacterium bovis subsp bovis AF2122/97
cgccguugccgccg

SEQ ID NO: 3053199 - RNA, 15 nt, Mycobacterium bovis subsp bovis AF2122/97
cgccguugccgccga

SEQ ID NO: 3053200 - RNA, 16 nt, Mycobacterium bovis subsp bovis AF2122/97
cgccguugccgccgaa

SEQ ID NO: 3053201 - RNA, 17 nt, Mycobacterium bovis subsp bovis AF2122/97
cgccguugccgccgaag

SEQ ID NO: 3053202 - RNA, 23 nt, Mycobacterium bovis subsp bovis AF2122/97
cgccguugccgccgacgccgccg

SEQ ID NO: 3053203 - RNA, 15 nt, Mycobacterium bovis subsp bovis AF2122/97
cgccguugccgccgg

SEQ ID NO: 3053204 - RNA, 16 nt, Mycobacterium bovis subsp bovis AF2122/97
cgccguugccgccggc

SEQ ID NO: 3053205 - RNA, 22 nt, Mycobacterium bovis subsp bovis AF2122/97
cgccguugccgccggcgccgcc

SEQ ID NO: 3053206 - RNA, 20 nt, Mycobacterium bovis subsp bovis AF2122/97
cgccguugccgccgucaccg

SEQ ID NO: 3053207 - RNA, 18 nt, Mycobacterium bovis subsp bovis AF2122/97
cgccguugccgccgucgc

SEQ ID NO: 3053208 - RNA, 14 nt, Mycobacterium bovis subsp bovis AF2122/97
cgccguugccgccu

SEQ ID NO: 3053209 - RNA, 15 nt, Mycobacterium bovis subsp bovis AF2122/97
cgccguugccgccuu

SEQ ID NO: 3053210 - RNA, 16 nt, Mycobacterium bovis subsp bovis AF2122/97
cgccguugccggcgac

SEQ ID NO: 3053211 - RNA, 15 nt, Mycobacterium bovis subsp bovis AF2122/97
cgccguugccggcgu

SEQ ID NO: 3053212 - RNA, 21 nt, Mycobacterium bovis subsp bovis AF2122/97
cgccguugccggcguugccgc

SEQ ID NO: 3053213 - RNA, 23 nt, Mycobacterium bovis subsp bovis AF2122/97
cgccguugccggcguugccgccg

SEQ ID NO: 3053214 - RNA, 18 nt, Mycobacterium bovis subsp bovis AF2122/97
cgccguugccggcuuggc

SEQ ID NO: 3053215 - RNA, 18 nt, Mycobacterium bovis subsp bovis AF2122/97
cgccguugccgucgucgc

SEQ ID NO: 3053216 - RNA, 23 nt, Mycobacterium bovis subsp bovis AF2122/97
cgccguugccguuggugccgccu

SEQ ID NO: 3053217 - RNA, 13 nt, Mycobacterium bovis subsp bovis AF2122/97
cgccguuggcgcc

SEQ ID NO: 3053218 - RNA, 14 nt, Mycobacterium bovis subsp bovis AF2122/97
cgccguuggcgcca

SEQ ID NO: 3053219 - RNA, 15 nt, Mycobacterium bovis subsp bovis AF2122/97
cgccguuggcgccaa

SEQ ID NO: 3053220 - RNA, 23 nt, Mycobacterium bovis subsp bovis AF2122/97
cgccguuggggccguucaaccgg

SEQ ID NO: 3053221 - RNA, 23 nt, Mycobacterium bovis subsp bovis AF2122/97
cgccguugucgaccuccucgacc

SEQ ID NO: 3053222 - RNA, 23 nt, Mycobacterium bovis subsp bovis AF2122/97
cgccguuguugaggaugacgacg

SEQ ID NO: 3053223 - RNA, 17 nt, Mycobacterium bovis subsp bovis AF2122/97
cgccguuuccgccgccg

SEQ ID NO: 3053224 - RNA, 14 nt, Mycobacterium bovis subsp bovis AF2122/97
cgccguuugcgccg

SEQ ID NO: 3053225 - RNA, 15 nt, Mycobacterium bovis subsp bovis AF2122/97
cgccguuugcgccgu

SEQ ID NO: 3053226 - RNA, 20 nt, Mycobacterium bovis subsp bovis AF2122/97
cgccguuuggccucacccgg

SEQ ID NO: 3053227 - RNA, 18 nt, Mycobacterium bovis subsp bovis AF2122/97
cgccuaagcauucagcgc

SEQ ID NO: 3053228 - RNA, 16 nt, Mycobacterium bovis subsp bovis AF2122/97
cgccuaaucggccugc

SEQ ID NO: 3053229 - RNA, 23 nt, Mycobacterium bovis subsp bovis AF2122/97
cgccuaaucggccugccggcagc

SEQ ID NO: 3053230 - RNA, 15 nt, Mycobacterium bovis subsp bovis AF2122/97
cgccuacaccggcgc

SEQ ID NO: 3053231 - RNA, 19 nt, Mycobacterium bovis subsp bovis AF2122/97
cgccuacaccggcgcucaa

SEQ ID NO: 3053232 - RNA, 15 nt, Mycobacterium bovis subsp bovis AF2122/97
cgccuaccagcaccg

SEQ ID NO: 3053233 - RNA, 20 nt, Mycobacterium bovis subsp bovis AF2122/97
cgccuaccagcaccgggaug

SEQ ID NO: 3053234 - RNA, 12 nt, Mycobacterium bovis subsp bovis AF2122/97
cgccuaccgcga

SEQ ID NO: 3053235 - RNA, 14 nt, Mycobacterium bovis subsp bovis AF2122/97
cgccuaccgcgacg

SEQ ID NO: 3053236 - RNA, 22 nt, Mycobacterium bovis subsp bovis AF2122/97
cgccuagcgagcgcacaccggc

SEQ ID NO: 3053237 - RNA, 23 nt, Mycobacterium bovis subsp bovis AF2122/97
cgccuagcgagcgcacaccggcu

SEQ ID NO: 3053238 - RNA, 14 nt, Mycobacterium bovis subsp bovis AF2122/97
cgccucaagcucgc

SEQ ID NO: 3053239 - RNA, 17 nt, Mycobacterium bovis subsp bovis AF2122/97
cgccucaagcucgccgg

SEQ ID NO: 3053240 - RNA, 16 nt, Mycobacterium bovis subsp bovis AF2122/97
cgccucaaugaccacc

SEQ ID NO: 3053241 - RNA, 19 nt, Mycobacterium bovis subsp bovis AF2122/97
cgccucaaugaccaccggg

SEQ ID NO: 3053242 - RNA, 15 nt, Mycobacterium bovis subsp bovis AF2122/97
cgccucaccacgucg

SEQ ID NO: 3053243 - RNA, 12 nt, Mycobacterium bovis subsp bovis AF2122/97
cgccucaccgac

SEQ ID NO: 3053244 - RNA, 17 nt, Mycobacterium bovis subsp bovis AF2122/97
cgccucaccgacgucgc

SEQ ID NO: 3053245 - RNA, 19 nt, Mycobacterium bovis subsp bovis AF2122/97
cgccucaccgacgucgcca

SEQ ID NO: 3053246 - RNA, 16 nt, Mycobacterium bovis subsp bovis AF2122/97
cgccucaccggcgcga

SEQ ID NO: 3053247 - RNA, 14 nt, Mycobacterium bovis subsp bovis AF2122/97
cgccuccaccgccg

SEQ ID NO: 3053248 - RNA, 14 nt, Mycobacterium bovis subsp bovis AF2122/97
cgccuccagcacca

SEQ ID NO: 3053249 - RNA, 16 nt, Mycobacterium bovis subsp bovis AF2122/97
cgccuccagcaccacg

SEQ ID NO: 3053250 - RNA, 20 nt, Mycobacterium bovis subsp bovis AF2122/97
cgccuccagcagguccgcgg

SEQ ID NO: 3053251 - RNA, 23 nt, Mycobacterium bovis subsp bovis AF2122/97
cgccuccagcagguccgcggccg

SEQ ID NO: 3053252 - RNA, 16 nt, Mycobacterium bovis subsp bovis AF2122/97
cgccuccagccggcga

SEQ ID NO: 3053253 - RNA, 15 nt, Mycobacterium bovis subsp bovis AF2122/97
cgccuccaggcgcca

SEQ ID NO: 3053254 - RNA, 18 nt, Mycobacterium bovis subsp bovis AF2122/97
cgccuccaggcgccaccc

SEQ ID NO: 3053255 - RNA, 12 nt, Mycobacterium bovis subsp bovis AF2122/97
cgccuccgccga

SEQ ID NO: 3053256 - RNA, 16 nt, Mycobacterium bovis subsp bovis AF2122/97
cgccuccgccgaggcc

SEQ ID NO: 3053257 - RNA, 19 nt, Mycobacterium bovis subsp bovis AF2122/97
cgccuccgccgaggccgcc

SEQ ID NO: 3053258 - RNA, 19 nt, Mycobacterium bovis subsp bovis AF2122/97
cgccuccggcaccuccagc

SEQ ID NO: 3053259 - RNA, 22 nt, Mycobacterium bovis subsp bovis AF2122/97
cgccugcccccgcgcgcacggc

SEQ ID NO: 3053260 - RNA, 13 nt, Mycobacterium bovis subsp bovis AF2122/97
cgccugcccggcc

SEQ ID NO: 3053261 - RNA, 18 nt, Mycobacterium bovis subsp bovis AF2122/97
cgccugcccggcccgcuc

SEQ ID NO: 3053262 - RNA, 17 nt, Mycobacterium bovis subsp bovis AF2122/97
cgccugcccgggugaga

SEQ ID NO: 3053263 - RNA, 22 nt, Mycobacterium bovis subsp bovis AF2122/97
cgccugccgaaacgccgaccgc

SEQ ID NO: 3053264 - RNA, 13 nt, Mycobacterium bovis subsp bovis AF2122/97
cgccugccgacga

SEQ ID NO: 3053265 - RNA, 18 nt, Mycobacterium bovis subsp bovis AF2122/97
cgccugccgacgaggggc

SEQ ID NO: 3053266 - RNA, 16 nt, Mycobacterium bovis subsp bovis AF2122/97
cgccugccucaccgcc

SEQ ID NO: 3053267 - RNA, 17 nt, Mycobacterium bovis subsp bovis AF2122/97
cgccugccucaccgccg

SEQ ID NO: 3053268 - RNA, 19 nt, Mycobacterium bovis subsp bovis AF2122/97
cgccugcgacagcacgugc

SEQ ID NO: 3053269 - RNA, 23 nt, Mycobacterium bovis subsp bovis AF2122/97
cgccugcgacuaagggcacucca

SEQ ID NO: 3053270 - RNA, 16 nt, Mycobacterium bovis subsp bovis AF2122/97
cgccugcgccacccgc

SEQ ID NO: 3053271 - RNA, 18 nt, Mycobacterium bovis subsp bovis AF2122/97
cgccugcgccacccgcgg

SEQ ID NO: 3053272 - RNA, 16 nt, Mycobacterium bovis subsp bovis AF2122/97
cgccugcgcccagccg

SEQ ID NO: 3053273 - RNA, 14 nt, Mycobacterium bovis subsp bovis AF2122/97
cgccugcgccgcca

SEQ ID NO: 3053274 - RNA, 14 nt, Mycobacterium bovis subsp bovis AF2122/97
cgccugcgccgccc

SEQ ID NO: 3053275 - RNA, 18 nt, Mycobacterium bovis subsp bovis AF2122/97
cgccugcgccgcccgcgc

SEQ ID NO: 3053276 - RNA, 21 nt, Mycobacterium bovis subsp bovis AF2122/97
cgccugcgccuugaagcggug

SEQ ID NO: 3053277 - RNA, 23 nt, Mycobacterium bovis subsp bovis AF2122/97
cgccugcgccuuggucgccggcg

SEQ ID NO: 3053278 - RNA, 18 nt, Mycobacterium bovis subsp bovis AF2122/97
cgccugcgcggcugccgu

SEQ ID NO: 3053279 - RNA, 17 nt, Mycobacterium bovis subsp bovis AF2122/97
cgccugcggcagcaccc

SEQ ID NO: 3053280 - RNA, 17 nt, Mycobacterium bovis subsp bovis AF2122/97
cgccugcuccaccgucg

SEQ ID NO: 3053281 - RNA, 17 nt, Mycobacterium bovis subsp bovis AF2122/97
cgccugcuccucggcca

SEQ ID NO: 3053282 - RNA, 20 nt, Mycobacterium bovis subsp bovis AF2122/97
cgccugcuggccgcggcugg

SEQ ID NO: 3053283 - RNA, 15 nt, Mycobacterium bovis subsp bovis AF2122/97
cgccugcugguaccg

SEQ ID NO: 3053284 - RNA, 14 nt, Mycobacterium bovis subsp bovis AF2122/97
cgccuggacgccgc

SEQ ID NO: 3053285 - RNA, 16 nt, Mycobacterium bovis subsp bovis AF2122/97
cgccuggacgccgccg

SEQ ID NO: 3053286 - RNA, 14 nt, Mycobacterium bovis subsp bovis AF2122/97
cgccuggaucagcg

SEQ ID NO: 3053287 - RNA, 21 nt, Mycobacterium bovis subsp bovis AF2122/97
cgccuggaucagcgcguugag

SEQ ID NO: 3053288 - RNA, 17 nt, Mycobacterium bovis subsp bovis AF2122/97
cgccuggaugccgaucg

SEQ ID NO: 3053289 - RNA, 20 nt, Mycobacterium bovis subsp bovis AF2122/97
cgccuggccggaauacccgc

SEQ ID NO: 3053290 - RNA, 14 nt, Mycobacterium bovis subsp bovis AF2122/97
cgccuggcggcgcc

SEQ ID NO: 3053291 - RNA, 17 nt, Mycobacterium bovis subsp bovis AF2122/97
cgccuggcggcgccgca

SEQ ID NO: 3053292 - RNA, 15 nt, Mycobacterium bovis subsp bovis AF2122/97
cgccuggcuacgcgc

SEQ ID NO: 3053293 - RNA, 17 nt, Mycobacterium bovis subsp bovis AF2122/97
cgccuggcuacgcgcgc

SEQ ID NO: 3053294 - RNA, 16 nt, Mycobacterium bovis subsp bovis AF2122/97
cgccuggcuggccagc

SEQ ID NO: 3053295 - RNA, 18 nt, Mycobacterium bovis subsp bovis AF2122/97
cgccuggcuggccagcug

SEQ ID NO: 3053296 - RNA, 19 nt, Mycobacterium bovis subsp bovis AF2122/97
cgccuggcuggccagcugc

SEQ ID NO: 3053297 - RNA, 17 nt, Mycobacterium bovis subsp bovis AF2122/97
cgccugggcgacgacgu

SEQ ID NO: 3053298 - RNA, 16 nt, Mycobacterium bovis subsp bovis AF2122/97
cgccugggcggccagc

SEQ ID NO: 3053299 - RNA, 18 nt, Mycobacterium bovis subsp bovis AF2122/97
cgccugggcggccagcac

SEQ ID NO: 3053300 - RNA, 19 nt, Mycobacterium bovis subsp bovis AF2122/97
cgccugggcggccagcacg

SEQ ID NO: 3053301 - RNA, 22 nt, Mycobacterium bovis subsp bovis AF2122/97
cgccugggcggccagcacgucg

SEQ ID NO: 3053302 - RNA, 20 nt, Mycobacterium bovis subsp bovis AF2122/97
cgccuggggguucuggccgu

SEQ ID NO: 3053303 - RNA, 14 nt, Mycobacterium bovis subsp bovis AF2122/97
cgccuggucaccga

SEQ ID NO: 3053304 - RNA, 17 nt, Mycobacterium bovis subsp bovis AF2122/97
cgccuggucaccgaaga

SEQ ID NO: 3053305 - RNA, 20 nt, Mycobacterium bovis subsp bovis AF2122/97
cgccugguguacacacccgc

SEQ ID NO: 3053306 - RNA, 21 nt, Mycobacterium bovis subsp bovis AF2122/97
cgccugguguacacacccgcc

SEQ ID NO: 3053307 - RNA, 15 nt, Mycobacterium bovis subsp bovis AF2122/97
cgccuguaccggcgu

SEQ ID NO: 3053308 - RNA, 16 nt, Mycobacterium bovis subsp bovis AF2122/97
cgccuguacggcggcu

SEQ ID NO: 3053309 - RNA, 17 nt, Mycobacterium bovis subsp bovis AF2122/97
cgccugucccgccggcc

SEQ ID NO: 3053310 - RNA, 13 nt, Mycobacterium bovis subsp bovis AF2122/97
cgccugugccacc

SEQ ID NO: 3053311 - RNA, 13 nt, Mycobacterium bovis subsp bovis AF2122/97
cgccugugccgcc

SEQ ID NO: 3053312 - RNA, 16 nt, Mycobacterium bovis subsp bovis AF2122/97
cgccugugccgccggc

SEQ ID NO: 3053313 - RNA, 19 nt, Mycobacterium bovis subsp bovis AF2122/97
cgccugugccgccggcgcc

SEQ ID NO: 3053314 - RNA, 16 nt, Mycobacterium bovis subsp bovis AF2122/97
cgccugugggugcuau

SEQ ID NO: 3053315 - RNA, 18 nt, Mycobacterium bovis subsp bovis AF2122/97
cgccugugggugcuaugc

SEQ ID NO: 3053316 - RNA, 21 nt, Mycobacterium bovis subsp bovis AF2122/97
cgccuguucgggagcugauca

SEQ ID NO: 3053317 - RNA, 21 nt, Mycobacterium bovis subsp bovis AF2122/97
cgccuuacgcaccgaugccuu

SEQ ID NO: 3053318 - RNA, 19 nt, Mycobacterium bovis subsp bovis AF2122/97
cgccuuaggcguccgagcg

SEQ ID NO: 3053319 - RNA, 17 nt, Mycobacterium bovis subsp bovis AF2122/97
cgccuucgccacguucg

SEQ ID NO: 3053320 - RNA, 17 nt, Mycobacterium bovis subsp bovis AF2122/97
cgccuucgccagcggcg

SEQ ID NO: 3053321 - RNA, 19 nt, Mycobacterium bovis subsp bovis AF2122/97
cgccuucucccgcacggcc

SEQ ID NO: 3053322 - RNA, 21 nt, Mycobacterium bovis subsp bovis AF2122/97
cgccuucuuggcaggugccuu

SEQ ID NO: 3053323 - RNA, 17 nt, Mycobacterium bovis subsp bovis AF2122/97
cgccuucuuggcggccu

SEQ ID NO: 3053324 - RNA, 16 nt, Mycobacterium bovis subsp bovis AF2122/97
cgccuugaagcggugg

SEQ ID NO: 3053325 - RNA, 13 nt, Mycobacterium bovis subsp bovis AF2122/97
cgccuugaccaca

SEQ ID NO: 3053326 - RNA, 20 nt, Mycobacterium bovis subsp bovis AF2122/97
cgccuugacugaacucaaca

SEQ ID NO: 3053327 - RNA, 19 nt, Mycobacterium bovis subsp bovis AF2122/97
cgccuugaggcccugcggc

SEQ ID NO: 3053328 - RNA, 14 nt, Mycobacterium bovis subsp bovis AF2122/97
cgccuugaucggcg

SEQ ID NO: 3053329 - RNA, 17 nt, Mycobacterium bovis subsp bovis AF2122/97
cgccuugaucggcgagg

SEQ ID NO: 3053330 - RNA, 15 nt, Mycobacterium bovis subsp bovis AF2122/97
cgccuugcagcgcgu

SEQ ID NO: 3053331 - RNA, 16 nt, Mycobacterium bovis subsp bovis AF2122/97
cgccuugcccagcgac

SEQ ID NO: 3053332 - RNA, 17 nt, Mycobacterium bovis subsp bovis AF2122/97
cgccuugcccagcgaca

SEQ ID NO: 3053333 - RNA, 14 nt, Mycobacterium bovis subsp bovis AF2122/97
cgccuugcgggccu

SEQ ID NO: 3053334 - RNA, 23 nt, Mycobacterium bovis subsp bovis AF2122/97
cgccuugcgggccugguggauga

SEQ ID NO: 3053335 - RNA, 23 nt, Mycobacterium bovis subsp bovis AF2122/97
cgccuugcuuccgggacuaccac

SEQ ID NO: 3053336 - RNA, 13 nt, Mycobacterium bovis subsp bovis AF2122/97
cgccuuggcaccc

SEQ ID NO: 3053337 - RNA, 23 nt, Mycobacterium bovis subsp bovis AF2122/97
cgccuuggccaccaucgccgccg

SEQ ID NO: 3053338 - RNA, 13 nt, Mycobacterium bovis subsp bovis AF2122/97
cgccuuggccccc

SEQ ID NO: 3053339 - RNA, 21 nt, Mycobacterium bovis subsp bovis AF2122/97
cgccuuggucaccuucuuggc

SEQ ID NO: 3053340 - RNA, 21 nt, Mycobacterium bovis subsp bovis AF2122/97
cgccuugguccguagcgcggc

SEQ ID NO: 3053341 - RNA, 15 nt, Mycobacterium bovis subsp bovis AF2122/97
cgccuuggucgccgc

SEQ ID NO: 3053342 - RNA, 16 nt, Mycobacterium bovis subsp bovis AF2122/97
cgccuuggucgccgcc

SEQ ID NO: 3053343 - RNA, 17 nt, Mycobacterium bovis subsp bovis AF2122/97
cgccuuggucgccgccu

SEQ ID NO: 3053344 - RNA, 21 nt, Mycobacterium bovis subsp bovis AF2122/97
cgccuuggucgccgccuucuu

SEQ ID NO: 3053345 - RNA, 15 nt, Mycobacterium bovis subsp bovis AF2122/97
cgcgacaacccggcg

SEQ ID NO: 3053346 - RNA, 16 nt, Mycobacterium bovis subsp bovis AF2122/97
cgcgacaacccggcgu

SEQ ID NO: 3053347 - RNA, 21 nt, Mycobacterium bovis subsp bovis AF2122/97
cgcgacaacccggcgucgacg

SEQ ID NO: 3053348 - RNA, 22 nt, Mycobacterium bovis subsp bovis AF2122/97
cgcgacaauggugcccaggaag

SEQ ID NO: 3053349 - RNA, 12 nt, Mycobacterium bovis subsp bovis AF2122/97
cgcgacaccccg

SEQ ID NO: 3053350 - RNA, 17 nt, Mycobacterium bovis subsp bovis AF2122/97
cgcgacacgccgauucg

SEQ ID NO: 3053351 - RNA, 13 nt, Mycobacterium bovis subsp bovis AF2122/97
cgcgacacgcggc

SEQ ID NO: 3053352 - RNA, 14 nt, Mycobacterium bovis subsp bovis AF2122/97
cgcgacacgcggcc

SEQ ID NO: 3053353 - RNA, 16 nt, Mycobacterium bovis subsp bovis AF2122/97
cgcgacacgcggcccg

SEQ ID NO: 3053354 - RNA, 20 nt, Mycobacterium bovis subsp bovis AF2122/97
cgcgacagacagcaccgccg

SEQ ID NO: 3053355 - RNA, 21 nt, Mycobacterium bovis subsp bovis AF2122/97
cgcgacagacagcaccgccgg

SEQ ID NO: 3053356 - RNA, 23 nt, Mycobacterium bovis subsp bovis AF2122/97
cgcgacagacagcaccgccggug

SEQ ID NO: 3053357 - RNA, 13 nt, Mycobacterium bovis subsp bovis AF2122/97
cgcgacagccacc

SEQ ID NO: 3053358 - RNA, 15 nt, Mycobacterium bovis subsp bovis AF2122/97
cgcgacagccaccuc

SEQ ID NO: 3053359 - RNA, 16 nt, Mycobacterium bovis subsp bovis AF2122/97
cgcgacagccaccucg

SEQ ID NO: 3053360 - RNA, 18 nt, Mycobacterium bovis subsp bovis AF2122/97
cgcgacagccguggcgcg

SEQ ID NO: 3053361 - RNA, 21 nt, Mycobacterium bovis subsp bovis AF2122/97
cgcgacagccguggcgcgacg

SEQ ID NO: 3053362 - RNA, 22 nt, Mycobacterium bovis subsp bovis AF2122/97
cgcgacagccguggcgcgacgu

SEQ ID NO: 3053363 - RNA, 15 nt, Mycobacterium bovis subsp bovis AF2122/97
cgcgacauccgcggc

SEQ ID NO: 3053364 - RNA, 18 nt, Mycobacterium bovis subsp bovis AF2122/97
cgcgacaucgguggcggc

SEQ ID NO: 3053365 - RNA, 13 nt, Mycobacterium bovis subsp bovis AF2122/97
cgcgaccacccgc

SEQ ID NO: 3053366 - RNA, 18 nt, Mycobacterium bovis subsp bovis AF2122/97
cgcgaccaccgccgagcc

SEQ ID NO: 3053367 - RNA, 13 nt, Mycobacterium bovis subsp bovis AF2122/97
cgcgaccacgcac

SEQ ID NO: 3053368 - RNA, 15 nt, Mycobacterium bovis subsp bovis AF2122/97
cgcgaccacgcaccg

SEQ ID NO: 3053369 - RNA, 18 nt, Mycobacterium bovis subsp bovis AF2122/97
cgcgaccacgcaccgccc

SEQ ID NO: 3053370 - RNA, 13 nt, Mycobacterium bovis subsp bovis AF2122/97
cgcgaccagccag

SEQ ID NO: 3053371 - RNA, 16 nt, Mycobacterium bovis subsp bovis AF2122/97
cgcgaccagccagcga

SEQ ID NO: 3053372 - RNA, 12 nt, Mycobacterium bovis subsp bovis AF2122/97
cgcgaccagcgc

SEQ ID NO: 3053373 - RNA, 15 nt, Mycobacterium bovis subsp bovis AF2122/97
cgcgaccagcgccgc

SEQ ID NO: 3053374 - RNA, 12 nt, Mycobacterium bovis subsp bovis AF2122/97
cgcgaccaggaa

SEQ ID NO: 3053375 - RNA, 13 nt, Mycobacterium bovis subsp bovis AF2122/97
cgcgaccaggaag

SEQ ID NO: 3053376 - RNA, 15 nt, Mycobacterium bovis subsp bovis AF2122/97
cgcgaccccaggcgc

SEQ ID NO: 3053377 - RNA, 16 nt, Mycobacterium bovis subsp bovis AF2122/97
cgcgacccgaucgcgc

SEQ ID NO: 3053378 - RNA, 17 nt, Mycobacterium bovis subsp bovis AF2122/97
cgcgacccgaucgcgcc

SEQ ID NO: 3053379 - RNA, 18 nt, Mycobacterium bovis subsp bovis AF2122/97
cgcgacccgaucgcgcca

SEQ ID NO: 3053380 - RNA, 22 nt, Mycobacterium bovis subsp bovis AF2122/97
cgcgacccgaucgcgccaggcc

SEQ ID NO: 3053381 - RNA, 14 nt, Mycobacterium bovis subsp bovis AF2122/97
cgcgacccggccca

SEQ ID NO: 3053382 - RNA, 17 nt, Mycobacterium bovis subsp bovis AF2122/97
cgcgacccggcccagcg

SEQ ID NO: 3053383 - RNA, 19 nt, Mycobacterium bovis subsp bovis AF2122/97
cgcgacccguagcuuggcg

SEQ ID NO: 3053384 - RNA, 15 nt, Mycobacterium bovis subsp bovis AF2122/97
cgcgaccgaccagcc

SEQ ID NO: 3053385 - RNA, 21 nt, Mycobacterium bovis subsp bovis AF2122/97
cgcgaccgaccagccguggug

SEQ ID NO: 3053386 - RNA, 20 nt, Mycobacterium bovis subsp bovis AF2122/97
cgcgaccgcauugagcuggc

SEQ ID NO: 3053387 - RNA, 22 nt, Mycobacterium bovis subsp bovis AF2122/97
cgcgaccgccucgccguagagc

SEQ ID NO: 3053388 - RNA, 21 nt, Mycobacterium bovis subsp bovis AF2122/97
cgcgaccgcgauccccacgau

SEQ ID NO: 3053389 - RNA, 13 nt, Mycobacterium bovis subsp bovis AF2122/97
cgcgaccgcggcg

SEQ ID NO: 3053390 - RNA, 18 nt, Mycobacterium bovis subsp bovis AF2122/97
cgcgaccgcgggccgacg

SEQ ID NO: 3053391 - RNA, 12 nt, Mycobacterium bovis subsp bovis AF2122/97
cgcgaccggcgu

SEQ ID NO: 3053392 - RNA, 22 nt, Mycobacterium bovis subsp bovis AF2122/97
cgcgaccggcguaaccggcagc

SEQ ID NO: 3053393 - RNA, 22 nt, Mycobacterium bovis subsp bovis AF2122/97
cgcgaccgucagggucaccugc

SEQ ID NO: 3053394 - RNA, 13 nt, Mycobacterium bovis subsp bovis AF2122/97
cgcgaccgucugg

SEQ ID NO: 3053395 - RNA, 14 nt, Mycobacterium bovis subsp bovis AF2122/97
cgcgaccucgcggc

SEQ ID NO: 3053396 - RNA, 13 nt, Mycobacterium bovis subsp bovis AF2122/97
cgcgaccucggag

SEQ ID NO: 3053397 - RNA, 17 nt, Mycobacterium bovis subsp bovis AF2122/97
cgcgaccuugcccgcua

SEQ ID NO: 3053398 - RNA, 14 nt, Mycobacterium bovis subsp bovis AF2122/97
cgcgacgacacgcc

SEQ ID NO: 3053399 - RNA, 21 nt, Mycobacterium bovis subsp bovis AF2122/97
cgcgacgagacgcaaaaucgc

SEQ ID NO: 3053400 - RNA, 13 nt, Mycobacterium bovis subsp bovis AF2122/97
cgcgacgagccgc

SEQ ID NO: 3053401 - RNA, 14 nt, Mycobacterium bovis subsp bovis AF2122/97
cgcgacgagccgca

SEQ ID NO: 3053402 - RNA, 15 nt, Mycobacterium bovis subsp bovis AF2122/97
cgcgacgagcggccg

SEQ ID NO: 3053403 - RNA, 12 nt, Mycobacterium bovis subsp bovis AF2122/97
cgcgacgaugcc

SEQ ID NO: 3053404 - RNA, 19 nt, Mycobacterium bovis subsp bovis AF2122/97
cgcgacgaugccccgguug

SEQ ID NO: 3053405 - RNA, 19 nt, Mycobacterium bovis subsp bovis AF2122/97
cgcgacgaugccucggcgg

SEQ ID NO: 3053406 - RNA, 20 nt, Mycobacterium bovis subsp bovis AF2122/97
cgcgacgaugccucggcggc

SEQ ID NO: 3053407 - RNA, 11 nt, Mycobacterium bovis subsp bovis AF2122/97
cgcgacgccgu

SEQ ID NO: 3053408 - RNA, 15 nt, Mycobacterium bovis subsp bovis AF2122/97
cgcgacgcggggcuc

SEQ ID NO: 3053409 - RNA, 16 nt, Mycobacterium bovis subsp bovis AF2122/97
cgcgacgcggggcuca

SEQ ID NO: 3053410 - RNA, 21 nt, Mycobacterium bovis subsp bovis AF2122/97
cgcgacgcucgcugcagcagg

SEQ ID NO: 3053411 - RNA, 22 nt, Mycobacterium bovis subsp bovis AF2122/97
cgcgacggaaccaguugacgaa

SEQ ID NO: 3053412 - RNA, 14 nt, Mycobacterium bovis subsp bovis AF2122/97
cgcgacggcaagca

SEQ ID NO: 3053413 - RNA, 19 nt, Mycobacterium bovis subsp bovis AF2122/97
cgcgacggcacgaucaucg

SEQ ID NO: 3053414 - RNA, 12 nt, Mycobacterium bovis subsp bovis AF2122/97
cgcgacggcagg

SEQ ID NO: 3053415 - RNA, 18 nt, Mycobacterium bovis subsp bovis AF2122/97
cgcgacggcauguaccga

SEQ ID NO: 3053416 - RNA, 23 nt, Mycobacterium bovis subsp bovis AF2122/97
cgcgacggcccgaucccgaucga

SEQ ID NO: 3053417 - RNA, 13 nt, Mycobacterium bovis subsp bovis AF2122/97
cgcgacggcgccg

SEQ ID NO: 3053418 - RNA, 15 nt, Mycobacterium bovis subsp bovis AF2122/97
cgcgacggcgccggc

SEQ ID NO: 3053419 - RNA, 16 nt, Mycobacterium bovis subsp bovis AF2122/97
cgcgacggcgccggca

SEQ ID NO: 3053420 - RNA, 16 nt, Mycobacterium bovis subsp bovis AF2122/97
cgcgacggcgcggugc

SEQ ID NO: 3053421 - RNA, 14 nt, Mycobacterium bovis subsp bovis AF2122/97
cgcgacggcggcuc

SEQ ID NO: 3053422 - RNA, 17 nt, Mycobacterium bovis subsp bovis AF2122/97
cgcgacggcggcucccg

SEQ ID NO: 3053423 - RNA, 19 nt, Mycobacterium bovis subsp bovis AF2122/97
cgcgacgggcacccgagcc

SEQ ID NO: 3053424 - RNA, 13 nt, Mycobacterium bovis subsp bovis AF2122/97
cgcgacgggccgc

SEQ ID NO: 3053425 - RNA, 14 nt, Mycobacterium bovis subsp bovis AF2122/97
cgcgacgggccgcg

SEQ ID NO: 3053426 - RNA, 16 nt, Mycobacterium bovis subsp bovis AF2122/97
cgcgacgggccgcgaa

SEQ ID NO: 3053427 - RNA, 19 nt, Mycobacterium bovis subsp bovis AF2122/97
cgcgacggggucgcgaugc

SEQ ID NO: 3053428 - RNA, 22 nt, Mycobacterium bovis subsp bovis AF2122/97
cgcgacggucaaggugcgccgc

SEQ ID NO: 3053429 - RNA, 22 nt, Mycobacterium bovis subsp bovis AF2122/97
cgcgacgguucgaugaaaaugc

SEQ ID NO: 3053430 - RNA, 12 nt, Mycobacterium bovis subsp bovis AF2122/97
cgcgacguagac

SEQ ID NO: 3053431 - RNA, 15 nt, Mycobacterium bovis subsp bovis AF2122/97
cgcgacguagacgac

SEQ ID NO: 3053432 - RNA, 18 nt, Mycobacterium bovis subsp bovis AF2122/97
cgcgaucccaacgcccgg

SEQ ID NO: 3053433 - RNA, 21 nt, Mycobacterium bovis subsp bovis AF2122/97
cgcgaucccaacgcccgggcg

SEQ ID NO: 3053434 - RNA, 13 nt, Mycobacterium bovis subsp bovis AF2122/97
cgcgauccccacg

SEQ ID NO: 3053435 - RNA, 12 nt, Mycobacterium bovis subsp bovis AF2122/97
cgcgaucgacgc

SEQ ID NO: 3053436 - RNA, 11 nt, Mycobacterium bovis subsp bovis AF2122/97
cgcgaucgcga

SEQ ID NO: 3053437 - RNA, 22 nt, Mycobacterium bovis subsp bovis AF2122/97
cgcgaucgcucauucgugcccg

SEQ ID NO: 3053438 - RNA, 13 nt, Mycobacterium bovis subsp bovis AF2122/97
cgcgaucggcguc

SEQ ID NO: 3053439 - RNA, 19 nt, Mycobacterium bovis subsp bovis AF2122/97
cgcgaucgggcccagcagc

SEQ ID NO: 3053440 - RNA, 20 nt, Mycobacterium bovis subsp bovis AF2122/97
cgcgaucgggcccagcagcg

SEQ ID NO: 3053441 - RNA, 20 nt, Mycobacterium bovis subsp bovis AF2122/97
cgcgaucgggccggcgcggu

SEQ ID NO: 3053442 - RNA, 21 nt, Mycobacterium bovis subsp bovis AF2122/97
cgcgaucgggccggcgcgguc

SEQ ID NO: 3053443 - RNA, 17 nt, Mycobacterium bovis subsp bovis AF2122/97
cgcgaucggugcgggcg

SEQ ID NO: 3053444 - RNA, 20 nt, Mycobacterium bovis subsp bovis AF2122/97
cgcgaucggugcgggcgccg

SEQ ID NO: 3053445 - RNA, 23 nt, Mycobacterium bovis subsp bovis AF2122/97
cgcgaucggugcgggcgccgcua

SEQ ID NO: 3053446 - RNA, 17 nt, Mycobacterium bovis subsp bovis AF2122/97
cgcgaucgucgacucgg

SEQ ID NO: 3053447 - RNA, 22 nt, Mycobacterium bovis subsp bovis AF2122/97
cgcgaucgucggguugucgcgg

SEQ ID NO: 3053448 - RNA, 20 nt, Mycobacterium bovis subsp bovis AF2122/97
cgcgaucuccuuggccguuc

SEQ ID NO: 3053449 - RNA, 14 nt, Mycobacterium bovis subsp bovis AF2122/97
cgcgaucucggagc

SEQ ID NO: 3053450 - RNA, 16 nt, Mycobacterium bovis subsp bovis AF2122/97
cgcgaucucggagcgc

SEQ ID NO: 3053451 - RNA, 18 nt, Mycobacterium bovis subsp bovis AF2122/97
cgcgaucugcucgcccca

SEQ ID NO: 3053452 - RNA, 14 nt, Mycobacterium bovis subsp bovis AF2122/97
cgcgaugaccgcac

SEQ ID NO: 3053453 - RNA, 15 nt, Mycobacterium bovis subsp bovis AF2122/97
cgcgaugaccucggc

SEQ ID NO: 3053454 - RNA, 19 nt, Mycobacterium bovis subsp bovis AF2122/97
cgcgaugaccucggcgaug

SEQ ID NO: 3053455 - RNA, 22 nt, Mycobacterium bovis subsp bovis AF2122/97
cgcgaugaccucggcgaugucg

SEQ ID NO: 3053456 - RNA, 16 nt, Mycobacterium bovis subsp bovis AF2122/97
cgcgaugacgaugucc

SEQ ID NO: 3053457 - RNA, 18 nt, Mycobacterium bovis subsp bovis AF2122/97
cgcgaugacggugccgac

SEQ ID NO: 3053458 - RNA, 13 nt, Mycobacterium bovis subsp bovis AF2122/97
cgcgaugagcggc

SEQ ID NO: 3053459 - RNA, 18 nt, Mycobacterium bovis subsp bovis AF2122/97
cgcgaugaucaugaacgc

SEQ ID NO: 3053460 - RNA, 20 nt, Mycobacterium bovis subsp bovis AF2122/97
cgcgaugaugaguucgcgca

SEQ ID NO: 3053461 - RNA, 14 nt, Mycobacterium bovis subsp bovis AF2122/97
cgcgaugaugaucg

SEQ ID NO: 3053462 - RNA, 18 nt, Mycobacterium bovis subsp bovis AF2122/97
cgcgaugaugaucggguc

SEQ ID NO: 3053463 - RNA, 14 nt, Mycobacterium bovis subsp bovis AF2122/97
cgcgaugauggcgg

SEQ ID NO: 3053464 - RNA, 23 nt, Mycobacterium bovis subsp bovis AF2122/97
cgcgaugcagugcgacccgggcg

SEQ ID NO: 3053465 - RNA, 18 nt, Mycobacterium bovis subsp bovis AF2122/97
cgcgaugccacccaacag

SEQ ID NO: 3053466 - RNA, 19 nt, Mycobacterium bovis subsp bovis AF2122/97
cgcgaugccacccaacagc

SEQ ID NO: 3053467 - RNA, 23 nt, Mycobacterium bovis subsp bovis AF2122/97
cgcgaugccacccaacagcgcua

SEQ ID NO: 3053468 - RNA, 20 nt, Mycobacterium bovis subsp bovis AF2122/97
cgcgaugccccacggugcgg

SEQ ID NO: 3053469 - RNA, 19 nt, Mycobacterium bovis subsp bovis AF2122/97
cgcgaugcgcaccagcggc

SEQ ID NO: 3053470 - RNA, 22 nt, Mycobacterium bovis subsp bovis AF2122/97
cgcgaugcucaaugugccgccg

SEQ ID NO: 3053471 - RNA, 23 nt, Mycobacterium bovis subsp bovis AF2122/97
cgcgaugcucaaugugccgccgg

SEQ ID NO: 3053472 - RNA, 14 nt, Mycobacterium bovis subsp bovis AF2122/97
cgcgauggacccaa

SEQ ID NO: 3053473 - RNA, 13 nt, Mycobacterium bovis subsp bovis AF2122/97
cgcgauggcagcg

SEQ ID NO: 3053474 - RNA, 22 nt, Mycobacterium bovis subsp bovis AF2122/97
cgcgauggccaucaucgacggu

SEQ ID NO: 3053475 - RNA, 22 nt, Mycobacterium bovis subsp bovis AF2122/97
cgcgauggccccugucaugucc

SEQ ID NO: 3053476 - RNA, 18 nt, Mycobacterium bovis subsp bovis AF2122/97
cgcgauggcgcguggucg

SEQ ID NO: 3053477 - RNA, 20 nt, Mycobacterium bovis subsp bovis AF2122/97
cgcgauggcgguccaccggc

SEQ ID NO: 3053478 - RNA, 20 nt, Mycobacterium bovis subsp bovis AF2122/97
cgcgaugggagcccggcggc

SEQ ID NO: 3053479 - RNA, 22 nt, Mycobacterium bovis subsp bovis AF2122/97
cgcgaugggcccagcggccgcg

SEQ ID NO: 3053480 - RNA, 22 nt, Mycobacterium bovis subsp bovis AF2122/97
cgcgauggugcgcccgccggcg

SEQ ID NO: 3053481 - RNA, 14 nt, Mycobacterium bovis subsp bovis AF2122/97
cgcgaugguggccg

SEQ ID NO: 3053482 - RNA, 13 nt, Mycobacterium bovis subsp bovis AF2122/97
cgcgaugucacgg

SEQ ID NO: 3053483 - RNA, 15 nt, Mycobacterium bovis subsp bovis AF2122/97
cgcgauguccaggug

SEQ ID NO: 3053484 - RNA, 21 nt, Mycobacterium bovis subsp bovis AF2122/97
cgcgauguccagguggcgcgg

SEQ ID NO: 3053485 - RNA, 14 nt, Mycobacterium bovis subsp bovis AF2122/97
cgcgauguccucga

SEQ ID NO: 3053486 - RNA, 21 nt, Mycobacterium bovis subsp bovis AF2122/97
cgcgauguccucgagcaccgc

SEQ ID NO: 3053487 - RNA, 22 nt, Mycobacterium bovis subsp bovis AF2122/97
cgcgauguccuuguuggccagu

SEQ ID NO: 3053488 - RNA, 17 nt, Mycobacterium bovis subsp bovis AF2122/97
cgcgaugucgccggcga

SEQ ID NO: 3053489 - RNA, 17 nt, Mycobacterium bovis subsp bovis AF2122/97
cgcgaugugcgccaccu

SEQ ID NO: 3053490 - RNA, 20 nt, Mycobacterium bovis subsp bovis AF2122/97
cgcgaugugcgccaccucga

SEQ ID NO: 3053491 - RNA, 19 nt, Mycobacterium bovis subsp bovis AF2122/97
cgcgaugugggcuaacgac

SEQ ID NO: 3053492 - RNA, 21 nt, Mycobacterium bovis subsp bovis AF2122/97
cgcgauuagcaaaccgaccgu

SEQ ID NO: 3053493 - RNA, 13 nt, Mycobacterium bovis subsp bovis AF2122/97
cgcgauucagaca

SEQ ID NO: 3053494 - RNA, 17 nt, Mycobacterium bovis subsp bovis AF2122/97
cgcgauuccggcggcca

SEQ ID NO: 3053495 - RNA, 17 nt, Mycobacterium bovis subsp bovis AF2122/97
cgcgauucgaccgguga

SEQ ID NO: 3053496 - RNA, 15 nt, Mycobacterium bovis subsp bovis AF2122/97
cgcgauugccgcggu

SEQ ID NO: 3053497 - RNA, 17 nt, Mycobacterium bovis subsp bovis AF2122/97
cgcgcaaaugccugcug

SEQ ID NO: 3053498 - RNA, 18 nt, Mycobacterium bovis subsp bovis AF2122/97
cgcgcaaaugccugcugg

SEQ ID NO: 3053499 - RNA, 21 nt, Mycobacterium bovis subsp bovis AF2122/97
cgcgcaaaugccugcuggucg

SEQ ID NO: 3053500 - RNA, 16 nt, Mycobacterium bovis subsp bovis AF2122/97
cgcgcaacaccucguc

SEQ ID NO: 3053501 - RNA, 17 nt, Mycobacterium bovis subsp bovis AF2122/97
cgcgcaacaccucgucg

SEQ ID NO: 3053502 - RNA, 14 nt, Mycobacterium bovis subsp bovis AF2122/97
cgcgcaaccagauc

SEQ ID NO: 3053503 - RNA, 16 nt, Mycobacterium bovis subsp bovis AF2122/97
cgcgcaacccggacga

SEQ ID NO: 3053504 - RNA, 18 nt, Mycobacterium bovis subsp bovis AF2122/97
cgcgcaacccggacgaac

SEQ ID NO: 3053505 - RNA, 14 nt, Mycobacterium bovis subsp bovis AF2122/97
cgcgcaacccugcc

SEQ ID NO: 3053506 - RNA, 17 nt, Mycobacterium bovis subsp bovis AF2122/97
cgcgcaacccugccgcg

SEQ ID NO: 3053507 - RNA, 21 nt, Mycobacterium bovis subsp bovis AF2122/97
cgcgcaacccugccgcgauga

SEQ ID NO: 3053508 - RNA, 13 nt, Mycobacterium bovis subsp bovis AF2122/97
cgcgcaaccgcuc

SEQ ID NO: 3053509 - RNA, 14 nt, Mycobacterium bovis subsp bovis AF2122/97
cgcgcaaccgcuca

SEQ ID NO: 3053510 - RNA, 15 nt, Mycobacterium bovis subsp bovis AF2122/97
cgcgcaaccgggcgg

SEQ ID NO: 3053511 - RNA, 19 nt, Mycobacterium bovis subsp bovis AF2122/97
cgcgcaaccgggcggacag

SEQ ID NO: 3053512 - RNA, 13 nt, Mycobacterium bovis subsp bovis AF2122/97
cgcgcaacgcugg

SEQ ID NO: 3053513 - RNA, 19 nt, Mycobacterium bovis subsp bovis AF2122/97
cgcgcaacgcuggaggcga

SEQ ID NO: 3053514 - RNA, 20 nt, Mycobacterium bovis subsp bovis AF2122/97
cgcgcaacgcuggaggcgau

SEQ ID NO: 3053515 - RNA, 19 nt, Mycobacterium bovis subsp bovis AF2122/97
cgcgcaacguacgcacgca

SEQ ID NO: 3053516 - RNA, 17 nt, Mycobacterium bovis subsp bovis AF2122/97
cgcgcaacguagccagc

SEQ ID NO: 3053517 - RNA, 21 nt, Mycobacterium bovis subsp bovis AF2122/97
cgcgcaacguagccagcagcg

SEQ ID NO: 3053518 - RNA, 17 nt, Mycobacterium bovis subsp bovis AF2122/97
cgcgccgagcccgggcc

SEQ ID NO: 3053519 - RNA, 17 nt, Mycobacterium bovis subsp bovis AF2122/97
cgcgccgaguugcccgg

SEQ ID NO: 3053520 - RNA, 18 nt, Mycobacterium bovis subsp bovis AF2122/97
cgcgccgaguugcccggg

SEQ ID NO: 3053521 - RNA, 20 nt, Mycobacterium bovis subsp bovis AF2122/97
cgcgccgaucaccaccggca

SEQ ID NO: 3053522 - RNA, 17 nt, Mycobacterium bovis subsp bovis AF2122/97
cgcgccgaucacggugg

SEQ ID NO: 3053523 - RNA, 14 nt, Mycobacterium bovis subsp bovis AF2122/97
cgcgccgaucgagu

SEQ ID NO: 3053524 - RNA, 17 nt, Mycobacterium bovis subsp bovis AF2122/97
cgcgccgaucggcaccg

SEQ ID NO: 3053525 - RNA, 16 nt, Mycobacterium bovis subsp bovis AF2122/97
cgcgccgauuccaccg

SEQ ID NO: 3053526 - RNA, 17 nt, Mycobacterium bovis subsp bovis AF2122/97
cgcgccgauuccaccgc

SEQ ID NO: 3053527 - RNA, 18 nt, Mycobacterium bovis subsp bovis AF2122/97
cgcgccgauuccaccgcc

SEQ ID NO: 3053528 - RNA, 14 nt, Mycobacterium bovis subsp bovis AF2122/97
cgcgccgcacacgu

SEQ ID NO: 3053529 - RNA, 23 nt, Mycobacterium bovis subsp bovis AF2122/97
cgcgccgcacauugguguccacc

SEQ ID NO: 3053530 - RNA, 21 nt, Mycobacterium bovis subsp bovis AF2122/97
cgcgccgcaccaucggcgagg

SEQ ID NO: 3053531 - RNA, 14 nt, Mycobacterium bovis subsp bovis AF2122/97
cgcgccgcacccgg

SEQ ID NO: 3053532 - RNA, 16 nt, Mycobacterium bovis subsp bovis AF2122/97
cgcgccgcacccggga

SEQ ID NO: 3053533 - RNA, 19 nt, Mycobacterium bovis subsp bovis AF2122/97
cgcgccgcagagcaccgcg

SEQ ID NO: 3053534 - RNA, 15 nt, Mycobacterium bovis subsp bovis AF2122/97
cgcgccgcauccagc

SEQ ID NO: 3053535 - RNA, 13 nt, Mycobacterium bovis subsp bovis AF2122/97
cgcgccgccccgc

SEQ ID NO: 3053536 - RNA, 14 nt, Mycobacterium bovis subsp bovis AF2122/97
cgcgccgccgcuac

SEQ ID NO: 3053537 - RNA, 13 nt, Mycobacterium bovis subsp bovis AF2122/97
cgcgccgccggcu

SEQ ID NO: 3053538 - RNA, 14 nt, Mycobacterium bovis subsp bovis AF2122/97
cgcgccgccggcuc

SEQ ID NO: 3053539 - RNA, 15 nt, Mycobacterium bovis subsp bovis AF2122/97
cgcgccgccucgggc

SEQ ID NO: 3053540 - RNA, 16 nt, Mycobacterium bovis subsp bovis AF2122/97
cgcgccgccucgggca

SEQ ID NO: 3053541 - RNA, 20 nt, Mycobacterium bovis subsp bovis AF2122/97
cgcgccgcgaggcaccgaca

SEQ ID NO: 3053542 - RNA, 19 nt, Mycobacterium bovis subsp bovis AF2122/97
cgcgccgcgcaucgcggcc

SEQ ID NO: 3053543 - RNA, 13 nt, Mycobacterium bovis subsp bovis AF2122/97
cgcgccgcgccgc

SEQ ID NO: 3053544 - RNA, 14 nt, Mycobacterium bovis subsp bovis AF2122/97
cgcgccgcgccgcc

SEQ ID NO: 3053545 - RNA, 15 nt, Mycobacterium bovis subsp bovis AF2122/97
cgcgccgcgccgccu

SEQ ID NO: 3053546 - RNA, 16 nt, Mycobacterium bovis subsp bovis AF2122/97
cgcgccgcgcucgccg

SEQ ID NO: 3053547 - RNA, 14 nt, Mycobacterium bovis subsp bovis AF2122/97
cgcgccgcggcccg

SEQ ID NO: 3053548 - RNA, 15 nt, Mycobacterium bovis subsp bovis AF2122/97
cgcgccgcggcccgc

SEQ ID NO: 3053549 - RNA, 21 nt, Mycobacterium bovis subsp bovis AF2122/97
cgcgccgcggcccgcuccacg

SEQ ID NO: 3053550 - RNA, 19 nt, Mycobacterium bovis subsp bovis AF2122/97
cgcgccgcgugguuccggc

SEQ ID NO: 3053551 - RNA, 17 nt, Mycobacterium bovis subsp bovis AF2122/97
cgcgccgcuaaccggac

SEQ ID NO: 3053552 - RNA, 16 nt, Mycobacterium bovis subsp bovis AF2122/97
cgcgccggacagcgca

SEQ ID NO: 3053553 - RNA, 18 nt, Mycobacterium bovis subsp bovis AF2122/97
cgcgccggauguauucca

SEQ ID NO: 3053554 - RNA, 16 nt, Mycobacterium bovis subsp bovis AF2122/97
cgcgccggcacgggcg

SEQ ID NO: 3053555 - RNA, 12 nt, Mycobacterium bovis subsp bovis AF2122/97
cgcgccggcccc

SEQ ID NO: 3053556 - RNA, 13 nt, Mycobacterium bovis subsp bovis AF2122/97
cgcgccggccgca

SEQ ID NO: 3053557 - RNA, 18 nt, Mycobacterium bovis subsp bovis AF2122/97
cgcgccggccgcacgccg

SEQ ID NO: 3053558 - RNA, 13 nt, Mycobacterium bovis subsp bovis AF2122/97
cgcgccggccgcu

SEQ ID NO: 3053559 - RNA, 12 nt, Mycobacterium bovis subsp bovis AF2122/97
cgcgccggcgac

SEQ ID NO: 3053560 - RNA, 15 nt, Mycobacterium bovis subsp bovis AF2122/97
cgcgccggcgacccg

SEQ ID NO: 3053561 - RNA, 21 nt, Mycobacterium bovis subsp bovis AF2122/97
cgcgccggcggaagcggcggc

SEQ ID NO: 3053562 - RNA, 22 nt, Mycobacterium bovis subsp bovis AF2122/97
cgcgccggcggaagcggcggcc

SEQ ID NO: 3053563 - RNA, 12 nt, Mycobacterium bovis subsp bovis AF2122/97
cgcgccggcggc

SEQ ID NO: 3053564 - RNA, 13 nt, Mycobacterium bovis subsp bovis AF2122/97
cgcgccggcggca

SEQ ID NO: 3053565 - RNA, 22 nt, Mycobacterium bovis subsp bovis AF2122/97
cgcgccggcgggcgcgggcgcc

SEQ ID NO: 3053566 - RNA, 12 nt, Mycobacterium bovis subsp bovis AF2122/97
cgcgccggcggu

SEQ ID NO: 3053567 - RNA, 14 nt, Mycobacterium bovis subsp bovis AF2122/97
cgcgccggcgguag

SEQ ID NO: 3053568 - RNA, 13 nt, Mycobacterium bovis subsp bovis AF2122/97
cgcgccggcguug

SEQ ID NO: 3053569 - RNA, 11 nt, Mycobacterium bovis subsp bovis AF2122/97
cgcgccggcuc

SEQ ID NO: 3053570 - RNA, 19 nt, Mycobacterium bovis subsp bovis AF2122/97
cgcgccggcucuccgguga

SEQ ID NO: 3053571 - RNA, 16 nt, Mycobacterium bovis subsp bovis AF2122/97
cgcgccggcugccaca

SEQ ID NO: 3053572 - RNA, 17 nt, Mycobacterium bovis subsp bovis AF2122/97
cgcgccgggcggcgcga

SEQ ID NO: 3053573 - RNA, 14 nt, Mycobacterium bovis subsp bovis AF2122/97
cgcgccggucagca

SEQ ID NO: 3053574 - RNA, 13 nt, Mycobacterium bovis subsp bovis AF2122/97
cgcgccggucgcc

SEQ ID NO: 3053575 - RNA, 17 nt, Mycobacterium bovis subsp bovis AF2122/97
cgcgccggucgccgacg

SEQ ID NO: 3053576 - RNA, 19 nt, Mycobacterium bovis subsp bovis AF2122/97
cgcgccggucgccgacggc

SEQ ID NO: 3053577 - RNA, 12 nt, Mycobacterium bovis subsp bovis AF2122/97
cgcgccggucgu

SEQ ID NO: 3053578 - RNA, 13 nt, Mycobacterium bovis subsp bovis AF2122/97
cgcgccggucguc

SEQ ID NO: 3053579 - RNA, 20 nt, Mycobacterium bovis subsp bovis AF2122/97
cgcgccggugaggcgaccgg

SEQ ID NO: 3053580 - RNA, 17 nt, Mycobacterium bovis subsp bovis AF2122/97
cgcgccgguggucaggu

SEQ ID NO: 3053581 - RNA, 17 nt, Mycobacterium bovis subsp bovis AF2122/97
cgcgccgguuggccagu

SEQ ID NO: 3053582 - RNA, 22 nt, Mycobacterium bovis subsp bovis AF2122/97
cgcgccguaacagccggccgga

SEQ ID NO: 3053583 - RNA, 17 nt, Mycobacterium bovis subsp bovis AF2122/97
cgcgccguacguucacc

SEQ ID NO: 3053584 - RNA, 20 nt, Mycobacterium bovis subsp bovis AF2122/97
cgcgccgucggcgaugaagu

SEQ ID NO: 3053585 - RNA, 22 nt, Mycobacterium bovis subsp bovis AF2122/97
cgcgccgucgucgaccacgacg

SEQ ID NO: 3053586 - RNA, 19 nt, Mycobacterium bovis subsp bovis AF2122/97
cgcgccgucgucgcgcagu

SEQ ID NO: 3053587 - RNA, 23 nt, Mycobacterium bovis subsp bovis AF2122/97
cgcgccguggacgaucaacccgg

SEQ ID NO: 3053588 - RNA, 13 nt, Mycobacterium bovis subsp bovis AF2122/97
cgcgccguucacc

SEQ ID NO: 3053589 - RNA, 23 nt, Mycobacterium bovis subsp bovis AF2122/97
cgcgccguucacccuggugguca

SEQ ID NO: 3053590 - RNA, 19 nt, Mycobacterium bovis subsp bovis AF2122/97
cgcgccguucgccugguca

SEQ ID NO: 3053591 - RNA, 18 nt, Mycobacterium bovis subsp bovis AF2122/97
cgcgccguucugaucugc

SEQ ID NO: 3053592 - RNA, 15 nt, Mycobacterium bovis subsp bovis AF2122/97
cgcgccguugccggc

SEQ ID NO: 3053593 - RNA, 19 nt, Mycobacterium bovis subsp bovis AF2122/97
cgcgccguugccggccacc

SEQ ID NO: 3053594 - RNA, 16 nt, Mycobacterium bovis subsp bovis AF2122/97
cgcgccguuggcgcca

SEQ ID NO: 3053595 - RNA, 14 nt, Mycobacterium bovis subsp bovis AF2122/97
cgcgccugcccggg

SEQ ID NO: 3053596 - RNA, 12 nt, Mycobacterium bovis subsp bovis AF2122/97
cgcgccugccuc

SEQ ID NO: 3053597 - RNA, 13 nt, Mycobacterium bovis subsp bovis AF2122/97
cgcgccugccuca

SEQ ID NO: 3053598 - RNA, 20 nt, Mycobacterium bovis subsp bovis AF2122/97
cgcgccugugccaccgcugg

SEQ ID NO: 3053599 - RNA, 19 nt, Mycobacterium bovis subsp bovis AF2122/97
cgcgccuucacgcuggccu

SEQ ID NO: 3053600 - RNA, 22 nt, Mycobacterium bovis subsp bovis AF2122/97
cgcgccuugauggucuccacca

SEQ ID NO: 3053601 - RNA, 15 nt, Mycobacterium bovis subsp bovis AF2122/97
cgcgccuugcuuccg

SEQ ID NO: 3053602 - RNA, 19 nt, Mycobacterium bovis subsp bovis AF2122/97
cgcgccuugcuuccgggac

SEQ ID NO: 3053603 - RNA, 23 nt, Mycobacterium bovis subsp bovis AF2122/97
cgcgccuuggcacccuccgccgg

SEQ ID NO: 3053604 - RNA, 17 nt, Mycobacterium bovis subsp bovis AF2122/97
cgcgccuuugagcccgc

SEQ ID NO: 3053605 - RNA, 19 nt, Mycobacterium bovis subsp bovis AF2122/97
cgcgcggguuacccgcagc

SEQ ID NO: 3053606 - RNA, 20 nt, Mycobacterium bovis subsp bovis AF2122/97
cgcgcggguuacccgcagcg

SEQ ID NO: 3053607 - RNA, 20 nt, Mycobacterium bovis subsp bovis AF2122/97
cgcgcgguacugcgcagcgc

SEQ ID NO: 3053608 - RNA, 17 nt, Mycobacterium bovis subsp bovis AF2122/97
cgcgcgguagucgucgc

SEQ ID NO: 3053609 - RNA, 22 nt, Mycobacterium bovis subsp bovis AF2122/97
cgcgcggucgagguggcgggcg

SEQ ID NO: 3053610 - RNA, 19 nt, Mycobacterium bovis subsp bovis AF2122/97
cgcgcggugauggucaccg

SEQ ID NO: 3053611 - RNA, 17 nt, Mycobacterium bovis subsp bovis AF2122/97
cgcgcggugcggccacu

SEQ ID NO: 3053612 - RNA, 12 nt, Mycobacterium bovis subsp bovis AF2122/97
cgcgcgguggcg

SEQ ID NO: 3053613 - RNA, 18 nt, Mycobacterium bovis subsp bovis AF2122/97
cgcgcgguuuuucgcagu

SEQ ID NO: 3053614 - RNA, 23 nt, Mycobacterium bovis subsp bovis AF2122/97
cgcgcguaauccgagcgcggcgg

SEQ ID NO: 3053615 - RNA, 14 nt, Mycobacterium bovis subsp bovis AF2122/97
cgcgcguacccgau

SEQ ID NO: 3053616 - RNA, 15 nt, Mycobacterium bovis subsp bovis AF2122/97
cgcgcguagcggggg

SEQ ID NO: 3053617 - RNA, 13 nt, Mycobacterium bovis subsp bovis AF2122/97
cgcgcguccgggc

SEQ ID NO: 3053618 - RNA, 14 nt, Mycobacterium bovis subsp bovis AF2122/97
cgcgcguccgucgg

SEQ ID NO: 3053619 - RNA, 14 nt, Mycobacterium bovis subsp bovis AF2122/97
cgcgcgucgcgagu

SEQ ID NO: 3053620 - RNA, 16 nt, Mycobacterium bovis subsp bovis AF2122/97
cgcgcguggucgcccc

SEQ ID NO: 3053621 - RNA, 17 nt, Mycobacterium bovis subsp bovis AF2122/97
cgcgcguggucgccccg

SEQ ID NO: 3053622 - RNA, 18 nt, Mycobacterium bovis subsp bovis AF2122/97
cgcgcguggucgccccga

SEQ ID NO: 3053623 - RNA, 21 nt, Mycobacterium bovis subsp bovis AF2122/97
cgcgcguggucgccccgauga

SEQ ID NO: 3053624 - RNA, 15 nt, Mycobacterium bovis subsp bovis AF2122/97
cgcgcgugugccuga

SEQ ID NO: 3053625 - RNA, 18 nt, Mycobacterium bovis subsp bovis AF2122/97
cgcgcgugugccugaguu

SEQ ID NO: 3053626 - RNA, 16 nt, Mycobacterium bovis subsp bovis AF2122/97
cgcgcguuccagcaca

SEQ ID NO: 3053627 - RNA, 14 nt, Mycobacterium bovis subsp bovis AF2122/97
cgcgcguucggcga

SEQ ID NO: 3053628 - RNA, 15 nt, Mycobacterium bovis subsp bovis AF2122/97
cgcgcguucggcgcu

SEQ ID NO: 3053629 - RNA, 22 nt, Mycobacterium bovis subsp bovis AF2122/97
cgcgcguucggcgcugaucgcg

SEQ ID NO: 3053630 - RNA, 14 nt, Mycobacterium bovis subsp bovis AF2122/97
cgcgcguugaaguc

SEQ ID NO: 3053631 - RNA, 20 nt, Mycobacterium bovis subsp bovis AF2122/97
cgcgcguugaagucgccggu

SEQ ID NO: 3053632 - RNA, 14 nt, Mycobacterium bovis subsp bovis AF2122/97
cgcgcguugcgguc

SEQ ID NO: 3053633 - RNA, 15 nt, Mycobacterium bovis subsp bovis AF2122/97
cgcgcguugcugguc

SEQ ID NO: 3053634 - RNA, 17 nt, Mycobacterium bovis subsp bovis AF2122/97
cgcgcguuuagucuccg

SEQ ID NO: 3053635 - RNA, 14 nt, Mycobacterium bovis subsp bovis AF2122/97
cgcgcuaaugucga

SEQ ID NO: 3053636 - RNA, 17 nt, Mycobacterium bovis subsp bovis AF2122/97
cgcgcuaccagcucacg

SEQ ID NO: 3053637 - RNA, 20 nt, Mycobacterium bovis subsp bovis AF2122/97
cgcgcuaccagcucacggcg

SEQ ID NO: 3053638 - RNA, 16 nt, Mycobacterium bovis subsp bovis AF2122/97
cgcgcuacgcggccga

SEQ ID NO: 3053639 - RNA, 19 nt, Mycobacterium bovis subsp bovis AF2122/97
cgcgcuacgcggccgaggu

SEQ ID NO: 3053640 - RNA, 21 nt, Mycobacterium bovis subsp bovis AF2122/97
cgcgcuacgucaagccgugcu

SEQ ID NO: 3053641 - RNA, 18 nt, Mycobacterium bovis subsp bovis AF2122/97
cgcgcuaucaugaccacc

SEQ ID NO: 3053642 - RNA, 14 nt, Mycobacterium bovis subsp bovis AF2122/97
cgcgcucaacggcg

SEQ ID NO: 3053643 - RNA, 14 nt, Mycobacterium bovis subsp bovis AF2122/97
cgcgcucaccgggg

SEQ ID NO: 3053644 - RNA, 15 nt, Mycobacterium bovis subsp bovis AF2122/97
cgcgcucaccggggc

SEQ ID NO: 3053645 - RNA, 21 nt, Mycobacterium bovis subsp bovis AF2122/97
cgcgcucaccggggccgucgg

SEQ ID NO: 3053646 - RNA, 24 nt, Mycobacterium bovis subsp bovis AF2122/97
cgcgcucaccggggccgucggcaa

SEQ ID NO: 3053647 - RNA, 16 nt, Mycobacterium bovis subsp bovis AF2122/97
cgcgcucagcuccggc

SEQ ID NO: 3053648 - RNA, 17 nt, Mycobacterium bovis subsp bovis AF2122/97
cgcgcucagcuccggcg

SEQ ID NO: 3053649 - RNA, 13 nt, Mycobacterium bovis subsp bovis AF2122/97
cgcgcucagguca

SEQ ID NO: 3053650 - RNA, 15 nt, Mycobacterium bovis subsp bovis AF2122/97
cgcgcucaucgaccg

SEQ ID NO: 3053651 - RNA, 19 nt, Mycobacterium bovis subsp bovis AF2122/97
cgcgcucaucgaccgcggc

SEQ ID NO: 3053652 - RNA, 18 nt, Mycobacterium bovis subsp bovis AF2122/97
cgcgcucaucgaccgggg

SEQ ID NO: 3053653 - RNA, 17 nt, Mycobacterium bovis subsp bovis AF2122/97
cgcgcucaucgcggcga

SEQ ID NO: 3053654 - RNA, 20 nt, Mycobacterium bovis subsp bovis AF2122/97
cgcgcucauguucucgaccg

SEQ ID NO: 3053655 - RNA, 18 nt, Mycobacterium bovis subsp bovis AF2122/97
cgcgcucauugcaucugc

SEQ ID NO: 3053656 - RNA, 14 nt, Mycobacterium bovis subsp bovis AF2122/97
cgcgcuccagaugg

SEQ ID NO: 3053657 - RNA, 12 nt, Mycobacterium bovis subsp bovis AF2122/97
cgcgcucccggc

SEQ ID NO: 3053658 - RNA, 23 nt, Mycobacterium bovis subsp bovis AF2122/97
cgcgcucgaacuccccggucgcc

SEQ ID NO: 3053659 - RNA, 20 nt, Mycobacterium bovis subsp bovis AF2122/97
cgcgcucgauggcggccacc

SEQ ID NO: 3053660 - RNA, 21 nt, Mycobacterium bovis subsp bovis AF2122/97
cgcgcucgauggcggccacca

SEQ ID NO: 3053661 - RNA, 23 nt, Mycobacterium bovis subsp bovis AF2122/97
cgcgcucgauggcggccaccagc

SEQ ID NO: 3053662 - RNA, 13 nt, Mycobacterium bovis subsp bovis AF2122/97
cgcgcucgcccag

SEQ ID NO: 3053663 - RNA, 15 nt, Mycobacterium bovis subsp bovis AF2122/97
cgcgcucgcccagga

SEQ ID NO: 3053664 - RNA, 12 nt, Mycobacterium bovis subsp bovis AF2122/97
cgcgcucgccgg

SEQ ID NO: 3053665 - RNA, 12 nt, Mycobacterium bovis subsp bovis AF2122/97
cgcgcucgcgca

SEQ ID NO: 3053666 - RNA, 13 nt, Mycobacterium bovis subsp bovis AF2122/97
cgcgcucgcgcaa

SEQ ID NO: 3053667 - RNA, 16 nt, Mycobacterium bovis subsp bovis AF2122/97
cgcgcucgcgcgguag

SEQ ID NO: 3053668 - RNA, 14 nt, Mycobacterium bovis subsp bovis AF2122/97
cgcgcucgcucacc

SEQ ID NO: 3053669 - RNA, 16 nt, Mycobacterium bovis subsp bovis AF2122/97
cgcgcucgcucaccgg

SEQ ID NO: 3053670 - RNA, 17 nt, Mycobacterium bovis subsp bovis AF2122/97
cgcgcucgcucaccggc

SEQ ID NO: 3053671 - RNA, 18 nt, Mycobacterium bovis subsp bovis AF2122/97
cgcgcucgcucaccggcg

SEQ ID NO: 3053672 - RNA, 18 nt, Mycobacterium bovis subsp bovis AF2122/97
cgcgcucgcucaccggcu

SEQ ID NO: 3053673 - RNA, 22 nt, Mycobacterium bovis subsp bovis AF2122/97
cgcgcucgcucaccggcuggug

SEQ ID NO: 3053674 - RNA, 15 nt, Mycobacterium bovis subsp bovis AF2122/97
cgcgcucggccagca

SEQ ID NO: 3053675 - RNA, 17 nt, Mycobacterium bovis subsp bovis AF2122/97
cgcgcucggugccgccc

SEQ ID NO: 3053676 - RNA, 16 nt, Mycobacterium bovis subsp bovis AF2122/97
cgcgcugaaccagaug

SEQ ID NO: 3053677 - RNA, 22 nt, Mycobacterium bovis subsp bovis AF2122/97
cgcgcugaaucaccccggcggc

SEQ ID NO: 3053678 - RNA, 12 nt, Mycobacterium bovis subsp bovis AF2122/97
cgcgcugagcac

SEQ ID NO: 3053679 - RNA, 13 nt, Mycobacterium bovis subsp bovis AF2122/97
cgcgcugagcgac

SEQ ID NO: 3053680 - RNA, 16 nt, Mycobacterium bovis subsp bovis AF2122/97
cgcgcugagcucgaug

SEQ ID NO: 3053681 - RNA, 16 nt, Mycobacterium bovis subsp bovis AF2122/97
cgcgcugagguggcgg

SEQ ID NO: 3053682 - RNA, 14 nt, Mycobacterium bovis subsp bovis AF2122/97
cgcgcugcagcacg

SEQ ID NO: 3053683 - RNA, 15 nt, Mycobacterium bovis subsp bovis AF2122/97
cgcgcugcagcacgg

SEQ ID NO: 3053684 - RNA, 21 nt, Mycobacterium bovis subsp bovis AF2122/97
cgcgcugccaguucuuggcga

SEQ ID NO: 3053685 - RNA, 13 nt, Mycobacterium bovis subsp bovis AF2122/97
cgcgcugccgacu

SEQ ID NO: 3053686 - RNA, 18 nt, Mycobacterium bovis subsp bovis AF2122/97
cgcgcugccgacuccucg

SEQ ID NO: 3053687 - RNA, 12 nt, Mycobacterium bovis subsp bovis AF2122/97
cgcgcugccggc

SEQ ID NO: 3053688 - RNA, 13 nt, Mycobacterium bovis subsp bovis AF2122/97
cgcgcugccggcc

SEQ ID NO: 3053689 - RNA, 17 nt, Mycobacterium bovis subsp bovis AF2122/97
cgcgcugccggccgcgu

SEQ ID NO: 3053690 - RNA, 12 nt, Mycobacterium bovis subsp bovis AF2122/97
cgcgcugcgcag

SEQ ID NO: 3053691 - RNA, 19 nt, Mycobacterium bovis subsp bovis AF2122/97
cgcgcugcggcccacacca

SEQ ID NO: 3053692 - RNA, 21 nt, Mycobacterium bovis subsp bovis AF2122/97
cgcggaucaccaucgccgccg

SEQ ID NO: 3053693 - RNA, 22 nt, Mycobacterium bovis subsp bovis AF2122/97
cgcggaucaccaucgccgccgc

SEQ ID NO: 3053694 - RNA, 20 nt, Mycobacterium bovis subsp bovis AF2122/97
cgcggaucagcccgcgcagc

SEQ ID NO: 3053695 - RNA, 21 nt, Mycobacterium bovis subsp bovis AF2122/97
cgcggaucagcccgcgcagca

SEQ ID NO: 3053696 - RNA, 19 nt, Mycobacterium bovis subsp bovis AF2122/97
cgcggauccgggcguggug

SEQ ID NO: 3053697 - RNA, 15 nt, Mycobacterium bovis subsp bovis AF2122/97
cgcggaucgaccgcc

SEQ ID NO: 3053698 - RNA, 19 nt, Mycobacterium bovis subsp bovis AF2122/97
cgcggaucgaccgccagcg

SEQ ID NO: 3053699 - RNA, 14 nt, Mycobacterium bovis subsp bovis AF2122/97
cgcggaucggcggc

SEQ ID NO: 3053700 - RNA, 16 nt, Mycobacterium bovis subsp bovis AF2122/97
cgcggaucggcggccg

SEQ ID NO: 3053701 - RNA, 17 nt, Mycobacterium bovis subsp bovis AF2122/97
cgcggaucggcggccgc

SEQ ID NO: 3053702 - RNA, 18 nt, Mycobacterium bovis subsp bovis AF2122/97
cgcggaucggcggccgcg

SEQ ID NO: 3053703 - RNA, 15 nt, Mycobacterium bovis subsp bovis AF2122/97
cgcggaucugggcgg

SEQ ID NO: 3053704 - RNA, 18 nt, Mycobacterium bovis subsp bovis AF2122/97
cgcggaucugggcggccu

SEQ ID NO: 3053705 - RNA, 19 nt, Mycobacterium bovis subsp bovis AF2122/97
cgcggaucugguccagugg

SEQ ID NO: 3053706 - RNA, 23 nt, Mycobacterium bovis subsp bovis AF2122/97
cgcggaugauguaaccguagccc

SEQ ID NO: 3053707 - RNA, 15 nt, Mycobacterium bovis subsp bovis AF2122/97
cgcggaugcauguca

SEQ ID NO: 3053708 - RNA, 20 nt, Mycobacterium bovis subsp bovis AF2122/97
cgcggaugcucaggucaccg

SEQ ID NO: 3053709 - RNA, 24 nt, Mycobacterium bovis subsp bovis AF2122/97
cgcggaugcucaggucaccggccg

SEQ ID NO: 3053710 - RNA, 14 nt, Mycobacterium bovis subsp bovis AF2122/97
cgcggaugcucguu

SEQ ID NO: 3053711 - RNA, 17 nt, Mycobacterium bovis subsp bovis AF2122/97
cgcggauggccucggcg

SEQ ID NO: 3053712 - RNA, 21 nt, Mycobacterium bovis subsp bovis AF2122/97
cgcggauggguacgacaccgc

SEQ ID NO: 3053713 - RNA, 16 nt, Mycobacterium bovis subsp bovis AF2122/97
cgcggauguccaggag

SEQ ID NO: 3053714 - RNA, 21 nt, Mycobacterium bovis subsp bovis AF2122/97
cgcggauguccaggagugcgg

SEQ ID NO: 3053715 - RNA, 15 nt, Mycobacterium bovis subsp bovis AF2122/97
cgcggauuccagcgc

SEQ ID NO: 3053716 - RNA, 23 nt, Mycobacterium bovis subsp bovis AF2122/97
cgcggauuccagcgcguaguccg

SEQ ID NO: 3053717 - RNA, 12 nt, Mycobacterium bovis subsp bovis AF2122/97
cgcggauuccgg

SEQ ID NO: 3053718 - RNA, 15 nt, Mycobacterium bovis subsp bovis AF2122/97
cgcggauuccggcuc

SEQ ID NO: 3053719 - RNA, 18 nt, Mycobacterium bovis subsp bovis AF2122/97
cgcggauugccgcgcgca

SEQ ID NO: 3053720 - RNA, 22 nt, Mycobacterium bovis subsp bovis AF2122/97
cgcggauugccgcgcgcaagcc

SEQ ID NO: 3053721 - RNA, 16 nt, Mycobacterium bovis subsp bovis AF2122/97
cgcggauuucgccgug

SEQ ID NO: 3053722 - RNA, 18 nt, Mycobacterium bovis subsp bovis AF2122/97
cgcggauuucgccgugau

SEQ ID NO: 3053723 - RNA, 20 nt, Mycobacterium bovis subsp bovis AF2122/97
cgcggauuucgccgugauga

SEQ ID NO: 3053724 - RNA, 22 nt, Mycobacterium bovis subsp bovis AF2122/97
cgcggcaaaccugaguccggca

SEQ ID NO: 3053725 - RNA, 19 nt, Mycobacterium bovis subsp bovis AF2122/97
cgcggcaaaguuggccgcc

SEQ ID NO: 3053726 - RNA, 13 nt, Mycobacterium bovis subsp bovis AF2122/97
cgcggcaacacca

SEQ ID NO: 3053727 - RNA, 18 nt, Mycobacterium bovis subsp bovis AF2122/97
cgcggcaacuccggucaa

SEQ ID NO: 3053728 - RNA, 12 nt, Mycobacterium bovis subsp bovis AF2122/97
cgcggcaagagu

SEQ ID NO: 3053729 - RNA, 19 nt, Mycobacterium bovis subsp bovis AF2122/97
cgcggcaagaguugccgga

SEQ ID NO: 3053730 - RNA, 22 nt, Mycobacterium bovis subsp bovis AF2122/97
cgcggcaagaguugccggaucg

SEQ ID NO: 3053731 - RNA, 20 nt, Mycobacterium bovis subsp bovis AF2122/97
cgcggcaaucucaugcccgg

SEQ ID NO: 3053732 - RNA, 22 nt, Mycobacterium bovis subsp bovis AF2122/97
cgcggcaaucucaugcccggga

SEQ ID NO: 3053733 - RNA, 16 nt, Mycobacterium bovis subsp bovis AF2122/97
cgcggcaaugaggccg

SEQ ID NO: 3053734 - RNA, 23 nt, Mycobacterium bovis subsp bovis AF2122/97
cgcggcaauugcgguucgaacgc

SEQ ID NO: 3053735 - RNA, 12 nt, Mycobacterium bovis subsp bovis AF2122/97
cgcggcaccacg

SEQ ID NO: 3053736 - RNA, 16 nt, Mycobacterium bovis subsp bovis AF2122/97
cgcggcaccacgucga

SEQ ID NO: 3053737 - RNA, 17 nt, Mycobacterium bovis subsp bovis AF2122/97
cgcggcaccacgucgac

SEQ ID NO: 3053738 - RNA, 20 nt, Mycobacterium bovis subsp bovis AF2122/97
cgcggcacccaaccaggccg

SEQ ID NO: 3053739 - RNA, 22 nt, Mycobacterium bovis subsp bovis AF2122/97
cgcggcacccaaccaggccgcg

SEQ ID NO: 3053740 - RNA, 14 nt, Mycobacterium bovis subsp bovis AF2122/97
cgcggcacccgguc

SEQ ID NO: 3053741 - RNA, 16 nt, Mycobacterium bovis subsp bovis AF2122/97
cgcggcaccgauggcg

SEQ ID NO: 3053742 - RNA, 18 nt, Mycobacterium bovis subsp bovis AF2122/97
cgcggcaccgauggcgca

SEQ ID NO: 3053743 - RNA, 20 nt, Mycobacterium bovis subsp bovis AF2122/97
cgcggcaccgauggcgcacc

SEQ ID NO: 3053744 - RNA, 23 nt, Mycobacterium bovis subsp bovis AF2122/97
cgcggcaccgauggcgcaccggc

SEQ ID NO: 3053745 - RNA, 20 nt, Mycobacterium bovis subsp bovis AF2122/97
cgcggcaccgccccgccaac

SEQ ID NO: 3053746 - RNA, 14 nt, Mycobacterium bovis subsp bovis AF2122/97
cgcggcaccgccga

SEQ ID NO: 3053747 - RNA, 17 nt, Mycobacterium bovis subsp bovis AF2122/97
cgcggcaccgccgagca

SEQ ID NO: 3053748 - RNA, 14 nt, Mycobacterium bovis subsp bovis AF2122/97
cgcggcaccuucgg

SEQ ID NO: 3053749 - RNA, 21 nt, Mycobacterium bovis subsp bovis AF2122/97
cgcggcacgaucaaccggguc

SEQ ID NO: 3053750 - RNA, 17 nt, Mycobacterium bovis subsp bovis AF2122/97
cgcggcacgcccacagc

SEQ ID NO: 3053751 - RNA, 14 nt, Mycobacterium bovis subsp bovis AF2122/97
cgcggcacgcucca

SEQ ID NO: 3053752 - RNA, 17 nt, Mycobacterium bovis subsp bovis AF2122/97
cgcggcacgcuccagcu

SEQ ID NO: 3053753 - RNA, 18 nt, Mycobacterium bovis subsp bovis AF2122/97
cgcggcacgcuccagcuc

SEQ ID NO: 3053754 - RNA, 18 nt, Mycobacterium bovis subsp bovis AF2122/97
cgcggcagcauccucgac

SEQ ID NO: 3053755 - RNA, 14 nt, Mycobacterium bovis subsp bovis AF2122/97
cgcggcagccggcg

SEQ ID NO: 3053756 - RNA, 16 nt, Mycobacterium bovis subsp bovis AF2122/97
cgcggcagccggcgga

SEQ ID NO: 3053757 - RNA, 14 nt, Mycobacterium bovis subsp bovis AF2122/97
cgcggcaggccggu

SEQ ID NO: 3053758 - RNA, 14 nt, Mycobacterium bovis subsp bovis AF2122/97
cgcggcaggccugg

SEQ ID NO: 3053759 - RNA, 20 nt, Mycobacterium bovis subsp bovis AF2122/97
cgcggcaggccuggcgagcc

SEQ ID NO: 3053760 - RNA, 12 nt, Mycobacterium bovis subsp bovis AF2122/97
cgcggcagggcg

SEQ ID NO: 3053761 - RNA, 14 nt, Mycobacterium bovis subsp bovis AF2122/97
cgcggcagggcggu

SEQ ID NO: 3053762 - RNA, 18 nt, Mycobacterium bovis subsp bovis AF2122/97
cgcggcagggcggugcca

SEQ ID NO: 3053763 - RNA, 21 nt, Mycobacterium bovis subsp bovis AF2122/97
cgcggcagggcggugccaucg

SEQ ID NO: 3053764 - RNA, 18 nt, Mycobacterium bovis subsp bovis AF2122/97
cgcggcagguugcguugc

SEQ ID NO: 3053765 - RNA, 22 nt, Mycobacterium bovis subsp bovis AF2122/97
cgcggcagguugcguugcagga

SEQ ID NO: 3053766 - RNA, 18 nt, Mycobacterium bovis subsp bovis AF2122/97
cgcggcaucccgccacac

SEQ ID NO: 3053767 - RNA, 21 nt, Mycobacterium bovis subsp bovis AF2122/97
cgcggcaucccgccacaccaa

SEQ ID NO: 3053768 - RNA, 22 nt, Mycobacterium bovis subsp bovis AF2122/97
cgcggcaucgaauuccagccag

SEQ ID NO: 3053769 - RNA, 13 nt, Mycobacterium bovis subsp bovis AF2122/97
cgcggcaucgacg

SEQ ID NO: 3053770 - RNA, 19 nt, Mycobacterium bovis subsp bovis AF2122/97
cgcggcaucgacgcggcca

SEQ ID NO: 3053771 - RNA, 22 nt, Mycobacterium bovis subsp bovis AF2122/97
cgcggcaugcaaugcuggcggc

SEQ ID NO: 3053772 - RNA, 23 nt, Mycobacterium bovis subsp bovis AF2122/97
cgcggcaugcaaugcuggcggcg

SEQ ID NO: 3053773 - RNA, 21 nt, Mycobacterium bovis subsp bovis AF2122/97
cgcggccaaucagcccgccgg

SEQ ID NO: 3053774 - RNA, 23 nt, Mycobacterium bovis subsp bovis AF2122/97
cgcggccaaucagcccgccggac

SEQ ID NO: 3053775 - RNA, 14 nt, Mycobacterium bovis subsp bovis AF2122/97
cgcggccaauggcc

SEQ ID NO: 3053776 - RNA, 17 nt, Mycobacterium bovis subsp bovis AF2122/97
cgcggccaauggccgcg

SEQ ID NO: 3053777 - RNA, 20 nt, Mycobacterium bovis subsp bovis AF2122/97
cgcggccaauugcgccgcca

SEQ ID NO: 3053778 - RNA, 22 nt, Mycobacterium bovis subsp bovis AF2122/97
cgcggcgaagcaagugaauacc

SEQ ID NO: 3053779 - RNA, 17 nt, Mycobacterium bovis subsp bovis AF2122/97
cgcggcgaagccgggug

SEQ ID NO: 3053780 - RNA, 19 nt, Mycobacterium bovis subsp bovis AF2122/97
cgcggcgaagugcacccgg

SEQ ID NO: 3053781 - RNA, 20 nt, Mycobacterium bovis subsp bovis AF2122/97
cgcggcgacaagccgagccc

SEQ ID NO: 3053782 - RNA, 24 nt, Mycobacterium bovis subsp bovis AF2122/97
cgcggcgacaagccgagcccgucg

SEQ ID NO: 3053783 - RNA, 14 nt, Mycobacterium bovis subsp bovis AF2122/97
cgcggcgacccggu

SEQ ID NO: 3053784 - RNA, 13 nt, Mycobacterium bovis subsp bovis AF2122/97
cgcggcgaccugu

SEQ ID NO: 3053785 - RNA, 16 nt, Mycobacterium bovis subsp bovis AF2122/97
cgcggcgacgacggcc

SEQ ID NO: 3053786 - RNA, 17 nt, Mycobacterium bovis subsp bovis AF2122/97
cgcggcgacgacggccu

SEQ ID NO: 3053787 - RNA, 23 nt, Mycobacterium bovis subsp bovis AF2122/97
cgcggcgacgacggccugcgagu

SEQ ID NO: 3053788 - RNA, 18 nt, Mycobacterium bovis subsp bovis AF2122/97
cgcggcgagcaccacccc

SEQ ID NO: 3053789 - RNA, 16 nt, Mycobacterium bovis subsp bovis AF2122/97
cgcggcgagcuccgau

SEQ ID NO: 3053790 - RNA, 14 nt, Mycobacterium bovis subsp bovis AF2122/97
cgcggcgaguggcu

SEQ ID NO: 3053791 - RNA, 20 nt, Mycobacterium bovis subsp bovis AF2122/97
cgcggcgaucgaggugacgg

SEQ ID NO: 3053792 - RNA, 12 nt, Mycobacterium bovis subsp bovis AF2122/97
cgcggcgaucgc

SEQ ID NO: 3053793 - RNA, 23 nt, Mycobacterium bovis subsp bovis AF2122/97
cgcggcgaucgcuccgcggcgca

SEQ ID NO: 3053794 - RNA, 23 nt, Mycobacterium bovis subsp bovis AF2122/97
cgcggcgaucugcgacaagaccg

SEQ ID NO: 3053795 - RNA, 19 nt, Mycobacterium bovis subsp bovis AF2122/97
cgcggcgaugauggcgcga

SEQ ID NO: 3053796 - RNA, 18 nt, Mycobacterium bovis subsp bovis AF2122/97
cgcggcgauuacggccag

SEQ ID NO: 3053797 - RNA, 19 nt, Mycobacterium bovis subsp bovis AF2122/97
cgcggcgauuacggccagu

SEQ ID NO: 3053798 - RNA, 19 nt, Mycobacterium bovis subsp bovis AF2122/97
cgcggcgcacaacccgucg

SEQ ID NO: 3053799 - RNA, 13 nt, Mycobacterium bovis subsp bovis AF2122/97
cgcggcgcagcac

SEQ ID NO: 3053800 - RNA, 17 nt, Mycobacterium bovis subsp bovis AF2122/97
cgcggcgcagcaccguc

SEQ ID NO: 3053801 - RNA, 17 nt, Mycobacterium bovis subsp bovis AF2122/97
cgcggcgcagcacggcg

SEQ ID NO: 3053802 - RNA, 17 nt, Mycobacterium bovis subsp bovis AF2122/97
cgcggcgcaggucgcgc

SEQ ID NO: 3053803 - RNA, 19 nt, Mycobacterium bovis subsp bovis AF2122/97
cgcggcgcaggucgcgcag

SEQ ID NO: 3053804 - RNA, 18 nt, Mycobacterium bovis subsp bovis AF2122/97
cgcggcgcauuccggcgc

SEQ ID NO: 3053805 - RNA, 16 nt, Mycobacterium bovis subsp bovis AF2122/97
cgcggcgccauagccg

SEQ ID NO: 3053806 - RNA, 14 nt, Mycobacterium bovis subsp bovis AF2122/97
cgcggcgcccagga

SEQ ID NO: 3053807 - RNA, 17 nt, Mycobacterium bovis subsp bovis AF2122/97
cgcggcgcccuggccgc

SEQ ID NO: 3053808 - RNA, 12 nt, Mycobacterium bovis subsp bovis AF2122/97
cgcggcgccgcc

SEQ ID NO: 3053809 - RNA, 13 nt, Mycobacterium bovis subsp bovis AF2122/97
cgcggcgccgcca

SEQ ID NO: 3053810 - RNA, 14 nt, Mycobacterium bovis subsp bovis AF2122/97
cgcggcgccggugg

SEQ ID NO: 3053811 - RNA, 19 nt, Mycobacterium bovis subsp bovis AF2122/97
cgcggcgccgucgucagcg

SEQ ID NO: 3053812 - RNA, 15 nt, Mycobacterium bovis subsp bovis AF2122/97
cgcggcgcgacggca

SEQ ID NO: 3053813 - RNA, 15 nt, Mycobacterium bovis subsp bovis AF2122/97
cgcggcgcgaucguc

SEQ ID NO: 3053814 - RNA, 17 nt, Mycobacterium bovis subsp bovis AF2122/97
cgcggcgcgaucgucgg

SEQ ID NO: 3053815 - RNA, 18 nt, Mycobacterium bovis subsp bovis AF2122/97
cgcggcgcgcaggaccug

SEQ ID NO: 3053816 - RNA, 14 nt, Mycobacterium bovis subsp bovis AF2122/97
cgcggcgcgcugaa

SEQ ID NO: 3053817 - RNA, 12 nt, Mycobacterium bovis subsp bovis AF2122/97
cgcggcgcggcc

SEQ ID NO: 3053818 - RNA, 15 nt, Mycobacterium bovis subsp bovis AF2122/97
cgcggcgcggccgca

SEQ ID NO: 3053819 - RNA, 18 nt, Mycobacterium bovis subsp bovis AF2122/97
cgcggcgcugaugccguc

SEQ ID NO: 3053820 - RNA, 18 nt, Mycobacterium bovis subsp bovis AF2122/97
cgcggcgcuggcugcggu

SEQ ID NO: 3053821 - RNA, 17 nt, Mycobacterium bovis subsp bovis AF2122/97
cgcggcggagccgggug

SEQ ID NO: 3053822 - RNA, 17 nt, Mycobacterium bovis subsp bovis AF2122/97
cgcggcggagugcaugu

SEQ ID NO: 3053823 - RNA, 20 nt, Mycobacterium bovis subsp bovis AF2122/97
cgcggcggagugcauguccg

SEQ ID NO: 3053824 - RNA, 19 nt, Mycobacterium bovis subsp bovis AF2122/97
cgcggcggcagcggcgauc

SEQ ID NO: 3053825 - RNA, 15 nt, Mycobacterium bovis subsp bovis AF2122/97
cgcggcggccagcgc

SEQ ID NO: 3053826 - RNA, 16 nt, Mycobacterium bovis subsp bovis AF2122/97
cgcggcggccagcgca

SEQ ID NO: 3053827 - RNA, 14 nt, Mycobacterium bovis subsp bovis AF2122/97
cgcggcggccccgc

SEQ ID NO: 3053828 - RNA, 17 nt, Mycobacterium bovis subsp bovis AF2122/97
cgcggcggccgcggcuu

SEQ ID NO: 3053829 - RNA, 16 nt, Mycobacterium bovis subsp bovis AF2122/97
cgcggcggccuccacc

SEQ ID NO: 3053830 - RNA, 18 nt, Mycobacterium bovis subsp bovis AF2122/97
cgcggcggccuccaccac

SEQ ID NO: 3053831 - RNA, 12 nt, Mycobacterium bovis subsp bovis AF2122/97
cgcggcggcgcc

SEQ ID NO: 3053832 - RNA, 16 nt, Mycobacterium bovis subsp bovis AF2122/97
cgcggcggcgccggcg

SEQ ID NO: 3053833 - RNA, 12 nt, Mycobacterium bovis subsp bovis AF2122/97
cgcggcggcgcu

SEQ ID NO: 3053834 - RNA, 20 nt, Mycobacterium bovis subsp bovis AF2122/97
cgcggcggcgcuggcgggca

SEQ ID NO: 3053835 - RNA, 13 nt, Mycobacterium bovis subsp bovis AF2122/97
cgcggcggcggcc

SEQ ID NO: 3053836 - RNA, 19 nt, Mycobacterium bovis subsp bovis AF2122/97
cgcggcggcguccaccugc

SEQ ID NO: 3053837 - RNA, 13 nt, Mycobacterium bovis subsp bovis AF2122/97
cgcggcggcgucg

SEQ ID NO: 3053838 - RNA, 14 nt, Mycobacterium bovis subsp bovis AF2122/97
cgcggcggcgugcu

SEQ ID NO: 3053839 - RNA, 12 nt, Mycobacterium bovis subsp bovis AF2122/97
cgcggcgggccc

SEQ ID NO: 3053840 - RNA, 20 nt, Mycobacterium bovis subsp bovis AF2122/97
cgcggcggguccucgcggag

SEQ ID NO: 3053841 - RNA, 23 nt, Mycobacterium bovis subsp bovis AF2122/97
cgcggcggucagucccgugacga

SEQ ID NO: 3053842 - RNA, 12 nt, Mycobacterium bovis subsp bovis AF2122/97
cgcggcggucgu

SEQ ID NO: 3053843 - RNA, 17 nt, Mycobacterium bovis subsp bovis AF2122/97
cgcggcggucuggguga

SEQ ID NO: 3053844 - RNA, 21 nt, Mycobacterium bovis subsp bovis AF2122/97
cgcggcgguuaucgucggguc

SEQ ID NO: 3053845 - RNA, 12 nt, Mycobacterium bovis subsp bovis AF2122/97
cgcggcgucgau

SEQ ID NO: 3053846 - RNA, 18 nt, Mycobacterium bovis subsp bovis AF2122/97
cgcggcgucggucgggug

SEQ ID NO: 3053847 - RNA, 13 nt, Mycobacterium bovis subsp bovis AF2122/97
cgcggcgugcgcg

SEQ ID NO: 3053848 - RNA, 16 nt, Mycobacterium bovis subsp bovis AF2122/97
cgcggcgugcgcggug

SEQ ID NO: 3053849 - RNA, 17 nt, Mycobacterium bovis subsp bovis AF2122/97
cgcggcgugcgcgguga

SEQ ID NO: 3053850 - RNA, 16 nt, Mycobacterium bovis subsp bovis AF2122/97
cgcggcguguacgucg

SEQ ID NO: 3053851 - RNA, 17 nt, Mycobacterium bovis subsp bovis AF2122/97
cgcggcguguacgucga

SEQ ID NO: 3053852 - RNA, 20 nt, Mycobacterium bovis subsp bovis AF2122/97
cgcggcguuguugcggaucg

SEQ ID NO: 3053853 - RNA, 18 nt, Mycobacterium bovis subsp bovis AF2122/97
cgcggcguuucccggguc

SEQ ID NO: 3053854 - RNA, 18 nt, Mycobacterium bovis subsp bovis AF2122/97
cgcggcuacaucggcggc

SEQ ID NO: 3053855 - RNA, 21 nt, Mycobacterium bovis subsp bovis AF2122/97
cgcggcuacaucggcggcguc

SEQ ID NO: 3053856 - RNA, 18 nt, Mycobacterium bovis subsp bovis AF2122/97
cgcggcuaggccaagccg

SEQ ID NO: 3053857 - RNA, 17 nt, Mycobacterium bovis subsp bovis AF2122/97
cgcggcuaggccagcac

SEQ ID NO: 3053858 - RNA, 21 nt, Mycobacterium bovis subsp bovis AF2122/97
cgcggcuaggccagcacggcg

SEQ ID NO: 3053859 - RNA, 15 nt, Mycobacterium bovis subsp bovis AF2122/97
cgcggcuauggcgcc

SEQ ID NO: 3053860 - RNA, 12 nt, Mycobacterium bovis subsp bovis AF2122/97
cgcggcuccguu

SEQ ID NO: 3053861 - RNA, 13 nt, Mycobacterium bovis subsp bovis AF2122/97
cgcggcucguugg

SEQ ID NO: 3053862 - RNA, 21 nt, Mycobacterium bovis subsp bovis AF2122/97
cgcggcugccaucccgauccc

SEQ ID NO: 3053863 - RNA, 18 nt, Mycobacterium bovis subsp bovis AF2122/97
cgcggcugcgucgucugc

SEQ ID NO: 3053864 - RNA, 22 nt, Mycobacterium bovis subsp bovis AF2122/97
cgcggcugcuccgucgccgaac

SEQ ID NO: 3053865 - RNA, 20 nt, Mycobacterium bovis subsp bovis AF2122/97
cgcgggggugggcgugacgg

SEQ ID NO: 3053866 - RNA, 22 nt, Mycobacterium bovis subsp bovis AF2122/97
cgcgggggugggcgugacgggc

SEQ ID NO: 3053867 - RNA, 16 nt, Mycobacterium bovis subsp bovis AF2122/97
cgcggggugcgcgcga

SEQ ID NO: 3053868 - RNA, 13 nt, Mycobacterium bovis subsp bovis AF2122/97
cgcgggguggcgg

SEQ ID NO: 3053869 - RNA, 14 nt, Mycobacterium bovis subsp bovis AF2122/97
cgcgggguggcggc

SEQ ID NO: 3053870 - RNA, 19 nt, Mycobacterium bovis subsp bovis AF2122/97
cgcgggguggcggcgcugc

SEQ ID NO: 3053871 - RNA, 12 nt, Mycobacterium bovis subsp bovis AF2122/97
cgcggguagcgg

SEQ ID NO: 3053872 - RNA, 13 nt, Mycobacterium bovis subsp bovis AF2122/97
cgcgggucacgac

SEQ ID NO: 3053873 - RNA, 13 nt, Mycobacterium bovis subsp bovis AF2122/97
cgcggguccagcc

SEQ ID NO: 3053874 - RNA, 15 nt, Mycobacterium bovis subsp bovis AF2122/97
cgcgggugaccaggc

SEQ ID NO: 3053875 - RNA, 18 nt, Mycobacterium bovis subsp bovis AF2122/97
cgcgggugaccaggcggc

SEQ ID NO: 3053876 - RNA, 21 nt, Mycobacterium bovis subsp bovis AF2122/97
cgcgggugaccaggcggcgcg

SEQ ID NO: 3053877 - RNA, 17 nt, Mycobacterium bovis subsp bovis AF2122/97
cgcgggugaucuccacc

SEQ ID NO: 3053878 - RNA, 18 nt, Mycobacterium bovis subsp bovis AF2122/97
cgcgggugaucuccaccg

SEQ ID NO: 3053879 - RNA, 21 nt, Mycobacterium bovis subsp bovis AF2122/97
cgcgggugaugacgccgucgg

SEQ ID NO: 3053880 - RNA, 20 nt, Mycobacterium bovis subsp bovis AF2122/97
cgcgggugccgacgucggca

SEQ ID NO: 3053881 - RNA, 14 nt, Mycobacterium bovis subsp bovis AF2122/97
cgcgggugccgggc

SEQ ID NO: 3053882 - RNA, 13 nt, Mycobacterium bovis subsp bovis AF2122/97
cgcgggugcgccg

SEQ ID NO: 3053883 - RNA, 15 nt, Mycobacterium bovis subsp bovis AF2122/97
cgcgggugcgccggc

SEQ ID NO: 3053884 - RNA, 16 nt, Mycobacterium bovis subsp bovis AF2122/97
cgcgggugcgccggcg

SEQ ID NO: 3053885 - RNA, 23 nt, Mycobacterium bovis subsp bovis AF2122/97
cgcgggugcgcugcagcgagacc

SEQ ID NO: 3053886 - RNA, 12 nt, Mycobacterium bovis subsp bovis AF2122/97
cgcgggugcgga

SEQ ID NO: 3053887 - RNA, 17 nt, Mycobacterium bovis subsp bovis AF2122/97
cgcgggugcggacaccg

SEQ ID NO: 3053888 - RNA, 23 nt, Mycobacterium bovis subsp bovis AF2122/97
cgcgggugcuggucaacagcggc

SEQ ID NO: 3053889 - RNA, 23 nt, Mycobacterium bovis subsp bovis AF2122/97
cgcggguggauguuugcucggcc

SEQ ID NO: 3053890 - RNA, 17 nt, Mycobacterium bovis subsp bovis AF2122/97
cgcggguggcagcggcg

SEQ ID NO: 3053891 - RNA, 18 nt, Mycobacterium bovis subsp bovis AF2122/97
cgcggguggcagcggcga

SEQ ID NO: 3053892 - RNA, 17 nt, Mycobacterium bovis subsp bovis AF2122/97
cgcggguggcucgggug

SEQ ID NO: 3053893 - RNA, 12 nt, Mycobacterium bovis subsp bovis AF2122/97
cgcggguguggc

SEQ ID NO: 3053894 - RNA, 17 nt, Mycobacterium bovis subsp bovis AF2122/97
cgcggguguuccacacc

SEQ ID NO: 3053895 - RNA, 18 nt, Mycobacterium bovis subsp bovis AF2122/97
cgcggguuacccgcagcg

SEQ ID NO: 3053896 - RNA, 19 nt, Mycobacterium bovis subsp bovis AF2122/97
cgcggguuacccgcagcgu

SEQ ID NO: 3053897 - RNA, 18 nt, Mycobacterium bovis subsp bovis AF2122/97
cgcggguugucggcgacc

SEQ ID NO: 3053898 - RNA, 23 nt, Mycobacterium bovis subsp bovis AF2122/97
cgcggguuugaucuccaccuucu

SEQ ID NO: 3053899 - RNA, 14 nt, Mycobacterium bovis subsp bovis AF2122/97
cgcgguaaagcccc

SEQ ID NO: 3053900 - RNA, 15 nt, Mycobacterium bovis subsp bovis AF2122/97
cgcgguaaagccccg

SEQ ID NO: 3053901 - RNA, 15 nt, Mycobacterium bovis subsp bovis AF2122/97
cgcgguaaccacgcg

SEQ ID NO: 3053902 - RNA, 19 nt, Mycobacterium bovis subsp bovis AF2122/97
cgcgguaaccacgcggauc

SEQ ID NO: 3053903 - RNA, 19 nt, Mycobacterium bovis subsp bovis AF2122/97
cgcgguaccaucaccgcgc

SEQ ID NO: 3053904 - RNA, 21 nt, Mycobacterium bovis subsp bovis AF2122/97
cgcgguaccaucaccgcgcca

SEQ ID NO: 3053905 - RNA, 24 nt, Mycobacterium bovis subsp bovis AF2122/97
cgcgguaccaucaccgcgccagcc

SEQ ID NO: 3053906 - RNA, 21 nt, Mycobacterium bovis subsp bovis AF2122/97
cgcgguacccaccucccgcag

SEQ ID NO: 3053907 - RNA, 20 nt, Mycobacterium bovis subsp bovis AF2122/97
cgcgguaccgcucgggcgcg

SEQ ID NO: 3053908 - RNA, 13 nt, Mycobacterium bovis subsp bovis AF2122/97
cgcgguacgccgg

SEQ ID NO: 3053909 - RNA, 16 nt, Mycobacterium bovis subsp bovis AF2122/97
cgcgguacugcgcagc

SEQ ID NO: 3053910 - RNA, 17 nt, Mycobacterium bovis subsp bovis AF2122/97
cgcgguacugcgcagcg

SEQ ID NO: 3053911 - RNA, 18 nt, Mycobacterium bovis subsp bovis AF2122/97
cgcgguacugcgcagcgc

SEQ ID NO: 3053912 - RNA, 16 nt, Mycobacterium bovis subsp bovis AF2122/97
cgcgguagccgaccga

SEQ ID NO: 3053913 - RNA, 17 nt, Mycobacterium bovis subsp bovis AF2122/97
cgcgguagccgcggcca

SEQ ID NO: 3053914 - RNA, 16 nt, Mycobacterium bovis subsp bovis AF2122/97
cgcgguagcgccguga

SEQ ID NO: 3053915 - RNA, 16 nt, Mycobacterium bovis subsp bovis AF2122/97
cgcgguagcucgucga

SEQ ID NO: 3053916 - RNA, 21 nt, Mycobacterium bovis subsp bovis AF2122/97
cgcgguaggugcaugucgaug

SEQ ID NO: 3053917 - RNA, 19 nt, Mycobacterium bovis subsp bovis AF2122/97
cgcgguagucguugccgau

SEQ ID NO: 3053918 - RNA, 22 nt, Mycobacterium bovis subsp bovis AF2122/97
cgcgguaguggaacagucgagg

SEQ ID NO: 3053919 - RNA, 15 nt, Mycobacterium bovis subsp bovis AF2122/97
cgcggucaccccggc

SEQ ID NO: 3053920 - RNA, 21 nt, Mycobacterium bovis subsp bovis AF2122/97
cgcggucaccccggcucggcc

SEQ ID NO: 3053921 - RNA, 14 nt, Mycobacterium bovis subsp bovis AF2122/97
cgcggucaccgacg

SEQ ID NO: 3053922 - RNA, 13 nt, Mycobacterium bovis subsp bovis AF2122/97
cgcggucaccgcg

SEQ ID NO: 3053923 - RNA, 15 nt, Mycobacterium bovis subsp bovis AF2122/97
cgcggucagauccag

SEQ ID NO: 3053924 - RNA, 18 nt, Mycobacterium bovis subsp bovis AF2122/97
cgcgguccaucccgagcu

SEQ ID NO: 3053925 - RNA, 16 nt, Mycobacterium bovis subsp bovis AF2122/97
cgcggucccacggccg

SEQ ID NO: 3053926 - RNA, 17 nt, Mycobacterium bovis subsp bovis AF2122/97
cgcggucccacucgucg

SEQ ID NO: 3053927 - RNA, 15 nt, Mycobacterium bovis subsp bovis AF2122/97
cgcgguccgagcggc

SEQ ID NO: 3053928 - RNA, 21 nt, Mycobacterium bovis subsp bovis AF2122/97
cgcgguccucgagccgauaag

SEQ ID NO: 3053929 - RNA, 21 nt, Mycobacterium bovis subsp bovis AF2122/97
cgcgguccuuguuagccucca

SEQ ID NO: 3053930 - RNA, 14 nt, Mycobacterium bovis subsp bovis AF2122/97
cgcggucgacgacg

SEQ ID NO: 3053931 - RNA, 20 nt, Mycobacterium bovis subsp bovis AF2122/97
cgcggucgagguccuugagg

SEQ ID NO: 3053932 - RNA, 22 nt, Mycobacterium bovis subsp bovis AF2122/97
cgcggucgagguccuugaggau

SEQ ID NO: 3053933 - RNA, 13 nt, Mycobacterium bovis subsp bovis AF2122/97
cgcggucgaggug

SEQ ID NO: 3053934 - RNA, 21 nt, Mycobacterium bovis subsp bovis AF2122/97
cgcggucgauguccgcagcac

SEQ ID NO: 3053935 - RNA, 17 nt, Mycobacterium bovis subsp bovis AF2122/97
cgcggucgcagcagacc

SEQ ID NO: 3053936 - RNA, 19 nt, Mycobacterium bovis subsp bovis AF2122/97
cgcggucgccaagaucggg

SEQ ID NO: 3053937 - RNA, 13 nt, Mycobacterium bovis subsp bovis AF2122/97
cgcggucgccacc

SEQ ID NO: 3053938 - RNA, 15 nt, Mycobacterium bovis subsp bovis AF2122/97
cgcggucgccaccgu

SEQ ID NO: 3053939 - RNA, 14 nt, Mycobacterium bovis subsp bovis AF2122/97
cgcggucgcugcga

SEQ ID NO: 3053940 - RNA, 16 nt, Mycobacterium bovis subsp bovis AF2122/97
cgcggucgcugcgaug

SEQ ID NO: 3053941 - RNA, 23 nt, Mycobacterium bovis subsp bovis AF2122/97
cgcggucgcugcgaugcugauca

SEQ ID NO: 3053942 - RNA, 18 nt, Mycobacterium bovis subsp bovis AF2122/97
cgcggucggagucgagca

SEQ ID NO: 3053943 - RNA, 22 nt, Mycobacterium bovis subsp bovis AF2122/97
cgcggucggagucgagcacacc

SEQ ID NO: 3053944 - RNA, 12 nt, Mycobacterium bovis subsp bovis AF2122/97
cgcggucggcag

SEQ ID NO: 3053945 - RNA, 20 nt, Mycobacterium bovis subsp bovis AF2122/97
cgcggucggcagcgacgccg

SEQ ID NO: 3053946 - RNA, 12 nt, Mycobacterium bovis subsp bovis AF2122/97
cgcggucggcca

SEQ ID NO: 3053947 - RNA, 15 nt, Mycobacterium bovis subsp bovis AF2122/97
cgcggucggccacca

SEQ ID NO: 3053948 - RNA, 17 nt, Mycobacterium bovis subsp bovis AF2122/97
cgcggucggccaccaac

SEQ ID NO: 3053949 - RNA, 19 nt, Mycobacterium bovis subsp bovis AF2122/97
cgcggucggccaccaacuc

SEQ ID NO: 3053950 - RNA, 14 nt, Mycobacterium bovis subsp bovis AF2122/97
cgcggucggcggcc

SEQ ID NO: 3053951 - RNA, 17 nt, Mycobacterium bovis subsp bovis AF2122/97
cgcggucggcggccgcc

SEQ ID NO: 3053952 - RNA, 19 nt, Mycobacterium bovis subsp bovis AF2122/97
cgcgguuuuucgcaguggc

SEQ ID NO: 3053953 - RNA, 23 nt, Mycobacterium bovis subsp bovis AF2122/97
cgcguaaaccggcugaccggggc

SEQ ID NO: 3053954 - RNA, 18 nt, Mycobacterium bovis subsp bovis AF2122/97
cgcguaacuugccgcaua

SEQ ID NO: 3053955 - RNA, 13 nt, Mycobacterium bovis subsp bovis AF2122/97
cgcguaauacuug

SEQ ID NO: 3053956 - RNA, 22 nt, Mycobacterium bovis subsp bovis AF2122/97
cgcguaauccgagcgcggcggc

SEQ ID NO: 3053957 - RNA, 15 nt, Mycobacterium bovis subsp bovis AF2122/97
cgcguaccacggugg

SEQ ID NO: 3053958 - RNA, 13 nt, Mycobacterium bovis subsp bovis AF2122/97
cgcguacgucggu

SEQ ID NO: 3053959 - RNA, 14 nt, Mycobacterium bovis subsp bovis AF2122/97
cgcguacugaucuu

SEQ ID NO: 3053960 - RNA, 18 nt, Mycobacterium bovis subsp bovis AF2122/97
cgcguagaccccaaucga

SEQ ID NO: 3053961 - RNA, 20 nt, Mycobacterium bovis subsp bovis AF2122/97
cgcguagcgggcgcccuuga

SEQ ID NO: 3053962 - RNA, 17 nt, Mycobacterium bovis subsp bovis AF2122/97
cgcguagggccagcgcc

SEQ ID NO: 3053963 - RNA, 19 nt, Mycobacterium bovis subsp bovis AF2122/97
cgcguagguggcacagucc

SEQ ID NO: 3053964 - RNA, 17 nt, Mycobacterium bovis subsp bovis AF2122/97
cgcguagguggccagcg

SEQ ID NO: 3053965 - RNA, 20 nt, Mycobacterium bovis subsp bovis AF2122/97
cgcguaguaaugcucgacgu

SEQ ID NO: 3053966 - RNA, 23 nt, Mycobacterium bovis subsp bovis AF2122/97
cgcguaguccaggccgucguugc

SEQ ID NO: 3053967 - RNA, 16 nt, Mycobacterium bovis subsp bovis AF2122/97
cgcguaguccgcaucc

SEQ ID NO: 3053968 - RNA, 22 nt, Mycobacterium bovis subsp bovis AF2122/97
cgcguaguccgcauccgcgacg

SEQ ID NO: 3053969 - RNA, 19 nt, Mycobacterium bovis subsp bovis AF2122/97
cgcguagugcuccguccga

SEQ ID NO: 3053970 - RNA, 14 nt, Mycobacterium bovis subsp bovis AF2122/97
cgcguaucccagau

SEQ ID NO: 3053971 - RNA, 13 nt, Mycobacterium bovis subsp bovis AF2122/97
cgcgucaaacacc

SEQ ID NO: 3053972 - RNA, 15 nt, Mycobacterium bovis subsp bovis AF2122/97
cgcgucaaacaccuc

SEQ ID NO: 3053973 - RNA, 19 nt, Mycobacterium bovis subsp bovis AF2122/97
cgcgucaaccgaucggucg

SEQ ID NO: 3053974 - RNA, 21 nt, Mycobacterium bovis subsp bovis AF2122/97
cgcgucaacgcuguugucguc

SEQ ID NO: 3053975 - RNA, 13 nt, Mycobacterium bovis subsp bovis AF2122/97
cgcgucaagucug

SEQ ID NO: 3053976 - RNA, 17 nt, Mycobacterium bovis subsp bovis AF2122/97
cgcgucacaccagcggg

SEQ ID NO: 3053977 - RNA, 17 nt, Mycobacterium bovis subsp bovis AF2122/97
cgcgucacggaccugga

SEQ ID NO: 3053978 - RNA, 14 nt, Mycobacterium bovis subsp bovis AF2122/97
cgcgucagccgcac

SEQ ID NO: 3053979 - RNA, 18 nt, Mycobacterium bovis subsp bovis AF2122/97
cgcgucagccgcaccccg

SEQ ID NO: 3053980 - RNA, 22 nt, Mycobacterium bovis subsp bovis AF2122/97
cgcgucagccgcaccccgcccg

SEQ ID NO: 3053981 - RNA, 23 nt, Mycobacterium bovis subsp bovis AF2122/97
cgcgucagccgcaccccgcccga

SEQ ID NO: 3053982 - RNA, 16 nt, Mycobacterium bovis subsp bovis AF2122/97
cgcgucagcggcgagc

SEQ ID NO: 3053983 - RNA, 15 nt, Mycobacterium bovis subsp bovis AF2122/97
cgcgucaggccagcg

SEQ ID NO: 3053984 - RNA, 13 nt, Mycobacterium bovis subsp bovis AF2122/97
cgcgucaucaccg

SEQ ID NO: 3053985 - RNA, 22 nt, Mycobacterium bovis subsp bovis AF2122/97
cgcgucaucaccgguacugcga

SEQ ID NO: 3053986 - RNA, 14 nt, Mycobacterium bovis subsp bovis AF2122/97
cgcgucauucaccg

SEQ ID NO: 3053987 - RNA, 20 nt, Mycobacterium bovis subsp bovis AF2122/97
cgcguccaaccaaggacgaa

SEQ ID NO: 3053988 - RNA, 19 nt, Mycobacterium bovis subsp bovis AF2122/97
cgcguccaaggcgcgcugg

SEQ ID NO: 3053989 - RNA, 23 nt, Mycobacterium bovis subsp bovis AF2122/97
cgcguccacccacgaucagcagc

SEQ ID NO: 3053990 - RNA, 21 nt, Mycobacterium bovis subsp bovis AF2122/97
cgcguccacgggaucugcgga

SEQ ID NO: 3053991 - RNA, 16 nt, Mycobacterium bovis subsp bovis AF2122/97
cgcguccagcgcggcc

SEQ ID NO: 3053992 - RNA, 19 nt, Mycobacterium bovis subsp bovis AF2122/97
cgcguccccagcgccaccg

SEQ ID NO: 3053993 - RNA, 21 nt, Mycobacterium bovis subsp bovis AF2122/97
cgcguccccagcgccaccguu

SEQ ID NO: 3053994 - RNA, 17 nt, Mycobacterium bovis subsp bovis AF2122/97
cgcgucccgccgcaccg

SEQ ID NO: 3053995 - RNA, 20 nt, Mycobacterium bovis subsp bovis AF2122/97
cgcgucccgccgcaccgccg

SEQ ID NO: 3053996 - RNA, 13 nt, Mycobacterium bovis subsp bovis AF2122/97
cgcguccgccucg

SEQ ID NO: 3053997 - RNA, 19 nt, Mycobacterium bovis subsp bovis AF2122/97
cgcguccgccucgggugca

SEQ ID NO: 3053998 - RNA, 18 nt, Mycobacterium bovis subsp bovis AF2122/97
cgcguccgcgaucugcag

SEQ ID NO: 3053999 - RNA, 16 nt, Mycobacterium bovis subsp bovis AF2122/97
cgcguccgcgcguugc

SEQ ID NO: 3054000 - RNA, 14 nt, Mycobacterium bovis subsp bovis AF2122/97
cgcguccgggcagc

SEQ ID NO: 3054001 - RNA, 15 nt, Mycobacterium bovis subsp bovis AF2122/97
cgcguccgggcagcc

SEQ ID NO: 3054002 - RNA, 21 nt, Mycobacterium bovis subsp bovis AF2122/97
cgcguccgggcagccgcgccg

SEQ ID NO: 3054003 - RNA, 22 nt, Mycobacterium bovis subsp bovis AF2122/97
cgcguccgggcagccgcgccgc

SEQ ID NO: 3054004 - RNA, 17 nt, Mycobacterium bovis subsp bovis AF2122/97
cgcguccgggcucgcgc

SEQ ID NO: 3054005 - RNA, 21 nt, Mycobacterium bovis subsp bovis AF2122/97
cgcguccgggcucgcgcucga

SEQ ID NO: 3054006 - RNA, 14 nt, Mycobacterium bovis subsp bovis AF2122/97
cgcguccucgccgc

SEQ ID NO: 3054007 - RNA, 18 nt, Mycobacterium bovis subsp bovis AF2122/97
cgcguccucgccgcacgc

SEQ ID NO: 3054008 - RNA, 20 nt, Mycobacterium bovis subsp bovis AF2122/97
cgcguccucggggaggucga

SEQ ID NO: 3054009 - RNA, 22 nt, Mycobacterium bovis subsp bovis AF2122/97
cgcgucgaauuccggcucaccg

SEQ ID NO: 3054010 - RNA, 13 nt, Mycobacterium bovis subsp bovis AF2122/97
cgcgucgacccga

SEQ ID NO: 3054011 - RNA, 22 nt, Mycobacterium bovis subsp bovis AF2122/97
cgcgucgacccgaacugggcga

SEQ ID NO: 3054012 - RNA, 20 nt, Mycobacterium bovis subsp bovis AF2122/97
cgcgucgagcgacccccagc

SEQ ID NO: 3054013 - RNA, 22 nt, Mycobacterium bovis subsp bovis AF2122/97
cgcgucgagcgacccccagcgc

SEQ ID NO: 3054014 - RNA, 14 nt, Mycobacterium bovis subsp bovis AF2122/97
cgcgucgagcgccg

SEQ ID NO: 3054015 - RNA, 18 nt, Mycobacterium bovis subsp bovis AF2122/97
cgcgucgagcgccggccg

SEQ ID NO: 3054016 - RNA, 19 nt, Mycobacterium bovis subsp bovis AF2122/97
cgcgucgagcgccggccgc

SEQ ID NO: 3054017 - RNA, 16 nt, Mycobacterium bovis subsp bovis AF2122/97
cgcgucgagugccgcc

SEQ ID NO: 3054018 - RNA, 17 nt, Mycobacterium bovis subsp bovis AF2122/97
cgcgucgagugccgcca

SEQ ID NO: 3054019 - RNA, 20 nt, Mycobacterium bovis subsp bovis AF2122/97
cgcgucgagugccgccaccg

SEQ ID NO: 3054020 - RNA, 23 nt, Mycobacterium bovis subsp bovis AF2122/97
cgcgucgagugccgccaccgcca

SEQ ID NO: 3054021 - RNA, 20 nt, Mycobacterium bovis subsp bovis AF2122/97
cgcgucgaucguuccgcugg

SEQ ID NO: 3054022 - RNA, 13 nt, Mycobacterium bovis subsp bovis AF2122/97
cgcgucgccgaaa

SEQ ID NO: 3054023 - RNA, 14 nt, Mycobacterium bovis subsp bovis AF2122/97
cgcgucgccggccg

SEQ ID NO: 3054024 - RNA, 21 nt, Mycobacterium bovis subsp bovis AF2122/97
cgcgucgccggccuugagcac

SEQ ID NO: 3054025 - RNA, 21 nt, Mycobacterium bovis subsp bovis AF2122/97
cgcgucgcgaaaggccacgau

SEQ ID NO: 3054026 - RNA, 22 nt, Mycobacterium bovis subsp bovis AF2122/97
cgcgucggaauacaacagcugg

SEQ ID NO: 3054027 - RNA, 12 nt, Mycobacterium bovis subsp bovis AF2122/97
cgcgucggaccg

SEQ ID NO: 3054028 - RNA, 15 nt, Mycobacterium bovis subsp bovis AF2122/97
cgcgucggagccggg

SEQ ID NO: 3054029 - RNA, 17 nt, Mycobacterium bovis subsp bovis AF2122/97
cgcgucggagccgggca

SEQ ID NO: 3054030 - RNA, 16 nt, Mycobacterium bovis subsp bovis AF2122/97
cgcgucggcggccagu

SEQ ID NO: 3054031 - RNA, 13 nt, Mycobacterium bovis subsp bovis AF2122/97
cgcgucggcggcg

SEQ ID NO: 3054032 - RNA, 21 nt, Mycobacterium bovis subsp bovis AF2122/97
cgcgucggcggcgaccgccag

SEQ ID NO: 3054033 - RNA, 13 nt, Mycobacterium bovis subsp bovis AF2122/97
cgcgucggcguug

SEQ ID NO: 3054034 - RNA, 19 nt, Mycobacterium bovis subsp bovis AF2122/97
cgcgucggcguuggggcuc

SEQ ID NO: 3054035 - RNA, 14 nt, Mycobacterium bovis subsp bovis AF2122/97
cgcgucggcugccg

SEQ ID NO: 3054036 - RNA, 13 nt, Mycobacterium bovis subsp bovis AF2122/97
cgcgucgggccgc

SEQ ID NO: 3054037 - RNA, 16 nt, Mycobacterium bovis subsp bovis AF2122/97
cgcgucgggcucggcg

SEQ ID NO: 3054038 - RNA, 21 nt, Mycobacterium bovis subsp bovis AF2122/97
cgcguugaugaccgccgccgg

SEQ ID NO: 3054039 - RNA, 13 nt, Mycobacterium bovis subsp bovis AF2122/97
cgcguugcacagc

SEQ ID NO: 3054040 - RNA, 19 nt, Mycobacterium bovis subsp bovis AF2122/97
cgcguugcagaccaccagu

SEQ ID NO: 3054041 - RNA, 17 nt, Mycobacterium bovis subsp bovis AF2122/97
cgcguuggacaauucga

SEQ ID NO: 3054042 - RNA, 22 nt, Mycobacterium bovis subsp bovis AF2122/97
cgcguuggacaauucgacgaac

SEQ ID NO: 3054043 - RNA, 13 nt, Mycobacterium bovis subsp bovis AF2122/97
cgcguuggccaca

SEQ ID NO: 3054044 - RNA, 14 nt, Mycobacterium bovis subsp bovis AF2122/97
cgcguuggguugaa

SEQ ID NO: 3054045 - RNA, 16 nt, Mycobacterium bovis subsp bovis AF2122/97
cgcguuguaggcuucc

SEQ ID NO: 3054046 - RNA, 23 nt, Mycobacterium bovis subsp bovis AF2122/97
cgcguuguaggcuuccagcucgu

SEQ ID NO: 3054047 - RNA, 20 nt, Mycobacterium bovis subsp bovis AF2122/97
cgcguuguccgcggccaacg

SEQ ID NO: 3054048 - RNA, 16 nt, Mycobacterium bovis subsp bovis AF2122/97
cgcguugugcccgccg

SEQ ID NO: 3054049 - RNA, 21 nt, Mycobacterium bovis subsp bovis AF2122/97
cgcguugugcccgccggccca

SEQ ID NO: 3054050 - RNA, 20 nt, Mycobacterium bovis subsp bovis AF2122/97
cgcguuuagucuccggcguc

SEQ ID NO: 3054051 - RNA, 20 nt, Mycobacterium bovis subsp bovis AF2122/97
cgcguuuauaccucgccgcc

SEQ ID NO: 3054052 - RNA, 22 nt, Mycobacterium bovis subsp bovis AF2122/97
cgcguuucacgaaacccagucg

SEQ ID NO: 3054053 - RNA, 19 nt, Mycobacterium bovis subsp bovis AF2122/97
cgcguuucgucgaccgcgc

SEQ ID NO: 3054054 - RNA, 20 nt, Mycobacterium bovis subsp bovis AF2122/97
cgcguuucgucgaccgcgcc

SEQ ID NO: 3054055 - RNA, 15 nt, Mycobacterium bovis subsp bovis AF2122/97
cgcguuugcgaagcc

SEQ ID NO: 3054056 - RNA, 18 nt, Mycobacterium bovis subsp bovis AF2122/97
cgcuaaaacgccagucga

SEQ ID NO: 3054057 - RNA, 22 nt, Mycobacterium bovis subsp bovis AF2122/97
cgcuaacagauuguccggccgg

SEQ ID NO: 3054058 - RNA, 23 nt, Mycobacterium bovis subsp bovis AF2122/97
cgcuaacagauuguccggccggu

SEQ ID NO: 3054059 - RNA, 16 nt, Mycobacterium bovis subsp bovis AF2122/97
cgcuaaccuuggcgau

SEQ ID NO: 3054060 - RNA, 20 nt, Mycobacterium bovis subsp bovis AF2122/97
cgcuaacugcuuuucgacgg

SEQ ID NO: 3054061 - RNA, 20 nt, Mycobacterium bovis subsp bovis AF2122/97
cgcuaaguccccgcuuggcg

SEQ ID NO: 3054062 - RNA, 20 nt, Mycobacterium bovis subsp bovis AF2122/97
cgcuaauggauccagcccga

SEQ ID NO: 3054063 - RNA, 19 nt, Mycobacterium bovis subsp bovis AF2122/97
cgcuaauugcggccgccgg

SEQ ID NO: 3054064 - RNA, 17 nt, Mycobacterium bovis subsp bovis AF2122/97
cgcuacaucagaaucag

SEQ ID NO: 3054065 - RNA, 16 nt, Mycobacterium bovis subsp bovis AF2122/97
cgcuaccagcugggcg

SEQ ID NO: 3054066 - RNA, 20 nt, Mycobacterium bovis subsp bovis AF2122/97
cgcuaccagcugggcgacca

SEQ ID NO: 3054067 - RNA, 23 nt, Mycobacterium bovis subsp bovis AF2122/97
cgcuaccagcugggcgaccacuu

SEQ ID NO: 3054068 - RNA, 15 nt, Mycobacterium bovis subsp bovis AF2122/97
cgcuacccagcgcgu

SEQ ID NO: 3054069 - RNA, 15 nt, Mycobacterium bovis subsp bovis AF2122/97
cgcuaccccagccgg

SEQ ID NO: 3054070 - RNA, 19 nt, Mycobacterium bovis subsp bovis AF2122/97
cgcuaccccagccggcagc

SEQ ID NO: 3054071 - RNA, 12 nt, Mycobacterium bovis subsp bovis AF2122/97
cgcuacccccga

SEQ ID NO: 3054072 - RNA, 16 nt, Mycobacterium bovis subsp bovis AF2122/97
cgcuacccgccacggu

SEQ ID NO: 3054073 - RNA, 23 nt, Mycobacterium bovis subsp bovis AF2122/97
cgcuaccgaacaguaggccuccg

SEQ ID NO: 3054074 - RNA, 12 nt, Mycobacterium bovis subsp bovis AF2122/97
cgcuaccgcaca

SEQ ID NO: 3054075 - RNA, 13 nt, Mycobacterium bovis subsp bovis AF2122/97
cgcuaccgcccgc

SEQ ID NO: 3054076 - RNA, 20 nt, Mycobacterium bovis subsp bovis AF2122/97
cgcuaccgcccgcgccaccg

SEQ ID NO: 3054077 - RNA, 21 nt, Mycobacterium bovis subsp bovis AF2122/97
cgcuaccgcccgcgccaccgg

SEQ ID NO: 3054078 - RNA, 23 nt, Mycobacterium bovis subsp bovis AF2122/97
cgcuaccgcccgcgccaccggca

SEQ ID NO: 3054079 - RNA, 14 nt, Mycobacterium bovis subsp bovis AF2122/97
cgcuaccgccgggg

SEQ ID NO: 3054080 - RNA, 16 nt, Mycobacterium bovis subsp bovis AF2122/97
cgcuaccuucuuggcu

SEQ ID NO: 3054081 - RNA, 20 nt, Mycobacterium bovis subsp bovis AF2122/97
cgcuacgcaacgggucgggu

SEQ ID NO: 3054082 - RNA, 17 nt, Mycobacterium bovis subsp bovis AF2122/97
cgcuacgcgcgcucgcu

SEQ ID NO: 3054083 - RNA, 18 nt, Mycobacterium bovis subsp bovis AF2122/97
cgcuacgucaagccgugc

SEQ ID NO: 3054084 - RNA, 14 nt, Mycobacterium bovis subsp bovis AF2122/97
cgcuacgucgaccg

SEQ ID NO: 3054085 - RNA, 17 nt, Mycobacterium bovis subsp bovis AF2122/97
cgcuacgucgaccgacg

SEQ ID NO: 3054086 - RNA, 18 nt, Mycobacterium bovis subsp bovis AF2122/97
cgcuacguuacgccgaga

SEQ ID NO: 3054087 - RNA, 14 nt, Mycobacterium bovis subsp bovis AF2122/97
cgcuacugcgacca

SEQ ID NO: 3054088 - RNA, 13 nt, Mycobacterium bovis subsp bovis AF2122/97
cgcuagccaggga

SEQ ID NO: 3054089 - RNA, 19 nt, Mycobacterium bovis subsp bovis AF2122/97
cgcuagccccgaucaucga

SEQ ID NO: 3054090 - RNA, 12 nt, Mycobacterium bovis subsp bovis AF2122/97
cgcuagccgaca

SEQ ID NO: 3054091 - RNA, 14 nt, Mycobacterium bovis subsp bovis AF2122/97
cgcuagccgacagc

SEQ ID NO: 3054092 - RNA, 21 nt, Mycobacterium bovis subsp bovis AF2122/97
cgcuagccgacagcucaucga

SEQ ID NO: 3054093 - RNA, 17 nt, Mycobacterium bovis subsp bovis AF2122/97
cgcuagccgggcgcgcc

SEQ ID NO: 3054094 - RNA, 19 nt, Mycobacterium bovis subsp bovis AF2122/97
cgcuagcgccgcgcuugcg

SEQ ID NO: 3054095 - RNA, 21 nt, Mycobacterium bovis subsp bovis AF2122/97
cgcuagcgccgcgcuugcgau

SEQ ID NO: 3054096 - RNA, 13 nt, Mycobacterium bovis subsp bovis AF2122/97
cgcuagcucggcc

SEQ ID NO: 3054097 - RNA, 15 nt, Mycobacterium bovis subsp bovis AF2122/97
cgcuaggaacgccac

SEQ ID NO: 3054098 - RNA, 15 nt, Mycobacterium bovis subsp bovis AF2122/97
cgcuaggacggcgcg

SEQ ID NO: 3054099 - RNA, 21 nt, Mycobacterium bovis subsp bovis AF2122/97
cgcuaggacggcgcgagccgc

SEQ ID NO: 3054100 - RNA, 17 nt, Mycobacterium bovis subsp bovis AF2122/97
cgcuaggcgauccagac

SEQ ID NO: 3054101 - RNA, 20 nt, Mycobacterium bovis subsp bovis AF2122/97
cgcuagggugagcccgggau

SEQ ID NO: 3054102 - RNA, 16 nt, Mycobacterium bovis subsp bovis AF2122/97
cgcuaggucaggugau

SEQ ID NO: 3054103 - RNA, 22 nt, Mycobacterium bovis subsp bovis AF2122/97
cgcuaggucaggugauucgcgc

SEQ ID NO: 3054104 - RNA, 20 nt, Mycobacterium bovis subsp bovis AF2122/97
cgcuaggugacgccgccagc

SEQ ID NO: 3054105 - RNA, 23 nt, Mycobacterium bovis subsp bovis AF2122/97
cgcuaggugacgccgccagcacc

SEQ ID NO: 3054106 - RNA, 20 nt, Mycobacterium bovis subsp bovis AF2122/97
cgcuaggugcaacaggcgcg

SEQ ID NO: 3054107 - RNA, 11 nt, Mycobacterium bovis subsp bovis AF2122/97
cgcuaggugcg

SEQ ID NO: 3054108 - RNA, 13 nt, Mycobacterium bovis subsp bovis AF2122/97
cgcuagucgucgg

SEQ ID NO: 3054109 - RNA, 16 nt, Mycobacterium bovis subsp bovis AF2122/97
cgcuagucgucggcgc

SEQ ID NO: 3054110 - RNA, 17 nt, Mycobacterium bovis subsp bovis AF2122/97
cgcuaucaugaccaccg

SEQ ID NO: 3054111 - RNA, 20 nt, Mycobacterium bovis subsp bovis AF2122/97
cgcuaugaggcagucguuga

SEQ ID NO: 3054112 - RNA, 16 nt, Mycobacterium bovis subsp bovis AF2122/97
cgcuaugaugccgccg

SEQ ID NO: 3054113 - RNA, 17 nt, Mycobacterium bovis subsp bovis AF2122/97
cgcuaugaugccgccgg

SEQ ID NO: 3054114 - RNA, 13 nt, Mycobacterium bovis subsp bovis AF2122/97
cgcuauggcauua

SEQ ID NO: 3054115 - RNA, 22 nt, Mycobacterium bovis subsp bovis AF2122/97
cgcuauggcauuaccacuucgg

SEQ ID NO: 3054116 - RNA, 14 nt, Mycobacterium bovis subsp bovis AF2122/97
cgcuauggcccggg

SEQ ID NO: 3054117 - RNA, 19 nt, Mycobacterium bovis subsp bovis AF2122/97
cgcuauggcccgggccgaa

SEQ ID NO: 3054118 - RNA, 15 nt, Mycobacterium bovis subsp bovis AF2122/97
cgcucaacucaguuu

SEQ ID NO: 3054119 - RNA, 21 nt, Mycobacterium bovis subsp bovis AF2122/97
cgcucaaugaucgcggcggcg

SEQ ID NO: 3054120 - RNA, 19 nt, Mycobacterium bovis subsp bovis AF2122/97
cgcucaaugcggucaacga

SEQ ID NO: 3054121 - RNA, 18 nt, Mycobacterium bovis subsp bovis AF2122/97
cgcucacauacagcaggc

SEQ ID NO: 3054122 - RNA, 12 nt, Mycobacterium bovis subsp bovis AF2122/97
cgcucaccaccg

SEQ ID NO: 3054123 - RNA, 14 nt, Mycobacterium bovis subsp bovis AF2122/97
cgcucaccaccgac

SEQ ID NO: 3054124 - RNA, 12 nt, Mycobacterium bovis subsp bovis AF2122/97
cgcuccuccggc

SEQ ID NO: 3054125 - RNA, 14 nt, Mycobacterium bovis subsp bovis AF2122/97
cgcuccuccggcac

SEQ ID NO: 3054126 - RNA, 14 nt, Mycobacterium bovis subsp bovis AF2122/97
cgcuccugcucguc

SEQ ID NO: 3054127 - RNA, 19 nt, Mycobacterium bovis subsp bovis AF2122/97
cgcuccuucagggcgucga

SEQ ID NO: 3054128 - RNA, 17 nt, Mycobacterium bovis subsp bovis AF2122/97
cgcucgaaagagccgcu

SEQ ID NO: 3054129 - RNA, 16 nt, Mycobacterium bovis subsp bovis AF2122/97
cgcucgaaagcgucga

SEQ ID NO: 3054130 - RNA, 22 nt, Mycobacterium bovis subsp bovis AF2122/97
cgcucgaaagcgucgaucaccu

SEQ ID NO: 3054131 - RNA, 14 nt, Mycobacterium bovis subsp bovis AF2122/97
cgcucgaccagacg

SEQ ID NO: 3054132 - RNA, 21 nt, Mycobacterium bovis subsp bovis AF2122/97
cgcucgaccagacgcugccca

SEQ ID NO: 3054133 - RNA, 13 nt, Mycobacterium bovis subsp bovis AF2122/97
cgcucgaccccgc

SEQ ID NO: 3054134 - RNA, 17 nt, Mycobacterium bovis subsp bovis AF2122/97
cgcucgacgacgggcgc

SEQ ID NO: 3054135 - RNA, 13 nt, Mycobacterium bovis subsp bovis AF2122/97
cgcucgagcagcg

SEQ ID NO: 3054136 - RNA, 18 nt, Mycobacterium bovis subsp bovis AF2122/97
cgcucgagcaggcuggcg

SEQ ID NO: 3054137 - RNA, 22 nt, Mycobacterium bovis subsp bovis AF2122/97
cgcucgagcaggcuggcguugg

SEQ ID NO: 3054138 - RNA, 18 nt, Mycobacterium bovis subsp bovis AF2122/97
cgcucgagguggucucgg

SEQ ID NO: 3054139 - RNA, 19 nt, Mycobacterium bovis subsp bovis AF2122/97
cgcucgaucacuagcgccc

SEQ ID NO: 3054140 - RNA, 21 nt, Mycobacterium bovis subsp bovis AF2122/97
cgcucgaucacuagcgccccu

SEQ ID NO: 3054141 - RNA, 15 nt, Mycobacterium bovis subsp bovis AF2122/97
cgcucgaucgcguug

SEQ ID NO: 3054142 - RNA, 19 nt, Mycobacterium bovis subsp bovis AF2122/97
cgcucgaucggcagccagg

SEQ ID NO: 3054143 - RNA, 21 nt, Mycobacterium bovis subsp bovis AF2122/97
cgcucgaucggcagccagggc

SEQ ID NO: 3054144 - RNA, 17 nt, Mycobacterium bovis subsp bovis AF2122/97
cgcucgauggcggccac

SEQ ID NO: 3054145 - RNA, 23 nt, Mycobacterium bovis subsp bovis AF2122/97
cgcucgauggcggccaccagcgc

SEQ ID NO: 3054146 - RNA, 18 nt, Mycobacterium bovis subsp bovis AF2122/97
cgcucgaugucccgagcc

SEQ ID NO: 3054147 - RNA, 12 nt, Mycobacterium bovis subsp bovis AF2122/97
cgcucgcacagc

SEQ ID NO: 3054148 - RNA, 13 nt, Mycobacterium bovis subsp bovis AF2122/97
cgcucgcacccgc

SEQ ID NO: 3054149 - RNA, 14 nt, Mycobacterium bovis subsp bovis AF2122/97
cgcucgcaccgccc

SEQ ID NO: 3054150 - RNA, 16 nt, Mycobacterium bovis subsp bovis AF2122/97
cgcucgcaccgcccgc

SEQ ID NO: 3054151 - RNA, 19 nt, Mycobacterium bovis subsp bovis AF2122/97
cgcucgcaccgcccgccga

SEQ ID NO: 3054152 - RNA, 23 nt, Mycobacterium bovis subsp bovis AF2122/97
cgcucgcccaggaagccgagacc

SEQ ID NO: 3054153 - RNA, 13 nt, Mycobacterium bovis subsp bovis AF2122/97
cgcucgcccgccg

SEQ ID NO: 3054154 - RNA, 16 nt, Mycobacterium bovis subsp bovis AF2122/97
cgcucgcccgccgcca

SEQ ID NO: 3054155 - RNA, 19 nt, Mycobacterium bovis subsp bovis AF2122/97
cgcucgcccgccgccacca

SEQ ID NO: 3054156 - RNA, 22 nt, Mycobacterium bovis subsp bovis AF2122/97
cgcucgcccgccgccaccagcu

SEQ ID NO: 3054157 - RNA, 17 nt, Mycobacterium bovis subsp bovis AF2122/97
cgcucgcccgcggccgu

SEQ ID NO: 3054158 - RNA, 20 nt, Mycobacterium bovis subsp bovis AF2122/97
cgcucgcccgcggccguggu

SEQ ID NO: 3054159 - RNA, 15 nt, Mycobacterium bovis subsp bovis AF2122/97
cgcucgccgagcugu

SEQ ID NO: 3054160 - RNA, 22 nt, Mycobacterium bovis subsp bovis AF2122/97
cgcucgccgguaggcggccagc

SEQ ID NO: 3054161 - RNA, 20 nt, Mycobacterium bovis subsp bovis AF2122/97
cgcucgccgguguccuuggc

SEQ ID NO: 3054162 - RNA, 16 nt, Mycobacterium bovis subsp bovis AF2122/97
cgcucgccucgauggc

SEQ ID NO: 3054163 - RNA, 23 nt, Mycobacterium bovis subsp bovis AF2122/97
cgcucgcgaagccgguucgccca

SEQ ID NO: 3054164 - RNA, 16 nt, Mycobacterium bovis subsp bovis AF2122/97
cgcucgcgcacccugc

SEQ ID NO: 3054165 - RNA, 13 nt, Mycobacterium bovis subsp bovis AF2122/97
cgcucgcgccagg

SEQ ID NO: 3054166 - RNA, 15 nt, Mycobacterium bovis subsp bovis AF2122/97
cgcucgcggcgacca

SEQ ID NO: 3054167 - RNA, 16 nt, Mycobacterium bovis subsp bovis AF2122/97
cgcucgcggcggcgcu

SEQ ID NO: 3054168 - RNA, 20 nt, Mycobacterium bovis subsp bovis AF2122/97
cgcucgcggcggcgcuggcg

SEQ ID NO: 3054169 - RNA, 23 nt, Mycobacterium bovis subsp bovis AF2122/97
cgcucgcggcuucaguccggccc

SEQ ID NO: 3054170 - RNA, 20 nt, Mycobacterium bovis subsp bovis AF2122/97
cgcucgcgguagcgccguga

SEQ ID NO: 3054171 - RNA, 15 nt, Mycobacterium bovis subsp bovis AF2122/97
cgcucgcucaccggc

SEQ ID NO: 3054172 - RNA, 16 nt, Mycobacterium bovis subsp bovis AF2122/97
cgcucgcucaccggcu

SEQ ID NO: 3054173 - RNA, 15 nt, Mycobacterium bovis subsp bovis AF2122/97
cgcucgcucacgccg

SEQ ID NO: 3054174 - RNA, 21 nt, Mycobacterium bovis subsp bovis AF2122/97
cgcucgcucacgccguccggu

SEQ ID NO: 3054175 - RNA, 14 nt, Mycobacterium bovis subsp bovis AF2122/97
cgcucgcugcagca

SEQ ID NO: 3054176 - RNA, 15 nt, Mycobacterium bovis subsp bovis AF2122/97
cgcucgcugcagcag

SEQ ID NO: 3054177 - RNA, 12 nt, Mycobacterium bovis subsp bovis AF2122/97
cgcucggcagcc

SEQ ID NO: 3054178 - RNA, 15 nt, Mycobacterium bovis subsp bovis AF2122/97
cgcucggcagccggc

SEQ ID NO: 3054179 - RNA, 22 nt, Mycobacterium bovis subsp bovis AF2122/97
cgcucggccauagcgccgcgcc

SEQ ID NO: 3054180 - RNA, 14 nt, Mycobacterium bovis subsp bovis AF2122/97
cgcucggccgcagc

SEQ ID NO: 3054181 - RNA, 16 nt, Mycobacterium bovis subsp bovis AF2122/97
cgcucggccgcagcca

SEQ ID NO: 3054182 - RNA, 21 nt, Mycobacterium bovis subsp bovis AF2122/97
cgcucggccgcagccagcggu

SEQ ID NO: 3054183 - RNA, 15 nt, Mycobacterium bovis subsp bovis AF2122/97
cgcucggccgccggg

SEQ ID NO: 3054184 - RNA, 19 nt, Mycobacterium bovis subsp bovis AF2122/97
cgcucggccgccggguccg

SEQ ID NO: 3054185 - RNA, 13 nt, Mycobacterium bovis subsp bovis AF2122/97
cgcucggccguca

SEQ ID NO: 3054186 - RNA, 22 nt, Mycobacterium bovis subsp bovis AF2122/97
cgcucggcgccacggugucgcg

SEQ ID NO: 3054187 - RNA, 12 nt, Mycobacterium bovis subsp bovis AF2122/97
cgcucggcgccg

SEQ ID NO: 3054188 - RNA, 17 nt, Mycobacterium bovis subsp bovis AF2122/97
cgcucggcguccgccca

SEQ ID NO: 3054189 - RNA, 19 nt, Mycobacterium bovis subsp bovis AF2122/97
cgcucggcguccgcccagc

SEQ ID NO: 3054190 - RNA, 17 nt, Mycobacterium bovis subsp bovis AF2122/97
cgcucgggcgagaucuu

SEQ ID NO: 3054191 - RNA, 15 nt, Mycobacterium bovis subsp bovis AF2122/97
cgcucgggcugccgc

SEQ ID NO: 3054192 - RNA, 18 nt, Mycobacterium bovis subsp bovis AF2122/97
cgcucgggguggucggcu

SEQ ID NO: 3054193 - RNA, 20 nt, Mycobacterium bovis subsp bovis AF2122/97
cgcucgggguggucggcucg

SEQ ID NO: 3054194 - RNA, 22 nt, Mycobacterium bovis subsp bovis AF2122/97
cgcucgggguggucggcucguc

SEQ ID NO: 3054195 - RNA, 22 nt, Mycobacterium bovis subsp bovis AF2122/97
cgcucgggguugcucgcgaucg

SEQ ID NO: 3054196 - RNA, 17 nt, Mycobacterium bovis subsp bovis AF2122/97
cgcucgguaccggucga

SEQ ID NO: 3054197 - RNA, 22 nt, Mycobacterium bovis subsp bovis AF2122/97
cgcucggucgccaccgccggca

SEQ ID NO: 3054198 - RNA, 19 nt, Mycobacterium bovis subsp bovis AF2122/97
cgcucggucuccaccaccg

SEQ ID NO: 3054199 - RNA, 15 nt, Mycobacterium bovis subsp bovis AF2122/97
cgcucggugccgccc

SEQ ID NO: 3054200 - RNA, 19 nt, Mycobacterium bovis subsp bovis AF2122/97
cgcucgguucggagucacg

SEQ ID NO: 3054201 - RNA, 20 nt, Mycobacterium bovis subsp bovis AF2122/97
cgcucgguuugcguccuggu

SEQ ID NO: 3054202 - RNA, 21 nt, Mycobacterium bovis subsp bovis AF2122/97
cgcucgguuugcguccuggug

SEQ ID NO: 3054203 - RNA, 16 nt, Mycobacterium bovis subsp bovis AF2122/97
cgcucguagaaccggg

SEQ ID NO: 3054204 - RNA, 21 nt, Mycobacterium bovis subsp bovis AF2122/97
cgcucguagaaucggcucagc

SEQ ID NO: 3054205 - RNA, 15 nt, Mycobacterium bovis subsp bovis AF2122/97
cgcucgucguccggc

SEQ ID NO: 3054206 - RNA, 17 nt, Mycobacterium bovis subsp bovis AF2122/97
cgcucgucguccggcca

SEQ ID NO: 3054207 - RNA, 18 nt, Mycobacterium bovis subsp bovis AF2122/97
cgcucgugacgaucagcg

SEQ ID NO: 3054208 - RNA, 14 nt, Mycobacterium bovis subsp bovis AF2122/97
cgcucguggucgac

SEQ ID NO: 3054209 - RNA, 16 nt, Mycobacterium bovis subsp bovis AF2122/97
cgcucguggucgacgu

SEQ ID NO: 3054210 - RNA, 20 nt, Mycobacterium bovis subsp bovis AF2122/97
cgcugcagcugcucgucgug

SEQ ID NO: 3054211 - RNA, 21 nt, Mycobacterium bovis subsp bovis AF2122/97
cgcugcaggcggccgagcugg

SEQ ID NO: 3054212 - RNA, 22 nt, Mycobacterium bovis subsp bovis AF2122/97
cgcugcauccgcagcaccaagg

SEQ ID NO: 3054213 - RNA, 21 nt, Mycobacterium bovis subsp bovis AF2122/97
cgcugccaaacuaacggcagc

SEQ ID NO: 3054214 - RNA, 16 nt, Mycobacterium bovis subsp bovis AF2122/97
cgcugccaauccgauc

SEQ ID NO: 3054215 - RNA, 15 nt, Mycobacterium bovis subsp bovis AF2122/97
cgcugccacagguga

SEQ ID NO: 3054216 - RNA, 14 nt, Mycobacterium bovis subsp bovis AF2122/97
cgcugccaccgcgg

SEQ ID NO: 3054217 - RNA, 17 nt, Mycobacterium bovis subsp bovis AF2122/97
cgcugccaccgcggugg

SEQ ID NO: 3054218 - RNA, 19 nt, Mycobacterium bovis subsp bovis AF2122/97
cgcugccaccgcgguggcg

SEQ ID NO: 3054219 - RNA, 21 nt, Mycobacterium bovis subsp bovis AF2122/97
cgcugccaccgcgguggcggc

SEQ ID NO: 3054220 - RNA, 19 nt, Mycobacterium bovis subsp bovis AF2122/97
cgcugccacuagcauuguc

SEQ ID NO: 3054221 - RNA, 13 nt, Mycobacterium bovis subsp bovis AF2122/97
cgcugccagccgu

SEQ ID NO: 3054222 - RNA, 18 nt, Mycobacterium bovis subsp bovis AF2122/97
cgcugccagccguucccc

SEQ ID NO: 3054223 - RNA, 16 nt, Mycobacterium bovis subsp bovis AF2122/97
cgcugccagcggccgg

SEQ ID NO: 3054224 - RNA, 18 nt, Mycobacterium bovis subsp bovis AF2122/97
cgcugccagcggccgggc

SEQ ID NO: 3054225 - RNA, 19 nt, Mycobacterium bovis subsp bovis AF2122/97
cgcugccagcggccgggcg

SEQ ID NO: 3054226 - RNA, 19 nt, Mycobacterium bovis subsp bovis AF2122/97
cgcugccagggugcgccgg

SEQ ID NO: 3054227 - RNA, 21 nt, Mycobacterium bovis subsp bovis AF2122/97
cgcugccagggugcgccgguc

SEQ ID NO: 3054228 - RNA, 14 nt, Mycobacterium bovis subsp bovis AF2122/97
cgcugccaguucuu

SEQ ID NO: 3054229 - RNA, 19 nt, Mycobacterium bovis subsp bovis AF2122/97
cgcugccaucggcaccagc

SEQ ID NO: 3054230 - RNA, 22 nt, Mycobacterium bovis subsp bovis AF2122/97
cgcugccaucggcaccagcgcg

SEQ ID NO: 3054231 - RNA, 15 nt, Mycobacterium bovis subsp bovis AF2122/97
cgcugcccaaaagcg

SEQ ID NO: 3054232 - RNA, 19 nt, Mycobacterium bovis subsp bovis AF2122/97
cgcugcccaaaagcgcggc

SEQ ID NO: 3054233 - RNA, 20 nt, Mycobacterium bovis subsp bovis AF2122/97
cgcugcccacggagggcagg

SEQ ID NO: 3054234 - RNA, 17 nt, Mycobacterium bovis subsp bovis AF2122/97
cgcugcccacgggccgg

SEQ ID NO: 3054235 - RNA, 13 nt, Mycobacterium bovis subsp bovis AF2122/97
cgcugcccagugg

SEQ ID NO: 3054236 - RNA, 13 nt, Mycobacterium bovis subsp bovis AF2122/97
cgcugccccgccg

SEQ ID NO: 3054237 - RNA, 14 nt, Mycobacterium bovis subsp bovis AF2122/97
cgcugccccgccgc

SEQ ID NO: 3054238 - RNA, 16 nt, Mycobacterium bovis subsp bovis AF2122/97
cgcugccccgccgcca

SEQ ID NO: 3054239 - RNA, 17 nt, Mycobacterium bovis subsp bovis AF2122/97
cgcugccccgccgccau

SEQ ID NO: 3054240 - RNA, 18 nt, Mycobacterium bovis subsp bovis AF2122/97
cgcugccccuugggcucg

SEQ ID NO: 3054241 - RNA, 15 nt, Mycobacterium bovis subsp bovis AF2122/97
cgcugcccgccgccc

SEQ ID NO: 3054242 - RNA, 14 nt, Mycobacterium bovis subsp bovis AF2122/97
cgcugcccgcgcgg

SEQ ID NO: 3054243 - RNA, 15 nt, Mycobacterium bovis subsp bovis AF2122/97
cgcugcccgcgcggc

SEQ ID NO: 3054244 - RNA, 18 nt, Mycobacterium bovis subsp bovis AF2122/97
cgcugcccgggcugccgc

SEQ ID NO: 3054245 - RNA, 17 nt, Mycobacterium bovis subsp bovis AF2122/97
cgcugccgaagcggcca

SEQ ID NO: 3054246 - RNA, 22 nt, Mycobacterium bovis subsp bovis AF2122/97
cgcugccgaagcggccaccgcc

SEQ ID NO: 3054247 - RNA, 14 nt, Mycobacterium bovis subsp bovis AF2122/97
cgcugccgacuccu

SEQ ID NO: 3054248 - RNA, 16 nt, Mycobacterium bovis subsp bovis AF2122/97
cgcugccgacuccucg

SEQ ID NO: 3054249 - RNA, 18 nt, Mycobacterium bovis subsp bovis AF2122/97
cgcugccgacuccucguc

SEQ ID NO: 3054250 - RNA, 20 nt, Mycobacterium bovis subsp bovis AF2122/97
cgcugccgagaucccagcgg

SEQ ID NO: 3054251 - RNA, 18 nt, Mycobacterium bovis subsp bovis AF2122/97
cgcugccgcagcucagca

SEQ ID NO: 3054252 - RNA, 13 nt, Mycobacterium bovis subsp bovis AF2122/97
cgcugccgcccuu

SEQ ID NO: 3054253 - RNA, 21 nt, Mycobacterium bovis subsp bovis AF2122/97
cgcugccgcccuugccgcccg

SEQ ID NO: 3054254 - RNA, 22 nt, Mycobacterium bovis subsp bovis AF2122/97
cgcugccgcccuugccgcccgc

SEQ ID NO: 3054255 - RNA, 12 nt, Mycobacterium bovis subsp bovis AF2122/97
cgcugccgccga

SEQ ID NO: 3054256 - RNA, 21 nt, Mycobacterium bovis subsp bovis AF2122/97
cgcugccgccgagcuggcgcg

SEQ ID NO: 3054257 - RNA, 12 nt, Mycobacterium bovis subsp bovis AF2122/97
cgcugccgccgc

SEQ ID NO: 3054258 - RNA, 15 nt, Mycobacterium bovis subsp bovis AF2122/97
cgcugccgccgccgg

SEQ ID NO: 3054259 - RNA, 22 nt, Mycobacterium bovis subsp bovis AF2122/97
cgcugccgccgccggcggucgc

SEQ ID NO: 3054260 - RNA, 15 nt, Mycobacterium bovis subsp bovis AF2122/97
cgcugccgccggugc

SEQ ID NO: 3054261 - RNA, 20 nt, Mycobacterium bovis subsp bovis AF2122/97
cgcugccgccggugccgccg

SEQ ID NO: 3054262 - RNA, 12 nt, Mycobacterium bovis subsp bovis AF2122/97
cgcugccgccgu

SEQ ID NO: 3054263 - RNA, 20 nt, Mycobacterium bovis subsp bovis AF2122/97
cgcugccgccgucgccgccg

SEQ ID NO: 3054264 - RNA, 14 nt, Mycobacterium bovis subsp bovis AF2122/97
cgcugccgcgcggc

SEQ ID NO: 3054265 - RNA, 17 nt, Mycobacterium bovis subsp bovis AF2122/97
cgcugccgcgcggcgag

SEQ ID NO: 3054266 - RNA, 15 nt, Mycobacterium bovis subsp bovis AF2122/97
cgcugccgcugccga

SEQ ID NO: 3054267 - RNA, 14 nt, Mycobacterium bovis subsp bovis AF2122/97
cgcugccggcagcg

SEQ ID NO: 3054268 - RNA, 13 nt, Mycobacterium bovis subsp bovis AF2122/97
cgcugccggcgcc

SEQ ID NO: 3054269 - RNA, 15 nt, Mycobacterium bovis subsp bovis AF2122/97
cgcugccggcgccgc

SEQ ID NO: 3054270 - RNA, 16 nt, Mycobacterium bovis subsp bovis AF2122/97
cgcugccggcgccgcc

SEQ ID NO: 3054271 - RNA, 19 nt, Mycobacterium bovis subsp bovis AF2122/97
cgcugccggcgccgccacu

SEQ ID NO: 3054272 - RNA, 21 nt, Mycobacterium bovis subsp bovis AF2122/97
cgcugccggcgccgccacugc

SEQ ID NO: 3054273 - RNA, 17 nt, Mycobacterium bovis subsp bovis AF2122/97
cgcugccggcugacgac

SEQ ID NO: 3054274 - RNA, 23 nt, Mycobacterium bovis subsp bovis AF2122/97
cgcugccgguagcacagcagcaa

SEQ ID NO: 3054275 - RNA, 16 nt, Mycobacterium bovis subsp bovis AF2122/97
cgcugccgguggcggc

SEQ ID NO: 3054276 - RNA, 12 nt, Mycobacterium bovis subsp bovis AF2122/97
cgcugccggugu

SEQ ID NO: 3054277 - RNA, 22 nt, Mycobacterium bovis subsp bovis AF2122/97
cgcugccggugucucccuugcc

SEQ ID NO: 3054278 - RNA, 22 nt, Mycobacterium bovis subsp bovis AF2122/97
cgcugccuggccgggaccgccc

SEQ ID NO: 3054279 - RNA, 19 nt, Mycobacterium bovis subsp bovis AF2122/97
cgcugccuucuuugccggc

SEQ ID NO: 3054280 - RNA, 20 nt, Mycobacterium bovis subsp bovis AF2122/97
cgcugccuucuuugccggcg

SEQ ID NO: 3054281 - RNA, 21 nt, Mycobacterium bovis subsp bovis AF2122/97
cgcugccuucuuugccggcgc

SEQ ID NO: 3054282 - RNA, 17 nt, Mycobacterium bovis subsp bovis AF2122/97
cgcugccuuggcgcggc

SEQ ID NO: 3054283 - RNA, 23 nt, Mycobacterium bovis subsp bovis AF2122/97
cgcugcgacguugguugcguccg

SEQ ID NO: 3054284 - RNA, 22 nt, Mycobacterium bovis subsp bovis AF2122/97
cgcugcgagaucgcggcgaccc

SEQ ID NO: 3054285 - RNA, 13 nt, Mycobacterium bovis subsp bovis AF2122/97
cgcugcgaucacc

SEQ ID NO: 3054286 - RNA, 17 nt, Mycobacterium bovis subsp bovis AF2122/97
cgcugcgaucacccccu

SEQ ID NO: 3054287 - RNA, 22 nt, Mycobacterium bovis subsp bovis AF2122/97
cgcugcgaucacccccuggacu

SEQ ID NO: 3054288 - RNA, 18 nt, Mycobacterium bovis subsp bovis AF2122/97
cgcugcgaugcugaucac

SEQ ID NO: 3054289 - RNA, 20 nt, Mycobacterium bovis subsp bovis AF2122/97
cgcugcgaugcugaucaccg

SEQ ID NO: 3054290 - RNA, 17 nt, Mycobacterium bovis subsp bovis AF2122/97
cgcugcgcaccgccgcg

SEQ ID NO: 3054291 - RNA, 15 nt, Mycobacterium bovis subsp bovis AF2122/97
cgcugcgccagguca

SEQ ID NO: 3054292 - RNA, 12 nt, Mycobacterium bovis subsp bovis AF2122/97
cgcugcgcccgg

SEQ ID NO: 3054293 - RNA, 13 nt, Mycobacterium bovis subsp bovis AF2122/97
cgcugcgccgagg

SEQ ID NO: 3054294 - RNA, 19 nt, Mycobacterium bovis subsp bovis AF2122/97
cgcugcgccgucgcagcca

SEQ ID NO: 3054295 - RNA, 20 nt, Mycobacterium bovis subsp bovis AF2122/97
cgcugcgcgaaucgcgucga

SEQ ID NO: 3054296 - RNA, 17 nt, Mycobacterium bovis subsp bovis AF2122/97
cgcuggcgccggccagc

SEQ ID NO: 3054297 - RNA, 18 nt, Mycobacterium bovis subsp bovis AF2122/97
cgcuggcgccggccagcc

SEQ ID NO: 3054298 - RNA, 13 nt, Mycobacterium bovis subsp bovis AF2122/97
cgcuggcggcgca

SEQ ID NO: 3054299 - RNA, 20 nt, Mycobacterium bovis subsp bovis AF2122/97
cgcuggcgggcacucagcag

SEQ ID NO: 3054300 - RNA, 14 nt, Mycobacterium bovis subsp bovis AF2122/97
cgcuggcgggcagc

SEQ ID NO: 3054301 - RNA, 16 nt, Mycobacterium bovis subsp bovis AF2122/97
cgcuggcgggcgaucg

SEQ ID NO: 3054302 - RNA, 20 nt, Mycobacterium bovis subsp bovis AF2122/97
cgcuggcgggcgaucgcggc

SEQ ID NO: 3054303 - RNA, 17 nt, Mycobacterium bovis subsp bovis AF2122/97
cgcuggcgggcggcgug

SEQ ID NO: 3054304 - RNA, 12 nt, Mycobacterium bovis subsp bovis AF2122/97
cgcuggcgucgu

SEQ ID NO: 3054305 - RNA, 19 nt, Mycobacterium bovis subsp bovis AF2122/97
cgcuggcgucgucuucggu

SEQ ID NO: 3054306 - RNA, 13 nt, Mycobacterium bovis subsp bovis AF2122/97
cgcuggcguugag

SEQ ID NO: 3054307 - RNA, 19 nt, Mycobacterium bovis subsp bovis AF2122/97
cgcuggcguuguugacgau

SEQ ID NO: 3054308 - RNA, 23 nt, Mycobacterium bovis subsp bovis AF2122/97
cgcuggcguuguugacgaucacc

SEQ ID NO: 3054309 - RNA, 19 nt, Mycobacterium bovis subsp bovis AF2122/97
cgcuggcuacccaccggcc

SEQ ID NO: 3054310 - RNA, 23 nt, Mycobacterium bovis subsp bovis AF2122/97
cgcuggcuacgccuccuucguga

SEQ ID NO: 3054311 - RNA, 17 nt, Mycobacterium bovis subsp bovis AF2122/97
cgcuggcugacaccgau

SEQ ID NO: 3054312 - RNA, 18 nt, Mycobacterium bovis subsp bovis AF2122/97
cgcuggcuugggccagcg

SEQ ID NO: 3054313 - RNA, 20 nt, Mycobacterium bovis subsp bovis AF2122/97
cgcuggcuugggccagcgca

SEQ ID NO: 3054314 - RNA, 18 nt, Mycobacterium bovis subsp bovis AF2122/97
cgcugggaaaucccgacc

SEQ ID NO: 3054315 - RNA, 14 nt, Mycobacterium bovis subsp bovis AF2122/97
cgcugggacggucg

SEQ ID NO: 3054316 - RNA, 15 nt, Mycobacterium bovis subsp bovis AF2122/97
cgcugggaggcgcgg

SEQ ID NO: 3054317 - RNA, 15 nt, Mycobacterium bovis subsp bovis AF2122/97
cgcugggccagggug

SEQ ID NO: 3054318 - RNA, 15 nt, Mycobacterium bovis subsp bovis AF2122/97
cgcugggcccaggag

SEQ ID NO: 3054319 - RNA, 18 nt, Mycobacterium bovis subsp bovis AF2122/97
cgcugggcccaggagauc

SEQ ID NO: 3054320 - RNA, 19 nt, Mycobacterium bovis subsp bovis AF2122/97
cgcugggcccgagcgcgcg

SEQ ID NO: 3054321 - RNA, 18 nt, Mycobacterium bovis subsp bovis AF2122/97
cgcugggcgccguagccg

SEQ ID NO: 3054322 - RNA, 14 nt, Mycobacterium bovis subsp bovis AF2122/97
cgcuggggcgcccg

SEQ ID NO: 3054323 - RNA, 20 nt, Mycobacterium bovis subsp bovis AF2122/97
cgcugggguccgcgucggcg

SEQ ID NO: 3054324 - RNA, 17 nt, Mycobacterium bovis subsp bovis AF2122/97
cgcuggguccccuccca

SEQ ID NO: 3054325 - RNA, 23 nt, Mycobacterium bovis subsp bovis AF2122/97
cgcuggguccccucccaccagcg

SEQ ID NO: 3054326 - RNA, 23 nt, Mycobacterium bovis subsp bovis AF2122/97
cgcugggucgugucgccacaccg

SEQ ID NO: 3054327 - RNA, 15 nt, Mycobacterium bovis subsp bovis AF2122/97
cgcuggguggccgcu

SEQ ID NO: 3054328 - RNA, 19 nt, Mycobacterium bovis subsp bovis AF2122/97
cgcugguauagcucacggu

SEQ ID NO: 3054329 - RNA, 21 nt, Mycobacterium bovis subsp bovis AF2122/97
cgcugguauagcucacggugg

SEQ ID NO: 3054330 - RNA, 20 nt, Mycobacterium bovis subsp bovis AF2122/97
cgcuggucaacuccacgcgg

SEQ ID NO: 3054331 - RNA, 15 nt, Mycobacterium bovis subsp bovis AF2122/97
cgcugguccuugucg

SEQ ID NO: 3054332 - RNA, 19 nt, Mycobacterium bovis subsp bovis AF2122/97
cgcuggucgaccggcguug

SEQ ID NO: 3054333 - RNA, 14 nt, Mycobacterium bovis subsp bovis AF2122/97
cgcuggucgagcag

SEQ ID NO: 3054334 - RNA, 18 nt, Mycobacterium bovis subsp bovis AF2122/97
cgcuggucgagcagugcc

SEQ ID NO: 3054335 - RNA, 22 nt, Mycobacterium bovis subsp bovis AF2122/97
cgcuggucgcaauggucguagg

SEQ ID NO: 3054336 - RNA, 16 nt, Mycobacterium bovis subsp bovis AF2122/97
cgcuggucgcgguggc

SEQ ID NO: 3054337 - RNA, 19 nt, Mycobacterium bovis subsp bovis AF2122/97
cgcuggucgcgguggcggc

SEQ ID NO: 3054338 - RNA, 15 nt, Mycobacterium bovis subsp bovis AF2122/97
cgcuggucggcggcu

SEQ ID NO: 3054339 - RNA, 15 nt, Mycobacterium bovis subsp bovis AF2122/97
cgcuggucgucgagu

SEQ ID NO: 3054340 - RNA, 15 nt, Mycobacterium bovis subsp bovis AF2122/97
cgcuggugcgccacg

SEQ ID NO: 3054341 - RNA, 14 nt, Mycobacterium bovis subsp bovis AF2122/97
cgcuggugcgccca

SEQ ID NO: 3054342 - RNA, 18 nt, Mycobacterium bovis subsp bovis AF2122/97
cgcugguggcgccauccc

SEQ ID NO: 3054343 - RNA, 19 nt, Mycobacterium bovis subsp bovis AF2122/97
cgcugguggcgccaucccc

SEQ ID NO: 3054344 - RNA, 23 nt, Mycobacterium bovis subsp bovis AF2122/97
cgcugguggcgccauccccgccg

SEQ ID NO: 3054345 - RNA, 13 nt, Mycobacterium bovis subsp bovis AF2122/97
cgcugguggcggc

SEQ ID NO: 3054346 - RNA, 18 nt, Mycobacterium bovis subsp bovis AF2122/97
cgcugguggcggucacca

SEQ ID NO: 3054347 - RNA, 22 nt, Mycobacterium bovis subsp bovis AF2122/97
cgcugguggcggucaccacgcg

SEQ ID NO: 3054348 - RNA, 24 nt, Mycobacterium bovis subsp bovis AF2122/97
cgcugguggcggucaccacgcggc

SEQ ID NO: 3054349 - RNA, 18 nt, Mycobacterium bovis subsp bovis AF2122/97
cgcugguggucagcaccc

SEQ ID NO: 3054350 - RNA, 19 nt, Mycobacterium bovis subsp bovis AF2122/97
cgcugguggucagcaccca

SEQ ID NO: 3054351 - RNA, 18 nt, Mycobacterium bovis subsp bovis AF2122/97
cgcugguuggccugccgu

SEQ ID NO: 3054352 - RNA, 15 nt, Mycobacterium bovis subsp bovis AF2122/97
cgcuguaggccagcc

SEQ ID NO: 3054353 - RNA, 18 nt, Mycobacterium bovis subsp bovis AF2122/97
cgcuguaggccagcccgg

SEQ ID NO: 3054354 - RNA, 20 nt, Mycobacterium bovis subsp bovis AF2122/97
cgcuguaggccagcccggcg

SEQ ID NO: 3054355 - RNA, 24 nt, Mycobacterium bovis subsp bovis AF2122/97
cgcugucaccccugggcggauggc

SEQ ID NO: 3054356 - RNA, 19 nt, Mycobacterium bovis subsp bovis AF2122/97
cgcugucaccguacggcca

SEQ ID NO: 3054357 - RNA, 19 nt, Mycobacterium bovis subsp bovis AF2122/97
cgcugucacguagcgagcc

SEQ ID NO: 3054358 - RNA, 16 nt, Mycobacterium bovis subsp bovis AF2122/97
cgcugucagccgaccg

SEQ ID NO: 3054359 - RNA, 13 nt, Mycobacterium bovis subsp bovis AF2122/97
cgcuguccagguc

SEQ ID NO: 3054360 - RNA, 15 nt, Mycobacterium bovis subsp bovis AF2122/97
cgcugucccagcccg

SEQ ID NO: 3054361 - RNA, 15 nt, Mycobacterium bovis subsp bovis AF2122/97
cgcuguccgacuugu

SEQ ID NO: 3054362 - RNA, 22 nt, Mycobacterium bovis subsp bovis AF2122/97
cgcuguccgacuugucgccauu

SEQ ID NO: 3054363 - RNA, 21 nt, Mycobacterium bovis subsp bovis AF2122/97
cgcuguccgcgugaaucccca

SEQ ID NO: 3054364 - RNA, 17 nt, Mycobacterium bovis subsp bovis AF2122/97
cgcugucgagccggugc

SEQ ID NO: 3054365 - RNA, 21 nt, Mycobacterium bovis subsp bovis AF2122/97
cgcugucgagccggugccgcg

SEQ ID NO: 3054366 - RNA, 22 nt, Mycobacterium bovis subsp bovis AF2122/97
cgcugucgagccggugccgcgg

SEQ ID NO: 3054367 - RNA, 12 nt, Mycobacterium bovis subsp bovis AF2122/97
cgcugucgauca

SEQ ID NO: 3054368 - RNA, 18 nt, Mycobacterium bovis subsp bovis AF2122/97
cgcugucgcccucgaucg

SEQ ID NO: 3054369 - RNA, 23 nt, Mycobacterium bovis subsp bovis AF2122/97
cgcugucgcccucgaucgccacg

SEQ ID NO: 3054370 - RNA, 16 nt, Mycobacterium bovis subsp bovis AF2122/97
cgcugucggcaguagc

SEQ ID NO: 3054371 - RNA, 21 nt, Mycobacterium bovis subsp bovis AF2122/97
cgcugucuugcuagcgcaucu

SEQ ID NO: 3054372 - RNA, 19 nt, Mycobacterium bovis subsp bovis AF2122/97
cgcugugagcuuggucgcc

SEQ ID NO: 3054373 - RNA, 13 nt, Mycobacterium bovis subsp bovis AF2122/97
cgcugugggcgag

SEQ ID NO: 3054374 - RNA, 22 nt, Mycobacterium bovis subsp bovis AF2122/97
cgcugugggcuuugccgucgag

SEQ ID NO: 3054375 - RNA, 16 nt, Mycobacterium bovis subsp bovis AF2122/97
cgcugugggucgaucc

SEQ ID NO: 3054376 - RNA, 13 nt, Mycobacterium bovis subsp bovis AF2122/97
cgcuguuccucga

SEQ ID NO: 3054377 - RNA, 14 nt, Mycobacterium bovis subsp bovis AF2122/97
cgcuguuccucgag

SEQ ID NO: 3054378 - RNA, 15 nt, Mycobacterium bovis subsp bovis AF2122/97
cgcuguugaagccgc

SEQ ID NO: 3054379 - RNA, 17 nt, Mycobacterium bovis subsp bovis AF2122/97
cgcuguugaagccgccc

SEQ ID NO: 3054380 - RNA, 18 nt, Mycobacterium bovis subsp bovis AF2122/97
cgcuguugaagccgcccg

SEQ ID NO: 3054381 - RNA, 15 nt, Mycobacterium bovis subsp bovis AF2122/97
cgcuguugccaucga

SEQ ID NO: 3054382 - RNA, 21 nt, Mycobacterium bovis subsp bovis AF2122/97
cggaaccagcguaucggccgg

SEQ ID NO: 3054383 - RNA, 22 nt, Mycobacterium bovis subsp bovis AF2122/97
cggaaccccuccaccccguugg

SEQ ID NO: 3054384 - RNA, 22 nt, Mycobacterium bovis subsp bovis AF2122/97
cggaaccccucgauucccggcg

SEQ ID NO: 3054385 - RNA, 12 nt, Mycobacterium bovis subsp bovis AF2122/97
cggaacccgaau

SEQ ID NO: 3054386 - RNA, 14 nt, Mycobacterium bovis subsp bovis AF2122/97
cggaacccgagccg

SEQ ID NO: 3054387 - RNA, 16 nt, Mycobacterium bovis subsp bovis AF2122/97
cggaaccgagggccgu

SEQ ID NO: 3054388 - RNA, 18 nt, Mycobacterium bovis subsp bovis AF2122/97
cggaaccgauaccucgcc

SEQ ID NO: 3054389 - RNA, 19 nt, Mycobacterium bovis subsp bovis AF2122/97
cggaaccgauaccucgcca

SEQ ID NO: 3054390 - RNA, 17 nt, Mycobacterium bovis subsp bovis AF2122/97
cggaaccguacgccaga

SEQ ID NO: 3054391 - RNA, 17 nt, Mycobacterium bovis subsp bovis AF2122/97
cggaaccugcucggccg

SEQ ID NO: 3054392 - RNA, 21 nt, Mycobacterium bovis subsp bovis AF2122/97
cggaaccugcucggccgugca

SEQ ID NO: 3054393 - RNA, 20 nt, Mycobacterium bovis subsp bovis AF2122/97
cggaacgaaugucaccccgc

SEQ ID NO: 3054394 - RNA, 15 nt, Mycobacterium bovis subsp bovis AF2122/97
cggaacgagcggccg

SEQ ID NO: 3054395 - RNA, 16 nt, Mycobacterium bovis subsp bovis AF2122/97
cggaacgagcggccgc

SEQ ID NO: 3054396 - RNA, 11 nt, Mycobacterium bovis subsp bovis AF2122/97
cggaacgccau

SEQ ID NO: 3054397 - RNA, 18 nt, Mycobacterium bovis subsp bovis AF2122/97
cggaacgccgccagcgcg

SEQ ID NO: 3054398 - RNA, 17 nt, Mycobacterium bovis subsp bovis AF2122/97
cggaacgccggcaccga

SEQ ID NO: 3054399 - RNA, 19 nt, Mycobacterium bovis subsp bovis AF2122/97
cggaacgccuaacgcguag

SEQ ID NO: 3054400 - RNA, 14 nt, Mycobacterium bovis subsp bovis AF2122/97
cggaacgcgucgcc

SEQ ID NO: 3054401 - RNA, 19 nt, Mycobacterium bovis subsp bovis AF2122/97
cggaacgcgucgccgacgc

SEQ ID NO: 3054402 - RNA, 13 nt, Mycobacterium bovis subsp bovis AF2122/97
cggaacggccagg

SEQ ID NO: 3054403 - RNA, 13 nt, Mycobacterium bovis subsp bovis AF2122/97
cggaacgggcagu

SEQ ID NO: 3054404 - RNA, 16 nt, Mycobacterium bovis subsp bovis AF2122/97
cggaacggguuggcga

SEQ ID NO: 3054405 - RNA, 22 nt, Mycobacterium bovis subsp bovis AF2122/97
cggaacgugaccgacgccgucg

SEQ ID NO: 3054406 - RNA, 22 nt, Mycobacterium bovis subsp bovis AF2122/97
cggaacguuccugcacagacag

SEQ ID NO: 3054407 - RNA, 16 nt, Mycobacterium bovis subsp bovis AF2122/97
cggaacucgucgcugc

SEQ ID NO: 3054408 - RNA, 15 nt, Mycobacterium bovis subsp bovis AF2122/97
cggaacugaccacgu

SEQ ID NO: 3054409 - RNA, 15 nt, Mycobacterium bovis subsp bovis AF2122/97
cggaacugcgcaaca

SEQ ID NO: 3054410 - RNA, 17 nt, Mycobacterium bovis subsp bovis AF2122/97
cggaacuugccggugcg

SEQ ID NO: 3054411 - RNA, 14 nt, Mycobacterium bovis subsp bovis AF2122/97
cggaagaagcagua

SEQ ID NO: 3054412 - RNA, 18 nt, Mycobacterium bovis subsp bovis AF2122/97
cggaagaagugcucacau

SEQ ID NO: 3054413 - RNA, 18 nt, Mycobacterium bovis subsp bovis AF2122/97
cggaagaccgcgggaccu

SEQ ID NO: 3054414 - RNA, 21 nt, Mycobacterium bovis subsp bovis AF2122/97
cggaagaccgcgggaccuucg

SEQ ID NO: 3054415 - RNA, 23 nt, Mycobacterium bovis subsp bovis AF2122/97
cggaagcccuuguagcacaccga

SEQ ID NO: 3054416 - RNA, 15 nt, Mycobacterium bovis subsp bovis AF2122/97
cggaagcgccggccc

SEQ ID NO: 3054417 - RNA, 16 nt, Mycobacterium bovis subsp bovis AF2122/97
cggaagcggcggcccu

SEQ ID NO: 3054418 - RNA, 13 nt, Mycobacterium bovis subsp bovis AF2122/97
cggaagcgggcga

SEQ ID NO: 3054419 - RNA, 14 nt, Mycobacterium bovis subsp bovis AF2122/97
cggaagcgggcgau

SEQ ID NO: 3054420 - RNA, 18 nt, Mycobacterium bovis subsp bovis AF2122/97
cggaagcuucgggaacca

SEQ ID NO: 3054421 - RNA, 15 nt, Mycobacterium bovis subsp bovis AF2122/97
cggaaggacggcagc

SEQ ID NO: 3054422 - RNA, 20 nt, Mycobacterium bovis subsp bovis AF2122/97
cggaaggacggcagccacca

SEQ ID NO: 3054423 - RNA, 13 nt, Mycobacterium bovis subsp bovis AF2122/97
cggaaggccagcu

SEQ ID NO: 3054424 - RNA, 13 nt, Mycobacterium bovis subsp bovis AF2122/97
cggaaggcccggc

SEQ ID NO: 3054425 - RNA, 16 nt, Mycobacterium bovis subsp bovis AF2122/97
cggaaggcccggcgcg

SEQ ID NO: 3054426 - RNA, 20 nt, Mycobacterium bovis subsp bovis AF2122/97
cggaaggcccggcgcggccg

SEQ ID NO: 3054427 - RNA, 14 nt, Mycobacterium bovis subsp bovis AF2122/97
cggaaggcgucgaa

SEQ ID NO: 3054428 - RNA, 20 nt, Mycobacterium bovis subsp bovis AF2122/97
cggaagggggcaagcuccag

SEQ ID NO: 3054429 - RNA, 15 nt, Mycobacterium bovis subsp bovis AF2122/97
cggaaguaucgccgg

SEQ ID NO: 3054430 - RNA, 19 nt, Mycobacterium bovis subsp bovis AF2122/97
cggaaguaucgccggccgc

SEQ ID NO: 3054431 - RNA, 22 nt, Mycobacterium bovis subsp bovis AF2122/97
cggaaguucuccucgugcagca

SEQ ID NO: 3054432 - RNA, 19 nt, Mycobacterium bovis subsp bovis AF2122/97
cggaauacaccagcgacgc

SEQ ID NO: 3054433 - RNA, 15 nt, Mycobacterium bovis subsp bovis AF2122/97
cggaauacccgcugg

SEQ ID NO: 3054434 - RNA, 16 nt, Mycobacterium bovis subsp bovis AF2122/97
cggaauacccgcuggc

SEQ ID NO: 3054435 - RNA, 16 nt, Mycobacterium bovis subsp bovis AF2122/97
cggaauacccggccca

SEQ ID NO: 3054436 - RNA, 15 nt, Mycobacterium bovis subsp bovis AF2122/97
cggaauacgcgccgc

SEQ ID NO: 3054437 - RNA, 22 nt, Mycobacterium bovis subsp bovis AF2122/97
cggaauacgcgccgccggcucg

SEQ ID NO: 3054438 - RNA, 16 nt, Mycobacterium bovis subsp bovis AF2122/97
cggaauagcaacgcug

SEQ ID NO: 3054439 - RNA, 17 nt, Mycobacterium bovis subsp bovis AF2122/97
cggaaucagcaccccau

SEQ ID NO: 3054440 - RNA, 18 nt, Mycobacterium bovis subsp bovis AF2122/97
cggaauccccccugucgc

SEQ ID NO: 3054441 - RNA, 23 nt, Mycobacterium bovis subsp bovis AF2122/97
cggaauccccccugucgccgaug

SEQ ID NO: 3054442 - RNA, 18 nt, Mycobacterium bovis subsp bovis AF2122/97
cggaauccuggccgccgc

SEQ ID NO: 3054443 - RNA, 19 nt, Mycobacterium bovis subsp bovis AF2122/97
cggaauccuggccgccgcc

SEQ ID NO: 3054444 - RNA, 22 nt, Mycobacterium bovis subsp bovis AF2122/97
cggaauccuggccgccgccccg

SEQ ID NO: 3054445 - RNA, 21 nt, Mycobacterium bovis subsp bovis AF2122/97
cggaaucgcaucggcggggcc

SEQ ID NO: 3054446 - RNA, 23 nt, Mycobacterium bovis subsp bovis AF2122/97
cggaaucgcaucuagguucaguu

SEQ ID NO: 3054447 - RNA, 14 nt, Mycobacterium bovis subsp bovis AF2122/97
cggaaucgcccggg

SEQ ID NO: 3054448 - RNA, 15 nt, Mycobacterium bovis subsp bovis AF2122/97
cggaaucgcccgggc

SEQ ID NO: 3054449 - RNA, 16 nt, Mycobacterium bovis subsp bovis AF2122/97
cggaaucgcccgggcg

SEQ ID NO: 3054450 - RNA, 16 nt, Mycobacterium bovis subsp bovis AF2122/97
cggaaucgcgaaacag

SEQ ID NO: 3054451 - RNA, 12 nt, Mycobacterium bovis subsp bovis AF2122/97
cggaaucgcgag

SEQ ID NO: 3054452 - RNA, 17 nt, Mycobacterium bovis subsp bovis AF2122/97
cggaaucggagccgucg

SEQ ID NO: 3054453 - RNA, 23 nt, Mycobacterium bovis subsp bovis AF2122/97
cggaaucggcggaugaugcaacg

SEQ ID NO: 3054454 - RNA, 14 nt, Mycobacterium bovis subsp bovis AF2122/97
cggaaucggcggcg

SEQ ID NO: 3054455 - RNA, 18 nt, Mycobacterium bovis subsp bovis AF2122/97
cggaaucgguuucgaccu

SEQ ID NO: 3054456 - RNA, 12 nt, Mycobacterium bovis subsp bovis AF2122/97
cggaaucgucgc

SEQ ID NO: 3054457 - RNA, 21 nt, Mycobacterium bovis subsp bovis AF2122/97
cggaaucgucgcggccgucgc

SEQ ID NO: 3054458 - RNA, 22 nt, Mycobacterium bovis subsp bovis AF2122/97
cggaaucgucgcggccgucgcg

SEQ ID NO: 3054459 - RNA, 15 nt, Mycobacterium bovis subsp bovis AF2122/97
cggaaucgucggcgc

SEQ ID NO: 3054460 - RNA, 16 nt, Mycobacterium bovis subsp bovis AF2122/97
cggaaucgucggcgcg

SEQ ID NO: 3054461 - RNA, 17 nt, Mycobacterium bovis subsp bovis AF2122/97
cggaaucgucggcgcgg

SEQ ID NO: 3054462 - RNA, 19 nt, Mycobacterium bovis subsp bovis AF2122/97
cggaaucuuguugucgugc

SEQ ID NO: 3054463 - RNA, 17 nt, Mycobacterium bovis subsp bovis AF2122/97
cggaaugcccgggcccg

SEQ ID NO: 3054464 - RNA, 13 nt, Mycobacterium bovis subsp bovis AF2122/97
cggaauggcgccg

SEQ ID NO: 3054465 - RNA, 19 nt, Mycobacterium bovis subsp bovis AF2122/97
cggaauggcgccggccggc

SEQ ID NO: 3054466 - RNA, 22 nt, Mycobacterium bovis subsp bovis AF2122/97
cggaaugggcgccacagccgua

SEQ ID NO: 3054467 - RNA, 23 nt, Mycobacterium bovis subsp bovis AF2122/97
cggaauggucccggguccaagaa

SEQ ID NO: 3054468 - RNA, 14 nt, Mycobacterium bovis subsp bovis AF2122/97
cggaaugucagccg

SEQ ID NO: 3054469 - RNA, 18 nt, Mycobacterium bovis subsp bovis AF2122/97
cggaccguccgacggcgg

SEQ ID NO: 3054470 - RNA, 15 nt, Mycobacterium bovis subsp bovis AF2122/97
cggaccgucgccggu

SEQ ID NO: 3054471 - RNA, 16 nt, Mycobacterium bovis subsp bovis AF2122/97
cggaccgucgccggug

SEQ ID NO: 3054472 - RNA, 16 nt, Mycobacterium bovis subsp bovis AF2122/97
cggaccgucguggcgg

SEQ ID NO: 3054473 - RNA, 23 nt, Mycobacterium bovis subsp bovis AF2122/97
cggaccgucuuuggugccgagca

SEQ ID NO: 3054474 - RNA, 17 nt, Mycobacterium bovis subsp bovis AF2122/97
cggaccguggcagcugc

SEQ ID NO: 3054475 - RNA, 22 nt, Mycobacterium bovis subsp bovis AF2122/97
cggaccguguuguuagccccgc

SEQ ID NO: 3054476 - RNA, 14 nt, Mycobacterium bovis subsp bovis AF2122/97
cggaccuccucgcc

SEQ ID NO: 3054477 - RNA, 17 nt, Mycobacterium bovis subsp bovis AF2122/97
cggaccuccucgcccau

SEQ ID NO: 3054478 - RNA, 16 nt, Mycobacterium bovis subsp bovis AF2122/97
cggaccucgaagccca

SEQ ID NO: 3054479 - RNA, 14 nt, Mycobacterium bovis subsp bovis AF2122/97
cggaccucgcccau

SEQ ID NO: 3054480 - RNA, 16 nt, Mycobacterium bovis subsp bovis AF2122/97
cggaccucgcccauga

SEQ ID NO: 3054481 - RNA, 16 nt, Mycobacterium bovis subsp bovis AF2122/97
cggaccucggcgaccu

SEQ ID NO: 3054482 - RNA, 18 nt, Mycobacterium bovis subsp bovis AF2122/97
cggaccucggcgaccugc

SEQ ID NO: 3054483 - RNA, 13 nt, Mycobacterium bovis subsp bovis AF2122/97
cggaccucggcgg

SEQ ID NO: 3054484 - RNA, 16 nt, Mycobacterium bovis subsp bovis AF2122/97
cggaccugaccggugg

SEQ ID NO: 3054485 - RNA, 23 nt, Mycobacterium bovis subsp bovis AF2122/97
cggaccugaccgguggccaucgc

SEQ ID NO: 3054486 - RNA, 17 nt, Mycobacterium bovis subsp bovis AF2122/97
cggaccugcgccgguga

SEQ ID NO: 3054487 - RNA, 16 nt, Mycobacterium bovis subsp bovis AF2122/97
cggaccuggcggcggu

SEQ ID NO: 3054488 - RNA, 22 nt, Mycobacterium bovis subsp bovis AF2122/97
cggaccugggcgacuaccggcu

SEQ ID NO: 3054489 - RNA, 20 nt, Mycobacterium bovis subsp bovis AF2122/97
cggaccuggguggcgucgcg

SEQ ID NO: 3054490 - RNA, 20 nt, Mycobacterium bovis subsp bovis AF2122/97
cggaccuuccgggugaaguu

SEQ ID NO: 3054491 - RNA, 14 nt, Mycobacterium bovis subsp bovis AF2122/97
cggaccuucggcgg

SEQ ID NO: 3054492 - RNA, 15 nt, Mycobacterium bovis subsp bovis AF2122/97
cggaccuucggcggu

SEQ ID NO: 3054493 - RNA, 15 nt, Mycobacterium bovis subsp bovis AF2122/97
cggaccuuguuggcc

SEQ ID NO: 3054494 - RNA, 22 nt, Mycobacterium bovis subsp bovis AF2122/97
cggacgaaaucggcggcgucca

SEQ ID NO: 3054495 - RNA, 21 nt, Mycobacterium bovis subsp bovis AF2122/97
cggacgaacgccgucgacgcg

SEQ ID NO: 3054496 - RNA, 23 nt, Mycobacterium bovis subsp bovis AF2122/97
cggacgaacgccgucgacgcggc

SEQ ID NO: 3054497 - RNA, 15 nt, Mycobacterium bovis subsp bovis AF2122/97
cggacgacgucgggu

SEQ ID NO: 3054498 - RNA, 14 nt, Mycobacterium bovis subsp bovis AF2122/97
cggacgagcgucag

SEQ ID NO: 3054499 - RNA, 17 nt, Mycobacterium bovis subsp bovis AF2122/97
cggacgaucaggguguc

SEQ ID NO: 3054500 - RNA, 21 nt, Mycobacterium bovis subsp bovis AF2122/97
cggacgauggcgucggccagg

SEQ ID NO: 3054501 - RNA, 22 nt, Mycobacterium bovis subsp bovis AF2122/97
cggacgauggcgucggccagga

SEQ ID NO: 3054502 - RNA, 19 nt, Mycobacterium bovis subsp bovis AF2122/97
cggacgcaacacccgggcg

SEQ ID NO: 3054503 - RNA, 19 nt, Mycobacterium bovis subsp bovis AF2122/97
cggacgcacgauccgcacc

SEQ ID NO: 3054504 - RNA, 21 nt, Mycobacterium bovis subsp bovis AF2122/97
cggacgccaugcccgcacgcu

SEQ ID NO: 3054505 - RNA, 15 nt, Mycobacterium bovis subsp bovis AF2122/97
cggacgcccggcgca

SEQ ID NO: 3054506 - RNA, 14 nt, Mycobacterium bovis subsp bovis AF2122/97
cggacgccgcgccg

SEQ ID NO: 3054507 - RNA, 12 nt, Mycobacterium bovis subsp bovis AF2122/97
cggacgcgccgg

SEQ ID NO: 3054508 - RNA, 15 nt, Mycobacterium bovis subsp bovis AF2122/97
cggacgcgcggaugg

SEQ ID NO: 3054509 - RNA, 20 nt, Mycobacterium bovis subsp bovis AF2122/97
cggacggauucgaaggucgg

SEQ ID NO: 3054510 - RNA, 17 nt, Mycobacterium bovis subsp bovis AF2122/97
cggacggcagccgggcg

SEQ ID NO: 3054511 - RNA, 23 nt, Mycobacterium bovis subsp bovis AF2122/97
cggacggcagccgggcggcagcg

SEQ ID NO: 3054512 - RNA, 13 nt, Mycobacterium bovis subsp bovis AF2122/97
cggacggcgucga

SEQ ID NO: 3054513 - RNA, 14 nt, Mycobacterium bovis subsp bovis AF2122/97
cggacggcgucgag

SEQ ID NO: 3054514 - RNA, 22 nt, Mycobacterium bovis subsp bovis AF2122/97
cggacggcguuuccuucgacga

SEQ ID NO: 3054515 - RNA, 18 nt, Mycobacterium bovis subsp bovis AF2122/97
cggacgggaucgcccagg

SEQ ID NO: 3054516 - RNA, 23 nt, Mycobacterium bovis subsp bovis AF2122/97
cggacgggaucgcccaggcgcga

SEQ ID NO: 3054517 - RNA, 16 nt, Mycobacterium bovis subsp bovis AF2122/97
cggacggguuacucgc

SEQ ID NO: 3054518 - RNA, 15 nt, Mycobacterium bovis subsp bovis AF2122/97
cggacgucgccccgu

SEQ ID NO: 3054519 - RNA, 17 nt, Mycobacterium bovis subsp bovis AF2122/97
cggacgucggcggccgu

SEQ ID NO: 3054520 - RNA, 19 nt, Mycobacterium bovis subsp bovis AF2122/97
cggacgucgugaccggcgg

SEQ ID NO: 3054521 - RNA, 13 nt, Mycobacterium bovis subsp bovis AF2122/97
cggacgugccggg

SEQ ID NO: 3054522 - RNA, 20 nt, Mycobacterium bovis subsp bovis AF2122/97
cggacgugccgggucaccga

SEQ ID NO: 3054523 - RNA, 14 nt, Mycobacterium bovis subsp bovis AF2122/97
cggacgugccgguc

SEQ ID NO: 3054524 - RNA, 19 nt, Mycobacterium bovis subsp bovis AF2122/97
cggacguggucggagcggg

SEQ ID NO: 3054525 - RNA, 14 nt, Mycobacterium bovis subsp bovis AF2122/97
cggacuaccgccgg

SEQ ID NO: 3054526 - RNA, 15 nt, Mycobacterium bovis subsp bovis AF2122/97
cggacuaccgccggc

SEQ ID NO: 3054527 - RNA, 16 nt, Mycobacterium bovis subsp bovis AF2122/97
cggacucccucgauca

SEQ ID NO: 3054528 - RNA, 13 nt, Mycobacterium bovis subsp bovis AF2122/97
cggacuccggccg

SEQ ID NO: 3054529 - RNA, 16 nt, Mycobacterium bovis subsp bovis AF2122/97
cggacuccggccggcc

SEQ ID NO: 3054530 - RNA, 15 nt, Mycobacterium bovis subsp bovis AF2122/97
cggacucgccgacgu

SEQ ID NO: 3054531 - RNA, 22 nt, Mycobacterium bovis subsp bovis AF2122/97
cggacucggaauucggcgucgu

SEQ ID NO: 3054532 - RNA, 23 nt, Mycobacterium bovis subsp bovis AF2122/97
cggacucggaauucggcgucgug

SEQ ID NO: 3054533 - RNA, 21 nt, Mycobacterium bovis subsp bovis AF2122/97
cggacugagagauggucgggc

SEQ ID NO: 3054534 - RNA, 15 nt, Mycobacterium bovis subsp bovis AF2122/97
cggacugcagcgcgg

SEQ ID NO: 3054535 - RNA, 19 nt, Mycobacterium bovis subsp bovis AF2122/97
cggacugcagcgcggccgg

SEQ ID NO: 3054536 - RNA, 20 nt, Mycobacterium bovis subsp bovis AF2122/97
cggacugcagcgcggccgga

SEQ ID NO: 3054537 - RNA, 23 nt, Mycobacterium bovis subsp bovis AF2122/97
cggacugcgaaaauccgugccga

SEQ ID NO: 3054538 - RNA, 18 nt, Mycobacterium bovis subsp bovis AF2122/97
cggacugcggcccgaccc

SEQ ID NO: 3054539 - RNA, 20 nt, Mycobacterium bovis subsp bovis AF2122/97
cggacuggcauccgccccgc

SEQ ID NO: 3054540 - RNA, 18 nt, Mycobacterium bovis subsp bovis AF2122/97
cggacuggccucggggau

SEQ ID NO: 3054541 - RNA, 16 nt, Mycobacterium bovis subsp bovis AF2122/97
cggacuucccgcgcga

SEQ ID NO: 3054542 - RNA, 19 nt, Mycobacterium bovis subsp bovis AF2122/97
cggacuucccgcgcgagcc

SEQ ID NO: 3054543 - RNA, 13 nt, Mycobacterium bovis subsp bovis AF2122/97
cggacuucgccgc

SEQ ID NO: 3054544 - RNA, 16 nt, Mycobacterium bovis subsp bovis AF2122/97
cggacuucgccgcccg

SEQ ID NO: 3054545 - RNA, 17 nt, Mycobacterium bovis subsp bovis AF2122/97
cggacuucgccgcccgc

SEQ ID NO: 3054546 - RNA, 19 nt, Mycobacterium bovis subsp bovis AF2122/97
cggacuucguuccgugccg

SEQ ID NO: 3054547 - RNA, 17 nt, Mycobacterium bovis subsp bovis AF2122/97
cggacuugaccagagca

SEQ ID NO: 3054548 - RNA, 21 nt, Mycobacterium bovis subsp bovis AF2122/97
cggacuugcgagccguagacc

SEQ ID NO: 3054549 - RNA, 21 nt, Mycobacterium bovis subsp bovis AF2122/97
cggacuugguuucgaugaaga

SEQ ID NO: 3054550 - RNA, 21 nt, Mycobacterium bovis subsp bovis AF2122/97
cggacuuuaaaccgaacccac

SEQ ID NO: 3054551 - RNA, 13 nt, Mycobacterium bovis subsp bovis AF2122/97
cggagaaaagcgc

SEQ ID NO: 3054552 - RNA, 16 nt, Mycobacterium bovis subsp bovis AF2122/97
cggagaaggcgcgggc

SEQ ID NO: 3054553 - RNA, 20 nt, Mycobacterium bovis subsp bovis AF2122/97
cggagaaggcgcgggcgacg

SEQ ID NO: 3054554 - RNA, 21 nt, Mycobacterium bovis subsp bovis AF2122/97
cggagaaggcgcgggcgacgu

SEQ ID NO: 3054555 - RNA, 14 nt, Mycobacterium bovis subsp bovis AF2122/97
cggaggcccgccac

SEQ ID NO: 3054556 - RNA, 13 nt, Mycobacterium bovis subsp bovis AF2122/97
cggaggccgccgc

SEQ ID NO: 3054557 - RNA, 18 nt, Mycobacterium bovis subsp bovis AF2122/97
cggaggccgccgcgccgg

SEQ ID NO: 3054558 - RNA, 19 nt, Mycobacterium bovis subsp bovis AF2122/97
cggaggccgccgcgccggu

SEQ ID NO: 3054559 - RNA, 17 nt, Mycobacterium bovis subsp bovis AF2122/97
cggaggcgaccacgucg

SEQ ID NO: 3054560 - RNA, 19 nt, Mycobacterium bovis subsp bovis AF2122/97
cggaggcgaccacgucggc

SEQ ID NO: 3054561 - RNA, 21 nt, Mycobacterium bovis subsp bovis AF2122/97
cggaggcgaccacgucggcga

SEQ ID NO: 3054562 - RNA, 23 nt, Mycobacterium bovis subsp bovis AF2122/97
cggaggcgaccacgucggcgaac

SEQ ID NO: 3054563 - RNA, 16 nt, Mycobacterium bovis subsp bovis AF2122/97
cggaggcgaccccggc

SEQ ID NO: 3054564 - RNA, 21 nt, Mycobacterium bovis subsp bovis AF2122/97
cggaggcgaccccggccccga

SEQ ID NO: 3054565 - RNA, 13 nt, Mycobacterium bovis subsp bovis AF2122/97
cggaggcggacca

SEQ ID NO: 3054566 - RNA, 20 nt, Mycobacterium bovis subsp bovis AF2122/97
cggaggcggaccaggccgcg

SEQ ID NO: 3054567 - RNA, 22 nt, Mycobacterium bovis subsp bovis AF2122/97
cggaggcggaccaggccgcgcg

SEQ ID NO: 3054568 - RNA, 22 nt, Mycobacterium bovis subsp bovis AF2122/97
cggaggcggccagccuaccggc

SEQ ID NO: 3054569 - RNA, 16 nt, Mycobacterium bovis subsp bovis AF2122/97
cggaggcgggugcggc

SEQ ID NO: 3054570 - RNA, 16 nt, Mycobacterium bovis subsp bovis AF2122/97
cggaggcugggcugag

SEQ ID NO: 3054571 - RNA, 16 nt, Mycobacterium bovis subsp bovis AF2122/97
cggaggguugccgccg

SEQ ID NO: 3054572 - RNA, 17 nt, Mycobacterium bovis subsp bovis AF2122/97
cggaggguugccgccga

SEQ ID NO: 3054573 - RNA, 13 nt, Mycobacterium bovis subsp bovis AF2122/97
cggaggucggagc

SEQ ID NO: 3054574 - RNA, 21 nt, Mycobacterium bovis subsp bovis AF2122/97
cggaggucggagcgggcuccg

SEQ ID NO: 3054575 - RNA, 21 nt, Mycobacterium bovis subsp bovis AF2122/97
cggaggugaaccccgccggca

SEQ ID NO: 3054576 - RNA, 13 nt, Mycobacterium bovis subsp bovis AF2122/97
cggaggugccggc

SEQ ID NO: 3054577 - RNA, 14 nt, Mycobacterium bovis subsp bovis AF2122/97
cggaggugccggcg

SEQ ID NO: 3054578 - RNA, 17 nt, Mycobacterium bovis subsp bovis AF2122/97
cggaggugccggcgcca

SEQ ID NO: 3054579 - RNA, 19 nt, Mycobacterium bovis subsp bovis AF2122/97
cggaggugggguggggagc

SEQ ID NO: 3054580 - RNA, 20 nt, Mycobacterium bovis subsp bovis AF2122/97
cggaggugggguggggagcu

SEQ ID NO: 3054581 - RNA, 20 nt, Mycobacterium bovis subsp bovis AF2122/97
cggaguaaacaaacccaaca

SEQ ID NO: 3054582 - RNA, 21 nt, Mycobacterium bovis subsp bovis AF2122/97
cggaguaaacaaacccaacac

SEQ ID NO: 3054583 - RNA, 22 nt, Mycobacterium bovis subsp bovis AF2122/97
cggaguaaacaaacccaacacc

SEQ ID NO: 3054584 - RNA, 23 nt, Mycobacterium bovis subsp bovis AF2122/97
cggaguaagcgauucccaaccgg

SEQ ID NO: 3054585 - RNA, 14 nt, Mycobacterium bovis subsp bovis AF2122/97
cggaguaccgcgcg

SEQ ID NO: 3054586 - RNA, 15 nt, Mycobacterium bovis subsp bovis AF2122/97
cggaguacuccagcc

SEQ ID NO: 3054587 - RNA, 23 nt, Mycobacterium bovis subsp bovis AF2122/97
cggagucaccagcaacagcccga

SEQ ID NO: 3054588 - RNA, 14 nt, Mycobacterium bovis subsp bovis AF2122/97
cggagucacgcagc

SEQ ID NO: 3054589 - RNA, 15 nt, Mycobacterium bovis subsp bovis AF2122/97
cggagucacgcagcc

SEQ ID NO: 3054590 - RNA, 17 nt, Mycobacterium bovis subsp bovis AF2122/97
cggagucacgcagccgc

SEQ ID NO: 3054591 - RNA, 18 nt, Mycobacterium bovis subsp bovis AF2122/97
cggagucacgcagccgcg

SEQ ID NO: 3054592 - RNA, 19 nt, Mycobacterium bovis subsp bovis AF2122/97
cggagucacgcagccgcgc

SEQ ID NO: 3054593 - RNA, 20 nt, Mycobacterium bovis subsp bovis AF2122/97
cggagucacgcagccgcgcg

SEQ ID NO: 3054594 - RNA, 21 nt, Mycobacterium bovis subsp bovis AF2122/97
cggagucacgcagccgcgcgg

SEQ ID NO: 3054595 - RNA, 20 nt, Mycobacterium bovis subsp bovis AF2122/97
cggaguccgucggggacauc

SEQ ID NO: 3054596 - RNA, 20 nt, Mycobacterium bovis subsp bovis AF2122/97
cggagucgacccugcccagc

SEQ ID NO: 3054597 - RNA, 21 nt, Mycobacterium bovis subsp bovis AF2122/97
cggagucgacccugcccagca

SEQ ID NO: 3054598 - RNA, 15 nt, Mycobacterium bovis subsp bovis AF2122/97
cggagucgacgacgu

SEQ ID NO: 3054599 - RNA, 19 nt, Mycobacterium bovis subsp bovis AF2122/97
cggagucgacggucacggu

SEQ ID NO: 3054600 - RNA, 13 nt, Mycobacterium bovis subsp bovis AF2122/97
cggagucgcccgg

SEQ ID NO: 3054601 - RNA, 19 nt, Mycobacterium bovis subsp bovis AF2122/97
cggagucgcccgguccgcc

SEQ ID NO: 3054602 - RNA, 23 nt, Mycobacterium bovis subsp bovis AF2122/97
cggagucgcccgguccgccgcag

SEQ ID NO: 3054603 - RNA, 16 nt, Mycobacterium bovis subsp bovis AF2122/97
cggagucgcgcagggc

SEQ ID NO: 3054604 - RNA, 21 nt, Mycobacterium bovis subsp bovis AF2122/97
cggagucgcgcagggcgacau

SEQ ID NO: 3054605 - RNA, 18 nt, Mycobacterium bovis subsp bovis AF2122/97
cggagucuucaacgucga

SEQ ID NO: 3054606 - RNA, 18 nt, Mycobacterium bovis subsp bovis AF2122/97
cggagucuucgucgucgg

SEQ ID NO: 3054607 - RNA, 14 nt, Mycobacterium bovis subsp bovis AF2122/97
cggaguggccaguu

SEQ ID NO: 3054608 - RNA, 16 nt, Mycobacterium bovis subsp bovis AF2122/97
cggagugguauccagg

SEQ ID NO: 3054609 - RNA, 19 nt, Mycobacterium bovis subsp bovis AF2122/97
cggagugguauccaggccc

SEQ ID NO: 3054610 - RNA, 18 nt, Mycobacterium bovis subsp bovis AF2122/97
cggagugucgaugcgcgc

SEQ ID NO: 3054611 - RNA, 19 nt, Mycobacterium bovis subsp bovis AF2122/97
cggagugucgaugcgcgcc

SEQ ID NO: 3054612 - RNA, 22 nt, Mycobacterium bovis subsp bovis AF2122/97
cggagugucgaugcgcgccggc

SEQ ID NO: 3054613 - RNA, 23 nt, Mycobacterium bovis subsp bovis AF2122/97
cggaguuaauuccucaaagccuc

SEQ ID NO: 3054614 - RNA, 13 nt, Mycobacterium bovis subsp bovis AF2122/97
cggaguucgcuga

SEQ ID NO: 3054615 - RNA, 18 nt, Mycobacterium bovis subsp bovis AF2122/97
cggaguucgcugacggcc

SEQ ID NO: 3054616 - RNA, 19 nt, Mycobacterium bovis subsp bovis AF2122/97
cggaguucgcugacggcca

SEQ ID NO: 3054617 - RNA, 16 nt, Mycobacterium bovis subsp bovis AF2122/97
cggaguucugcgauca

SEQ ID NO: 3054618 - RNA, 18 nt, Mycobacterium bovis subsp bovis AF2122/97
cggaguucuucgaaggcg

SEQ ID NO: 3054619 - RNA, 18 nt, Mycobacterium bovis subsp bovis AF2122/97
cggaguugaagaagcccg

SEQ ID NO: 3054620 - RNA, 21 nt, Mycobacterium bovis subsp bovis AF2122/97
cggaguugaagaagcccgacg

SEQ ID NO: 3054621 - RNA, 16 nt, Mycobacterium bovis subsp bovis AF2122/97
cggaguuggcccgacg

SEQ ID NO: 3054622 - RNA, 21 nt, Mycobacterium bovis subsp bovis AF2122/97
cggaguugucgacggccaccc

SEQ ID NO: 3054623 - RNA, 17 nt, Mycobacterium bovis subsp bovis AF2122/97
cggaguuuaagacgccc

SEQ ID NO: 3054624 - RNA, 18 nt, Mycobacterium bovis subsp bovis AF2122/97
cggaguuuaagacgcccg

SEQ ID NO: 3054625 - RNA, 21 nt, Mycobacterium bovis subsp bovis AF2122/97
cggaguuuaagacgcccgagu

SEQ ID NO: 3054626 - RNA, 18 nt, Mycobacterium bovis subsp bovis AF2122/97
cggauaacccagcggcgc

SEQ ID NO: 3054627 - RNA, 14 nt, Mycobacterium bovis subsp bovis AF2122/97
cggauaacccgugg

SEQ ID NO: 3054628 - RNA, 21 nt, Mycobacterium bovis subsp bovis AF2122/97
cggauaacccguggcgguugc

SEQ ID NO: 3054629 - RNA, 15 nt, Mycobacterium bovis subsp bovis AF2122/97
cggauaaccggcaug

SEQ ID NO: 3054630 - RNA, 23 nt, Mycobacterium bovis subsp bovis AF2122/97
cggauaauucaacagcaccgcga

SEQ ID NO: 3054631 - RNA, 15 nt, Mycobacterium bovis subsp bovis AF2122/97
cggauacagccgccg

SEQ ID NO: 3054632 - RNA, 23 nt, Mycobacterium bovis subsp bovis AF2122/97
cggauacagccgccgccggcaac

SEQ ID NO: 3054633 - RNA, 21 nt, Mycobacterium bovis subsp bovis AF2122/97
cggauacccuuugcacggugg

SEQ ID NO: 3054634 - RNA, 14 nt, Mycobacterium bovis subsp bovis AF2122/97
cggauacggcgaca

SEQ ID NO: 3054635 - RNA, 17 nt, Mycobacterium bovis subsp bovis AF2122/97
cggauagacggcgacga

SEQ ID NO: 3054636 - RNA, 14 nt, Mycobacterium bovis subsp bovis AF2122/97
cggauagcaccggc

SEQ ID NO: 3054637 - RNA, 18 nt, Mycobacterium bovis subsp bovis AF2122/97
cggauagcaccggcaccc

SEQ ID NO: 3054638 - RNA, 19 nt, Mycobacterium bovis subsp bovis AF2122/97
cggauagcaccggcacccg

SEQ ID NO: 3054639 - RNA, 21 nt, Mycobacterium bovis subsp bovis AF2122/97
cggauagcgucuggcgacauc

SEQ ID NO: 3054640 - RNA, 20 nt, Mycobacterium bovis subsp bovis AF2122/97
cggauaggacgaacaacgcg

SEQ ID NO: 3054641 - RNA, 16 nt, Mycobacterium bovis subsp bovis AF2122/97
cggauggccccgccaa

SEQ ID NO: 3054642 - RNA, 20 nt, Mycobacterium bovis subsp bovis AF2122/97
cggauggccucgaacgccgc

SEQ ID NO: 3054643 - RNA, 23 nt, Mycobacterium bovis subsp bovis AF2122/97
cggauggccucgaacgccgcccg

SEQ ID NO: 3054644 - RNA, 13 nt, Mycobacterium bovis subsp bovis AF2122/97
cggauggccucgg

SEQ ID NO: 3054645 - RNA, 13 nt, Mycobacterium bovis subsp bovis AF2122/97
cggauggcgucga

SEQ ID NO: 3054646 - RNA, 14 nt, Mycobacterium bovis subsp bovis AF2122/97
cggaugggcgucga

SEQ ID NO: 3054647 - RNA, 17 nt, Mycobacterium bovis subsp bovis AF2122/97
cggauggugugucgggu

SEQ ID NO: 3054648 - RNA, 18 nt, Mycobacterium bovis subsp bovis AF2122/97
cggauguauuccaggcgu

SEQ ID NO: 3054649 - RNA, 21 nt, Mycobacterium bovis subsp bovis AF2122/97
cggauguccaggagugcgggc

SEQ ID NO: 3054650 - RNA, 15 nt, Mycobacterium bovis subsp bovis AF2122/97
cggauguccgccgac

SEQ ID NO: 3054651 - RNA, 17 nt, Mycobacterium bovis subsp bovis AF2122/97
cggauguccgccgacgu

SEQ ID NO: 3054652 - RNA, 21 nt, Mycobacterium bovis subsp bovis AF2122/97
cggaugucgacgagcaccgcg

SEQ ID NO: 3054653 - RNA, 15 nt, Mycobacterium bovis subsp bovis AF2122/97
cggaugucgucgacc

SEQ ID NO: 3054654 - RNA, 22 nt, Mycobacterium bovis subsp bovis AF2122/97
cggaugucgugcgggcgcacca

SEQ ID NO: 3054655 - RNA, 17 nt, Mycobacterium bovis subsp bovis AF2122/97
cggaugucucggcacca

SEQ ID NO: 3054656 - RNA, 20 nt, Mycobacterium bovis subsp bovis AF2122/97
cggaugucucggcaccacag

SEQ ID NO: 3054657 - RNA, 18 nt, Mycobacterium bovis subsp bovis AF2122/97
cggauguggugucgaugc

SEQ ID NO: 3054658 - RNA, 14 nt, Mycobacterium bovis subsp bovis AF2122/97
cggaugugucggcg

SEQ ID NO: 3054659 - RNA, 15 nt, Mycobacterium bovis subsp bovis AF2122/97
cggaugugucggcga

SEQ ID NO: 3054660 - RNA, 17 nt, Mycobacterium bovis subsp bovis AF2122/97
cggauguguucuccugc

SEQ ID NO: 3054661 - RNA, 18 nt, Mycobacterium bovis subsp bovis AF2122/97
cggauguugaccggcucg

SEQ ID NO: 3054662 - RNA, 18 nt, Mycobacterium bovis subsp bovis AF2122/97
cggauguuggucggcuga

SEQ ID NO: 3054663 - RNA, 19 nt, Mycobacterium bovis subsp bovis AF2122/97
cggauuaagucggcggccu

SEQ ID NO: 3054664 - RNA, 15 nt, Mycobacterium bovis subsp bovis AF2122/97
cggauucacgcaccg

SEQ ID NO: 3054665 - RNA, 20 nt, Mycobacterium bovis subsp bovis AF2122/97
cggauucacgcaccggcgca

SEQ ID NO: 3054666 - RNA, 18 nt, Mycobacterium bovis subsp bovis AF2122/97
cggauucaucacgggacg

SEQ ID NO: 3054667 - RNA, 14 nt, Mycobacterium bovis subsp bovis AF2122/97
cggauuccagcgcg

SEQ ID NO: 3054668 - RNA, 15 nt, Mycobacterium bovis subsp bovis AF2122/97
cggauuccagcgcgu

SEQ ID NO: 3054669 - RNA, 14 nt, Mycobacterium bovis subsp bovis AF2122/97
cggauuccucguca

SEQ ID NO: 3054670 - RNA, 18 nt, Mycobacterium bovis subsp bovis AF2122/97
cggauuccucgucaccgc

SEQ ID NO: 3054671 - RNA, 23 nt, Mycobacterium bovis subsp bovis AF2122/97
cggauuccucgucaccgcgacca

SEQ ID NO: 3054672 - RNA, 14 nt, Mycobacterium bovis subsp bovis AF2122/97
cggauucgaaggca

SEQ ID NO: 3054673 - RNA, 14 nt, Mycobacterium bovis subsp bovis AF2122/97
cggauucgcccggg

SEQ ID NO: 3054674 - RNA, 16 nt, Mycobacterium bovis subsp bovis AF2122/97
cggauucgcccgggcg

SEQ ID NO: 3054675 - RNA, 13 nt, Mycobacterium bovis subsp bovis AF2122/97
cggauucggcgcu

SEQ ID NO: 3054676 - RNA, 15 nt, Mycobacterium bovis subsp bovis AF2122/97
cggauucgggcgaag

SEQ ID NO: 3054677 - RNA, 20 nt, Mycobacterium bovis subsp bovis AF2122/97
cggauucgggcgaagcuagc

SEQ ID NO: 3054678 - RNA, 14 nt, Mycobacterium bovis subsp bovis AF2122/97
cggauucuccgccc

SEQ ID NO: 3054679 - RNA, 16 nt, Mycobacterium bovis subsp bovis AF2122/97
cggauucuucggugaa

SEQ ID NO: 3054680 - RNA, 18 nt, Mycobacterium bovis subsp bovis AF2122/97
cggauucuucggugaaga

SEQ ID NO: 3054681 - RNA, 12 nt, Mycobacterium bovis subsp bovis AF2122/97
cggauugagcac

SEQ ID NO: 3054682 - RNA, 16 nt, Mycobacterium bovis subsp bovis AF2122/97
cggauugagcacgcgc

SEQ ID NO: 3054683 - RNA, 24 nt, Mycobacterium bovis subsp bovis AF2122/97
cggauugcagcgcgauggccuggc

SEQ ID NO: 3054684 - RNA, 14 nt, Mycobacterium bovis subsp bovis AF2122/97
cggauugccgcgcg

SEQ ID NO: 3054685 - RNA, 17 nt, Mycobacterium bovis subsp bovis AF2122/97
cggauugcucgaucugu

SEQ ID NO: 3054686 - RNA, 23 nt, Mycobacterium bovis subsp bovis AF2122/97
cggauuggccuugugcagaucag

SEQ ID NO: 3054687 - RNA, 14 nt, Mycobacterium bovis subsp bovis AF2122/97
cggauuggcgauga

SEQ ID NO: 3054688 - RNA, 21 nt, Mycobacterium bovis subsp bovis AF2122/97
cggauuggugggccagcagca

SEQ ID NO: 3054689 - RNA, 23 nt, Mycobacterium bovis subsp bovis AF2122/97
cggauuggugggccagcagcaac

SEQ ID NO: 3054690 - RNA, 18 nt, Mycobacterium bovis subsp bovis AF2122/97
cggauuugggucagugcg

SEQ ID NO: 3054691 - RNA, 14 nt, Mycobacterium bovis subsp bovis AF2122/97
cggcaaaccgucgg

SEQ ID NO: 3054692 - RNA, 16 nt, Mycobacterium bovis subsp bovis AF2122/97
cggcaaaccugagucc

SEQ ID NO: 3054693 - RNA, 18 nt, Mycobacterium bovis subsp bovis AF2122/97
cggcaaaccugaguccgg

SEQ ID NO: 3054694 - RNA, 21 nt, Mycobacterium bovis subsp bovis AF2122/97
cggcaaaccugaguccggcac

SEQ ID NO: 3054695 - RNA, 14 nt, Mycobacterium bovis subsp bovis AF2122/97
cggcaaacuccagc

SEQ ID NO: 3054696 - RNA, 19 nt, Mycobacterium bovis subsp bovis AF2122/97
cggcaaagaacagccggcc

SEQ ID NO: 3054697 - RNA, 23 nt, Mycobacterium bovis subsp bovis AF2122/97
cggcaaagaaggcgacccgcugg

SEQ ID NO: 3054698 - RNA, 17 nt, Mycobacterium bovis subsp bovis AF2122/97
cggcaaaggacgucgac

SEQ ID NO: 3054699 - RNA, 21 nt, Mycobacterium bovis subsp bovis AF2122/97
cggcaaaggauucgcgcgaau

SEQ ID NO: 3054700 - RNA, 12 nt, Mycobacterium bovis subsp bovis AF2122/97
cggcaaaggcgc

SEQ ID NO: 3054701 - RNA, 18 nt, Mycobacterium bovis subsp bovis AF2122/97
cggcaaaguuggccgccc

SEQ ID NO: 3054702 - RNA, 16 nt, Mycobacterium bovis subsp bovis AF2122/97
cggcaaauaggucuga

SEQ ID NO: 3054703 - RNA, 18 nt, Mycobacterium bovis subsp bovis AF2122/97
cggcaacaaagucgccau

SEQ ID NO: 3054704 - RNA, 14 nt, Mycobacterium bovis subsp bovis AF2122/97
cggcaacagcgcca

SEQ ID NO: 3054705 - RNA, 19 nt, Mycobacterium bovis subsp bovis AF2122/97
cggcaacagcgccaagacg

SEQ ID NO: 3054706 - RNA, 23 nt, Mycobacterium bovis subsp bovis AF2122/97
cggcaacagcgccaagacgucgg

SEQ ID NO: 3054707 - RNA, 16 nt, Mycobacterium bovis subsp bovis AF2122/97
cggcaaccaaccgcgc

SEQ ID NO: 3054708 - RNA, 18 nt, Mycobacterium bovis subsp bovis AF2122/97
cggcaaccaccggccgcg

SEQ ID NO: 3054709 - RNA, 20 nt, Mycobacterium bovis subsp bovis AF2122/97
cggcaaccaccggccgcgca

SEQ ID NO: 3054710 - RNA, 17 nt, Mycobacterium bovis subsp bovis AF2122/97
cggcaaccaccucgugg

SEQ ID NO: 3054711 - RNA, 14 nt, Mycobacterium bovis subsp bovis AF2122/97
cggcaacccacacg

SEQ ID NO: 3054712 - RNA, 18 nt, Mycobacterium bovis subsp bovis AF2122/97
cggcaacccacacgcccu

SEQ ID NO: 3054713 - RNA, 15 nt, Mycobacterium bovis subsp bovis AF2122/97
cggcaacccgcacca

SEQ ID NO: 3054714 - RNA, 20 nt, Mycobacterium bovis subsp bovis AF2122/97
cggcaacccugcccggcccg

SEQ ID NO: 3054715 - RNA, 21 nt, Mycobacterium bovis subsp bovis AF2122/97
cggcaacccugcccggcccgc

SEQ ID NO: 3054716 - RNA, 22 nt, Mycobacterium bovis subsp bovis AF2122/97
cggcaacccugcccggcccgcc

SEQ ID NO: 3054717 - RNA, 17 nt, Mycobacterium bovis subsp bovis AF2122/97
cggcaaccgccgccacc

SEQ ID NO: 3054718 - RNA, 17 nt, Mycobacterium bovis subsp bovis AF2122/97
cggcaaccgccgugugc

SEQ ID NO: 3054719 - RNA, 12 nt, Mycobacterium bovis subsp bovis AF2122/97
cggcaaccggga

SEQ ID NO: 3054720 - RNA, 14 nt, Mycobacterium bovis subsp bovis AF2122/97
cggcaaccgggauc

SEQ ID NO: 3054721 - RNA, 16 nt, Mycobacterium bovis subsp bovis AF2122/97
cggcaaccugaaucca

SEQ ID NO: 3054722 - RNA, 20 nt, Mycobacterium bovis subsp bovis AF2122/97
cggcaaccugaauccagacc

SEQ ID NO: 3054723 - RNA, 17 nt, Mycobacterium bovis subsp bovis AF2122/97
cggcaacgacccgccgc

SEQ ID NO: 3054724 - RNA, 17 nt, Mycobacterium bovis subsp bovis AF2122/97
cggcaacgacugcauga

SEQ ID NO: 3054725 - RNA, 21 nt, Mycobacterium bovis subsp bovis AF2122/97
cggcaacgaggucugcggccg

SEQ ID NO: 3054726 - RNA, 21 nt, Mycobacterium bovis subsp bovis AF2122/97
cggcaacgaucgacaccaggg

SEQ ID NO: 3054727 - RNA, 22 nt, Mycobacterium bovis subsp bovis AF2122/97
cggcaacgaucgacaccagggc

SEQ ID NO: 3054728 - RNA, 16 nt, Mycobacterium bovis subsp bovis AF2122/97
cggcaccaaccaccga

SEQ ID NO: 3054729 - RNA, 20 nt, Mycobacterium bovis subsp bovis AF2122/97
cggcaccaaugcggugacaa

SEQ ID NO: 3054730 - RNA, 23 nt, Mycobacterium bovis subsp bovis AF2122/97
cggcaccaccaagcucggccagc

SEQ ID NO: 3054731 - RNA, 19 nt, Mycobacterium bovis subsp bovis AF2122/97
cggcaccaccacgccgacc

SEQ ID NO: 3054732 - RNA, 14 nt, Mycobacterium bovis subsp bovis AF2122/97
cggcaccaccgcga

SEQ ID NO: 3054733 - RNA, 15 nt, Mycobacterium bovis subsp bovis AF2122/97
cggcaccaccgcgac

SEQ ID NO: 3054734 - RNA, 19 nt, Mycobacterium bovis subsp bovis AF2122/97
cggcaccaccgcgaccucg

SEQ ID NO: 3054735 - RNA, 20 nt, Mycobacterium bovis subsp bovis AF2122/97
cggcaccaccgcgaccucgc

SEQ ID NO: 3054736 - RNA, 12 nt, Mycobacterium bovis subsp bovis AF2122/97
cggcaccacgau

SEQ ID NO: 3054737 - RNA, 14 nt, Mycobacterium bovis subsp bovis AF2122/97
cggcaccacgucga

SEQ ID NO: 3054738 - RNA, 15 nt, Mycobacterium bovis subsp bovis AF2122/97
cggcaccacgucgac

SEQ ID NO: 3054739 - RNA, 14 nt, Mycobacterium bovis subsp bovis AF2122/97
cggcaccagcaccg

SEQ ID NO: 3054740 - RNA, 17 nt, Mycobacterium bovis subsp bovis AF2122/97
cggcaccagcgcgcgcc

SEQ ID NO: 3054741 - RNA, 18 nt, Mycobacterium bovis subsp bovis AF2122/97
cggcaccagcgcgcgccg

SEQ ID NO: 3054742 - RNA, 19 nt, Mycobacterium bovis subsp bovis AF2122/97
cggcaccagcgcgcgccga

SEQ ID NO: 3054743 - RNA, 15 nt, Mycobacterium bovis subsp bovis AF2122/97
cggcaccagcggcac

SEQ ID NO: 3054744 - RNA, 18 nt, Mycobacterium bovis subsp bovis AF2122/97
cggcaccagcggcaccgc

SEQ ID NO: 3054745 - RNA, 17 nt, Mycobacterium bovis subsp bovis AF2122/97
cggcaccagcgggucgg

SEQ ID NO: 3054746 - RNA, 15 nt, Mycobacterium bovis subsp bovis AF2122/97
cggcaccagguugcc

SEQ ID NO: 3054747 - RNA, 16 nt, Mycobacterium bovis subsp bovis AF2122/97
cggcaccagguugccg

SEQ ID NO: 3054748 - RNA, 21 nt, Mycobacterium bovis subsp bovis AF2122/97
cggcacccaaccaggccgcga

SEQ ID NO: 3054749 - RNA, 23 nt, Mycobacterium bovis subsp bovis AF2122/97
cggcacccaaccaggccgcgaca

SEQ ID NO: 3054750 - RNA, 19 nt, Mycobacterium bovis subsp bovis AF2122/97
cggcacccacccguucggc

SEQ ID NO: 3054751 - RNA, 17 nt, Mycobacterium bovis subsp bovis AF2122/97
cggcacccagucggcgc

SEQ ID NO: 3054752 - RNA, 21 nt, Mycobacterium bovis subsp bovis AF2122/97
cggcacccagucggcgccgcc

SEQ ID NO: 3054753 - RNA, 22 nt, Mycobacterium bovis subsp bovis AF2122/97
cggcacccagucggcgccgccg

SEQ ID NO: 3054754 - RNA, 20 nt, Mycobacterium bovis subsp bovis AF2122/97
cggcaccccacgccugccga

SEQ ID NO: 3054755 - RNA, 16 nt, Mycobacterium bovis subsp bovis AF2122/97
cggcaccccacggcca

SEQ ID NO: 3054756 - RNA, 14 nt, Mycobacterium bovis subsp bovis AF2122/97
cggcacccccgacg

SEQ ID NO: 3054757 - RNA, 15 nt, Mycobacterium bovis subsp bovis AF2122/97
cggcacccccgacga

SEQ ID NO: 3054758 - RNA, 21 nt, Mycobacterium bovis subsp bovis AF2122/97
cggcacccccgucgccaccga

SEQ ID NO: 3054759 - RNA, 17 nt, Mycobacterium bovis subsp bovis AF2122/97
cggcaccccggccacuu

SEQ ID NO: 3054760 - RNA, 20 nt, Mycobacterium bovis subsp bovis AF2122/97
cggcaccccuuugacgccga

SEQ ID NO: 3054761 - RNA, 22 nt, Mycobacterium bovis subsp bovis AF2122/97
cggcacccgacucgucggccug

SEQ ID NO: 3054762 - RNA, 23 nt, Mycobacterium bovis subsp bovis AF2122/97
cggcacccgaguuauagaagccg

SEQ ID NO: 3054763 - RNA, 14 nt, Mycobacterium bovis subsp bovis AF2122/97
cggcacccgcacgg

SEQ ID NO: 3054764 - RNA, 15 nt, Mycobacterium bovis subsp bovis AF2122/97
cggcacccgcacggc

SEQ ID NO: 3054765 - RNA, 18 nt, Mycobacterium bovis subsp bovis AF2122/97
cggcacccgcacggccuc

SEQ ID NO: 3054766 - RNA, 22 nt, Mycobacterium bovis subsp bovis AF2122/97
cggcacccgcacggccuccgga

SEQ ID NO: 3054767 - RNA, 14 nt, Mycobacterium bovis subsp bovis AF2122/97
cggcacccgccgug

SEQ ID NO: 3054768 - RNA, 15 nt, Mycobacterium bovis subsp bovis AF2122/97
cggcacccgccgugc

SEQ ID NO: 3054769 - RNA, 22 nt, Mycobacterium bovis subsp bovis AF2122/97
cggcacccgccgugcccccggc

SEQ ID NO: 3054770 - RNA, 14 nt, Mycobacterium bovis subsp bovis AF2122/97
cggcacccgcggcg

SEQ ID NO: 3054771 - RNA, 21 nt, Mycobacterium bovis subsp bovis AF2122/97
cggcacccgcuggcgguaagc

SEQ ID NO: 3054772 - RNA, 12 nt, Mycobacterium bovis subsp bovis AF2122/97
cggcacccggca

SEQ ID NO: 3054773 - RNA, 16 nt, Mycobacterium bovis subsp bovis AF2122/97
cggcacccggcagagc

SEQ ID NO: 3054774 - RNA, 24 nt, Mycobacterium bovis subsp bovis AF2122/97
cggcacccggucggccauccaccg

SEQ ID NO: 3054775 - RNA, 12 nt, Mycobacterium bovis subsp bovis AF2122/97
cggcacccggug

SEQ ID NO: 3054776 - RNA, 16 nt, Mycobacterium bovis subsp bovis AF2122/97
cggcacccgucgggug

SEQ ID NO: 3054777 - RNA, 18 nt, Mycobacterium bovis subsp bovis AF2122/97
cggcacccgucgggugcu

SEQ ID NO: 3054778 - RNA, 20 nt, Mycobacterium bovis subsp bovis AF2122/97
cggcacccgucgggugcuga

SEQ ID NO: 3054779 - RNA, 14 nt, Mycobacterium bovis subsp bovis AF2122/97
cggcacccugcggc

SEQ ID NO: 3054780 - RNA, 18 nt, Mycobacterium bovis subsp bovis AF2122/97
cggcacccugcggcaccu

SEQ ID NO: 3054781 - RNA, 13 nt, Mycobacterium bovis subsp bovis AF2122/97
cggcaccgacggu

SEQ ID NO: 3054782 - RNA, 22 nt, Mycobacterium bovis subsp bovis AF2122/97
cggcaccgacugcugucaccgc

SEQ ID NO: 3054783 - RNA, 22 nt, Mycobacterium bovis subsp bovis AF2122/97
cggcaccgaugcacuccaugaa

SEQ ID NO: 3054784 - RNA, 12 nt, Mycobacterium bovis subsp bovis AF2122/97
cggcaccgaugg

SEQ ID NO: 3054785 - RNA, 14 nt, Mycobacterium bovis subsp bovis AF2122/97
cggcaccgauggcg

SEQ ID NO: 3054786 - RNA, 19 nt, Mycobacterium bovis subsp bovis AF2122/97
cggcaccgauggcgcaccg

SEQ ID NO: 3054787 - RNA, 23 nt, Mycobacterium bovis subsp bovis AF2122/97
cggcaccgauggcgcaccggcgu

SEQ ID NO: 3054788 - RNA, 13 nt, Mycobacterium bovis subsp bovis AF2122/97
cggcaccgcagcg

SEQ ID NO: 3054789 - RNA, 11 nt, Mycobacterium bovis subsp bovis AF2122/97
cggcaccgcca

SEQ ID NO: 3054790 - RNA, 15 nt, Mycobacterium bovis subsp bovis AF2122/97
cggcaccgccagugc

SEQ ID NO: 3054791 - RNA, 11 nt, Mycobacterium bovis subsp bovis AF2122/97
cggcaccgccg

SEQ ID NO: 3054792 - RNA, 14 nt, Mycobacterium bovis subsp bovis AF2122/97
cggcaccgccgccc

SEQ ID NO: 3054793 - RNA, 18 nt, Mycobacterium bovis subsp bovis AF2122/97
cggcaccgccgcccccgc

SEQ ID NO: 3054794 - RNA, 19 nt, Mycobacterium bovis subsp bovis AF2122/97
cggcaccgccgcccccgcc

SEQ ID NO: 3054795 - RNA, 13 nt, Mycobacterium bovis subsp bovis AF2122/97
cggcaccgccggc

SEQ ID NO: 3054796 - RNA, 19 nt, Mycobacterium bovis subsp bovis AF2122/97
cggcaccgccggcaccgcc

SEQ ID NO: 3054797 - RNA, 20 nt, Mycobacterium bovis subsp bovis AF2122/97
cggcaccgccggcaccgccg

SEQ ID NO: 3054798 - RNA, 21 nt, Mycobacterium bovis subsp bovis AF2122/97
cggcaccgccggcaccgccgg

SEQ ID NO: 3054799 - RNA, 15 nt, Mycobacterium bovis subsp bovis AF2122/97
cggcaccgccggcgc

SEQ ID NO: 3054800 - RNA, 16 nt, Mycobacterium bovis subsp bovis AF2122/97
cggcaccgccggcgcc

SEQ ID NO: 3054801 - RNA, 17 nt, Mycobacterium bovis subsp bovis AF2122/97
cggcaccgccggcgcca

SEQ ID NO: 3054802 - RNA, 21 nt, Mycobacterium bovis subsp bovis AF2122/97
cggcaccgccggcgccaccgu

SEQ ID NO: 3054803 - RNA, 17 nt, Mycobacterium bovis subsp bovis AF2122/97
cggcaccgccggcgccc

SEQ ID NO: 3054804 - RNA, 18 nt, Mycobacterium bovis subsp bovis AF2122/97
cggcaccgccggcgccca

SEQ ID NO: 3054805 - RNA, 19 nt, Mycobacterium bovis subsp bovis AF2122/97
cggcaccgccggcgcccag

SEQ ID NO: 3054806 - RNA, 20 nt, Mycobacterium bovis subsp bovis AF2122/97
cggcaccgccggcgcccagg

SEQ ID NO: 3054807 - RNA, 14 nt, Mycobacterium bovis subsp bovis AF2122/97
cggcaccgccggcu

SEQ ID NO: 3054808 - RNA, 20 nt, Mycobacterium bovis subsp bovis AF2122/97
cggcaccgccggcuccgccg

SEQ ID NO: 3054809 - RNA, 15 nt, Mycobacterium bovis subsp bovis AF2122/97
cggcaccgccugcgc

SEQ ID NO: 3054810 - RNA, 19 nt, Mycobacterium bovis subsp bovis AF2122/97
cggcaccgccugcgccgcc

SEQ ID NO: 3054811 - RNA, 20 nt, Mycobacterium bovis subsp bovis AF2122/97
cggcaccgccugcgccgccc

SEQ ID NO: 3054812 - RNA, 22 nt, Mycobacterium bovis subsp bovis AF2122/97
cggcaccgccugcgccgcccgc

SEQ ID NO: 3054813 - RNA, 14 nt, Mycobacterium bovis subsp bovis AF2122/97
cggcaccgcgccgg

SEQ ID NO: 3054814 - RNA, 22 nt, Mycobacterium bovis subsp bovis AF2122/97
cggcaccgcggauaggccgcgc

SEQ ID NO: 3054815 - RNA, 20 nt, Mycobacterium bovis subsp bovis AF2122/97
cggcagaccgaccucggcga

SEQ ID NO: 3054816 - RNA, 14 nt, Mycobacterium bovis subsp bovis AF2122/97
cggcagaccggcau

SEQ ID NO: 3054817 - RNA, 16 nt, Mycobacterium bovis subsp bovis AF2122/97
cggcagaccggcaucg

SEQ ID NO: 3054818 - RNA, 17 nt, Mycobacterium bovis subsp bovis AF2122/97
cggcagaccggugcugu

SEQ ID NO: 3054819 - RNA, 19 nt, Mycobacterium bovis subsp bovis AF2122/97
cggcagaccggugcugucg

SEQ ID NO: 3054820 - RNA, 22 nt, Mycobacterium bovis subsp bovis AF2122/97
cggcagaccggugcugucgacg

SEQ ID NO: 3054821 - RNA, 23 nt, Mycobacterium bovis subsp bovis AF2122/97
cggcagaccggugcugucgacgu

SEQ ID NO: 3054822 - RNA, 13 nt, Mycobacterium bovis subsp bovis AF2122/97
cggcagacgcguu

SEQ ID NO: 3054823 - RNA, 23 nt, Mycobacterium bovis subsp bovis AF2122/97
cggcagacgcguuucgucgaccg

SEQ ID NO: 3054824 - RNA, 21 nt, Mycobacterium bovis subsp bovis AF2122/97
cggcagagacguacugggcga

SEQ ID NO: 3054825 - RNA, 17 nt, Mycobacterium bovis subsp bovis AF2122/97
cggcagauacucggcga

SEQ ID NO: 3054826 - RNA, 17 nt, Mycobacterium bovis subsp bovis AF2122/97
cggcagaucccacgcca

SEQ ID NO: 3054827 - RNA, 22 nt, Mycobacterium bovis subsp bovis AF2122/97
cggcagaugagucaaaauccgc

SEQ ID NO: 3054828 - RNA, 18 nt, Mycobacterium bovis subsp bovis AF2122/97
cggcagaugcagcggguc

SEQ ID NO: 3054829 - RNA, 11 nt, Mycobacterium bovis subsp bovis AF2122/97
cggcagauggu

SEQ ID NO: 3054830 - RNA, 23 nt, Mycobacterium bovis subsp bovis AF2122/97
cggcagauggucucgaacuccau

SEQ ID NO: 3054831 - RNA, 21 nt, Mycobacterium bovis subsp bovis AF2122/97
cggcagauguguccggcaucg

SEQ ID NO: 3054832 - RNA, 17 nt, Mycobacterium bovis subsp bovis AF2122/97
cggcagauugucgcuga

SEQ ID NO: 3054833 - RNA, 15 nt, Mycobacterium bovis subsp bovis AF2122/97
cggcagcaccgcacg

SEQ ID NO: 3054834 - RNA, 14 nt, Mycobacterium bovis subsp bovis AF2122/97
cggcagcacggucu

SEQ ID NO: 3054835 - RNA, 15 nt, Mycobacterium bovis subsp bovis AF2122/97
cggcagcacggucug

SEQ ID NO: 3054836 - RNA, 15 nt, Mycobacterium bovis subsp bovis AF2122/97
cggcagcagaguucc

SEQ ID NO: 3054837 - RNA, 11 nt, Mycobacterium bovis subsp bovis AF2122/97
cggcagcagca

SEQ ID NO: 3054838 - RNA, 15 nt, Mycobacterium bovis subsp bovis AF2122/97
cggcagcagccggcg

SEQ ID NO: 3054839 - RNA, 16 nt, Mycobacterium bovis subsp bovis AF2122/97
cggcagcagccggcgg

SEQ ID NO: 3054840 - RNA, 14 nt, Mycobacterium bovis subsp bovis AF2122/97
cggcagcagcgccg

SEQ ID NO: 3054841 - RNA, 21 nt, Mycobacterium bovis subsp bovis AF2122/97
cggcagcagcgccguaguugg

SEQ ID NO: 3054842 - RNA, 15 nt, Mycobacterium bovis subsp bovis AF2122/97
cggcagcagcgggcg

SEQ ID NO: 3054843 - RNA, 23 nt, Mycobacterium bovis subsp bovis AF2122/97
cggcagcagcggugcagcccgcc

SEQ ID NO: 3054844 - RNA, 14 nt, Mycobacterium bovis subsp bovis AF2122/97
cggcagcaggacac

SEQ ID NO: 3054845 - RNA, 19 nt, Mycobacterium bovis subsp bovis AF2122/97
cggcagcaggacaccuacc

SEQ ID NO: 3054846 - RNA, 16 nt, Mycobacterium bovis subsp bovis AF2122/97
cggcagcauauccgcc

SEQ ID NO: 3054847 - RNA, 19 nt, Mycobacterium bovis subsp bovis AF2122/97
cggcagcauauccgccggc

SEQ ID NO: 3054848 - RNA, 15 nt, Mycobacterium bovis subsp bovis AF2122/97
cggcagcauccucga

SEQ ID NO: 3054849 - RNA, 20 nt, Mycobacterium bovis subsp bovis AF2122/97
cggcagcaucggcaccccgg

SEQ ID NO: 3054850 - RNA, 23 nt, Mycobacterium bovis subsp bovis AF2122/97
cggcagcaucggcaccccggcca

SEQ ID NO: 3054851 - RNA, 14 nt, Mycobacterium bovis subsp bovis AF2122/97
cggcagcauggcca

SEQ ID NO: 3054852 - RNA, 18 nt, Mycobacterium bovis subsp bovis AF2122/97
cggcagccaaccggcgca

SEQ ID NO: 3054853 - RNA, 12 nt, Mycobacterium bovis subsp bovis AF2122/97
cggcagccacca

SEQ ID NO: 3054854 - RNA, 14 nt, Mycobacterium bovis subsp bovis AF2122/97
cggcagccaccagc

SEQ ID NO: 3054855 - RNA, 15 nt, Mycobacterium bovis subsp bovis AF2122/97
cggcagccaccagcg

SEQ ID NO: 3054856 - RNA, 17 nt, Mycobacterium bovis subsp bovis AF2122/97
cggcagccaccagcgac

SEQ ID NO: 3054857 - RNA, 18 nt, Mycobacterium bovis subsp bovis AF2122/97
cggcagccaccagcgacg

SEQ ID NO: 3054858 - RNA, 19 nt, Mycobacterium bovis subsp bovis AF2122/97
cggcagccaccagcgacga

SEQ ID NO: 3054859 - RNA, 20 nt, Mycobacterium bovis subsp bovis AF2122/97
cggcagccaccagcgacgac

SEQ ID NO: 3054860 - RNA, 12 nt, Mycobacterium bovis subsp bovis AF2122/97
cggcagccaccg

SEQ ID NO: 3054861 - RNA, 16 nt, Mycobacterium bovis subsp bovis AF2122/97
cggcagccagccaccg

SEQ ID NO: 3054862 - RNA, 14 nt, Mycobacterium bovis subsp bovis AF2122/97
cggcagccagggcg

SEQ ID NO: 3054863 - RNA, 16 nt, Mycobacterium bovis subsp bovis AF2122/97
cggcagccagggcgcc

SEQ ID NO: 3054864 - RNA, 17 nt, Mycobacterium bovis subsp bovis AF2122/97
cggcagccagggcgccg

SEQ ID NO: 3054865 - RNA, 18 nt, Mycobacterium bovis subsp bovis AF2122/97
cggcagccagggcgccga

SEQ ID NO: 3054866 - RNA, 14 nt, Mycobacterium bovis subsp bovis AF2122/97
cggcagccaugcgg

SEQ ID NO: 3054867 - RNA, 19 nt, Mycobacterium bovis subsp bovis AF2122/97
cggcagcccaaagcgccag

SEQ ID NO: 3054868 - RNA, 13 nt, Mycobacterium bovis subsp bovis AF2122/97
cggcagcccccgg

SEQ ID NO: 3054869 - RNA, 15 nt, Mycobacterium bovis subsp bovis AF2122/97
cggcagccccugccg

SEQ ID NO: 3054870 - RNA, 16 nt, Mycobacterium bovis subsp bovis AF2122/97
cggcagccccugccga

SEQ ID NO: 3054871 - RNA, 17 nt, Mycobacterium bovis subsp bovis AF2122/97
cggcagccccugccgau

SEQ ID NO: 3054872 - RNA, 19 nt, Mycobacterium bovis subsp bovis AF2122/97
cggcagccccugccgaucc

SEQ ID NO: 3054873 - RNA, 15 nt, Mycobacterium bovis subsp bovis AF2122/97
cggcagcccggcggc

SEQ ID NO: 3054874 - RNA, 17 nt, Mycobacterium bovis subsp bovis AF2122/97
cggcagcccggcggccg

SEQ ID NO: 3054875 - RNA, 18 nt, Mycobacterium bovis subsp bovis AF2122/97
cggcagcccggcggccgc

SEQ ID NO: 3054876 - RNA, 16 nt, Mycobacterium bovis subsp bovis AF2122/97
cggcagcccggugugc

SEQ ID NO: 3054877 - RNA, 19 nt, Mycobacterium bovis subsp bovis AF2122/97
cggcagccggcuugggcgg

SEQ ID NO: 3054878 - RNA, 20 nt, Mycobacterium bovis subsp bovis AF2122/97
cggcagccggcuugggcggu

SEQ ID NO: 3054879 - RNA, 23 nt, Mycobacterium bovis subsp bovis AF2122/97
cggcagccggcuugggcgguagc

SEQ ID NO: 3054880 - RNA, 18 nt, Mycobacterium bovis subsp bovis AF2122/97
cggcagccgggcggcagc

SEQ ID NO: 3054881 - RNA, 22 nt, Mycobacterium bovis subsp bovis AF2122/97
cggcagccgggcggcagcggcu

SEQ ID NO: 3054882 - RNA, 13 nt, Mycobacterium bovis subsp bovis AF2122/97
cggcagccuggcc

SEQ ID NO: 3054883 - RNA, 14 nt, Mycobacterium bovis subsp bovis AF2122/97
cggcagccuggccu

SEQ ID NO: 3054884 - RNA, 20 nt, Mycobacterium bovis subsp bovis AF2122/97
cggcagccuggccucgccau

SEQ ID NO: 3054885 - RNA, 17 nt, Mycobacterium bovis subsp bovis AF2122/97
cggcagccuugaucucg

SEQ ID NO: 3054886 - RNA, 19 nt, Mycobacterium bovis subsp bovis AF2122/97
cggcagcgacgccggcccg

SEQ ID NO: 3054887 - RNA, 20 nt, Mycobacterium bovis subsp bovis AF2122/97
cggcagcgacgccggcccga

SEQ ID NO: 3054888 - RNA, 13 nt, Mycobacterium bovis subsp bovis AF2122/97
cggcagcgagacu

SEQ ID NO: 3054889 - RNA, 23 nt, Mycobacterium bovis subsp bovis AF2122/97
cggcagcgagacuucgacgcggc

SEQ ID NO: 3054890 - RNA, 13 nt, Mycobacterium bovis subsp bovis AF2122/97
cggcagcgaggcc

SEQ ID NO: 3054891 - RNA, 17 nt, Mycobacterium bovis subsp bovis AF2122/97
cggcagcgaggcucgca

SEQ ID NO: 3054892 - RNA, 15 nt, Mycobacterium bovis subsp bovis AF2122/97
cggcagcgagucgac

SEQ ID NO: 3054893 - RNA, 19 nt, Mycobacterium bovis subsp bovis AF2122/97
cggcagcgagucgacgucg

SEQ ID NO: 3054894 - RNA, 20 nt, Mycobacterium bovis subsp bovis AF2122/97
cggcagcgaugcggugucgg

SEQ ID NO: 3054895 - RNA, 22 nt, Mycobacterium bovis subsp bovis AF2122/97
cggcagcgaugcggugucgggc

SEQ ID NO: 3054896 - RNA, 23 nt, Mycobacterium bovis subsp bovis AF2122/97
cggcagcgaugcggugucgggcu

SEQ ID NO: 3054897 - RNA, 13 nt, Mycobacterium bovis subsp bovis AF2122/97
cggcagcgcccag

SEQ ID NO: 3054898 - RNA, 14 nt, Mycobacterium bovis subsp bovis AF2122/97
cggcagcgcccaga

SEQ ID NO: 3054899 - RNA, 19 nt, Mycobacterium bovis subsp bovis AF2122/97
cggcagcgcccagaucgcc

SEQ ID NO: 3054900 - RNA, 19 nt, Mycobacterium bovis subsp bovis AF2122/97
cggcagcgcccuuggacgc

SEQ ID NO: 3054901 - RNA, 11 nt, Mycobacterium bovis subsp bovis AF2122/97
cggcagcgcgg

SEQ ID NO: 3054902 - RNA, 14 nt, Mycobacterium bovis subsp bovis AF2122/97
cggcauacaacugg

SEQ ID NO: 3054903 - RNA, 16 nt, Mycobacterium bovis subsp bovis AF2122/97
cggcauacaacuggug

SEQ ID NO: 3054904 - RNA, 15 nt, Mycobacterium bovis subsp bovis AF2122/97
cggcauacaccguga

SEQ ID NO: 3054905 - RNA, 17 nt, Mycobacterium bovis subsp bovis AF2122/97
cggcauacauccaggcu

SEQ ID NO: 3054906 - RNA, 23 nt, Mycobacterium bovis subsp bovis AF2122/97
cggcauacauccaggcuguggcc

SEQ ID NO: 3054907 - RNA, 21 nt, Mycobacterium bovis subsp bovis AF2122/97
cggcauacaucgccuugccca

SEQ ID NO: 3054908 - RNA, 16 nt, Mycobacterium bovis subsp bovis AF2122/97
cggcauacccaucaac

SEQ ID NO: 3054909 - RNA, 19 nt, Mycobacterium bovis subsp bovis AF2122/97
cggcauacccaucaacauc

SEQ ID NO: 3054910 - RNA, 20 nt, Mycobacterium bovis subsp bovis AF2122/97
cggcauaccgaacagcaccu

SEQ ID NO: 3054911 - RNA, 20 nt, Mycobacterium bovis subsp bovis AF2122/97
cggcauacucuuugugccca

SEQ ID NO: 3054912 - RNA, 21 nt, Mycobacterium bovis subsp bovis AF2122/97
cggcauagaucgggucguugg

SEQ ID NO: 3054913 - RNA, 23 nt, Mycobacterium bovis subsp bovis AF2122/97
cggcauagaucgggucguuggcg

SEQ ID NO: 3054914 - RNA, 18 nt, Mycobacterium bovis subsp bovis AF2122/97
cggcauagcggcccaucg

SEQ ID NO: 3054915 - RNA, 19 nt, Mycobacterium bovis subsp bovis AF2122/97
cggcauagcggcccaucgg

SEQ ID NO: 3054916 - RNA, 16 nt, Mycobacterium bovis subsp bovis AF2122/97
cggcauagcgggucag

SEQ ID NO: 3054917 - RNA, 19 nt, Mycobacterium bovis subsp bovis AF2122/97
cggcauagcucagaccggc

SEQ ID NO: 3054918 - RNA, 22 nt, Mycobacterium bovis subsp bovis AF2122/97
cggcauagcucagaccggcgcc

SEQ ID NO: 3054919 - RNA, 23 nt, Mycobacterium bovis subsp bovis AF2122/97
cggcaucaacgcgggcgcuugcc

SEQ ID NO: 3054920 - RNA, 21 nt, Mycobacterium bovis subsp bovis AF2122/97
cggcaucccgccacaccaacg

SEQ ID NO: 3054921 - RNA, 20 nt, Mycobacterium bovis subsp bovis AF2122/97
cggcaucccggaacgccgcc

SEQ ID NO: 3054922 - RNA, 14 nt, Mycobacterium bovis subsp bovis AF2122/97
cggcauccgcgggg

SEQ ID NO: 3054923 - RNA, 15 nt, Mycobacterium bovis subsp bovis AF2122/97
cggcauccgcgggga

SEQ ID NO: 3054924 - RNA, 23 nt, Mycobacterium bovis subsp bovis AF2122/97
cggcauccucugaaccagcugag

SEQ ID NO: 3054925 - RNA, 21 nt, Mycobacterium bovis subsp bovis AF2122/97
cggcauccuguggcggggcaa

SEQ ID NO: 3054926 - RNA, 20 nt, Mycobacterium bovis subsp bovis AF2122/97
cggcaucgaagugcggcccg

SEQ ID NO: 3054927 - RNA, 14 nt, Mycobacterium bovis subsp bovis AF2122/97
cggcaucgacgcgg

SEQ ID NO: 3054928 - RNA, 15 nt, Mycobacterium bovis subsp bovis AF2122/97
cggcaucgacugcca

SEQ ID NO: 3054929 - RNA, 22 nt, Mycobacterium bovis subsp bovis AF2122/97
cggcaucgacugccagcgccgc

SEQ ID NO: 3054930 - RNA, 20 nt, Mycobacterium bovis subsp bovis AF2122/97
cggcaucgaguucggcccgc

SEQ ID NO: 3054931 - RNA, 12 nt, Mycobacterium bovis subsp bovis AF2122/97
cggcaucgauca

SEQ ID NO: 3054932 - RNA, 16 nt, Mycobacterium bovis subsp bovis AF2122/97
cggcaucgccgagcuc

SEQ ID NO: 3054933 - RNA, 17 nt, Mycobacterium bovis subsp bovis AF2122/97
cggcaucgccgagcucg

SEQ ID NO: 3054934 - RNA, 17 nt, Mycobacterium bovis subsp bovis AF2122/97
cggcaucgccgcgggug

SEQ ID NO: 3054935 - RNA, 16 nt, Mycobacterium bovis subsp bovis AF2122/97
cggcaucgcgagcugc

SEQ ID NO: 3054936 - RNA, 18 nt, Mycobacterium bovis subsp bovis AF2122/97
cggcaucgcgagcugcga

SEQ ID NO: 3054937 - RNA, 15 nt, Mycobacterium bovis subsp bovis AF2122/97
cggcaucgcgggcgg

SEQ ID NO: 3054938 - RNA, 23 nt, Mycobacterium bovis subsp bovis AF2122/97
cggcaucgcgggcggcgcuggcg

SEQ ID NO: 3054939 - RNA, 20 nt, Mycobacterium bovis subsp bovis AF2122/97
cggcaucggagauacgggcc

SEQ ID NO: 3054940 - RNA, 21 nt, Mycobacterium bovis subsp bovis AF2122/97
cggcaucggagauacgggcca

SEQ ID NO: 3054941 - RNA, 15 nt, Mycobacterium bovis subsp bovis AF2122/97
cggcaucggccagcc

SEQ ID NO: 3054942 - RNA, 12 nt, Mycobacterium bovis subsp bovis AF2122/97
cggcaucggcga

SEQ ID NO: 3054943 - RNA, 15 nt, Mycobacterium bovis subsp bovis AF2122/97
cggcaucggcggcaa

SEQ ID NO: 3054944 - RNA, 21 nt, Mycobacterium bovis subsp bovis AF2122/97
cggcaucggcggcaacggcgg

SEQ ID NO: 3054945 - RNA, 18 nt, Mycobacterium bovis subsp bovis AF2122/97
cggcaucggucaccgcgg

SEQ ID NO: 3054946 - RNA, 17 nt, Mycobacterium bovis subsp bovis AF2122/97
cggcaucggugguaaca

SEQ ID NO: 3054947 - RNA, 19 nt, Mycobacterium bovis subsp bovis AF2122/97
cggcaucgucgacgcccga

SEQ ID NO: 3054948 - RNA, 20 nt, Mycobacterium bovis subsp bovis AF2122/97
cggcaucgucgacgcccgau

SEQ ID NO: 3054949 - RNA, 13 nt, Mycobacterium bovis subsp bovis AF2122/97
cggcaucuccacc

SEQ ID NO: 3054950 - RNA, 15 nt, Mycobacterium bovis subsp bovis AF2122/97
cggcaucuccaccgu

SEQ ID NO: 3054951 - RNA, 19 nt, Mycobacterium bovis subsp bovis AF2122/97
cggcaucuccaccgucgcc

SEQ ID NO: 3054952 - RNA, 23 nt, Mycobacterium bovis subsp bovis AF2122/97
cggcaucuccaccgucgccgccg

SEQ ID NO: 3054953 - RNA, 22 nt, Mycobacterium bovis subsp bovis AF2122/97
cggcaucugaaaauugaccccc

SEQ ID NO: 3054954 - RNA, 23 nt, Mycobacterium bovis subsp bovis AF2122/97
cggcaucugaaaauugacccccu

SEQ ID NO: 3054955 - RNA, 18 nt, Mycobacterium bovis subsp bovis AF2122/97
cggcaucugguauggguc

SEQ ID NO: 3054956 - RNA, 18 nt, Mycobacterium bovis subsp bovis AF2122/97
cggcaugcaaugcuggcg

SEQ ID NO: 3054957 - RNA, 21 nt, Mycobacterium bovis subsp bovis AF2122/97
cggcaugcaaugcuggcggcg

SEQ ID NO: 3054958 - RNA, 15 nt, Mycobacterium bovis subsp bovis AF2122/97
cggcaugcagaucuc

SEQ ID NO: 3054959 - RNA, 15 nt, Mycobacterium bovis subsp bovis AF2122/97
cggcaugcagcccca

SEQ ID NO: 3054960 - RNA, 17 nt, Mycobacterium bovis subsp bovis AF2122/97
cggcaugccagccacga

SEQ ID NO: 3054961 - RNA, 15 nt, Mycobacterium bovis subsp bovis AF2122/97
cggcaugccgccaug

SEQ ID NO: 3054962 - RNA, 22 nt, Mycobacterium bovis subsp bovis AF2122/97
cggcaugccgccaugcgcacca

SEQ ID NO: 3054963 - RNA, 14 nt, Mycobacterium bovis subsp bovis AF2122/97
cggcaugcgugccg

SEQ ID NO: 3054964 - RNA, 16 nt, Mycobacterium bovis subsp bovis AF2122/97
cggcaugcgugccggc

SEQ ID NO: 3054965 - RNA, 20 nt, Mycobacterium bovis subsp bovis AF2122/97
cggcaugcgugccggcagcg

SEQ ID NO: 3054966 - RNA, 18 nt, Mycobacterium bovis subsp bovis AF2122/97
cggcaugcucaccgaaac

SEQ ID NO: 3054967 - RNA, 13 nt, Mycobacterium bovis subsp bovis AF2122/97
cggcauggcaggc

SEQ ID NO: 3054968 - RNA, 15 nt, Mycobacterium bovis subsp bovis AF2122/97
cggcaugggcccugc

SEQ ID NO: 3054969 - RNA, 14 nt, Mycobacterium bovis subsp bovis AF2122/97
cggcaugggccggc

SEQ ID NO: 3054970 - RNA, 16 nt, Mycobacterium bovis subsp bovis AF2122/97
cggcaugggccggcgc

SEQ ID NO: 3054971 - RNA, 17 nt, Mycobacterium bovis subsp bovis AF2122/97
cggcaugggccggcgcc

SEQ ID NO: 3054972 - RNA, 18 nt, Mycobacterium bovis subsp bovis AF2122/97
cggcaugggccggcgccg

SEQ ID NO: 3054973 - RNA, 21 nt, Mycobacterium bovis subsp bovis AF2122/97
cggcaugggccggcgccgcac

SEQ ID NO: 3054974 - RNA, 15 nt, Mycobacterium bovis subsp bovis AF2122/97
cggcauguaccgacc

SEQ ID NO: 3054975 - RNA, 17 nt, Mycobacterium bovis subsp bovis AF2122/97
cggcaugugacaucggg

SEQ ID NO: 3054976 - RNA, 22 nt, Mycobacterium bovis subsp bovis AF2122/97
cggcauguucagcccgaacucg

SEQ ID NO: 3054977 - RNA, 22 nt, Mycobacterium bovis subsp bovis AF2122/97
cggcauguuccuugcggccgcu

SEQ ID NO: 3054978 - RNA, 18 nt, Mycobacterium bovis subsp bovis AF2122/97
cggcauuaggccgggguc

SEQ ID NO: 3054979 - RNA, 14 nt, Mycobacterium bovis subsp bovis AF2122/97
cggcauucaccgcg

SEQ ID NO: 3054980 - RNA, 14 nt, Mycobacterium bovis subsp bovis AF2122/97
cggcauuccacagg

SEQ ID NO: 3054981 - RNA, 14 nt, Mycobacterium bovis subsp bovis AF2122/97
cggcauucgcacca

SEQ ID NO: 3054982 - RNA, 23 nt, Mycobacterium bovis subsp bovis AF2122/97
cggcauugacccauccggcucgg

SEQ ID NO: 3054983 - RNA, 15 nt, Mycobacterium bovis subsp bovis AF2122/97
cggcauugccagccg

SEQ ID NO: 3054984 - RNA, 19 nt, Mycobacterium bovis subsp bovis AF2122/97
cggcauugcccgagcccag

SEQ ID NO: 3054985 - RNA, 20 nt, Mycobacterium bovis subsp bovis AF2122/97
cggcauugcccgagcccagc

SEQ ID NO: 3054986 - RNA, 21 nt, Mycobacterium bovis subsp bovis AF2122/97
cggcauugcccgagcccagcg

SEQ ID NO: 3054987 - RNA, 15 nt, Mycobacterium bovis subsp bovis AF2122/97
cggcauugccgccgu

SEQ ID NO: 3054988 - RNA, 19 nt, Mycobacterium bovis subsp bovis AF2122/97
cggccaccagggccaccgc

SEQ ID NO: 3054989 - RNA, 13 nt, Mycobacterium bovis subsp bovis AF2122/97
cggccaccaggug

SEQ ID NO: 3054990 - RNA, 15 nt, Mycobacterium bovis subsp bovis AF2122/97
cggccaccaggugcc

SEQ ID NO: 3054991 - RNA, 14 nt, Mycobacterium bovis subsp bovis AF2122/97
cggccaccaucgcc

SEQ ID NO: 3054992 - RNA, 18 nt, Mycobacterium bovis subsp bovis AF2122/97
cggccaccaucgccccga

SEQ ID NO: 3054993 - RNA, 18 nt, Mycobacterium bovis subsp bovis AF2122/97
cggccacccacauggcgg

SEQ ID NO: 3054994 - RNA, 12 nt, Mycobacterium bovis subsp bovis AF2122/97
cggccaccccac

SEQ ID NO: 3054995 - RNA, 13 nt, Mycobacterium bovis subsp bovis AF2122/97
cggccacccgcga

SEQ ID NO: 3054996 - RNA, 15 nt, Mycobacterium bovis subsp bovis AF2122/97
cggccacccgcgacg

SEQ ID NO: 3054997 - RNA, 15 nt, Mycobacterium bovis subsp bovis AF2122/97
cggccacccgcgcga

SEQ ID NO: 3054998 - RNA, 15 nt, Mycobacterium bovis subsp bovis AF2122/97
cggccacccggucca

SEQ ID NO: 3054999 - RNA, 20 nt, Mycobacterium bovis subsp bovis AF2122/97
cggccaccgaggcguucagu

SEQ ID NO: 3055000 - RNA, 18 nt, Mycobacterium bovis subsp bovis AF2122/97
cggccaccgagucgauca

SEQ ID NO: 3055001 - RNA, 18 nt, Mycobacterium bovis subsp bovis AF2122/97
cggccaccgcacgcuggc

SEQ ID NO: 3055002 - RNA, 21 nt, Mycobacterium bovis subsp bovis AF2122/97
cggccaccgcacgcuggcggg

SEQ ID NO: 3055003 - RNA, 13 nt, Mycobacterium bovis subsp bovis AF2122/97
cggccaccgccgc

SEQ ID NO: 3055004 - RNA, 15 nt, Mycobacterium bovis subsp bovis AF2122/97
cggccaccgccgccg

SEQ ID NO: 3055005 - RNA, 16 nt, Mycobacterium bovis subsp bovis AF2122/97
cggccaccgccgccgc

SEQ ID NO: 3055006 - RNA, 17 nt, Mycobacterium bovis subsp bovis AF2122/97
cggccaccgccgccgcc

SEQ ID NO: 3055007 - RNA, 18 nt, Mycobacterium bovis subsp bovis AF2122/97
cggccaccgccgccgcca

SEQ ID NO: 3055008 - RNA, 20 nt, Mycobacterium bovis subsp bovis AF2122/97
cggccaccgccgccgccacc

SEQ ID NO: 3055009 - RNA, 23 nt, Mycobacterium bovis subsp bovis AF2122/97
cggccaccgccgccgccaccggc

SEQ ID NO: 3055010 - RNA, 12 nt, Mycobacterium bovis subsp bovis AF2122/97
cggccaccgccu

SEQ ID NO: 3055011 - RNA, 15 nt, Mycobacterium bovis subsp bovis AF2122/97
cggccaccgcgcaac

SEQ ID NO: 3055012 - RNA, 16 nt, Mycobacterium bovis subsp bovis AF2122/97
cggccaccgcggcguu

SEQ ID NO: 3055013 - RNA, 13 nt, Mycobacterium bovis subsp bovis AF2122/97
cggccaccggcgu

SEQ ID NO: 3055014 - RNA, 17 nt, Mycobacterium bovis subsp bovis AF2122/97
cggccaccggcgucugc

SEQ ID NO: 3055015 - RNA, 14 nt, Mycobacterium bovis subsp bovis AF2122/97
cggccaccgggguc

SEQ ID NO: 3055016 - RNA, 20 nt, Mycobacterium bovis subsp bovis AF2122/97
cggccaccgucagcgcgacc

SEQ ID NO: 3055017 - RNA, 14 nt, Mycobacterium bovis subsp bovis AF2122/97
cggccaccucaucg

SEQ ID NO: 3055018 - RNA, 14 nt, Mycobacterium bovis subsp bovis AF2122/97
cggccaccucggug

SEQ ID NO: 3055019 - RNA, 20 nt, Mycobacterium bovis subsp bovis AF2122/97
cggccaccucggugcggaac

SEQ ID NO: 3055020 - RNA, 16 nt, Mycobacterium bovis subsp bovis AF2122/97
cggccaccucuucucg

SEQ ID NO: 3055021 - RNA, 12 nt, Mycobacterium bovis subsp bovis AF2122/97
cggccaccugcu

SEQ ID NO: 3055022 - RNA, 13 nt, Mycobacterium bovis subsp bovis AF2122/97
cggccaccugcuc

SEQ ID NO: 3055023 - RNA, 15 nt, Mycobacterium bovis subsp bovis AF2122/97
cggccaccuggucgg

SEQ ID NO: 3055024 - RNA, 16 nt, Mycobacterium bovis subsp bovis AF2122/97
cggccaccuggucggc

SEQ ID NO: 3055025 - RNA, 17 nt, Mycobacterium bovis subsp bovis AF2122/97
cggccaccuggucggca

SEQ ID NO: 3055026 - RNA, 13 nt, Mycobacterium bovis subsp bovis AF2122/97
cggccacggccau

SEQ ID NO: 3055027 - RNA, 21 nt, Mycobacterium bovis subsp bovis AF2122/97
cggccacggcgucggccaccc

SEQ ID NO: 3055028 - RNA, 21 nt, Mycobacterium bovis subsp bovis AF2122/97
cggccacggucagccaggugu

SEQ ID NO: 3055029 - RNA, 21 nt, Mycobacterium bovis subsp bovis AF2122/97
cggccacgguggagcgcgccu

SEQ ID NO: 3055030 - RNA, 17 nt, Mycobacterium bovis subsp bovis AF2122/97
cggccacgguggcgcaa

SEQ ID NO: 3055031 - RNA, 12 nt, Mycobacterium bovis subsp bovis AF2122/97
cggccacgucga

SEQ ID NO: 3055032 - RNA, 21 nt, Mycobacterium bovis subsp bovis AF2122/97
cggccacgucgaugugcgccc

SEQ ID NO: 3055033 - RNA, 14 nt, Mycobacterium bovis subsp bovis AF2122/97
cggccacguggucg

SEQ ID NO: 3055034 - RNA, 16 nt, Mycobacterium bovis subsp bovis AF2122/97
cggccacguuguccgc

SEQ ID NO: 3055035 - RNA, 23 nt, Mycobacterium bovis subsp bovis AF2122/97
cggccacuacggccuggccaccu

SEQ ID NO: 3055036 - RNA, 16 nt, Mycobacterium bovis subsp bovis AF2122/97
cggccacucaacgacc

SEQ ID NO: 3055037 - RNA, 22 nt, Mycobacterium bovis subsp bovis AF2122/97
cggccacucgggacuucccgcg

SEQ ID NO: 3055038 - RNA, 19 nt, Mycobacterium bovis subsp bovis AF2122/97
cggccacugauucgcaggc

SEQ ID NO: 3055039 - RNA, 21 nt, Mycobacterium bovis subsp bovis AF2122/97
cggccacugauucgcaggcuc

SEQ ID NO: 3055040 - RNA, 16 nt, Mycobacterium bovis subsp bovis AF2122/97
cggccagaaacccggc

SEQ ID NO: 3055041 - RNA, 19 nt, Mycobacterium bovis subsp bovis AF2122/97
cggccagaaacccggcgac

SEQ ID NO: 3055042 - RNA, 19 nt, Mycobacterium bovis subsp bovis AF2122/97
cggccagaaagaucgguug

SEQ ID NO: 3055043 - RNA, 12 nt, Mycobacterium bovis subsp bovis AF2122/97
cggccagacggu

SEQ ID NO: 3055044 - RNA, 14 nt, Mycobacterium bovis subsp bovis AF2122/97
cggccagacggugc

SEQ ID NO: 3055045 - RNA, 17 nt, Mycobacterium bovis subsp bovis AF2122/97
cggccagacucgcgguc

SEQ ID NO: 3055046 - RNA, 18 nt, Mycobacterium bovis subsp bovis AF2122/97
cggccagacucgcggucg

SEQ ID NO: 3055047 - RNA, 13 nt, Mycobacterium bovis subsp bovis AF2122/97
cggccagagccgc

SEQ ID NO: 3055048 - RNA, 17 nt, Mycobacterium bovis subsp bovis AF2122/97
cggccagagccgcgcgc

SEQ ID NO: 3055049 - RNA, 22 nt, Mycobacterium bovis subsp bovis AF2122/97
cggccagauagguuccaccggg

SEQ ID NO: 3055050 - RNA, 15 nt, Mycobacterium bovis subsp bovis AF2122/97
cggccagcaacuuug

SEQ ID NO: 3055051 - RNA, 23 nt, Mycobacterium bovis subsp bovis AF2122/97
cggccagcaagacgaugacagac

SEQ ID NO: 3055052 - RNA, 20 nt, Mycobacterium bovis subsp bovis AF2122/97
cggccagcacccgaaccggg

SEQ ID NO: 3055053 - RNA, 23 nt, Mycobacterium bovis subsp bovis AF2122/97
cggccagcacgccgccggccgcc

SEQ ID NO: 3055054 - RNA, 19 nt, Mycobacterium bovis subsp bovis AF2122/97
cggccagcacuccgcgggg

SEQ ID NO: 3055055 - RNA, 12 nt, Mycobacterium bovis subsp bovis AF2122/97
cggccagcagca

SEQ ID NO: 3055056 - RNA, 21 nt, Mycobacterium bovis subsp bovis AF2122/97
cggccagcagcaacgacccga

SEQ ID NO: 3055057 - RNA, 13 nt, Mycobacterium bovis subsp bovis AF2122/97
cggccagcagcag

SEQ ID NO: 3055058 - RNA, 14 nt, Mycobacterium bovis subsp bovis AF2122/97
cggccagcagcaga

SEQ ID NO: 3055059 - RNA, 15 nt, Mycobacterium bovis subsp bovis AF2122/97
cggccagcagcagau

SEQ ID NO: 3055060 - RNA, 18 nt, Mycobacterium bovis subsp bovis AF2122/97
cggccagcagcagugcca

SEQ ID NO: 3055061 - RNA, 12 nt, Mycobacterium bovis subsp bovis AF2122/97
cggccagcagcg

SEQ ID NO: 3055062 - RNA, 15 nt, Mycobacterium bovis subsp bovis AF2122/97
cggccagcagcgacu

SEQ ID NO: 3055063 - RNA, 14 nt, Mycobacterium bovis subsp bovis AF2122/97
cggccagcaggaug

SEQ ID NO: 3055064 - RNA, 22 nt, Mycobacterium bovis subsp bovis AF2122/97
cggccagcaggaugaugaccgc

SEQ ID NO: 3055065 - RNA, 20 nt, Mycobacterium bovis subsp bovis AF2122/97
cggccagcaguagaucggau

SEQ ID NO: 3055066 - RNA, 20 nt, Mycobacterium bovis subsp bovis AF2122/97
cggccagcaucagcucgaug

SEQ ID NO: 3055067 - RNA, 18 nt, Mycobacterium bovis subsp bovis AF2122/97
cggccagcaucgcggugg

SEQ ID NO: 3055068 - RNA, 16 nt, Mycobacterium bovis subsp bovis AF2122/97
cggccagcaucgggug

SEQ ID NO: 3055069 - RNA, 13 nt, Mycobacterium bovis subsp bovis AF2122/97
cggccagcccagc

SEQ ID NO: 3055070 - RNA, 17 nt, Mycobacterium bovis subsp bovis AF2122/97
cggccagcccagccggg

SEQ ID NO: 3055071 - RNA, 17 nt, Mycobacterium bovis subsp bovis AF2122/97
cggccagccgacgcggc

SEQ ID NO: 3055072 - RNA, 14 nt, Mycobacterium bovis subsp bovis AF2122/97
cggccagccgcggc

SEQ ID NO: 3055073 - RNA, 15 nt, Mycobacterium bovis subsp bovis AF2122/97
cggccagccgcggcc

SEQ ID NO: 3055074 - RNA, 17 nt, Mycobacterium bovis subsp bovis AF2122/97
cggccagccuaccggcu

SEQ ID NO: 3055075 - RNA, 18 nt, Mycobacterium bovis subsp bovis AF2122/97
cggccauagcgccgcgcc

SEQ ID NO: 3055076 - RNA, 21 nt, Mycobacterium bovis subsp bovis AF2122/97
cggccauagcgccgcgcccac

SEQ ID NO: 3055077 - RNA, 22 nt, Mycobacterium bovis subsp bovis AF2122/97
cggccauagcgccgcgcccacc

SEQ ID NO: 3055078 - RNA, 22 nt, Mycobacterium bovis subsp bovis AF2122/97
cggccauaucgcccaccacgaa

SEQ ID NO: 3055079 - RNA, 19 nt, Mycobacterium bovis subsp bovis AF2122/97
cggccaucagaaccuccuc

SEQ ID NO: 3055080 - RNA, 20 nt, Mycobacterium bovis subsp bovis AF2122/97
cggccaucagaaccuccucg

SEQ ID NO: 3055081 - RNA, 12 nt, Mycobacterium bovis subsp bovis AF2122/97
cggccauccacc

SEQ ID NO: 3055082 - RNA, 14 nt, Mycobacterium bovis subsp bovis AF2122/97
cggccauccaccgc

SEQ ID NO: 3055083 - RNA, 17 nt, Mycobacterium bovis subsp bovis AF2122/97
cggccauccaccgcaga

SEQ ID NO: 3055084 - RNA, 19 nt, Mycobacterium bovis subsp bovis AF2122/97
cggccauccaccgcagauc

SEQ ID NO: 3055085 - RNA, 16 nt, Mycobacterium bovis subsp bovis AF2122/97
cggccauccggcggcg

SEQ ID NO: 3055086 - RNA, 15 nt, Mycobacterium bovis subsp bovis AF2122/97
cggccaucgaccguc

SEQ ID NO: 3055087 - RNA, 17 nt, Mycobacterium bovis subsp bovis AF2122/97
cggccaucgaccguccg

SEQ ID NO: 3055088 - RNA, 21 nt, Mycobacterium bovis subsp bovis AF2122/97
cggccaucgaccguccggguc

SEQ ID NO: 3055089 - RNA, 13 nt, Mycobacterium bovis subsp bovis AF2122/97
cggccaucgcccg

SEQ ID NO: 3055090 - RNA, 15 nt, Mycobacterium bovis subsp bovis AF2122/97
cggccaucgcccgau

SEQ ID NO: 3055091 - RNA, 14 nt, Mycobacterium bovis subsp bovis AF2122/97
cggccaucguccag

SEQ ID NO: 3055092 - RNA, 17 nt, Mycobacterium bovis subsp bovis AF2122/97
cggccaucugcucgugg

SEQ ID NO: 3055093 - RNA, 15 nt, Mycobacterium bovis subsp bovis AF2122/97
cggccaugccuucgg

SEQ ID NO: 3055094 - RNA, 17 nt, Mycobacterium bovis subsp bovis AF2122/97
cggccauggcacugccg

SEQ ID NO: 3055095 - RNA, 19 nt, Mycobacterium bovis subsp bovis AF2122/97
cggccauggcacugccggc

SEQ ID NO: 3055096 - RNA, 17 nt, Mycobacterium bovis subsp bovis AF2122/97
cggccauggcagcgcgc

SEQ ID NO: 3055097 - RNA, 21 nt, Mycobacterium bovis subsp bovis AF2122/97
cggccauggcagcgcgcugag

SEQ ID NO: 3055098 - RNA, 17 nt, Mycobacterium bovis subsp bovis AF2122/97
cggccauggcgcgcaac

SEQ ID NO: 3055099 - RNA, 19 nt, Mycobacterium bovis subsp bovis AF2122/97
cggccauggcgcgcaaccg

SEQ ID NO: 3055100 - RNA, 19 nt, Mycobacterium bovis subsp bovis AF2122/97
cggccauggcggcgccggu

SEQ ID NO: 3055101 - RNA, 21 nt, Mycobacterium bovis subsp bovis AF2122/97
cggccauggcggcgccggugg

SEQ ID NO: 3055102 - RNA, 22 nt, Mycobacterium bovis subsp bovis AF2122/97
cggccauggcggcgccgguggu

SEQ ID NO: 3055103 - RNA, 13 nt, Mycobacterium bovis subsp bovis AF2122/97
cggccauggcggg

SEQ ID NO: 3055104 - RNA, 17 nt, Mycobacterium bovis subsp bovis AF2122/97
cggccauggcgggucgg

SEQ ID NO: 3055105 - RNA, 13 nt, Mycobacterium bovis subsp bovis AF2122/97
cggccauggugag

SEQ ID NO: 3055106 - RNA, 16 nt, Mycobacterium bovis subsp bovis AF2122/97
cggccaugguguucgg

SEQ ID NO: 3055107 - RNA, 20 nt, Mycobacterium bovis subsp bovis AF2122/97
cggccaugguguucggcagc

SEQ ID NO: 3055108 - RNA, 21 nt, Mycobacterium bovis subsp bovis AF2122/97
cggccaugguguucggcagcg

SEQ ID NO: 3055109 - RNA, 20 nt, Mycobacterium bovis subsp bovis AF2122/97
cggccauguagccguugccg

SEQ ID NO: 3055110 - RNA, 16 nt, Mycobacterium bovis subsp bovis AF2122/97
cggccaugucagcggc

SEQ ID NO: 3055111 - RNA, 17 nt, Mycobacterium bovis subsp bovis AF2122/97
cggccaugucagcggcc

SEQ ID NO: 3055112 - RNA, 20 nt, Mycobacterium bovis subsp bovis AF2122/97
cggccaugucagcggccugc

SEQ ID NO: 3055113 - RNA, 19 nt, Mycobacterium bovis subsp bovis AF2122/97
cggccauuagcagcacccg

SEQ ID NO: 3055114 - RNA, 20 nt, Mycobacterium bovis subsp bovis AF2122/97
cggccauuagcagcacccgg

SEQ ID NO: 3055115 - RNA, 22 nt, Mycobacterium bovis subsp bovis AF2122/97
cggccauuagcagcacccgggc

SEQ ID NO: 3055116 - RNA, 16 nt, Mycobacterium bovis subsp bovis AF2122/97
cggccauucuugguga

SEQ ID NO: 3055117 - RNA, 18 nt, Mycobacterium bovis subsp bovis AF2122/97
cggccauugcccgggcgg

SEQ ID NO: 3055118 - RNA, 19 nt, Mycobacterium bovis subsp bovis AF2122/97
cggccauugcccgggcggg

SEQ ID NO: 3055119 - RNA, 14 nt, Mycobacterium bovis subsp bovis AF2122/97
cggccauugcgggc

SEQ ID NO: 3055120 - RNA, 15 nt, Mycobacterium bovis subsp bovis AF2122/97
cggcccaaccggucg

SEQ ID NO: 3055121 - RNA, 19 nt, Mycobacterium bovis subsp bovis AF2122/97
cggcccaaggaacggcguc

SEQ ID NO: 3055122 - RNA, 12 nt, Mycobacterium bovis subsp bovis AF2122/97
cggcccacacca

SEQ ID NO: 3055123 - RNA, 15 nt, Mycobacterium bovis subsp bovis AF2122/97
cggcccacaccagcg

SEQ ID NO: 3055124 - RNA, 16 nt, Mycobacterium bovis subsp bovis AF2122/97
cggcccacaccagcgc

SEQ ID NO: 3055125 - RNA, 15 nt, Mycobacterium bovis subsp bovis AF2122/97
cggcccacacggucg

SEQ ID NO: 3055126 - RNA, 21 nt, Mycobacterium bovis subsp bovis AF2122/97
cggcccacacggucgucgcga

SEQ ID NO: 3055127 - RNA, 20 nt, Mycobacterium bovis subsp bovis AF2122/97
cggcccacacuaggccccac

SEQ ID NO: 3055128 - RNA, 15 nt, Mycobacterium bovis subsp bovis AF2122/97
cggcccaccaggccc

SEQ ID NO: 3055129 - RNA, 13 nt, Mycobacterium bovis subsp bovis AF2122/97
cggcccaccgacg

SEQ ID NO: 3055130 - RNA, 14 nt, Mycobacterium bovis subsp bovis AF2122/97
cggcccaccggucg

SEQ ID NO: 3055131 - RNA, 23 nt, Mycobacterium bovis subsp bovis AF2122/97
cggcccaccucaccgaucucgac

SEQ ID NO: 3055132 - RNA, 14 nt, Mycobacterium bovis subsp bovis AF2122/97
cggcccacgguguc

SEQ ID NO: 3055133 - RNA, 17 nt, Mycobacterium bovis subsp bovis AF2122/97
cggcccacggugucccg

SEQ ID NO: 3055134 - RNA, 22 nt, Mycobacterium bovis subsp bovis AF2122/97
cggcccacucacacaaccgacg

SEQ ID NO: 3055135 - RNA, 18 nt, Mycobacterium bovis subsp bovis AF2122/97
cggcccacucucgccacg

SEQ ID NO: 3055136 - RNA, 15 nt, Mycobacterium bovis subsp bovis AF2122/97
cggcccagcgccccc

SEQ ID NO: 3055137 - RNA, 18 nt, Mycobacterium bovis subsp bovis AF2122/97
cggcccagcgcccccagc

SEQ ID NO: 3055138 - RNA, 15 nt, Mycobacterium bovis subsp bovis AF2122/97
cggcccagcgcgcca

SEQ ID NO: 3055139 - RNA, 16 nt, Mycobacterium bovis subsp bovis AF2122/97
cggcccagcgcgccag

SEQ ID NO: 3055140 - RNA, 17 nt, Mycobacterium bovis subsp bovis AF2122/97
cggcccagcgcgccagc

SEQ ID NO: 3055141 - RNA, 21 nt, Mycobacterium bovis subsp bovis AF2122/97
cggcccagguugccuuggcgg

SEQ ID NO: 3055142 - RNA, 22 nt, Mycobacterium bovis subsp bovis AF2122/97
cggcccagugggacaggucggc

SEQ ID NO: 3055143 - RNA, 20 nt, Mycobacterium bovis subsp bovis AF2122/97
cggcccaguucugcaggaag

SEQ ID NO: 3055144 - RNA, 21 nt, Mycobacterium bovis subsp bovis AF2122/97
cggcccauaacagcuggcggc

SEQ ID NO: 3055145 - RNA, 23 nt, Mycobacterium bovis subsp bovis AF2122/97
cggcccaucuucggacgccagcu

SEQ ID NO: 3055146 - RNA, 20 nt, Mycobacterium bovis subsp bovis AF2122/97
cggcccaugaaggagauccc

SEQ ID NO: 3055147 - RNA, 18 nt, Mycobacterium bovis subsp bovis AF2122/97
cggcccaugcagcggcga

SEQ ID NO: 3055148 - RNA, 22 nt, Mycobacterium bovis subsp bovis AF2122/97
cggcccauucaucuugcggcag

SEQ ID NO: 3055149 - RNA, 17 nt, Mycobacterium bovis subsp bovis AF2122/97
cggcccauugucgauca

SEQ ID NO: 3055150 - RNA, 20 nt, Mycobacterium bovis subsp bovis AF2122/97
cggccccaccgacagcccca

SEQ ID NO: 3055151 - RNA, 15 nt, Mycobacterium bovis subsp bovis AF2122/97
cggccccaccggcac

SEQ ID NO: 3055152 - RNA, 14 nt, Mycobacterium bovis subsp bovis AF2122/97
cggccccaccggua

SEQ ID NO: 3055153 - RNA, 20 nt, Mycobacterium bovis subsp bovis AF2122/97
cggccccaccgguaccgcca

SEQ ID NO: 3055154 - RNA, 22 nt, Mycobacterium bovis subsp bovis AF2122/97
cggccccaccgguaccgccacu

SEQ ID NO: 3055155 - RNA, 19 nt, Mycobacterium bovis subsp bovis AF2122/97
cggccccaccggugccgcc

SEQ ID NO: 3055156 - RNA, 12 nt, Mycobacterium bovis subsp bovis AF2122/97
cggccccagggg

SEQ ID NO: 3055157 - RNA, 19 nt, Mycobacterium bovis subsp bovis AF2122/97
cggcccccaagcucugcgu

SEQ ID NO: 3055158 - RNA, 23 nt, Mycobacterium bovis subsp bovis AF2122/97
cggcccccgacuccggcaggccc

SEQ ID NO: 3055159 - RNA, 16 nt, Mycobacterium bovis subsp bovis AF2122/97
cggcccccgaggcugg

SEQ ID NO: 3055160 - RNA, 18 nt, Mycobacterium bovis subsp bovis AF2122/97
cggccccgaaacgauggc

SEQ ID NO: 3055161 - RNA, 21 nt, Mycobacterium bovis subsp bovis AF2122/97
cggcccucgaugccgcguagc

SEQ ID NO: 3055162 - RNA, 22 nt, Mycobacterium bovis subsp bovis AF2122/97
cggcccugaacgguucggccgg

SEQ ID NO: 3055163 - RNA, 13 nt, Mycobacterium bovis subsp bovis AF2122/97
cggcccugccgcc

SEQ ID NO: 3055164 - RNA, 15 nt, Mycobacterium bovis subsp bovis AF2122/97
cggcccugccgccgg

SEQ ID NO: 3055165 - RNA, 16 nt, Mycobacterium bovis subsp bovis AF2122/97
cggcccugccgccggc

SEQ ID NO: 3055166 - RNA, 18 nt, Mycobacterium bovis subsp bovis AF2122/97
cggcccugccgccggccc

SEQ ID NO: 3055167 - RNA, 12 nt, Mycobacterium bovis subsp bovis AF2122/97
cggcccugcggc

SEQ ID NO: 3055168 - RNA, 15 nt, Mycobacterium bovis subsp bovis AF2122/97
cggcccugcucgccg

SEQ ID NO: 3055169 - RNA, 20 nt, Mycobacterium bovis subsp bovis AF2122/97
cggcccugcucgccgucucg

SEQ ID NO: 3055170 - RNA, 21 nt, Mycobacterium bovis subsp bovis AF2122/97
cggcccuggacauaccggccc

SEQ ID NO: 3055171 - RNA, 22 nt, Mycobacterium bovis subsp bovis AF2122/97
cggcccuggacauaccggcccg

SEQ ID NO: 3055172 - RNA, 14 nt, Mycobacterium bovis subsp bovis AF2122/97
cggcccuucgacga

SEQ ID NO: 3055173 - RNA, 18 nt, Mycobacterium bovis subsp bovis AF2122/97
cggccgaaagagccagcg

SEQ ID NO: 3055174 - RNA, 19 nt, Mycobacterium bovis subsp bovis AF2122/97
cggccgaacgccucgccgg

SEQ ID NO: 3055175 - RNA, 22 nt, Mycobacterium bovis subsp bovis AF2122/97
cggccgaacgccucgccggcca

SEQ ID NO: 3055176 - RNA, 13 nt, Mycobacterium bovis subsp bovis AF2122/97
cggccgaaggcgc

SEQ ID NO: 3055177 - RNA, 21 nt, Mycobacterium bovis subsp bovis AF2122/97
cggccgaauuccucaaggucg

SEQ ID NO: 3055178 - RNA, 16 nt, Mycobacterium bovis subsp bovis AF2122/97
cggccgacaacccggc

SEQ ID NO: 3055179 - RNA, 19 nt, Mycobacterium bovis subsp bovis AF2122/97
cggccgacaacccggccgg

SEQ ID NO: 3055180 - RNA, 21 nt, Mycobacterium bovis subsp bovis AF2122/97
cggccgacaacccggccgggc

SEQ ID NO: 3055181 - RNA, 12 nt, Mycobacterium bovis subsp bovis AF2122/97
cggccgacaccg

SEQ ID NO: 3055182 - RNA, 15 nt, Mycobacterium bovis subsp bovis AF2122/97
cggccgacaccgcca

SEQ ID NO: 3055183 - RNA, 16 nt, Mycobacterium bovis subsp bovis AF2122/97
cggccgacaccgccac

SEQ ID NO: 3055184 - RNA, 17 nt, Mycobacterium bovis subsp bovis AF2122/97
cggccgacaccgccacc

SEQ ID NO: 3055185 - RNA, 15 nt, Mycobacterium bovis subsp bovis AF2122/97
cggccgacacgccga

SEQ ID NO: 3055186 - RNA, 19 nt, Mycobacterium bovis subsp bovis AF2122/97
cggccgacacgccgaugcc

SEQ ID NO: 3055187 - RNA, 14 nt, Mycobacterium bovis subsp bovis AF2122/97
cggccgacccggau

SEQ ID NO: 3055188 - RNA, 14 nt, Mycobacterium bovis subsp bovis AF2122/97
cggccgaccgcgac

SEQ ID NO: 3055189 - RNA, 15 nt, Mycobacterium bovis subsp bovis AF2122/97
cggccgaccgcgacc

SEQ ID NO: 3055190 - RNA, 15 nt, Mycobacterium bovis subsp bovis AF2122/97
cggccgaccucggca

SEQ ID NO: 3055191 - RNA, 15 nt, Mycobacterium bovis subsp bovis AF2122/97
cggccgacgaucaua

SEQ ID NO: 3055192 - RNA, 17 nt, Mycobacterium bovis subsp bovis AF2122/97
cggccgacgcuggcggu

SEQ ID NO: 3055193 - RNA, 13 nt, Mycobacterium bovis subsp bovis AF2122/97
cggccgacgggug

SEQ ID NO: 3055194 - RNA, 21 nt, Mycobacterium bovis subsp bovis AF2122/97
cggccgacuuggugaccccgu

SEQ ID NO: 3055195 - RNA, 13 nt, Mycobacterium bovis subsp bovis AF2122/97
cggccgagacggc

SEQ ID NO: 3055196 - RNA, 17 nt, Mycobacterium bovis subsp bovis AF2122/97
cggccgagacggcguug

SEQ ID NO: 3055197 - RNA, 15 nt, Mycobacterium bovis subsp bovis AF2122/97
cggccgagcgcaccg

SEQ ID NO: 3055198 - RNA, 21 nt, Mycobacterium bovis subsp bovis AF2122/97
cggccgagcgcacuggggagg

SEQ ID NO: 3055199 - RNA, 23 nt, Mycobacterium bovis subsp bovis AF2122/97
cggccgagcguggccaauccggc

SEQ ID NO: 3055200 - RNA, 17 nt, Mycobacterium bovis subsp bovis AF2122/97
cggccgagcugguuggc

SEQ ID NO: 3055201 - RNA, 19 nt, Mycobacterium bovis subsp bovis AF2122/97
cggccgaggaccagaggcg

SEQ ID NO: 3055202 - RNA, 16 nt, Mycobacterium bovis subsp bovis AF2122/97
cggccgaggcggucuu

SEQ ID NO: 3055203 - RNA, 21 nt, Mycobacterium bovis subsp bovis AF2122/97
cggccgagggauugccgugcu

SEQ ID NO: 3055204 - RNA, 15 nt, Mycobacterium bovis subsp bovis AF2122/97
cggccgaggucaccc

SEQ ID NO: 3055205 - RNA, 17 nt, Mycobacterium bovis subsp bovis AF2122/97
cggccgaggucacccgg

SEQ ID NO: 3055206 - RNA, 18 nt, Mycobacterium bovis subsp bovis AF2122/97
cggccgaggucacccggu

SEQ ID NO: 3055207 - RNA, 15 nt, Mycobacterium bovis subsp bovis AF2122/97
cggccgaggucgcgg

SEQ ID NO: 3055208 - RNA, 18 nt, Mycobacterium bovis subsp bovis AF2122/97
cggccgaggucgcggucu

SEQ ID NO: 3055209 - RNA, 15 nt, Mycobacterium bovis subsp bovis AF2122/97
cggccgaguaccagc

SEQ ID NO: 3055210 - RNA, 17 nt, Mycobacterium bovis subsp bovis AF2122/97
cggccgaguaccagccc

SEQ ID NO: 3055211 - RNA, 18 nt, Mycobacterium bovis subsp bovis AF2122/97
cggccgaguaccagccca

SEQ ID NO: 3055212 - RNA, 21 nt, Mycobacterium bovis subsp bovis AF2122/97
cggccgaguaccagcccaccg

SEQ ID NO: 3055213 - RNA, 17 nt, Mycobacterium bovis subsp bovis AF2122/97
cggccgagucgauugcc

SEQ ID NO: 3055214 - RNA, 21 nt, Mycobacterium bovis subsp bovis AF2122/97
cggccgagucgauugccaccg

SEQ ID NO: 3055215 - RNA, 22 nt, Mycobacterium bovis subsp bovis AF2122/97
cggccgagucgauugccaccga

SEQ ID NO: 3055216 - RNA, 23 nt, Mycobacterium bovis subsp bovis AF2122/97
cggccgagucgauugccaccgag

SEQ ID NO: 3055217 - RNA, 18 nt, Mycobacterium bovis subsp bovis AF2122/97
cggccgauacagaucugg

SEQ ID NO: 3055218 - RNA, 16 nt, Mycobacterium bovis subsp bovis AF2122/97
cggccgauacgaagcc

SEQ ID NO: 3055219 - RNA, 16 nt, Mycobacterium bovis subsp bovis AF2122/97
cggccgaucagcagcu

SEQ ID NO: 3055220 - RNA, 16 nt, Mycobacterium bovis subsp bovis AF2122/97
cggccgaucggccggu

SEQ ID NO: 3055221 - RNA, 14 nt, Mycobacterium bovis subsp bovis AF2122/97
cggccgaugcgacc

SEQ ID NO: 3055222 - RNA, 18 nt, Mycobacterium bovis subsp bovis AF2122/97
cggccgaugcgcagugca

SEQ ID NO: 3055223 - RNA, 21 nt, Mycobacterium bovis subsp bovis AF2122/97
cggccgaugcgcagugcaccg

SEQ ID NO: 3055224 - RNA, 18 nt, Mycobacterium bovis subsp bovis AF2122/97
cggccgcaaggcgccgau

SEQ ID NO: 3055225 - RNA, 24 nt, Mycobacterium bovis subsp bovis AF2122/97
cggccgcaaucaugucagcgcuga

SEQ ID NO: 3055226 - RNA, 13 nt, Mycobacterium bovis subsp bovis AF2122/97
cggccgcacauga

SEQ ID NO: 3055227 - RNA, 13 nt, Mycobacterium bovis subsp bovis AF2122/97
cggccgcaccagc

SEQ ID NO: 3055228 - RNA, 15 nt, Mycobacterium bovis subsp bovis AF2122/97
cggccgcacccguug

SEQ ID NO: 3055229 - RNA, 13 nt, Mycobacterium bovis subsp bovis AF2122/97
cggccgcacgccg

SEQ ID NO: 3055230 - RNA, 19 nt, Mycobacterium bovis subsp bovis AF2122/97
cggccgcacgccgaccagc

SEQ ID NO: 3055231 - RNA, 22 nt, Mycobacterium bovis subsp bovis AF2122/97
cggccgcacgccgaccagcacc

SEQ ID NO: 3055232 - RNA, 12 nt, Mycobacterium bovis subsp bovis AF2122/97
cggccgcacugg

SEQ ID NO: 3055233 - RNA, 14 nt, Mycobacterium bovis subsp bovis AF2122/97
cggccgcagccagc

SEQ ID NO: 3055234 - RNA, 19 nt, Mycobacterium bovis subsp bovis AF2122/97
cggccgcagccagcaaguc

SEQ ID NO: 3055235 - RNA, 13 nt, Mycobacterium bovis subsp bovis AF2122/97
cggccgcagcggc

SEQ ID NO: 3055236 - RNA, 15 nt, Mycobacterium bovis subsp bovis AF2122/97
cggccgcagcggcca

SEQ ID NO: 3055237 - RNA, 19 nt, Mycobacterium bovis subsp bovis AF2122/97
cggccgcagcggccagccc

SEQ ID NO: 3055238 - RNA, 18 nt, Mycobacterium bovis subsp bovis AF2122/97
cggccgcaggcgaacacc

SEQ ID NO: 3055239 - RNA, 14 nt, Mycobacterium bovis subsp bovis AF2122/97
cggccgcaggcuug

SEQ ID NO: 3055240 - RNA, 18 nt, Mycobacterium bovis subsp bovis AF2122/97
cggccgcaggcuugccga

SEQ ID NO: 3055241 - RNA, 18 nt, Mycobacterium bovis subsp bovis AF2122/97
cggccgcauccccgguac

SEQ ID NO: 3055242 - RNA, 15 nt, Mycobacterium bovis subsp bovis AF2122/97
cggccgcaucgccca

SEQ ID NO: 3055243 - RNA, 17 nt, Mycobacterium bovis subsp bovis AF2122/97
cggccgcaucgcccaac

SEQ ID NO: 3055244 - RNA, 21 nt, Mycobacterium bovis subsp bovis AF2122/97
cggccgcaucgcccaacaacg

SEQ ID NO: 3055245 - RNA, 16 nt, Mycobacterium bovis subsp bovis AF2122/97
cggccgcaucggucaa

SEQ ID NO: 3055246 - RNA, 19 nt, Mycobacterium bovis subsp bovis AF2122/97
cggccgcauucgugacgag

SEQ ID NO: 3055247 - RNA, 20 nt, Mycobacterium bovis subsp bovis AF2122/97
cggccgccaacuccagcacc

SEQ ID NO: 3055248 - RNA, 17 nt, Mycobacterium bovis subsp bovis AF2122/97
cggccggaguccgucgg

SEQ ID NO: 3055249 - RNA, 18 nt, Mycobacterium bovis subsp bovis AF2122/97
cggccggaguccgucggg

SEQ ID NO: 3055250 - RNA, 20 nt, Mycobacterium bovis subsp bovis AF2122/97
cggccggauacggcgacacc

SEQ ID NO: 3055251 - RNA, 20 nt, Mycobacterium bovis subsp bovis AF2122/97
cggccggauacgggcugacg

SEQ ID NO: 3055252 - RNA, 19 nt, Mycobacterium bovis subsp bovis AF2122/97
cggccggauguugaccggc

SEQ ID NO: 3055253 - RNA, 23 nt, Mycobacterium bovis subsp bovis AF2122/97
cggccggauguugaccggcucga

SEQ ID NO: 3055254 - RNA, 14 nt, Mycobacterium bovis subsp bovis AF2122/97
cggccggcaagcag

SEQ ID NO: 3055255 - RNA, 22 nt, Mycobacterium bovis subsp bovis AF2122/97
cggccggcaaugccgcggccag

SEQ ID NO: 3055256 - RNA, 12 nt, Mycobacterium bovis subsp bovis AF2122/97
cggccggcaccc

SEQ ID NO: 3055257 - RNA, 13 nt, Mycobacterium bovis subsp bovis AF2122/97
cggccggcacccc

SEQ ID NO: 3055258 - RNA, 15 nt, Mycobacterium bovis subsp bovis AF2122/97
cggccggcaccccac

SEQ ID NO: 3055259 - RNA, 18 nt, Mycobacterium bovis subsp bovis AF2122/97
cggccggcaccccacggc

SEQ ID NO: 3055260 - RNA, 20 nt, Mycobacterium bovis subsp bovis AF2122/97
cggccggcaccccacggcca

SEQ ID NO: 3055261 - RNA, 22 nt, Mycobacterium bovis subsp bovis AF2122/97
cggccggcaccccacggccagu

SEQ ID NO: 3055262 - RNA, 17 nt, Mycobacterium bovis subsp bovis AF2122/97
cggccggcacgaccgcu

SEQ ID NO: 3055263 - RNA, 18 nt, Mycobacterium bovis subsp bovis AF2122/97
cggccggcaguccgagcu

SEQ ID NO: 3055264 - RNA, 19 nt, Mycobacterium bovis subsp bovis AF2122/97
cggccggcaguccgagcuu

SEQ ID NO: 3055265 - RNA, 14 nt, Mycobacterium bovis subsp bovis AF2122/97
cggccggccagcac

SEQ ID NO: 3055266 - RNA, 15 nt, Mycobacterium bovis subsp bovis AF2122/97
cggccggccagcacc

SEQ ID NO: 3055267 - RNA, 16 nt, Mycobacterium bovis subsp bovis AF2122/97
cggccggccagcaccc

SEQ ID NO: 3055268 - RNA, 18 nt, Mycobacterium bovis subsp bovis AF2122/97
cggccggccagcacccga

SEQ ID NO: 3055269 - RNA, 13 nt, Mycobacterium bovis subsp bovis AF2122/97
cggccggccaggu

SEQ ID NO: 3055270 - RNA, 23 nt, Mycobacterium bovis subsp bovis AF2122/97
cggccggccagguguugacgauc

SEQ ID NO: 3055271 - RNA, 14 nt, Mycobacterium bovis subsp bovis AF2122/97
cggccggcccgggu

SEQ ID NO: 3055272 - RNA, 12 nt, Mycobacterium bovis subsp bovis AF2122/97
cggccggccgcc

SEQ ID NO: 3055273 - RNA, 13 nt, Mycobacterium bovis subsp bovis AF2122/97
cggccggccgcgg

SEQ ID NO: 3055274 - RNA, 12 nt, Mycobacterium bovis subsp bovis AF2122/97
cggccggccgcu

SEQ ID NO: 3055275 - RNA, 14 nt, Mycobacterium bovis subsp bovis AF2122/97
cggccggccgcuca

SEQ ID NO: 3055276 - RNA, 23 nt, Mycobacterium bovis subsp bovis AF2122/97
cggccggccgcucaccccgcgcu

SEQ ID NO: 3055277 - RNA, 13 nt, Mycobacterium bovis subsp bovis AF2122/97
cggccggccgcug

SEQ ID NO: 3055278 - RNA, 16 nt, Mycobacterium bovis subsp bovis AF2122/97
cggccggccuagccga

SEQ ID NO: 3055279 - RNA, 17 nt, Mycobacterium bovis subsp bovis AF2122/97
cggccggccuagccgau

SEQ ID NO: 3055280 - RNA, 17 nt, Mycobacterium bovis subsp bovis AF2122/97
cggccggcgcagugcga

SEQ ID NO: 3055281 - RNA, 17 nt, Mycobacterium bovis subsp bovis AF2122/97
cggccggcgccggcgcg

SEQ ID NO: 3055282 - RNA, 17 nt, Mycobacterium bovis subsp bovis AF2122/97
cggccggcgcucgcggc

SEQ ID NO: 3055283 - RNA, 19 nt, Mycobacterium bovis subsp bovis AF2122/97
cggccggcgcucgcggcgg

SEQ ID NO: 3055284 - RNA, 16 nt, Mycobacterium bovis subsp bovis AF2122/97
cggccggcggccgccc

SEQ ID NO: 3055285 - RNA, 12 nt, Mycobacterium bovis subsp bovis AF2122/97
cggccggcggcg

SEQ ID NO: 3055286 - RNA, 14 nt, Mycobacterium bovis subsp bovis AF2122/97
cggccggcgucagc

SEQ ID NO: 3055287 - RNA, 17 nt, Mycobacterium bovis subsp bovis AF2122/97
cggccggcgucagcccc

SEQ ID NO: 3055288 - RNA, 13 nt, Mycobacterium bovis subsp bovis AF2122/97
cggccggcgucgg

SEQ ID NO: 3055289 - RNA, 14 nt, Mycobacterium bovis subsp bovis AF2122/97
cggccggcgugcca

SEQ ID NO: 3055290 - RNA, 17 nt, Mycobacterium bovis subsp bovis AF2122/97
cggccggcgugccagca

SEQ ID NO: 3055291 - RNA, 17 nt, Mycobacterium bovis subsp bovis AF2122/97
cggccggcuagcgguuu

SEQ ID NO: 3055292 - RNA, 13 nt, Mycobacterium bovis subsp bovis AF2122/97
cggccggcuccgg

SEQ ID NO: 3055293 - RNA, 15 nt, Mycobacterium bovis subsp bovis AF2122/97
cggccggcucguccg

SEQ ID NO: 3055294 - RNA, 15 nt, Mycobacterium bovis subsp bovis AF2122/97
cggccgggacggcga

SEQ ID NO: 3055295 - RNA, 13 nt, Mycobacterium bovis subsp bovis AF2122/97
cggccgggcccuc

SEQ ID NO: 3055296 - RNA, 12 nt, Mycobacterium bovis subsp bovis AF2122/97
cggccgggccgu

SEQ ID NO: 3055297 - RNA, 20 nt, Mycobacterium bovis subsp bovis AF2122/97
cggccgggccugcaccacgg

SEQ ID NO: 3055298 - RNA, 15 nt, Mycobacterium bovis subsp bovis AF2122/97
cggccgggcggccag

SEQ ID NO: 3055299 - RNA, 15 nt, Mycobacterium bovis subsp bovis AF2122/97
cggccgggcguccuc

SEQ ID NO: 3055300 - RNA, 19 nt, Mycobacterium bovis subsp bovis AF2122/97
cggccgggcguccucgucg

SEQ ID NO: 3055301 - RNA, 22 nt, Mycobacterium bovis subsp bovis AF2122/97
cggccgggcguccucgucgaga

SEQ ID NO: 3055302 - RNA, 22 nt, Mycobacterium bovis subsp bovis AF2122/97
cggccgggcuccccaagucgac

SEQ ID NO: 3055303 - RNA, 14 nt, Mycobacterium bovis subsp bovis AF2122/97
cggccggggccacc

SEQ ID NO: 3055304 - RNA, 15 nt, Mycobacterium bovis subsp bovis AF2122/97
cggccggggccaccc

SEQ ID NO: 3055305 - RNA, 16 nt, Mycobacterium bovis subsp bovis AF2122/97
cggccggggccacccg

SEQ ID NO: 3055306 - RNA, 17 nt, Mycobacterium bovis subsp bovis AF2122/97
cggccggggccacccgc

SEQ ID NO: 3055307 - RNA, 16 nt, Mycobacterium bovis subsp bovis AF2122/97
cggccggggcgaacgg

SEQ ID NO: 3055308 - RNA, 20 nt, Mycobacterium bovis subsp bovis AF2122/97
cggccgggucgcgcuggcgc

SEQ ID NO: 3055309 - RNA, 17 nt, Mycobacterium bovis subsp bovis AF2122/97
cggccggguggcccggc

SEQ ID NO: 3055310 - RNA, 18 nt, Mycobacterium bovis subsp bovis AF2122/97
cggccggguguagcucgg

SEQ ID NO: 3055311 - RNA, 19 nt, Mycobacterium bovis subsp bovis AF2122/97
cggccggguuaucggcagc

SEQ ID NO: 3055312 - RNA, 20 nt, Mycobacterium bovis subsp bovis AF2122/97
cggccggguuaucggcagca

SEQ ID NO: 3055313 - RNA, 21 nt, Mycobacterium bovis subsp bovis AF2122/97
cggccggguuaucggcagcag

SEQ ID NO: 3055314 - RNA, 17 nt, Mycobacterium bovis subsp bovis AF2122/97
cggccggguucgcgucu

SEQ ID NO: 3055315 - RNA, 13 nt, Mycobacterium bovis subsp bovis AF2122/97
cggccgguacacg

SEQ ID NO: 3055316 - RNA, 22 nt, Mycobacterium bovis subsp bovis AF2122/97
cggccgguagaucuucggccgc

SEQ ID NO: 3055317 - RNA, 21 nt, Mycobacterium bovis subsp bovis AF2122/97
cggccgguggaaaccgggcga

SEQ ID NO: 3055318 - RNA, 18 nt, Mycobacterium bovis subsp bovis AF2122/97
cggccgguggccagcacg

SEQ ID NO: 3055319 - RNA, 20 nt, Mycobacterium bovis subsp bovis AF2122/97
cggccgguggguagccagcg

SEQ ID NO: 3055320 - RNA, 16 nt, Mycobacterium bovis subsp bovis AF2122/97
cggccgguucagguug

SEQ ID NO: 3055321 - RNA, 17 nt, Mycobacterium bovis subsp bovis AF2122/97
cggccgguuggccagcc

SEQ ID NO: 3055322 - RNA, 23 nt, Mycobacterium bovis subsp bovis AF2122/97
cggccguagugcacgucggcggg

SEQ ID NO: 3055323 - RNA, 20 nt, Mycobacterium bovis subsp bovis AF2122/97
cggccgucaccggucggcca

SEQ ID NO: 3055324 - RNA, 14 nt, Mycobacterium bovis subsp bovis AF2122/97
cggccgucagcaca

SEQ ID NO: 3055325 - RNA, 18 nt, Mycobacterium bovis subsp bovis AF2122/97
cggccgucaggguguugc

SEQ ID NO: 3055326 - RNA, 15 nt, Mycobacterium bovis subsp bovis AF2122/97
cggccgucauggccc

SEQ ID NO: 3055327 - RNA, 16 nt, Mycobacterium bovis subsp bovis AF2122/97
cggccgucauggcccg

SEQ ID NO: 3055328 - RNA, 16 nt, Mycobacterium bovis subsp bovis AF2122/97
cggccgucccgcgagc

SEQ ID NO: 3055329 - RNA, 17 nt, Mycobacterium bovis subsp bovis AF2122/97
cggccgucccgcgagca

SEQ ID NO: 3055330 - RNA, 22 nt, Mycobacterium bovis subsp bovis AF2122/97
cggccguccuuuccaggagaga

SEQ ID NO: 3055331 - RNA, 12 nt, Mycobacterium bovis subsp bovis AF2122/97
cggccgucgacg

SEQ ID NO: 3055332 - RNA, 15 nt, Mycobacterium bovis subsp bovis AF2122/97
cggccgucgauugca

SEQ ID NO: 3055333 - RNA, 15 nt, Mycobacterium bovis subsp bovis AF2122/97
cggccgucgcgggac

SEQ ID NO: 3055334 - RNA, 16 nt, Mycobacterium bovis subsp bovis AF2122/97
cggccgucggcgggca

SEQ ID NO: 3055335 - RNA, 23 nt, Mycobacterium bovis subsp bovis AF2122/97
cggccugcuggucaccaucaccg

SEQ ID NO: 3055336 - RNA, 20 nt, Mycobacterium bovis subsp bovis AF2122/97
cggccuggaucgugccgaac

SEQ ID NO: 3055337 - RNA, 19 nt, Mycobacterium bovis subsp bovis AF2122/97
cggccuggcaggguggggc

SEQ ID NO: 3055338 - RNA, 14 nt, Mycobacterium bovis subsp bovis AF2122/97
cggccuggccaccu

SEQ ID NO: 3055339 - RNA, 18 nt, Mycobacterium bovis subsp bovis AF2122/97
cggccuggccaccugguu

SEQ ID NO: 3055340 - RNA, 15 nt, Mycobacterium bovis subsp bovis AF2122/97
cggccuggccgccag

SEQ ID NO: 3055341 - RNA, 16 nt, Mycobacterium bovis subsp bovis AF2122/97
cggccuggccgccaga

SEQ ID NO: 3055342 - RNA, 12 nt, Mycobacterium bovis subsp bovis AF2122/97
cggccuggcucg

SEQ ID NO: 3055343 - RNA, 16 nt, Mycobacterium bovis subsp bovis AF2122/97
cggccugggccagccg

SEQ ID NO: 3055344 - RNA, 11 nt, Mycobacterium bovis subsp bovis AF2122/97
cggccuggggc

SEQ ID NO: 3055345 - RNA, 14 nt, Mycobacterium bovis subsp bovis AF2122/97
cggccuggggcagc

SEQ ID NO: 3055346 - RNA, 19 nt, Mycobacterium bovis subsp bovis AF2122/97
cggccuggggcagccgggc

SEQ ID NO: 3055347 - RNA, 21 nt, Mycobacterium bovis subsp bovis AF2122/97
cggccuggggcagccgggcgu

SEQ ID NO: 3055348 - RNA, 17 nt, Mycobacterium bovis subsp bovis AF2122/97
cggccugguacucccgc

SEQ ID NO: 3055349 - RNA, 22 nt, Mycobacterium bovis subsp bovis AF2122/97
cggccugguacucccgcgaucg

SEQ ID NO: 3055350 - RNA, 20 nt, Mycobacterium bovis subsp bovis AF2122/97
cggccuggucggccaggucg

SEQ ID NO: 3055351 - RNA, 16 nt, Mycobacterium bovis subsp bovis AF2122/97
cggccuggugcucaac

SEQ ID NO: 3055352 - RNA, 17 nt, Mycobacterium bovis subsp bovis AF2122/97
cggccuggugcucaacg

SEQ ID NO: 3055353 - RNA, 15 nt, Mycobacterium bovis subsp bovis AF2122/97
cggccuguccaccga

SEQ ID NO: 3055354 - RNA, 16 nt, Mycobacterium bovis subsp bovis AF2122/97
cggccuguccaccgau

SEQ ID NO: 3055355 - RNA, 15 nt, Mycobacterium bovis subsp bovis AF2122/97
cggccuguucgccgu

SEQ ID NO: 3055356 - RNA, 17 nt, Mycobacterium bovis subsp bovis AF2122/97
cggccuguucgccgucg

SEQ ID NO: 3055357 - RNA, 18 nt, Mycobacterium bovis subsp bovis AF2122/97
cggccuguucgccgucgc

SEQ ID NO: 3055358 - RNA, 21 nt, Mycobacterium bovis subsp bovis AF2122/97
cggccuguucggcggcugcca

SEQ ID NO: 3055359 - RNA, 22 nt, Mycobacterium bovis subsp bovis AF2122/97
cggccuuaggugaccaggguga

SEQ ID NO: 3055360 - RNA, 21 nt, Mycobacterium bovis subsp bovis AF2122/97
cggccuucaaggaagccgcgg

SEQ ID NO: 3055361 - RNA, 19 nt, Mycobacterium bovis subsp bovis AF2122/97
cggccuucuccaucgucgg

SEQ ID NO: 3055362 - RNA, 19 nt, Mycobacterium bovis subsp bovis AF2122/97
cggccuugagcacccgaua

SEQ ID NO: 3055363 - RNA, 19 nt, Mycobacterium bovis subsp bovis AF2122/97
cggccuugaucaccgugcg

SEQ ID NO: 3055364 - RNA, 22 nt, Mycobacterium bovis subsp bovis AF2122/97
cggccuugaucaccgugcgguc

SEQ ID NO: 3055365 - RNA, 23 nt, Mycobacterium bovis subsp bovis AF2122/97
cggccuugaucaccgugcggucg

SEQ ID NO: 3055366 - RNA, 19 nt, Mycobacterium bovis subsp bovis AF2122/97
cggccuugaucgugcuggc

SEQ ID NO: 3055367 - RNA, 23 nt, Mycobacterium bovis subsp bovis AF2122/97
cggccuugccaccgguaccgccg

SEQ ID NO: 3055368 - RNA, 23 nt, Mycobacterium bovis subsp bovis AF2122/97
cggccuugcccucaacggcggca

SEQ ID NO: 3055369 - RNA, 13 nt, Mycobacterium bovis subsp bovis AF2122/97
cggccuugccgcc

SEQ ID NO: 3055370 - RNA, 14 nt, Mycobacterium bovis subsp bovis AF2122/97
cggccuugccgccg

SEQ ID NO: 3055371 - RNA, 17 nt, Mycobacterium bovis subsp bovis AF2122/97
cggccuugccgccggcc

SEQ ID NO: 3055372 - RNA, 19 nt, Mycobacterium bovis subsp bovis AF2122/97
cggccuugccgccggcccc

SEQ ID NO: 3055373 - RNA, 21 nt, Mycobacterium bovis subsp bovis AF2122/97
cggccuugccgccggccccgc

SEQ ID NO: 3055374 - RNA, 22 nt, Mycobacterium bovis subsp bovis AF2122/97
cggccuugccgccggcgccgcc

SEQ ID NO: 3055375 - RNA, 14 nt, Mycobacterium bovis subsp bovis AF2122/97
cggccuugcgcaca

SEQ ID NO: 3055376 - RNA, 17 nt, Mycobacterium bovis subsp bovis AF2122/97
cggccuugcgcacaggc

SEQ ID NO: 3055377 - RNA, 18 nt, Mycobacterium bovis subsp bovis AF2122/97
cggccuugcgggcucucg

SEQ ID NO: 3055378 - RNA, 20 nt, Mycobacterium bovis subsp bovis AF2122/97
cggccuugcgggcucucggc

SEQ ID NO: 3055379 - RNA, 23 nt, Mycobacterium bovis subsp bovis AF2122/97
cggccuugcgggcucucggcguc

SEQ ID NO: 3055380 - RNA, 14 nt, Mycobacterium bovis subsp bovis AF2122/97
cggccuugcucagc

SEQ ID NO: 3055381 - RNA, 18 nt, Mycobacterium bovis subsp bovis AF2122/97
cggccuugcucagcacgc

SEQ ID NO: 3055382 - RNA, 20 nt, Mycobacterium bovis subsp bovis AF2122/97
cggccuugcucagcacgccg

SEQ ID NO: 3055383 - RNA, 22 nt, Mycobacterium bovis subsp bovis AF2122/97
cggccuugcucagcacgccggg

SEQ ID NO: 3055384 - RNA, 22 nt, Mycobacterium bovis subsp bovis AF2122/97
cggccuuggcgacgucgcgggu

SEQ ID NO: 3055385 - RNA, 13 nt, Mycobacterium bovis subsp bovis AF2122/97
cggccuuggcggc

SEQ ID NO: 3055386 - RNA, 18 nt, Mycobacterium bovis subsp bovis AF2122/97
cggccuuggcggccgcga

SEQ ID NO: 3055387 - RNA, 20 nt, Mycobacterium bovis subsp bovis AF2122/97
cggccuuggcggccgcgacc

SEQ ID NO: 3055388 - RNA, 20 nt, Mycobacterium bovis subsp bovis AF2122/97
cggccuugugcucgaugcga

SEQ ID NO: 3055389 - RNA, 21 nt, Mycobacterium bovis subsp bovis AF2122/97
cggccuuuacccgggcggcgg

SEQ ID NO: 3055390 - RNA, 16 nt, Mycobacterium bovis subsp bovis AF2122/97
cggccuuuccagcacc

SEQ ID NO: 3055391 - RNA, 19 nt, Mycobacterium bovis subsp bovis AF2122/97
cggccuuuccagcaccccg

SEQ ID NO: 3055392 - RNA, 14 nt, Mycobacterium bovis subsp bovis AF2122/97
cggccuuugucgcc

SEQ ID NO: 3055393 - RNA, 22 nt, Mycobacterium bovis subsp bovis AF2122/97
cggccuuugucgccuucuuggc

SEQ ID NO: 3055394 - RNA, 15 nt, Mycobacterium bovis subsp bovis AF2122/97
cggccuuuuccgggu

SEQ ID NO: 3055395 - RNA, 22 nt, Mycobacterium bovis subsp bovis AF2122/97
cggccuuuuccgggucgugcga

SEQ ID NO: 3055396 - RNA, 21 nt, Mycobacterium bovis subsp bovis AF2122/97
cggcgaaaaccaucgcuugcg

SEQ ID NO: 3055397 - RNA, 16 nt, Mycobacterium bovis subsp bovis AF2122/97
cggcgaaacccgggau

SEQ ID NO: 3055398 - RNA, 16 nt, Mycobacterium bovis subsp bovis AF2122/97
cggcgaaacucgucga

SEQ ID NO: 3055399 - RNA, 20 nt, Mycobacterium bovis subsp bovis AF2122/97
cggcgaaacucgucgauucg

SEQ ID NO: 3055400 - RNA, 21 nt, Mycobacterium bovis subsp bovis AF2122/97
cggcgaaagcuugggcgaucg

SEQ ID NO: 3055401 - RNA, 15 nt, Mycobacterium bovis subsp bovis AF2122/97
cggcgaaaggccagu

SEQ ID NO: 3055402 - RNA, 23 nt, Mycobacterium bovis subsp bovis AF2122/97
cggcgaacaaccacgcacggugg

SEQ ID NO: 3055403 - RNA, 19 nt, Mycobacterium bovis subsp bovis AF2122/97
cggcgaacaaccgccgcuc

SEQ ID NO: 3055404 - RNA, 16 nt, Mycobacterium bovis subsp bovis AF2122/97
cggcgaacaggcgacc

SEQ ID NO: 3055405 - RNA, 18 nt, Mycobacterium bovis subsp bovis AF2122/97
cggcgaacaggcgaccgg

SEQ ID NO: 3055406 - RNA, 19 nt, Mycobacterium bovis subsp bovis AF2122/97
cggcgaacaggcgaccggg

SEQ ID NO: 3055407 - RNA, 17 nt, Mycobacterium bovis subsp bovis AF2122/97
cggcgaacaucaccguc

SEQ ID NO: 3055408 - RNA, 20 nt, Mycobacterium bovis subsp bovis AF2122/97
cggcgaacaucaccgucgcc

SEQ ID NO: 3055409 - RNA, 14 nt, Mycobacterium bovis subsp bovis AF2122/97
cggcgaaccacggc

SEQ ID NO: 3055410 - RNA, 14 nt, Mycobacterium bovis subsp bovis AF2122/97
cggcgaacccaccg

SEQ ID NO: 3055411 - RNA, 15 nt, Mycobacterium bovis subsp bovis AF2122/97
cggcgaacccaccgc

SEQ ID NO: 3055412 - RNA, 18 nt, Mycobacterium bovis subsp bovis AF2122/97
cggcgaacccaccgcauu

SEQ ID NO: 3055413 - RNA, 14 nt, Mycobacterium bovis subsp bovis AF2122/97
cggcgaacccagcg

SEQ ID NO: 3055414 - RNA, 23 nt, Mycobacterium bovis subsp bovis AF2122/97
cggcgaacccagcggagccacuc

SEQ ID NO: 3055415 - RNA, 14 nt, Mycobacterium bovis subsp bovis AF2122/97
cggcgaaccccagc

SEQ ID NO: 3055416 - RNA, 16 nt, Mycobacterium bovis subsp bovis AF2122/97
cggcgaaccccagcgc

SEQ ID NO: 3055417 - RNA, 12 nt, Mycobacterium bovis subsp bovis AF2122/97
cggcgaacccgc

SEQ ID NO: 3055418 - RNA, 15 nt, Mycobacterium bovis subsp bovis AF2122/97
cggcgaacccgcagu

SEQ ID NO: 3055419 - RNA, 18 nt, Mycobacterium bovis subsp bovis AF2122/97
cggcgaacccuccgcagc

SEQ ID NO: 3055420 - RNA, 19 nt, Mycobacterium bovis subsp bovis AF2122/97
cggcgaaccggcccaccga

SEQ ID NO: 3055421 - RNA, 12 nt, Mycobacterium bovis subsp bovis AF2122/97
cggcgaccaucu

SEQ ID NO: 3055422 - RNA, 24 nt, Mycobacterium bovis subsp bovis AF2122/97
cggcgaccaugaugccuaccgggc

SEQ ID NO: 3055423 - RNA, 14 nt, Mycobacterium bovis subsp bovis AF2122/97
cggcgacccagcgg

SEQ ID NO: 3055424 - RNA, 23 nt, Mycobacterium bovis subsp bovis AF2122/97
cggcgaccccgaacauccgccgc

SEQ ID NO: 3055425 - RNA, 20 nt, Mycobacterium bovis subsp bovis AF2122/97
cggcgaccccgaagaugacc

SEQ ID NO: 3055426 - RNA, 13 nt, Mycobacterium bovis subsp bovis AF2122/97
cggcgacccgggu

SEQ ID NO: 3055427 - RNA, 20 nt, Mycobacterium bovis subsp bovis AF2122/97
cggcgacccggguagacacc

SEQ ID NO: 3055428 - RNA, 21 nt, Mycobacterium bovis subsp bovis AF2122/97
cggcgacccggguagacaccg

SEQ ID NO: 3055429 - RNA, 22 nt, Mycobacterium bovis subsp bovis AF2122/97
cggcgacccggguagacaccgc

SEQ ID NO: 3055430 - RNA, 20 nt, Mycobacterium bovis subsp bovis AF2122/97
cggcgacccggucgcggaac

SEQ ID NO: 3055431 - RNA, 21 nt, Mycobacterium bovis subsp bovis AF2122/97
cggcgacccgucccccgcacg

SEQ ID NO: 3055432 - RNA, 16 nt, Mycobacterium bovis subsp bovis AF2122/97
cggcgaccgacgccgg

SEQ ID NO: 3055433 - RNA, 22 nt, Mycobacterium bovis subsp bovis AF2122/97
cggcgaccgacgccggugucgg

SEQ ID NO: 3055434 - RNA, 23 nt, Mycobacterium bovis subsp bovis AF2122/97
cggcgaccgacgccggugucggc

SEQ ID NO: 3055435 - RNA, 18 nt, Mycobacterium bovis subsp bovis AF2122/97
cggcgaccgagacggcgu

SEQ ID NO: 3055436 - RNA, 13 nt, Mycobacterium bovis subsp bovis AF2122/97
cggcgaccgccag

SEQ ID NO: 3055437 - RNA, 17 nt, Mycobacterium bovis subsp bovis AF2122/97
cggcgaccgccugcgcg

SEQ ID NO: 3055438 - RNA, 22 nt, Mycobacterium bovis subsp bovis AF2122/97
cggcgaccgccugcgcggcugc

SEQ ID NO: 3055439 - RNA, 13 nt, Mycobacterium bovis subsp bovis AF2122/97
cggcgaccgcgcu

SEQ ID NO: 3055440 - RNA, 18 nt, Mycobacterium bovis subsp bovis AF2122/97
cggcgaccgcgcucaccg

SEQ ID NO: 3055441 - RNA, 15 nt, Mycobacterium bovis subsp bovis AF2122/97
cggcgaccgcggucg

SEQ ID NO: 3055442 - RNA, 11 nt, Mycobacterium bovis subsp bovis AF2122/97
cggcgaccggc

SEQ ID NO: 3055443 - RNA, 17 nt, Mycobacterium bovis subsp bovis AF2122/97
cggcgaccggccggccg

SEQ ID NO: 3055444 - RNA, 19 nt, Mycobacterium bovis subsp bovis AF2122/97
cggcgaccggccggccgcg

SEQ ID NO: 3055445 - RNA, 22 nt, Mycobacterium bovis subsp bovis AF2122/97
cggcgaccggccggccgcgggc

SEQ ID NO: 3055446 - RNA, 13 nt, Mycobacterium bovis subsp bovis AF2122/97
cggcgaccgggau

SEQ ID NO: 3055447 - RNA, 14 nt, Mycobacterium bovis subsp bovis AF2122/97
cggcgaccgggauc

SEQ ID NO: 3055448 - RNA, 15 nt, Mycobacterium bovis subsp bovis AF2122/97
cggcgaccgggcccc

SEQ ID NO: 3055449 - RNA, 22 nt, Mycobacterium bovis subsp bovis AF2122/97
cggcgaccgggcccccagguag

SEQ ID NO: 3055450 - RNA, 13 nt, Mycobacterium bovis subsp bovis AF2122/97
cggcgaccggguc

SEQ ID NO: 3055451 - RNA, 13 nt, Mycobacterium bovis subsp bovis AF2122/97
cggcgaccggugc

SEQ ID NO: 3055452 - RNA, 14 nt, Mycobacterium bovis subsp bovis AF2122/97
cggcgaccgucggg

SEQ ID NO: 3055453 - RNA, 17 nt, Mycobacterium bovis subsp bovis AF2122/97
cggcgaccuccgggaug

SEQ ID NO: 3055454 - RNA, 16 nt, Mycobacterium bovis subsp bovis AF2122/97
cggcgaccucggcggc

SEQ ID NO: 3055455 - RNA, 17 nt, Mycobacterium bovis subsp bovis AF2122/97
cggcgaccucggcggcg

SEQ ID NO: 3055456 - RNA, 18 nt, Mycobacterium bovis subsp bovis AF2122/97
cggcgaccucggcggcgg

SEQ ID NO: 3055457 - RNA, 20 nt, Mycobacterium bovis subsp bovis AF2122/97
cggcgaccucggcggcggca

SEQ ID NO: 3055458 - RNA, 18 nt, Mycobacterium bovis subsp bovis AF2122/97
cggcgaccugccggaccg

SEQ ID NO: 3055459 - RNA, 15 nt, Mycobacterium bovis subsp bovis AF2122/97
cggcgaccugcucgc

SEQ ID NO: 3055460 - RNA, 18 nt, Mycobacterium bovis subsp bovis AF2122/97
cggcgaccuguccgguau

SEQ ID NO: 3055461 - RNA, 17 nt, Mycobacterium bovis subsp bovis AF2122/97
cggcgacgaaugcagca

SEQ ID NO: 3055462 - RNA, 19 nt, Mycobacterium bovis subsp bovis AF2122/97
cggcgacgacaucugccca

SEQ ID NO: 3055463 - RNA, 16 nt, Mycobacterium bovis subsp bovis AF2122/97
cggcgacgaccgucgg

SEQ ID NO: 3055464 - RNA, 19 nt, Mycobacterium bovis subsp bovis AF2122/97
cggcgacgaccgucggcuc

SEQ ID NO: 3055465 - RNA, 15 nt, Mycobacterium bovis subsp bovis AF2122/97
cggcgacgagcgcag

SEQ ID NO: 3055466 - RNA, 13 nt, Mycobacterium bovis subsp bovis AF2122/97
cggcgacgaucuc

SEQ ID NO: 3055467 - RNA, 15 nt, Mycobacterium bovis subsp bovis AF2122/97
cggcgacgaucucgc

SEQ ID NO: 3055468 - RNA, 21 nt, Mycobacterium bovis subsp bovis AF2122/97
cggcgacgaucucgccgccag

SEQ ID NO: 3055469 - RNA, 22 nt, Mycobacterium bovis subsp bovis AF2122/97
cggcgacgaucucgccgccagc

SEQ ID NO: 3055470 - RNA, 17 nt, Mycobacterium bovis subsp bovis AF2122/97
cggcgacgaucucggcg

SEQ ID NO: 3055471 - RNA, 18 nt, Mycobacterium bovis subsp bovis AF2122/97
cggcgacgaucucggcgg

SEQ ID NO: 3055472 - RNA, 22 nt, Mycobacterium bovis subsp bovis AF2122/97
cggcgacgaucucggcggccgc

SEQ ID NO: 3055473 - RNA, 24 nt, Mycobacterium bovis subsp bovis AF2122/97
cggcgacgaucucggcggccgcgu

SEQ ID NO: 3055474 - RNA, 22 nt, Mycobacterium bovis subsp bovis AF2122/97
cggcgacgaugccgggucgcgg

SEQ ID NO: 3055475 - RNA, 15 nt, Mycobacterium bovis subsp bovis AF2122/97
cggcgacgaugucga

SEQ ID NO: 3055476 - RNA, 19 nt, Mycobacterium bovis subsp bovis AF2122/97
cggcgacgaugucgagcgc

SEQ ID NO: 3055477 - RNA, 21 nt, Mycobacterium bovis subsp bovis AF2122/97
cggcgacgaugucgagcgcga

SEQ ID NO: 3055478 - RNA, 13 nt, Mycobacterium bovis subsp bovis AF2122/97
cggcgacgauucg

SEQ ID NO: 3055479 - RNA, 19 nt, Mycobacterium bovis subsp bovis AF2122/97
cggcgacgauucgagcggu

SEQ ID NO: 3055480 - RNA, 15 nt, Mycobacterium bovis subsp bovis AF2122/97
cggcgacgccgcugg

SEQ ID NO: 3055481 - RNA, 15 nt, Mycobacterium bovis subsp bovis AF2122/97
cggcgacgccggccu

SEQ ID NO: 3055482 - RNA, 14 nt, Mycobacterium bovis subsp bovis AF2122/97
cggcgacgcgccgg

SEQ ID NO: 3055483 - RNA, 16 nt, Mycobacterium bovis subsp bovis AF2122/97
cggcgacgcuaccgcc

SEQ ID NO: 3055484 - RNA, 17 nt, Mycobacterium bovis subsp bovis AF2122/97
cggcgacggccgcucgg

SEQ ID NO: 3055485 - RNA, 19 nt, Mycobacterium bovis subsp bovis AF2122/97
cggcgacggccgcucgggc

SEQ ID NO: 3055486 - RNA, 22 nt, Mycobacterium bovis subsp bovis AF2122/97
cggcgacggccgcucgggccag

SEQ ID NO: 3055487 - RNA, 17 nt, Mycobacterium bovis subsp bovis AF2122/97
cggcgacggcgcccaua

SEQ ID NO: 3055488 - RNA, 13 nt, Mycobacterium bovis subsp bovis AF2122/97
cggcgacggcggc

SEQ ID NO: 3055489 - RNA, 14 nt, Mycobacterium bovis subsp bovis AF2122/97
cggcgacggcggca

SEQ ID NO: 3055490 - RNA, 15 nt, Mycobacterium bovis subsp bovis AF2122/97
cggcgacggcggcac

SEQ ID NO: 3055491 - RNA, 17 nt, Mycobacterium bovis subsp bovis AF2122/97
cggcgacggcggcacgg

SEQ ID NO: 3055492 - RNA, 16 nt, Mycobacterium bovis subsp bovis AF2122/97
cggcgacgggucgggc

SEQ ID NO: 3055493 - RNA, 13 nt, Mycobacterium bovis subsp bovis AF2122/97
cggcgacggugag

SEQ ID NO: 3055494 - RNA, 16 nt, Mycobacterium bovis subsp bovis AF2122/97
cggcgacggugagggc

SEQ ID NO: 3055495 - RNA, 12 nt, Mycobacterium bovis subsp bovis AF2122/97
cggcgacggugc

SEQ ID NO: 3055496 - RNA, 17 nt, Mycobacterium bovis subsp bovis AF2122/97
cggcgacggugccaccg

SEQ ID NO: 3055497 - RNA, 18 nt, Mycobacterium bovis subsp bovis AF2122/97
cggcgacggugccaccgc

SEQ ID NO: 3055498 - RNA, 15 nt, Mycobacterium bovis subsp bovis AF2122/97
cggcgacguagacgg

SEQ ID NO: 3055499 - RNA, 21 nt, Mycobacterium bovis subsp bovis AF2122/97
cggcgacguagacgguccggu

SEQ ID NO: 3055500 - RNA, 19 nt, Mycobacterium bovis subsp bovis AF2122/97
cggcgacgucgcgcaggua

SEQ ID NO: 3055501 - RNA, 19 nt, Mycobacterium bovis subsp bovis AF2122/97
cggcgacgugaaugguggu

SEQ ID NO: 3055502 - RNA, 14 nt, Mycobacterium bovis subsp bovis AF2122/97
cggcgacguggcgc

SEQ ID NO: 3055503 - RNA, 16 nt, Mycobacterium bovis subsp bovis AF2122/97
cggcgacguggcgccg

SEQ ID NO: 3055504 - RNA, 21 nt, Mycobacterium bovis subsp bovis AF2122/97
cggcgacguggcgccgacagg

SEQ ID NO: 3055505 - RNA, 21 nt, Mycobacterium bovis subsp bovis AF2122/97
cggcgacuacccagccagccg

SEQ ID NO: 3055506 - RNA, 22 nt, Mycobacterium bovis subsp bovis AF2122/97
cggcgacuacccagccagccgc

SEQ ID NO: 3055507 - RNA, 24 nt, Mycobacterium bovis subsp bovis AF2122/97
cggcgacuacccagccagccgcga

SEQ ID NO: 3055508 - RNA, 19 nt, Mycobacterium bovis subsp bovis AF2122/97
cggcgaucggaggcccgcc

SEQ ID NO: 3055509 - RNA, 15 nt, Mycobacterium bovis subsp bovis AF2122/97
cggcgaucgggcggg

SEQ ID NO: 3055510 - RNA, 19 nt, Mycobacterium bovis subsp bovis AF2122/97
cggcgaucguguccaccgg

SEQ ID NO: 3055511 - RNA, 19 nt, Mycobacterium bovis subsp bovis AF2122/97
cggcgaucuccggcggauc

SEQ ID NO: 3055512 - RNA, 22 nt, Mycobacterium bovis subsp bovis AF2122/97
cggcgaucuccggcggaucugg

SEQ ID NO: 3055513 - RNA, 16 nt, Mycobacterium bovis subsp bovis AF2122/97
cggcgaucucgaccgu

SEQ ID NO: 3055514 - RNA, 14 nt, Mycobacterium bovis subsp bovis AF2122/97
cggcgaucucgucg

SEQ ID NO: 3055515 - RNA, 17 nt, Mycobacterium bovis subsp bovis AF2122/97
cggcgaucucgucgcgg

SEQ ID NO: 3055516 - RNA, 14 nt, Mycobacterium bovis subsp bovis AF2122/97
cggcgaucugcucg

SEQ ID NO: 3055517 - RNA, 17 nt, Mycobacterium bovis subsp bovis AF2122/97
cggcgaucugcuguguc

SEQ ID NO: 3055518 - RNA, 16 nt, Mycobacterium bovis subsp bovis AF2122/97
cggcgaugaccagaug

SEQ ID NO: 3055519 - RNA, 14 nt, Mycobacterium bovis subsp bovis AF2122/97
cggcgaugaucacc

SEQ ID NO: 3055520 - RNA, 21 nt, Mycobacterium bovis subsp bovis AF2122/97
cggcgaugaugacggcggccc

SEQ ID NO: 3055521 - RNA, 20 nt, Mycobacterium bovis subsp bovis AF2122/97
cggcgaugauguugagcugg

SEQ ID NO: 3055522 - RNA, 14 nt, Mycobacterium bovis subsp bovis AF2122/97
cggcgaugcagccg

SEQ ID NO: 3055523 - RNA, 15 nt, Mycobacterium bovis subsp bovis AF2122/97
cggcgaugcagccgg

SEQ ID NO: 3055524 - RNA, 16 nt, Mycobacterium bovis subsp bovis AF2122/97
cggcgaugcagccggg

SEQ ID NO: 3055525 - RNA, 14 nt, Mycobacterium bovis subsp bovis AF2122/97
cggcgaugcgcggg

SEQ ID NO: 3055526 - RNA, 16 nt, Mycobacterium bovis subsp bovis AF2122/97
cggcgaugcgcgggug

SEQ ID NO: 3055527 - RNA, 18 nt, Mycobacterium bovis subsp bovis AF2122/97
cggcgaugcgcggguggu

SEQ ID NO: 3055528 - RNA, 13 nt, Mycobacterium bovis subsp bovis AF2122/97
cggcgaugcgguc

SEQ ID NO: 3055529 - RNA, 14 nt, Mycobacterium bovis subsp bovis AF2122/97
cggcgaugcggucg

SEQ ID NO: 3055530 - RNA, 15 nt, Mycobacterium bovis subsp bovis AF2122/97
cggcgaugcggucgg

SEQ ID NO: 3055531 - RNA, 16 nt, Mycobacterium bovis subsp bovis AF2122/97
cggcgaugcggucggc

SEQ ID NO: 3055532 - RNA, 18 nt, Mycobacterium bovis subsp bovis AF2122/97
cggcgaugcggucggcca

SEQ ID NO: 3055533 - RNA, 20 nt, Mycobacterium bovis subsp bovis AF2122/97
cggcgaugcggucggccaca

SEQ ID NO: 3055534 - RNA, 21 nt, Mycobacterium bovis subsp bovis AF2122/97
cggcgaugcggucggccacau

SEQ ID NO: 3055535 - RNA, 22 nt, Mycobacterium bovis subsp bovis AF2122/97
cggcgaugcggucggccacauc

SEQ ID NO: 3055536 - RNA, 14 nt, Mycobacterium bovis subsp bovis AF2122/97
cggcgaugcguccg

SEQ ID NO: 3055537 - RNA, 17 nt, Mycobacterium bovis subsp bovis AF2122/97
cggcgaugcguccgccc

SEQ ID NO: 3055538 - RNA, 20 nt, Mycobacterium bovis subsp bovis AF2122/97
cggcgaugcguccgcccagc

SEQ ID NO: 3055539 - RNA, 15 nt, Mycobacterium bovis subsp bovis AF2122/97
cggcgaugcugagcc

SEQ ID NO: 3055540 - RNA, 16 nt, Mycobacterium bovis subsp bovis AF2122/97
cggcgauggccagcac

SEQ ID NO: 3055541 - RNA, 18 nt, Mycobacterium bovis subsp bovis AF2122/97
cggcgauggccagcacgg

SEQ ID NO: 3055542 - RNA, 14 nt, Mycobacterium bovis subsp bovis AF2122/97
cggcgauggcgcgc

SEQ ID NO: 3055543 - RNA, 15 nt, Mycobacterium bovis subsp bovis AF2122/97
cggcgauggcgcgca

SEQ ID NO: 3055544 - RNA, 23 nt, Mycobacterium bovis subsp bovis AF2122/97
cggcgauggcgcgcaacguagcc

SEQ ID NO: 3055545 - RNA, 16 nt, Mycobacterium bovis subsp bovis AF2122/97
cggcgauggcggcauc

SEQ ID NO: 3055546 - RNA, 18 nt, Mycobacterium bovis subsp bovis AF2122/97
cggcgaugguagucgcga

SEQ ID NO: 3055547 - RNA, 17 nt, Mycobacterium bovis subsp bovis AF2122/97
cggcgaugguaucgccg

SEQ ID NO: 3055548 - RNA, 19 nt, Mycobacterium bovis subsp bovis AF2122/97
cggcgaugguaucgccgcu

SEQ ID NO: 3055549 - RNA, 14 nt, Mycobacterium bovis subsp bovis AF2122/97
cggcgauggucccg

SEQ ID NO: 3055550 - RNA, 12 nt, Mycobacterium bovis subsp bovis AF2122/97
cggcgaugucga

SEQ ID NO: 3055551 - RNA, 16 nt, Mycobacterium bovis subsp bovis AF2122/97
cggcgauuaccggcac

SEQ ID NO: 3055552 - RNA, 18 nt, Mycobacterium bovis subsp bovis AF2122/97
cggcgauuaccggcacgc

SEQ ID NO: 3055553 - RNA, 20 nt, Mycobacterium bovis subsp bovis AF2122/97
cggcgauugcccgugcgaug

SEQ ID NO: 3055554 - RNA, 19 nt, Mycobacterium bovis subsp bovis AF2122/97
cggcgauuuugcgucgcgc

SEQ ID NO: 3055555 - RNA, 23 nt, Mycobacterium bovis subsp bovis AF2122/97
cggcgauuuugcgucgcgccugc

SEQ ID NO: 3055556 - RNA, 16 nt, Mycobacterium bovis subsp bovis AF2122/97
cggcgcaacaaccggu

SEQ ID NO: 3055557 - RNA, 17 nt, Mycobacterium bovis subsp bovis AF2122/97
cggcgcaacaccucgua

SEQ ID NO: 3055558 - RNA, 19 nt, Mycobacterium bovis subsp bovis AF2122/97
cggcgcaacucgaccacuu

SEQ ID NO: 3055559 - RNA, 15 nt, Mycobacterium bovis subsp bovis AF2122/97
cggcgcaagcgccgc

SEQ ID NO: 3055560 - RNA, 18 nt, Mycobacterium bovis subsp bovis AF2122/97
cggcgcaagcgccgcgcu

SEQ ID NO: 3055561 - RNA, 19 nt, Mycobacterium bovis subsp bovis AF2122/97
cggcgcaagcgccgcgcuu

SEQ ID NO: 3055562 - RNA, 12 nt, Mycobacterium bovis subsp bovis AF2122/97
cggcgcaccaca

SEQ ID NO: 3055563 - RNA, 18 nt, Mycobacterium bovis subsp bovis AF2122/97
cggcgcaccaucgcggcc

SEQ ID NO: 3055564 - RNA, 21 nt, Mycobacterium bovis subsp bovis AF2122/97
cggcgcaccaucgcggccgcu

SEQ ID NO: 3055565 - RNA, 14 nt, Mycobacterium bovis subsp bovis AF2122/97
cggcgcaccgucgc

SEQ ID NO: 3055566 - RNA, 15 nt, Mycobacterium bovis subsp bovis AF2122/97
cggcgcaccugggcu

SEQ ID NO: 3055567 - RNA, 20 nt, Mycobacterium bovis subsp bovis AF2122/97
cggcgcaccugggcugccgg

SEQ ID NO: 3055568 - RNA, 21 nt, Mycobacterium bovis subsp bovis AF2122/97
cggcgcaccuugaccgucgcg

SEQ ID NO: 3055569 - RNA, 22 nt, Mycobacterium bovis subsp bovis AF2122/97
cggcgcaccuugaccgucgcgc

SEQ ID NO: 3055570 - RNA, 20 nt, Mycobacterium bovis subsp bovis AF2122/97
cggcgcacgaaaccgcagcg

SEQ ID NO: 3055571 - RNA, 23 nt, Mycobacterium bovis subsp bovis AF2122/97
cggcgcacgaaaccgcagcgcga

SEQ ID NO: 3055572 - RNA, 13 nt, Mycobacterium bovis subsp bovis AF2122/97
cggcgcagcaccg

SEQ ID NO: 3055573 - RNA, 18 nt, Mycobacterium bovis subsp bovis AF2122/97
cggcgcagcacggcggcc

SEQ ID NO: 3055574 - RNA, 13 nt, Mycobacterium bovis subsp bovis AF2122/97
cggcgcagcgacc

SEQ ID NO: 3055575 - RNA, 16 nt, Mycobacterium bovis subsp bovis AF2122/97
cggcgcagcgaccggu

SEQ ID NO: 3055576 - RNA, 21 nt, Mycobacterium bovis subsp bovis AF2122/97
cggcgcagcgacgcgauuucg

SEQ ID NO: 3055577 - RNA, 20 nt, Mycobacterium bovis subsp bovis AF2122/97
cggcgcagcuaacccgccac

SEQ ID NO: 3055578 - RNA, 21 nt, Mycobacterium bovis subsp bovis AF2122/97
cggcgcagcuaacccgccacg

SEQ ID NO: 3055579 - RNA, 12 nt, Mycobacterium bovis subsp bovis AF2122/97
cggcgcagcugc

SEQ ID NO: 3055580 - RNA, 12 nt, Mycobacterium bovis subsp bovis AF2122/97
cggcgcagcugu

SEQ ID NO: 3055581 - RNA, 13 nt, Mycobacterium bovis subsp bovis AF2122/97
cggcgcagggacu

SEQ ID NO: 3055582 - RNA, 21 nt, Mycobacterium bovis subsp bovis AF2122/97
cggcgcagggacugugggggc

SEQ ID NO: 3055583 - RNA, 22 nt, Mycobacterium bovis subsp bovis AF2122/97
cggcgcagguauaccgaggguc

SEQ ID NO: 3055584 - RNA, 18 nt, Mycobacterium bovis subsp bovis AF2122/97
cggcgcaggucgcgcagu

SEQ ID NO: 3055585 - RNA, 15 nt, Mycobacterium bovis subsp bovis AF2122/97
cggcgcagguucucg

SEQ ID NO: 3055586 - RNA, 18 nt, Mycobacterium bovis subsp bovis AF2122/97
cggcgcagguucucggug

SEQ ID NO: 3055587 - RNA, 17 nt, Mycobacterium bovis subsp bovis AF2122/97
cggcgcaguagccgacc

SEQ ID NO: 3055588 - RNA, 15 nt, Mycobacterium bovis subsp bovis AF2122/97
cggcgcagugcgacu

SEQ ID NO: 3055589 - RNA, 17 nt, Mycobacterium bovis subsp bovis AF2122/97
cggcgcagugcgacucu

SEQ ID NO: 3055590 - RNA, 17 nt, Mycobacterium bovis subsp bovis AF2122/97
cggcgcaguggugucgg

SEQ ID NO: 3055591 - RNA, 18 nt, Mycobacterium bovis subsp bovis AF2122/97
cggcgcaguucgucgugg

SEQ ID NO: 3055592 - RNA, 19 nt, Mycobacterium bovis subsp bovis AF2122/97
cggcgcaguuggcaccagc

SEQ ID NO: 3055593 - RNA, 20 nt, Mycobacterium bovis subsp bovis AF2122/97
cggcgcaguuggcaccagcc

SEQ ID NO: 3055594 - RNA, 23 nt, Mycobacterium bovis subsp bovis AF2122/97
cggcgcaguuggcaccagccggu

SEQ ID NO: 3055595 - RNA, 11 nt, Mycobacterium bovis subsp bovis AF2122/97
cggcgccgcca

SEQ ID NO: 3055596 - RNA, 21 nt, Mycobacterium bovis subsp bovis AF2122/97
cggcgccgccaagggccccuc

SEQ ID NO: 3055597 - RNA, 13 nt, Mycobacterium bovis subsp bovis AF2122/97
cggcgccgccacg

SEQ ID NO: 3055598 - RNA, 16 nt, Mycobacterium bovis subsp bovis AF2122/97
cggcgccgccacggau

SEQ ID NO: 3055599 - RNA, 13 nt, Mycobacterium bovis subsp bovis AF2122/97
cggcgccgccacu

SEQ ID NO: 3055600 - RNA, 16 nt, Mycobacterium bovis subsp bovis AF2122/97
cggcgccgccacugcc

SEQ ID NO: 3055601 - RNA, 23 nt, Mycobacterium bovis subsp bovis AF2122/97
cggcgccgccacugccggcagcg

SEQ ID NO: 3055602 - RNA, 17 nt, Mycobacterium bovis subsp bovis AF2122/97
cggcgccgccagcacca

SEQ ID NO: 3055603 - RNA, 20 nt, Mycobacterium bovis subsp bovis AF2122/97
cggcgccgccagcaccaccg

SEQ ID NO: 3055604 - RNA, 22 nt, Mycobacterium bovis subsp bovis AF2122/97
cggcgccgccagcaccaccggc

SEQ ID NO: 3055605 - RNA, 13 nt, Mycobacterium bovis subsp bovis AF2122/97
cggcgccgccauc

SEQ ID NO: 3055606 - RNA, 13 nt, Mycobacterium bovis subsp bovis AF2122/97
cggcgccgccauu

SEQ ID NO: 3055607 - RNA, 14 nt, Mycobacterium bovis subsp bovis AF2122/97
cggcgccgccauug

SEQ ID NO: 3055608 - RNA, 22 nt, Mycobacterium bovis subsp bovis AF2122/97
cggcgccgcccaacgcgagcuu

SEQ ID NO: 3055609 - RNA, 14 nt, Mycobacterium bovis subsp bovis AF2122/97
cggcgccgcccaau

SEQ ID NO: 3055610 - RNA, 18 nt, Mycobacterium bovis subsp bovis AF2122/97
cggcgccgcccacggggc

SEQ ID NO: 3055611 - RNA, 14 nt, Mycobacterium bovis subsp bovis AF2122/97
cggcgccgcccagc

SEQ ID NO: 3055612 - RNA, 18 nt, Mycobacterium bovis subsp bovis AF2122/97
cggcgccgcccagcaucu

SEQ ID NO: 3055613 - RNA, 23 nt, Mycobacterium bovis subsp bovis AF2122/97
cggcgccgcccgcgccgccgcca

SEQ ID NO: 3055614 - RNA, 13 nt, Mycobacterium bovis subsp bovis AF2122/97
cggcgccgcccuu

SEQ ID NO: 3055615 - RNA, 14 nt, Mycobacterium bovis subsp bovis AF2122/97
cggcgccgcccuug

SEQ ID NO: 3055616 - RNA, 17 nt, Mycobacterium bovis subsp bovis AF2122/97
cggcgccgcccuugccg

SEQ ID NO: 3055617 - RNA, 22 nt, Mycobacterium bovis subsp bovis AF2122/97
cggcgccgcccuugccgccggc

SEQ ID NO: 3055618 - RNA, 11 nt, Mycobacterium bovis subsp bovis AF2122/97
cggcgccgccg

SEQ ID NO: 3055619 - RNA, 14 nt, Mycobacterium bovis subsp bovis AF2122/97
cggcgccgccgaug

SEQ ID NO: 3055620 - RNA, 20 nt, Mycobacterium bovis subsp bovis AF2122/97
cggcgccgccggcacccgcc

SEQ ID NO: 3055621 - RNA, 18 nt, Mycobacterium bovis subsp bovis AF2122/97
cggcgccgccggcgccgc

SEQ ID NO: 3055622 - RNA, 19 nt, Mycobacterium bovis subsp bovis AF2122/97
cggcgccgccggcgccgcc

SEQ ID NO: 3055623 - RNA, 21 nt, Mycobacterium bovis subsp bovis AF2122/97
cggcgccgccggugccaccgg

SEQ ID NO: 3055624 - RNA, 22 nt, Mycobacterium bovis subsp bovis AF2122/97
cggcgccgccggugccaccggc

SEQ ID NO: 3055625 - RNA, 15 nt, Mycobacterium bovis subsp bovis AF2122/97
cggcgccgccgucca

SEQ ID NO: 3055626 - RNA, 20 nt, Mycobacterium bovis subsp bovis AF2122/97
cggcgccgccguccagcgcc

SEQ ID NO: 3055627 - RNA, 15 nt, Mycobacterium bovis subsp bovis AF2122/97
cggcgccgccgucgc

SEQ ID NO: 3055628 - RNA, 18 nt, Mycobacterium bovis subsp bovis AF2122/97
cggcgccgccgucgccgc

SEQ ID NO: 3055629 - RNA, 20 nt, Mycobacterium bovis subsp bovis AF2122/97
cggcgccgccguuaccgccg

SEQ ID NO: 3055630 - RNA, 14 nt, Mycobacterium bovis subsp bovis AF2122/97
cggcgccgccguuc

SEQ ID NO: 3055631 - RNA, 22 nt, Mycobacterium bovis subsp bovis AF2122/97
cggcgccgccguucccgccggc

SEQ ID NO: 3055632 - RNA, 22 nt, Mycobacterium bovis subsp bovis AF2122/97
cggcgccgccuggacgccgccg

SEQ ID NO: 3055633 - RNA, 15 nt, Mycobacterium bovis subsp bovis AF2122/97
cggcgccgcgcggcu

SEQ ID NO: 3055634 - RNA, 12 nt, Mycobacterium bovis subsp bovis AF2122/97
cggcgccgcggg

SEQ ID NO: 3055635 - RNA, 15 nt, Mycobacterium bovis subsp bovis AF2122/97
cggcgccgcgggugc

SEQ ID NO: 3055636 - RNA, 19 nt, Mycobacterium bovis subsp bovis AF2122/97
cggcgccgcgggugcggca

SEQ ID NO: 3055637 - RNA, 18 nt, Mycobacterium bovis subsp bovis AF2122/97
cggcgccggaggcggcgc

SEQ ID NO: 3055638 - RNA, 10 nt, Mycobacterium bovis subsp bovis AF2122/97
cggcgccggc

SEQ ID NO: 3055639 - RNA, 13 nt, Mycobacterium bovis subsp bovis AF2122/97
cggcgccggcauc

SEQ ID NO: 3055640 - RNA, 13 nt, Mycobacterium bovis subsp bovis AF2122/97
cggcgccggccuc

SEQ ID NO: 3055641 - RNA, 14 nt, Mycobacterium bovis subsp bovis AF2122/97
cggcgccggcgcug

SEQ ID NO: 3055642 - RNA, 18 nt, Mycobacterium bovis subsp bovis AF2122/97
cggcgccggcgcugcugc

SEQ ID NO: 3055643 - RNA, 17 nt, Mycobacterium bovis subsp bovis AF2122/97
cggcgccggcggccgcg

SEQ ID NO: 3055644 - RNA, 14 nt, Mycobacterium bovis subsp bovis AF2122/97
cggcgccggcgucg

SEQ ID NO: 3055645 - RNA, 13 nt, Mycobacterium bovis subsp bovis AF2122/97
cggcgccggcuug

SEQ ID NO: 3055646 - RNA, 22 nt, Mycobacterium bovis subsp bovis AF2122/97
cggcgccggggggcugcugcuc

SEQ ID NO: 3055647 - RNA, 18 nt, Mycobacterium bovis subsp bovis AF2122/97
cggcgccgggucgauggg

SEQ ID NO: 3055648 - RNA, 16 nt, Mycobacterium bovis subsp bovis AF2122/97
cggcgccggugccgcc

SEQ ID NO: 3055649 - RNA, 13 nt, Mycobacterium bovis subsp bovis AF2122/97
cggcgccgguggu

SEQ ID NO: 3055650 - RNA, 16 nt, Mycobacterium bovis subsp bovis AF2122/97
cggcgccggugguaac

SEQ ID NO: 3055651 - RNA, 22 nt, Mycobacterium bovis subsp bovis AF2122/97
cggcgccggugguaacggcggc

SEQ ID NO: 3055652 - RNA, 23 nt, Mycobacterium bovis subsp bovis AF2122/97
cggcgccggugguaccggcggcg

SEQ ID NO: 3055653 - RNA, 20 nt, Mycobacterium bovis subsp bovis AF2122/97
cggcgccgguuucgaggcga

SEQ ID NO: 3055654 - RNA, 18 nt, Mycobacterium bovis subsp bovis AF2122/97
cggcgccguagugcgcau

SEQ ID NO: 3055655 - RNA, 12 nt, Mycobacterium bovis subsp bovis AF2122/97
cggcgccgucga

SEQ ID NO: 3055656 - RNA, 22 nt, Mycobacterium bovis subsp bovis AF2122/97
cggcgccgucgaaauacccggu

SEQ ID NO: 3055657 - RNA, 21 nt, Mycobacterium bovis subsp bovis AF2122/97
cggcgccgucgcccagcguga

SEQ ID NO: 3055658 - RNA, 18 nt, Mycobacterium bovis subsp bovis AF2122/97
cggcgccgucggagccgg

SEQ ID NO: 3055659 - RNA, 19 nt, Mycobacterium bovis subsp bovis AF2122/97
cggcgccgucggagccggc

SEQ ID NO: 3055660 - RNA, 23 nt, Mycobacterium bovis subsp bovis AF2122/97
cggcgccgucggagccggccacc

SEQ ID NO: 3055661 - RNA, 12 nt, Mycobacterium bovis subsp bovis AF2122/97
cggcgccgucgu

SEQ ID NO: 3055662 - RNA, 14 nt, Mycobacterium bovis subsp bovis AF2122/97
cggcgccgucguug

SEQ ID NO: 3055663 - RNA, 22 nt, Mycobacterium bovis subsp bovis AF2122/97
cggcgccgucguugugccgguc

SEQ ID NO: 3055664 - RNA, 14 nt, Mycobacterium bovis subsp bovis AF2122/97
cggcgccgucucga

SEQ ID NO: 3055665 - RNA, 14 nt, Mycobacterium bovis subsp bovis AF2122/97
cggcgccgugauca

SEQ ID NO: 3055666 - RNA, 16 nt, Mycobacterium bovis subsp bovis AF2122/97
cggcgccgugucaccg

SEQ ID NO: 3055667 - RNA, 18 nt, Mycobacterium bovis subsp bovis AF2122/97
cggcgccguugccaccgu

SEQ ID NO: 3055668 - RNA, 18 nt, Mycobacterium bovis subsp bovis AF2122/97
cggcgccuaaagacucga

SEQ ID NO: 3055669 - RNA, 20 nt, Mycobacterium bovis subsp bovis AF2122/97
cggcgccuaaagacucgacc

SEQ ID NO: 3055670 - RNA, 16 nt, Mycobacterium bovis subsp bovis AF2122/97
cggcgccuacaccggc

SEQ ID NO: 3055671 - RNA, 17 nt, Mycobacterium bovis subsp bovis AF2122/97
cggcgccucaucggaca

SEQ ID NO: 3055672 - RNA, 15 nt, Mycobacterium bovis subsp bovis AF2122/97
cggcgccuccgcucg

SEQ ID NO: 3055673 - RNA, 16 nt, Mycobacterium bovis subsp bovis AF2122/97
cggcgccuccgcucgg

SEQ ID NO: 3055674 - RNA, 13 nt, Mycobacterium bovis subsp bovis AF2122/97
cggcgccuccggc

SEQ ID NO: 3055675 - RNA, 16 nt, Mycobacterium bovis subsp bovis AF2122/97
cggcgccuccggcacc

SEQ ID NO: 3055676 - RNA, 19 nt, Mycobacterium bovis subsp bovis AF2122/97
cggcgccuccggcaccucc

SEQ ID NO: 3055677 - RNA, 22 nt, Mycobacterium bovis subsp bovis AF2122/97
cggcgccuccggcaccuccagc

SEQ ID NO: 3055678 - RNA, 14 nt, Mycobacterium bovis subsp bovis AF2122/97
cggcgccucggacc

SEQ ID NO: 3055679 - RNA, 18 nt, Mycobacterium bovis subsp bovis AF2122/97
cggcgccucggaccagac

SEQ ID NO: 3055680 - RNA, 20 nt, Mycobacterium bovis subsp bovis AF2122/97
cggcgccucggaccagaccc

SEQ ID NO: 3055681 - RNA, 20 nt, Mycobacterium bovis subsp bovis AF2122/97
cggcgccugacucaucaccg

SEQ ID NO: 3055682 - RNA, 13 nt, Mycobacterium bovis subsp bovis AF2122/97
cggcgcugaucgc

SEQ ID NO: 3055683 - RNA, 18 nt, Mycobacterium bovis subsp bovis AF2122/97
cggcgcugaucgcgaagc

SEQ ID NO: 3055684 - RNA, 20 nt, Mycobacterium bovis subsp bovis AF2122/97
cggcgcugaucgcgcgcacc

SEQ ID NO: 3055685 - RNA, 21 nt, Mycobacterium bovis subsp bovis AF2122/97
cggcgcugaucgcgcgcaccg

SEQ ID NO: 3055686 - RNA, 14 nt, Mycobacterium bovis subsp bovis AF2122/97
cggcgcugccaggc

SEQ ID NO: 3055687 - RNA, 21 nt, Mycobacterium bovis subsp bovis AF2122/97
cggcgcugcccacgccggggc

SEQ ID NO: 3055688 - RNA, 19 nt, Mycobacterium bovis subsp bovis AF2122/97
cggcgcugcccgggcugcc

SEQ ID NO: 3055689 - RNA, 20 nt, Mycobacterium bovis subsp bovis AF2122/97
cggcgcugcccgggcugccg

SEQ ID NO: 3055690 - RNA, 21 nt, Mycobacterium bovis subsp bovis AF2122/97
cggcgcugcccgggcugccgc

SEQ ID NO: 3055691 - RNA, 22 nt, Mycobacterium bovis subsp bovis AF2122/97
cggcgcugcccgggcugccgcc

SEQ ID NO: 3055692 - RNA, 19 nt, Mycobacterium bovis subsp bovis AF2122/97
cggcgcugcgcgcgaucca

SEQ ID NO: 3055693 - RNA, 18 nt, Mycobacterium bovis subsp bovis AF2122/97
cggcgcugcggcgugccg

SEQ ID NO: 3055694 - RNA, 13 nt, Mycobacterium bovis subsp bovis AF2122/97
cggcgcugcugcc

SEQ ID NO: 3055695 - RNA, 21 nt, Mycobacterium bovis subsp bovis AF2122/97
cggcgcugcugccauugccga

SEQ ID NO: 3055696 - RNA, 23 nt, Mycobacterium bovis subsp bovis AF2122/97
cggcgcuggcaggcuuagcuucc

SEQ ID NO: 3055697 - RNA, 15 nt, Mycobacterium bovis subsp bovis AF2122/97
cggcgcuggccagca

SEQ ID NO: 3055698 - RNA, 22 nt, Mycobacterium bovis subsp bovis AF2122/97
cggcgcuggccgucgaagacga

SEQ ID NO: 3055699 - RNA, 12 nt, Mycobacterium bovis subsp bovis AF2122/97
cggcgcuggcgg

SEQ ID NO: 3055700 - RNA, 15 nt, Mycobacterium bovis subsp bovis AF2122/97
cggcgcuggcgggca

SEQ ID NO: 3055701 - RNA, 17 nt, Mycobacterium bovis subsp bovis AF2122/97
cggcgcuggcgggcagc

SEQ ID NO: 3055702 - RNA, 15 nt, Mycobacterium bovis subsp bovis AF2122/97
cggcgcuggcugcgg

SEQ ID NO: 3055703 - RNA, 18 nt, Mycobacterium bovis subsp bovis AF2122/97
cggcgcugggacggucgc

SEQ ID NO: 3055704 - RNA, 18 nt, Mycobacterium bovis subsp bovis AF2122/97
cggcgcuggugcgccacg

SEQ ID NO: 3055705 - RNA, 14 nt, Mycobacterium bovis subsp bovis AF2122/97
cggcggaaacaacc

SEQ ID NO: 3055706 - RNA, 17 nt, Mycobacterium bovis subsp bovis AF2122/97
cggcggaaauggcgucg

SEQ ID NO: 3055707 - RNA, 23 nt, Mycobacterium bovis subsp bovis AF2122/97
cggcggaaauggcgucgccggca

SEQ ID NO: 3055708 - RNA, 16 nt, Mycobacterium bovis subsp bovis AF2122/97
cggcggaagcggcggc

SEQ ID NO: 3055709 - RNA, 18 nt, Mycobacterium bovis subsp bovis AF2122/97
cggcggaaggacggcagc

SEQ ID NO: 3055710 - RNA, 19 nt, Mycobacterium bovis subsp bovis AF2122/97
cggcggaaggacggcagcc

SEQ ID NO: 3055711 - RNA, 15 nt, Mycobacterium bovis subsp bovis AF2122/97
cggcggaaggcgucg

SEQ ID NO: 3055712 - RNA, 16 nt, Mycobacterium bovis subsp bovis AF2122/97
cggcggaaggcgucga

SEQ ID NO: 3055713 - RNA, 18 nt, Mycobacterium bovis subsp bovis AF2122/97
cggcggaaggcgucgaac

SEQ ID NO: 3055714 - RNA, 19 nt, Mycobacterium bovis subsp bovis AF2122/97
cggcggacaccucgggcgc

SEQ ID NO: 3055715 - RNA, 22 nt, Mycobacterium bovis subsp bovis AF2122/97
cggcggacaccucgggcgcccg

SEQ ID NO: 3055716 - RNA, 20 nt, Mycobacterium bovis subsp bovis AF2122/97
cggcggacaugcaccucgag

SEQ ID NO: 3055717 - RNA, 17 nt, Mycobacterium bovis subsp bovis AF2122/97
cggcggaccccucgacc

SEQ ID NO: 3055718 - RNA, 13 nt, Mycobacterium bovis subsp bovis AF2122/97
cggcggacccgcu

SEQ ID NO: 3055719 - RNA, 18 nt, Mycobacterium bovis subsp bovis AF2122/97
cggcggacccgcucgcgg

SEQ ID NO: 3055720 - RNA, 13 nt, Mycobacterium bovis subsp bovis AF2122/97
cggcggacccggu

SEQ ID NO: 3055721 - RNA, 14 nt, Mycobacterium bovis subsp bovis AF2122/97
cggcggaccgcagc

SEQ ID NO: 3055722 - RNA, 15 nt, Mycobacterium bovis subsp bovis AF2122/97
cggcggaccgcagcg

SEQ ID NO: 3055723 - RNA, 18 nt, Mycobacterium bovis subsp bovis AF2122/97
cggcggaccguccgacgg

SEQ ID NO: 3055724 - RNA, 21 nt, Mycobacterium bovis subsp bovis AF2122/97
cggcggaccguccgacggcgg

SEQ ID NO: 3055725 - RNA, 13 nt, Mycobacterium bovis subsp bovis AF2122/97
cggcggacgacgu

SEQ ID NO: 3055726 - RNA, 16 nt, Mycobacterium bovis subsp bovis AF2122/97
cggcggacgacgucgg

SEQ ID NO: 3055727 - RNA, 18 nt, Mycobacterium bovis subsp bovis AF2122/97
cggcggacgcccggcgca

SEQ ID NO: 3055728 - RNA, 19 nt, Mycobacterium bovis subsp bovis AF2122/97
cggcggacugagagauggu

SEQ ID NO: 3055729 - RNA, 18 nt, Mycobacterium bovis subsp bovis AF2122/97
cggcggagaaggcgacca

SEQ ID NO: 3055730 - RNA, 19 nt, Mycobacterium bovis subsp bovis AF2122/97
cggcggagccgggugaggc

SEQ ID NO: 3055731 - RNA, 12 nt, Mycobacterium bovis subsp bovis AF2122/97
cggcggagcggg

SEQ ID NO: 3055732 - RNA, 13 nt, Mycobacterium bovis subsp bovis AF2122/97
cggcggagcgggc

SEQ ID NO: 3055733 - RNA, 15 nt, Mycobacterium bovis subsp bovis AF2122/97
cggcggagcgggcca

SEQ ID NO: 3055734 - RNA, 14 nt, Mycobacterium bovis subsp bovis AF2122/97
cggcggaggcuucg

SEQ ID NO: 3055735 - RNA, 14 nt, Mycobacterium bovis subsp bovis AF2122/97
cggcggagucgacg

SEQ ID NO: 3055736 - RNA, 15 nt, Mycobacterium bovis subsp bovis AF2122/97
cggcggagucgacgg

SEQ ID NO: 3055737 - RNA, 16 nt, Mycobacterium bovis subsp bovis AF2122/97
cggcggagucgacggu

SEQ ID NO: 3055738 - RNA, 15 nt, Mycobacterium bovis subsp bovis AF2122/97
cggcggagucgcgca

SEQ ID NO: 3055739 - RNA, 21 nt, Mycobacterium bovis subsp bovis AF2122/97
cggcggagucgcgcagggcga

SEQ ID NO: 3055740 - RNA, 23 nt, Mycobacterium bovis subsp bovis AF2122/97
cggcggagucgcgcagggcgaca

SEQ ID NO: 3055741 - RNA, 12 nt, Mycobacterium bovis subsp bovis AF2122/97
cggcggagugca

SEQ ID NO: 3055742 - RNA, 18 nt, Mycobacterium bovis subsp bovis AF2122/97
cggcggauagucgcgggc

SEQ ID NO: 3055743 - RNA, 17 nt, Mycobacterium bovis subsp bovis AF2122/97
cggcggaucccgaggcg

SEQ ID NO: 3055744 - RNA, 19 nt, Mycobacterium bovis subsp bovis AF2122/97
cggcggaucccgaggcgcc

SEQ ID NO: 3055745 - RNA, 22 nt, Mycobacterium bovis subsp bovis AF2122/97
cggcggaucccgaggcgcccaa

SEQ ID NO: 3055746 - RNA, 23 nt, Mycobacterium bovis subsp bovis AF2122/97
cggcggaucccgaggcgcccaac

SEQ ID NO: 3055747 - RNA, 15 nt, Mycobacterium bovis subsp bovis AF2122/97
cggcggaucggcggc

SEQ ID NO: 3055748 - RNA, 16 nt, Mycobacterium bovis subsp bovis AF2122/97
cggcggaucggcggcc

SEQ ID NO: 3055749 - RNA, 13 nt, Mycobacterium bovis subsp bovis AF2122/97
cggcggauggcgu

SEQ ID NO: 3055750 - RNA, 19 nt, Mycobacterium bovis subsp bovis AF2122/97
cggcggauggcgucgacca

SEQ ID NO: 3055751 - RNA, 20 nt, Mycobacterium bovis subsp bovis AF2122/97
cggcggauggcgucgaccac

SEQ ID NO: 3055752 - RNA, 18 nt, Mycobacterium bovis subsp bovis AF2122/97
cggcggauuccggcaucg

SEQ ID NO: 3055753 - RNA, 16 nt, Mycobacterium bovis subsp bovis AF2122/97
cggcggauucgcgcug

SEQ ID NO: 3055754 - RNA, 19 nt, Mycobacterium bovis subsp bovis AF2122/97
cggcggauucgcgcugguc

SEQ ID NO: 3055755 - RNA, 20 nt, Mycobacterium bovis subsp bovis AF2122/97
cggcggauucgcgcugguca

SEQ ID NO: 3055756 - RNA, 21 nt, Mycobacterium bovis subsp bovis AF2122/97
cggcggauucggcgcugcggc

SEQ ID NO: 3055757 - RNA, 22 nt, Mycobacterium bovis subsp bovis AF2122/97
cggcggauucggcgcugcggcg

SEQ ID NO: 3055758 - RNA, 21 nt, Mycobacterium bovis subsp bovis AF2122/97
cggcggauucgguaucagggg

SEQ ID NO: 3055759 - RNA, 19 nt, Mycobacterium bovis subsp bovis AF2122/97
cggcggcaaccccgagcgg

SEQ ID NO: 3055760 - RNA, 22 nt, Mycobacterium bovis subsp bovis AF2122/97
cggcggcaaccccgagcggagc

SEQ ID NO: 3055761 - RNA, 23 nt, Mycobacterium bovis subsp bovis AF2122/97
cggcggcaacccugcccggcccg

SEQ ID NO: 3055762 - RNA, 13 nt, Mycobacterium bovis subsp bovis AF2122/97
cggcggcaaccgc

SEQ ID NO: 3055763 - RNA, 15 nt, Mycobacterium bovis subsp bovis AF2122/97
cggcggcaaccgccg

SEQ ID NO: 3055764 - RNA, 20 nt, Mycobacterium bovis subsp bovis AF2122/97
cggcggcaaccgccgccacc

SEQ ID NO: 3055765 - RNA, 22 nt, Mycobacterium bovis subsp bovis AF2122/97
cggcggcaaccgccgccaccag

SEQ ID NO: 3055766 - RNA, 19 nt, Mycobacterium bovis subsp bovis AF2122/97
cggcggcaacggcggcauc

SEQ ID NO: 3055767 - RNA, 18 nt, Mycobacterium bovis subsp bovis AF2122/97
cggcggcaacggcggcga

SEQ ID NO: 3055768 - RNA, 15 nt, Mycobacterium bovis subsp bovis AF2122/97
cggcggccucggucu

SEQ ID NO: 3055769 - RNA, 18 nt, Mycobacterium bovis subsp bovis AF2122/97
cggcggccuggcacccgg

SEQ ID NO: 3055770 - RNA, 18 nt, Mycobacterium bovis subsp bovis AF2122/97
cggcggccugggccagcc

SEQ ID NO: 3055771 - RNA, 19 nt, Mycobacterium bovis subsp bovis AF2122/97
cggcggccugggccagccg

SEQ ID NO: 3055772 - RNA, 20 nt, Mycobacterium bovis subsp bovis AF2122/97
cggcggccugggccagccgc

SEQ ID NO: 3055773 - RNA, 22 nt, Mycobacterium bovis subsp bovis AF2122/97
cggcggccuucggccggcgugu

SEQ ID NO: 3055774 - RNA, 21 nt, Mycobacterium bovis subsp bovis AF2122/97
cggcggcgaacucggcgauga

SEQ ID NO: 3055775 - RNA, 21 nt, Mycobacterium bovis subsp bovis AF2122/97
cggcggcgaagaagccggcaa

SEQ ID NO: 3055776 - RNA, 13 nt, Mycobacterium bovis subsp bovis AF2122/97
cggcggcgaccag

SEQ ID NO: 3055777 - RNA, 14 nt, Mycobacterium bovis subsp bovis AF2122/97
cggcggcgaccaga

SEQ ID NO: 3055778 - RNA, 23 nt, Mycobacterium bovis subsp bovis AF2122/97
cggcggcgaccgccagcguggag

SEQ ID NO: 3055779 - RNA, 17 nt, Mycobacterium bovis subsp bovis AF2122/97
cggcggcgacgagcgca

SEQ ID NO: 3055780 - RNA, 19 nt, Mycobacterium bovis subsp bovis AF2122/97
cggcggcgacgagcgcagc

SEQ ID NO: 3055781 - RNA, 20 nt, Mycobacterium bovis subsp bovis AF2122/97
cggcggcgacgagcgcagcg

SEQ ID NO: 3055782 - RNA, 15 nt, Mycobacterium bovis subsp bovis AF2122/97
cggcggcgacggcgg

SEQ ID NO: 3055783 - RNA, 17 nt, Mycobacterium bovis subsp bovis AF2122/97
cggcggcgacggcggca

SEQ ID NO: 3055784 - RNA, 13 nt, Mycobacterium bovis subsp bovis AF2122/97
cggcggcgacggu

SEQ ID NO: 3055785 - RNA, 18 nt, Mycobacterium bovis subsp bovis AF2122/97
cggcggcgacguggcgcc

SEQ ID NO: 3055786 - RNA, 19 nt, Mycobacterium bovis subsp bovis AF2122/97
cggcggcgacguggcgccg

SEQ ID NO: 3055787 - RNA, 14 nt, Mycobacterium bovis subsp bovis AF2122/97
cggcggcgacgugu

SEQ ID NO: 3055788 - RNA, 21 nt, Mycobacterium bovis subsp bovis AF2122/97
cggcggcgaggcgagucaccg

SEQ ID NO: 3055789 - RNA, 18 nt, Mycobacterium bovis subsp bovis AF2122/97
cggcggcgaugucaacca

SEQ ID NO: 3055790 - RNA, 14 nt, Mycobacterium bovis subsp bovis AF2122/97
cggcggcgcaggua

SEQ ID NO: 3055791 - RNA, 13 nt, Mycobacterium bovis subsp bovis AF2122/97
cggcggcgcccgg

SEQ ID NO: 3055792 - RNA, 13 nt, Mycobacterium bovis subsp bovis AF2122/97
cggcggcgccgcc

SEQ ID NO: 3055793 - RNA, 14 nt, Mycobacterium bovis subsp bovis AF2122/97
cggcggcgccgccc

SEQ ID NO: 3055794 - RNA, 15 nt, Mycobacterium bovis subsp bovis AF2122/97
cggcggcgccgccca

SEQ ID NO: 3055795 - RNA, 21 nt, Mycobacterium bovis subsp bovis AF2122/97
cggcggcgccgcccaacgcga

SEQ ID NO: 3055796 - RNA, 12 nt, Mycobacterium bovis subsp bovis AF2122/97
cggcggcgccgg

SEQ ID NO: 3055797 - RNA, 15 nt, Mycobacterium bovis subsp bovis AF2122/97
cggcggcgccggccu

SEQ ID NO: 3055798 - RNA, 14 nt, Mycobacterium bovis subsp bovis AF2122/97
cggcggcgccggcg

SEQ ID NO: 3055799 - RNA, 13 nt, Mycobacterium bovis subsp bovis AF2122/97
cggcggcgccggu

SEQ ID NO: 3055800 - RNA, 16 nt, Mycobacterium bovis subsp bovis AF2122/97
cggcggcgccgguggu

SEQ ID NO: 3055801 - RNA, 15 nt, Mycobacterium bovis subsp bovis AF2122/97
cggcggcgcgaucga

SEQ ID NO: 3055802 - RNA, 12 nt, Mycobacterium bovis subsp bovis AF2122/97
cggcggcgcgcc

SEQ ID NO: 3055803 - RNA, 14 nt, Mycobacterium bovis subsp bovis AF2122/97
cggcggcgcgccga

SEQ ID NO: 3055804 - RNA, 15 nt, Mycobacterium bovis subsp bovis AF2122/97
cggcggcgcucgucg

SEQ ID NO: 3055805 - RNA, 16 nt, Mycobacterium bovis subsp bovis AF2122/97
cggcggcgcucgucga

SEQ ID NO: 3055806 - RNA, 17 nt, Mycobacterium bovis subsp bovis AF2122/97
cggcggcgcuggcgggc

SEQ ID NO: 3055807 - RNA, 12 nt, Mycobacterium bovis subsp bovis AF2122/97
cggcggcggagg

SEQ ID NO: 3055808 - RNA, 10 nt, Mycobacterium bovis subsp bovis AF2122/97
cggcggcggc

SEQ ID NO: 3055809 - RNA, 14 nt, Mycobacterium bovis subsp bovis AF2122/97
cggcggcggcaacg

SEQ ID NO: 3055810 - RNA, 17 nt, Mycobacterium bovis subsp bovis AF2122/97
cggcggcggcaacggcg

SEQ ID NO: 3055811 - RNA, 13 nt, Mycobacterium bovis subsp bovis AF2122/97
cggcggcggcacg

SEQ ID NO: 3055812 - RNA, 15 nt, Mycobacterium bovis subsp bovis AF2122/97
cggcggcggcacgcu

SEQ ID NO: 3055813 - RNA, 13 nt, Mycobacterium bovis subsp bovis AF2122/97
cggcggcggccag

SEQ ID NO: 3055814 - RNA, 14 nt, Mycobacterium bovis subsp bovis AF2122/97
cggcggcggcccgu

SEQ ID NO: 3055815 - RNA, 12 nt, Mycobacterium bovis subsp bovis AF2122/97
cggcggcggccg

SEQ ID NO: 3055816 - RNA, 14 nt, Mycobacterium bovis subsp bovis AF2122/97
cggcggcggccgca

SEQ ID NO: 3055817 - RNA, 14 nt, Mycobacterium bovis subsp bovis AF2122/97
cggcggcggcggca

SEQ ID NO: 3055818 - RNA, 17 nt, Mycobacterium bovis subsp bovis AF2122/97
cggcggcgguaucggca

SEQ ID NO: 3055819 - RNA, 20 nt, Mycobacterium bovis subsp bovis AF2122/97
cggcggcggucaccaccgac

SEQ ID NO: 3055820 - RNA, 16 nt, Mycobacterium bovis subsp bovis AF2122/97
cggcggcggugcgccc

SEQ ID NO: 3055821 - RNA, 16 nt, Mycobacterium bovis subsp bovis AF2122/97
cggcggcgguggcgaa

SEQ ID NO: 3055822 - RNA, 20 nt, Mycobacterium bovis subsp bovis AF2122/97
cggcggcggugguaccggcg

SEQ ID NO: 3055823 - RNA, 21 nt, Mycobacterium bovis subsp bovis AF2122/97
cggcggcggugguaccggcgc

SEQ ID NO: 3055824 - RNA, 22 nt, Mycobacterium bovis subsp bovis AF2122/97
cggcggcguccaucgcgcgccg

SEQ ID NO: 3055825 - RNA, 15 nt, Mycobacterium bovis subsp bovis AF2122/97
cggcggcguccgggu

SEQ ID NO: 3055826 - RNA, 13 nt, Mycobacterium bovis subsp bovis AF2122/97
cggcggcgucgac

SEQ ID NO: 3055827 - RNA, 15 nt, Mycobacterium bovis subsp bovis AF2122/97
cggcggcgucgacgg

SEQ ID NO: 3055828 - RNA, 12 nt, Mycobacterium bovis subsp bovis AF2122/97
cggcggcgucgg

SEQ ID NO: 3055829 - RNA, 14 nt, Mycobacterium bovis subsp bovis AF2122/97
cggcggcgucggga

SEQ ID NO: 3055830 - RNA, 13 nt, Mycobacterium bovis subsp bovis AF2122/97
cggcggcuaccga

SEQ ID NO: 3055831 - RNA, 15 nt, Mycobacterium bovis subsp bovis AF2122/97
cggcggcuaggcacc

SEQ ID NO: 3055832 - RNA, 19 nt, Mycobacterium bovis subsp bovis AF2122/97
cggcggcuaggcaccagcg

SEQ ID NO: 3055833 - RNA, 14 nt, Mycobacterium bovis subsp bovis AF2122/97
cggcggcucccggg

SEQ ID NO: 3055834 - RNA, 16 nt, Mycobacterium bovis subsp bovis AF2122/97
cggcggcucccggggg

SEQ ID NO: 3055835 - RNA, 17 nt, Mycobacterium bovis subsp bovis AF2122/97
cggcggcucccgggggu

SEQ ID NO: 3055836 - RNA, 14 nt, Mycobacterium bovis subsp bovis AF2122/97
cggcggcucgggug

SEQ ID NO: 3055837 - RNA, 16 nt, Mycobacterium bovis subsp bovis AF2122/97
cggcggcucgggugcg

SEQ ID NO: 3055838 - RNA, 13 nt, Mycobacterium bovis subsp bovis AF2122/97
cggcggcugccgg

SEQ ID NO: 3055839 - RNA, 16 nt, Mycobacterium bovis subsp bovis AF2122/97
cggcggcugucggccg

SEQ ID NO: 3055840 - RNA, 20 nt, Mycobacterium bovis subsp bovis AF2122/97
cggcggcuguggucgcugcu

SEQ ID NO: 3055841 - RNA, 19 nt, Mycobacterium bovis subsp bovis AF2122/97
cggcggcuguugcggcggc

SEQ ID NO: 3055842 - RNA, 20 nt, Mycobacterium bovis subsp bovis AF2122/97
cggcggcuguugcggcggcg

SEQ ID NO: 3055843 - RNA, 15 nt, Mycobacterium bovis subsp bovis AF2122/97
cggcggcuucgccga

SEQ ID NO: 3055844 - RNA, 20 nt, Mycobacterium bovis subsp bovis AF2122/97
cggcggcuucguggcggcgc

SEQ ID NO: 3055845 - RNA, 21 nt, Mycobacterium bovis subsp bovis AF2122/97
cggcggcuucguggcggcgcg

SEQ ID NO: 3055846 - RNA, 16 nt, Mycobacterium bovis subsp bovis AF2122/97
cggcggcuuggccgcc

SEQ ID NO: 3055847 - RNA, 18 nt, Mycobacterium bovis subsp bovis AF2122/97
cggcggcuuggccgcccc

SEQ ID NO: 3055848 - RNA, 17 nt, Mycobacterium bovis subsp bovis AF2122/97
cggcggcuuuggccgcc

SEQ ID NO: 3055849 - RNA, 24 nt, Mycobacterium bovis subsp bovis AF2122/97
cggcgggaaacacguucucaccac

SEQ ID NO: 3055850 - RNA, 22 nt, Mycobacterium bovis subsp bovis AF2122/97
cggcgggaacccuugccacgaa

SEQ ID NO: 3055851 - RNA, 21 nt, Mycobacterium bovis subsp bovis AF2122/97
cggcgggaacggugccgaucg

SEQ ID NO: 3055852 - RNA, 14 nt, Mycobacterium bovis subsp bovis AF2122/97
cggcgggauccucg

SEQ ID NO: 3055853 - RNA, 15 nt, Mycobacterium bovis subsp bovis AF2122/97
cggcgggauccucga

SEQ ID NO: 3055854 - RNA, 22 nt, Mycobacterium bovis subsp bovis AF2122/97
cggcgggaugcagcugcccggc

SEQ ID NO: 3055855 - RNA, 19 nt, Mycobacterium bovis subsp bovis AF2122/97
cggcggugaaaucgcacag

SEQ ID NO: 3055856 - RNA, 20 nt, Mycobacterium bovis subsp bovis AF2122/97
cggcggugaaaucgcacagc

SEQ ID NO: 3055857 - RNA, 20 nt, Mycobacterium bovis subsp bovis AF2122/97
cggcggugaagugggcguug

SEQ ID NO: 3055858 - RNA, 15 nt, Mycobacterium bovis subsp bovis AF2122/97
cggcggugacggcgg

SEQ ID NO: 3055859 - RNA, 17 nt, Mycobacterium bovis subsp bovis AF2122/97
cggcggugacggcggca

SEQ ID NO: 3055860 - RNA, 19 nt, Mycobacterium bovis subsp bovis AF2122/97
cggcggugauguggaugcc

SEQ ID NO: 3055861 - RNA, 14 nt, Mycobacterium bovis subsp bovis AF2122/97
cggcggugcagcag

SEQ ID NO: 3055862 - RNA, 19 nt, Mycobacterium bovis subsp bovis AF2122/97
cggcggugcagcagggcgc

SEQ ID NO: 3055863 - RNA, 22 nt, Mycobacterium bovis subsp bovis AF2122/97
cggcggugcagcagggcgcgca

SEQ ID NO: 3055864 - RNA, 15 nt, Mycobacterium bovis subsp bovis AF2122/97
cggcggugcaguggc

SEQ ID NO: 3055865 - RNA, 21 nt, Mycobacterium bovis subsp bovis AF2122/97
cggcggugccacgaucggcgg

SEQ ID NO: 3055866 - RNA, 13 nt, Mycobacterium bovis subsp bovis AF2122/97
cggcggugcccag

SEQ ID NO: 3055867 - RNA, 15 nt, Mycobacterium bovis subsp bovis AF2122/97
cggcggugcccagca

SEQ ID NO: 3055868 - RNA, 17 nt, Mycobacterium bovis subsp bovis AF2122/97
cggcggugcccagcagc

SEQ ID NO: 3055869 - RNA, 21 nt, Mycobacterium bovis subsp bovis AF2122/97
cggcggugcccagcagcgcga

SEQ ID NO: 3055870 - RNA, 15 nt, Mycobacterium bovis subsp bovis AF2122/97
cggcggugccgacgg

SEQ ID NO: 3055871 - RNA, 16 nt, Mycobacterium bovis subsp bovis AF2122/97
cggcggugccgacggu

SEQ ID NO: 3055872 - RNA, 18 nt, Mycobacterium bovis subsp bovis AF2122/97
cggcggugccgacggugg

SEQ ID NO: 3055873 - RNA, 14 nt, Mycobacterium bovis subsp bovis AF2122/97
cggcggugccgcgg

SEQ ID NO: 3055874 - RNA, 16 nt, Mycobacterium bovis subsp bovis AF2122/97
cggcggugccgguggu

SEQ ID NO: 3055875 - RNA, 19 nt, Mycobacterium bovis subsp bovis AF2122/97
cggcggugccgucagcggc

SEQ ID NO: 3055876 - RNA, 18 nt, Mycobacterium bovis subsp bovis AF2122/97
cggcggugccgucgccgc

SEQ ID NO: 3055877 - RNA, 20 nt, Mycobacterium bovis subsp bovis AF2122/97
cggcggugccgucgccgccc

SEQ ID NO: 3055878 - RNA, 15 nt, Mycobacterium bovis subsp bovis AF2122/97
cggcggugccgugcu

SEQ ID NO: 3055879 - RNA, 19 nt, Mycobacterium bovis subsp bovis AF2122/97
cggcggugccgugcucacg

SEQ ID NO: 3055880 - RNA, 14 nt, Mycobacterium bovis subsp bovis AF2122/97
cggcggugcgggug

SEQ ID NO: 3055881 - RNA, 15 nt, Mycobacterium bovis subsp bovis AF2122/97
cggcggugcgggugg

SEQ ID NO: 3055882 - RNA, 22 nt, Mycobacterium bovis subsp bovis AF2122/97
cggcggugcggguggugccggc

SEQ ID NO: 3055883 - RNA, 23 nt, Mycobacterium bovis subsp bovis AF2122/97
cggcggugcggguggugccggcg

SEQ ID NO: 3055884 - RNA, 14 nt, Mycobacterium bovis subsp bovis AF2122/97
cggcgguggccagc

SEQ ID NO: 3055885 - RNA, 15 nt, Mycobacterium bovis subsp bovis AF2122/97
cggcgguggccagcg

SEQ ID NO: 3055886 - RNA, 12 nt, Mycobacterium bovis subsp bovis AF2122/97
cggcggugggcg

SEQ ID NO: 3055887 - RNA, 16 nt, Mycobacterium bovis subsp bovis AF2122/97
cggcgguggggccggc

SEQ ID NO: 3055888 - RNA, 17 nt, Mycobacterium bovis subsp bovis AF2122/97
cggcgguguugcccgac

SEQ ID NO: 3055889 - RNA, 23 nt, Mycobacterium bovis subsp bovis AF2122/97
cggcgguuaucgucgggucaccc

SEQ ID NO: 3055890 - RNA, 22 nt, Mycobacterium bovis subsp bovis AF2122/97
cggcgguuccauacagccgccg

SEQ ID NO: 3055891 - RNA, 23 nt, Mycobacterium bovis subsp bovis AF2122/97
cggcgguuccauacagccgccga

SEQ ID NO: 3055892 - RNA, 19 nt, Mycobacterium bovis subsp bovis AF2122/97
cggcgguucugcggccgcg

SEQ ID NO: 3055893 - RNA, 14 nt, Mycobacterium bovis subsp bovis AF2122/97
cggcgguuucggug

SEQ ID NO: 3055894 - RNA, 20 nt, Mycobacterium bovis subsp bovis AF2122/97
cggcgguuucggugguaacg

SEQ ID NO: 3055895 - RNA, 19 nt, Mycobacterium bovis subsp bovis AF2122/97
cggcguacaaaccgucggg

SEQ ID NO: 3055896 - RNA, 22 nt, Mycobacterium bovis subsp bovis AF2122/97
cggcguacccguuaugcgccgc

SEQ ID NO: 3055897 - RNA, 23 nt, Mycobacterium bovis subsp bovis AF2122/97
cggcguacccguuaugcgccgcc

SEQ ID NO: 3055898 - RNA, 20 nt, Mycobacterium bovis subsp bovis AF2122/97
cggcguacgccggacccggu

SEQ ID NO: 3055899 - RNA, 23 nt, Mycobacterium bovis subsp bovis AF2122/97
cggcguacgguacggaccguggc

SEQ ID NO: 3055900 - RNA, 15 nt, Mycobacterium bovis subsp bovis AF2122/97
cggcguacucggcau

SEQ ID NO: 3055901 - RNA, 21 nt, Mycobacterium bovis subsp bovis AF2122/97
cggcguacucggugaucgcgg

SEQ ID NO: 3055902 - RNA, 18 nt, Mycobacterium bovis subsp bovis AF2122/97
cggcguacucgugcaccg

SEQ ID NO: 3055903 - RNA, 22 nt, Mycobacterium bovis subsp bovis AF2122/97
cggcguacucgugcaccgucgg

SEQ ID NO: 3055904 - RNA, 18 nt, Mycobacterium bovis subsp bovis AF2122/97
cggcguacuucgacagcg

SEQ ID NO: 3055905 - RNA, 20 nt, Mycobacterium bovis subsp bovis AF2122/97
cggcguacuucgacagcggc

SEQ ID NO: 3055906 - RNA, 22 nt, Mycobacterium bovis subsp bovis AF2122/97
cggcguacuucgacagcggcga

SEQ ID NO: 3055907 - RNA, 19 nt, Mycobacterium bovis subsp bovis AF2122/97
cggcguagacguagaaugc

SEQ ID NO: 3055908 - RNA, 23 nt, Mycobacterium bovis subsp bovis AF2122/97
cggcguagacguagaaugcgccg

SEQ ID NO: 3055909 - RNA, 14 nt, Mycobacterium bovis subsp bovis AF2122/97
cggcguagacgucc

SEQ ID NO: 3055910 - RNA, 23 nt, Mycobacterium bovis subsp bovis AF2122/97
cggcguagacguccgcggucgca

SEQ ID NO: 3055911 - RNA, 23 nt, Mycobacterium bovis subsp bovis AF2122/97
cggcguagaucaucagcgacuug

SEQ ID NO: 3055912 - RNA, 22 nt, Mycobacterium bovis subsp bovis AF2122/97
cggcguagaugcgcccggcgug

SEQ ID NO: 3055913 - RNA, 16 nt, Mycobacterium bovis subsp bovis AF2122/97
cggcguaggcgauggc

SEQ ID NO: 3055914 - RNA, 15 nt, Mycobacterium bovis subsp bovis AF2122/97
cggcguagucguugu

SEQ ID NO: 3055915 - RNA, 16 nt, Mycobacterium bovis subsp bovis AF2122/97
cggcguagucguuguc

SEQ ID NO: 3055916 - RNA, 16 nt, Mycobacterium bovis subsp bovis AF2122/97
cggcguauugcaccgc

SEQ ID NO: 3055917 - RNA, 17 nt, Mycobacterium bovis subsp bovis AF2122/97
cggcguauugcggccug

SEQ ID NO: 3055918 - RNA, 19 nt, Mycobacterium bovis subsp bovis AF2122/97
cggcguauugcggccuguu

SEQ ID NO: 3055919 - RNA, 23 nt, Mycobacterium bovis subsp bovis AF2122/97
cggcgucacccgcaacgacugau

SEQ ID NO: 3055920 - RNA, 14 nt, Mycobacterium bovis subsp bovis AF2122/97
cggcgucacggugg

SEQ ID NO: 3055921 - RNA, 15 nt, Mycobacterium bovis subsp bovis AF2122/97
cggcgucagccccga

SEQ ID NO: 3055922 - RNA, 19 nt, Mycobacterium bovis subsp bovis AF2122/97
cggcgucagccccgacugc

SEQ ID NO: 3055923 - RNA, 16 nt, Mycobacterium bovis subsp bovis AF2122/97
cggcgucaggcacaac

SEQ ID NO: 3055924 - RNA, 14 nt, Mycobacterium bovis subsp bovis AF2122/97
cggcgucauccacc

SEQ ID NO: 3055925 - RNA, 19 nt, Mycobacterium bovis subsp bovis AF2122/97
cggcguccaccugcuccgc

SEQ ID NO: 3055926 - RNA, 23 nt, Mycobacterium bovis subsp bovis AF2122/97
cggcguccaccugcuccgcuguc

SEQ ID NO: 3055927 - RNA, 16 nt, Mycobacterium bovis subsp bovis AF2122/97
cggcguccagggcgcc

SEQ ID NO: 3055928 - RNA, 21 nt, Mycobacterium bovis subsp bovis AF2122/97
cggcguccagggcgccacuga

SEQ ID NO: 3055929 - RNA, 16 nt, Mycobacterium bovis subsp bovis AF2122/97
cggcguccaucaccag

SEQ ID NO: 3055930 - RNA, 23 nt, Mycobacterium bovis subsp bovis AF2122/97
cggcguccaucaccagcaguggc

SEQ ID NO: 3055931 - RNA, 17 nt, Mycobacterium bovis subsp bovis AF2122/97
cggcguccaucgcgcgc

SEQ ID NO: 3055932 - RNA, 23 nt, Mycobacterium bovis subsp bovis AF2122/97
cggcguccaucgcgcgccgaccg

SEQ ID NO: 3055933 - RNA, 24 nt, Mycobacterium bovis subsp bovis AF2122/97
cggcguccaucgcgcgccgaccga

SEQ ID NO: 3055934 - RNA, 15 nt, Mycobacterium bovis subsp bovis AF2122/97
cggcgucccagggca

SEQ ID NO: 3055935 - RNA, 13 nt, Mycobacterium bovis subsp bovis AF2122/97
cggcguccgaccg

SEQ ID NO: 3055936 - RNA, 15 nt, Mycobacterium bovis subsp bovis AF2122/97
cggcguccgaccggu

SEQ ID NO: 3055937 - RNA, 14 nt, Mycobacterium bovis subsp bovis AF2122/97
cggcguccgcccag

SEQ ID NO: 3055938 - RNA, 16 nt, Mycobacterium bovis subsp bovis AF2122/97
cggcguccgcccagca

SEQ ID NO: 3055939 - RNA, 21 nt, Mycobacterium bovis subsp bovis AF2122/97
cggcguccggguggcacacca

SEQ ID NO: 3055940 - RNA, 18 nt, Mycobacterium bovis subsp bovis AF2122/97
cggcguccuugcgcagca

SEQ ID NO: 3055941 - RNA, 18 nt, Mycobacterium bovis subsp bovis AF2122/97
cggcguggcuuguucgga

SEQ ID NO: 3055942 - RNA, 16 nt, Mycobacterium bovis subsp bovis AF2122/97
cggcgugggagguggc

SEQ ID NO: 3055943 - RNA, 18 nt, Mycobacterium bovis subsp bovis AF2122/97
cggcgugguauccgccgu

SEQ ID NO: 3055944 - RNA, 20 nt, Mycobacterium bovis subsp bovis AF2122/97
cggcgugguauccgccguuc

SEQ ID NO: 3055945 - RNA, 17 nt, Mycobacterium bovis subsp bovis AF2122/97
cggcguggucgcgcggc

SEQ ID NO: 3055946 - RNA, 18 nt, Mycobacterium bovis subsp bovis AF2122/97
cggcguggucgcgcggca

SEQ ID NO: 3055947 - RNA, 16 nt, Mycobacterium bovis subsp bovis AF2122/97
cggcguggucggcaaa

SEQ ID NO: 3055948 - RNA, 21 nt, Mycobacterium bovis subsp bovis AF2122/97
cggcguggugagccucggcga

SEQ ID NO: 3055949 - RNA, 15 nt, Mycobacterium bovis subsp bovis AF2122/97
cggcgugguguccac

SEQ ID NO: 3055950 - RNA, 18 nt, Mycobacterium bovis subsp bovis AF2122/97
cggcgugguguccaccgc

SEQ ID NO: 3055951 - RNA, 15 nt, Mycobacterium bovis subsp bovis AF2122/97
cggcguguacgucga

SEQ ID NO: 3055952 - RNA, 16 nt, Mycobacterium bovis subsp bovis AF2122/97
cggcguguacgucgau

SEQ ID NO: 3055953 - RNA, 18 nt, Mycobacterium bovis subsp bovis AF2122/97
cggcguguacgucgauca

SEQ ID NO: 3055954 - RNA, 15 nt, Mycobacterium bovis subsp bovis AF2122/97
cggcgugucacgucg

SEQ ID NO: 3055955 - RNA, 16 nt, Mycobacterium bovis subsp bovis AF2122/97
cggcgugucacgucgc

SEQ ID NO: 3055956 - RNA, 13 nt, Mycobacterium bovis subsp bovis AF2122/97
cggcguguccgcc

SEQ ID NO: 3055957 - RNA, 14 nt, Mycobacterium bovis subsp bovis AF2122/97
cggcgugucgaggg

SEQ ID NO: 3055958 - RNA, 15 nt, Mycobacterium bovis subsp bovis AF2122/97
cggcgugucgccgcc

SEQ ID NO: 3055959 - RNA, 16 nt, Mycobacterium bovis subsp bovis AF2122/97
cggcgugucgccgcca

SEQ ID NO: 3055960 - RNA, 13 nt, Mycobacterium bovis subsp bovis AF2122/97
cggcgugucgggg

SEQ ID NO: 3055961 - RNA, 16 nt, Mycobacterium bovis subsp bovis AF2122/97
cggcgugucgggggcu

SEQ ID NO: 3055962 - RNA, 19 nt, Mycobacterium bovis subsp bovis AF2122/97
cggcgugucguugccaggg

SEQ ID NO: 3055963 - RNA, 22 nt, Mycobacterium bovis subsp bovis AF2122/97
cggcgugucguugccagggcgg

SEQ ID NO: 3055964 - RNA, 15 nt, Mycobacterium bovis subsp bovis AF2122/97
cggcgugucucgucg

SEQ ID NO: 3055965 - RNA, 20 nt, Mycobacterium bovis subsp bovis AF2122/97
cggcguguucugaucggugg

SEQ ID NO: 3055966 - RNA, 20 nt, Mycobacterium bovis subsp bovis AF2122/97
cggcguuaaugcuucgcguc

SEQ ID NO: 3055967 - RNA, 15 nt, Mycobacterium bovis subsp bovis AF2122/97
cggcguuaccaccgu

SEQ ID NO: 3055968 - RNA, 19 nt, Mycobacterium bovis subsp bovis AF2122/97
cggcguuaccaccgucacc

SEQ ID NO: 3055969 - RNA, 17 nt, Mycobacterium bovis subsp bovis AF2122/97
cggcguuacguggugga

SEQ ID NO: 3055970 - RNA, 17 nt, Mycobacterium bovis subsp bovis AF2122/97
cggcguuagucgaucac

SEQ ID NO: 3055971 - RNA, 18 nt, Mycobacterium bovis subsp bovis AF2122/97
cggcguuagucgaucacg

SEQ ID NO: 3055972 - RNA, 19 nt, Mycobacterium bovis subsp bovis AF2122/97
cggcguucccacuggaggu

SEQ ID NO: 3055973 - RNA, 15 nt, Mycobacterium bovis subsp bovis AF2122/97
cggcguugagcuggc

SEQ ID NO: 3055974 - RNA, 16 nt, Mycobacterium bovis subsp bovis AF2122/97
cggcguugagcuggcg

SEQ ID NO: 3055975 - RNA, 17 nt, Mycobacterium bovis subsp bovis AF2122/97
cggcguugagcuggcgg

SEQ ID NO: 3055976 - RNA, 23 nt, Mycobacterium bovis subsp bovis AF2122/97
cggcguugaucagugccaggugg

SEQ ID NO: 3055977 - RNA, 20 nt, Mycobacterium bovis subsp bovis AF2122/97
cggcguugauccgcacccca

SEQ ID NO: 3055978 - RNA, 13 nt, Mycobacterium bovis subsp bovis AF2122/97
cggcguugaucga

SEQ ID NO: 3055979 - RNA, 22 nt, Mycobacterium bovis subsp bovis AF2122/97
cggcguugaucgacaucaccac

SEQ ID NO: 3055980 - RNA, 15 nt, Mycobacterium bovis subsp bovis AF2122/97
cggcguugccgccgg

SEQ ID NO: 3055981 - RNA, 16 nt, Mycobacterium bovis subsp bovis AF2122/97
cggcguugccgccggc

SEQ ID NO: 3055982 - RNA, 16 nt, Mycobacterium bovis subsp bovis AF2122/97
cggcguugccgccguu

SEQ ID NO: 3055983 - RNA, 18 nt, Mycobacterium bovis subsp bovis AF2122/97
cggcguugccgccguugc

SEQ ID NO: 3055984 - RNA, 20 nt, Mycobacterium bovis subsp bovis AF2122/97
cggcguuggaaaagucgggc

SEQ ID NO: 3055985 - RNA, 15 nt, Mycobacterium bovis subsp bovis AF2122/97
cggcguuggcgccgu

SEQ ID NO: 3055986 - RNA, 17 nt, Mycobacterium bovis subsp bovis AF2122/97
cggcguuggcgccguua

SEQ ID NO: 3055987 - RNA, 23 nt, Mycobacterium bovis subsp bovis AF2122/97
cggcguuggcgccguuaccgccg

SEQ ID NO: 3055988 - RNA, 17 nt, Mycobacterium bovis subsp bovis AF2122/97
cggcguuggugcagucg

SEQ ID NO: 3055989 - RNA, 19 nt, Mycobacterium bovis subsp bovis AF2122/97
cggcguuguggcguguggc

SEQ ID NO: 3055990 - RNA, 17 nt, Mycobacterium bovis subsp bovis AF2122/97
cggcguuguugaccagc

SEQ ID NO: 3055991 - RNA, 18 nt, Mycobacterium bovis subsp bovis AF2122/97
cggcguuguugaccagca

SEQ ID NO: 3055992 - RNA, 12 nt, Mycobacterium bovis subsp bovis AF2122/97
cggcguuuauca

SEQ ID NO: 3055993 - RNA, 18 nt, Mycobacterium bovis subsp bovis AF2122/97
cggcguuuccuucgacga

SEQ ID NO: 3055994 - RNA, 19 nt, Mycobacterium bovis subsp bovis AF2122/97
cggcguuuccuucgacgaa

SEQ ID NO: 3055995 - RNA, 16 nt, Mycobacterium bovis subsp bovis AF2122/97
cggcguuugagaacaa

SEQ ID NO: 3055996 - RNA, 18 nt, Mycobacterium bovis subsp bovis AF2122/97
cggcguuugagaacaacg

SEQ ID NO: 3055997 - RNA, 19 nt, Mycobacterium bovis subsp bovis AF2122/97
cggcguuugaggcagcgua

SEQ ID NO: 3055998 - RNA, 23 nt, Mycobacterium bovis subsp bovis AF2122/97
cggcguuuucaauuucacugcga

SEQ ID NO: 3055999 - RNA, 21 nt, Mycobacterium bovis subsp bovis AF2122/97
cggcuaacgaagccagaucag

SEQ ID NO: 3056000 - RNA, 20 nt, Mycobacterium bovis subsp bovis AF2122/97
cggcuaacuggacuggggcg

SEQ ID NO: 3056001 - RNA, 18 nt, Mycobacterium bovis subsp bovis AF2122/97
cggcuacaucggcggcgu

SEQ ID NO: 3056002 - RNA, 17 nt, Mycobacterium bovis subsp bovis AF2122/97
cggcuaccaccgcaccu

SEQ ID NO: 3056003 - RNA, 19 nt, Mycobacterium bovis subsp bovis AF2122/97
cggcuaccccgcagaaucc

SEQ ID NO: 3056004 - RNA, 15 nt, Mycobacterium bovis subsp bovis AF2122/97
cggcuaccgccgacc

SEQ ID NO: 3056005 - RNA, 16 nt, Mycobacterium bovis subsp bovis AF2122/97
cggcuaccgccgaccg

SEQ ID NO: 3056006 - RNA, 15 nt, Mycobacterium bovis subsp bovis AF2122/97
cggcuaccgccuugu

SEQ ID NO: 3056007 - RNA, 15 nt, Mycobacterium bovis subsp bovis AF2122/97
cggcuaccggcgugu

SEQ ID NO: 3056008 - RNA, 21 nt, Mycobacterium bovis subsp bovis AF2122/97
cggcuaccuaacccgcgccgg

SEQ ID NO: 3056009 - RNA, 18 nt, Mycobacterium bovis subsp bovis AF2122/97
cggcuaccuuguccggcc

SEQ ID NO: 3056010 - RNA, 20 nt, Mycobacterium bovis subsp bovis AF2122/97
cggcuaccuuguccggcccg

SEQ ID NO: 3056011 - RNA, 21 nt, Mycobacterium bovis subsp bovis AF2122/97
cggcuaccuuguccggcccgu

SEQ ID NO: 3056012 - RNA, 14 nt, Mycobacterium bovis subsp bovis AF2122/97
cggcuacggccagu

SEQ ID NO: 3056013 - RNA, 18 nt, Mycobacterium bovis subsp bovis AF2122/97
cggcuacggccagugcca

SEQ ID NO: 3056014 - RNA, 23 nt, Mycobacterium bovis subsp bovis AF2122/97
cggcuacggccagugccaucgcc

SEQ ID NO: 3056015 - RNA, 14 nt, Mycobacterium bovis subsp bovis AF2122/97
cggcuacggcgaca

SEQ ID NO: 3056016 - RNA, 21 nt, Mycobacterium bovis subsp bovis AF2122/97
cggcuacggcgacacgccagc

SEQ ID NO: 3056017 - RNA, 15 nt, Mycobacterium bovis subsp bovis AF2122/97
cggcuacggcugccc

SEQ ID NO: 3056018 - RNA, 17 nt, Mycobacterium bovis subsp bovis AF2122/97
cggcuacuagcgguguc

SEQ ID NO: 3056019 - RNA, 16 nt, Mycobacterium bovis subsp bovis AF2122/97
cggcuagcaacggguc

SEQ ID NO: 3056020 - RNA, 20 nt, Mycobacterium bovis subsp bovis AF2122/97
cggcuagcaacgggucgaug

SEQ ID NO: 3056021 - RNA, 23 nt, Mycobacterium bovis subsp bovis AF2122/97
cggcuagcaacgggucgaugucg

SEQ ID NO: 3056022 - RNA, 15 nt, Mycobacterium bovis subsp bovis AF2122/97
cggcuagcugaugcc

SEQ ID NO: 3056023 - RNA, 21 nt, Mycobacterium bovis subsp bovis AF2122/97
cggcuagcugaugccuggucg

SEQ ID NO: 3056024 - RNA, 22 nt, Mycobacterium bovis subsp bovis AF2122/97
cggcuagcugugcuucguuguc

SEQ ID NO: 3056025 - RNA, 16 nt, Mycobacterium bovis subsp bovis AF2122/97
cggcuaggcaccagcg

SEQ ID NO: 3056026 - RNA, 19 nt, Mycobacterium bovis subsp bovis AF2122/97
cggcuaggccaagccgcgg

SEQ ID NO: 3056027 - RNA, 22 nt, Mycobacterium bovis subsp bovis AF2122/97
cggcucggccagccagcgggcg

SEQ ID NO: 3056028 - RNA, 15 nt, Mycobacterium bovis subsp bovis AF2122/97
cggcucggcccccga

SEQ ID NO: 3056029 - RNA, 12 nt, Mycobacterium bovis subsp bovis AF2122/97
cggcucggcgcu

SEQ ID NO: 3056030 - RNA, 15 nt, Mycobacterium bovis subsp bovis AF2122/97
cggcucggcgcugac

SEQ ID NO: 3056031 - RNA, 13 nt, Mycobacterium bovis subsp bovis AF2122/97
cggcucggcggcg

SEQ ID NO: 3056032 - RNA, 20 nt, Mycobacterium bovis subsp bovis AF2122/97
cggcucggcgggggaccccg

SEQ ID NO: 3056033 - RNA, 13 nt, Mycobacterium bovis subsp bovis AF2122/97
cggcucggcggug

SEQ ID NO: 3056034 - RNA, 20 nt, Mycobacterium bovis subsp bovis AF2122/97
cggcucgggaacuucgccga

SEQ ID NO: 3056035 - RNA, 22 nt, Mycobacterium bovis subsp bovis AF2122/97
cggcucgggaacuucgccgaag

SEQ ID NO: 3056036 - RNA, 24 nt, Mycobacterium bovis subsp bovis AF2122/97
cggcucgggugcgcccggccaagc

SEQ ID NO: 3056037 - RNA, 16 nt, Mycobacterium bovis subsp bovis AF2122/97
cggcucggugcgccag

SEQ ID NO: 3056038 - RNA, 18 nt, Mycobacterium bovis subsp bovis AF2122/97
cggcucguagcuggugcg

SEQ ID NO: 3056039 - RNA, 22 nt, Mycobacterium bovis subsp bovis AF2122/97
cggcucgucagguuccgcgaca

SEQ ID NO: 3056040 - RNA, 13 nt, Mycobacterium bovis subsp bovis AF2122/97
cggcucguccggg

SEQ ID NO: 3056041 - RNA, 18 nt, Mycobacterium bovis subsp bovis AF2122/97
cggcucgucgauccccgc

SEQ ID NO: 3056042 - RNA, 20 nt, Mycobacterium bovis subsp bovis AF2122/97
cggcucgucgaugucgacgu

SEQ ID NO: 3056043 - RNA, 23 nt, Mycobacterium bovis subsp bovis AF2122/97
cggcucgucgaugucgacgucgc

SEQ ID NO: 3056044 - RNA, 15 nt, Mycobacterium bovis subsp bovis AF2122/97
cggcucgucgcucga

SEQ ID NO: 3056045 - RNA, 13 nt, Mycobacterium bovis subsp bovis AF2122/97
cggcucgucgggc

SEQ ID NO: 3056046 - RNA, 17 nt, Mycobacterium bovis subsp bovis AF2122/97
cggcucguugcgggcgg

SEQ ID NO: 3056047 - RNA, 18 nt, Mycobacterium bovis subsp bovis AF2122/97
cggcucguugcgggcggg

SEQ ID NO: 3056048 - RNA, 20 nt, Mycobacterium bovis subsp bovis AF2122/97
cggcucuagaucgccgagcg

SEQ ID NO: 3056049 - RNA, 15 nt, Mycobacterium bovis subsp bovis AF2122/97
cggcucuccggugau

SEQ ID NO: 3056050 - RNA, 20 nt, Mycobacterium bovis subsp bovis AF2122/97
cggcucuccggugaucaccg

SEQ ID NO: 3056051 - RNA, 21 nt, Mycobacterium bovis subsp bovis AF2122/97
cggcucuccggugaucaccga

SEQ ID NO: 3056052 - RNA, 22 nt, Mycobacterium bovis subsp bovis AF2122/97
cggcucuccggugaucaccgac

SEQ ID NO: 3056053 - RNA, 21 nt, Mycobacterium bovis subsp bovis AF2122/97
cggcucucuucgcgcgcuggg

SEQ ID NO: 3056054 - RNA, 19 nt, Mycobacterium bovis subsp bovis AF2122/97
cggcucuuuuucgaucgcu

SEQ ID NO: 3056055 - RNA, 15 nt, Mycobacterium bovis subsp bovis AF2122/97
cggcugaaccgcugg

SEQ ID NO: 3056056 - RNA, 15 nt, Mycobacterium bovis subsp bovis AF2122/97
cggcugaacggcagc

SEQ ID NO: 3056057 - RNA, 16 nt, Mycobacterium bovis subsp bovis AF2122/97
cggcugaauucggcga

SEQ ID NO: 3056058 - RNA, 15 nt, Mycobacterium bovis subsp bovis AF2122/97
cggcugaccggggcg

SEQ ID NO: 3056059 - RNA, 18 nt, Mycobacterium bovis subsp bovis AF2122/97
cggcugaccggggcgccc

SEQ ID NO: 3056060 - RNA, 19 nt, Mycobacterium bovis subsp bovis AF2122/97
cggcugaccggggucggcc

SEQ ID NO: 3056061 - RNA, 21 nt, Mycobacterium bovis subsp bovis AF2122/97
cggcugaccggggucggccug

SEQ ID NO: 3056062 - RNA, 14 nt, Mycobacterium bovis subsp bovis AF2122/97
cggcugaccuccca

SEQ ID NO: 3056063 - RNA, 21 nt, Mycobacterium bovis subsp bovis AF2122/97
cggcugaccucccacccccgg

SEQ ID NO: 3056064 - RNA, 22 nt, Mycobacterium bovis subsp bovis AF2122/97
cggcugaccuucucacgcacca

SEQ ID NO: 3056065 - RNA, 20 nt, Mycobacterium bovis subsp bovis AF2122/97
cggcugacgaccaaccaccg

SEQ ID NO: 3056066 - RNA, 18 nt, Mycobacterium bovis subsp bovis AF2122/97
cggcugagacagaccggg

SEQ ID NO: 3056067 - RNA, 21 nt, Mycobacterium bovis subsp bovis AF2122/97
cggcugagcgugcggugaucg

SEQ ID NO: 3056068 - RNA, 20 nt, Mycobacterium bovis subsp bovis AF2122/97
cggcugauucgagccacaug

SEQ ID NO: 3056069 - RNA, 19 nt, Mycobacterium bovis subsp bovis AF2122/97
cggcugauuggcccaccgc

SEQ ID NO: 3056070 - RNA, 23 nt, Mycobacterium bovis subsp bovis AF2122/97
cggcugauuggcccaccgccguu

SEQ ID NO: 3056071 - RNA, 20 nt, Mycobacterium bovis subsp bovis AF2122/97
cggcugcaaccagcggcaca

SEQ ID NO: 3056072 - RNA, 13 nt, Mycobacterium bovis subsp bovis AF2122/97
cggcugcagccga

SEQ ID NO: 3056073 - RNA, 15 nt, Mycobacterium bovis subsp bovis AF2122/97
cggcugcagccgacc

SEQ ID NO: 3056074 - RNA, 16 nt, Mycobacterium bovis subsp bovis AF2122/97
cggcugcauccuccuc

SEQ ID NO: 3056075 - RNA, 21 nt, Mycobacterium bovis subsp bovis AF2122/97
cggcugcauccuccucgucga

SEQ ID NO: 3056076 - RNA, 15 nt, Mycobacterium bovis subsp bovis AF2122/97
cggcugccacacagg

SEQ ID NO: 3056077 - RNA, 19 nt, Mycobacterium bovis subsp bovis AF2122/97
cggcugccacacaggcguc

SEQ ID NO: 3056078 - RNA, 13 nt, Mycobacterium bovis subsp bovis AF2122/97
cggcugccaccgc

SEQ ID NO: 3056079 - RNA, 16 nt, Mycobacterium bovis subsp bovis AF2122/97
cggcugccagcgccgc

SEQ ID NO: 3056080 - RNA, 19 nt, Mycobacterium bovis subsp bovis AF2122/97
cggcugccagcgccgccgc

SEQ ID NO: 3056081 - RNA, 22 nt, Mycobacterium bovis subsp bovis AF2122/97
cggcugccagcgccgccgccga

SEQ ID NO: 3056082 - RNA, 14 nt, Mycobacterium bovis subsp bovis AF2122/97
cggcugccagcgcu

SEQ ID NO: 3056083 - RNA, 15 nt, Mycobacterium bovis subsp bovis AF2122/97
cggcugccaucccga

SEQ ID NO: 3056084 - RNA, 19 nt, Mycobacterium bovis subsp bovis AF2122/97
cggcugcccaugguggcga

SEQ ID NO: 3056085 - RNA, 22 nt, Mycobacterium bovis subsp bovis AF2122/97
cggcugcccguucugcccaggc

SEQ ID NO: 3056086 - RNA, 21 nt, Mycobacterium bovis subsp bovis AF2122/97
cggcugccgcaaacgcggcgu

SEQ ID NO: 3056087 - RNA, 13 nt, Mycobacterium bovis subsp bovis AF2122/97
cggcugccgcacc

SEQ ID NO: 3056088 - RNA, 14 nt, Mycobacterium bovis subsp bovis AF2122/97
cggcugccgcacca

SEQ ID NO: 3056089 - RNA, 16 nt, Mycobacterium bovis subsp bovis AF2122/97
cggcugccgcaccaag

SEQ ID NO: 3056090 - RNA, 12 nt, Mycobacterium bovis subsp bovis AF2122/97
cggcugccgcgg

SEQ ID NO: 3056091 - RNA, 13 nt, Mycobacterium bovis subsp bovis AF2122/97
cggcugccgcggc

SEQ ID NO: 3056092 - RNA, 14 nt, Mycobacterium bovis subsp bovis AF2122/97
cggcugccgcggcu

SEQ ID NO: 3056093 - RNA, 16 nt, Mycobacterium bovis subsp bovis AF2122/97
cggcugccgcggcugc

SEQ ID NO: 3056094 - RNA, 18 nt, Mycobacterium bovis subsp bovis AF2122/97
cggcugccgcggcugcca

SEQ ID NO: 3056095 - RNA, 22 nt, Mycobacterium bovis subsp bovis AF2122/97
cggcugccgcggcugccauccc

SEQ ID NO: 3056096 - RNA, 16 nt, Mycobacterium bovis subsp bovis AF2122/97
cggcugccgcucgacc

SEQ ID NO: 3056097 - RNA, 21 nt, Mycobacterium bovis subsp bovis AF2122/97
cggcugccucccuuccgcgcu

SEQ ID NO: 3056098 - RNA, 19 nt, Mycobacterium bovis subsp bovis AF2122/97
cggcugcgaaagccacucg

SEQ ID NO: 3056099 - RNA, 17 nt, Mycobacterium bovis subsp bovis AF2122/97
cggcugcgcgcucggcc

SEQ ID NO: 3056100 - RNA, 18 nt, Mycobacterium bovis subsp bovis AF2122/97
cggcugcgcgcucggcca

SEQ ID NO: 3056101 - RNA, 20 nt, Mycobacterium bovis subsp bovis AF2122/97
cggcugcgcuuugcacagcg

SEQ ID NO: 3056102 - RNA, 22 nt, Mycobacterium bovis subsp bovis AF2122/97
cggcugcgcuuugcacagcggc

SEQ ID NO: 3056103 - RNA, 17 nt, Mycobacterium bovis subsp bovis AF2122/97
cggcugcggaacggguc

SEQ ID NO: 3056104 - RNA, 14 nt, Mycobacterium bovis subsp bovis AF2122/97
cggcugcggcaacg

SEQ ID NO: 3056105 - RNA, 15 nt, Mycobacterium bovis subsp bovis AF2122/97
cggcugcggcaacga

SEQ ID NO: 3056106 - RNA, 20 nt, Mycobacterium bovis subsp bovis AF2122/97
cggcugcgggaagacgucgg

SEQ ID NO: 3056107 - RNA, 13 nt, Mycobacterium bovis subsp bovis AF2122/97
cggcugcggggcg

SEQ ID NO: 3056108 - RNA, 14 nt, Mycobacterium bovis subsp bovis AF2122/97
cggcugcggggcga

SEQ ID NO: 3056109 - RNA, 22 nt, Mycobacterium bovis subsp bovis AF2122/97
cggcugcgguaaucgccaccgc

SEQ ID NO: 3056110 - RNA, 22 nt, Mycobacterium bovis subsp bovis AF2122/97
cggcugcgucgucugcagaccu

SEQ ID NO: 3056111 - RNA, 17 nt, Mycobacterium bovis subsp bovis AF2122/97
cggcugcguuggcuggu

SEQ ID NO: 3056112 - RNA, 19 nt, Mycobacterium bovis subsp bovis AF2122/97
cggcugcguuggcuggugc

SEQ ID NO: 3056113 - RNA, 16 nt, Mycobacterium bovis subsp bovis AF2122/97
cggcuuggcgucggcc

SEQ ID NO: 3056114 - RNA, 16 nt, Mycobacterium bovis subsp bovis AF2122/97
cggcuuggcugccucc

SEQ ID NO: 3056115 - RNA, 18 nt, Mycobacterium bovis subsp bovis AF2122/97
cggcuugggaaacccggc

SEQ ID NO: 3056116 - RNA, 22 nt, Mycobacterium bovis subsp bovis AF2122/97
cggcuugggaaacccggccagc

SEQ ID NO: 3056117 - RNA, 23 nt, Mycobacterium bovis subsp bovis AF2122/97
cggcuugggaaacccggccagcu

SEQ ID NO: 3056118 - RNA, 17 nt, Mycobacterium bovis subsp bovis AF2122/97
cggcuugggccaggccc

SEQ ID NO: 3056119 - RNA, 18 nt, Mycobacterium bovis subsp bovis AF2122/97
cggcuugggccaggccca

SEQ ID NO: 3056120 - RNA, 21 nt, Mycobacterium bovis subsp bovis AF2122/97
cggcuugggccaggcccagcu

SEQ ID NO: 3056121 - RNA, 22 nt, Mycobacterium bovis subsp bovis AF2122/97
cggcuugggcgguagccgacga

SEQ ID NO: 3056122 - RNA, 20 nt, Mycobacterium bovis subsp bovis AF2122/97
cggcuugggcuugcgccgga

SEQ ID NO: 3056123 - RNA, 15 nt, Mycobacterium bovis subsp bovis AF2122/97
cggcuugucgaccac

SEQ ID NO: 3056124 - RNA, 18 nt, Mycobacterium bovis subsp bovis AF2122/97
cggcuugucgaccacgac

SEQ ID NO: 3056125 - RNA, 12 nt, Mycobacterium bovis subsp bovis AF2122/97
cggcuugucgcc

SEQ ID NO: 3056126 - RNA, 17 nt, Mycobacterium bovis subsp bovis AF2122/97
cggcuuucccaccgcuu

SEQ ID NO: 3056127 - RNA, 21 nt, Mycobacterium bovis subsp bovis AF2122/97
cggcuuugacgcccggcaccc

SEQ ID NO: 3056128 - RNA, 15 nt, Mycobacterium bovis subsp bovis AF2122/97
cggcuuugagccgcu

SEQ ID NO: 3056129 - RNA, 18 nt, Mycobacterium bovis subsp bovis AF2122/97
cggcuuugagccgcucga

SEQ ID NO: 3056130 - RNA, 14 nt, Mycobacterium bovis subsp bovis AF2122/97
cggcuuugcggcgc

SEQ ID NO: 3056131 - RNA, 15 nt, Mycobacterium bovis subsp bovis AF2122/97
cggcuuugcggcgcg

SEQ ID NO: 3056132 - RNA, 16 nt, Mycobacterium bovis subsp bovis AF2122/97
cggcuuugcggcgcga

SEQ ID NO: 3056133 - RNA, 14 nt, Mycobacterium bovis subsp bovis AF2122/97
cggcuuugcuugcc

SEQ ID NO: 3056134 - RNA, 14 nt, Mycobacterium bovis subsp bovis AF2122/97
cggcuuuggccgcc

SEQ ID NO: 3056135 - RNA, 16 nt, Mycobacterium bovis subsp bovis AF2122/97
cggcuuuggccgccgu

SEQ ID NO: 3056136 - RNA, 18 nt, Mycobacterium bovis subsp bovis AF2122/97
cggcuuuggccgccgugg

SEQ ID NO: 3056137 - RNA, 16 nt, Mycobacterium bovis subsp bovis AF2122/97
cggcuuuuccggcauu

SEQ ID NO: 3056138 - RNA, 12 nt, Mycobacterium bovis subsp bovis AF2122/97
cggcuuuucgac

SEQ ID NO: 3056139 - RNA, 23 nt, Mycobacterium bovis subsp bovis AF2122/97
cggcuuuucgacgcuguggcucg

SEQ ID NO: 3056140 - RNA, 19 nt, Mycobacterium bovis subsp bovis AF2122/97
cggcuuuugucacaggcga

SEQ ID NO: 3056141 - RNA, 21 nt, Mycobacterium bovis subsp bovis AF2122/97
cggcuuuugucacaggcgaca

SEQ ID NO: 3056142 - RNA, 22 nt, Mycobacterium bovis subsp bovis AF2122/97
cggcuuuugucacaggcgacac

SEQ ID NO: 3056143 - RNA, 13 nt, Mycobacterium bovis subsp bovis AF2122/97
cgggaaacaccgg

SEQ ID NO: 3056144 - RNA, 23 nt, Mycobacterium bovis subsp bovis AF2122/97
cgggaaacacguucucaccacca

SEQ ID NO: 3056145 - RNA, 22 nt, Mycobacterium bovis subsp bovis AF2122/97
cgggaaacguuccagcuugucg

SEQ ID NO: 3056146 - RNA, 19 nt, Mycobacterium bovis subsp bovis AF2122/97
cgggaaacuccgcggcgcg

SEQ ID NO: 3056147 - RNA, 16 nt, Mycobacterium bovis subsp bovis AF2122/97
cgggaaagccaccuac

SEQ ID NO: 3056148 - RNA, 22 nt, Mycobacterium bovis subsp bovis AF2122/97
cgggaaaguuguaucgcagcau

SEQ ID NO: 3056149 - RNA, 17 nt, Mycobacterium bovis subsp bovis AF2122/97
cgggaaauaucucggug

SEQ ID NO: 3056150 - RNA, 16 nt, Mycobacterium bovis subsp bovis AF2122/97
cgggaaccaacaccag

SEQ ID NO: 3056151 - RNA, 13 nt, Mycobacterium bovis subsp bovis AF2122/97
cgggaaccccagc

SEQ ID NO: 3056152 - RNA, 16 nt, Mycobacterium bovis subsp bovis AF2122/97
cgggaaccucgaccgu

SEQ ID NO: 3056153 - RNA, 21 nt, Mycobacterium bovis subsp bovis AF2122/97
cgggaaccucgaccgucaccg

SEQ ID NO: 3056154 - RNA, 16 nt, Mycobacterium bovis subsp bovis AF2122/97
cgggaacgaugccgcc

SEQ ID NO: 3056155 - RNA, 20 nt, Mycobacterium bovis subsp bovis AF2122/97
cgggaacgccucaggggcgc

SEQ ID NO: 3056156 - RNA, 22 nt, Mycobacterium bovis subsp bovis AF2122/97
cgggaacgccucaggggcgccu

SEQ ID NO: 3056157 - RNA, 16 nt, Mycobacterium bovis subsp bovis AF2122/97
cgggaacgcggcggcg

SEQ ID NO: 3056158 - RNA, 16 nt, Mycobacterium bovis subsp bovis AF2122/97
cgggaacgcucgucga

SEQ ID NO: 3056159 - RNA, 17 nt, Mycobacterium bovis subsp bovis AF2122/97
cgggaacuucgccgaag

SEQ ID NO: 3056160 - RNA, 13 nt, Mycobacterium bovis subsp bovis AF2122/97
cgggaagccgcau

SEQ ID NO: 3056161 - RNA, 16 nt, Mycobacterium bovis subsp bovis AF2122/97
cgggaagccgccgggc

SEQ ID NO: 3056162 - RNA, 13 nt, Mycobacterium bovis subsp bovis AF2122/97
cgggaagcgagca

SEQ ID NO: 3056163 - RNA, 14 nt, Mycobacterium bovis subsp bovis AF2122/97
cgggaagcgagcag

SEQ ID NO: 3056164 - RNA, 15 nt, Mycobacterium bovis subsp bovis AF2122/97
cgggaaggaaccggg

SEQ ID NO: 3056165 - RNA, 22 nt, Mycobacterium bovis subsp bovis AF2122/97
cgggaaggaaccgggcaaauca

SEQ ID NO: 3056166 - RNA, 23 nt, Mycobacterium bovis subsp bovis AF2122/97
cgggaaggaaccgggcaaaucaa

SEQ ID NO: 3056167 - RNA, 18 nt, Mycobacterium bovis subsp bovis AF2122/97
cgggaaggcucaccacgg

SEQ ID NO: 3056168 - RNA, 17 nt, Mycobacterium bovis subsp bovis AF2122/97
cgggaaguacggcaggc

SEQ ID NO: 3056169 - RNA, 17 nt, Mycobacterium bovis subsp bovis AF2122/97
cgggaagucccgagugg

SEQ ID NO: 3056170 - RNA, 20 nt, Mycobacterium bovis subsp bovis AF2122/97
cgggaagucgcugaagccgu

SEQ ID NO: 3056171 - RNA, 16 nt, Mycobacterium bovis subsp bovis AF2122/97
cgggaagucgggccgg

SEQ ID NO: 3056172 - RNA, 19 nt, Mycobacterium bovis subsp bovis AF2122/97
cgggaagucggggucgcgg

SEQ ID NO: 3056173 - RNA, 13 nt, Mycobacterium bovis subsp bovis AF2122/97
cgggaauccggug

SEQ ID NO: 3056174 - RNA, 19 nt, Mycobacterium bovis subsp bovis AF2122/97
cgggaauccggugaugacc

SEQ ID NO: 3056175 - RNA, 14 nt, Mycobacterium bovis subsp bovis AF2122/97
cgggaaugaccuug

SEQ ID NO: 3056176 - RNA, 15 nt, Mycobacterium bovis subsp bovis AF2122/97
cgggaauggacaggu

SEQ ID NO: 3056177 - RNA, 19 nt, Mycobacterium bovis subsp bovis AF2122/97
cgggacaaaaucagcagcc

SEQ ID NO: 3056178 - RNA, 16 nt, Mycobacterium bovis subsp bovis AF2122/97
cgggacaaagccgaac

SEQ ID NO: 3056179 - RNA, 15 nt, Mycobacterium bovis subsp bovis AF2122/97
cgggacaaccgggcg

SEQ ID NO: 3056180 - RNA, 23 nt, Mycobacterium bovis subsp bovis AF2122/97
cgggacaaguucgguagcgaucg

SEQ ID NO: 3056181 - RNA, 15 nt, Mycobacterium bovis subsp bovis AF2122/97
cgggacaaucgucca

SEQ ID NO: 3056182 - RNA, 19 nt, Mycobacterium bovis subsp bovis AF2122/97
cgggacaaucucggccgca

SEQ ID NO: 3056183 - RNA, 13 nt, Mycobacterium bovis subsp bovis AF2122/97
cgggacaccaccg

SEQ ID NO: 3056184 - RNA, 14 nt, Mycobacterium bovis subsp bovis AF2122/97
cgggacaccaccgc

SEQ ID NO: 3056185 - RNA, 17 nt, Mycobacterium bovis subsp bovis AF2122/97
cgggacagauggcggcc

SEQ ID NO: 3056186 - RNA, 19 nt, Mycobacterium bovis subsp bovis AF2122/97
cgggacagauggcggccga

SEQ ID NO: 3056187 - RNA, 12 nt, Mycobacterium bovis subsp bovis AF2122/97
cgggacagcgcc

SEQ ID NO: 3056188 - RNA, 14 nt, Mycobacterium bovis subsp bovis AF2122/97
cgggacagcgccgg

SEQ ID NO: 3056189 - RNA, 19 nt, Mycobacterium bovis subsp bovis AF2122/97
cgggacauccagugcggug

SEQ ID NO: 3056190 - RNA, 22 nt, Mycobacterium bovis subsp bovis AF2122/97
cgggaccauagccugcgccgac

SEQ ID NO: 3056191 - RNA, 16 nt, Mycobacterium bovis subsp bovis AF2122/97
cgggaccauagucgcc

SEQ ID NO: 3056192 - RNA, 20 nt, Mycobacterium bovis subsp bovis AF2122/97
cgggaccauagucgccgucg

SEQ ID NO: 3056193 - RNA, 21 nt, Mycobacterium bovis subsp bovis AF2122/97
cgggacccgugagcucgucga

SEQ ID NO: 3056194 - RNA, 21 nt, Mycobacterium bovis subsp bovis AF2122/97
cgggaccgaucuuggccaccg

SEQ ID NO: 3056195 - RNA, 23 nt, Mycobacterium bovis subsp bovis AF2122/97
cgggaccgccccggccaggacau

SEQ ID NO: 3056196 - RNA, 19 nt, Mycobacterium bovis subsp bovis AF2122/97
cgggaccggcuugccgccg

SEQ ID NO: 3056197 - RNA, 19 nt, Mycobacterium bovis subsp bovis AF2122/97
cgggaccggugugcacgcg

SEQ ID NO: 3056198 - RNA, 21 nt, Mycobacterium bovis subsp bovis AF2122/97
cgggaccgugacguaucgccg

SEQ ID NO: 3056199 - RNA, 17 nt, Mycobacterium bovis subsp bovis AF2122/97
cgggauggccgccgaca

SEQ ID NO: 3056200 - RNA, 21 nt, Mycobacterium bovis subsp bovis AF2122/97
cgggauggccgccgacaaccc

SEQ ID NO: 3056201 - RNA, 19 nt, Mycobacterium bovis subsp bovis AF2122/97
cgggauguaccccggcccg

SEQ ID NO: 3056202 - RNA, 22 nt, Mycobacterium bovis subsp bovis AF2122/97
cgggaugugcggcugcaccggc

SEQ ID NO: 3056203 - RNA, 19 nt, Mycobacterium bovis subsp bovis AF2122/97
cgggauucgggcgccgcag

SEQ ID NO: 3056204 - RNA, 22 nt, Mycobacterium bovis subsp bovis AF2122/97
cgggauugccgccaccuuggcu

SEQ ID NO: 3056205 - RNA, 15 nt, Mycobacterium bovis subsp bovis AF2122/97
cgggauugccgucgg

SEQ ID NO: 3056206 - RNA, 17 nt, Mycobacterium bovis subsp bovis AF2122/97
cgggauugccgucggug

SEQ ID NO: 3056207 - RNA, 14 nt, Mycobacterium bovis subsp bovis AF2122/97
cgggauugcgcgcu

SEQ ID NO: 3056208 - RNA, 15 nt, Mycobacterium bovis subsp bovis AF2122/97
cgggauuggugaguu

SEQ ID NO: 3056209 - RNA, 17 nt, Mycobacterium bovis subsp bovis AF2122/97
cgggcaaaucaagcaca

SEQ ID NO: 3056210 - RNA, 18 nt, Mycobacterium bovis subsp bovis AF2122/97
cgggcaaaucaagcacag

SEQ ID NO: 3056211 - RNA, 19 nt, Mycobacterium bovis subsp bovis AF2122/97
cgggcaaaucaagcacagc

SEQ ID NO: 3056212 - RNA, 15 nt, Mycobacterium bovis subsp bovis AF2122/97
cgggcaaccagcagc

SEQ ID NO: 3056213 - RNA, 19 nt, Mycobacterium bovis subsp bovis AF2122/97
cgggcaaccagcagcaggu

SEQ ID NO: 3056214 - RNA, 12 nt, Mycobacterium bovis subsp bovis AF2122/97
cgggcaaccgau

SEQ ID NO: 3056215 - RNA, 16 nt, Mycobacterium bovis subsp bovis AF2122/97
cgggcaaccgaugacg

SEQ ID NO: 3056216 - RNA, 18 nt, Mycobacterium bovis subsp bovis AF2122/97
cgggcaaccggagauccc

SEQ ID NO: 3056217 - RNA, 17 nt, Mycobacterium bovis subsp bovis AF2122/97
cgggcaaccugccgggc

SEQ ID NO: 3056218 - RNA, 20 nt, Mycobacterium bovis subsp bovis AF2122/97
cgggcaacgccucgagcaac

SEQ ID NO: 3056219 - RNA, 17 nt, Mycobacterium bovis subsp bovis AF2122/97
cgggcaacgcgaaccgg

SEQ ID NO: 3056220 - RNA, 23 nt, Mycobacterium bovis subsp bovis AF2122/97
cgggcaacgcgaaccggccaucg

SEQ ID NO: 3056221 - RNA, 14 nt, Mycobacterium bovis subsp bovis AF2122/97
cgggcaacggcagc

SEQ ID NO: 3056222 - RNA, 16 nt, Mycobacterium bovis subsp bovis AF2122/97
cgggcaacggcagccc

SEQ ID NO: 3056223 - RNA, 22 nt, Mycobacterium bovis subsp bovis AF2122/97
cgggcaacggcggggccggcgg

SEQ ID NO: 3056224 - RNA, 20 nt, Mycobacterium bovis subsp bovis AF2122/97
cgggcaacugcagcauggcc

SEQ ID NO: 3056225 - RNA, 21 nt, Mycobacterium bovis subsp bovis AF2122/97
cgggcaacugcagcauggccc

SEQ ID NO: 3056226 - RNA, 15 nt, Mycobacterium bovis subsp bovis AF2122/97
cgggcaaggccaccg

SEQ ID NO: 3056227 - RNA, 17 nt, Mycobacterium bovis subsp bovis AF2122/97
cgggcaaggccaccggc

SEQ ID NO: 3056228 - RNA, 18 nt, Mycobacterium bovis subsp bovis AF2122/97
cgggcaaggccaccggcg

SEQ ID NO: 3056229 - RNA, 19 nt, Mycobacterium bovis subsp bovis AF2122/97
cgggcaaggccaccggcgg

SEQ ID NO: 3056230 - RNA, 20 nt, Mycobacterium bovis subsp bovis AF2122/97
cgggcaaggccaccggcggu

SEQ ID NO: 3056231 - RNA, 16 nt, Mycobacterium bovis subsp bovis AF2122/97
cgggcaaggccaccgu

SEQ ID NO: 3056232 - RNA, 16 nt, Mycobacterium bovis subsp bovis AF2122/97
cgggcaaggcccgguc

SEQ ID NO: 3056233 - RNA, 15 nt, Mycobacterium bovis subsp bovis AF2122/97
cgggcaaggcggcgg

SEQ ID NO: 3056234 - RNA, 18 nt, Mycobacterium bovis subsp bovis AF2122/97
cgggcaaggcggcggcca

SEQ ID NO: 3056235 - RNA, 22 nt, Mycobacterium bovis subsp bovis AF2122/97
cgggcaagucgcccagccgagc

SEQ ID NO: 3056236 - RNA, 13 nt, Mycobacterium bovis subsp bovis AF2122/97
cgggcaaucaccg

SEQ ID NO: 3056237 - RNA, 18 nt, Mycobacterium bovis subsp bovis AF2122/97
cgggcaaucaccgccggc

SEQ ID NO: 3056238 - RNA, 19 nt, Mycobacterium bovis subsp bovis AF2122/97
cgggcaaucaccgccggcg

SEQ ID NO: 3056239 - RNA, 15 nt, Mycobacterium bovis subsp bovis AF2122/97
cgggcaaucgcucug

SEQ ID NO: 3056240 - RNA, 22 nt, Mycobacterium bovis subsp bovis AF2122/97
cgggcaaucgcucugugucgcc

SEQ ID NO: 3056241 - RNA, 13 nt, Mycobacterium bovis subsp bovis AF2122/97
cgggcaaugucga

SEQ ID NO: 3056242 - RNA, 19 nt, Mycobacterium bovis subsp bovis AF2122/97
cgggcaaugucgacaccgg

SEQ ID NO: 3056243 - RNA, 20 nt, Mycobacterium bovis subsp bovis AF2122/97
cgggcaaugucgacaccggc

SEQ ID NO: 3056244 - RNA, 21 nt, Mycobacterium bovis subsp bovis AF2122/97
cgggcaaugucgacaccggcg

SEQ ID NO: 3056245 - RNA, 21 nt, Mycobacterium bovis subsp bovis AF2122/97
cgggcacaccgacgccgccag

SEQ ID NO: 3056246 - RNA, 16 nt, Mycobacterium bovis subsp bovis AF2122/97
cgggcacaccgcaccu

SEQ ID NO: 3056247 - RNA, 21 nt, Mycobacterium bovis subsp bovis AF2122/97
cgggcacaccgcaccugggcg

SEQ ID NO: 3056248 - RNA, 12 nt, Mycobacterium bovis subsp bovis AF2122/97
cgggcaccacca

SEQ ID NO: 3056249 - RNA, 13 nt, Mycobacterium bovis subsp bovis AF2122/97
cgggcaccagucg

SEQ ID NO: 3056250 - RNA, 15 nt, Mycobacterium bovis subsp bovis AF2122/97
cgggcaccagucgcc

SEQ ID NO: 3056251 - RNA, 15 nt, Mycobacterium bovis subsp bovis AF2122/97
cgggcacccuugccg

SEQ ID NO: 3056252 - RNA, 12 nt, Mycobacterium bovis subsp bovis AF2122/97
cgggcaccgcca

SEQ ID NO: 3056253 - RNA, 15 nt, Mycobacterium bovis subsp bovis AF2122/97
cgggcaccgcgcgcu

SEQ ID NO: 3056254 - RNA, 18 nt, Mycobacterium bovis subsp bovis AF2122/97
cgggcaccgcgcgcucca

SEQ ID NO: 3056255 - RNA, 16 nt, Mycobacterium bovis subsp bovis AF2122/97
cgggcaccggccggug

SEQ ID NO: 3056256 - RNA, 12 nt, Mycobacterium bovis subsp bovis AF2122/97
cgggcaccgguu

SEQ ID NO: 3056257 - RNA, 18 nt, Mycobacterium bovis subsp bovis AF2122/97
cgggcaccgguuugacgu

SEQ ID NO: 3056258 - RNA, 22 nt, Mycobacterium bovis subsp bovis AF2122/97
cgggcaccgucggaacugacca

SEQ ID NO: 3056259 - RNA, 14 nt, Mycobacterium bovis subsp bovis AF2122/97
cgggcaccuggucg

SEQ ID NO: 3056260 - RNA, 16 nt, Mycobacterium bovis subsp bovis AF2122/97
cgggcaccuggucggc

SEQ ID NO: 3056261 - RNA, 22 nt, Mycobacterium bovis subsp bovis AF2122/97
cgggcacgaacaucagaucgcc

SEQ ID NO: 3056262 - RNA, 13 nt, Mycobacterium bovis subsp bovis AF2122/97
cgggcacgaucgu

SEQ ID NO: 3056263 - RNA, 22 nt, Mycobacterium bovis subsp bovis AF2122/97
cgggcacgcccucgucgaucgc

SEQ ID NO: 3056264 - RNA, 23 nt, Mycobacterium bovis subsp bovis AF2122/97
cgggcacgcccucgucgaucgcc

SEQ ID NO: 3056265 - RNA, 14 nt, Mycobacterium bovis subsp bovis AF2122/97
cgggcacgcgaggc

SEQ ID NO: 3056266 - RNA, 14 nt, Mycobacterium bovis subsp bovis AF2122/97
cgggcacgcggcga

SEQ ID NO: 3056267 - RNA, 15 nt, Mycobacterium bovis subsp bovis AF2122/97
cgggcacucagcagg

SEQ ID NO: 3056268 - RNA, 20 nt, Mycobacterium bovis subsp bovis AF2122/97
cgggcacucagcaggggauc

SEQ ID NO: 3056269 - RNA, 15 nt, Mycobacterium bovis subsp bovis AF2122/97
cgggcacugugaggu

SEQ ID NO: 3056270 - RNA, 17 nt, Mycobacterium bovis subsp bovis AF2122/97
cgggcacugugagguca

SEQ ID NO: 3056271 - RNA, 16 nt, Mycobacterium bovis subsp bovis AF2122/97
cgggcagaggcuggcg

SEQ ID NO: 3056272 - RNA, 18 nt, Mycobacterium bovis subsp bovis AF2122/97
cgggcagaggcuggcgca

SEQ ID NO: 3056273 - RNA, 22 nt, Mycobacterium bovis subsp bovis AF2122/97
cgggcagaggcuggcgcagauc

SEQ ID NO: 3056274 - RNA, 23 nt, Mycobacterium bovis subsp bovis AF2122/97
cgggcagauacgccaaccgcuuc

SEQ ID NO: 3056275 - RNA, 21 nt, Mycobacterium bovis subsp bovis AF2122/97
cgggcagcaaaaaccagcguc

SEQ ID NO: 3056276 - RNA, 22 nt, Mycobacterium bovis subsp bovis AF2122/97
cgggcagcaacaggcccacggc

SEQ ID NO: 3056277 - RNA, 23 nt, Mycobacterium bovis subsp bovis AF2122/97
cgggcagcaacaggcccacggcg

SEQ ID NO: 3056278 - RNA, 11 nt, Mycobacterium bovis subsp bovis AF2122/97
cgggcagcacc

SEQ ID NO: 3056279 - RNA, 14 nt, Mycobacterium bovis subsp bovis AF2122/97
cgggcagcaccagc

SEQ ID NO: 3056280 - RNA, 20 nt, Mycobacterium bovis subsp bovis AF2122/97
cgggcagcaccagcgccuug

SEQ ID NO: 3056281 - RNA, 17 nt, Mycobacterium bovis subsp bovis AF2122/97
cgggcagcacccgcgcc

SEQ ID NO: 3056282 - RNA, 16 nt, Mycobacterium bovis subsp bovis AF2122/97
cgggcagcacgccagc

SEQ ID NO: 3056283 - RNA, 17 nt, Mycobacterium bovis subsp bovis AF2122/97
cgggcagcacgccagcc

SEQ ID NO: 3056284 - RNA, 18 nt, Mycobacterium bovis subsp bovis AF2122/97
cgggcagcacgccagccc

SEQ ID NO: 3056285 - RNA, 11 nt, Mycobacterium bovis subsp bovis AF2122/97
cgggcagcacu

SEQ ID NO: 3056286 - RNA, 16 nt, Mycobacterium bovis subsp bovis AF2122/97
cgggcagccccuccgc

SEQ ID NO: 3056287 - RNA, 14 nt, Mycobacterium bovis subsp bovis AF2122/97
cgggcagccgcacg

SEQ ID NO: 3056288 - RNA, 20 nt, Mycobacterium bovis subsp bovis AF2122/97
cgggcagccgcacgguucgg

SEQ ID NO: 3056289 - RNA, 15 nt, Mycobacterium bovis subsp bovis AF2122/97
cgggcagccgcccgc

SEQ ID NO: 3056290 - RNA, 15 nt, Mycobacterium bovis subsp bovis AF2122/97
cgggcagccgcgccg

SEQ ID NO: 3056291 - RNA, 21 nt, Mycobacterium bovis subsp bovis AF2122/97
cgggcagccgcgccgcggccc

SEQ ID NO: 3056292 - RNA, 12 nt, Mycobacterium bovis subsp bovis AF2122/97
cgggcagccugc

SEQ ID NO: 3056293 - RNA, 15 nt, Mycobacterium bovis subsp bovis AF2122/97
cgggcagccugcugc

SEQ ID NO: 3056294 - RNA, 17 nt, Mycobacterium bovis subsp bovis AF2122/97
cgggcagccugcugcau

SEQ ID NO: 3056295 - RNA, 20 nt, Mycobacterium bovis subsp bovis AF2122/97
cgggcagcgaaacgagccgg

SEQ ID NO: 3056296 - RNA, 15 nt, Mycobacterium bovis subsp bovis AF2122/97
cgggcagcgcggcca

SEQ ID NO: 3056297 - RNA, 17 nt, Mycobacterium bovis subsp bovis AF2122/97
cgggcagcgcggccagu

SEQ ID NO: 3056298 - RNA, 18 nt, Mycobacterium bovis subsp bovis AF2122/97
cgggcagcgcggccagug

SEQ ID NO: 3056299 - RNA, 15 nt, Mycobacterium bovis subsp bovis AF2122/97
cgggcagcgcucuca

SEQ ID NO: 3056300 - RNA, 11 nt, Mycobacterium bovis subsp bovis AF2122/97
cgggcagcugg

SEQ ID NO: 3056301 - RNA, 16 nt, Mycobacterium bovis subsp bovis AF2122/97
cgggcagcuggcgacg

SEQ ID NO: 3056302 - RNA, 17 nt, Mycobacterium bovis subsp bovis AF2122/97
cgggcagcuggcgacgg

SEQ ID NO: 3056303 - RNA, 15 nt, Mycobacterium bovis subsp bovis AF2122/97
cgggcagcugggcag

SEQ ID NO: 3056304 - RNA, 20 nt, Mycobacterium bovis subsp bovis AF2122/97
cgggcagcugguaggucacc

SEQ ID NO: 3056305 - RNA, 21 nt, Mycobacterium bovis subsp bovis AF2122/97
cgggcagcugguaggucaccg

SEQ ID NO: 3056306 - RNA, 22 nt, Mycobacterium bovis subsp bovis AF2122/97
cgggcagcugguaggucaccgg

SEQ ID NO: 3056307 - RNA, 21 nt, Mycobacterium bovis subsp bovis AF2122/97
cgggcagcuucaaugucggug

SEQ ID NO: 3056308 - RNA, 21 nt, Mycobacterium bovis subsp bovis AF2122/97
cgggcaggagcagcacgucga

SEQ ID NO: 3056309 - RNA, 17 nt, Mycobacterium bovis subsp bovis AF2122/97
cgggcaggccccacugg

SEQ ID NO: 3056310 - RNA, 14 nt, Mycobacterium bovis subsp bovis AF2122/97
cgggcaggccgucg

SEQ ID NO: 3056311 - RNA, 15 nt, Mycobacterium bovis subsp bovis AF2122/97
cgggcaggcggccag

SEQ ID NO: 3056312 - RNA, 22 nt, Mycobacterium bovis subsp bovis AF2122/97
cgggcaguagcuguggcccgcg

SEQ ID NO: 3056313 - RNA, 22 nt, Mycobacterium bovis subsp bovis AF2122/97
cgggcagucaggccuagcgcgg

SEQ ID NO: 3056314 - RNA, 14 nt, Mycobacterium bovis subsp bovis AF2122/97
cgggcaguccaggc

SEQ ID NO: 3056315 - RNA, 19 nt, Mycobacterium bovis subsp bovis AF2122/97
cgggcaguccaggcacucc

SEQ ID NO: 3056316 - RNA, 15 nt, Mycobacterium bovis subsp bovis AF2122/97
cgggcagugcgcggc

SEQ ID NO: 3056317 - RNA, 16 nt, Mycobacterium bovis subsp bovis AF2122/97
cgggcagugcgcggcg

SEQ ID NO: 3056318 - RNA, 15 nt, Mycobacterium bovis subsp bovis AF2122/97
cgggcagugugguca

SEQ ID NO: 3056319 - RNA, 22 nt, Mycobacterium bovis subsp bovis AF2122/97
cgggcaguucaacgaggccgac

SEQ ID NO: 3056320 - RNA, 15 nt, Mycobacterium bovis subsp bovis AF2122/97
cgggcaguucacggu

SEQ ID NO: 3056321 - RNA, 16 nt, Mycobacterium bovis subsp bovis AF2122/97
cgggcaguucacgguu

SEQ ID NO: 3056322 - RNA, 18 nt, Mycobacterium bovis subsp bovis AF2122/97
cgggcaguucacgguuga

SEQ ID NO: 3056323 - RNA, 19 nt, Mycobacterium bovis subsp bovis AF2122/97
cgggcaguuuggcggcagg

SEQ ID NO: 3056324 - RNA, 20 nt, Mycobacterium bovis subsp bovis AF2122/97
cgggcaguuuguucgcgaag

SEQ ID NO: 3056325 - RNA, 20 nt, Mycobacterium bovis subsp bovis AF2122/97
cgggcauaacccgcaccggg

SEQ ID NO: 3056326 - RNA, 15 nt, Mycobacterium bovis subsp bovis AF2122/97
cgggcauccuucacc

SEQ ID NO: 3056327 - RNA, 21 nt, Mycobacterium bovis subsp bovis AF2122/97
cgggcauccuucaccagcugc

SEQ ID NO: 3056328 - RNA, 23 nt, Mycobacterium bovis subsp bovis AF2122/97
cgggcauccuucaccagcugcga

SEQ ID NO: 3056329 - RNA, 13 nt, Mycobacterium bovis subsp bovis AF2122/97
cgggcaucggcgg

SEQ ID NO: 3056330 - RNA, 22 nt, Mycobacterium bovis subsp bovis AF2122/97
cgggcaucgucgucgcugccgc

SEQ ID NO: 3056331 - RNA, 17 nt, Mycobacterium bovis subsp bovis AF2122/97
cgggcaugaucacacug

SEQ ID NO: 3056332 - RNA, 15 nt, Mycobacterium bovis subsp bovis AF2122/97
cgggcaugauccccg

SEQ ID NO: 3056333 - RNA, 20 nt, Mycobacterium bovis subsp bovis AF2122/97
cgggcaugauccccguugac

SEQ ID NO: 3056334 - RNA, 23 nt, Mycobacterium bovis subsp bovis AF2122/97
cgggcaugauguugaaacaccgc

SEQ ID NO: 3056335 - RNA, 13 nt, Mycobacterium bovis subsp bovis AF2122/97
cgggcaugccggc

SEQ ID NO: 3056336 - RNA, 19 nt, Mycobacterium bovis subsp bovis AF2122/97
cgggcaugcucuggcaaug

SEQ ID NO: 3056337 - RNA, 16 nt, Mycobacterium bovis subsp bovis AF2122/97
cgggcauggcggcgua

SEQ ID NO: 3056338 - RNA, 19 nt, Mycobacterium bovis subsp bovis AF2122/97
cgggcauggucgccggaga

SEQ ID NO: 3056339 - RNA, 14 nt, Mycobacterium bovis subsp bovis AF2122/97
cgggccaaagccgu

SEQ ID NO: 3056340 - RNA, 22 nt, Mycobacterium bovis subsp bovis AF2122/97
cgggccaaagccgucagcucac

SEQ ID NO: 3056341 - RNA, 21 nt, Mycobacterium bovis subsp bovis AF2122/97
cgggccaacucggcgaugaca

SEQ ID NO: 3056342 - RNA, 20 nt, Mycobacterium bovis subsp bovis AF2122/97
cgggccaagccggagcccgg

SEQ ID NO: 3056343 - RNA, 16 nt, Mycobacterium bovis subsp bovis AF2122/97
cgggccaaugccguug

SEQ ID NO: 3056344 - RNA, 20 nt, Mycobacterium bovis subsp bovis AF2122/97
cgggccaccacgcgccgcac

SEQ ID NO: 3056345 - RNA, 13 nt, Mycobacterium bovis subsp bovis AF2122/97
cgggccaccagcg

SEQ ID NO: 3056346 - RNA, 23 nt, Mycobacterium bovis subsp bovis AF2122/97
cgggccaccggaauccuggccgc

SEQ ID NO: 3056347 - RNA, 18 nt, Mycobacterium bovis subsp bovis AF2122/97
cgggccacguccugcccg

SEQ ID NO: 3056348 - RNA, 15 nt, Mycobacterium bovis subsp bovis AF2122/97
cgggccacugagcca

SEQ ID NO: 3056349 - RNA, 21 nt, Mycobacterium bovis subsp bovis AF2122/97
cgggccagaucgaagcgcagc

SEQ ID NO: 3056350 - RNA, 17 nt, Mycobacterium bovis subsp bovis AF2122/97
cgggccagcacccgcuc

SEQ ID NO: 3056351 - RNA, 13 nt, Mycobacterium bovis subsp bovis AF2122/97
cgggccagcaccu

SEQ ID NO: 3056352 - RNA, 16 nt, Mycobacterium bovis subsp bovis AF2122/97
cgggccaggauccgac

SEQ ID NO: 3056353 - RNA, 20 nt, Mycobacterium bovis subsp bovis AF2122/97
cgggccaggauccgaccccg

SEQ ID NO: 3056354 - RNA, 21 nt, Mycobacterium bovis subsp bovis AF2122/97
cgggccaggcccucgacggcg

SEQ ID NO: 3056355 - RNA, 22 nt, Mycobacterium bovis subsp bovis AF2122/97
cgggccaggccgaugccgaccu

SEQ ID NO: 3056356 - RNA, 19 nt, Mycobacterium bovis subsp bovis AF2122/97
cgggccauggguagccgcc

SEQ ID NO: 3056357 - RNA, 20 nt, Mycobacterium bovis subsp bovis AF2122/97
cgggccauggguagccgccc

SEQ ID NO: 3056358 - RNA, 21 nt, Mycobacterium bovis subsp bovis AF2122/97
cgggccauggguagccgccca

SEQ ID NO: 3056359 - RNA, 18 nt, Mycobacterium bovis subsp bovis AF2122/97
cgggcccacguuggcccc

SEQ ID NO: 3056360 - RNA, 19 nt, Mycobacterium bovis subsp bovis AF2122/97
cgggcccacguuggccccg

SEQ ID NO: 3056361 - RNA, 20 nt, Mycobacterium bovis subsp bovis AF2122/97
cgggcccacguuggccccgc

SEQ ID NO: 3056362 - RNA, 14 nt, Mycobacterium bovis subsp bovis AF2122/97
cgggcccagcagcg

SEQ ID NO: 3056363 - RNA, 12 nt, Mycobacterium bovis subsp bovis AF2122/97
cgggcccagccg

SEQ ID NO: 3056364 - RNA, 13 nt, Mycobacterium bovis subsp bovis AF2122/97
cgggcccagccgg

SEQ ID NO: 3056365 - RNA, 16 nt, Mycobacterium bovis subsp bovis AF2122/97
cgggcccaggacagca

SEQ ID NO: 3056366 - RNA, 21 nt, Mycobacterium bovis subsp bovis AF2122/97
cgggcccaggacagcagccgc

SEQ ID NO: 3056367 - RNA, 22 nt, Mycobacterium bovis subsp bovis AF2122/97
cgggcccaggacagcagccgcc

SEQ ID NO: 3056368 - RNA, 16 nt, Mycobacterium bovis subsp bovis AF2122/97
cgggcccaucgcccgg

SEQ ID NO: 3056369 - RNA, 17 nt, Mycobacterium bovis subsp bovis AF2122/97
cgggcccaucgcccggu

SEQ ID NO: 3056370 - RNA, 14 nt, Mycobacterium bovis subsp bovis AF2122/97
cgggccccacaucg

SEQ ID NO: 3056371 - RNA, 14 nt, Mycobacterium bovis subsp bovis AF2122/97
cgggcgaaccgcuc

SEQ ID NO: 3056372 - RNA, 17 nt, Mycobacterium bovis subsp bovis AF2122/97
cgggcgaagcuagcgcc

SEQ ID NO: 3056373 - RNA, 15 nt, Mycobacterium bovis subsp bovis AF2122/97
cgggcgaccaacacg

SEQ ID NO: 3056374 - RNA, 14 nt, Mycobacterium bovis subsp bovis AF2122/97
cgggcgaccaccac

SEQ ID NO: 3056375 - RNA, 17 nt, Mycobacterium bovis subsp bovis AF2122/97
cgggcgaccaccaccgc

SEQ ID NO: 3056376 - RNA, 18 nt, Mycobacterium bovis subsp bovis AF2122/97
cgggcgaccaccaccgcc

SEQ ID NO: 3056377 - RNA, 20 nt, Mycobacterium bovis subsp bovis AF2122/97
cgggcgaccaccaccgccgc

SEQ ID NO: 3056378 - RNA, 23 nt, Mycobacterium bovis subsp bovis AF2122/97
cgggcgaccaccaccgccgccga

SEQ ID NO: 3056379 - RNA, 14 nt, Mycobacterium bovis subsp bovis AF2122/97
cgggcgaccaccgc

SEQ ID NO: 3056380 - RNA, 15 nt, Mycobacterium bovis subsp bovis AF2122/97
cgggcgaccaccgcg

SEQ ID NO: 3056381 - RNA, 12 nt, Mycobacterium bovis subsp bovis AF2122/97
cgggcgacccgu

SEQ ID NO: 3056382 - RNA, 13 nt, Mycobacterium bovis subsp bovis AF2122/97
cgggcgacccguu

SEQ ID NO: 3056383 - RNA, 20 nt, Mycobacterium bovis subsp bovis AF2122/97
cgggcgacccguucucggug

SEQ ID NO: 3056384 - RNA, 20 nt, Mycobacterium bovis subsp bovis AF2122/97
cgggcgaccuccggaaucgc

SEQ ID NO: 3056385 - RNA, 20 nt, Mycobacterium bovis subsp bovis AF2122/97
cgggcgagaacccacgcaug

SEQ ID NO: 3056386 - RNA, 22 nt, Mycobacterium bovis subsp bovis AF2122/97
cgggcgagaacccacgcaugca

SEQ ID NO: 3056387 - RNA, 21 nt, Mycobacterium bovis subsp bovis AF2122/97
cgggcgagaagucaagguguc

SEQ ID NO: 3056388 - RNA, 12 nt, Mycobacterium bovis subsp bovis AF2122/97
cgggcgagaucu

SEQ ID NO: 3056389 - RNA, 21 nt, Mycobacterium bovis subsp bovis AF2122/97
cgggcgagccgugccagcagg

SEQ ID NO: 3056390 - RNA, 20 nt, Mycobacterium bovis subsp bovis AF2122/97
cgggcgagcgcaucgauggc

SEQ ID NO: 3056391 - RNA, 14 nt, Mycobacterium bovis subsp bovis AF2122/97
cgggcgagcgcggc

SEQ ID NO: 3056392 - RNA, 19 nt, Mycobacterium bovis subsp bovis AF2122/97
cgggcgaguacaggcgcag

SEQ ID NO: 3056393 - RNA, 21 nt, Mycobacterium bovis subsp bovis AF2122/97
cgggcgaguagucgacgucga

SEQ ID NO: 3056394 - RNA, 20 nt, Mycobacterium bovis subsp bovis AF2122/97
cgggcgagucccggcgguug

SEQ ID NO: 3056395 - RNA, 20 nt, Mycobacterium bovis subsp bovis AF2122/97
cgggcgagugucagcagaug

SEQ ID NO: 3056396 - RNA, 21 nt, Mycobacterium bovis subsp bovis AF2122/97
cgggcgaucaaagccagcacc

SEQ ID NO: 3056397 - RNA, 23 nt, Mycobacterium bovis subsp bovis AF2122/97
cgggcgaucaacccuagggcggu

SEQ ID NO: 3056398 - RNA, 23 nt, Mycobacterium bovis subsp bovis AF2122/97
cgggcgaucgcggcgagcaccac

SEQ ID NO: 3056399 - RNA, 13 nt, Mycobacterium bovis subsp bovis AF2122/97
cgggcgaucucga

SEQ ID NO: 3056400 - RNA, 22 nt, Mycobacterium bovis subsp bovis AF2122/97
cgggcgaucucgauguacagcg

SEQ ID NO: 3056401 - RNA, 16 nt, Mycobacterium bovis subsp bovis AF2122/97
cgggcgaucuuggcga

SEQ ID NO: 3056402 - RNA, 15 nt, Mycobacterium bovis subsp bovis AF2122/97
cgggcgaugacccgg

SEQ ID NO: 3056403 - RNA, 16 nt, Mycobacterium bovis subsp bovis AF2122/97
cgggcgaugcgggccg

SEQ ID NO: 3056404 - RNA, 20 nt, Mycobacterium bovis subsp bovis AF2122/97
cgggcgaugcgggccgccag

SEQ ID NO: 3056405 - RNA, 17 nt, Mycobacterium bovis subsp bovis AF2122/97
cgggcgauuucggcgcc

SEQ ID NO: 3056406 - RNA, 19 nt, Mycobacterium bovis subsp bovis AF2122/97
cgggcgauuucggcgccgg

SEQ ID NO: 3056407 - RNA, 24 nt, Mycobacterium bovis subsp bovis AF2122/97
cgggcgauuucggcgccggcgucg

SEQ ID NO: 3056408 - RNA, 14 nt, Mycobacterium bovis subsp bovis AF2122/97
cgggcgcaagcagc

SEQ ID NO: 3056409 - RNA, 19 nt, Mycobacterium bovis subsp bovis AF2122/97
cgggcgcaagcagcccggg

SEQ ID NO: 3056410 - RNA, 21 nt, Mycobacterium bovis subsp bovis AF2122/97
cgggcgcaccaagacgccacc

SEQ ID NO: 3056411 - RNA, 13 nt, Mycobacterium bovis subsp bovis AF2122/97
cgggcgcaccagg

SEQ ID NO: 3056412 - RNA, 16 nt, Mycobacterium bovis subsp bovis AF2122/97
cgggcgcacgcccgca

SEQ ID NO: 3056413 - RNA, 17 nt, Mycobacterium bovis subsp bovis AF2122/97
cgggcgcacgcccgcac

SEQ ID NO: 3056414 - RNA, 21 nt, Mycobacterium bovis subsp bovis AF2122/97
cgggcgcacgcccgcacucgg

SEQ ID NO: 3056415 - RNA, 20 nt, Mycobacterium bovis subsp bovis AF2122/97
cgggcgccaacgggcugccc

SEQ ID NO: 3056416 - RNA, 14 nt, Mycobacterium bovis subsp bovis AF2122/97
cgggcgcccaugcu

SEQ ID NO: 3056417 - RNA, 16 nt, Mycobacterium bovis subsp bovis AF2122/97
cgggcgccccaccggc

SEQ ID NO: 3056418 - RNA, 17 nt, Mycobacterium bovis subsp bovis AF2122/97
cgggcgccccaccggcc

SEQ ID NO: 3056419 - RNA, 19 nt, Mycobacterium bovis subsp bovis AF2122/97
cgggcgccccaccggcccg

SEQ ID NO: 3056420 - RNA, 20 nt, Mycobacterium bovis subsp bovis AF2122/97
cgggcgcccuuaagccggcg

SEQ ID NO: 3056421 - RNA, 15 nt, Mycobacterium bovis subsp bovis AF2122/97
cgggcgccgaucacg

SEQ ID NO: 3056422 - RNA, 13 nt, Mycobacterium bovis subsp bovis AF2122/97
cgggcgccgcagc

SEQ ID NO: 3056423 - RNA, 16 nt, Mycobacterium bovis subsp bovis AF2122/97
cgggcgccgcagcgcu

SEQ ID NO: 3056424 - RNA, 17 nt, Mycobacterium bovis subsp bovis AF2122/97
cgggcgccgcagcgcuc

SEQ ID NO: 3056425 - RNA, 22 nt, Mycobacterium bovis subsp bovis AF2122/97
cgggcgccggaacgagcggccg

SEQ ID NO: 3056426 - RNA, 19 nt, Mycobacterium bovis subsp bovis AF2122/97
cgggcgccgguuacccgga

SEQ ID NO: 3056427 - RNA, 23 nt, Mycobacterium bovis subsp bovis AF2122/97
cgggcgccuuccaggcgggcggc

SEQ ID NO: 3056428 - RNA, 19 nt, Mycobacterium bovis subsp bovis AF2122/97
cgggcgccuuggucgccgc

SEQ ID NO: 3056429 - RNA, 21 nt, Mycobacterium bovis subsp bovis AF2122/97
cgggcgccuuggucgccgccu

SEQ ID NO: 3056430 - RNA, 22 nt, Mycobacterium bovis subsp bovis AF2122/97
cgggcgccuuggucgccgccuu

SEQ ID NO: 3056431 - RNA, 22 nt, Mycobacterium bovis subsp bovis AF2122/97
cgggcgcgaggacgcugaucca

SEQ ID NO: 3056432 - RNA, 13 nt, Mycobacterium bovis subsp bovis AF2122/97
cgggcgcgccggc

SEQ ID NO: 3056433 - RNA, 14 nt, Mycobacterium bovis subsp bovis AF2122/97
cgggcgcgcugccc

SEQ ID NO: 3056434 - RNA, 18 nt, Mycobacterium bovis subsp bovis AF2122/97
cgggcgcgggcgccggga

SEQ ID NO: 3056435 - RNA, 14 nt, Mycobacterium bovis subsp bovis AF2122/97
cgggcgcggggcgg

SEQ ID NO: 3056436 - RNA, 14 nt, Mycobacterium bovis subsp bovis AF2122/97
cgggcgcgguaacc

SEQ ID NO: 3056437 - RNA, 12 nt, Mycobacterium bovis subsp bovis AF2122/97
cgggcgcguccu

SEQ ID NO: 3056438 - RNA, 13 nt, Mycobacterium bovis subsp bovis AF2122/97
cgggcgcguccuc

SEQ ID NO: 3056439 - RNA, 18 nt, Mycobacterium bovis subsp bovis AF2122/97
cgggcgcguccucgccgc

SEQ ID NO: 3056440 - RNA, 19 nt, Mycobacterium bovis subsp bovis AF2122/97
cgggcgcguccucgccgca

SEQ ID NO: 3056441 - RNA, 22 nt, Mycobacterium bovis subsp bovis AF2122/97
cgggcgcguccucgccgcacgc

SEQ ID NO: 3056442 - RNA, 17 nt, Mycobacterium bovis subsp bovis AF2122/97
cgggcgcgucggcguug

SEQ ID NO: 3056443 - RNA, 22 nt, Mycobacterium bovis subsp bovis AF2122/97
cgggcgcugaugcgcugggcca

SEQ ID NO: 3056444 - RNA, 14 nt, Mycobacterium bovis subsp bovis AF2122/97
cgggcgcuggacgg

SEQ ID NO: 3056445 - RNA, 19 nt, Mycobacterium bovis subsp bovis AF2122/97
cgggcgcuggacggcgggc

SEQ ID NO: 3056446 - RNA, 21 nt, Mycobacterium bovis subsp bovis AF2122/97
cgggcgcuggacggcgggccg

SEQ ID NO: 3056447 - RNA, 19 nt, Mycobacterium bovis subsp bovis AF2122/97
cgggcgcuguagucgcgcc

SEQ ID NO: 3056448 - RNA, 21 nt, Mycobacterium bovis subsp bovis AF2122/97
cgggcgcuguagucgcgccuc

SEQ ID NO: 3056449 - RNA, 18 nt, Mycobacterium bovis subsp bovis AF2122/97
cgggcgcuugcaccaggg

SEQ ID NO: 3056450 - RNA, 20 nt, Mycobacterium bovis subsp bovis AF2122/97
cgggcgcuugcaccaggggc

SEQ ID NO: 3056451 - RNA, 19 nt, Mycobacterium bovis subsp bovis AF2122/97
cgggcgcuugccggggugu

SEQ ID NO: 3056452 - RNA, 15 nt, Mycobacterium bovis subsp bovis AF2122/97
cgggcggaaacaagc

SEQ ID NO: 3056453 - RNA, 20 nt, Mycobacterium bovis subsp bovis AF2122/97
cgggcggaaagcccgucggg

SEQ ID NO: 3056454 - RNA, 17 nt, Mycobacterium bovis subsp bovis AF2122/97
cgggcggaacgccggca

SEQ ID NO: 3056455 - RNA, 20 nt, Mycobacterium bovis subsp bovis AF2122/97
cgggcggaacgccggcaccg

SEQ ID NO: 3056456 - RNA, 23 nt, Mycobacterium bovis subsp bovis AF2122/97
cgggcggaacgccggcaccgacg

SEQ ID NO: 3056457 - RNA, 18 nt, Mycobacterium bovis subsp bovis AF2122/97
cgggcucgcauucggcga

SEQ ID NO: 3056458 - RNA, 15 nt, Mycobacterium bovis subsp bovis AF2122/97
cgggcucgcccgcua

SEQ ID NO: 3056459 - RNA, 17 nt, Mycobacterium bovis subsp bovis AF2122/97
cgggcucgcccgcuacg

SEQ ID NO: 3056460 - RNA, 15 nt, Mycobacterium bovis subsp bovis AF2122/97
cgggcucgcugcacc

SEQ ID NO: 3056461 - RNA, 16 nt, Mycobacterium bovis subsp bovis AF2122/97
cgggcucgcugcacca

SEQ ID NO: 3056462 - RNA, 15 nt, Mycobacterium bovis subsp bovis AF2122/97
cgggcucgcuucagg

SEQ ID NO: 3056463 - RNA, 12 nt, Mycobacterium bovis subsp bovis AF2122/97
cgggcucggcag

SEQ ID NO: 3056464 - RNA, 19 nt, Mycobacterium bovis subsp bovis AF2122/97
cgggcucggcgaaacccgg

SEQ ID NO: 3056465 - RNA, 19 nt, Mycobacterium bovis subsp bovis AF2122/97
cgggcucggugacccccga

SEQ ID NO: 3056466 - RNA, 19 nt, Mycobacterium bovis subsp bovis AF2122/97
cgggcucgguggcggacgg

SEQ ID NO: 3056467 - RNA, 15 nt, Mycobacterium bovis subsp bovis AF2122/97
cgggcucguccagca

SEQ ID NO: 3056468 - RNA, 17 nt, Mycobacterium bovis subsp bovis AF2122/97
cgggcucguccagcaac

SEQ ID NO: 3056469 - RNA, 17 nt, Mycobacterium bovis subsp bovis AF2122/97
cgggcucguguccgccg

SEQ ID NO: 3056470 - RNA, 21 nt, Mycobacterium bovis subsp bovis AF2122/97
cgggcucguguccgccgucac

SEQ ID NO: 3056471 - RNA, 19 nt, Mycobacterium bovis subsp bovis AF2122/97
cgggcucuacucgcggccg

SEQ ID NO: 3056472 - RNA, 20 nt, Mycobacterium bovis subsp bovis AF2122/97
cgggcucuacucgcggccgg

SEQ ID NO: 3056473 - RNA, 21 nt, Mycobacterium bovis subsp bovis AF2122/97
cgggcucuacucgcggccggc

SEQ ID NO: 3056474 - RNA, 15 nt, Mycobacterium bovis subsp bovis AF2122/97
cgggcucucggcguc

SEQ ID NO: 3056475 - RNA, 17 nt, Mycobacterium bovis subsp bovis AF2122/97
cgggcucucggcgucga

SEQ ID NO: 3056476 - RNA, 19 nt, Mycobacterium bovis subsp bovis AF2122/97
cgggcucugcugccagccg

SEQ ID NO: 3056477 - RNA, 19 nt, Mycobacterium bovis subsp bovis AF2122/97
cgggcugacgaucuccacc

SEQ ID NO: 3056478 - RNA, 19 nt, Mycobacterium bovis subsp bovis AF2122/97
cgggcugaggcggcgacga

SEQ ID NO: 3056479 - RNA, 10 nt, Mycobacterium bovis subsp bovis AF2122/97
cgggcugcag

SEQ ID NO: 3056480 - RNA, 15 nt, Mycobacterium bovis subsp bovis AF2122/97
cgggcugcagccgac

SEQ ID NO: 3056481 - RNA, 16 nt, Mycobacterium bovis subsp bovis AF2122/97
cgggcugcagccgaca

SEQ ID NO: 3056482 - RNA, 14 nt, Mycobacterium bovis subsp bovis AF2122/97
cgggcugcagugac

SEQ ID NO: 3056483 - RNA, 16 nt, Mycobacterium bovis subsp bovis AF2122/97
cgggcugccgcaugcg

SEQ ID NO: 3056484 - RNA, 23 nt, Mycobacterium bovis subsp bovis AF2122/97
cgggcugccgcaugcgcuccggc

SEQ ID NO: 3056485 - RNA, 13 nt, Mycobacterium bovis subsp bovis AF2122/97
cgggcugccgccc

SEQ ID NO: 3056486 - RNA, 16 nt, Mycobacterium bovis subsp bovis AF2122/97
cgggcugccgcccaug

SEQ ID NO: 3056487 - RNA, 18 nt, Mycobacterium bovis subsp bovis AF2122/97
cgggcugcuugcgcccgg

SEQ ID NO: 3056488 - RNA, 16 nt, Mycobacterium bovis subsp bovis AF2122/97
cgggcuggccagcgcg

SEQ ID NO: 3056489 - RNA, 17 nt, Mycobacterium bovis subsp bovis AF2122/97
cgggcuggcccggcuac

SEQ ID NO: 3056490 - RNA, 15 nt, Mycobacterium bovis subsp bovis AF2122/97
cgggcuggccgacuc

SEQ ID NO: 3056491 - RNA, 17 nt, Mycobacterium bovis subsp bovis AF2122/97
cgggcuggccgacucga

SEQ ID NO: 3056492 - RNA, 14 nt, Mycobacterium bovis subsp bovis AF2122/97
cgggcuggucgguc

SEQ ID NO: 3056493 - RNA, 21 nt, Mycobacterium bovis subsp bovis AF2122/97
cgggcuguaggcgaucacgau

SEQ ID NO: 3056494 - RNA, 19 nt, Mycobacterium bovis subsp bovis AF2122/97
cgggcugugaacagcgcgu

SEQ ID NO: 3056495 - RNA, 16 nt, Mycobacterium bovis subsp bovis AF2122/97
cgggcugugauccgac

SEQ ID NO: 3056496 - RNA, 22 nt, Mycobacterium bovis subsp bovis AF2122/97
cgggcugugauccgacaguggc

SEQ ID NO: 3056497 - RNA, 13 nt, Mycobacterium bovis subsp bovis AF2122/97
cgggcuguucggc

SEQ ID NO: 3056498 - RNA, 15 nt, Mycobacterium bovis subsp bovis AF2122/97
cgggcuguucggcca

SEQ ID NO: 3056499 - RNA, 18 nt, Mycobacterium bovis subsp bovis AF2122/97
cgggcuguucggccaugg

SEQ ID NO: 3056500 - RNA, 22 nt, Mycobacterium bovis subsp bovis AF2122/97
cgggcuguucggccauggcggc

SEQ ID NO: 3056501 - RNA, 15 nt, Mycobacterium bovis subsp bovis AF2122/97
cgggcuuaggccgcg

SEQ ID NO: 3056502 - RNA, 17 nt, Mycobacterium bovis subsp bovis AF2122/97
cgggcuuaugcacgacg

SEQ ID NO: 3056503 - RNA, 15 nt, Mycobacterium bovis subsp bovis AF2122/97
cgggcuucaacacac

SEQ ID NO: 3056504 - RNA, 13 nt, Mycobacterium bovis subsp bovis AF2122/97
cgggcuucggcca

SEQ ID NO: 3056505 - RNA, 15 nt, Mycobacterium bovis subsp bovis AF2122/97
cgggcuucggccaga

SEQ ID NO: 3056506 - RNA, 22 nt, Mycobacterium bovis subsp bovis AF2122/97
cgggcuugacccuugggcacca

SEQ ID NO: 3056507 - RNA, 19 nt, Mycobacterium bovis subsp bovis AF2122/97
cgggcuugagcgccgaugu

SEQ ID NO: 3056508 - RNA, 17 nt, Mycobacterium bovis subsp bovis AF2122/97
cgggcuugcgcagcagc

SEQ ID NO: 3056509 - RNA, 14 nt, Mycobacterium bovis subsp bovis AF2122/97
cgggcuuggccgcg

SEQ ID NO: 3056510 - RNA, 18 nt, Mycobacterium bovis subsp bovis AF2122/97
cgggcuuggccgcgccgg

SEQ ID NO: 3056511 - RNA, 15 nt, Mycobacterium bovis subsp bovis AF2122/97
cgggcuuggcgucga

SEQ ID NO: 3056512 - RNA, 24 nt, Mycobacterium bovis subsp bovis AF2122/97
cgggcuuggcgucgacgucgacgg

SEQ ID NO: 3056513 - RNA, 19 nt, Mycobacterium bovis subsp bovis AF2122/97
cgggcuuggggucccgccg

SEQ ID NO: 3056514 - RNA, 20 nt, Mycobacterium bovis subsp bovis AF2122/97
cgggcuuugagcgcccgucg

SEQ ID NO: 3056515 - RNA, 22 nt, Mycobacterium bovis subsp bovis AF2122/97
cggggaaaccggccagccgacg

SEQ ID NO: 3056516 - RNA, 19 nt, Mycobacterium bovis subsp bovis AF2122/97
cggggaaagccgcagccgc

SEQ ID NO: 3056517 - RNA, 19 nt, Mycobacterium bovis subsp bovis AF2122/97
cggggaaccguccaagccg

SEQ ID NO: 3056518 - RNA, 19 nt, Mycobacterium bovis subsp bovis AF2122/97
cggggaaccuugaccgacc

SEQ ID NO: 3056519 - RNA, 19 nt, Mycobacterium bovis subsp bovis AF2122/97
cggggaacguccgcgccga

SEQ ID NO: 3056520 - RNA, 20 nt, Mycobacterium bovis subsp bovis AF2122/97
cggggaacguccgcgccgag

SEQ ID NO: 3056521 - RNA, 22 nt, Mycobacterium bovis subsp bovis AF2122/97
cggggaacgugacccccagcag

SEQ ID NO: 3056522 - RNA, 22 nt, Mycobacterium bovis subsp bovis AF2122/97
cggggaacuuaccgaggccaug

SEQ ID NO: 3056523 - RNA, 19 nt, Mycobacterium bovis subsp bovis AF2122/97
cggggaagacgaccgugcu

SEQ ID NO: 3056524 - RNA, 18 nt, Mycobacterium bovis subsp bovis AF2122/97
cggggaagcccggcagau

SEQ ID NO: 3056525 - RNA, 22 nt, Mycobacterium bovis subsp bovis AF2122/97
cggggaagcccggcagaugcag

SEQ ID NO: 3056526 - RNA, 20 nt, Mycobacterium bovis subsp bovis AF2122/97
cggggaagccugcgggccgg

SEQ ID NO: 3056527 - RNA, 22 nt, Mycobacterium bovis subsp bovis AF2122/97
cggggaagccugcgggccggca

SEQ ID NO: 3056528 - RNA, 23 nt, Mycobacterium bovis subsp bovis AF2122/97
cggggaaugaguguugccgacga

SEQ ID NO: 3056529 - RNA, 22 nt, Mycobacterium bovis subsp bovis AF2122/97
cggggacaacucgcguggcacc

SEQ ID NO: 3056530 - RNA, 15 nt, Mycobacterium bovis subsp bovis AF2122/97
cggggacagcccggc

SEQ ID NO: 3056531 - RNA, 21 nt, Mycobacterium bovis subsp bovis AF2122/97
cggggacagcccuucgcggga

SEQ ID NO: 3056532 - RNA, 14 nt, Mycobacterium bovis subsp bovis AF2122/97
cggggaccacgccg

SEQ ID NO: 3056533 - RNA, 17 nt, Mycobacterium bovis subsp bovis AF2122/97
cggggaccacgccgacg

SEQ ID NO: 3056534 - RNA, 23 nt, Mycobacterium bovis subsp bovis AF2122/97
cggggaccagauacgucgucgug

SEQ ID NO: 3056535 - RNA, 13 nt, Mycobacterium bovis subsp bovis AF2122/97
cggggaccgcggu

SEQ ID NO: 3056536 - RNA, 21 nt, Mycobacterium bovis subsp bovis AF2122/97
cggggaccgcggucauggcga

SEQ ID NO: 3056537 - RNA, 16 nt, Mycobacterium bovis subsp bovis AF2122/97
cggggaccucggcgau

SEQ ID NO: 3056538 - RNA, 14 nt, Mycobacterium bovis subsp bovis AF2122/97
cggggaccuuggcg

SEQ ID NO: 3056539 - RNA, 21 nt, Mycobacterium bovis subsp bovis AF2122/97
cggggacgccgcggcgccggu

SEQ ID NO: 3056540 - RNA, 13 nt, Mycobacterium bovis subsp bovis AF2122/97
cggggacgcgccc

SEQ ID NO: 3056541 - RNA, 17 nt, Mycobacterium bovis subsp bovis AF2122/97
cggggacgcgccccagu

SEQ ID NO: 3056542 - RNA, 15 nt, Mycobacterium bovis subsp bovis AF2122/97
cggggacggcggcaa

SEQ ID NO: 3056543 - RNA, 19 nt, Mycobacterium bovis subsp bovis AF2122/97
cgggggagcgaacggcgca

SEQ ID NO: 3056544 - RNA, 22 nt, Mycobacterium bovis subsp bovis AF2122/97
cgggggaguaguggugggcgug

SEQ ID NO: 3056545 - RNA, 18 nt, Mycobacterium bovis subsp bovis AF2122/97
cgggggaucucgagccgc

SEQ ID NO: 3056546 - RNA, 20 nt, Mycobacterium bovis subsp bovis AF2122/97
cgggggauuucgcgucugcu

SEQ ID NO: 3056547 - RNA, 15 nt, Mycobacterium bovis subsp bovis AF2122/97
cgggggcagcgccuc

SEQ ID NO: 3056548 - RNA, 13 nt, Mycobacterium bovis subsp bovis AF2122/97
cgggggcagcgcg

SEQ ID NO: 3056549 - RNA, 17 nt, Mycobacterium bovis subsp bovis AF2122/97
cgggggccgcgucucgg

SEQ ID NO: 3056550 - RNA, 14 nt, Mycobacterium bovis subsp bovis AF2122/97
cgggggcgccgccg

SEQ ID NO: 3056551 - RNA, 13 nt, Mycobacterium bovis subsp bovis AF2122/97
cgggggcgccggc

SEQ ID NO: 3056552 - RNA, 12 nt, Mycobacterium bovis subsp bovis AF2122/97
cgggggcgcgcg

SEQ ID NO: 3056553 - RNA, 16 nt, Mycobacterium bovis subsp bovis AF2122/97
cgggggcggccggcgg

SEQ ID NO: 3056554 - RNA, 22 nt, Mycobacterium bovis subsp bovis AF2122/97
cgggggcggccggcggccaugg

SEQ ID NO: 3056555 - RNA, 13 nt, Mycobacterium bovis subsp bovis AF2122/97
cgggggcgucgcc

SEQ ID NO: 3056556 - RNA, 18 nt, Mycobacterium bovis subsp bovis AF2122/97
cgggggcgucgccgccgg

SEQ ID NO: 3056557 - RNA, 14 nt, Mycobacterium bovis subsp bovis AF2122/97
cgggggcugcacgc

SEQ ID NO: 3056558 - RNA, 15 nt, Mycobacterium bovis subsp bovis AF2122/97
cgggggcugcacgcu

SEQ ID NO: 3056559 - RNA, 20 nt, Mycobacterium bovis subsp bovis AF2122/97
cgggggcuguccaccgaggc

SEQ ID NO: 3056560 - RNA, 20 nt, Mycobacterium bovis subsp bovis AF2122/97
cgggggcuuaugcgucugcu

SEQ ID NO: 3056561 - RNA, 20 nt, Mycobacterium bovis subsp bovis AF2122/97
cgggggcuuuuacgucugcu

SEQ ID NO: 3056562 - RNA, 22 nt, Mycobacterium bovis subsp bovis AF2122/97
cgggggcuuuuacgucugcucg

SEQ ID NO: 3056563 - RNA, 14 nt, Mycobacterium bovis subsp bovis AF2122/97
cggggggcagcucc

SEQ ID NO: 3056564 - RNA, 20 nt, Mycobacterium bovis subsp bovis AF2122/97
cggggggcaggucgagcgcc

SEQ ID NO: 3056565 - RNA, 15 nt, Mycobacterium bovis subsp bovis AF2122/97
cggggggcugcugcu

SEQ ID NO: 3056566 - RNA, 19 nt, Mycobacterium bovis subsp bovis AF2122/97
cggggguaauugccagccu

SEQ ID NO: 3056567 - RNA, 12 nt, Mycobacterium bovis subsp bovis AF2122/97
cgggggucgggc

SEQ ID NO: 3056568 - RNA, 18 nt, Mycobacterium bovis subsp bovis AF2122/97
cgggggucgggcgugucg

SEQ ID NO: 3056569 - RNA, 19 nt, Mycobacterium bovis subsp bovis AF2122/97
cgggggucgggcgugucgg

SEQ ID NO: 3056570 - RNA, 20 nt, Mycobacterium bovis subsp bovis AF2122/97
cgggggucgggcgugucggg

SEQ ID NO: 3056571 - RNA, 21 nt, Mycobacterium bovis subsp bovis AF2122/97
cgggggugcucggucgaugcu

SEQ ID NO: 3056572 - RNA, 13 nt, Mycobacterium bovis subsp bovis AF2122/97
cggggguugcggc

SEQ ID NO: 3056573 - RNA, 17 nt, Mycobacterium bovis subsp bovis AF2122/97
cggggguugcggcagcu

SEQ ID NO: 3056574 - RNA, 15 nt, Mycobacterium bovis subsp bovis AF2122/97
cgggguaaccggcgg

SEQ ID NO: 3056575 - RNA, 21 nt, Mycobacterium bovis subsp bovis AF2122/97
cgggguaaggcuugucagccg

SEQ ID NO: 3056576 - RNA, 22 nt, Mycobacterium bovis subsp bovis AF2122/97
cgggguacaggcugcugcgcga

SEQ ID NO: 3056577 - RNA, 21 nt, Mycobacterium bovis subsp bovis AF2122/97
cgggguagaccuucucgccgc

SEQ ID NO: 3056578 - RNA, 15 nt, Mycobacterium bovis subsp bovis AF2122/97
cgggguaggcccagc

SEQ ID NO: 3056579 - RNA, 22 nt, Mycobacterium bovis subsp bovis AF2122/97
cgggguaggcccagcaaccgcu

SEQ ID NO: 3056580 - RNA, 16 nt, Mycobacterium bovis subsp bovis AF2122/97
cgggguaguugaggcc

SEQ ID NO: 3056581 - RNA, 18 nt, Mycobacterium bovis subsp bovis AF2122/97
cgggguaucgacccucca

SEQ ID NO: 3056582 - RNA, 21 nt, Mycobacterium bovis subsp bovis AF2122/97
cggggucaaagcccgacgcga

SEQ ID NO: 3056583 - RNA, 20 nt, Mycobacterium bovis subsp bovis AF2122/97
cggggucaacaggccguggc

SEQ ID NO: 3056584 - RNA, 23 nt, Mycobacterium bovis subsp bovis AF2122/97
cggggucaacaggccguggcgga

SEQ ID NO: 3056585 - RNA, 14 nt, Mycobacterium bovis subsp bovis AF2122/97
cggggucaccggcu

SEQ ID NO: 3056586 - RNA, 13 nt, Mycobacterium bovis subsp bovis AF2122/97
cgggguccgcggc

SEQ ID NO: 3056587 - RNA, 23 nt, Mycobacterium bovis subsp bovis AF2122/97
cggggucgaacaugauccgccgg

SEQ ID NO: 3056588 - RNA, 14 nt, Mycobacterium bovis subsp bovis AF2122/97
cggggucgccggca

SEQ ID NO: 3056589 - RNA, 19 nt, Mycobacterium bovis subsp bovis AF2122/97
cggggucgccggcaccgga

SEQ ID NO: 3056590 - RNA, 19 nt, Mycobacterium bovis subsp bovis AF2122/97
cggggucguugaggccggu

SEQ ID NO: 3056591 - RNA, 21 nt, Mycobacterium bovis subsp bovis AF2122/97
cggggucguugaggccgguga

SEQ ID NO: 3056592 - RNA, 18 nt, Mycobacterium bovis subsp bovis AF2122/97
cggggugaaaaucgccau

SEQ ID NO: 3056593 - RNA, 19 nt, Mycobacterium bovis subsp bovis AF2122/97
cggggugaaaaucgccauc

SEQ ID NO: 3056594 - RNA, 22 nt, Mycobacterium bovis subsp bovis AF2122/97
cggggugaacgcggacaccgcg

SEQ ID NO: 3056595 - RNA, 23 nt, Mycobacterium bovis subsp bovis AF2122/97
cggggugaacgcggacaccgcgg

SEQ ID NO: 3056596 - RNA, 22 nt, Mycobacterium bovis subsp bovis AF2122/97
cggggugaaugcaacuccucga

SEQ ID NO: 3056597 - RNA, 23 nt, Mycobacterium bovis subsp bovis AF2122/97
cggggugaaugcaacuccucgac

SEQ ID NO: 3056598 - RNA, 15 nt, Mycobacterium bovis subsp bovis AF2122/97
cggggugacaucgcg

SEQ ID NO: 3056599 - RNA, 16 nt, Mycobacterium bovis subsp bovis AF2122/97
cggggugacaucgcga

SEQ ID NO: 3056600 - RNA, 19 nt, Mycobacterium bovis subsp bovis AF2122/97
cggggugacaucgcgaggc

SEQ ID NO: 3056601 - RNA, 14 nt, Mycobacterium bovis subsp bovis AF2122/97
cggggugagccgac

SEQ ID NO: 3056602 - RNA, 16 nt, Mycobacterium bovis subsp bovis AF2122/97
cggggugagugaccac

SEQ ID NO: 3056603 - RNA, 13 nt, Mycobacterium bovis subsp bovis AF2122/97
cggggugcacacc

SEQ ID NO: 3056604 - RNA, 15 nt, Mycobacterium bovis subsp bovis AF2122/97
cggggugcacaccgu

SEQ ID NO: 3056605 - RNA, 18 nt, Mycobacterium bovis subsp bovis AF2122/97
cggggugcacaccgucgc

SEQ ID NO: 3056606 - RNA, 24 nt, Mycobacterium bovis subsp bovis AF2122/97
cggggugcacaccgucgcgcucgc

SEQ ID NO: 3056607 - RNA, 17 nt, Mycobacterium bovis subsp bovis AF2122/97
cggggugcacgaugacg

SEQ ID NO: 3056608 - RNA, 13 nt, Mycobacterium bovis subsp bovis AF2122/97
cggggugcccccg

SEQ ID NO: 3056609 - RNA, 21 nt, Mycobacterium bovis subsp bovis AF2122/97
cggggugcccccggugccgcc

SEQ ID NO: 3056610 - RNA, 23 nt, Mycobacterium bovis subsp bovis AF2122/97
cggggugcccccggugccgcccg

SEQ ID NO: 3056611 - RNA, 21 nt, Mycobacterium bovis subsp bovis AF2122/97
cggggugcccggccgccagcg

SEQ ID NO: 3056612 - RNA, 15 nt, Mycobacterium bovis subsp bovis AF2122/97
cggggugccggcgau

SEQ ID NO: 3056613 - RNA, 13 nt, Mycobacterium bovis subsp bovis AF2122/97
cggggugccggcu

SEQ ID NO: 3056614 - RNA, 15 nt, Mycobacterium bovis subsp bovis AF2122/97
cggggugcgcgcgac

SEQ ID NO: 3056615 - RNA, 14 nt, Mycobacterium bovis subsp bovis AF2122/97
cgggguggcacgca

SEQ ID NO: 3056616 - RNA, 19 nt, Mycobacterium bovis subsp bovis AF2122/97
cgggguggccaccagcggc

SEQ ID NO: 3056617 - RNA, 17 nt, Mycobacterium bovis subsp bovis AF2122/97
cgggguggucgcaccgc

SEQ ID NO: 3056618 - RNA, 20 nt, Mycobacterium bovis subsp bovis AF2122/97
cgggguggucgcaccgccgg

SEQ ID NO: 3056619 - RNA, 12 nt, Mycobacterium bovis subsp bovis AF2122/97
cgggguggugga

SEQ ID NO: 3056620 - RNA, 15 nt, Mycobacterium bovis subsp bovis AF2122/97
cggggugguggaagg

SEQ ID NO: 3056621 - RNA, 22 nt, Mycobacterium bovis subsp bovis AF2122/97
cggggugguggaagguguuggu

SEQ ID NO: 3056622 - RNA, 23 nt, Mycobacterium bovis subsp bovis AF2122/97
cggggugguggaagguguuggug

SEQ ID NO: 3056623 - RNA, 17 nt, Mycobacterium bovis subsp bovis AF2122/97
cggggugugcgggcggu

SEQ ID NO: 3056624 - RNA, 19 nt, Mycobacterium bovis subsp bovis AF2122/97
cggggugugcgggcggugc

SEQ ID NO: 3056625 - RNA, 14 nt, Mycobacterium bovis subsp bovis AF2122/97
cggggugugcgggg

SEQ ID NO: 3056626 - RNA, 17 nt, Mycobacterium bovis subsp bovis AF2122/97
cgggguuacucgcagcg

SEQ ID NO: 3056627 - RNA, 20 nt, Mycobacterium bovis subsp bovis AF2122/97
cgggguuacucgcagcgccg

SEQ ID NO: 3056628 - RNA, 14 nt, Mycobacterium bovis subsp bovis AF2122/97
cgggguugaccgcc

SEQ ID NO: 3056629 - RNA, 15 nt, Mycobacterium bovis subsp bovis AF2122/97
cgggugaucugggcg

SEQ ID NO: 3056630 - RNA, 11 nt, Mycobacterium bovis subsp bovis AF2122/97
cgggugaucuu

SEQ ID NO: 3056631 - RNA, 18 nt, Mycobacterium bovis subsp bovis AF2122/97
cgggugaucuuggcgccc

SEQ ID NO: 3056632 - RNA, 20 nt, Mycobacterium bovis subsp bovis AF2122/97
cgggugaucuuggcgcccgc

SEQ ID NO: 3056633 - RNA, 21 nt, Mycobacterium bovis subsp bovis AF2122/97
cgggugauggaugggucgacc

SEQ ID NO: 3056634 - RNA, 19 nt, Mycobacterium bovis subsp bovis AF2122/97
cgggugcaacggcguuggc

SEQ ID NO: 3056635 - RNA, 18 nt, Mycobacterium bovis subsp bovis AF2122/97
cgggugcagaucgcccca

SEQ ID NO: 3056636 - RNA, 20 nt, Mycobacterium bovis subsp bovis AF2122/97
cgggugcagaucgccccagc

SEQ ID NO: 3056637 - RNA, 22 nt, Mycobacterium bovis subsp bovis AF2122/97
cgggugcagcacggcgccgcca

SEQ ID NO: 3056638 - RNA, 13 nt, Mycobacterium bovis subsp bovis AF2122/97
cgggugcaggcga

SEQ ID NO: 3056639 - RNA, 23 nt, Mycobacterium bovis subsp bovis AF2122/97
cgggugcaggcgaguuaggccgc

SEQ ID NO: 3056640 - RNA, 13 nt, Mycobacterium bovis subsp bovis AF2122/97
cgggugccagccc

SEQ ID NO: 3056641 - RNA, 15 nt, Mycobacterium bovis subsp bovis AF2122/97
cgggugccgagcugg

SEQ ID NO: 3056642 - RNA, 15 nt, Mycobacterium bovis subsp bovis AF2122/97
cgggugcgacaucgg

SEQ ID NO: 3056643 - RNA, 17 nt, Mycobacterium bovis subsp bovis AF2122/97
cgggugcgacaucgguc

SEQ ID NO: 3056644 - RNA, 13 nt, Mycobacterium bovis subsp bovis AF2122/97
cgggugcgacgcg

SEQ ID NO: 3056645 - RNA, 17 nt, Mycobacterium bovis subsp bovis AF2122/97
cgggugcgacgcgaccg

SEQ ID NO: 3056646 - RNA, 21 nt, Mycobacterium bovis subsp bovis AF2122/97
cgggugcgacgcgaccgcgau

SEQ ID NO: 3056647 - RNA, 17 nt, Mycobacterium bovis subsp bovis AF2122/97
cgggugcgaucgcaaca

SEQ ID NO: 3056648 - RNA, 19 nt, Mycobacterium bovis subsp bovis AF2122/97
cgggugcgaucgcaacacc

SEQ ID NO: 3056649 - RNA, 21 nt, Mycobacterium bovis subsp bovis AF2122/97
cgggugcgaucgcaacaccgg

SEQ ID NO: 3056650 - RNA, 12 nt, Mycobacterium bovis subsp bovis AF2122/97
cgggugcgcacc

SEQ ID NO: 3056651 - RNA, 17 nt, Mycobacterium bovis subsp bovis AF2122/97
cgggugcgcacccgggu

SEQ ID NO: 3056652 - RNA, 14 nt, Mycobacterium bovis subsp bovis AF2122/97
cgggugcgccggcg

SEQ ID NO: 3056653 - RNA, 18 nt, Mycobacterium bovis subsp bovis AF2122/97
cgggugcgccggcguuug

SEQ ID NO: 3056654 - RNA, 18 nt, Mycobacterium bovis subsp bovis AF2122/97
cgggugcgccguugccgc

SEQ ID NO: 3056655 - RNA, 20 nt, Mycobacterium bovis subsp bovis AF2122/97
cgggugcgccguugccgccg

SEQ ID NO: 3056656 - RNA, 15 nt, Mycobacterium bovis subsp bovis AF2122/97
cgggugcgcugcagc

SEQ ID NO: 3056657 - RNA, 16 nt, Mycobacterium bovis subsp bovis AF2122/97
cgggugcgcugcagcg

SEQ ID NO: 3056658 - RNA, 14 nt, Mycobacterium bovis subsp bovis AF2122/97
cgggugcgcugcga

SEQ ID NO: 3056659 - RNA, 19 nt, Mycobacterium bovis subsp bovis AF2122/97
cgggugcgcugcgaucacc

SEQ ID NO: 3056660 - RNA, 14 nt, Mycobacterium bovis subsp bovis AF2122/97
cgggugcgggccga

SEQ ID NO: 3056661 - RNA, 21 nt, Mycobacterium bovis subsp bovis AF2122/97
cgggugcgggccgaacacacc

SEQ ID NO: 3056662 - RNA, 22 nt, Mycobacterium bovis subsp bovis AF2122/97
cgggugcgggccgaacacaccg

SEQ ID NO: 3056663 - RNA, 23 nt, Mycobacterium bovis subsp bovis AF2122/97
cgggugcgggccgaacacaccgg

SEQ ID NO: 3056664 - RNA, 19 nt, Mycobacterium bovis subsp bovis AF2122/97
cgggugcgggcgugguaac

SEQ ID NO: 3056665 - RNA, 17 nt, Mycobacterium bovis subsp bovis AF2122/97
cgggugcgugcgcgucg

SEQ ID NO: 3056666 - RNA, 18 nt, Mycobacterium bovis subsp bovis AF2122/97
cgggugcgugcgcgucgg

SEQ ID NO: 3056667 - RNA, 18 nt, Mycobacterium bovis subsp bovis AF2122/97
cgggugcuacuggguggg

SEQ ID NO: 3056668 - RNA, 19 nt, Mycobacterium bovis subsp bovis AF2122/97
cgggugcuacugggugggu

SEQ ID NO: 3056669 - RNA, 23 nt, Mycobacterium bovis subsp bovis AF2122/97
cgggugcuacuggguggguagcu

SEQ ID NO: 3056670 - RNA, 16 nt, Mycobacterium bovis subsp bovis AF2122/97
cgggugcugauggguc

SEQ ID NO: 3056671 - RNA, 22 nt, Mycobacterium bovis subsp bovis AF2122/97
cgggugcugaugggucaggccg

SEQ ID NO: 3056672 - RNA, 23 nt, Mycobacterium bovis subsp bovis AF2122/97
cgggugcugaugggucaggccga

SEQ ID NO: 3056673 - RNA, 23 nt, Mycobacterium bovis subsp bovis AF2122/97
cgggugcuggucaacagcggcaa

SEQ ID NO: 3056674 - RNA, 18 nt, Mycobacterium bovis subsp bovis AF2122/97
cggguggaguuggcugcc

SEQ ID NO: 3056675 - RNA, 19 nt, Mycobacterium bovis subsp bovis AF2122/97
cggguggaguuggcugccg

SEQ ID NO: 3056676 - RNA, 20 nt, Mycobacterium bovis subsp bovis AF2122/97
cggguggaguuggcugccgg

SEQ ID NO: 3056677 - RNA, 19 nt, Mycobacterium bovis subsp bovis AF2122/97
cggguggaucuucaccucg

SEQ ID NO: 3056678 - RNA, 16 nt, Mycobacterium bovis subsp bovis AF2122/97
cggguggcagcggcga

SEQ ID NO: 3056679 - RNA, 13 nt, Mycobacterium bovis subsp bovis AF2122/97
cggguggccacga

SEQ ID NO: 3056680 - RNA, 18 nt, Mycobacterium bovis subsp bovis AF2122/97
cggguggccacgcccagg

SEQ ID NO: 3056681 - RNA, 19 nt, Mycobacterium bovis subsp bovis AF2122/97
cggguggccacgcccaggc

SEQ ID NO: 3056682 - RNA, 20 nt, Mycobacterium bovis subsp bovis AF2122/97
cggguggcccccgccggcca

SEQ ID NO: 3056683 - RNA, 18 nt, Mycobacterium bovis subsp bovis AF2122/97
cggguggcccggaacacc

SEQ ID NO: 3056684 - RNA, 22 nt, Mycobacterium bovis subsp bovis AF2122/97
cggguggcgaggcagcacccgc

SEQ ID NO: 3056685 - RNA, 19 nt, Mycobacterium bovis subsp bovis AF2122/97
cggguggcgccggugcggc

SEQ ID NO: 3056686 - RNA, 15 nt, Mycobacterium bovis subsp bovis AF2122/97
cggguggcgucaccg

SEQ ID NO: 3056687 - RNA, 19 nt, Mycobacterium bovis subsp bovis AF2122/97
cggguggcgucaccgccgg

SEQ ID NO: 3056688 - RNA, 20 nt, Mycobacterium bovis subsp bovis AF2122/97
cggguggcgucaccgccggu

SEQ ID NO: 3056689 - RNA, 21 nt, Mycobacterium bovis subsp bovis AF2122/97
cggguggcuuccggggugaca

SEQ ID NO: 3056690 - RNA, 19 nt, Mycobacterium bovis subsp bovis AF2122/97
cgggugggacaccaucucc

SEQ ID NO: 3056691 - RNA, 16 nt, Mycobacterium bovis subsp bovis AF2122/97
cgggugggagcagccg

SEQ ID NO: 3056692 - RNA, 19 nt, Mycobacterium bovis subsp bovis AF2122/97
cgggugggagcagccgaac

SEQ ID NO: 3056693 - RNA, 23 nt, Mycobacterium bovis subsp bovis AF2122/97
cgggugggcaagcugaccgccag

SEQ ID NO: 3056694 - RNA, 15 nt, Mycobacterium bovis subsp bovis AF2122/97
cgggugggcacaccg

SEQ ID NO: 3056695 - RNA, 14 nt, Mycobacterium bovis subsp bovis AF2122/97
cgggugggccagug

SEQ ID NO: 3056696 - RNA, 15 nt, Mycobacterium bovis subsp bovis AF2122/97
cggguggugagcuga

SEQ ID NO: 3056697 - RNA, 22 nt, Mycobacterium bovis subsp bovis AF2122/97
cggguggugagcugaaggcccg

SEQ ID NO: 3056698 - RNA, 14 nt, Mycobacterium bovis subsp bovis AF2122/97
cggguggugccggc

SEQ ID NO: 3056699 - RNA, 17 nt, Mycobacterium bovis subsp bovis AF2122/97
cggguggugccggcgga

SEQ ID NO: 3056700 - RNA, 15 nt, Mycobacterium bovis subsp bovis AF2122/97
cggguggugcggccg

SEQ ID NO: 3056701 - RNA, 16 nt, Mycobacterium bovis subsp bovis AF2122/97
cggguggugcggccgu

SEQ ID NO: 3056702 - RNA, 23 nt, Mycobacterium bovis subsp bovis AF2122/97
cgggugguucaccucggcgacga

SEQ ID NO: 3056703 - RNA, 18 nt, Mycobacterium bovis subsp bovis AF2122/97
cgggugguuguucggcca

SEQ ID NO: 3056704 - RNA, 16 nt, Mycobacterium bovis subsp bovis AF2122/97
cgggugguuugcgccc

SEQ ID NO: 3056705 - RNA, 19 nt, Mycobacterium bovis subsp bovis AF2122/97
cgggugucacagugguggg

SEQ ID NO: 3056706 - RNA, 13 nt, Mycobacterium bovis subsp bovis AF2122/97
cgggugucgggcg

SEQ ID NO: 3056707 - RNA, 20 nt, Mycobacterium bovis subsp bovis AF2122/97
cgggugugcgucgagguggc

SEQ ID NO: 3056708 - RNA, 14 nt, Mycobacterium bovis subsp bovis AF2122/97
cggguguggccguu

SEQ ID NO: 3056709 - RNA, 14 nt, Mycobacterium bovis subsp bovis AF2122/97
cggguguggucacc

SEQ ID NO: 3056710 - RNA, 15 nt, Mycobacterium bovis subsp bovis AF2122/97
cggguguuccacacc

SEQ ID NO: 3056711 - RNA, 17 nt, Mycobacterium bovis subsp bovis AF2122/97
cggguguuccacaccag

SEQ ID NO: 3056712 - RNA, 18 nt, Mycobacterium bovis subsp bovis AF2122/97
cggguguuccacaccagg

SEQ ID NO: 3056713 - RNA, 18 nt, Mycobacterium bovis subsp bovis AF2122/97
cggguguucgcgcgcgac

SEQ ID NO: 3056714 - RNA, 19 nt, Mycobacterium bovis subsp bovis AF2122/97
cggguguucgcgcgcgacu

SEQ ID NO: 3056715 - RNA, 18 nt, Mycobacterium bovis subsp bovis AF2122/97
cgguagcauccagcgcgc

SEQ ID NO: 3056716 - RNA, 23 nt, Mycobacterium bovis subsp bovis AF2122/97
cgguagcauccagcgcgcgcuga

SEQ ID NO: 3056717 - RNA, 17 nt, Mycobacterium bovis subsp bovis AF2122/97
cgguagccaagcgagcg

SEQ ID NO: 3056718 - RNA, 20 nt, Mycobacterium bovis subsp bovis AF2122/97
cgguagccccgucgaccucc

SEQ ID NO: 3056719 - RNA, 15 nt, Mycobacterium bovis subsp bovis AF2122/97
cgguagccgaccagc

SEQ ID NO: 3056720 - RNA, 14 nt, Mycobacterium bovis subsp bovis AF2122/97
cgguagccgaccga

SEQ ID NO: 3056721 - RNA, 13 nt, Mycobacterium bovis subsp bovis AF2122/97
cgguagccgacga

SEQ ID NO: 3056722 - RNA, 20 nt, Mycobacterium bovis subsp bovis AF2122/97
cgguagccgacgacacgggu

SEQ ID NO: 3056723 - RNA, 14 nt, Mycobacterium bovis subsp bovis AF2122/97
cgguagccgagcuc

SEQ ID NO: 3056724 - RNA, 15 nt, Mycobacterium bovis subsp bovis AF2122/97
cgguagccgggcacc

SEQ ID NO: 3056725 - RNA, 16 nt, Mycobacterium bovis subsp bovis AF2122/97
cgguagccuggcuguc

SEQ ID NO: 3056726 - RNA, 19 nt, Mycobacterium bovis subsp bovis AF2122/97
cgguagccuggcuguccgc

SEQ ID NO: 3056727 - RNA, 20 nt, Mycobacterium bovis subsp bovis AF2122/97
cgguagcgaucgugcugccc

SEQ ID NO: 3056728 - RNA, 22 nt, Mycobacterium bovis subsp bovis AF2122/97
cgguagcgaucgugcugcccgc

SEQ ID NO: 3056729 - RNA, 14 nt, Mycobacterium bovis subsp bovis AF2122/97
cgguagcgcgggug

SEQ ID NO: 3056730 - RNA, 15 nt, Mycobacterium bovis subsp bovis AF2122/97
cgguagcggaccugc

SEQ ID NO: 3056731 - RNA, 17 nt, Mycobacterium bovis subsp bovis AF2122/97
cgguagcucauugccga

SEQ ID NO: 3056732 - RNA, 14 nt, Mycobacterium bovis subsp bovis AF2122/97
cgguagcucgucga

SEQ ID NO: 3056733 - RNA, 14 nt, Mycobacterium bovis subsp bovis AF2122/97
cgguagcugcccag

SEQ ID NO: 3056734 - RNA, 22 nt, Mycobacterium bovis subsp bovis AF2122/97
cgguagcuuccgcgacgcucgc

SEQ ID NO: 3056735 - RNA, 24 nt, Mycobacterium bovis subsp bovis AF2122/97
cgguaggcaccgaucggugccggc

SEQ ID NO: 3056736 - RNA, 23 nt, Mycobacterium bovis subsp bovis AF2122/97
cgguaggcaggccggcucgccga

SEQ ID NO: 3056737 - RNA, 13 nt, Mycobacterium bovis subsp bovis AF2122/97
cgguaggcgagac

SEQ ID NO: 3056738 - RNA, 15 nt, Mycobacterium bovis subsp bovis AF2122/97
cgguaggcggccagc

SEQ ID NO: 3056739 - RNA, 18 nt, Mycobacterium bovis subsp bovis AF2122/97
cgguaggcggccagcgcg

SEQ ID NO: 3056740 - RNA, 19 nt, Mycobacterium bovis subsp bovis AF2122/97
cgguaggugcaugucgaug

SEQ ID NO: 3056741 - RNA, 15 nt, Mycobacterium bovis subsp bovis AF2122/97
cgguaguagcugacc

SEQ ID NO: 3056742 - RNA, 14 nt, Mycobacterium bovis subsp bovis AF2122/97
cgguaguccgcgcu

SEQ ID NO: 3056743 - RNA, 17 nt, Mycobacterium bovis subsp bovis AF2122/97
cgguaguccgcgcucag

SEQ ID NO: 3056744 - RNA, 12 nt, Mycobacterium bovis subsp bovis AF2122/97
cgguaguccgcu

SEQ ID NO: 3056745 - RNA, 13 nt, Mycobacterium bovis subsp bovis AF2122/97
cgguaguccggcu

SEQ ID NO: 3056746 - RNA, 13 nt, Mycobacterium bovis subsp bovis AF2122/97
cgguagucgaugc

SEQ ID NO: 3056747 - RNA, 15 nt, Mycobacterium bovis subsp bovis AF2122/97
cgguagugucguagg

SEQ ID NO: 3056748 - RNA, 19 nt, Mycobacterium bovis subsp bovis AF2122/97
cgguaguuaacccagggcc

SEQ ID NO: 3056749 - RNA, 15 nt, Mycobacterium bovis subsp bovis AF2122/97
cgguaguugcgcggc

SEQ ID NO: 3056750 - RNA, 17 nt, Mycobacterium bovis subsp bovis AF2122/97
cgguaguugcgcggcau

SEQ ID NO: 3056751 - RNA, 18 nt, Mycobacterium bovis subsp bovis AF2122/97
cgguaguugcgcggcauc

SEQ ID NO: 3056752 - RNA, 20 nt, Mycobacterium bovis subsp bovis AF2122/97
cgguaguugcgcggcauccc

SEQ ID NO: 3056753 - RNA, 16 nt, Mycobacterium bovis subsp bovis AF2122/97
cgguauacccggcccc

SEQ ID NO: 3056754 - RNA, 23 nt, Mycobacterium bovis subsp bovis AF2122/97
cgguauagccaagugagcgaucg

SEQ ID NO: 3056755 - RNA, 17 nt, Mycobacterium bovis subsp bovis AF2122/97
cgguaucccccagccgc

SEQ ID NO: 3056756 - RNA, 15 nt, Mycobacterium bovis subsp bovis AF2122/97
cgguaucccucaagg

SEQ ID NO: 3056757 - RNA, 19 nt, Mycobacterium bovis subsp bovis AF2122/97
cgguaucgagggcagccgc

SEQ ID NO: 3056758 - RNA, 22 nt, Mycobacterium bovis subsp bovis AF2122/97
cgguaucgagggcagccgccca

SEQ ID NO: 3056759 - RNA, 23 nt, Mycobacterium bovis subsp bovis AF2122/97
cgguaucgccgcuacgccggccc

SEQ ID NO: 3056760 - RNA, 15 nt, Mycobacterium bovis subsp bovis AF2122/97
cgguaucggcgacca

SEQ ID NO: 3056761 - RNA, 18 nt, Mycobacterium bovis subsp bovis AF2122/97
cgguaucggcgaccagcu

SEQ ID NO: 3056762 - RNA, 18 nt, Mycobacterium bovis subsp bovis AF2122/97
cgguaucggucagccacg

SEQ ID NO: 3056763 - RNA, 17 nt, Mycobacterium bovis subsp bovis AF2122/97
cgguaucggugcugguc

SEQ ID NO: 3056764 - RNA, 22 nt, Mycobacterium bovis subsp bovis AF2122/97
cgguaucgucccggcgaccggg

SEQ ID NO: 3056765 - RNA, 21 nt, Mycobacterium bovis subsp bovis AF2122/97
cgguaugcgcguccccagcgc

SEQ ID NO: 3056766 - RNA, 13 nt, Mycobacterium bovis subsp bovis AF2122/97
cgguaugcucgcu

SEQ ID NO: 3056767 - RNA, 18 nt, Mycobacterium bovis subsp bovis AF2122/97
cgguaugcucgcuggcgc

SEQ ID NO: 3056768 - RNA, 18 nt, Mycobacterium bovis subsp bovis AF2122/97
cgguauucccgcuuggcg

SEQ ID NO: 3056769 - RNA, 18 nt, Mycobacterium bovis subsp bovis AF2122/97
cggucaaaccggugccgg

SEQ ID NO: 3056770 - RNA, 19 nt, Mycobacterium bovis subsp bovis AF2122/97
cggucaaacgcgcgcgcca

SEQ ID NO: 3056771 - RNA, 21 nt, Mycobacterium bovis subsp bovis AF2122/97
cggucaaacugccaucggaca

SEQ ID NO: 3056772 - RNA, 20 nt, Mycobacterium bovis subsp bovis AF2122/97
cggucaaagaugucgcuggg

SEQ ID NO: 3056773 - RNA, 21 nt, Mycobacterium bovis subsp bovis AF2122/97
cggucaaagaugucgcugggu

SEQ ID NO: 3056774 - RNA, 18 nt, Mycobacterium bovis subsp bovis AF2122/97
cggucaaauccagcagcc

SEQ ID NO: 3056775 - RNA, 19 nt, Mycobacterium bovis subsp bovis AF2122/97
cggucaaauccagcagcca

SEQ ID NO: 3056776 - RNA, 13 nt, Mycobacterium bovis subsp bovis AF2122/97
cggucaacgacag

SEQ ID NO: 3056777 - RNA, 18 nt, Mycobacterium bovis subsp bovis AF2122/97
cggucaacgaucccgggg

SEQ ID NO: 3056778 - RNA, 13 nt, Mycobacterium bovis subsp bovis AF2122/97
cggucaacucgaa

SEQ ID NO: 3056779 - RNA, 14 nt, Mycobacterium bovis subsp bovis AF2122/97
cggucaagccggcg

SEQ ID NO: 3056780 - RNA, 16 nt, Mycobacterium bovis subsp bovis AF2122/97
cggucaagccggcgcc

SEQ ID NO: 3056781 - RNA, 18 nt, Mycobacterium bovis subsp bovis AF2122/97
cggucaaucccggccagg

SEQ ID NO: 3056782 - RNA, 21 nt, Mycobacterium bovis subsp bovis AF2122/97
cggucaaucccggccaggggc

SEQ ID NO: 3056783 - RNA, 23 nt, Mycobacterium bovis subsp bovis AF2122/97
cggucaaugccacuaggaaggug

SEQ ID NO: 3056784 - RNA, 16 nt, Mycobacterium bovis subsp bovis AF2122/97
cggucaauugugcggc

SEQ ID NO: 3056785 - RNA, 18 nt, Mycobacterium bovis subsp bovis AF2122/97
cggucaauugugcggccc

SEQ ID NO: 3056786 - RNA, 19 nt, Mycobacterium bovis subsp bovis AF2122/97
cggucaauugugcggcccc

SEQ ID NO: 3056787 - RNA, 12 nt, Mycobacterium bovis subsp bovis AF2122/97
cggucacaccga

SEQ ID NO: 3056788 - RNA, 16 nt, Mycobacterium bovis subsp bovis AF2122/97
cggucacacgccagcc

SEQ ID NO: 3056789 - RNA, 19 nt, Mycobacterium bovis subsp bovis AF2122/97
cggucacacgccagccggu

SEQ ID NO: 3056790 - RNA, 12 nt, Mycobacterium bovis subsp bovis AF2122/97
cggucaccaccg

SEQ ID NO: 3056791 - RNA, 23 nt, Mycobacterium bovis subsp bovis AF2122/97
cggucaccaccgacccgcugcca

SEQ ID NO: 3056792 - RNA, 14 nt, Mycobacterium bovis subsp bovis AF2122/97
cggucaccaccgug

SEQ ID NO: 3056793 - RNA, 17 nt, Mycobacterium bovis subsp bovis AF2122/97
cggucaccacgcggcgg

SEQ ID NO: 3056794 - RNA, 16 nt, Mycobacterium bovis subsp bovis AF2122/97
cggucaccauggcgcc

SEQ ID NO: 3056795 - RNA, 18 nt, Mycobacterium bovis subsp bovis AF2122/97
cggucaccauggcgccgc

SEQ ID NO: 3056796 - RNA, 20 nt, Mycobacterium bovis subsp bovis AF2122/97
cggucaccauggcgccgcgc

SEQ ID NO: 3056797 - RNA, 21 nt, Mycobacterium bovis subsp bovis AF2122/97
cggucaccauggcgccgcgcc

SEQ ID NO: 3056798 - RNA, 23 nt, Mycobacterium bovis subsp bovis AF2122/97
cggucaccauggcgccgcgccga

SEQ ID NO: 3056799 - RNA, 14 nt, Mycobacterium bovis subsp bovis AF2122/97
cggucaccccggcu

SEQ ID NO: 3056800 - RNA, 17 nt, Mycobacterium bovis subsp bovis AF2122/97
cggucaccccggcucgg

SEQ ID NO: 3056801 - RNA, 17 nt, Mycobacterium bovis subsp bovis AF2122/97
cgguccaucagcacggu

SEQ ID NO: 3056802 - RNA, 20 nt, Mycobacterium bovis subsp bovis AF2122/97
cgguccaucccgagcuccgc

SEQ ID NO: 3056803 - RNA, 17 nt, Mycobacterium bovis subsp bovis AF2122/97
cgguccauggacggcca

SEQ ID NO: 3056804 - RNA, 15 nt, Mycobacterium bovis subsp bovis AF2122/97
cggucccacggccgg

SEQ ID NO: 3056805 - RNA, 18 nt, Mycobacterium bovis subsp bovis AF2122/97
cggucccacggccggccg

SEQ ID NO: 3056806 - RNA, 15 nt, Mycobacterium bovis subsp bovis AF2122/97
cggucccacucgucg

SEQ ID NO: 3056807 - RNA, 22 nt, Mycobacterium bovis subsp bovis AF2122/97
cggucccagguuggagcccgag

SEQ ID NO: 3056808 - RNA, 19 nt, Mycobacterium bovis subsp bovis AF2122/97
cgguccccccguugccgcc

SEQ ID NO: 3056809 - RNA, 20 nt, Mycobacterium bovis subsp bovis AF2122/97
cgguccccccguugccgccg

SEQ ID NO: 3056810 - RNA, 23 nt, Mycobacterium bovis subsp bovis AF2122/97
cgguccccccguugccgccguug

SEQ ID NO: 3056811 - RNA, 14 nt, Mycobacterium bovis subsp bovis AF2122/97
cggucccccgccca

SEQ ID NO: 3056812 - RNA, 14 nt, Mycobacterium bovis subsp bovis AF2122/97
cgguccccgcagcu

SEQ ID NO: 3056813 - RNA, 17 nt, Mycobacterium bovis subsp bovis AF2122/97
cgguccccgcagcucga

SEQ ID NO: 3056814 - RNA, 18 nt, Mycobacterium bovis subsp bovis AF2122/97
cgguccccgccggcgggu

SEQ ID NO: 3056815 - RNA, 16 nt, Mycobacterium bovis subsp bovis AF2122/97
cggucccgcauauccg

SEQ ID NO: 3056816 - RNA, 13 nt, Mycobacterium bovis subsp bovis AF2122/97
cggucccgccggu

SEQ ID NO: 3056817 - RNA, 17 nt, Mycobacterium bovis subsp bovis AF2122/97
cggucccgccgugccgc

SEQ ID NO: 3056818 - RNA, 19 nt, Mycobacterium bovis subsp bovis AF2122/97
cggucccggacgugccggg

SEQ ID NO: 3056819 - RNA, 13 nt, Mycobacterium bovis subsp bovis AF2122/97
cggucccggcacg

SEQ ID NO: 3056820 - RNA, 19 nt, Mycobacterium bovis subsp bovis AF2122/97
cggucccggcacgucgacc

SEQ ID NO: 3056821 - RNA, 17 nt, Mycobacterium bovis subsp bovis AF2122/97
cggucccguugccgccc

SEQ ID NO: 3056822 - RNA, 18 nt, Mycobacterium bovis subsp bovis AF2122/97
cggucccguugccgccca

SEQ ID NO: 3056823 - RNA, 17 nt, Mycobacterium bovis subsp bovis AF2122/97
cggucccuuuguggggc

SEQ ID NO: 3056824 - RNA, 23 nt, Mycobacterium bovis subsp bovis AF2122/97
cggucccuuuguggggccgggcu

SEQ ID NO: 3056825 - RNA, 18 nt, Mycobacterium bovis subsp bovis AF2122/97
cgguccgagcggcaucgg

SEQ ID NO: 3056826 - RNA, 18 nt, Mycobacterium bovis subsp bovis AF2122/97
cgguccgaugcgcgcggc

SEQ ID NO: 3056827 - RNA, 15 nt, Mycobacterium bovis subsp bovis AF2122/97
cgguccgccacggcg

SEQ ID NO: 3056828 - RNA, 17 nt, Mycobacterium bovis subsp bovis AF2122/97
cgguccgccacggcggg

SEQ ID NO: 3056829 - RNA, 23 nt, Mycobacterium bovis subsp bovis AF2122/97
cgguccgccacggcgggcgaccc

SEQ ID NO: 3056830 - RNA, 16 nt, Mycobacterium bovis subsp bovis AF2122/97
cgguccgccagcgcga

SEQ ID NO: 3056831 - RNA, 12 nt, Mycobacterium bovis subsp bovis AF2122/97
cgguccgccauu

SEQ ID NO: 3056832 - RNA, 13 nt, Mycobacterium bovis subsp bovis AF2122/97
cgguccgccgccu

SEQ ID NO: 3056833 - RNA, 18 nt, Mycobacterium bovis subsp bovis AF2122/97
cgguccgcugccaucggc

SEQ ID NO: 3056834 - RNA, 20 nt, Mycobacterium bovis subsp bovis AF2122/97
cgguccggaaauuccggcgc

SEQ ID NO: 3056835 - RNA, 16 nt, Mycobacterium bovis subsp bovis AF2122/97
cgguccggcccaccag

SEQ ID NO: 3056836 - RNA, 17 nt, Mycobacterium bovis subsp bovis AF2122/97
cgguccggcuucggcga

SEQ ID NO: 3056837 - RNA, 22 nt, Mycobacterium bovis subsp bovis AF2122/97
cgguccggcuucggcgaacccu

SEQ ID NO: 3056838 - RNA, 22 nt, Mycobacterium bovis subsp bovis AF2122/97
cgguccggggcaacgaucaggu

SEQ ID NO: 3056839 - RNA, 12 nt, Mycobacterium bovis subsp bovis AF2122/97
cgguccggucgc

SEQ ID NO: 3056840 - RNA, 16 nt, Mycobacterium bovis subsp bovis AF2122/97
cgguccggugaugguc

SEQ ID NO: 3056841 - RNA, 14 nt, Mycobacterium bovis subsp bovis AF2122/97
cgguccgucaccac

SEQ ID NO: 3056842 - RNA, 18 nt, Mycobacterium bovis subsp bovis AF2122/97
cgguccgucaccaccgcc

SEQ ID NO: 3056843 - RNA, 20 nt, Mycobacterium bovis subsp bovis AF2122/97
cgguccgucaccaccgccgc

SEQ ID NO: 3056844 - RNA, 22 nt, Mycobacterium bovis subsp bovis AF2122/97
cgguccgucaccaccgccgcca

SEQ ID NO: 3056845 - RNA, 16 nt, Mycobacterium bovis subsp bovis AF2122/97
cgguccucgagccgau

SEQ ID NO: 3056846 - RNA, 13 nt, Mycobacterium bovis subsp bovis AF2122/97
cgguccucgaucg

SEQ ID NO: 3056847 - RNA, 16 nt, Mycobacterium bovis subsp bovis AF2122/97
cgguccugccaaugcu

SEQ ID NO: 3056848 - RNA, 23 nt, Mycobacterium bovis subsp bovis AF2122/97
cgguccugggauccggcggcagg

SEQ ID NO: 3056849 - RNA, 14 nt, Mycobacterium bovis subsp bovis AF2122/97
cggucgaacaucau

SEQ ID NO: 3056850 - RNA, 18 nt, Mycobacterium bovis subsp bovis AF2122/97
cggucgaagagguggggc

SEQ ID NO: 3056851 - RNA, 23 nt, Mycobacterium bovis subsp bovis AF2122/97
cggucgaagcuggcacgcagagc

SEQ ID NO: 3056852 - RNA, 14 nt, Mycobacterium bovis subsp bovis AF2122/97
cggucgacagcgca

SEQ ID NO: 3056853 - RNA, 15 nt, Mycobacterium bovis subsp bovis AF2122/97
cggucgaccgugcgu

SEQ ID NO: 3056854 - RNA, 15 nt, Mycobacterium bovis subsp bovis AF2122/97
cggucgacgaucucg

SEQ ID NO: 3056855 - RNA, 22 nt, Mycobacterium bovis subsp bovis AF2122/97
cggucgacgggucggcgccgag

SEQ ID NO: 3056856 - RNA, 20 nt, Mycobacterium bovis subsp bovis AF2122/97
cggucgacggguucacccug

SEQ ID NO: 3056857 - RNA, 13 nt, Mycobacterium bovis subsp bovis AF2122/97
cggucgacuccag

SEQ ID NO: 3056858 - RNA, 16 nt, Mycobacterium bovis subsp bovis AF2122/97
cggucgacuccagcac

SEQ ID NO: 3056859 - RNA, 17 nt, Mycobacterium bovis subsp bovis AF2122/97
cggucgacuccagcacc

SEQ ID NO: 3056860 - RNA, 20 nt, Mycobacterium bovis subsp bovis AF2122/97
cggucgacuccagcaccagc

SEQ ID NO: 3056861 - RNA, 23 nt, Mycobacterium bovis subsp bovis AF2122/97
cggucgagacgcuuuccgccgca

SEQ ID NO: 3056862 - RNA, 16 nt, Mycobacterium bovis subsp bovis AF2122/97
cggucgagccagcgga

SEQ ID NO: 3056863 - RNA, 19 nt, Mycobacterium bovis subsp bovis AF2122/97
cggucgagcuucaucccgg

SEQ ID NO: 3056864 - RNA, 19 nt, Mycobacterium bovis subsp bovis AF2122/97
cggucgaguccacagcgca

SEQ ID NO: 3056865 - RNA, 23 nt, Mycobacterium bovis subsp bovis AF2122/97
cggucgagugccucgaccuggau

SEQ ID NO: 3056866 - RNA, 19 nt, Mycobacterium bovis subsp bovis AF2122/97
cggucgaucaacaccaacg

SEQ ID NO: 3056867 - RNA, 20 nt, Mycobacterium bovis subsp bovis AF2122/97
cggucgaucauggcggcagc

SEQ ID NO: 3056868 - RNA, 14 nt, Mycobacterium bovis subsp bovis AF2122/97
cggucgaugaccuc

SEQ ID NO: 3056869 - RNA, 19 nt, Mycobacterium bovis subsp bovis AF2122/97
cggucgaugaucucgcccc

SEQ ID NO: 3056870 - RNA, 22 nt, Mycobacterium bovis subsp bovis AF2122/97
cggucgaugaucucgccccagu

SEQ ID NO: 3056871 - RNA, 14 nt, Mycobacterium bovis subsp bovis AF2122/97
cggucgauguccgc

SEQ ID NO: 3056872 - RNA, 17 nt, Mycobacterium bovis subsp bovis AF2122/97
cggucgauguccgcagc

SEQ ID NO: 3056873 - RNA, 18 nt, Mycobacterium bovis subsp bovis AF2122/97
cggucgauguccgcagca

SEQ ID NO: 3056874 - RNA, 18 nt, Mycobacterium bovis subsp bovis AF2122/97
cggucgcacuuggccccc

SEQ ID NO: 3056875 - RNA, 20 nt, Mycobacterium bovis subsp bovis AF2122/97
cggucgcacuuggcccccga

SEQ ID NO: 3056876 - RNA, 15 nt, Mycobacterium bovis subsp bovis AF2122/97
cggucgcagcagacc

SEQ ID NO: 3056877 - RNA, 18 nt, Mycobacterium bovis subsp bovis AF2122/97
cggucgcagugcacccgg

SEQ ID NO: 3056878 - RNA, 21 nt, Mycobacterium bovis subsp bovis AF2122/97
cggucgcagugcacccgggcc

SEQ ID NO: 3056879 - RNA, 23 nt, Mycobacterium bovis subsp bovis AF2122/97
cggucgcagugcacccgggccgc

SEQ ID NO: 3056880 - RNA, 18 nt, Mycobacterium bovis subsp bovis AF2122/97
cggucgcauggucgacga

SEQ ID NO: 3056881 - RNA, 20 nt, Mycobacterium bovis subsp bovis AF2122/97
cggucgcauggucgacgaac

SEQ ID NO: 3056882 - RNA, 18 nt, Mycobacterium bovis subsp bovis AF2122/97
cggucgccacacccgcga

SEQ ID NO: 3056883 - RNA, 13 nt, Mycobacterium bovis subsp bovis AF2122/97
cggucgccaccgc

SEQ ID NO: 3056884 - RNA, 14 nt, Mycobacterium bovis subsp bovis AF2122/97
cggucgccaccgcc

SEQ ID NO: 3056885 - RNA, 15 nt, Mycobacterium bovis subsp bovis AF2122/97
cggucgccaccgccg

SEQ ID NO: 3056886 - RNA, 19 nt, Mycobacterium bovis subsp bovis AF2122/97
cggucgccaccgccggcag

SEQ ID NO: 3056887 - RNA, 17 nt, Mycobacterium bovis subsp bovis AF2122/97
cggucguuggucggggu

SEQ ID NO: 3056888 - RNA, 18 nt, Mycobacterium bovis subsp bovis AF2122/97
cggucguuggugcagacc

SEQ ID NO: 3056889 - RNA, 18 nt, Mycobacterium bovis subsp bovis AF2122/97
cggucuauuugccugccg

SEQ ID NO: 3056890 - RNA, 21 nt, Mycobacterium bovis subsp bovis AF2122/97
cggucucagugcucgcccagu

SEQ ID NO: 3056891 - RNA, 17 nt, Mycobacterium bovis subsp bovis AF2122/97
cggucucauagugcagg

SEQ ID NO: 3056892 - RNA, 16 nt, Mycobacterium bovis subsp bovis AF2122/97
cggucucaugcacccg

SEQ ID NO: 3056893 - RNA, 14 nt, Mycobacterium bovis subsp bovis AF2122/97
cggucuccaccacc

SEQ ID NO: 3056894 - RNA, 22 nt, Mycobacterium bovis subsp bovis AF2122/97
cggucuccaccaccgacgagga

SEQ ID NO: 3056895 - RNA, 19 nt, Mycobacterium bovis subsp bovis AF2122/97
cggucuccccagagcuggu

SEQ ID NO: 3056896 - RNA, 15 nt, Mycobacterium bovis subsp bovis AF2122/97
cggucuccgcugaug

SEQ ID NO: 3056897 - RNA, 17 nt, Mycobacterium bovis subsp bovis AF2122/97
cggucucgaccgcgccu

SEQ ID NO: 3056898 - RNA, 18 nt, Mycobacterium bovis subsp bovis AF2122/97
cggucucgacggcggccg

SEQ ID NO: 3056899 - RNA, 16 nt, Mycobacterium bovis subsp bovis AF2122/97
cggucucgucgcgggu

SEQ ID NO: 3056900 - RNA, 22 nt, Mycobacterium bovis subsp bovis AF2122/97
cggucugcagaucguagugcgc

SEQ ID NO: 3056901 - RNA, 13 nt, Mycobacterium bovis subsp bovis AF2122/97
cggucugcaugcg

SEQ ID NO: 3056902 - RNA, 20 nt, Mycobacterium bovis subsp bovis AF2122/97
cggucugcaugcgcuggaau

SEQ ID NO: 3056903 - RNA, 21 nt, Mycobacterium bovis subsp bovis AF2122/97
cggucugcgccaaaauccgcc

SEQ ID NO: 3056904 - RNA, 15 nt, Mycobacterium bovis subsp bovis AF2122/97
cggucugcuccaggc

SEQ ID NO: 3056905 - RNA, 17 nt, Mycobacterium bovis subsp bovis AF2122/97
cggucugcuccaggcgc

SEQ ID NO: 3056906 - RNA, 22 nt, Mycobacterium bovis subsp bovis AF2122/97
cggucugcuccaggcgcgccgc

SEQ ID NO: 3056907 - RNA, 21 nt, Mycobacterium bovis subsp bovis AF2122/97
cggucugcuccuuggcccagc

SEQ ID NO: 3056908 - RNA, 20 nt, Mycobacterium bovis subsp bovis AF2122/97
cggucuggaucagaucccgc

SEQ ID NO: 3056909 - RNA, 14 nt, Mycobacterium bovis subsp bovis AF2122/97
cggucuggcgauga

SEQ ID NO: 3056910 - RNA, 15 nt, Mycobacterium bovis subsp bovis AF2122/97
cggucugguggucgg

SEQ ID NO: 3056911 - RNA, 18 nt, Mycobacterium bovis subsp bovis AF2122/97
cggucugguggucggcga

SEQ ID NO: 3056912 - RNA, 15 nt, Mycobacterium bovis subsp bovis AF2122/97
cggucuugcaucgcc

SEQ ID NO: 3056913 - RNA, 16 nt, Mycobacterium bovis subsp bovis AF2122/97
cggucuugccgcaggc

SEQ ID NO: 3056914 - RNA, 17 nt, Mycobacterium bovis subsp bovis AF2122/97
cggucuugccgcaggcc

SEQ ID NO: 3056915 - RNA, 19 nt, Mycobacterium bovis subsp bovis AF2122/97
cggucuugccgcaggccug

SEQ ID NO: 3056916 - RNA, 16 nt, Mycobacterium bovis subsp bovis AF2122/97
cggucuuggcgaucca

SEQ ID NO: 3056917 - RNA, 21 nt, Mycobacterium bovis subsp bovis AF2122/97
cggucuuggcgauccaggcca

SEQ ID NO: 3056918 - RNA, 18 nt, Mycobacterium bovis subsp bovis AF2122/97
cggucuugggcgcgggug

SEQ ID NO: 3056919 - RNA, 13 nt, Mycobacterium bovis subsp bovis AF2122/97
cggucuuggugcu

SEQ ID NO: 3056920 - RNA, 21 nt, Mycobacterium bovis subsp bovis AF2122/97
cggucuuuaauccagcgccga

SEQ ID NO: 3056921 - RNA, 15 nt, Mycobacterium bovis subsp bovis AF2122/97
cggucuuuggcauug

SEQ ID NO: 3056922 - RNA, 23 nt, Mycobacterium bovis subsp bovis AF2122/97
cggucuuuggcauugccgccagc

SEQ ID NO: 3056923 - RNA, 18 nt, Mycobacterium bovis subsp bovis AF2122/97
cggucuuuguccgucgcg

SEQ ID NO: 3056924 - RNA, 19 nt, Mycobacterium bovis subsp bovis AF2122/97
cggucuuuguccgucgcgu

SEQ ID NO: 3056925 - RNA, 15 nt, Mycobacterium bovis subsp bovis AF2122/97
cggugaaacgaucgu

SEQ ID NO: 3056926 - RNA, 19 nt, Mycobacterium bovis subsp bovis AF2122/97
cggugaaaucgcacagcgc

SEQ ID NO: 3056927 - RNA, 18 nt, Mycobacterium bovis subsp bovis AF2122/97
cggugaacaaaugccggu

SEQ ID NO: 3056928 - RNA, 20 nt, Mycobacterium bovis subsp bovis AF2122/97
cggugaacaccagcaggaag

SEQ ID NO: 3056929 - RNA, 15 nt, Mycobacterium bovis subsp bovis AF2122/97
cggugaacccgccgg

SEQ ID NO: 3056930 - RNA, 15 nt, Mycobacterium bovis subsp bovis AF2122/97
cggugaacgccgccc

SEQ ID NO: 3056931 - RNA, 17 nt, Mycobacterium bovis subsp bovis AF2122/97
cggugaacgccgccccg

SEQ ID NO: 3056932 - RNA, 18 nt, Mycobacterium bovis subsp bovis AF2122/97
cggugaacgccgccccga

SEQ ID NO: 3056933 - RNA, 20 nt, Mycobacterium bovis subsp bovis AF2122/97
cggugaacggcagcacgguc

SEQ ID NO: 3056934 - RNA, 17 nt, Mycobacterium bovis subsp bovis AF2122/97
cggugaacgguagcacu

SEQ ID NO: 3056935 - RNA, 21 nt, Mycobacterium bovis subsp bovis AF2122/97
cggugaacgucacguggucgg

SEQ ID NO: 3056936 - RNA, 22 nt, Mycobacterium bovis subsp bovis AF2122/97
cggugaacgucacguggucggc

SEQ ID NO: 3056937 - RNA, 21 nt, Mycobacterium bovis subsp bovis AF2122/97
cggugaacugcuggccgaugu

SEQ ID NO: 3056938 - RNA, 18 nt, Mycobacterium bovis subsp bovis AF2122/97
cggugaagaaguucgggu

SEQ ID NO: 3056939 - RNA, 20 nt, Mycobacterium bovis subsp bovis AF2122/97
cggugaagaaguucggguag

SEQ ID NO: 3056940 - RNA, 16 nt, Mycobacterium bovis subsp bovis AF2122/97
cggugaagccgagcgc

SEQ ID NO: 3056941 - RNA, 18 nt, Mycobacterium bovis subsp bovis AF2122/97
cggugaaggccccgccgg

SEQ ID NO: 3056942 - RNA, 18 nt, Mycobacterium bovis subsp bovis AF2122/97
cggugaaguagugcucgc

SEQ ID NO: 3056943 - RNA, 17 nt, Mycobacterium bovis subsp bovis AF2122/97
cggugaaucgaagcccg

SEQ ID NO: 3056944 - RNA, 23 nt, Mycobacterium bovis subsp bovis AF2122/97
cggugaaucgaagcccggcggca

SEQ ID NO: 3056945 - RNA, 17 nt, Mycobacterium bovis subsp bovis AF2122/97
cggugaaucgucugacg

SEQ ID NO: 3056946 - RNA, 16 nt, Mycobacterium bovis subsp bovis AF2122/97
cggugaauguugccgc

SEQ ID NO: 3056947 - RNA, 19 nt, Mycobacterium bovis subsp bovis AF2122/97
cggugaauguugccgccgc

SEQ ID NO: 3056948 - RNA, 14 nt, Mycobacterium bovis subsp bovis AF2122/97
cggugaauucacga

SEQ ID NO: 3056949 - RNA, 23 nt, Mycobacterium bovis subsp bovis AF2122/97
cggugaauucacgaugcucgccg

SEQ ID NO: 3056950 - RNA, 15 nt, Mycobacterium bovis subsp bovis AF2122/97
cggugaauucggcga

SEQ ID NO: 3056951 - RNA, 16 nt, Mycobacterium bovis subsp bovis AF2122/97
cggugaauucggcgag

SEQ ID NO: 3056952 - RNA, 19 nt, Mycobacterium bovis subsp bovis AF2122/97
cggugacaaauucggcgug

SEQ ID NO: 3056953 - RNA, 20 nt, Mycobacterium bovis subsp bovis AF2122/97
cggugacaaauucggcgugu

SEQ ID NO: 3056954 - RNA, 20 nt, Mycobacterium bovis subsp bovis AF2122/97
cggugacaagcggcccgcug

SEQ ID NO: 3056955 - RNA, 17 nt, Mycobacterium bovis subsp bovis AF2122/97
cggugacaaggaugguc

SEQ ID NO: 3056956 - RNA, 16 nt, Mycobacterium bovis subsp bovis AF2122/97
cggugacaccaacacc

SEQ ID NO: 3056957 - RNA, 18 nt, Mycobacterium bovis subsp bovis AF2122/97
cggugacaccaacaccgg

SEQ ID NO: 3056958 - RNA, 20 nt, Mycobacterium bovis subsp bovis AF2122/97
cggugacaccaacaccggug

SEQ ID NO: 3056959 - RNA, 22 nt, Mycobacterium bovis subsp bovis AF2122/97
cggugacauagacguugccgga

SEQ ID NO: 3056960 - RNA, 18 nt, Mycobacterium bovis subsp bovis AF2122/97
cggugaccacuugcagca

SEQ ID NO: 3056961 - RNA, 16 nt, Mycobacterium bovis subsp bovis AF2122/97
cggugaccagcaacca

SEQ ID NO: 3056962 - RNA, 23 nt, Mycobacterium bovis subsp bovis AF2122/97
cggugaccagcaaccaccccagg

SEQ ID NO: 3056963 - RNA, 14 nt, Mycobacterium bovis subsp bovis AF2122/97
cggugaccaggccg

SEQ ID NO: 3056964 - RNA, 14 nt, Mycobacterium bovis subsp bovis AF2122/97
cggugacccccgag

SEQ ID NO: 3056965 - RNA, 12 nt, Mycobacterium bovis subsp bovis AF2122/97
cggugacccgcu

SEQ ID NO: 3056966 - RNA, 14 nt, Mycobacterium bovis subsp bovis AF2122/97
cggugaccggcucg

SEQ ID NO: 3056967 - RNA, 18 nt, Mycobacterium bovis subsp bovis AF2122/97
cggugaccggcucggcgg

SEQ ID NO: 3056968 - RNA, 16 nt, Mycobacterium bovis subsp bovis AF2122/97
cggugaccucggcgac

SEQ ID NO: 3056969 - RNA, 18 nt, Mycobacterium bovis subsp bovis AF2122/97
cggugaccucggcgacca

SEQ ID NO: 3056970 - RNA, 20 nt, Mycobacterium bovis subsp bovis AF2122/97
cggugacgaagagcaccgcg

SEQ ID NO: 3056971 - RNA, 21 nt, Mycobacterium bovis subsp bovis AF2122/97
cggugacgaagagcaccgcgc

SEQ ID NO: 3056972 - RNA, 18 nt, Mycobacterium bovis subsp bovis AF2122/97
cggugacgaccacgucga

SEQ ID NO: 3056973 - RNA, 21 nt, Mycobacterium bovis subsp bovis AF2122/97
cggugcacggcgcuaccagcc

SEQ ID NO: 3056974 - RNA, 16 nt, Mycobacterium bovis subsp bovis AF2122/97
cggugcagaucggcuc

SEQ ID NO: 3056975 - RNA, 12 nt, Mycobacterium bovis subsp bovis AF2122/97
cggugcagcacg

SEQ ID NO: 3056976 - RNA, 16 nt, Mycobacterium bovis subsp bovis AF2122/97
cggugcagcagcgcgc

SEQ ID NO: 3056977 - RNA, 22 nt, Mycobacterium bovis subsp bovis AF2122/97
cggugcagcagggcgcgcaucu

SEQ ID NO: 3056978 - RNA, 14 nt, Mycobacterium bovis subsp bovis AF2122/97
cggugcagcccgcc

SEQ ID NO: 3056979 - RNA, 15 nt, Mycobacterium bovis subsp bovis AF2122/97
cggugcagcccgccg

SEQ ID NO: 3056980 - RNA, 16 nt, Mycobacterium bovis subsp bovis AF2122/97
cggugcagcccgccgg

SEQ ID NO: 3056981 - RNA, 12 nt, Mycobacterium bovis subsp bovis AF2122/97
cggugcagcgca

SEQ ID NO: 3056982 - RNA, 16 nt, Mycobacterium bovis subsp bovis AF2122/97
cggugcagcuccccgc

SEQ ID NO: 3056983 - RNA, 20 nt, Mycobacterium bovis subsp bovis AF2122/97
cggugcaggaccagaacucg

SEQ ID NO: 3056984 - RNA, 20 nt, Mycobacterium bovis subsp bovis AF2122/97
cggugcaggucguccaucgc

SEQ ID NO: 3056985 - RNA, 15 nt, Mycobacterium bovis subsp bovis AF2122/97
cggugcaucgccacc

SEQ ID NO: 3056986 - RNA, 19 nt, Mycobacterium bovis subsp bovis AF2122/97
cggugcaucgccaccaccg

SEQ ID NO: 3056987 - RNA, 21 nt, Mycobacterium bovis subsp bovis AF2122/97
cggugcauugagccugccgga

SEQ ID NO: 3056988 - RNA, 19 nt, Mycobacterium bovis subsp bovis AF2122/97
cggugccaagggccggaug

SEQ ID NO: 3056989 - RNA, 22 nt, Mycobacterium bovis subsp bovis AF2122/97
cggugccaagggccggaugggc

SEQ ID NO: 3056990 - RNA, 14 nt, Mycobacterium bovis subsp bovis AF2122/97
cggugccaccacgc

SEQ ID NO: 3056991 - RNA, 15 nt, Mycobacterium bovis subsp bovis AF2122/97
cggugccaccacgcu

SEQ ID NO: 3056992 - RNA, 12 nt, Mycobacterium bovis subsp bovis AF2122/97
cggugccaccag

SEQ ID NO: 3056993 - RNA, 17 nt, Mycobacterium bovis subsp bovis AF2122/97
cggugccaccagugagc

SEQ ID NO: 3056994 - RNA, 20 nt, Mycobacterium bovis subsp bovis AF2122/97
cggugccacccuugccgccg

SEQ ID NO: 3056995 - RNA, 21 nt, Mycobacterium bovis subsp bovis AF2122/97
cggugccacccuugccgccgg

SEQ ID NO: 3056996 - RNA, 22 nt, Mycobacterium bovis subsp bovis AF2122/97
cggugccacccuugccgccggu

SEQ ID NO: 3056997 - RNA, 12 nt, Mycobacterium bovis subsp bovis AF2122/97
cggugccaccga

SEQ ID NO: 3056998 - RNA, 18 nt, Mycobacterium bovis subsp bovis AF2122/97
cggugccaccgcgacggc

SEQ ID NO: 3056999 - RNA, 12 nt, Mycobacterium bovis subsp bovis AF2122/97
cggugccaccgg

SEQ ID NO: 3057000 - RNA, 16 nt, Mycobacterium bovis subsp bovis AF2122/97
cggugccacgaucggc

SEQ ID NO: 3057001 - RNA, 17 nt, Mycobacterium bovis subsp bovis AF2122/97
cggugccacggcaccga

SEQ ID NO: 3057002 - RNA, 14 nt, Mycobacterium bovis subsp bovis AF2122/97
cggugccacgguga

SEQ ID NO: 3057003 - RNA, 23 nt, Mycobacterium bovis subsp bovis AF2122/97
cggugccacggugacccuggugg

SEQ ID NO: 3057004 - RNA, 21 nt, Mycobacterium bovis subsp bovis AF2122/97
cggugccacugccguugccgc

SEQ ID NO: 3057005 - RNA, 19 nt, Mycobacterium bovis subsp bovis AF2122/97
cggugccagaaugccgaac

SEQ ID NO: 3057006 - RNA, 21 nt, Mycobacterium bovis subsp bovis AF2122/97
cggugccagcaccacgucgac

SEQ ID NO: 3057007 - RNA, 23 nt, Mycobacterium bovis subsp bovis AF2122/97
cggugccagcaccacgucgacga

SEQ ID NO: 3057008 - RNA, 20 nt, Mycobacterium bovis subsp bovis AF2122/97
cggugccagcacuccaccgc

SEQ ID NO: 3057009 - RNA, 13 nt, Mycobacterium bovis subsp bovis AF2122/97
cggugccagcagg

SEQ ID NO: 3057010 - RNA, 20 nt, Mycobacterium bovis subsp bovis AF2122/97
cggugccagcaggccgaaga

SEQ ID NO: 3057011 - RNA, 18 nt, Mycobacterium bovis subsp bovis AF2122/97
cggugccaucgggcgcgg

SEQ ID NO: 3057012 - RNA, 22 nt, Mycobacterium bovis subsp bovis AF2122/97
cggugccaucgggcgcgguaac

SEQ ID NO: 3057013 - RNA, 18 nt, Mycobacterium bovis subsp bovis AF2122/97
cggugcccaacccacucg

SEQ ID NO: 3057014 - RNA, 17 nt, Mycobacterium bovis subsp bovis AF2122/97
cggugcccagcagcgcg

SEQ ID NO: 3057015 - RNA, 18 nt, Mycobacterium bovis subsp bovis AF2122/97
cggugcccagcagcgcga

SEQ ID NO: 3057016 - RNA, 16 nt, Mycobacterium bovis subsp bovis AF2122/97
cggugcccgcaccaca

SEQ ID NO: 3057017 - RNA, 20 nt, Mycobacterium bovis subsp bovis AF2122/97
cggugcccgcaccacaccgu

SEQ ID NO: 3057018 - RNA, 18 nt, Mycobacterium bovis subsp bovis AF2122/97
cggugcccgcggugacga

SEQ ID NO: 3057019 - RNA, 15 nt, Mycobacterium bovis subsp bovis AF2122/97
cggugcccugccggc

SEQ ID NO: 3057020 - RNA, 17 nt, Mycobacterium bovis subsp bovis AF2122/97
cggugccgaagcugccc

SEQ ID NO: 3057021 - RNA, 18 nt, Mycobacterium bovis subsp bovis AF2122/97
cggugccgaagcugccca

SEQ ID NO: 3057022 - RNA, 13 nt, Mycobacterium bovis subsp bovis AF2122/97
cggugccgaccgc

SEQ ID NO: 3057023 - RNA, 15 nt, Mycobacterium bovis subsp bovis AF2122/97
cggugccgaccgcgu

SEQ ID NO: 3057024 - RNA, 14 nt, Mycobacterium bovis subsp bovis AF2122/97
cggugccgaccggu

SEQ ID NO: 3057025 - RNA, 12 nt, Mycobacterium bovis subsp bovis AF2122/97
cggugccgacga

SEQ ID NO: 3057026 - RNA, 12 nt, Mycobacterium bovis subsp bovis AF2122/97
cggugccgacgg

SEQ ID NO: 3057027 - RNA, 16 nt, Mycobacterium bovis subsp bovis AF2122/97
cggugccgacggcgcc

SEQ ID NO: 3057028 - RNA, 18 nt, Mycobacterium bovis subsp bovis AF2122/97
cggugccgacggugaugg

SEQ ID NO: 3057029 - RNA, 14 nt, Mycobacterium bovis subsp bovis AF2122/97
cggugccgagcacu

SEQ ID NO: 3057030 - RNA, 16 nt, Mycobacterium bovis subsp bovis AF2122/97
cggugccgaucagcag

SEQ ID NO: 3057031 - RNA, 13 nt, Mycobacterium bovis subsp bovis AF2122/97
cggugccgaucgg

SEQ ID NO: 3057032 - RNA, 16 nt, Mycobacterium bovis subsp bovis AF2122/97
cggugccgaugaccga

SEQ ID NO: 3057033 - RNA, 14 nt, Mycobacterium bovis subsp bovis AF2122/97
cggugccgcagcag

SEQ ID NO: 3057034 - RNA, 13 nt, Mycobacterium bovis subsp bovis AF2122/97
cggugccgccacc

SEQ ID NO: 3057035 - RNA, 16 nt, Mycobacterium bovis subsp bovis AF2122/97
cggugccgccaccggc

SEQ ID NO: 3057036 - RNA, 17 nt, Mycobacterium bovis subsp bovis AF2122/97
cggugccgccaucgccg

SEQ ID NO: 3057037 - RNA, 18 nt, Mycobacterium bovis subsp bovis AF2122/97
cggugccgccaucgccgc

SEQ ID NO: 3057038 - RNA, 21 nt, Mycobacterium bovis subsp bovis AF2122/97
cggugccgccaucgccgccgg

SEQ ID NO: 3057039 - RNA, 13 nt, Mycobacterium bovis subsp bovis AF2122/97
cggugccgccauu

SEQ ID NO: 3057040 - RNA, 13 nt, Mycobacterium bovis subsp bovis AF2122/97
cggugccgcccga

SEQ ID NO: 3057041 - RNA, 16 nt, Mycobacterium bovis subsp bovis AF2122/97
cggugccgcccgagcc

SEQ ID NO: 3057042 - RNA, 19 nt, Mycobacterium bovis subsp bovis AF2122/97
cggugccgcccgcgccgcc

SEQ ID NO: 3057043 - RNA, 21 nt, Mycobacterium bovis subsp bovis AF2122/97
cggugccgcccgcgccgccgc

SEQ ID NO: 3057044 - RNA, 20 nt, Mycobacterium bovis subsp bovis AF2122/97
cggugccgcccgcgccuccg

SEQ ID NO: 3057045 - RNA, 13 nt, Mycobacterium bovis subsp bovis AF2122/97
cggugccgccgau

SEQ ID NO: 3057046 - RNA, 17 nt, Mycobacterium bovis subsp bovis AF2122/97
cggugccgccgauaccg

SEQ ID NO: 3057047 - RNA, 20 nt, Mycobacterium bovis subsp bovis AF2122/97
cggugccgccgauaccgccg

SEQ ID NO: 3057048 - RNA, 21 nt, Mycobacterium bovis subsp bovis AF2122/97
cggugccgccgauaccgccgg

SEQ ID NO: 3057049 - RNA, 14 nt, Mycobacterium bovis subsp bovis AF2122/97
cggugccgccgccg

SEQ ID NO: 3057050 - RNA, 19 nt, Mycobacterium bovis subsp bovis AF2122/97
cggugccgccgccggcgcc

SEQ ID NO: 3057051 - RNA, 16 nt, Mycobacterium bovis subsp bovis AF2122/97
cggugccgccgccugc

SEQ ID NO: 3057052 - RNA, 13 nt, Mycobacterium bovis subsp bovis AF2122/97
cggugccgccgcg

SEQ ID NO: 3057053 - RNA, 20 nt, Mycobacterium bovis subsp bovis AF2122/97
cggugccgccgcggccacca

SEQ ID NO: 3057054 - RNA, 22 nt, Mycobacterium bovis subsp bovis AF2122/97
cggugccgccgcggccaccacc

SEQ ID NO: 3057055 - RNA, 24 nt, Mycobacterium bovis subsp bovis AF2122/97
cggugccgccgcggccaccaccgc

SEQ ID NO: 3057056 - RNA, 19 nt, Mycobacterium bovis subsp bovis AF2122/97
cggugccgccggugccgcc

SEQ ID NO: 3057057 - RNA, 12 nt, Mycobacterium bovis subsp bovis AF2122/97
cggugccgccgu

SEQ ID NO: 3057058 - RNA, 15 nt, Mycobacterium bovis subsp bovis AF2122/97
cggugccgccgucga

SEQ ID NO: 3057059 - RNA, 18 nt, Mycobacterium bovis subsp bovis AF2122/97
cggugccgccguucccac

SEQ ID NO: 3057060 - RNA, 21 nt, Mycobacterium bovis subsp bovis AF2122/97
cggugcucuucggcaccaccg

SEQ ID NO: 3057061 - RNA, 16 nt, Mycobacterium bovis subsp bovis AF2122/97
cggugcugaccccgcc

SEQ ID NO: 3057062 - RNA, 13 nt, Mycobacterium bovis subsp bovis AF2122/97
cggugcugacgac

SEQ ID NO: 3057063 - RNA, 21 nt, Mycobacterium bovis subsp bovis AF2122/97
cggugcugaucgguccggcga

SEQ ID NO: 3057064 - RNA, 17 nt, Mycobacterium bovis subsp bovis AF2122/97
cggugcuguugcgcggu

SEQ ID NO: 3057065 - RNA, 15 nt, Mycobacterium bovis subsp bovis AF2122/97
cgguggaaaaagccc

SEQ ID NO: 3057066 - RNA, 16 nt, Mycobacterium bovis subsp bovis AF2122/97
cgguggaaacccugca

SEQ ID NO: 3057067 - RNA, 19 nt, Mycobacterium bovis subsp bovis AF2122/97
cgguggaagaguuggggca

SEQ ID NO: 3057068 - RNA, 18 nt, Mycobacterium bovis subsp bovis AF2122/97
cgguggaauccaccagcc

SEQ ID NO: 3057069 - RNA, 19 nt, Mycobacterium bovis subsp bovis AF2122/97
cgguggaauccaccagccg

SEQ ID NO: 3057070 - RNA, 22 nt, Mycobacterium bovis subsp bovis AF2122/97
cgguggaauccaccagccggua

SEQ ID NO: 3057071 - RNA, 21 nt, Mycobacterium bovis subsp bovis AF2122/97
cgguggacagaaucgaccgcc

SEQ ID NO: 3057072 - RNA, 15 nt, Mycobacterium bovis subsp bovis AF2122/97
cgguggaccaccgga

SEQ ID NO: 3057073 - RNA, 15 nt, Mycobacterium bovis subsp bovis AF2122/97
cgguggacccggcgg

SEQ ID NO: 3057074 - RNA, 14 nt, Mycobacterium bovis subsp bovis AF2122/97
cgguggaccgggca

SEQ ID NO: 3057075 - RNA, 13 nt, Mycobacterium bovis subsp bovis AF2122/97
cgguggacgagcc

SEQ ID NO: 3057076 - RNA, 22 nt, Mycobacterium bovis subsp bovis AF2122/97
cgguggacgagccagaggugga

SEQ ID NO: 3057077 - RNA, 16 nt, Mycobacterium bovis subsp bovis AF2122/97
cgguggacgauacgcg

SEQ ID NO: 3057078 - RNA, 20 nt, Mycobacterium bovis subsp bovis AF2122/97
cgguggacgcagagucaaca

SEQ ID NO: 3057079 - RNA, 23 nt, Mycobacterium bovis subsp bovis AF2122/97
cgguggacgcagagucaacagau

SEQ ID NO: 3057080 - RNA, 15 nt, Mycobacterium bovis subsp bovis AF2122/97
cgguggagcgcgccu

SEQ ID NO: 3057081 - RNA, 18 nt, Mycobacterium bovis subsp bovis AF2122/97
cgguggagcgcgggaugu

SEQ ID NO: 3057082 - RNA, 17 nt, Mycobacterium bovis subsp bovis AF2122/97
cgguggaggcguagucg

SEQ ID NO: 3057083 - RNA, 16 nt, Mycobacterium bovis subsp bovis AF2122/97
cgguggagggcgagca

SEQ ID NO: 3057084 - RNA, 22 nt, Mycobacterium bovis subsp bovis AF2122/97
cgguggcaacggaggugccggc

SEQ ID NO: 3057085 - RNA, 13 nt, Mycobacterium bovis subsp bovis AF2122/97
cgguggcacccgc

SEQ ID NO: 3057086 - RNA, 15 nt, Mycobacterium bovis subsp bovis AF2122/97
cgguggcaccggcgg

SEQ ID NO: 3057087 - RNA, 19 nt, Mycobacterium bovis subsp bovis AF2122/97
cgguggcaccggcggcgac

SEQ ID NO: 3057088 - RNA, 20 nt, Mycobacterium bovis subsp bovis AF2122/97
cgguggcaccggcggcgacg

SEQ ID NO: 3057089 - RNA, 15 nt, Mycobacterium bovis subsp bovis AF2122/97
cgguggcacggcccc

SEQ ID NO: 3057090 - RNA, 17 nt, Mycobacterium bovis subsp bovis AF2122/97
cgguggcagagccgccg

SEQ ID NO: 3057091 - RNA, 18 nt, Mycobacterium bovis subsp bovis AF2122/97
cgguggcagagccgccgu

SEQ ID NO: 3057092 - RNA, 19 nt, Mycobacterium bovis subsp bovis AF2122/97
cgguggcagcacagcgucg

SEQ ID NO: 3057093 - RNA, 14 nt, Mycobacterium bovis subsp bovis AF2122/97
cgguggcagccugc

SEQ ID NO: 3057094 - RNA, 20 nt, Mycobacterium bovis subsp bovis AF2122/97
cgguggcauucguugaugau

SEQ ID NO: 3057095 - RNA, 14 nt, Mycobacterium bovis subsp bovis AF2122/97
cgguggccaacacc

SEQ ID NO: 3057096 - RNA, 19 nt, Mycobacterium bovis subsp bovis AF2122/97
cgguggccaacaccgccag

SEQ ID NO: 3057097 - RNA, 21 nt, Mycobacterium bovis subsp bovis AF2122/97
cgguggccaacaccgccagca

SEQ ID NO: 3057098 - RNA, 14 nt, Mycobacterium bovis subsp bovis AF2122/97
cgguggccaccacc

SEQ ID NO: 3057099 - RNA, 14 nt, Mycobacterium bovis subsp bovis AF2122/97
cgguggccacccgg

SEQ ID NO: 3057100 - RNA, 15 nt, Mycobacterium bovis subsp bovis AF2122/97
cgguggccacccggc

SEQ ID NO: 3057101 - RNA, 18 nt, Mycobacterium bovis subsp bovis AF2122/97
cgguggccacccggccgc

SEQ ID NO: 3057102 - RNA, 19 nt, Mycobacterium bovis subsp bovis AF2122/97
cgguggccccgauggcgau

SEQ ID NO: 3057103 - RNA, 18 nt, Mycobacterium bovis subsp bovis AF2122/97
cgguggcccgccggcagu

SEQ ID NO: 3057104 - RNA, 20 nt, Mycobacterium bovis subsp bovis AF2122/97
cgguggcccgccggcaguga

SEQ ID NO: 3057105 - RNA, 20 nt, Mycobacterium bovis subsp bovis AF2122/97
cgguggccgaacaggaugau

SEQ ID NO: 3057106 - RNA, 20 nt, Mycobacterium bovis subsp bovis AF2122/97
cgguggccgacaagucaaga

SEQ ID NO: 3057107 - RNA, 14 nt, Mycobacterium bovis subsp bovis AF2122/97
cgguggccgcaucg

SEQ ID NO: 3057108 - RNA, 21 nt, Mycobacterium bovis subsp bovis AF2122/97
cgguggccgcaucgacgcuca

SEQ ID NO: 3057109 - RNA, 17 nt, Mycobacterium bovis subsp bovis AF2122/97
cgguggccgcugccagc

SEQ ID NO: 3057110 - RNA, 23 nt, Mycobacterium bovis subsp bovis AF2122/97
cgguggccggcaacggcgcgccg

SEQ ID NO: 3057111 - RNA, 15 nt, Mycobacterium bovis subsp bovis AF2122/97
cgguggccggcagcc

SEQ ID NO: 3057112 - RNA, 18 nt, Mycobacterium bovis subsp bovis AF2122/97
cgguggccggcagccaga

SEQ ID NO: 3057113 - RNA, 14 nt, Mycobacterium bovis subsp bovis AF2122/97
cgguggccgucggg

SEQ ID NO: 3057114 - RNA, 15 nt, Mycobacterium bovis subsp bovis AF2122/97
cgguggccgucgggu

SEQ ID NO: 3057115 - RNA, 17 nt, Mycobacterium bovis subsp bovis AF2122/97
cgguggccucccacggc

SEQ ID NO: 3057116 - RNA, 19 nt, Mycobacterium bovis subsp bovis AF2122/97
cgguggccucccacggcgc

SEQ ID NO: 3057117 - RNA, 22 nt, Mycobacterium bovis subsp bovis AF2122/97
cgguggcgagguggucacgcag

SEQ ID NO: 3057118 - RNA, 21 nt, Mycobacterium bovis subsp bovis AF2122/97
cgguggcgccgaacgccagca

SEQ ID NO: 3057119 - RNA, 16 nt, Mycobacterium bovis subsp bovis AF2122/97
cgguggcgccggggcc

SEQ ID NO: 3057120 - RNA, 18 nt, Mycobacterium bovis subsp bovis AF2122/97
cgguggcgccggggccgc

SEQ ID NO: 3057121 - RNA, 20 nt, Mycobacterium bovis subsp bovis AF2122/97
cgguggcgccggggccgccg

SEQ ID NO: 3057122 - RNA, 21 nt, Mycobacterium bovis subsp bovis AF2122/97
cgguggcgccggggccgccga

SEQ ID NO: 3057123 - RNA, 20 nt, Mycobacterium bovis subsp bovis AF2122/97
cgguggcgccggggcgcagg

SEQ ID NO: 3057124 - RNA, 18 nt, Mycobacterium bovis subsp bovis AF2122/97
cgguggcgcgcagcgcga

SEQ ID NO: 3057125 - RNA, 20 nt, Mycobacterium bovis subsp bovis AF2122/97
cgguggcgcggugccggcgg

SEQ ID NO: 3057126 - RNA, 18 nt, Mycobacterium bovis subsp bovis AF2122/97
cgguggcggacggcguuu

SEQ ID NO: 3057127 - RNA, 14 nt, Mycobacterium bovis subsp bovis AF2122/97
cgguggcggcagca

SEQ ID NO: 3057128 - RNA, 18 nt, Mycobacterium bovis subsp bovis AF2122/97
cgguggcggcggcggcaa

SEQ ID NO: 3057129 - RNA, 22 nt, Mycobacterium bovis subsp bovis AF2122/97
cgguggcggcggcggcaacggc

SEQ ID NO: 3057130 - RNA, 20 nt, Mycobacterium bovis subsp bovis AF2122/97
cgguggcggcggugccacga

SEQ ID NO: 3057131 - RNA, 15 nt, Mycobacterium bovis subsp bovis AF2122/97
cgguggcggcucacg

SEQ ID NO: 3057132 - RNA, 12 nt, Mycobacterium bovis subsp bovis AF2122/97
cgguggcgggcu

SEQ ID NO: 3057133 - RNA, 20 nt, Mycobacterium bovis subsp bovis AF2122/97
cgguggcggucgccacaccc

SEQ ID NO: 3057134 - RNA, 22 nt, Mycobacterium bovis subsp bovis AF2122/97
cgguggcggucgccacacccgc

SEQ ID NO: 3057135 - RNA, 23 nt, Mycobacterium bovis subsp bovis AF2122/97
cgguggcggucgccacacccgcg

SEQ ID NO: 3057136 - RNA, 19 nt, Mycobacterium bovis subsp bovis AF2122/97
cgguggcgucgucggcggg

SEQ ID NO: 3057137 - RNA, 23 nt, Mycobacterium bovis subsp bovis AF2122/97
cgguggcgugguggaaacugaug

SEQ ID NO: 3057138 - RNA, 12 nt, Mycobacterium bovis subsp bovis AF2122/97
cgguggcuacgc

SEQ ID NO: 3057139 - RNA, 13 nt, Mycobacterium bovis subsp bovis AF2122/97
cgguggcugccac

SEQ ID NO: 3057140 - RNA, 22 nt, Mycobacterium bovis subsp bovis AF2122/97
cgguggcugccacuuggacgaa

SEQ ID NO: 3057141 - RNA, 13 nt, Mycobacterium bovis subsp bovis AF2122/97
cgguggcuggccg

SEQ ID NO: 3057142 - RNA, 15 nt, Mycobacterium bovis subsp bovis AF2122/97
cgguggcuggccgcc

SEQ ID NO: 3057143 - RNA, 17 nt, Mycobacterium bovis subsp bovis AF2122/97
cgguggcuggccgccac

SEQ ID NO: 3057144 - RNA, 17 nt, Mycobacterium bovis subsp bovis AF2122/97
cgguggcuucaacccgg

SEQ ID NO: 3057145 - RNA, 22 nt, Mycobacterium bovis subsp bovis AF2122/97
cgguggcuucaacccgggcagc

SEQ ID NO: 3057146 - RNA, 20 nt, Mycobacterium bovis subsp bovis AF2122/97
cgguguaggccucggcagca

SEQ ID NO: 3057147 - RNA, 17 nt, Mycobacterium bovis subsp bovis AF2122/97
cgguguagggcggcguu

SEQ ID NO: 3057148 - RNA, 13 nt, Mycobacterium bovis subsp bovis AF2122/97
cgguguauccgac

SEQ ID NO: 3057149 - RNA, 18 nt, Mycobacterium bovis subsp bovis AF2122/97
cgguguauccgacgucgg

SEQ ID NO: 3057150 - RNA, 17 nt, Mycobacterium bovis subsp bovis AF2122/97
cgguguauccgacuggc

SEQ ID NO: 3057151 - RNA, 23 nt, Mycobacterium bovis subsp bovis AF2122/97
cggugucaguccgacaccacgga

SEQ ID NO: 3057152 - RNA, 15 nt, Mycobacterium bovis subsp bovis AF2122/97
cgguguccagccacg

SEQ ID NO: 3057153 - RNA, 19 nt, Mycobacterium bovis subsp bovis AF2122/97
cgguguccagccacgcugu

SEQ ID NO: 3057154 - RNA, 23 nt, Mycobacterium bovis subsp bovis AF2122/97
cgguguccagugcauucccgccu

SEQ ID NO: 3057155 - RNA, 16 nt, Mycobacterium bovis subsp bovis AF2122/97
cggugucccgcgaggc

SEQ ID NO: 3057156 - RNA, 12 nt, Mycobacterium bovis subsp bovis AF2122/97
cggugucgacgg

SEQ ID NO: 3057157 - RNA, 18 nt, Mycobacterium bovis subsp bovis AF2122/97
cggugucgaugcgcagcc

SEQ ID NO: 3057158 - RNA, 14 nt, Mycobacterium bovis subsp bovis AF2122/97
cggugucgaugcug

SEQ ID NO: 3057159 - RNA, 15 nt, Mycobacterium bovis subsp bovis AF2122/97
cggugucgccacccg

SEQ ID NO: 3057160 - RNA, 14 nt, Mycobacterium bovis subsp bovis AF2122/97
cggugucggccagc

SEQ ID NO: 3057161 - RNA, 15 nt, Mycobacterium bovis subsp bovis AF2122/97
cggugucggccagca

SEQ ID NO: 3057162 - RNA, 13 nt, Mycobacterium bovis subsp bovis AF2122/97
cggugucggccgc

SEQ ID NO: 3057163 - RNA, 14 nt, Mycobacterium bovis subsp bovis AF2122/97
cggugucggccgcg

SEQ ID NO: 3057164 - RNA, 14 nt, Mycobacterium bovis subsp bovis AF2122/97
cggugucggcgccg

SEQ ID NO: 3057165 - RNA, 16 nt, Mycobacterium bovis subsp bovis AF2122/97
cggugucggcuggucg

SEQ ID NO: 3057166 - RNA, 19 nt, Mycobacterium bovis subsp bovis AF2122/97
cggugucgggcuggguggc

SEQ ID NO: 3057167 - RNA, 17 nt, Mycobacterium bovis subsp bovis AF2122/97
cggugucggggcccccg

SEQ ID NO: 3057168 - RNA, 15 nt, Mycobacterium bovis subsp bovis AF2122/97
cggugucgucaucgg

SEQ ID NO: 3057169 - RNA, 20 nt, Mycobacterium bovis subsp bovis AF2122/97
cggugucgucaucggggccu

SEQ ID NO: 3057170 - RNA, 12 nt, Mycobacterium bovis subsp bovis AF2122/97
cggugucgucga

SEQ ID NO: 3057171 - RNA, 22 nt, Mycobacterium bovis subsp bovis AF2122/97
cggugucuuccaacccaaccga

SEQ ID NO: 3057172 - RNA, 15 nt, Mycobacterium bovis subsp bovis AF2122/97
cggugugaucggcgg

SEQ ID NO: 3057173 - RNA, 13 nt, Mycobacterium bovis subsp bovis AF2122/97
cggugugcacggc

SEQ ID NO: 3057174 - RNA, 15 nt, Mycobacterium bovis subsp bovis AF2122/97
cggugugcacggcga

SEQ ID NO: 3057175 - RNA, 15 nt, Mycobacterium bovis subsp bovis AF2122/97
cggugugcaggauca

SEQ ID NO: 3057176 - RNA, 17 nt, Mycobacterium bovis subsp bovis AF2122/97
cggugugcaggaucacg

SEQ ID NO: 3057177 - RNA, 21 nt, Mycobacterium bovis subsp bovis AF2122/97
cggugugcaucgacucacgga

SEQ ID NO: 3057178 - RNA, 18 nt, Mycobacterium bovis subsp bovis AF2122/97
cggugugccagugcugca

SEQ ID NO: 3057179 - RNA, 21 nt, Mycobacterium bovis subsp bovis AF2122/97
cggugugccagugcugcaccg

SEQ ID NO: 3057180 - RNA, 16 nt, Mycobacterium bovis subsp bovis AF2122/97
cggugugcgcaccccg

SEQ ID NO: 3057181 - RNA, 15 nt, Mycobacterium bovis subsp bovis AF2122/97
cggugugcgcgccag

SEQ ID NO: 3057182 - RNA, 17 nt, Mycobacterium bovis subsp bovis AF2122/97
cggugugcggcagcccg

SEQ ID NO: 3057183 - RNA, 17 nt, Mycobacterium bovis subsp bovis AF2122/97
cggugugcggcgcaugc

SEQ ID NO: 3057184 - RNA, 18 nt, Mycobacterium bovis subsp bovis AF2122/97
cggugugcggcgcaugca

SEQ ID NO: 3057185 - RNA, 19 nt, Mycobacterium bovis subsp bovis AF2122/97
cggugugcggcguacucgg

SEQ ID NO: 3057186 - RNA, 14 nt, Mycobacterium bovis subsp bovis AF2122/97
cggugugcuaccaa

SEQ ID NO: 3057187 - RNA, 15 nt, Mycobacterium bovis subsp bovis AF2122/97
cggugugcucgccga

SEQ ID NO: 3057188 - RNA, 16 nt, Mycobacterium bovis subsp bovis AF2122/97
cgguguggacugggcc

SEQ ID NO: 3057189 - RNA, 20 nt, Mycobacterium bovis subsp bovis AF2122/97
cgguguggacuucagcaggc

SEQ ID NO: 3057190 - RNA, 21 nt, Mycobacterium bovis subsp bovis AF2122/97
cgguguggcccaacaccgcca

SEQ ID NO: 3057191 - RNA, 17 nt, Mycobacterium bovis subsp bovis AF2122/97
cgguguggccgugggug

SEQ ID NO: 3057192 - RNA, 22 nt, Mycobacterium bovis subsp bovis AF2122/97
cgguguggcgcugaucggcagg

SEQ ID NO: 3057193 - RNA, 14 nt, Mycobacterium bovis subsp bovis AF2122/97
cgguguggcuugcg

SEQ ID NO: 3057194 - RNA, 19 nt, Mycobacterium bovis subsp bovis AF2122/97
cggugugugcaagccgaac

SEQ ID NO: 3057195 - RNA, 23 nt, Mycobacterium bovis subsp bovis AF2122/97
cgguguguuccaacuccugcagc

SEQ ID NO: 3057196 - RNA, 13 nt, Mycobacterium bovis subsp bovis AF2122/97
cgguguguucggc

SEQ ID NO: 3057197 - RNA, 15 nt, Mycobacterium bovis subsp bovis AF2122/97
cgguguuagccccga

SEQ ID NO: 3057198 - RNA, 21 nt, Mycobacterium bovis subsp bovis AF2122/97
cgguguuagugaggcccgagu

SEQ ID NO: 3057199 - RNA, 21 nt, Mycobacterium bovis subsp bovis AF2122/97
cgguguucaucacgccgccgg

SEQ ID NO: 3057200 - RNA, 22 nt, Mycobacterium bovis subsp bovis AF2122/97
cgguguucaucacgccgccgga

SEQ ID NO: 3057201 - RNA, 15 nt, Mycobacterium bovis subsp bovis AF2122/97
cgguguuccgcccag

SEQ ID NO: 3057202 - RNA, 14 nt, Mycobacterium bovis subsp bovis AF2122/97
cgguguuccgccgc

SEQ ID NO: 3057203 - RNA, 15 nt, Mycobacterium bovis subsp bovis AF2122/97
cgguguuccgccgcg

SEQ ID NO: 3057204 - RNA, 16 nt, Mycobacterium bovis subsp bovis AF2122/97
cgguguuccgccgcgc

SEQ ID NO: 3057205 - RNA, 17 nt, Mycobacterium bovis subsp bovis AF2122/97
cgguguuccgccgcgcu

SEQ ID NO: 3057206 - RNA, 21 nt, Mycobacterium bovis subsp bovis AF2122/97
cgguguucguggccgacagcg

SEQ ID NO: 3057207 - RNA, 15 nt, Mycobacterium bovis subsp bovis AF2122/97
cgguguugagaucgc

SEQ ID NO: 3057208 - RNA, 12 nt, Mycobacterium bovis subsp bovis AF2122/97
cgguguugauuc

SEQ ID NO: 3057209 - RNA, 23 nt, Mycobacterium bovis subsp bovis AF2122/97
cgguguugcccgaccacaccggg

SEQ ID NO: 3057210 - RNA, 18 nt, Mycobacterium bovis subsp bovis AF2122/97
cgguguugccgaagcccg

SEQ ID NO: 3057211 - RNA, 20 nt, Mycobacterium bovis subsp bovis AF2122/97
cgguguugccguuaccgcca

SEQ ID NO: 3057212 - RNA, 14 nt, Mycobacterium bovis subsp bovis AF2122/97
cgguguugcgcacc

SEQ ID NO: 3057213 - RNA, 16 nt, Mycobacterium bovis subsp bovis AF2122/97
cgguguugcgcacccg

SEQ ID NO: 3057214 - RNA, 19 nt, Mycobacterium bovis subsp bovis AF2122/97
cgguguugcucgccgucgu

SEQ ID NO: 3057215 - RNA, 15 nt, Mycobacterium bovis subsp bovis AF2122/97
cgguguuggacacuc

SEQ ID NO: 3057216 - RNA, 21 nt, Mycobacterium bovis subsp bovis AF2122/97
cgguguuggacacucccgggu

SEQ ID NO: 3057217 - RNA, 15 nt, Mycobacterium bovis subsp bovis AF2122/97
cgguguuggugaccg

SEQ ID NO: 3057218 - RNA, 17 nt, Mycobacterium bovis subsp bovis AF2122/97
cgguguuggugaccggg

SEQ ID NO: 3057219 - RNA, 15 nt, Mycobacterium bovis subsp bovis AF2122/97
cgguguugguguucg

SEQ ID NO: 3057220 - RNA, 20 nt, Mycobacterium bovis subsp bovis AF2122/97
cgguguuguaggccgggccg

SEQ ID NO: 3057221 - RNA, 23 nt, Mycobacterium bovis subsp bovis AF2122/97
cgguguuguaggccgggccggcc

SEQ ID NO: 3057222 - RNA, 21 nt, Mycobacterium bovis subsp bovis AF2122/97
cgguguuuaugguugugcggc

SEQ ID NO: 3057223 - RNA, 16 nt, Mycobacterium bovis subsp bovis AF2122/97
cgguguuuccgaaacc

SEQ ID NO: 3057224 - RNA, 18 nt, Mycobacterium bovis subsp bovis AF2122/97
cgguguuuccgaaacccg

SEQ ID NO: 3057225 - RNA, 19 nt, Mycobacterium bovis subsp bovis AF2122/97
cgguguuuccgaaacccgc

SEQ ID NO: 3057226 - RNA, 23 nt, Mycobacterium bovis subsp bovis AF2122/97
cgguguuuccgaaacccgccgcg

SEQ ID NO: 3057227 - RNA, 18 nt, Mycobacterium bovis subsp bovis AF2122/97
cgguguuucgugccaugg

SEQ ID NO: 3057228 - RNA, 17 nt, Mycobacterium bovis subsp bovis AF2122/97
cgguguuuggccgccga

SEQ ID NO: 3057229 - RNA, 17 nt, Mycobacterium bovis subsp bovis AF2122/97
cgguuaaggugcgaucc

SEQ ID NO: 3057230 - RNA, 15 nt, Mycobacterium bovis subsp bovis AF2122/97
cgguuacccggaccg

SEQ ID NO: 3057231 - RNA, 21 nt, Mycobacterium bovis subsp bovis AF2122/97
cgguuacccggaccgucgugg

SEQ ID NO: 3057232 - RNA, 14 nt, Mycobacterium bovis subsp bovis AF2122/97
cgguuagaucaccc

SEQ ID NO: 3057233 - RNA, 17 nt, Mycobacterium bovis subsp bovis AF2122/97
cgguugucgcagcgcac

SEQ ID NO: 3057234 - RNA, 17 nt, Mycobacterium bovis subsp bovis AF2122/97
cgguugugcgcgcgccc

SEQ ID NO: 3057235 - RNA, 18 nt, Mycobacterium bovis subsp bovis AF2122/97
cgguugugcgcgcgcccg

SEQ ID NO: 3057236 - RNA, 20 nt, Mycobacterium bovis subsp bovis AF2122/97
cgguugugcugggugccgca

SEQ ID NO: 3057237 - RNA, 18 nt, Mycobacterium bovis subsp bovis AF2122/97
cgguuguggaaccacggc

SEQ ID NO: 3057238 - RNA, 23 nt, Mycobacterium bovis subsp bovis AF2122/97
cgguuguguugggagccaccggc

SEQ ID NO: 3057239 - RNA, 13 nt, Mycobacterium bovis subsp bovis AF2122/97
cgguuuagccgcu

SEQ ID NO: 3057240 - RNA, 16 nt, Mycobacterium bovis subsp bovis AF2122/97
cgguuuccagacgacc

SEQ ID NO: 3057241 - RNA, 17 nt, Mycobacterium bovis subsp bovis AF2122/97
cgguuuccagacgacca

SEQ ID NO: 3057242 - RNA, 20 nt, Mycobacterium bovis subsp bovis AF2122/97
cgguuuccuccggcagcagc

SEQ ID NO: 3057243 - RNA, 15 nt, Mycobacterium bovis subsp bovis AF2122/97
cgguuucgaccacca

SEQ ID NO: 3057244 - RNA, 17 nt, Mycobacterium bovis subsp bovis AF2122/97
cgguuucgaccaccacc

SEQ ID NO: 3057245 - RNA, 16 nt, Mycobacterium bovis subsp bovis AF2122/97
cgguuucugcggcccc

SEQ ID NO: 3057246 - RNA, 16 nt, Mycobacterium bovis subsp bovis AF2122/97
cgguuucuucggccag

SEQ ID NO: 3057247 - RNA, 17 nt, Mycobacterium bovis subsp bovis AF2122/97
cgguuucuucggccagc

SEQ ID NO: 3057248 - RNA, 16 nt, Mycobacterium bovis subsp bovis AF2122/97
cgguuugcacgcacca

SEQ ID NO: 3057249 - RNA, 18 nt, Mycobacterium bovis subsp bovis AF2122/97
cgguuugcacgcaccaca

SEQ ID NO: 3057250 - RNA, 22 nt, Mycobacterium bovis subsp bovis AF2122/97
cgguuugcacgucacgcggaaa

SEQ ID NO: 3057251 - RNA, 12 nt, Mycobacterium bovis subsp bovis AF2122/97
cgguuugccggu

SEQ ID NO: 3057252 - RNA, 19 nt, Mycobacterium bovis subsp bovis AF2122/97
cgguuugcguccugguggc

SEQ ID NO: 3057253 - RNA, 17 nt, Mycobacterium bovis subsp bovis AF2122/97
cgguuuggaucacccgc

SEQ ID NO: 3057254 - RNA, 20 nt, Mycobacterium bovis subsp bovis AF2122/97
cgguuuggaucacccgccgc

SEQ ID NO: 3057255 - RNA, 15 nt, Mycobacterium bovis subsp bovis AF2122/97
cguaaaagccgauga

SEQ ID NO: 3057256 - RNA, 13 nt, Mycobacterium bovis subsp bovis AF2122/97
cguaaacagcgcg

SEQ ID NO: 3057257 - RNA, 22 nt, Mycobacterium bovis subsp bovis AF2122/97
cguaaaccgauaucgcugcgga

SEQ ID NO: 3057258 - RNA, 23 nt, Mycobacterium bovis subsp bovis AF2122/97
cguaaaccgauaucgcugcggaa

SEQ ID NO: 3057259 - RNA, 19 nt, Mycobacterium bovis subsp bovis AF2122/97
cguaaaccguggccgcgau

SEQ ID NO: 3057260 - RNA, 15 nt, Mycobacterium bovis subsp bovis AF2122/97
cguaaagccaacugg

SEQ ID NO: 3057261 - RNA, 17 nt, Mycobacterium bovis subsp bovis AF2122/97
cguaaagggcgucguag

SEQ ID NO: 3057262 - RNA, 15 nt, Mycobacterium bovis subsp bovis AF2122/97
cguaaauagcgcccu

SEQ ID NO: 3057263 - RNA, 13 nt, Mycobacterium bovis subsp bovis AF2122/97
cguaacagccggc

SEQ ID NO: 3057264 - RNA, 17 nt, Mycobacterium bovis subsp bovis AF2122/97
cguaaccacgacgacga

SEQ ID NO: 3057265 - RNA, 14 nt, Mycobacterium bovis subsp bovis AF2122/97
cguaaccggcagcg

SEQ ID NO: 3057266 - RNA, 20 nt, Mycobacterium bovis subsp bovis AF2122/97
cguaaccggcagcgguaagc

SEQ ID NO: 3057267 - RNA, 17 nt, Mycobacterium bovis subsp bovis AF2122/97
cguaaccgucgccugcc

SEQ ID NO: 3057268 - RNA, 22 nt, Mycobacterium bovis subsp bovis AF2122/97
cguaaccgucgccugccgacga

SEQ ID NO: 3057269 - RNA, 13 nt, Mycobacterium bovis subsp bovis AF2122/97
cguaacgccgcuc

SEQ ID NO: 3057270 - RNA, 15 nt, Mycobacterium bovis subsp bovis AF2122/97
cguaacugcccgcgg

SEQ ID NO: 3057271 - RNA, 17 nt, Mycobacterium bovis subsp bovis AF2122/97
cguaaggccggagucga

SEQ ID NO: 3057272 - RNA, 16 nt, Mycobacterium bovis subsp bovis AF2122/97
cguaauagcugcgucc

SEQ ID NO: 3057273 - RNA, 15 nt, Mycobacterium bovis subsp bovis AF2122/97
cguaaucaagcagcg

SEQ ID NO: 3057274 - RNA, 21 nt, Mycobacterium bovis subsp bovis AF2122/97
cguaaucaauaaucacaucgg

SEQ ID NO: 3057275 - RNA, 24 nt, Mycobacterium bovis subsp bovis AF2122/97
cguaauccacacacagccgguggc

SEQ ID NO: 3057276 - RNA, 22 nt, Mycobacterium bovis subsp bovis AF2122/97
cguaaucggcaaugagcuaccg

SEQ ID NO: 3057277 - RNA, 15 nt, Mycobacterium bovis subsp bovis AF2122/97
cguaauugucgaugu

SEQ ID NO: 3057278 - RNA, 23 nt, Mycobacterium bovis subsp bovis AF2122/97
cguaauuucuucacggucgacga

SEQ ID NO: 3057279 - RNA, 15 nt, Mycobacterium bovis subsp bovis AF2122/97
cguacaacacgggca

SEQ ID NO: 3057280 - RNA, 23 nt, Mycobacterium bovis subsp bovis AF2122/97
cguacaaccacccacccgcacca

SEQ ID NO: 3057281 - RNA, 21 nt, Mycobacterium bovis subsp bovis AF2122/97
cguacaccucgagcgcggcga

SEQ ID NO: 3057282 - RNA, 12 nt, Mycobacterium bovis subsp bovis AF2122/97
cguacagcaccg

SEQ ID NO: 3057283 - RNA, 23 nt, Mycobacterium bovis subsp bovis AF2122/97
cguacagcccggccuugccgccg

SEQ ID NO: 3057284 - RNA, 18 nt, Mycobacterium bovis subsp bovis AF2122/97
cguacaggccggccacca

SEQ ID NO: 3057285 - RNA, 16 nt, Mycobacterium bovis subsp bovis AF2122/97
cguacagugucugcca

SEQ ID NO: 3057286 - RNA, 15 nt, Mycobacterium bovis subsp bovis AF2122/97
cguacaucagcgcga

SEQ ID NO: 3057287 - RNA, 17 nt, Mycobacterium bovis subsp bovis AF2122/97
cguacaucagcgcgaac

SEQ ID NO: 3057288 - RNA, 14 nt, Mycobacterium bovis subsp bovis AF2122/97
cguacauucgggcg

SEQ ID NO: 3057289 - RNA, 23 nt, Mycobacterium bovis subsp bovis AF2122/97
cguacauucgggcgugcucgccg

SEQ ID NO: 3057290 - RNA, 20 nt, Mycobacterium bovis subsp bovis AF2122/97
cguaccacugcucgaugucc

SEQ ID NO: 3057291 - RNA, 15 nt, Mycobacterium bovis subsp bovis AF2122/97
cguaccagcuggcca

SEQ ID NO: 3057292 - RNA, 16 nt, Mycobacterium bovis subsp bovis AF2122/97
cguaccagcuggccac

SEQ ID NO: 3057293 - RNA, 14 nt, Mycobacterium bovis subsp bovis AF2122/97
cguacccggccugc

SEQ ID NO: 3057294 - RNA, 20 nt, Mycobacterium bovis subsp bovis AF2122/97
cguacccggccugcgucgaa

SEQ ID NO: 3057295 - RNA, 20 nt, Mycobacterium bovis subsp bovis AF2122/97
cguacccguuaugcgccgcc

SEQ ID NO: 3057296 - RNA, 21 nt, Mycobacterium bovis subsp bovis AF2122/97
cguacccguuaugcgccgccc

SEQ ID NO: 3057297 - RNA, 12 nt, Mycobacterium bovis subsp bovis AF2122/97
cguaccgacagg

SEQ ID NO: 3057298 - RNA, 21 nt, Mycobacterium bovis subsp bovis AF2122/97
cguaccgacgaagaucgcugc

SEQ ID NO: 3057299 - RNA, 11 nt, Mycobacterium bovis subsp bovis AF2122/97
cguaccgcgcg

SEQ ID NO: 3057300 - RNA, 15 nt, Mycobacterium bovis subsp bovis AF2122/97
cguaccgcgcguugu

SEQ ID NO: 3057301 - RNA, 14 nt, Mycobacterium bovis subsp bovis AF2122/97
cguaccgggcgagu

SEQ ID NO: 3057302 - RNA, 12 nt, Mycobacterium bovis subsp bovis AF2122/97
cguaccggugau

SEQ ID NO: 3057303 - RNA, 21 nt, Mycobacterium bovis subsp bovis AF2122/97
cguaccgguggaaacccugca

SEQ ID NO: 3057304 - RNA, 17 nt, Mycobacterium bovis subsp bovis AF2122/97
cguaccgguugacgggc

SEQ ID NO: 3057305 - RNA, 17 nt, Mycobacterium bovis subsp bovis AF2122/97
cguaccguucgggccgu

SEQ ID NO: 3057306 - RNA, 17 nt, Mycobacterium bovis subsp bovis AF2122/97
cguaccuaaggcucacc

SEQ ID NO: 3057307 - RNA, 12 nt, Mycobacterium bovis subsp bovis AF2122/97
cguacgcagcgu

SEQ ID NO: 3057308 - RNA, 15 nt, Mycobacterium bovis subsp bovis AF2122/97
cguacgccggcggug

SEQ ID NO: 3057309 - RNA, 13 nt, Mycobacterium bovis subsp bovis AF2122/97
cguacgcggcugc

SEQ ID NO: 3057310 - RNA, 18 nt, Mycobacterium bovis subsp bovis AF2122/97
cguacggggucgccggca

SEQ ID NO: 3057311 - RNA, 16 nt, Mycobacterium bovis subsp bovis AF2122/97
cguacuccaccgcgcc

SEQ ID NO: 3057312 - RNA, 20 nt, Mycobacterium bovis subsp bovis AF2122/97
cguacucccaggccgccgcc

SEQ ID NO: 3057313 - RNA, 16 nt, Mycobacterium bovis subsp bovis AF2122/97
cguacuccccgcgcgc

SEQ ID NO: 3057314 - RNA, 15 nt, Mycobacterium bovis subsp bovis AF2122/97
cguacucgaccgcga

SEQ ID NO: 3057315 - RNA, 18 nt, Mycobacterium bovis subsp bovis AF2122/97
cguacucggcauccaggc

SEQ ID NO: 3057316 - RNA, 15 nt, Mycobacterium bovis subsp bovis AF2122/97
cguacucggcgcgca

SEQ ID NO: 3057317 - RNA, 15 nt, Mycobacterium bovis subsp bovis AF2122/97
cguacucggcggcca

SEQ ID NO: 3057318 - RNA, 20 nt, Mycobacterium bovis subsp bovis AF2122/97
cguacucggucgaguagccg

SEQ ID NO: 3057319 - RNA, 22 nt, Mycobacterium bovis subsp bovis AF2122/97
cguacucggugaucgcgguggc

SEQ ID NO: 3057320 - RNA, 13 nt, Mycobacterium bovis subsp bovis AF2122/97
cguaggcgccgaa

SEQ ID NO: 3057321 - RNA, 22 nt, Mycobacterium bovis subsp bovis AF2122/97
cguaggcgcuaggaacgccacc

SEQ ID NO: 3057322 - RNA, 14 nt, Mycobacterium bovis subsp bovis AF2122/97
cguaggcggcgacc

SEQ ID NO: 3057323 - RNA, 15 nt, Mycobacterium bovis subsp bovis AF2122/97
cguaggcggcggccc

SEQ ID NO: 3057324 - RNA, 19 nt, Mycobacterium bovis subsp bovis AF2122/97
cguaggcggcggcccgcag

SEQ ID NO: 3057325 - RNA, 15 nt, Mycobacterium bovis subsp bovis AF2122/97
cguaggcguacacca

SEQ ID NO: 3057326 - RNA, 20 nt, Mycobacterium bovis subsp bovis AF2122/97
cguaggcguacaccagggug

SEQ ID NO: 3057327 - RNA, 22 nt, Mycobacterium bovis subsp bovis AF2122/97
cguaggcguuguagcgguccag

SEQ ID NO: 3057328 - RNA, 16 nt, Mycobacterium bovis subsp bovis AF2122/97
cguagggacgccgagc

SEQ ID NO: 3057329 - RNA, 20 nt, Mycobacterium bovis subsp bovis AF2122/97
cguagggcagcgccaggccg

SEQ ID NO: 3057330 - RNA, 14 nt, Mycobacterium bovis subsp bovis AF2122/97
cguagggccagcgc

SEQ ID NO: 3057331 - RNA, 15 nt, Mycobacterium bovis subsp bovis AF2122/97
cguagggccagcgcc

SEQ ID NO: 3057332 - RNA, 21 nt, Mycobacterium bovis subsp bovis AF2122/97
cguagggccagcgccucggca

SEQ ID NO: 3057333 - RNA, 23 nt, Mycobacterium bovis subsp bovis AF2122/97
cguaggggugguagcugacgcug

SEQ ID NO: 3057334 - RNA, 12 nt, Mycobacterium bovis subsp bovis AF2122/97
cguaggucgugg

SEQ ID NO: 3057335 - RNA, 15 nt, Mycobacterium bovis subsp bovis AF2122/97
cguaggugcacaacc

SEQ ID NO: 3057336 - RNA, 17 nt, Mycobacterium bovis subsp bovis AF2122/97
cguaggugccgaagaug

SEQ ID NO: 3057337 - RNA, 20 nt, Mycobacterium bovis subsp bovis AF2122/97
cguaggugccgaagaugacc

SEQ ID NO: 3057338 - RNA, 14 nt, Mycobacterium bovis subsp bovis AF2122/97
cguagguggccagc

SEQ ID NO: 3057339 - RNA, 17 nt, Mycobacterium bovis subsp bovis AF2122/97
cguagguggccagcgcg

SEQ ID NO: 3057340 - RNA, 18 nt, Mycobacterium bovis subsp bovis AF2122/97
cguagguggccagcgcgg

SEQ ID NO: 3057341 - RNA, 22 nt, Mycobacterium bovis subsp bovis AF2122/97
cguagguggccagcgcggcgag

SEQ ID NO: 3057342 - RNA, 19 nt, Mycobacterium bovis subsp bovis AF2122/97
cguagguggccggcuugca

SEQ ID NO: 3057343 - RNA, 23 nt, Mycobacterium bovis subsp bovis AF2122/97
cguagguggccggcuugcaguga

SEQ ID NO: 3057344 - RNA, 15 nt, Mycobacterium bovis subsp bovis AF2122/97
cguaguaaugcucga

SEQ ID NO: 3057345 - RNA, 14 nt, Mycobacterium bovis subsp bovis AF2122/97
cguaguacagcgcg

SEQ ID NO: 3057346 - RNA, 15 nt, Mycobacterium bovis subsp bovis AF2122/97
cguaguacagcgcga

SEQ ID NO: 3057347 - RNA, 16 nt, Mycobacterium bovis subsp bovis AF2122/97
cguaguagcgaugcac

SEQ ID NO: 3057348 - RNA, 17 nt, Mycobacterium bovis subsp bovis AF2122/97
cguaguagcgaugcacc

SEQ ID NO: 3057349 - RNA, 16 nt, Mycobacterium bovis subsp bovis AF2122/97
cguaguaguggccgcc

SEQ ID NO: 3057350 - RNA, 18 nt, Mycobacterium bovis subsp bovis AF2122/97
cguaguaguggccgccac

SEQ ID NO: 3057351 - RNA, 16 nt, Mycobacterium bovis subsp bovis AF2122/97
cguagucccacugcca

SEQ ID NO: 3057352 - RNA, 19 nt, Mycobacterium bovis subsp bovis AF2122/97
cguagucgcgggugcggac

SEQ ID NO: 3057353 - RNA, 18 nt, Mycobacterium bovis subsp bovis AF2122/97
cguagucggcggugcaga

SEQ ID NO: 3057354 - RNA, 14 nt, Mycobacterium bovis subsp bovis AF2122/97
cguagucguagcag

SEQ ID NO: 3057355 - RNA, 21 nt, Mycobacterium bovis subsp bovis AF2122/97
cguagucgucuucgucauggc

SEQ ID NO: 3057356 - RNA, 23 nt, Mycobacterium bovis subsp bovis AF2122/97
cguagucgucuucgucauggccg

SEQ ID NO: 3057357 - RNA, 23 nt, Mycobacterium bovis subsp bovis AF2122/97
cguagugaacggcucgggcagcg

SEQ ID NO: 3057358 - RNA, 14 nt, Mycobacterium bovis subsp bovis AF2122/97
cguagugcaccgcc

SEQ ID NO: 3057359 - RNA, 20 nt, Mycobacterium bovis subsp bovis AF2122/97
cguagugcaccgccugcgcc

SEQ ID NO: 3057360 - RNA, 18 nt, Mycobacterium bovis subsp bovis AF2122/97
cguagugcacgucggcgg

SEQ ID NO: 3057361 - RNA, 19 nt, Mycobacterium bovis subsp bovis AF2122/97
cguagugcucgccggcacc

SEQ ID NO: 3057362 - RNA, 20 nt, Mycobacterium bovis subsp bovis AF2122/97
cguagugcucgccggcaccg

SEQ ID NO: 3057363 - RNA, 16 nt, Mycobacterium bovis subsp bovis AF2122/97
cguaguggaagccgac

SEQ ID NO: 3057364 - RNA, 16 nt, Mycobacterium bovis subsp bovis AF2122/97
cguaguuccgcaccga

SEQ ID NO: 3057365 - RNA, 20 nt, Mycobacterium bovis subsp bovis AF2122/97
cguaguugccggcuucggcg

SEQ ID NO: 3057366 - RNA, 21 nt, Mycobacterium bovis subsp bovis AF2122/97
cguaguugccggcuucggcga

SEQ ID NO: 3057367 - RNA, 22 nt, Mycobacterium bovis subsp bovis AF2122/97
cguaguugccggcuucggcgag

SEQ ID NO: 3057368 - RNA, 24 nt, Mycobacterium bovis subsp bovis AF2122/97
cguaguugccggcuucggcgagcg

SEQ ID NO: 3057369 - RNA, 14 nt, Mycobacterium bovis subsp bovis AF2122/97
cguauacccgggcg

SEQ ID NO: 3057370 - RNA, 16 nt, Mycobacterium bovis subsp bovis AF2122/97
cguauaccgcacccug

SEQ ID NO: 3057371 - RNA, 22 nt, Mycobacterium bovis subsp bovis AF2122/97
cguaucacgguugccgcgaucg

SEQ ID NO: 3057372 - RNA, 20 nt, Mycobacterium bovis subsp bovis AF2122/97
cguauccacggucgaccagg

SEQ ID NO: 3057373 - RNA, 12 nt, Mycobacterium bovis subsp bovis AF2122/97
cguauccaggcg

SEQ ID NO: 3057374 - RNA, 15 nt, Mycobacterium bovis subsp bovis AF2122/97
cguaucgggcaacga

SEQ ID NO: 3057375 - RNA, 15 nt, Mycobacterium bovis subsp bovis AF2122/97
cguaucggggcacca

SEQ ID NO: 3057376 - RNA, 20 nt, Mycobacterium bovis subsp bovis AF2122/97
cguaucggguuucgaucuuc

SEQ ID NO: 3057377 - RNA, 21 nt, Mycobacterium bovis subsp bovis AF2122/97
cguaucggguuucgaucuucu

SEQ ID NO: 3057378 - RNA, 18 nt, Mycobacterium bovis subsp bovis AF2122/97
cguaucgugggugccggc

SEQ ID NO: 3057379 - RNA, 17 nt, Mycobacterium bovis subsp bovis AF2122/97
cguaugacgcccaccga

SEQ ID NO: 3057380 - RNA, 19 nt, Mycobacterium bovis subsp bovis AF2122/97
cguaugccguggccgccau

SEQ ID NO: 3057381 - RNA, 14 nt, Mycobacterium bovis subsp bovis AF2122/97
cguauggacgagga

SEQ ID NO: 3057382 - RNA, 21 nt, Mycobacterium bovis subsp bovis AF2122/97
cguauggcucaccccggucga

SEQ ID NO: 3057383 - RNA, 20 nt, Mycobacterium bovis subsp bovis AF2122/97
cguauucguuggggcugccg

SEQ ID NO: 3057384 - RNA, 19 nt, Mycobacterium bovis subsp bovis AF2122/97
cguauugauacugcccgcg

SEQ ID NO: 3057385 - RNA, 22 nt, Mycobacterium bovis subsp bovis AF2122/97
cguauugcaccgccaggucgag

SEQ ID NO: 3057386 - RNA, 19 nt, Mycobacterium bovis subsp bovis AF2122/97
cguauugccaaagcccgac

SEQ ID NO: 3057387 - RNA, 16 nt, Mycobacterium bovis subsp bovis AF2122/97
cgucaaacccagcgac

SEQ ID NO: 3057388 - RNA, 21 nt, Mycobacterium bovis subsp bovis AF2122/97
cgucaaacccagcgacgcggc

SEQ ID NO: 3057389 - RNA, 22 nt, Mycobacterium bovis subsp bovis AF2122/97
cgucaaacccagcgacgcggcc

SEQ ID NO: 3057390 - RNA, 17 nt, Mycobacterium bovis subsp bovis AF2122/97
cgucaaacgacagcccu

SEQ ID NO: 3057391 - RNA, 18 nt, Mycobacterium bovis subsp bovis AF2122/97
cgucaaacgacagcccua

SEQ ID NO: 3057392 - RNA, 23 nt, Mycobacterium bovis subsp bovis AF2122/97
cgucaacaccaugguggugaugc

SEQ ID NO: 3057393 - RNA, 14 nt, Mycobacterium bovis subsp bovis AF2122/97
cgucaacagcgugg

SEQ ID NO: 3057394 - RNA, 24 nt, Mycobacterium bovis subsp bovis AF2122/97
cgucaaccaccaggagcggauagc

SEQ ID NO: 3057395 - RNA, 16 nt, Mycobacterium bovis subsp bovis AF2122/97
cgucaaccacggccgc

SEQ ID NO: 3057396 - RNA, 18 nt, Mycobacterium bovis subsp bovis AF2122/97
cgucaaccacggccgccg

SEQ ID NO: 3057397 - RNA, 21 nt, Mycobacterium bovis subsp bovis AF2122/97
cgucaaccagggugccggcgg

SEQ ID NO: 3057398 - RNA, 21 nt, Mycobacterium bovis subsp bovis AF2122/97
cgucaaccgaucggucguccg

SEQ ID NO: 3057399 - RNA, 14 nt, Mycobacterium bovis subsp bovis AF2122/97
cgucaaccgggcgg

SEQ ID NO: 3057400 - RNA, 23 nt, Mycobacterium bovis subsp bovis AF2122/97
cgucaaccugcgcaucaccacug

SEQ ID NO: 3057401 - RNA, 20 nt, Mycobacterium bovis subsp bovis AF2122/97
cgucaacgacuggguggugc

SEQ ID NO: 3057402 - RNA, 18 nt, Mycobacterium bovis subsp bovis AF2122/97
cgucaacgaugguggcga

SEQ ID NO: 3057403 - RNA, 22 nt, Mycobacterium bovis subsp bovis AF2122/97
cgucaacggaagaagcaguagc

SEQ ID NO: 3057404 - RNA, 21 nt, Mycobacterium bovis subsp bovis AF2122/97
cgucaagagugcucagcgcgc

SEQ ID NO: 3057405 - RNA, 23 nt, Mycobacterium bovis subsp bovis AF2122/97
cgucaagagugcucagcgcgcgc

SEQ ID NO: 3057406 - RNA, 15 nt, Mycobacterium bovis subsp bovis AF2122/97
cgucacugccaccuc

SEQ ID NO: 3057407 - RNA, 15 nt, Mycobacterium bovis subsp bovis AF2122/97
cgucacuucccggau

SEQ ID NO: 3057408 - RNA, 23 nt, Mycobacterium bovis subsp bovis AF2122/97
cgucacuucccggauagacggcg

SEQ ID NO: 3057409 - RNA, 21 nt, Mycobacterium bovis subsp bovis AF2122/97
cgucagaacaccggccaggcc

SEQ ID NO: 3057410 - RNA, 15 nt, Mycobacterium bovis subsp bovis AF2122/97
cgucagaccgcgaac

SEQ ID NO: 3057411 - RNA, 13 nt, Mycobacterium bovis subsp bovis AF2122/97
cgucagauccggc

SEQ ID NO: 3057412 - RNA, 16 nt, Mycobacterium bovis subsp bovis AF2122/97
cgucagauccggccgu

SEQ ID NO: 3057413 - RNA, 15 nt, Mycobacterium bovis subsp bovis AF2122/97
cgucagcaccauccc

SEQ ID NO: 3057414 - RNA, 13 nt, Mycobacterium bovis subsp bovis AF2122/97
cgucagccaccgc

SEQ ID NO: 3057415 - RNA, 16 nt, Mycobacterium bovis subsp bovis AF2122/97
cgucagccaccgcaug

SEQ ID NO: 3057416 - RNA, 17 nt, Mycobacterium bovis subsp bovis AF2122/97
cgucagccaggugccca

SEQ ID NO: 3057417 - RNA, 16 nt, Mycobacterium bovis subsp bovis AF2122/97
cgucagcccgacguug

SEQ ID NO: 3057418 - RNA, 17 nt, Mycobacterium bovis subsp bovis AF2122/97
cgucagcccgacguugc

SEQ ID NO: 3057419 - RNA, 13 nt, Mycobacterium bovis subsp bovis AF2122/97
cgucagccgcacc

SEQ ID NO: 3057420 - RNA, 20 nt, Mycobacterium bovis subsp bovis AF2122/97
cgucagcgccgccggaagcg

SEQ ID NO: 3057421 - RNA, 18 nt, Mycobacterium bovis subsp bovis AF2122/97
cgucagcgcgaccgucag

SEQ ID NO: 3057422 - RNA, 14 nt, Mycobacterium bovis subsp bovis AF2122/97
cgucagcgcgccgu

SEQ ID NO: 3057423 - RNA, 13 nt, Mycobacterium bovis subsp bovis AF2122/97
cgucagcggccag

SEQ ID NO: 3057424 - RNA, 13 nt, Mycobacterium bovis subsp bovis AF2122/97
cgucagcggcggc

SEQ ID NO: 3057425 - RNA, 15 nt, Mycobacterium bovis subsp bovis AF2122/97
cgucagcggcggcca

SEQ ID NO: 3057426 - RNA, 19 nt, Mycobacterium bovis subsp bovis AF2122/97
cgucagcggcggccacggc

SEQ ID NO: 3057427 - RNA, 16 nt, Mycobacterium bovis subsp bovis AF2122/97
cgucagcgggcagcag

SEQ ID NO: 3057428 - RNA, 21 nt, Mycobacterium bovis subsp bovis AF2122/97
cgucagcggguaagacgucgg

SEQ ID NO: 3057429 - RNA, 15 nt, Mycobacterium bovis subsp bovis AF2122/97
cgucagcgucggcgc

SEQ ID NO: 3057430 - RNA, 19 nt, Mycobacterium bovis subsp bovis AF2122/97
cgucagcgucugagcgccg

SEQ ID NO: 3057431 - RNA, 14 nt, Mycobacterium bovis subsp bovis AF2122/97
cgucagcucaccac

SEQ ID NO: 3057432 - RNA, 19 nt, Mycobacterium bovis subsp bovis AF2122/97
cgucagcucaccacccaga

SEQ ID NO: 3057433 - RNA, 22 nt, Mycobacterium bovis subsp bovis AF2122/97
cgucagcuguuugccggcuuug

SEQ ID NO: 3057434 - RNA, 14 nt, Mycobacterium bovis subsp bovis AF2122/97
cgucaggaaccacc

SEQ ID NO: 3057435 - RNA, 24 nt, Mycobacterium bovis subsp bovis AF2122/97
cgucaggaaccacccaccggccac

SEQ ID NO: 3057436 - RNA, 13 nt, Mycobacterium bovis subsp bovis AF2122/97
cgucaggccagcg

SEQ ID NO: 3057437 - RNA, 21 nt, Mycobacterium bovis subsp bovis AF2122/97
cgucaggccuccaaaaucgcg

SEQ ID NO: 3057438 - RNA, 16 nt, Mycobacterium bovis subsp bovis AF2122/97
cgucaggugcgcgacc

SEQ ID NO: 3057439 - RNA, 19 nt, Mycobacterium bovis subsp bovis AF2122/97
cgucaggugcgcgaccagg

SEQ ID NO: 3057440 - RNA, 16 nt, Mycobacterium bovis subsp bovis AF2122/97
cgucagguuccgcgac

SEQ ID NO: 3057441 - RNA, 19 nt, Mycobacterium bovis subsp bovis AF2122/97
cgucagguuccgcgacaac

SEQ ID NO: 3057442 - RNA, 18 nt, Mycobacterium bovis subsp bovis AF2122/97
cgucaguaccgcacgcaa

SEQ ID NO: 3057443 - RNA, 21 nt, Mycobacterium bovis subsp bovis AF2122/97
cgucagucaacucaccgucgg

SEQ ID NO: 3057444 - RNA, 15 nt, Mycobacterium bovis subsp bovis AF2122/97
cgucaguccucaucg

SEQ ID NO: 3057445 - RNA, 19 nt, Mycobacterium bovis subsp bovis AF2122/97
cgucaguccucaucgagcg

SEQ ID NO: 3057446 - RNA, 20 nt, Mycobacterium bovis subsp bovis AF2122/97
cgucagugccccgcagcacu

SEQ ID NO: 3057447 - RNA, 22 nt, Mycobacterium bovis subsp bovis AF2122/97
cgucaguuacgcaucgucagcg

SEQ ID NO: 3057448 - RNA, 23 nt, Mycobacterium bovis subsp bovis AF2122/97
cgucaguuacgcaucgucagcga

SEQ ID NO: 3057449 - RNA, 13 nt, Mycobacterium bovis subsp bovis AF2122/97
cgucauacagcgc

SEQ ID NO: 3057450 - RNA, 16 nt, Mycobacterium bovis subsp bovis AF2122/97
cgucauacagcgcccu

SEQ ID NO: 3057451 - RNA, 13 nt, Mycobacterium bovis subsp bovis AF2122/97
cgucaucaggucg

SEQ ID NO: 3057452 - RNA, 12 nt, Mycobacterium bovis subsp bovis AF2122/97
cgucauccaccg

SEQ ID NO: 3057453 - RNA, 15 nt, Mycobacterium bovis subsp bovis AF2122/97
cgucauccaccgcaa

SEQ ID NO: 3057454 - RNA, 22 nt, Mycobacterium bovis subsp bovis AF2122/97
cgucauccauccgggccgcggc

SEQ ID NO: 3057455 - RNA, 15 nt, Mycobacterium bovis subsp bovis AF2122/97
cgucaucccgagcuc

SEQ ID NO: 3057456 - RNA, 14 nt, Mycobacterium bovis subsp bovis AF2122/97
cgucauccucgucg

SEQ ID NO: 3057457 - RNA, 19 nt, Mycobacterium bovis subsp bovis AF2122/97
cgucaucgagcgggaucgg

SEQ ID NO: 3057458 - RNA, 18 nt, Mycobacterium bovis subsp bovis AF2122/97
cgucaucgccgacccgcc

SEQ ID NO: 3057459 - RNA, 13 nt, Mycobacterium bovis subsp bovis AF2122/97
cgucaucgcgggu

SEQ ID NO: 3057460 - RNA, 14 nt, Mycobacterium bovis subsp bovis AF2122/97
cgucaucgcgggug

SEQ ID NO: 3057461 - RNA, 14 nt, Mycobacterium bovis subsp bovis AF2122/97
cgucaucgcggugu

SEQ ID NO: 3057462 - RNA, 21 nt, Mycobacterium bovis subsp bovis AF2122/97
cgucaucgcggugugccgguc

SEQ ID NO: 3057463 - RNA, 21 nt, Mycobacterium bovis subsp bovis AF2122/97
cgucaucggcuggccgcgccu

SEQ ID NO: 3057464 - RNA, 15 nt, Mycobacterium bovis subsp bovis AF2122/97
cgucaucggggccug

SEQ ID NO: 3057465 - RNA, 17 nt, Mycobacterium bovis subsp bovis AF2122/97
cgucaucuccgacucga

SEQ ID NO: 3057466 - RNA, 22 nt, Mycobacterium bovis subsp bovis AF2122/97
cgucaucugguggaccuccgga

SEQ ID NO: 3057467 - RNA, 23 nt, Mycobacterium bovis subsp bovis AF2122/97
cgucaugaagccguugccgccac

SEQ ID NO: 3057468 - RNA, 19 nt, Mycobacterium bovis subsp bovis AF2122/97
cgucaugaugucgacaucg

SEQ ID NO: 3057469 - RNA, 20 nt, Mycobacterium bovis subsp bovis AF2122/97
cgucaugaugucgacaucga

SEQ ID NO: 3057470 - RNA, 16 nt, Mycobacterium bovis subsp bovis AF2122/97
cgucaugccagucgcc

SEQ ID NO: 3057471 - RNA, 18 nt, Mycobacterium bovis subsp bovis AF2122/97
cgucaugccagucgccga

SEQ ID NO: 3057472 - RNA, 14 nt, Mycobacterium bovis subsp bovis AF2122/97
cgucaugcccaccg

SEQ ID NO: 3057473 - RNA, 14 nt, Mycobacterium bovis subsp bovis AF2122/97
cgucaugccgacga

SEQ ID NO: 3057474 - RNA, 17 nt, Mycobacterium bovis subsp bovis AF2122/97
cgucauggcccgaucga

SEQ ID NO: 3057475 - RNA, 23 nt, Mycobacterium bovis subsp bovis AF2122/97
cgucauggcgaaccgucagcgcg

SEQ ID NO: 3057476 - RNA, 14 nt, Mycobacterium bovis subsp bovis AF2122/97
cgucauggcgagua

SEQ ID NO: 3057477 - RNA, 23 nt, Mycobacterium bovis subsp bovis AF2122/97
cgucauggcgaguacggccugcc

SEQ ID NO: 3057478 - RNA, 18 nt, Mycobacterium bovis subsp bovis AF2122/97
cgucauggcgggugcggc

SEQ ID NO: 3057479 - RNA, 17 nt, Mycobacterium bovis subsp bovis AF2122/97
cgucaugggcggcuucg

SEQ ID NO: 3057480 - RNA, 14 nt, Mycobacterium bovis subsp bovis AF2122/97
cgucauucaccgcg

SEQ ID NO: 3057481 - RNA, 14 nt, Mycobacterium bovis subsp bovis AF2122/97
cgucauugccacca

SEQ ID NO: 3057482 - RNA, 16 nt, Mycobacterium bovis subsp bovis AF2122/97
cgucauuuccacaucc

SEQ ID NO: 3057483 - RNA, 12 nt, Mycobacterium bovis subsp bovis AF2122/97
cguccaacccag

SEQ ID NO: 3057484 - RNA, 15 nt, Mycobacterium bovis subsp bovis AF2122/97
cguccaacccagggu

SEQ ID NO: 3057485 - RNA, 17 nt, Mycobacterium bovis subsp bovis AF2122/97
cguccaacuacgccagc

SEQ ID NO: 3057486 - RNA, 20 nt, Mycobacterium bovis subsp bovis AF2122/97
cguccaacuacgccagccgc

SEQ ID NO: 3057487 - RNA, 16 nt, Mycobacterium bovis subsp bovis AF2122/97
cguccaacucggcccg

SEQ ID NO: 3057488 - RNA, 13 nt, Mycobacterium bovis subsp bovis AF2122/97
cguccaagauguc

SEQ ID NO: 3057489 - RNA, 17 nt, Mycobacterium bovis subsp bovis AF2122/97
cguccaagccagcguug

SEQ ID NO: 3057490 - RNA, 18 nt, Mycobacterium bovis subsp bovis AF2122/97
cguccaagccagcguugg

SEQ ID NO: 3057491 - RNA, 21 nt, Mycobacterium bovis subsp bovis AF2122/97
cguccaagccagcguuggcgg

SEQ ID NO: 3057492 - RNA, 22 nt, Mycobacterium bovis subsp bovis AF2122/97
cguccaagccagcguuggcggc

SEQ ID NO: 3057493 - RNA, 22 nt, Mycobacterium bovis subsp bovis AF2122/97
cgucccgcgagcagcccggcga

SEQ ID NO: 3057494 - RNA, 13 nt, Mycobacterium bovis subsp bovis AF2122/97
cgucccgcggcgc

SEQ ID NO: 3057495 - RNA, 13 nt, Mycobacterium bovis subsp bovis AF2122/97
cgucccgcucgag

SEQ ID NO: 3057496 - RNA, 16 nt, Mycobacterium bovis subsp bovis AF2122/97
cgucccgcucgagcag

SEQ ID NO: 3057497 - RNA, 17 nt, Mycobacterium bovis subsp bovis AF2122/97
cgucccgcucgagcagc

SEQ ID NO: 3057498 - RNA, 18 nt, Mycobacterium bovis subsp bovis AF2122/97
cgucccgcucgagcagcg

SEQ ID NO: 3057499 - RNA, 22 nt, Mycobacterium bovis subsp bovis AF2122/97
cgucccggcgaccggguccggc

SEQ ID NO: 3057500 - RNA, 14 nt, Mycobacterium bovis subsp bovis AF2122/97
cgucccggcgguca

SEQ ID NO: 3057501 - RNA, 19 nt, Mycobacterium bovis subsp bovis AF2122/97
cgucccggcggucagcggc

SEQ ID NO: 3057502 - RNA, 21 nt, Mycobacterium bovis subsp bovis AF2122/97
cgucccgguugacgccggucc

SEQ ID NO: 3057503 - RNA, 21 nt, Mycobacterium bovis subsp bovis AF2122/97
cgucccugugucgccgucgcg

SEQ ID NO: 3057504 - RNA, 17 nt, Mycobacterium bovis subsp bovis AF2122/97
cguccgacaacgacugc

SEQ ID NO: 3057505 - RNA, 20 nt, Mycobacterium bovis subsp bovis AF2122/97
cguccgacaacgacugcguu

SEQ ID NO: 3057506 - RNA, 13 nt, Mycobacterium bovis subsp bovis AF2122/97
cguccgaccaggg

SEQ ID NO: 3057507 - RNA, 21 nt, Mycobacterium bovis subsp bovis AF2122/97
cguccgaccgauaacacccgg

SEQ ID NO: 3057508 - RNA, 19 nt, Mycobacterium bovis subsp bovis AF2122/97
cguccgaccgguacccgua

SEQ ID NO: 3057509 - RNA, 18 nt, Mycobacterium bovis subsp bovis AF2122/97
cguccgacgaguacacga

SEQ ID NO: 3057510 - RNA, 19 nt, Mycobacterium bovis subsp bovis AF2122/97
cguccgacgaguacacgau

SEQ ID NO: 3057511 - RNA, 15 nt, Mycobacterium bovis subsp bovis AF2122/97
cguccgaucggcgcg

SEQ ID NO: 3057512 - RNA, 16 nt, Mycobacterium bovis subsp bovis AF2122/97
cguccgaucggcgcgc

SEQ ID NO: 3057513 - RNA, 12 nt, Mycobacterium bovis subsp bovis AF2122/97
cguccgaucggu

SEQ ID NO: 3057514 - RNA, 15 nt, Mycobacterium bovis subsp bovis AF2122/97
cguccgcccagcacc

SEQ ID NO: 3057515 - RNA, 14 nt, Mycobacterium bovis subsp bovis AF2122/97
cguccgcccagccg

SEQ ID NO: 3057516 - RNA, 20 nt, Mycobacterium bovis subsp bovis AF2122/97
cguccgcccagccgcagcac

SEQ ID NO: 3057517 - RNA, 15 nt, Mycobacterium bovis subsp bovis AF2122/97
cguccgccgcagacg

SEQ ID NO: 3057518 - RNA, 16 nt, Mycobacterium bovis subsp bovis AF2122/97
cguccgccgcagacgc

SEQ ID NO: 3057519 - RNA, 15 nt, Mycobacterium bovis subsp bovis AF2122/97
cguccgccugcaccg

SEQ ID NO: 3057520 - RNA, 18 nt, Mycobacterium bovis subsp bovis AF2122/97
cguccgccugcaccgccg

SEQ ID NO: 3057521 - RNA, 20 nt, Mycobacterium bovis subsp bovis AF2122/97
cguccgccugcaccgccgcc

SEQ ID NO: 3057522 - RNA, 18 nt, Mycobacterium bovis subsp bovis AF2122/97
cguccgcgaucugcagcg

SEQ ID NO: 3057523 - RNA, 19 nt, Mycobacterium bovis subsp bovis AF2122/97
cguccgcgcccaccggcua

SEQ ID NO: 3057524 - RNA, 13 nt, Mycobacterium bovis subsp bovis AF2122/97
cguccgcgccgag

SEQ ID NO: 3057525 - RNA, 14 nt, Mycobacterium bovis subsp bovis AF2122/97
cguccgcggaugca

SEQ ID NO: 3057526 - RNA, 21 nt, Mycobacterium bovis subsp bovis AF2122/97
cguccgcgggggaccgcccga

SEQ ID NO: 3057527 - RNA, 20 nt, Mycobacterium bovis subsp bovis AF2122/97
cguccgcggguagcgguuca

SEQ ID NO: 3057528 - RNA, 14 nt, Mycobacterium bovis subsp bovis AF2122/97
cguccgcgguguug

SEQ ID NO: 3057529 - RNA, 21 nt, Mycobacterium bovis subsp bovis AF2122/97
cguccgcugcagguccagggu

SEQ ID NO: 3057530 - RNA, 16 nt, Mycobacterium bovis subsp bovis AF2122/97
cguccggaucggucgg

SEQ ID NO: 3057531 - RNA, 20 nt, Mycobacterium bovis subsp bovis AF2122/97
cguccggaucggucggcacc

SEQ ID NO: 3057532 - RNA, 17 nt, Mycobacterium bovis subsp bovis AF2122/97
cguccggccacgguccg

SEQ ID NO: 3057533 - RNA, 20 nt, Mycobacterium bovis subsp bovis AF2122/97
cguccggccgggcccuccac

SEQ ID NO: 3057534 - RNA, 12 nt, Mycobacterium bovis subsp bovis AF2122/97
cguccggcgaug

SEQ ID NO: 3057535 - RNA, 14 nt, Mycobacterium bovis subsp bovis AF2122/97
cguccggcggcagg

SEQ ID NO: 3057536 - RNA, 13 nt, Mycobacterium bovis subsp bovis AF2122/97
cguccggcuuggc

SEQ ID NO: 3057537 - RNA, 18 nt, Mycobacterium bovis subsp bovis AF2122/97
cguccggcuuggcggcga

SEQ ID NO: 3057538 - RNA, 20 nt, Mycobacterium bovis subsp bovis AF2122/97
cguccgggcagaugaugccg

SEQ ID NO: 3057539 - RNA, 15 nt, Mycobacterium bovis subsp bovis AF2122/97
cguccgggcggccuc

SEQ ID NO: 3057540 - RNA, 16 nt, Mycobacterium bovis subsp bovis AF2122/97
cguccggggccgcggc

SEQ ID NO: 3057541 - RNA, 17 nt, Mycobacterium bovis subsp bovis AF2122/97
cguccggggccgcggcc

SEQ ID NO: 3057542 - RNA, 23 nt, Mycobacterium bovis subsp bovis AF2122/97
cguccggguuuugcgcggccacc

SEQ ID NO: 3057543 - RNA, 16 nt, Mycobacterium bovis subsp bovis AF2122/97
cguccggugcuggucc

SEQ ID NO: 3057544 - RNA, 19 nt, Mycobacterium bovis subsp bovis AF2122/97
cguccggugcugguccagc

SEQ ID NO: 3057545 - RNA, 18 nt, Mycobacterium bovis subsp bovis AF2122/97
cguccgguggaccgccga

SEQ ID NO: 3057546 - RNA, 13 nt, Mycobacterium bovis subsp bovis AF2122/97
cguccgucggcgc

SEQ ID NO: 3057547 - RNA, 14 nt, Mycobacterium bovis subsp bovis AF2122/97
cguccgucggcgcu

SEQ ID NO: 3057548 - RNA, 19 nt, Mycobacterium bovis subsp bovis AF2122/97
cguccgucggcgcucgucg

SEQ ID NO: 3057549 - RNA, 18 nt, Mycobacterium bovis subsp bovis AF2122/97
cguccgucucgcaggcgc

SEQ ID NO: 3057550 - RNA, 21 nt, Mycobacterium bovis subsp bovis AF2122/97
cguccucagccgugcccaggc

SEQ ID NO: 3057551 - RNA, 20 nt, Mycobacterium bovis subsp bovis AF2122/97
cguccuccccuacugcguug

SEQ ID NO: 3057552 - RNA, 17 nt, Mycobacterium bovis subsp bovis AF2122/97
cguccucgaagaacugg

SEQ ID NO: 3057553 - RNA, 13 nt, Mycobacterium bovis subsp bovis AF2122/97
cguccucgcugga

SEQ ID NO: 3057554 - RNA, 20 nt, Mycobacterium bovis subsp bovis AF2122/97
cguccucggucacgaucacg

SEQ ID NO: 3057555 - RNA, 19 nt, Mycobacterium bovis subsp bovis AF2122/97
cguccucggucagcucguc

SEQ ID NO: 3057556 - RNA, 15 nt, Mycobacterium bovis subsp bovis AF2122/97
cguccugaaucgguu

SEQ ID NO: 3057557 - RNA, 15 nt, Mycobacterium bovis subsp bovis AF2122/97
cguccugccaguccg

SEQ ID NO: 3057558 - RNA, 17 nt, Mycobacterium bovis subsp bovis AF2122/97
cguccugccaguccgca

SEQ ID NO: 3057559 - RNA, 18 nt, Mycobacterium bovis subsp bovis AF2122/97
cguccugccaguccgcag

SEQ ID NO: 3057560 - RNA, 20 nt, Mycobacterium bovis subsp bovis AF2122/97
cguccugccaguccgcagcg

SEQ ID NO: 3057561 - RNA, 17 nt, Mycobacterium bovis subsp bovis AF2122/97
cguccugcccgucgucg

SEQ ID NO: 3057562 - RNA, 22 nt, Mycobacterium bovis subsp bovis AF2122/97
cguccugcccgucgucggcaac

SEQ ID NO: 3057563 - RNA, 23 nt, Mycobacterium bovis subsp bovis AF2122/97
cguccugcgagaggugcugcacc

SEQ ID NO: 3057564 - RNA, 22 nt, Mycobacterium bovis subsp bovis AF2122/97
cguccugcggguaggugacgac

SEQ ID NO: 3057565 - RNA, 23 nt, Mycobacterium bovis subsp bovis AF2122/97
cguccugcggguaggugacgacg

SEQ ID NO: 3057566 - RNA, 16 nt, Mycobacterium bovis subsp bovis AF2122/97
cguccugcucgcgagg

SEQ ID NO: 3057567 - RNA, 21 nt, Mycobacterium bovis subsp bovis AF2122/97
cguccuggugagauugguggc

SEQ ID NO: 3057568 - RNA, 14 nt, Mycobacterium bovis subsp bovis AF2122/97
cguccuuuccagga

SEQ ID NO: 3057569 - RNA, 15 nt, Mycobacterium bovis subsp bovis AF2122/97
cguccuuuccaggag

SEQ ID NO: 3057570 - RNA, 18 nt, Mycobacterium bovis subsp bovis AF2122/97
cguccuuuggguucuucg

SEQ ID NO: 3057571 - RNA, 20 nt, Mycobacterium bovis subsp bovis AF2122/97
cgucgaaaagccgugcacca

SEQ ID NO: 3057572 - RNA, 22 nt, Mycobacterium bovis subsp bovis AF2122/97
cgucgaaaagccgugcaccagc

SEQ ID NO: 3057573 - RNA, 23 nt, Mycobacterium bovis subsp bovis AF2122/97
cgucgaaaagccgugcaccagcg

SEQ ID NO: 3057574 - RNA, 22 nt, Mycobacterium bovis subsp bovis AF2122/97
cgucgaaauccacaaugcccgg

SEQ ID NO: 3057575 - RNA, 21 nt, Mycobacterium bovis subsp bovis AF2122/97
cgucgaaauggauugcggcac

SEQ ID NO: 3057576 - RNA, 22 nt, Mycobacterium bovis subsp bovis AF2122/97
cgucgaaauggauugcggcacg

SEQ ID NO: 3057577 - RNA, 20 nt, Mycobacterium bovis subsp bovis AF2122/97
cgucgaacacgucgggaugc

SEQ ID NO: 3057578 - RNA, 18 nt, Mycobacterium bovis subsp bovis AF2122/97
cgucgaacagcaccgccg

SEQ ID NO: 3057579 - RNA, 18 nt, Mycobacterium bovis subsp bovis AF2122/97
cgucgagauagucggccg

SEQ ID NO: 3057580 - RNA, 19 nt, Mycobacterium bovis subsp bovis AF2122/97
cgucgagauccucgucgag

SEQ ID NO: 3057581 - RNA, 21 nt, Mycobacterium bovis subsp bovis AF2122/97
cgucgagauccucgucgaggu

SEQ ID NO: 3057582 - RNA, 21 nt, Mycobacterium bovis subsp bovis AF2122/97
cgucgagcaacgugacccgga

SEQ ID NO: 3057583 - RNA, 15 nt, Mycobacterium bovis subsp bovis AF2122/97
cgucgagcaccaccc

SEQ ID NO: 3057584 - RNA, 20 nt, Mycobacterium bovis subsp bovis AF2122/97
cgucgagcaccacccgggcc

SEQ ID NO: 3057585 - RNA, 14 nt, Mycobacterium bovis subsp bovis AF2122/97
cgucgagcaccucc

SEQ ID NO: 3057586 - RNA, 19 nt, Mycobacterium bovis subsp bovis AF2122/97
cgucgagcacggugagccg

SEQ ID NO: 3057587 - RNA, 22 nt, Mycobacterium bovis subsp bovis AF2122/97
cgucgagcagcaccacccgcac

SEQ ID NO: 3057588 - RNA, 13 nt, Mycobacterium bovis subsp bovis AF2122/97
cgucgagcagccg

SEQ ID NO: 3057589 - RNA, 14 nt, Mycobacterium bovis subsp bovis AF2122/97
cgucgagcagccga

SEQ ID NO: 3057590 - RNA, 15 nt, Mycobacterium bovis subsp bovis AF2122/97
cgucgagcagccgcg

SEQ ID NO: 3057591 - RNA, 21 nt, Mycobacterium bovis subsp bovis AF2122/97
cgucgagcagcgccacccgcg

SEQ ID NO: 3057592 - RNA, 16 nt, Mycobacterium bovis subsp bovis AF2122/97
cgucgagcauccaccc

SEQ ID NO: 3057593 - RNA, 19 nt, Mycobacterium bovis subsp bovis AF2122/97
cgucgagccacagcgucga

SEQ ID NO: 3057594 - RNA, 17 nt, Mycobacterium bovis subsp bovis AF2122/97
cgucgagccgaccgcgg

SEQ ID NO: 3057595 - RNA, 18 nt, Mycobacterium bovis subsp bovis AF2122/97
cgucgagccgaccgcggg

SEQ ID NO: 3057596 - RNA, 18 nt, Mycobacterium bovis subsp bovis AF2122/97
cgucgagccgaucgcccg

SEQ ID NO: 3057597 - RNA, 17 nt, Mycobacterium bovis subsp bovis AF2122/97
cgucgagccggacaggc

SEQ ID NO: 3057598 - RNA, 17 nt, Mycobacterium bovis subsp bovis AF2122/97
cgucgagccgugccucg

SEQ ID NO: 3057599 - RNA, 19 nt, Mycobacterium bovis subsp bovis AF2122/97
cgucgagccgugccucgag

SEQ ID NO: 3057600 - RNA, 22 nt, Mycobacterium bovis subsp bovis AF2122/97
cgucgagcgccuugucgaucuc

SEQ ID NO: 3057601 - RNA, 16 nt, Mycobacterium bovis subsp bovis AF2122/97
cgucgagcgcgccacu

SEQ ID NO: 3057602 - RNA, 12 nt, Mycobacterium bovis subsp bovis AF2122/97
cgucgagcgcgg

SEQ ID NO: 3057603 - RNA, 21 nt, Mycobacterium bovis subsp bovis AF2122/97
cgucgagcgcggugccgccac

SEQ ID NO: 3057604 - RNA, 15 nt, Mycobacterium bovis subsp bovis AF2122/97
cgucgagcgcgucgg

SEQ ID NO: 3057605 - RNA, 14 nt, Mycobacterium bovis subsp bovis AF2122/97
cgucgagcgcuccc

SEQ ID NO: 3057606 - RNA, 22 nt, Mycobacterium bovis subsp bovis AF2122/97
cgucgagcgucugcgaucccga

SEQ ID NO: 3057607 - RNA, 18 nt, Mycobacterium bovis subsp bovis AF2122/97
cgucgagcgugcgcacgg

SEQ ID NO: 3057608 - RNA, 23 nt, Mycobacterium bovis subsp bovis AF2122/97
cgucgagcucguccucgucuucg

SEQ ID NO: 3057609 - RNA, 13 nt, Mycobacterium bovis subsp bovis AF2122/97
cgucgaggcggca

SEQ ID NO: 3057610 - RNA, 14 nt, Mycobacterium bovis subsp bovis AF2122/97
cgucgaggcugacc

SEQ ID NO: 3057611 - RNA, 16 nt, Mycobacterium bovis subsp bovis AF2122/97
cgucgaggcugaccgu

SEQ ID NO: 3057612 - RNA, 23 nt, Mycobacterium bovis subsp bovis AF2122/97
cgucgagggagcgccgcaggguc

SEQ ID NO: 3057613 - RNA, 16 nt, Mycobacterium bovis subsp bovis AF2122/97
cgucgaggucagcucc

SEQ ID NO: 3057614 - RNA, 19 nt, Mycobacterium bovis subsp bovis AF2122/97
cgucgaggucagugggcgg

SEQ ID NO: 3057615 - RNA, 18 nt, Mycobacterium bovis subsp bovis AF2122/97
cgucgagguccaccaccc

SEQ ID NO: 3057616 - RNA, 15 nt, Mycobacterium bovis subsp bovis AF2122/97
cgucgagguccucga

SEQ ID NO: 3057617 - RNA, 20 nt, Mycobacterium bovis subsp bovis AF2122/97
cgucgagguccucgucgucg

SEQ ID NO: 3057618 - RNA, 21 nt, Mycobacterium bovis subsp bovis AF2122/97
cgucgagguccucgucgucga

SEQ ID NO: 3057619 - RNA, 23 nt, Mycobacterium bovis subsp bovis AF2122/97
cgucgagguggcgcacaucgcga

SEQ ID NO: 3057620 - RNA, 16 nt, Mycobacterium bovis subsp bovis AF2122/97
cgucgagguucucccg

SEQ ID NO: 3057621 - RNA, 21 nt, Mycobacterium bovis subsp bovis AF2122/97
cgucgagguuuuucgaugggu

SEQ ID NO: 3057622 - RNA, 24 nt, Mycobacterium bovis subsp bovis AF2122/97
cgucgaguagguaacgcgcacgcu

SEQ ID NO: 3057623 - RNA, 18 nt, Mycobacterium bovis subsp bovis AF2122/97
cgucgaguaguucgucga

SEQ ID NO: 3057624 - RNA, 20 nt, Mycobacterium bovis subsp bovis AF2122/97
cgucgaguaguucgucgacg

SEQ ID NO: 3057625 - RNA, 15 nt, Mycobacterium bovis subsp bovis AF2122/97
cgucgaguccaggcc

SEQ ID NO: 3057626 - RNA, 19 nt, Mycobacterium bovis subsp bovis AF2122/97
cgucgaguccaggccggca

SEQ ID NO: 3057627 - RNA, 14 nt, Mycobacterium bovis subsp bovis AF2122/97
cgucgagucgccga

SEQ ID NO: 3057628 - RNA, 17 nt, Mycobacterium bovis subsp bovis AF2122/97
cgucgaguuccggccgg

SEQ ID NO: 3057629 - RNA, 15 nt, Mycobacterium bovis subsp bovis AF2122/97
cgucgaguuggccau

SEQ ID NO: 3057630 - RNA, 16 nt, Mycobacterium bovis subsp bovis AF2122/97
cgucgauaaccuggcg

SEQ ID NO: 3057631 - RNA, 19 nt, Mycobacterium bovis subsp bovis AF2122/97
cgucgaucaacaacagccg

SEQ ID NO: 3057632 - RNA, 20 nt, Mycobacterium bovis subsp bovis AF2122/97
cgucgaucaagugcgguccg

SEQ ID NO: 3057633 - RNA, 21 nt, Mycobacterium bovis subsp bovis AF2122/97
cgucgaucaagugcgguccgg

SEQ ID NO: 3057634 - RNA, 14 nt, Mycobacterium bovis subsp bovis AF2122/97
cgucgaucacgucg

SEQ ID NO: 3057635 - RNA, 23 nt, Mycobacterium bovis subsp bovis AF2122/97
cgucgaucagaacgugacggucc

SEQ ID NO: 3057636 - RNA, 16 nt, Mycobacterium bovis subsp bovis AF2122/97
cgucgaucagggcccc

SEQ ID NO: 3057637 - RNA, 17 nt, Mycobacterium bovis subsp bovis AF2122/97
cgucgauccgucggcgg

SEQ ID NO: 3057638 - RNA, 16 nt, Mycobacterium bovis subsp bovis AF2122/97
cgucgaucgacucaca

SEQ ID NO: 3057639 - RNA, 13 nt, Mycobacterium bovis subsp bovis AF2122/97
cgucgaucgccgc

SEQ ID NO: 3057640 - RNA, 15 nt, Mycobacterium bovis subsp bovis AF2122/97
cgucgaucgccgcgc

SEQ ID NO: 3057641 - RNA, 12 nt, Mycobacterium bovis subsp bovis AF2122/97
cgucgaucggcu

SEQ ID NO: 3057642 - RNA, 17 nt, Mycobacterium bovis subsp bovis AF2122/97
cgucgaucggcuugccu

SEQ ID NO: 3057643 - RNA, 16 nt, Mycobacterium bovis subsp bovis AF2122/97
cgucgaucucggcgca

SEQ ID NO: 3057644 - RNA, 17 nt, Mycobacterium bovis subsp bovis AF2122/97
cgucgaucucggcgcag

SEQ ID NO: 3057645 - RNA, 21 nt, Mycobacterium bovis subsp bovis AF2122/97
cgucgaugaccagcacaccgc

SEQ ID NO: 3057646 - RNA, 23 nt, Mycobacterium bovis subsp bovis AF2122/97
cgucgaugaccuugggaccaccg

SEQ ID NO: 3057647 - RNA, 21 nt, Mycobacterium bovis subsp bovis AF2122/97
cgucgaugagguucaucgccg

SEQ ID NO: 3057648 - RNA, 14 nt, Mycobacterium bovis subsp bovis AF2122/97
cgucgaugagucgg

SEQ ID NO: 3057649 - RNA, 18 nt, Mycobacterium bovis subsp bovis AF2122/97
cgucgaugaugccggaca

SEQ ID NO: 3057650 - RNA, 14 nt, Mycobacterium bovis subsp bovis AF2122/97
cgucgaugccggcu

SEQ ID NO: 3057651 - RNA, 21 nt, Mycobacterium bovis subsp bovis AF2122/97
cgucgaugccggcugccgcac

SEQ ID NO: 3057652 - RNA, 15 nt, Mycobacterium bovis subsp bovis AF2122/97
cgucgaugcgggcca

SEQ ID NO: 3057653 - RNA, 15 nt, Mycobacterium bovis subsp bovis AF2122/97
cgucgaugcgguggu

SEQ ID NO: 3057654 - RNA, 13 nt, Mycobacterium bovis subsp bovis AF2122/97
cgucgauggccac

SEQ ID NO: 3057655 - RNA, 15 nt, Mycobacterium bovis subsp bovis AF2122/97
cgucgauggccaccc

SEQ ID NO: 3057656 - RNA, 14 nt, Mycobacterium bovis subsp bovis AF2122/97
cgucgauggcgucg

SEQ ID NO: 3057657 - RNA, 16 nt, Mycobacterium bovis subsp bovis AF2122/97
cgucgauggcgucggu

SEQ ID NO: 3057658 - RNA, 15 nt, Mycobacterium bovis subsp bovis AF2122/97
cgucgauggucagca

SEQ ID NO: 3057659 - RNA, 17 nt, Mycobacterium bovis subsp bovis AF2122/97
cgucgauggucuccgga

SEQ ID NO: 3057660 - RNA, 18 nt, Mycobacterium bovis subsp bovis AF2122/97
cgucgauggucuccggac

SEQ ID NO: 3057661 - RNA, 21 nt, Mycobacterium bovis subsp bovis AF2122/97
cgucgauggucuccggacgca

SEQ ID NO: 3057662 - RNA, 15 nt, Mycobacterium bovis subsp bovis AF2122/97
cgucgauggugcggc

SEQ ID NO: 3057663 - RNA, 17 nt, Mycobacterium bovis subsp bovis AF2122/97
cgucgauggugcggccc

SEQ ID NO: 3057664 - RNA, 17 nt, Mycobacterium bovis subsp bovis AF2122/97
cgucgauguccccggcg

SEQ ID NO: 3057665 - RNA, 14 nt, Mycobacterium bovis subsp bovis AF2122/97
cgucgccgcgcaga

SEQ ID NO: 3057666 - RNA, 11 nt, Mycobacterium bovis subsp bovis AF2122/97
cgucgccgcgg

SEQ ID NO: 3057667 - RNA, 18 nt, Mycobacterium bovis subsp bovis AF2122/97
cgucgccgcggcggcagc

SEQ ID NO: 3057668 - RNA, 19 nt, Mycobacterium bovis subsp bovis AF2122/97
cgucgccgcggcggcagcg

SEQ ID NO: 3057669 - RNA, 21 nt, Mycobacterium bovis subsp bovis AF2122/97
cgucgccgcggcggcagcggc

SEQ ID NO: 3057670 - RNA, 15 nt, Mycobacterium bovis subsp bovis AF2122/97
cgucgccgcgguaga

SEQ ID NO: 3057671 - RNA, 22 nt, Mycobacterium bovis subsp bovis AF2122/97
cgucgccgcgguagacgccgcc

SEQ ID NO: 3057672 - RNA, 12 nt, Mycobacterium bovis subsp bovis AF2122/97
cgucgccggcac

SEQ ID NO: 3057673 - RNA, 16 nt, Mycobacterium bovis subsp bovis AF2122/97
cgucgccggcaccggc

SEQ ID NO: 3057674 - RNA, 20 nt, Mycobacterium bovis subsp bovis AF2122/97
cgucgccggcaccggccuug

SEQ ID NO: 3057675 - RNA, 15 nt, Mycobacterium bovis subsp bovis AF2122/97
cgucgccggccccgc

SEQ ID NO: 3057676 - RNA, 22 nt, Mycobacterium bovis subsp bovis AF2122/97
cgucgccggccccgccggcgcc

SEQ ID NO: 3057677 - RNA, 16 nt, Mycobacterium bovis subsp bovis AF2122/97
cgucgccggcggcggu

SEQ ID NO: 3057678 - RNA, 19 nt, Mycobacterium bovis subsp bovis AF2122/97
cgucgccggucaggccgcc

SEQ ID NO: 3057679 - RNA, 21 nt, Mycobacterium bovis subsp bovis AF2122/97
cgucgccggucaggccgccgc

SEQ ID NO: 3057680 - RNA, 16 nt, Mycobacterium bovis subsp bovis AF2122/97
cgucgccggugacgac

SEQ ID NO: 3057681 - RNA, 13 nt, Mycobacterium bovis subsp bovis AF2122/97
cgucgccggugcc

SEQ ID NO: 3057682 - RNA, 14 nt, Mycobacterium bovis subsp bovis AF2122/97
cgucgccgguggca

SEQ ID NO: 3057683 - RNA, 16 nt, Mycobacterium bovis subsp bovis AF2122/97
cgucgccguccagucg

SEQ ID NO: 3057684 - RNA, 20 nt, Mycobacterium bovis subsp bovis AF2122/97
cgucgccgucggugccgccg

SEQ ID NO: 3057685 - RNA, 21 nt, Mycobacterium bovis subsp bovis AF2122/97
cgucgcgacgacguagauggu

SEQ ID NO: 3057686 - RNA, 13 nt, Mycobacterium bovis subsp bovis AF2122/97
cgucgcgacgucg

SEQ ID NO: 3057687 - RNA, 18 nt, Mycobacterium bovis subsp bovis AF2122/97
cgucgcgacgucggccgu

SEQ ID NO: 3057688 - RNA, 19 nt, Mycobacterium bovis subsp bovis AF2122/97
cgucgcgaguagcugaccc

SEQ ID NO: 3057689 - RNA, 20 nt, Mycobacterium bovis subsp bovis AF2122/97
cgucgcgauccacuccggcg

SEQ ID NO: 3057690 - RNA, 20 nt, Mycobacterium bovis subsp bovis AF2122/97
cgucgcgauugccgcgguug

SEQ ID NO: 3057691 - RNA, 21 nt, Mycobacterium bovis subsp bovis AF2122/97
cgucgcgcagguagcgccgca

SEQ ID NO: 3057692 - RNA, 17 nt, Mycobacterium bovis subsp bovis AF2122/97
cgucgcgcaucgccucc

SEQ ID NO: 3057693 - RNA, 21 nt, Mycobacterium bovis subsp bovis AF2122/97
cgucgcgcaucgccuccucga

SEQ ID NO: 3057694 - RNA, 18 nt, Mycobacterium bovis subsp bovis AF2122/97
cgucgcgcucgacaaagc

SEQ ID NO: 3057695 - RNA, 16 nt, Mycobacterium bovis subsp bovis AF2122/97
cgucgcgcucgcacca

SEQ ID NO: 3057696 - RNA, 19 nt, Mycobacterium bovis subsp bovis AF2122/97
cgucgcgcucgcaccacca

SEQ ID NO: 3057697 - RNA, 15 nt, Mycobacterium bovis subsp bovis AF2122/97
cgucgcgcugccggc

SEQ ID NO: 3057698 - RNA, 16 nt, Mycobacterium bovis subsp bovis AF2122/97
cgucgcgcugccggcc

SEQ ID NO: 3057699 - RNA, 19 nt, Mycobacterium bovis subsp bovis AF2122/97
cgucgcggaaucgcgacac

SEQ ID NO: 3057700 - RNA, 16 nt, Mycobacterium bovis subsp bovis AF2122/97
cgucgcggaguagccg

SEQ ID NO: 3057701 - RNA, 19 nt, Mycobacterium bovis subsp bovis AF2122/97
cgucgcggaguagccgcag

SEQ ID NO: 3057702 - RNA, 20 nt, Mycobacterium bovis subsp bovis AF2122/97
cgucgcggaguagccgcagc

SEQ ID NO: 3057703 - RNA, 19 nt, Mycobacterium bovis subsp bovis AF2122/97
cgucgcggaucagcccgcg

SEQ ID NO: 3057704 - RNA, 22 nt, Mycobacterium bovis subsp bovis AF2122/97
cgucgcggaucagcccgcgcag

SEQ ID NO: 3057705 - RNA, 13 nt, Mycobacterium bovis subsp bovis AF2122/97
cgucgcggaucug

SEQ ID NO: 3057706 - RNA, 17 nt, Mycobacterium bovis subsp bovis AF2122/97
cgucgcggccacgguca

SEQ ID NO: 3057707 - RNA, 19 nt, Mycobacterium bovis subsp bovis AF2122/97
cgucgcggccacggucagc

SEQ ID NO: 3057708 - RNA, 14 nt, Mycobacterium bovis subsp bovis AF2122/97
cgucgcggccagca

SEQ ID NO: 3057709 - RNA, 15 nt, Mycobacterium bovis subsp bovis AF2122/97
cgucgcggcccgcga

SEQ ID NO: 3057710 - RNA, 19 nt, Mycobacterium bovis subsp bovis AF2122/97
cgucgcggccgagacggcg

SEQ ID NO: 3057711 - RNA, 22 nt, Mycobacterium bovis subsp bovis AF2122/97
cgucgcggccgagacggcguug

SEQ ID NO: 3057712 - RNA, 13 nt, Mycobacterium bovis subsp bovis AF2122/97
cgucgcggccgcg

SEQ ID NO: 3057713 - RNA, 14 nt, Mycobacterium bovis subsp bovis AF2122/97
cgucgcggccggcg

SEQ ID NO: 3057714 - RNA, 18 nt, Mycobacterium bovis subsp bovis AF2122/97
cgucgcggccggcggccg

SEQ ID NO: 3057715 - RNA, 19 nt, Mycobacterium bovis subsp bovis AF2122/97
cgucgcgggauugcgcgcu

SEQ ID NO: 3057716 - RNA, 16 nt, Mycobacterium bovis subsp bovis AF2122/97
cgucgcgggccaccgc

SEQ ID NO: 3057717 - RNA, 16 nt, Mycobacterium bovis subsp bovis AF2122/97
cgucgcgggcgauggc

SEQ ID NO: 3057718 - RNA, 20 nt, Mycobacterium bovis subsp bovis AF2122/97
cgucgcggguaaccggcucc

SEQ ID NO: 3057719 - RNA, 16 nt, Mycobacterium bovis subsp bovis AF2122/97
cgucgcggguccaggc

SEQ ID NO: 3057720 - RNA, 20 nt, Mycobacterium bovis subsp bovis AF2122/97
cgucgcggguccaggcguug

SEQ ID NO: 3057721 - RNA, 12 nt, Mycobacterium bovis subsp bovis AF2122/97
cgucgcgguagg

SEQ ID NO: 3057722 - RNA, 13 nt, Mycobacterium bovis subsp bovis AF2122/97
cgucgcgguaggc

SEQ ID NO: 3057723 - RNA, 15 nt, Mycobacterium bovis subsp bovis AF2122/97
cgucgcggucgauca

SEQ ID NO: 3057724 - RNA, 23 nt, Mycobacterium bovis subsp bovis AF2122/97
cgucgcguccgcgaucugcagcg

SEQ ID NO: 3057725 - RNA, 14 nt, Mycobacterium bovis subsp bovis AF2122/97
cgucgcgucgccag

SEQ ID NO: 3057726 - RNA, 21 nt, Mycobacterium bovis subsp bovis AF2122/97
cgucgcgucgccaggcccccu

SEQ ID NO: 3057727 - RNA, 22 nt, Mycobacterium bovis subsp bovis AF2122/97
cgucgcguggaguggugaucca

SEQ ID NO: 3057728 - RNA, 18 nt, Mycobacterium bovis subsp bovis AF2122/97
cgucgcgugggaugucga

SEQ ID NO: 3057729 - RNA, 19 nt, Mycobacterium bovis subsp bovis AF2122/97
cgucgcguucuccggcacc

SEQ ID NO: 3057730 - RNA, 20 nt, Mycobacterium bovis subsp bovis AF2122/97
cgucgcguucuccggcaccg

SEQ ID NO: 3057731 - RNA, 18 nt, Mycobacterium bovis subsp bovis AF2122/97
cgucgcguugagcgcagc

SEQ ID NO: 3057732 - RNA, 16 nt, Mycobacterium bovis subsp bovis AF2122/97
cgucgcuagggugagc

SEQ ID NO: 3057733 - RNA, 17 nt, Mycobacterium bovis subsp bovis AF2122/97
cgucgcuagggugagcc

SEQ ID NO: 3057734 - RNA, 18 nt, Mycobacterium bovis subsp bovis AF2122/97
cgucgcuagggugagccc

SEQ ID NO: 3057735 - RNA, 21 nt, Mycobacterium bovis subsp bovis AF2122/97
cgucgcuaucgugcgccgacg

SEQ ID NO: 3057736 - RNA, 15 nt, Mycobacterium bovis subsp bovis AF2122/97
cgucgcuaugcgccg

SEQ ID NO: 3057737 - RNA, 19 nt, Mycobacterium bovis subsp bovis AF2122/97
cgucgcucgaauacaccuu

SEQ ID NO: 3057738 - RNA, 20 nt, Mycobacterium bovis subsp bovis AF2122/97
cgucgcucgucgucaccgau

SEQ ID NO: 3057739 - RNA, 23 nt, Mycobacterium bovis subsp bovis AF2122/97
cgucgcugaaaucgguggccacc

SEQ ID NO: 3057740 - RNA, 13 nt, Mycobacterium bovis subsp bovis AF2122/97
cgucgcugaccgc

SEQ ID NO: 3057741 - RNA, 14 nt, Mycobacterium bovis subsp bovis AF2122/97
cgucgcugacgccc

SEQ ID NO: 3057742 - RNA, 23 nt, Mycobacterium bovis subsp bovis AF2122/97
cgucgcugagcacggcgcggcgg

SEQ ID NO: 3057743 - RNA, 24 nt, Mycobacterium bovis subsp bovis AF2122/97
cgucgcugagcacggcgcggcgga

SEQ ID NO: 3057744 - RNA, 17 nt, Mycobacterium bovis subsp bovis AF2122/97
cgucgcugagcagcgcc

SEQ ID NO: 3057745 - RNA, 18 nt, Mycobacterium bovis subsp bovis AF2122/97
cgucgcugagcagcgccg

SEQ ID NO: 3057746 - RNA, 18 nt, Mycobacterium bovis subsp bovis AF2122/97
cgucgcugcccaugcggc

SEQ ID NO: 3057747 - RNA, 13 nt, Mycobacterium bovis subsp bovis AF2122/97
cgucgcugcccgc

SEQ ID NO: 3057748 - RNA, 16 nt, Mycobacterium bovis subsp bovis AF2122/97
cgucgcugcccgcggu

SEQ ID NO: 3057749 - RNA, 20 nt, Mycobacterium bovis subsp bovis AF2122/97
cgucgcugcccgcgguuugc

SEQ ID NO: 3057750 - RNA, 14 nt, Mycobacterium bovis subsp bovis AF2122/97
cgucgcuggccggc

SEQ ID NO: 3057751 - RNA, 13 nt, Mycobacterium bovis subsp bovis AF2122/97
cgucggcggccag

SEQ ID NO: 3057752 - RNA, 16 nt, Mycobacterium bovis subsp bovis AF2122/97
cgucggcggccguggc

SEQ ID NO: 3057753 - RNA, 14 nt, Mycobacterium bovis subsp bovis AF2122/97
cgucggcggcgacc

SEQ ID NO: 3057754 - RNA, 16 nt, Mycobacterium bovis subsp bovis AF2122/97
cgucggcggcgaccgc

SEQ ID NO: 3057755 - RNA, 19 nt, Mycobacterium bovis subsp bovis AF2122/97
cgucggcggcgaccgccag

SEQ ID NO: 3057756 - RNA, 16 nt, Mycobacterium bovis subsp bovis AF2122/97
cgucggcggugagcaa

SEQ ID NO: 3057757 - RNA, 17 nt, Mycobacterium bovis subsp bovis AF2122/97
cgucggcguacagcgcc

SEQ ID NO: 3057758 - RNA, 18 nt, Mycobacterium bovis subsp bovis AF2122/97
cgucggcguacagcgccu

SEQ ID NO: 3057759 - RNA, 13 nt, Mycobacterium bovis subsp bovis AF2122/97
cgucggcgucgcg

SEQ ID NO: 3057760 - RNA, 16 nt, Mycobacterium bovis subsp bovis AF2122/97
cgucggcgugacgucg

SEQ ID NO: 3057761 - RNA, 23 nt, Mycobacterium bovis subsp bovis AF2122/97
cgucggcgugcggacugacgucg

SEQ ID NO: 3057762 - RNA, 15 nt, Mycobacterium bovis subsp bovis AF2122/97
cgucggcugccgcgg

SEQ ID NO: 3057763 - RNA, 16 nt, Mycobacterium bovis subsp bovis AF2122/97
cgucggcugccgcggc

SEQ ID NO: 3057764 - RNA, 14 nt, Mycobacterium bovis subsp bovis AF2122/97
cgucgggacgccgc

SEQ ID NO: 3057765 - RNA, 15 nt, Mycobacterium bovis subsp bovis AF2122/97
cgucgggacgccgcc

SEQ ID NO: 3057766 - RNA, 16 nt, Mycobacterium bovis subsp bovis AF2122/97
cgucgggacgccgccc

SEQ ID NO: 3057767 - RNA, 17 nt, Mycobacterium bovis subsp bovis AF2122/97
cgucgggacgccgcccc

SEQ ID NO: 3057768 - RNA, 22 nt, Mycobacterium bovis subsp bovis AF2122/97
cgucgggaucggcguccaucac

SEQ ID NO: 3057769 - RNA, 15 nt, Mycobacterium bovis subsp bovis AF2122/97
cgucgggaugcccgc

SEQ ID NO: 3057770 - RNA, 23 nt, Mycobacterium bovis subsp bovis AF2122/97
cgucgggcaccgccaaaaacgcc

SEQ ID NO: 3057771 - RNA, 16 nt, Mycobacterium bovis subsp bovis AF2122/97
cgucgggcauggcggc

SEQ ID NO: 3057772 - RNA, 19 nt, Mycobacterium bovis subsp bovis AF2122/97
cgucgggcauggcggcgua

SEQ ID NO: 3057773 - RNA, 20 nt, Mycobacterium bovis subsp bovis AF2122/97
cgucgggcccagccggaccg

SEQ ID NO: 3057774 - RNA, 14 nt, Mycobacterium bovis subsp bovis AF2122/97
cgucgggccgucgg

SEQ ID NO: 3057775 - RNA, 21 nt, Mycobacterium bovis subsp bovis AF2122/97
cgucgggcgucccggcgguca

SEQ ID NO: 3057776 - RNA, 22 nt, Mycobacterium bovis subsp bovis AF2122/97
cgucgggcgucccggcggucag

SEQ ID NO: 3057777 - RNA, 24 nt, Mycobacterium bovis subsp bovis AF2122/97
cgucgggcgucccggcggucagcg

SEQ ID NO: 3057778 - RNA, 19 nt, Mycobacterium bovis subsp bovis AF2122/97
cgucggggaguucgcgcag

SEQ ID NO: 3057779 - RNA, 22 nt, Mycobacterium bovis subsp bovis AF2122/97
cgucggggaguucgcgcagcac

SEQ ID NO: 3057780 - RNA, 18 nt, Mycobacterium bovis subsp bovis AF2122/97
cgucggggaugccgaacc

SEQ ID NO: 3057781 - RNA, 14 nt, Mycobacterium bovis subsp bovis AF2122/97
cgucgggggcuucg

SEQ ID NO: 3057782 - RNA, 15 nt, Mycobacterium bovis subsp bovis AF2122/97
cgucggggucguuga

SEQ ID NO: 3057783 - RNA, 15 nt, Mycobacterium bovis subsp bovis AF2122/97
cgucggggugccggc

SEQ ID NO: 3057784 - RNA, 17 nt, Mycobacterium bovis subsp bovis AF2122/97
cgucggggugccggcug

SEQ ID NO: 3057785 - RNA, 15 nt, Mycobacterium bovis subsp bovis AF2122/97
cgucgggguggcggu

SEQ ID NO: 3057786 - RNA, 20 nt, Mycobacterium bovis subsp bovis AF2122/97
cgucgggguguucgaugggu

SEQ ID NO: 3057787 - RNA, 20 nt, Mycobacterium bovis subsp bovis AF2122/97
cgucgggguugauguagagc

SEQ ID NO: 3057788 - RNA, 18 nt, Mycobacterium bovis subsp bovis AF2122/97
cgucggguaggccgccgu

SEQ ID NO: 3057789 - RNA, 22 nt, Mycobacterium bovis subsp bovis AF2122/97
cgucgggucaaugcuggcagcg

SEQ ID NO: 3057790 - RNA, 14 nt, Mycobacterium bovis subsp bovis AF2122/97
cgucgggucgcgag

SEQ ID NO: 3057791 - RNA, 19 nt, Mycobacterium bovis subsp bovis AF2122/97
cgucgggugcagcacggcg

SEQ ID NO: 3057792 - RNA, 23 nt, Mycobacterium bovis subsp bovis AF2122/97
cgucgggugcagcacggcgccgc

SEQ ID NO: 3057793 - RNA, 24 nt, Mycobacterium bovis subsp bovis AF2122/97
cgucgggugcagcacggcgccgcc

SEQ ID NO: 3057794 - RNA, 21 nt, Mycobacterium bovis subsp bovis AF2122/97
cgucggguuccuccucggcag

SEQ ID NO: 3057795 - RNA, 22 nt, Mycobacterium bovis subsp bovis AF2122/97
cgucggguuccuccucggcagg

SEQ ID NO: 3057796 - RNA, 20 nt, Mycobacterium bovis subsp bovis AF2122/97
cgucggguugucgcgguuca

SEQ ID NO: 3057797 - RNA, 18 nt, Mycobacterium bovis subsp bovis AF2122/97
cgucgguaaagggcucga

SEQ ID NO: 3057798 - RNA, 18 nt, Mycobacterium bovis subsp bovis AF2122/97
cgucgguaagcgccaagg

SEQ ID NO: 3057799 - RNA, 21 nt, Mycobacterium bovis subsp bovis AF2122/97
cgucgguaagcgccaaggcga

SEQ ID NO: 3057800 - RNA, 17 nt, Mycobacterium bovis subsp bovis AF2122/97
cgucgguaaugccgggc

SEQ ID NO: 3057801 - RNA, 16 nt, Mycobacterium bovis subsp bovis AF2122/97
cgucggucaccuggcg

SEQ ID NO: 3057802 - RNA, 19 nt, Mycobacterium bovis subsp bovis AF2122/97
cgucggucaugucggccac

SEQ ID NO: 3057803 - RNA, 20 nt, Mycobacterium bovis subsp bovis AF2122/97
cgucggucaugucggccacc

SEQ ID NO: 3057804 - RNA, 21 nt, Mycobacterium bovis subsp bovis AF2122/97
cgucggucaugucggccaccg

SEQ ID NO: 3057805 - RNA, 23 nt, Mycobacterium bovis subsp bovis AF2122/97
cgucggucaugucggccaccggc

SEQ ID NO: 3057806 - RNA, 13 nt, Mycobacterium bovis subsp bovis AF2122/97
cgucgguccaccc

SEQ ID NO: 3057807 - RNA, 12 nt, Mycobacterium bovis subsp bovis AF2122/97
cgucggucgucg

SEQ ID NO: 3057808 - RNA, 20 nt, Mycobacterium bovis subsp bovis AF2122/97
cgucggucucaugcacccgg

SEQ ID NO: 3057809 - RNA, 18 nt, Mycobacterium bovis subsp bovis AF2122/97
cgucggugaaauucgcgg

SEQ ID NO: 3057810 - RNA, 15 nt, Mycobacterium bovis subsp bovis AF2122/97
cgucggugaacgcgu

SEQ ID NO: 3057811 - RNA, 22 nt, Mycobacterium bovis subsp bovis AF2122/97
cgucggugaaguagugcucgca

SEQ ID NO: 3057812 - RNA, 17 nt, Mycobacterium bovis subsp bovis AF2122/97
cgucggugaaugccguc

SEQ ID NO: 3057813 - RNA, 14 nt, Mycobacterium bovis subsp bovis AF2122/97
cgucggugagcgcg

SEQ ID NO: 3057814 - RNA, 19 nt, Mycobacterium bovis subsp bovis AF2122/97
cgucggugagcgcgucgcg

SEQ ID NO: 3057815 - RNA, 22 nt, Mycobacterium bovis subsp bovis AF2122/97
cgucggugagcgcgucgcggga

SEQ ID NO: 3057816 - RNA, 17 nt, Mycobacterium bovis subsp bovis AF2122/97
cgucggugaucaccgcg

SEQ ID NO: 3057817 - RNA, 19 nt, Mycobacterium bovis subsp bovis AF2122/97
cgucggugaucaccgcggc

SEQ ID NO: 3057818 - RNA, 21 nt, Mycobacterium bovis subsp bovis AF2122/97
cgucggugauggagccgguga

SEQ ID NO: 3057819 - RNA, 14 nt, Mycobacterium bovis subsp bovis AF2122/97
cgucggugccacca

SEQ ID NO: 3057820 - RNA, 15 nt, Mycobacterium bovis subsp bovis AF2122/97
cgucggugccgccgc

SEQ ID NO: 3057821 - RNA, 22 nt, Mycobacterium bovis subsp bovis AF2122/97
cgucggugccgccgccggcgcc

SEQ ID NO: 3057822 - RNA, 16 nt, Mycobacterium bovis subsp bovis AF2122/97
cgucggugccgcggac

SEQ ID NO: 3057823 - RNA, 20 nt, Mycobacterium bovis subsp bovis AF2122/97
cgucggugccggggcugccg

SEQ ID NO: 3057824 - RNA, 22 nt, Mycobacterium bovis subsp bovis AF2122/97
cgucggugccggggcugccgcc

SEQ ID NO: 3057825 - RNA, 13 nt, Mycobacterium bovis subsp bovis AF2122/97
cgucggugcgcgc

SEQ ID NO: 3057826 - RNA, 20 nt, Mycobacterium bovis subsp bovis AF2122/97
cgucggugguuuucccgucg

SEQ ID NO: 3057827 - RNA, 18 nt, Mycobacterium bovis subsp bovis AF2122/97
cgucgguguaacccuggc

SEQ ID NO: 3057828 - RNA, 16 nt, Mycobacterium bovis subsp bovis AF2122/97
cgucggugugcgcgcc

SEQ ID NO: 3057829 - RNA, 17 nt, Mycobacterium bovis subsp bovis AF2122/97
cgucggugugcgcgcca

SEQ ID NO: 3057830 - RNA, 17 nt, Mycobacterium bovis subsp bovis AF2122/97
cgucgguugccacgccg

SEQ ID NO: 3057831 - RNA, 18 nt, Mycobacterium bovis subsp bovis AF2122/97
cgucgguugccacgccgc

SEQ ID NO: 3057832 - RNA, 15 nt, Mycobacterium bovis subsp bovis AF2122/97
cgucguaaaccggga

SEQ ID NO: 3057833 - RNA, 16 nt, Mycobacterium bovis subsp bovis AF2122/97
cgucguaaaccgggau

SEQ ID NO: 3057834 - RNA, 18 nt, Mycobacterium bovis subsp bovis AF2122/97
cgucguaaacgucggucg

SEQ ID NO: 3057835 - RNA, 22 nt, Mycobacterium bovis subsp bovis AF2122/97
cgucguaaccgucgccugccga

SEQ ID NO: 3057836 - RNA, 18 nt, Mycobacterium bovis subsp bovis AF2122/97
cgucguacaccucgagcg

SEQ ID NO: 3057837 - RNA, 21 nt, Mycobacterium bovis subsp bovis AF2122/97
cgucgugccacuuccacggcg

SEQ ID NO: 3057838 - RNA, 16 nt, Mycobacterium bovis subsp bovis AF2122/97
cgucgugcgauucaca

SEQ ID NO: 3057839 - RNA, 14 nt, Mycobacterium bovis subsp bovis AF2122/97
cgucgugcgcggcc

SEQ ID NO: 3057840 - RNA, 12 nt, Mycobacterium bovis subsp bovis AF2122/97
cgucgugcgggc

SEQ ID NO: 3057841 - RNA, 17 nt, Mycobacterium bovis subsp bovis AF2122/97
cgucgugcgugcggcga

SEQ ID NO: 3057842 - RNA, 17 nt, Mycobacterium bovis subsp bovis AF2122/97
cgucguggcgcucggcg

SEQ ID NO: 3057843 - RNA, 15 nt, Mycobacterium bovis subsp bovis AF2122/97
cgucguggcgguggc

SEQ ID NO: 3057844 - RNA, 14 nt, Mycobacterium bovis subsp bovis AF2122/97
cgucguggcuuccg

SEQ ID NO: 3057845 - RNA, 19 nt, Mycobacterium bovis subsp bovis AF2122/97
cgucguggcuuccgguggu

SEQ ID NO: 3057846 - RNA, 16 nt, Mycobacterium bovis subsp bovis AF2122/97
cgucgugucgccgccg

SEQ ID NO: 3057847 - RNA, 17 nt, Mycobacterium bovis subsp bovis AF2122/97
cgucgugucgccgccgu

SEQ ID NO: 3057848 - RNA, 21 nt, Mycobacterium bovis subsp bovis AF2122/97
cgucgugucgccgccguugcc

SEQ ID NO: 3057849 - RNA, 22 nt, Mycobacterium bovis subsp bovis AF2122/97
cgucgugucgccgccguugccg

SEQ ID NO: 3057850 - RNA, 14 nt, Mycobacterium bovis subsp bovis AF2122/97
cgucguguggggcg

SEQ ID NO: 3057851 - RNA, 16 nt, Mycobacterium bovis subsp bovis AF2122/97
cgucguguuggccggg

SEQ ID NO: 3057852 - RNA, 17 nt, Mycobacterium bovis subsp bovis AF2122/97
cgucguguuggccgggu

SEQ ID NO: 3057853 - RNA, 16 nt, Mycobacterium bovis subsp bovis AF2122/97
cgucguuaagacggcg

SEQ ID NO: 3057854 - RNA, 20 nt, Mycobacterium bovis subsp bovis AF2122/97
cgucguucaaugucguugcc

SEQ ID NO: 3057855 - RNA, 20 nt, Mycobacterium bovis subsp bovis AF2122/97
cgucguugagcaucaccgua

SEQ ID NO: 3057856 - RNA, 13 nt, Mycobacterium bovis subsp bovis AF2122/97
cgucguugaggaa

SEQ ID NO: 3057857 - RNA, 16 nt, Mycobacterium bovis subsp bovis AF2122/97
cgucguugaggaagcc

SEQ ID NO: 3057858 - RNA, 19 nt, Mycobacterium bovis subsp bovis AF2122/97
cgucguugaggaagcccga

SEQ ID NO: 3057859 - RNA, 17 nt, Mycobacterium bovis subsp bovis AF2122/97
cgucguugccguccacc

SEQ ID NO: 3057860 - RNA, 21 nt, Mycobacterium bovis subsp bovis AF2122/97
cgucguugggcaugucgccga

SEQ ID NO: 3057861 - RNA, 14 nt, Mycobacterium bovis subsp bovis AF2122/97
cgucguugucgucg

SEQ ID NO: 3057862 - RNA, 23 nt, Mycobacterium bovis subsp bovis AF2122/97
cgucguugucgucgccggcggcg

SEQ ID NO: 3057863 - RNA, 22 nt, Mycobacterium bovis subsp bovis AF2122/97
cgucguugugcagaucgucgcc

SEQ ID NO: 3057864 - RNA, 21 nt, Mycobacterium bovis subsp bovis AF2122/97
cgucguugugccggucgauga

SEQ ID NO: 3057865 - RNA, 16 nt, Mycobacterium bovis subsp bovis AF2122/97
cgucguuucgccagcc

SEQ ID NO: 3057866 - RNA, 19 nt, Mycobacterium bovis subsp bovis AF2122/97
cgucguuucgccagccggc

SEQ ID NO: 3057867 - RNA, 22 nt, Mycobacterium bovis subsp bovis AF2122/97
cgucguuucgccagccggccgc

SEQ ID NO: 3057868 - RNA, 20 nt, Mycobacterium bovis subsp bovis AF2122/97
cgucguuuggccucagcccg

SEQ ID NO: 3057869 - RNA, 18 nt, Mycobacterium bovis subsp bovis AF2122/97
cgucguuugggugcgccg

SEQ ID NO: 3057870 - RNA, 18 nt, Mycobacterium bovis subsp bovis AF2122/97
cgucuacgucguccagca

SEQ ID NO: 3057871 - RNA, 20 nt, Mycobacterium bovis subsp bovis AF2122/97
cgucuacgucguccagcacc

SEQ ID NO: 3057872 - RNA, 21 nt, Mycobacterium bovis subsp bovis AF2122/97
cgucuacgucguccagcacca

SEQ ID NO: 3057873 - RNA, 17 nt, Mycobacterium bovis subsp bovis AF2122/97
cgucuaucuggucgggu

SEQ ID NO: 3057874 - RNA, 22 nt, Mycobacterium bovis subsp bovis AF2122/97
cgucuccacuuucugcggucaa

SEQ ID NO: 3057875 - RNA, 19 nt, Mycobacterium bovis subsp bovis AF2122/97
cgucuccgccggcucgucg

SEQ ID NO: 3057876 - RNA, 14 nt, Mycobacterium bovis subsp bovis AF2122/97
cgucuccggcgcca

SEQ ID NO: 3057877 - RNA, 18 nt, Mycobacterium bovis subsp bovis AF2122/97
cgucuccggcgccaccgc

SEQ ID NO: 3057878 - RNA, 21 nt, Mycobacterium bovis subsp bovis AF2122/97
cgucuccggcgccaccgccgc

SEQ ID NO: 3057879 - RNA, 17 nt, Mycobacterium bovis subsp bovis AF2122/97
cgucuccuugagcuucu

SEQ ID NO: 3057880 - RNA, 16 nt, Mycobacterium bovis subsp bovis AF2122/97
cgucuccuugaucgac

SEQ ID NO: 3057881 - RNA, 21 nt, Mycobacterium bovis subsp bovis AF2122/97
cgucuccuugaucgacaacgc

SEQ ID NO: 3057882 - RNA, 23 nt, Mycobacterium bovis subsp bovis AF2122/97
cgucuccuugaucgacaacgcgg

SEQ ID NO: 3057883 - RNA, 22 nt, Mycobacterium bovis subsp bovis AF2122/97
cgucucgacacugcagugaucg

SEQ ID NO: 3057884 - RNA, 14 nt, Mycobacterium bovis subsp bovis AF2122/97
cgucucgaucgcgg

SEQ ID NO: 3057885 - RNA, 18 nt, Mycobacterium bovis subsp bovis AF2122/97
cgucucgaugcauggcuu

SEQ ID NO: 3057886 - RNA, 14 nt, Mycobacterium bovis subsp bovis AF2122/97
cgucucgcaccgcg

SEQ ID NO: 3057887 - RNA, 17 nt, Mycobacterium bovis subsp bovis AF2122/97
cgucucgcagcaacggc

SEQ ID NO: 3057888 - RNA, 13 nt, Mycobacterium bovis subsp bovis AF2122/97
cgucucgccgcgc

SEQ ID NO: 3057889 - RNA, 14 nt, Mycobacterium bovis subsp bovis AF2122/97
cgucucgccgcgca

SEQ ID NO: 3057890 - RNA, 15 nt, Mycobacterium bovis subsp bovis AF2122/97
cgucucgccgcgcac

SEQ ID NO: 3057891 - RNA, 21 nt, Mycobacterium bovis subsp bovis AF2122/97
cgucucgccgggaaacaccgg

SEQ ID NO: 3057892 - RNA, 12 nt, Mycobacterium bovis subsp bovis AF2122/97
cgucucgcgcga

SEQ ID NO: 3057893 - RNA, 19 nt, Mycobacterium bovis subsp bovis AF2122/97
cgucucgcggugcggcaac

SEQ ID NO: 3057894 - RNA, 17 nt, Mycobacterium bovis subsp bovis AF2122/97
cgucucggaggcgacca

SEQ ID NO: 3057895 - RNA, 21 nt, Mycobacterium bovis subsp bovis AF2122/97
cgucucucgcagcuccucgcc

SEQ ID NO: 3057896 - RNA, 21 nt, Mycobacterium bovis subsp bovis AF2122/97
cgucugacaauuccuggaucg

SEQ ID NO: 3057897 - RNA, 16 nt, Mycobacterium bovis subsp bovis AF2122/97
cgucugacccaccgcc

SEQ ID NO: 3057898 - RNA, 14 nt, Mycobacterium bovis subsp bovis AF2122/97
cgucugagcgccgg

SEQ ID NO: 3057899 - RNA, 14 nt, Mycobacterium bovis subsp bovis AF2122/97
cgucugccaggcgc

SEQ ID NO: 3057900 - RNA, 18 nt, Mycobacterium bovis subsp bovis AF2122/97
cgucugccaggcgcagcu

SEQ ID NO: 3057901 - RNA, 15 nt, Mycobacterium bovis subsp bovis AF2122/97
cgucugcccgcccag

SEQ ID NO: 3057902 - RNA, 16 nt, Mycobacterium bovis subsp bovis AF2122/97
cgucugcccgcccagc

SEQ ID NO: 3057903 - RNA, 16 nt, Mycobacterium bovis subsp bovis AF2122/97
cgucugcggaccggcg

SEQ ID NO: 3057904 - RNA, 18 nt, Mycobacterium bovis subsp bovis AF2122/97
cgucugcggaccggcgcg

SEQ ID NO: 3057905 - RNA, 14 nt, Mycobacterium bovis subsp bovis AF2122/97
cgucugcggucgag

SEQ ID NO: 3057906 - RNA, 17 nt, Mycobacterium bovis subsp bovis AF2122/97
cgucugcggucgagggu

SEQ ID NO: 3057907 - RNA, 13 nt, Mycobacterium bovis subsp bovis AF2122/97
cgucugcucacca

SEQ ID NO: 3057908 - RNA, 16 nt, Mycobacterium bovis subsp bovis AF2122/97
cgucugcucaccagcg

SEQ ID NO: 3057909 - RNA, 12 nt, Mycobacterium bovis subsp bovis AF2122/97
cgucugcucgcc

SEQ ID NO: 3057910 - RNA, 14 nt, Mycobacterium bovis subsp bovis AF2122/97
cgucugcucgccag

SEQ ID NO: 3057911 - RNA, 17 nt, Mycobacterium bovis subsp bovis AF2122/97
cgucugcucgccagccg

SEQ ID NO: 3057912 - RNA, 18 nt, Mycobacterium bovis subsp bovis AF2122/97
cgucugcucgccagccgg

SEQ ID NO: 3057913 - RNA, 21 nt, Mycobacterium bovis subsp bovis AF2122/97
cgucugcucgccagccggccu

SEQ ID NO: 3057914 - RNA, 16 nt, Mycobacterium bovis subsp bovis AF2122/97
cgucugcucgccagcg

SEQ ID NO: 3057915 - RNA, 20 nt, Mycobacterium bovis subsp bovis AF2122/97
cgucugcucgccagcggggc

SEQ ID NO: 3057916 - RNA, 16 nt, Mycobacterium bovis subsp bovis AF2122/97
cgucugcucgccaggc

SEQ ID NO: 3057917 - RNA, 17 nt, Mycobacterium bovis subsp bovis AF2122/97
cgucugcucgccaggcc

SEQ ID NO: 3057918 - RNA, 17 nt, Mycobacterium bovis subsp bovis AF2122/97
cgucugcucgccguggu

SEQ ID NO: 3057919 - RNA, 14 nt, Mycobacterium bovis subsp bovis AF2122/97
cgucugcucgcgca

SEQ ID NO: 3057920 - RNA, 16 nt, Mycobacterium bovis subsp bovis AF2122/97
cgucugcucgcgccgg

SEQ ID NO: 3057921 - RNA, 16 nt, Mycobacterium bovis subsp bovis AF2122/97
cgucugcucgcgggua

SEQ ID NO: 3057922 - RNA, 11 nt, Mycobacterium bovis subsp bovis AF2122/97
cgucugcucgg

SEQ ID NO: 3057923 - RNA, 13 nt, Mycobacterium bovis subsp bovis AF2122/97
cgucugcucggca

SEQ ID NO: 3057924 - RNA, 17 nt, Mycobacterium bovis subsp bovis AF2122/97
cgugagccccagcgacg

SEQ ID NO: 3057925 - RNA, 14 nt, Mycobacterium bovis subsp bovis AF2122/97
cgugagccggaccg

SEQ ID NO: 3057926 - RNA, 17 nt, Mycobacterium bovis subsp bovis AF2122/97
cgugagccuguccacgu

SEQ ID NO: 3057927 - RNA, 23 nt, Mycobacterium bovis subsp bovis AF2122/97
cgugagccuuucgugcaccgcga

SEQ ID NO: 3057928 - RNA, 16 nt, Mycobacterium bovis subsp bovis AF2122/97
cgugagcgccgcggcg

SEQ ID NO: 3057929 - RNA, 15 nt, Mycobacterium bovis subsp bovis AF2122/97
cgugagcggccaggu

SEQ ID NO: 3057930 - RNA, 22 nt, Mycobacterium bovis subsp bovis AF2122/97
cgugagcucgucgaggcugacc

SEQ ID NO: 3057931 - RNA, 20 nt, Mycobacterium bovis subsp bovis AF2122/97
cgugagggucaugucgauca

SEQ ID NO: 3057932 - RNA, 18 nt, Mycobacterium bovis subsp bovis AF2122/97
cgugaggucccggcuggg

SEQ ID NO: 3057933 - RNA, 20 nt, Mycobacterium bovis subsp bovis AF2122/97
cgugaguacucggucaacgu

SEQ ID NO: 3057934 - RNA, 14 nt, Mycobacterium bovis subsp bovis AF2122/97
cgugagucacccgg

SEQ ID NO: 3057935 - RNA, 15 nt, Mycobacterium bovis subsp bovis AF2122/97
cgugagugcagcacg

SEQ ID NO: 3057936 - RNA, 14 nt, Mycobacterium bovis subsp bovis AF2122/97
cgugagugccggcg

SEQ ID NO: 3057937 - RNA, 15 nt, Mycobacterium bovis subsp bovis AF2122/97
cgugagugccggcgu

SEQ ID NO: 3057938 - RNA, 20 nt, Mycobacterium bovis subsp bovis AF2122/97
cgugaguucacguucggcgc

SEQ ID NO: 3057939 - RNA, 17 nt, Mycobacterium bovis subsp bovis AF2122/97
cgugaguucgcaaucag

SEQ ID NO: 3057940 - RNA, 15 nt, Mycobacterium bovis subsp bovis AF2122/97
cgugaguuucaccac

SEQ ID NO: 3057941 - RNA, 20 nt, Mycobacterium bovis subsp bovis AF2122/97
cgugauacagcucggugcac

SEQ ID NO: 3057942 - RNA, 21 nt, Mycobacterium bovis subsp bovis AF2122/97
cgugauauccuuugccgccga

SEQ ID NO: 3057943 - RNA, 19 nt, Mycobacterium bovis subsp bovis AF2122/97
cgugaucaccggcaucccg

SEQ ID NO: 3057944 - RNA, 13 nt, Mycobacterium bovis subsp bovis AF2122/97
cgugaucagcagg

SEQ ID NO: 3057945 - RNA, 14 nt, Mycobacterium bovis subsp bovis AF2122/97
cgugaucaggucac

SEQ ID NO: 3057946 - RNA, 19 nt, Mycobacterium bovis subsp bovis AF2122/97
cgugaucaggucacccagc

SEQ ID NO: 3057947 - RNA, 21 nt, Mycobacterium bovis subsp bovis AF2122/97
cgugauccccgcguucggcgg

SEQ ID NO: 3057948 - RNA, 13 nt, Mycobacterium bovis subsp bovis AF2122/97
cgugauccgccga

SEQ ID NO: 3057949 - RNA, 12 nt, Mycobacterium bovis subsp bovis AF2122/97
cgugaucgaccg

SEQ ID NO: 3057950 - RNA, 14 nt, Mycobacterium bovis subsp bovis AF2122/97
cgugaucgaccgga

SEQ ID NO: 3057951 - RNA, 12 nt, Mycobacterium bovis subsp bovis AF2122/97
cgugaucgacga

SEQ ID NO: 3057952 - RNA, 13 nt, Mycobacterium bovis subsp bovis AF2122/97
cgugaucgacgac

SEQ ID NO: 3057953 - RNA, 20 nt, Mycobacterium bovis subsp bovis AF2122/97
cgugaucgcgguccaacagc

SEQ ID NO: 3057954 - RNA, 21 nt, Mycobacterium bovis subsp bovis AF2122/97
cgugaucgcgguccaacagcg

SEQ ID NO: 3057955 - RNA, 17 nt, Mycobacterium bovis subsp bovis AF2122/97
cgugaucgcuggcgacc

SEQ ID NO: 3057956 - RNA, 17 nt, Mycobacterium bovis subsp bovis AF2122/97
cgugaucggcgaaccca

SEQ ID NO: 3057957 - RNA, 22 nt, Mycobacterium bovis subsp bovis AF2122/97
cgugaucggcgaacccaccgca

SEQ ID NO: 3057958 - RNA, 15 nt, Mycobacterium bovis subsp bovis AF2122/97
cgugaucggcgcccg

SEQ ID NO: 3057959 - RNA, 15 nt, Mycobacterium bovis subsp bovis AF2122/97
cgugaucuggccgaa

SEQ ID NO: 3057960 - RNA, 15 nt, Mycobacterium bovis subsp bovis AF2122/97
cgugaugccacggcg

SEQ ID NO: 3057961 - RNA, 16 nt, Mycobacterium bovis subsp bovis AF2122/97
cgugaugccacggcgu

SEQ ID NO: 3057962 - RNA, 18 nt, Mycobacterium bovis subsp bovis AF2122/97
cgugaugccacggcgucg

SEQ ID NO: 3057963 - RNA, 11 nt, Mycobacterium bovis subsp bovis AF2122/97
cgugaugcggg

SEQ ID NO: 3057964 - RNA, 14 nt, Mycobacterium bovis subsp bovis AF2122/97
cgugaugcggucgc

SEQ ID NO: 3057965 - RNA, 15 nt, Mycobacterium bovis subsp bovis AF2122/97
cgugaugcguucggc

SEQ ID NO: 3057966 - RNA, 20 nt, Mycobacterium bovis subsp bovis AF2122/97
cgugaugcguucggccgggc

SEQ ID NO: 3057967 - RNA, 18 nt, Mycobacterium bovis subsp bovis AF2122/97
cgugaugggucaccucgg

SEQ ID NO: 3057968 - RNA, 23 nt, Mycobacterium bovis subsp bovis AF2122/97
cgugaugucaacgugucccaagc

SEQ ID NO: 3057969 - RNA, 20 nt, Mycobacterium bovis subsp bovis AF2122/97
cgugauguggucggacagcg

SEQ ID NO: 3057970 - RNA, 21 nt, Mycobacterium bovis subsp bovis AF2122/97
cgugauguggucggacagcgu

SEQ ID NO: 3057971 - RNA, 11 nt, Mycobacterium bovis subsp bovis AF2122/97
cgugcaaccac

SEQ ID NO: 3057972 - RNA, 15 nt, Mycobacterium bovis subsp bovis AF2122/97
cgugcaaccacggcg

SEQ ID NO: 3057973 - RNA, 21 nt, Mycobacterium bovis subsp bovis AF2122/97
cgugcaaccauggcggcuccg

SEQ ID NO: 3057974 - RNA, 20 nt, Mycobacterium bovis subsp bovis AF2122/97
cgugcaauagcucgggcgca

SEQ ID NO: 3057975 - RNA, 19 nt, Mycobacterium bovis subsp bovis AF2122/97
cgugcacaggucagcgcug

SEQ ID NO: 3057976 - RNA, 19 nt, Mycobacterium bovis subsp bovis AF2122/97
cgugcaccacauuggcgau

SEQ ID NO: 3057977 - RNA, 16 nt, Mycobacterium bovis subsp bovis AF2122/97
cgugcaccagcgacca

SEQ ID NO: 3057978 - RNA, 14 nt, Mycobacterium bovis subsp bovis AF2122/97
cgugcaccgcgacc

SEQ ID NO: 3057979 - RNA, 16 nt, Mycobacterium bovis subsp bovis AF2122/97
cgugcaccgcgaccgc

SEQ ID NO: 3057980 - RNA, 18 nt, Mycobacterium bovis subsp bovis AF2122/97
cgugcaccgcgaccgcgc

SEQ ID NO: 3057981 - RNA, 19 nt, Mycobacterium bovis subsp bovis AF2122/97
cgugcaccgcgaccgcgca

SEQ ID NO: 3057982 - RNA, 20 nt, Mycobacterium bovis subsp bovis AF2122/97
cgugcaccgcgaccgcgcac

SEQ ID NO: 3057983 - RNA, 18 nt, Mycobacterium bovis subsp bovis AF2122/97
cgugcaccucgucccagc

SEQ ID NO: 3057984 - RNA, 20 nt, Mycobacterium bovis subsp bovis AF2122/97
cgugcaccucgucccagcgg

SEQ ID NO: 3057985 - RNA, 16 nt, Mycobacterium bovis subsp bovis AF2122/97
cgugcacgaaaaccgg

SEQ ID NO: 3057986 - RNA, 17 nt, Mycobacterium bovis subsp bovis AF2122/97
cgugcacgacgacaucg

SEQ ID NO: 3057987 - RNA, 16 nt, Mycobacterium bovis subsp bovis AF2122/97
cgugcacgaucgcggu

SEQ ID NO: 3057988 - RNA, 13 nt, Mycobacterium bovis subsp bovis AF2122/97
cgugcacggcggc

SEQ ID NO: 3057989 - RNA, 14 nt, Mycobacterium bovis subsp bovis AF2122/97
cgugcacggcggcc

SEQ ID NO: 3057990 - RNA, 16 nt, Mycobacterium bovis subsp bovis AF2122/97
cgugcacggcggccag

SEQ ID NO: 3057991 - RNA, 22 nt, Mycobacterium bovis subsp bovis AF2122/97
cgugcagaauccguucgacgag

SEQ ID NO: 3057992 - RNA, 17 nt, Mycobacterium bovis subsp bovis AF2122/97
cgugcagaucacgggug

SEQ ID NO: 3057993 - RNA, 18 nt, Mycobacterium bovis subsp bovis AF2122/97
cgugcagaucacgggugu

SEQ ID NO: 3057994 - RNA, 23 nt, Mycobacterium bovis subsp bovis AF2122/97
cgugcagcacuuccaagccgacc

SEQ ID NO: 3057995 - RNA, 17 nt, Mycobacterium bovis subsp bovis AF2122/97
cgugcagccgcaggugg

SEQ ID NO: 3057996 - RNA, 23 nt, Mycobacterium bovis subsp bovis AF2122/97
cgugcagcggcgccgccaagggc

SEQ ID NO: 3057997 - RNA, 18 nt, Mycobacterium bovis subsp bovis AF2122/97
cgugcagcggcgggcgau

SEQ ID NO: 3057998 - RNA, 18 nt, Mycobacterium bovis subsp bovis AF2122/97
cgugcagcucggucagcg

SEQ ID NO: 3057999 - RNA, 16 nt, Mycobacterium bovis subsp bovis AF2122/97
cgugcaggaacaccca

SEQ ID NO: 3058000 - RNA, 19 nt, Mycobacterium bovis subsp bovis AF2122/97
cgugcaggaacacccauac

SEQ ID NO: 3058001 - RNA, 18 nt, Mycobacterium bovis subsp bovis AF2122/97
cgugcaggaccagcaccg

SEQ ID NO: 3058002 - RNA, 19 nt, Mycobacterium bovis subsp bovis AF2122/97
cgugcaggaccagcaccgc

SEQ ID NO: 3058003 - RNA, 21 nt, Mycobacterium bovis subsp bovis AF2122/97
cgugcaggaccagcaccgccg

SEQ ID NO: 3058004 - RNA, 23 nt, Mycobacterium bovis subsp bovis AF2122/97
cgugcaggaccagcaccgccgcg

SEQ ID NO: 3058005 - RNA, 12 nt, Mycobacterium bovis subsp bovis AF2122/97
cgugcaggcgca

SEQ ID NO: 3058006 - RNA, 20 nt, Mycobacterium bovis subsp bovis AF2122/97
cgugcagggcauugcggccc

SEQ ID NO: 3058007 - RNA, 18 nt, Mycobacterium bovis subsp bovis AF2122/97
cgugcagguagguauagc

SEQ ID NO: 3058008 - RNA, 16 nt, Mycobacterium bovis subsp bovis AF2122/97
cgugcauaagcccgcg

SEQ ID NO: 3058009 - RNA, 17 nt, Mycobacterium bovis subsp bovis AF2122/97
cgugcaucgccugcgcc

SEQ ID NO: 3058010 - RNA, 14 nt, Mycobacterium bovis subsp bovis AF2122/97
cgugcaucgcgauu

SEQ ID NO: 3058011 - RNA, 18 nt, Mycobacterium bovis subsp bovis AF2122/97
cgugcggaucgcgcugcg

SEQ ID NO: 3058012 - RNA, 18 nt, Mycobacterium bovis subsp bovis AF2122/97
cgugcggcacucccuggg

SEQ ID NO: 3058013 - RNA, 17 nt, Mycobacterium bovis subsp bovis AF2122/97
cgugcggcgcggcgaca

SEQ ID NO: 3058014 - RNA, 14 nt, Mycobacterium bovis subsp bovis AF2122/97
cgugcggcggccca

SEQ ID NO: 3058015 - RNA, 13 nt, Mycobacterium bovis subsp bovis AF2122/97
cgugcggcggccu

SEQ ID NO: 3058016 - RNA, 17 nt, Mycobacterium bovis subsp bovis AF2122/97
cgugcggcggccucggg

SEQ ID NO: 3058017 - RNA, 12 nt, Mycobacterium bovis subsp bovis AF2122/97
cgugcggcggcu

SEQ ID NO: 3058018 - RNA, 17 nt, Mycobacterium bovis subsp bovis AF2122/97
cgugcggcggcugccgg

SEQ ID NO: 3058019 - RNA, 14 nt, Mycobacterium bovis subsp bovis AF2122/97
cgugcggcucgccg

SEQ ID NO: 3058020 - RNA, 17 nt, Mycobacterium bovis subsp bovis AF2122/97
cgugcggcucgccggcg

SEQ ID NO: 3058021 - RNA, 15 nt, Mycobacterium bovis subsp bovis AF2122/97
cgugcggcugccagu

SEQ ID NO: 3058022 - RNA, 15 nt, Mycobacterium bovis subsp bovis AF2122/97
cgugcgggcgcacca

SEQ ID NO: 3058023 - RNA, 18 nt, Mycobacterium bovis subsp bovis AF2122/97
cgugcgggcgggcgucca

SEQ ID NO: 3058024 - RNA, 22 nt, Mycobacterium bovis subsp bovis AF2122/97
cgugcgggggacgggucgccgc

SEQ ID NO: 3058025 - RNA, 23 nt, Mycobacterium bovis subsp bovis AF2122/97
cgugcgggggacgggucgccgcc

SEQ ID NO: 3058026 - RNA, 21 nt, Mycobacterium bovis subsp bovis AF2122/97
cgugcggguaauacggcgccu

SEQ ID NO: 3058027 - RNA, 17 nt, Mycobacterium bovis subsp bovis AF2122/97
cgugcgggucguccgcc

SEQ ID NO: 3058028 - RNA, 18 nt, Mycobacterium bovis subsp bovis AF2122/97
cgugcggguucacugccg

SEQ ID NO: 3058029 - RNA, 22 nt, Mycobacterium bovis subsp bovis AF2122/97
cgugcggguucacugccggcca

SEQ ID NO: 3058030 - RNA, 11 nt, Mycobacterium bovis subsp bovis AF2122/97
cgugcggucau

SEQ ID NO: 3058031 - RNA, 22 nt, Mycobacterium bovis subsp bovis AF2122/97
cgugcggucauauaggagcggg

SEQ ID NO: 3058032 - RNA, 18 nt, Mycobacterium bovis subsp bovis AF2122/97
cgugcgguggcgcgcagc

SEQ ID NO: 3058033 - RNA, 19 nt, Mycobacterium bovis subsp bovis AF2122/97
cgugcgguggcgcgcagcg

SEQ ID NO: 3058034 - RNA, 22 nt, Mycobacterium bovis subsp bovis AF2122/97
cgugcgguggcgcgcagcgcga

SEQ ID NO: 3058035 - RNA, 15 nt, Mycobacterium bovis subsp bovis AF2122/97
cgugcgucgauggcg

SEQ ID NO: 3058036 - RNA, 16 nt, Mycobacterium bovis subsp bovis AF2122/97
cgugcgucggcccggu

SEQ ID NO: 3058037 - RNA, 17 nt, Mycobacterium bovis subsp bovis AF2122/97
cgugcgugggcgcggcg

SEQ ID NO: 3058038 - RNA, 20 nt, Mycobacterium bovis subsp bovis AF2122/97
cgugcgugggcgcggcgcca

SEQ ID NO: 3058039 - RNA, 22 nt, Mycobacterium bovis subsp bovis AF2122/97
cgugcucacggcaggcggugaa

SEQ ID NO: 3058040 - RNA, 15 nt, Mycobacterium bovis subsp bovis AF2122/97
cgugcuccugcccga

SEQ ID NO: 3058041 - RNA, 21 nt, Mycobacterium bovis subsp bovis AF2122/97
cgugcucgccguaagcaccag

SEQ ID NO: 3058042 - RNA, 23 nt, Mycobacterium bovis subsp bovis AF2122/97
cgugcucgccguaagcaccagcc

SEQ ID NO: 3058043 - RNA, 14 nt, Mycobacterium bovis subsp bovis AF2122/97
cgugcucggaggcg

SEQ ID NO: 3058044 - RNA, 14 nt, Mycobacterium bovis subsp bovis AF2122/97
cgugcucggccugu

SEQ ID NO: 3058045 - RNA, 23 nt, Mycobacterium bovis subsp bovis AF2122/97
cgugcucggccuguucggcggcu

SEQ ID NO: 3058046 - RNA, 17 nt, Mycobacterium bovis subsp bovis AF2122/97
cgugcugaacuccgccg

SEQ ID NO: 3058047 - RNA, 18 nt, Mycobacterium bovis subsp bovis AF2122/97
cgugcugaacuccgccgc

SEQ ID NO: 3058048 - RNA, 20 nt, Mycobacterium bovis subsp bovis AF2122/97
cgugcugaacuccgccgcga

SEQ ID NO: 3058049 - RNA, 23 nt, Mycobacterium bovis subsp bovis AF2122/97
cgugcugaagcuguaggcgacca

SEQ ID NO: 3058050 - RNA, 20 nt, Mycobacterium bovis subsp bovis AF2122/97
cgugcugcagaucggccgga

SEQ ID NO: 3058051 - RNA, 15 nt, Mycobacterium bovis subsp bovis AF2122/97
cgugcugcccauccc

SEQ ID NO: 3058052 - RNA, 16 nt, Mycobacterium bovis subsp bovis AF2122/97
cgugcugcccaucccg

SEQ ID NO: 3058053 - RNA, 20 nt, Mycobacterium bovis subsp bovis AF2122/97
cgugcugcccaucccggccg

SEQ ID NO: 3058054 - RNA, 12 nt, Mycobacterium bovis subsp bovis AF2122/97
cgugcugccgcc

SEQ ID NO: 3058055 - RNA, 21 nt, Mycobacterium bovis subsp bovis AF2122/97
cgugcugccgccuuggucgcg

SEQ ID NO: 3058056 - RNA, 21 nt, Mycobacterium bovis subsp bovis AF2122/97
cgugcugccguauccaggcgu

SEQ ID NO: 3058057 - RNA, 21 nt, Mycobacterium bovis subsp bovis AF2122/97
cgugcugcuagccagucggcc

SEQ ID NO: 3058058 - RNA, 22 nt, Mycobacterium bovis subsp bovis AF2122/97
cgugcugcuagccagucggcca

SEQ ID NO: 3058059 - RNA, 14 nt, Mycobacterium bovis subsp bovis AF2122/97
cgugcuggaacagg

SEQ ID NO: 3058060 - RNA, 16 nt, Mycobacterium bovis subsp bovis AF2122/97
cgugcuggcaccagca

SEQ ID NO: 3058061 - RNA, 13 nt, Mycobacterium bovis subsp bovis AF2122/97
cgugcuggcgacg

SEQ ID NO: 3058062 - RNA, 20 nt, Mycobacterium bovis subsp bovis AF2122/97
cgugcugggcaucaccgacg

SEQ ID NO: 3058063 - RNA, 22 nt, Mycobacterium bovis subsp bovis AF2122/97
cgugcugggcaucaccgacgcg

SEQ ID NO: 3058064 - RNA, 15 nt, Mycobacterium bovis subsp bovis AF2122/97
cgugcugggccgacg

SEQ ID NO: 3058065 - RNA, 18 nt, Mycobacterium bovis subsp bovis AF2122/97
cgugcugggccgacggga

SEQ ID NO: 3058066 - RNA, 17 nt, Mycobacterium bovis subsp bovis AF2122/97
cgugcugggcgccgcgc

SEQ ID NO: 3058067 - RNA, 18 nt, Mycobacterium bovis subsp bovis AF2122/97
cgugcugggcgccgcgcu

SEQ ID NO: 3058068 - RNA, 20 nt, Mycobacterium bovis subsp bovis AF2122/97
cgugcugggugacaccggug

SEQ ID NO: 3058069 - RNA, 17 nt, Mycobacterium bovis subsp bovis AF2122/97
cgugcuggugggccgga

SEQ ID NO: 3058070 - RNA, 15 nt, Mycobacterium bovis subsp bovis AF2122/97
cgugcugugcucacg

SEQ ID NO: 3058071 - RNA, 21 nt, Mycobacterium bovis subsp bovis AF2122/97
cgugcuguggaugccgacggc

SEQ ID NO: 3058072 - RNA, 13 nt, Mycobacterium bovis subsp bovis AF2122/97
cgugcuuccauuc

SEQ ID NO: 3058073 - RNA, 16 nt, Mycobacterium bovis subsp bovis AF2122/97
cgugcuuccauucgcg

SEQ ID NO: 3058074 - RNA, 15 nt, Mycobacterium bovis subsp bovis AF2122/97
cgugcuugcccgguu

SEQ ID NO: 3058075 - RNA, 18 nt, Mycobacterium bovis subsp bovis AF2122/97
cgugcuuggcagcggugu

SEQ ID NO: 3058076 - RNA, 22 nt, Mycobacterium bovis subsp bovis AF2122/97
cgugcuuguugcgcgacgccgc

SEQ ID NO: 3058077 - RNA, 15 nt, Mycobacterium bovis subsp bovis AF2122/97
cguggaaagccggcg

SEQ ID NO: 3058078 - RNA, 21 nt, Mycobacterium bovis subsp bovis AF2122/97
cguggaacacgaagucgaacg

SEQ ID NO: 3058079 - RNA, 19 nt, Mycobacterium bovis subsp bovis AF2122/97
cguggaacuccguccgccg

SEQ ID NO: 3058080 - RNA, 15 nt, Mycobacterium bovis subsp bovis AF2122/97
cguggaagccgacga

SEQ ID NO: 3058081 - RNA, 22 nt, Mycobacterium bovis subsp bovis AF2122/97
cguggaagccgacgaccagcag

SEQ ID NO: 3058082 - RNA, 15 nt, Mycobacterium bovis subsp bovis AF2122/97
cguggacaagcacag

SEQ ID NO: 3058083 - RNA, 17 nt, Mycobacterium bovis subsp bovis AF2122/97
cguggacaagcacagcg

SEQ ID NO: 3058084 - RNA, 13 nt, Mycobacterium bovis subsp bovis AF2122/97
cguggacaucggg

SEQ ID NO: 3058085 - RNA, 19 nt, Mycobacterium bovis subsp bovis AF2122/97
cguggacaucgggcggcac

SEQ ID NO: 3058086 - RNA, 22 nt, Mycobacterium bovis subsp bovis AF2122/97
cguggacaucgggcggcaccgc

SEQ ID NO: 3058087 - RNA, 17 nt, Mycobacterium bovis subsp bovis AF2122/97
cguggaccacggcguug

SEQ ID NO: 3058088 - RNA, 23 nt, Mycobacterium bovis subsp bovis AF2122/97
cguggacgcccgcccgcacgacg

SEQ ID NO: 3058089 - RNA, 19 nt, Mycobacterium bovis subsp bovis AF2122/97
cguggacguacugucgucg

SEQ ID NO: 3058090 - RNA, 21 nt, Mycobacterium bovis subsp bovis AF2122/97
cguggacguacugucgucgcc

SEQ ID NO: 3058091 - RNA, 21 nt, Mycobacterium bovis subsp bovis AF2122/97
cguggagaucacgugccggcu

SEQ ID NO: 3058092 - RNA, 15 nt, Mycobacterium bovis subsp bovis AF2122/97
cguggagccggccgu

SEQ ID NO: 3058093 - RNA, 19 nt, Mycobacterium bovis subsp bovis AF2122/97
cguggagcgcaaguugagc

SEQ ID NO: 3058094 - RNA, 13 nt, Mycobacterium bovis subsp bovis AF2122/97
cguggagcgcuug

SEQ ID NO: 3058095 - RNA, 21 nt, Mycobacterium bovis subsp bovis AF2122/97
cguggagcucacgugcugccg

SEQ ID NO: 3058096 - RNA, 22 nt, Mycobacterium bovis subsp bovis AF2122/97
cguggaguggacugagucguag

SEQ ID NO: 3058097 - RNA, 15 nt, Mycobacterium bovis subsp bovis AF2122/97
cgugggcagcgcgau

SEQ ID NO: 3058098 - RNA, 16 nt, Mycobacterium bovis subsp bovis AF2122/97
cgugggcaugcggauu

SEQ ID NO: 3058099 - RNA, 18 nt, Mycobacterium bovis subsp bovis AF2122/97
cgugggcauucucgagcc

SEQ ID NO: 3058100 - RNA, 18 nt, Mycobacterium bovis subsp bovis AF2122/97
cgugggcauugcggcgcg

SEQ ID NO: 3058101 - RNA, 20 nt, Mycobacterium bovis subsp bovis AF2122/97
cgugggcauugcggcgcggg

SEQ ID NO: 3058102 - RNA, 13 nt, Mycobacterium bovis subsp bovis AF2122/97
cgugggccaccac

SEQ ID NO: 3058103 - RNA, 20 nt, Mycobacterium bovis subsp bovis AF2122/97
cgugggccacuugaugcucg

SEQ ID NO: 3058104 - RNA, 21 nt, Mycobacterium bovis subsp bovis AF2122/97
cgugggccacuugaugcucga

SEQ ID NO: 3058105 - RNA, 15 nt, Mycobacterium bovis subsp bovis AF2122/97
cgugggccgcuggga

SEQ ID NO: 3058106 - RNA, 16 nt, Mycobacterium bovis subsp bovis AF2122/97
cgugggccugcccggc

SEQ ID NO: 3058107 - RNA, 17 nt, Mycobacterium bovis subsp bovis AF2122/97
cgugggccugcccggcg

SEQ ID NO: 3058108 - RNA, 22 nt, Mycobacterium bovis subsp bovis AF2122/97
cgugggccugcccggcgccgua

SEQ ID NO: 3058109 - RNA, 22 nt, Mycobacterium bovis subsp bovis AF2122/97
cgugggccuguugcugcccgac

SEQ ID NO: 3058110 - RNA, 17 nt, Mycobacterium bovis subsp bovis AF2122/97
cgugggcgacggcggcg

SEQ ID NO: 3058111 - RNA, 14 nt, Mycobacterium bovis subsp bovis AF2122/97
cgugggcgcggcgc

SEQ ID NO: 3058112 - RNA, 18 nt, Mycobacterium bovis subsp bovis AF2122/97
cgugggcgcggcgccaga

SEQ ID NO: 3058113 - RNA, 20 nt, Mycobacterium bovis subsp bovis AF2122/97
cgugggcgugcaggcugguu

SEQ ID NO: 3058114 - RNA, 21 nt, Mycobacterium bovis subsp bovis AF2122/97
cgugggcuugcuucucucaaa

SEQ ID NO: 3058115 - RNA, 18 nt, Mycobacterium bovis subsp bovis AF2122/97
cguggggccgccaccagc

SEQ ID NO: 3058116 - RNA, 18 nt, Mycobacterium bovis subsp bovis AF2122/97
cgugggguaucgccagcc

SEQ ID NO: 3058117 - RNA, 16 nt, Mycobacterium bovis subsp bovis AF2122/97
cguggguaccgagcag

SEQ ID NO: 3058118 - RNA, 22 nt, Mycobacterium bovis subsp bovis AF2122/97
cguggguacgcaucucgagcau

SEQ ID NO: 3058119 - RNA, 17 nt, Mycobacterium bovis subsp bovis AF2122/97
cguggguccaacccgcg

SEQ ID NO: 3058120 - RNA, 18 nt, Mycobacterium bovis subsp bovis AF2122/97
cgugggugagcgaccugg

SEQ ID NO: 3058121 - RNA, 12 nt, Mycobacterium bovis subsp bovis AF2122/97
cgugggugucgg

SEQ ID NO: 3058122 - RNA, 14 nt, Mycobacterium bovis subsp bovis AF2122/97
cgugggugucggcu

SEQ ID NO: 3058123 - RNA, 21 nt, Mycobacterium bovis subsp bovis AF2122/97
cgugggugucggcuagcaacg

SEQ ID NO: 3058124 - RNA, 14 nt, Mycobacterium bovis subsp bovis AF2122/97
cgugggugucggug

SEQ ID NO: 3058125 - RNA, 21 nt, Mycobacterium bovis subsp bovis AF2122/97
cguggguguugaugggcagcc

SEQ ID NO: 3058126 - RNA, 15 nt, Mycobacterium bovis subsp bovis AF2122/97
cgugguaaccagggc

SEQ ID NO: 3058127 - RNA, 17 nt, Mycobacterium bovis subsp bovis AF2122/97
cgugguaaccagggcag

SEQ ID NO: 3058128 - RNA, 22 nt, Mycobacterium bovis subsp bovis AF2122/97
cgugguaaccauauggcccgcg

SEQ ID NO: 3058129 - RNA, 19 nt, Mycobacterium bovis subsp bovis AF2122/97
cgugguagacggccugcga

SEQ ID NO: 3058130 - RNA, 14 nt, Mycobacterium bovis subsp bovis AF2122/97
cgugguagccggcg

SEQ ID NO: 3058131 - RNA, 16 nt, Mycobacterium bovis subsp bovis AF2122/97
cgugguagccggcgac

SEQ ID NO: 3058132 - RNA, 22 nt, Mycobacterium bovis subsp bovis AF2122/97
cgugguagccggcgacaccgca

SEQ ID NO: 3058133 - RNA, 17 nt, Mycobacterium bovis subsp bovis AF2122/97
cgugguagcgccucgug

SEQ ID NO: 3058134 - RNA, 16 nt, Mycobacterium bovis subsp bovis AF2122/97
cgugguaucgccggga

SEQ ID NO: 3058135 - RNA, 18 nt, Mycobacterium bovis subsp bovis AF2122/97
cguggucaccccuucgcc

SEQ ID NO: 3058136 - RNA, 22 nt, Mycobacterium bovis subsp bovis AF2122/97
cguggucaccccuucgccagcg

SEQ ID NO: 3058137 - RNA, 22 nt, Mycobacterium bovis subsp bovis AF2122/97
cgugguccaaccgggccggcua

SEQ ID NO: 3058138 - RNA, 20 nt, Mycobacterium bovis subsp bovis AF2122/97
cguggucgacggggcggucg

SEQ ID NO: 3058139 - RNA, 22 nt, Mycobacterium bovis subsp bovis AF2122/97
cguggucgacggggcggucggc

SEQ ID NO: 3058140 - RNA, 17 nt, Mycobacterium bovis subsp bovis AF2122/97
cguggucgagcaggcga

SEQ ID NO: 3058141 - RNA, 19 nt, Mycobacterium bovis subsp bovis AF2122/97
cguggucgauccacucggc

SEQ ID NO: 3058142 - RNA, 22 nt, Mycobacterium bovis subsp bovis AF2122/97
cguggucgccccgaugaccgcc

SEQ ID NO: 3058143 - RNA, 15 nt, Mycobacterium bovis subsp bovis AF2122/97
cguggucgcgcggca

SEQ ID NO: 3058144 - RNA, 13 nt, Mycobacterium bovis subsp bovis AF2122/97
cguggucggcaaa

SEQ ID NO: 3058145 - RNA, 15 nt, Mycobacterium bovis subsp bovis AF2122/97
cguggucggccaccc

SEQ ID NO: 3058146 - RNA, 18 nt, Mycobacterium bovis subsp bovis AF2122/97
cguggucggcgaccccga

SEQ ID NO: 3058147 - RNA, 17 nt, Mycobacterium bovis subsp bovis AF2122/97
cguggucgugggugagc

SEQ ID NO: 3058148 - RNA, 18 nt, Mycobacterium bovis subsp bovis AF2122/97
cguggugagccucggcga

SEQ ID NO: 3058149 - RNA, 20 nt, Mycobacterium bovis subsp bovis AF2122/97
cguggugauccggucuccgc

SEQ ID NO: 3058150 - RNA, 18 nt, Mycobacterium bovis subsp bovis AF2122/97
cguggugcaacacgccgg

SEQ ID NO: 3058151 - RNA, 19 nt, Mycobacterium bovis subsp bovis AF2122/97
cguggugcaacacgccggc

SEQ ID NO: 3058152 - RNA, 19 nt, Mycobacterium bovis subsp bovis AF2122/97
cguggugccuacaccggca

SEQ ID NO: 3058153 - RNA, 20 nt, Mycobacterium bovis subsp bovis AF2122/97
cguggugccuacaccggcaa

SEQ ID NO: 3058154 - RNA, 13 nt, Mycobacterium bovis subsp bovis AF2122/97
cguggugcggccg

SEQ ID NO: 3058155 - RNA, 18 nt, Mycobacterium bovis subsp bovis AF2122/97
cguggugcuagcgccgcc

SEQ ID NO: 3058156 - RNA, 19 nt, Mycobacterium bovis subsp bovis AF2122/97
cguggugcuagcgccgcca

SEQ ID NO: 3058157 - RNA, 21 nt, Mycobacterium bovis subsp bovis AF2122/97
cguggugcuagcgccgccagu

SEQ ID NO: 3058158 - RNA, 18 nt, Mycobacterium bovis subsp bovis AF2122/97
cguggugcugaccgcgcc

SEQ ID NO: 3058159 - RNA, 19 nt, Mycobacterium bovis subsp bovis AF2122/97
cgugguggacgcagaguca

SEQ ID NO: 3058160 - RNA, 20 nt, Mycobacterium bovis subsp bovis AF2122/97
cgugguggacgcagagucaa

SEQ ID NO: 3058161 - RNA, 22 nt, Mycobacterium bovis subsp bovis AF2122/97
cgugguggcgccaugaagccgg

SEQ ID NO: 3058162 - RNA, 20 nt, Mycobacterium bovis subsp bovis AF2122/97
cguggugggcgcagagucaa

SEQ ID NO: 3058163 - RNA, 14 nt, Mycobacterium bovis subsp bovis AF2122/97
cgugguggucgggc

SEQ ID NO: 3058164 - RNA, 17 nt, Mycobacterium bovis subsp bovis AF2122/97
cgugguggucgggcgca

SEQ ID NO: 3058165 - RNA, 22 nt, Mycobacterium bovis subsp bovis AF2122/97
cgugguguacccgccucgggcc

SEQ ID NO: 3058166 - RNA, 21 nt, Mycobacterium bovis subsp bovis AF2122/97
cgugguguaucgacggcggcc

SEQ ID NO: 3058167 - RNA, 17 nt, Mycobacterium bovis subsp bovis AF2122/97
cgugguuccggcgugca

SEQ ID NO: 3058168 - RNA, 21 nt, Mycobacterium bovis subsp bovis AF2122/97
cgugguugcacguucggcgug

SEQ ID NO: 3058169 - RNA, 16 nt, Mycobacterium bovis subsp bovis AF2122/97
cgugguuguaccagcc

SEQ ID NO: 3058170 - RNA, 17 nt, Mycobacterium bovis subsp bovis AF2122/97
cgugguuugcgucagcg

SEQ ID NO: 3058171 - RNA, 21 nt, Mycobacterium bovis subsp bovis AF2122/97
cguguaaccccaggcgcugcc

SEQ ID NO: 3058172 - RNA, 20 nt, Mycobacterium bovis subsp bovis AF2122/97
cguguaacgccgacuccccc

SEQ ID NO: 3058173 - RNA, 21 nt, Mycobacterium bovis subsp bovis AF2122/97
cguguaccuccucgaguaccc

SEQ ID NO: 3058174 - RNA, 15 nt, Mycobacterium bovis subsp bovis AF2122/97
cguguacgucgauca

SEQ ID NO: 3058175 - RNA, 17 nt, Mycobacterium bovis subsp bovis AF2122/97
cguguacgucgaucagg

SEQ ID NO: 3058176 - RNA, 22 nt, Mycobacterium bovis subsp bovis AF2122/97
cguguaggcaaccuuuggccgc

SEQ ID NO: 3058177 - RNA, 16 nt, Mycobacterium bovis subsp bovis AF2122/97
cgugucaaccggucgg

SEQ ID NO: 3058178 - RNA, 21 nt, Mycobacterium bovis subsp bovis AF2122/97
cgugucacccaauggagccgc

SEQ ID NO: 3058179 - RNA, 15 nt, Mycobacterium bovis subsp bovis AF2122/97
cgugucacccucggg

SEQ ID NO: 3058180 - RNA, 12 nt, Mycobacterium bovis subsp bovis AF2122/97
cgugucaccggg

SEQ ID NO: 3058181 - RNA, 16 nt, Mycobacterium bovis subsp bovis AF2122/97
cgugucaccgggugca

SEQ ID NO: 3058182 - RNA, 18 nt, Mycobacterium bovis subsp bovis AF2122/97
cgugucacgcgaccaccg

SEQ ID NO: 3058183 - RNA, 23 nt, Mycobacterium bovis subsp bovis AF2122/97
cguucacgcgcggaucggcggcc

SEQ ID NO: 3058184 - RNA, 20 nt, Mycobacterium bovis subsp bovis AF2122/97
cguucagcccaugcccggcg

SEQ ID NO: 3058185 - RNA, 18 nt, Mycobacterium bovis subsp bovis AF2122/97
cguucagcgaccaaugca

SEQ ID NO: 3058186 - RNA, 18 nt, Mycobacterium bovis subsp bovis AF2122/97
cguucagcgacggccgcc

SEQ ID NO: 3058187 - RNA, 19 nt, Mycobacterium bovis subsp bovis AF2122/97
cguucagcgacggccgcca

SEQ ID NO: 3058188 - RNA, 17 nt, Mycobacterium bovis subsp bovis AF2122/97
cguucagcgccagcgcc

SEQ ID NO: 3058189 - RNA, 14 nt, Mycobacterium bovis subsp bovis AF2122/97
cguucagcggccag

SEQ ID NO: 3058190 - RNA, 19 nt, Mycobacterium bovis subsp bovis AF2122/97
cguucagcggccagcagug

SEQ ID NO: 3058191 - RNA, 18 nt, Mycobacterium bovis subsp bovis AF2122/97
cguucaggccagcggauu

SEQ ID NO: 3058192 - RNA, 19 nt, Mycobacterium bovis subsp bovis AF2122/97
cguucagguguugacgcca

SEQ ID NO: 3058193 - RNA, 19 nt, Mycobacterium bovis subsp bovis AF2122/97
cguucaucuucaccacgcc

SEQ ID NO: 3058194 - RNA, 16 nt, Mycobacterium bovis subsp bovis AF2122/97
cguucaugaucggcag

SEQ ID NO: 3058195 - RNA, 15 nt, Mycobacterium bovis subsp bovis AF2122/97
cguucaugcggcggc

SEQ ID NO: 3058196 - RNA, 17 nt, Mycobacterium bovis subsp bovis AF2122/97
cguucaugcggcggcgc

SEQ ID NO: 3058197 - RNA, 23 nt, Mycobacterium bovis subsp bovis AF2122/97
cguuccacaucaaaacggcggug

SEQ ID NO: 3058198 - RNA, 19 nt, Mycobacterium bovis subsp bovis AF2122/97
cguuccagcacacccagau

SEQ ID NO: 3058199 - RNA, 20 nt, Mycobacterium bovis subsp bovis AF2122/97
cguuccagcaguacaccgcc

SEQ ID NO: 3058200 - RNA, 21 nt, Mycobacterium bovis subsp bovis AF2122/97
cguuccagcaguacaccgccc

SEQ ID NO: 3058201 - RNA, 16 nt, Mycobacterium bovis subsp bovis AF2122/97
cguuccagcaucggug

SEQ ID NO: 3058202 - RNA, 14 nt, Mycobacterium bovis subsp bovis AF2122/97
cguuccaucacgga

SEQ ID NO: 3058203 - RNA, 19 nt, Mycobacterium bovis subsp bovis AF2122/97
cguuccaucacggaccagg

SEQ ID NO: 3058204 - RNA, 22 nt, Mycobacterium bovis subsp bovis AF2122/97
cguuccaucacggaccaggccu

SEQ ID NO: 3058205 - RNA, 16 nt, Mycobacterium bovis subsp bovis AF2122/97
cguuccaucgccgacg

SEQ ID NO: 3058206 - RNA, 17 nt, Mycobacterium bovis subsp bovis AF2122/97
cguuccaucgccgacgc

SEQ ID NO: 3058207 - RNA, 22 nt, Mycobacterium bovis subsp bovis AF2122/97
cguucccacgguucugccggaa

SEQ ID NO: 3058208 - RNA, 13 nt, Mycobacterium bovis subsp bovis AF2122/97
cguucccccggca

SEQ ID NO: 3058209 - RNA, 23 nt, Mycobacterium bovis subsp bovis AF2122/97
cguucccccggcaccgccggcuc

SEQ ID NO: 3058210 - RNA, 19 nt, Mycobacterium bovis subsp bovis AF2122/97
cguucccgccauugccgcc

SEQ ID NO: 3058211 - RNA, 21 nt, Mycobacterium bovis subsp bovis AF2122/97
cguucccgccauugccgccgu

SEQ ID NO: 3058212 - RNA, 13 nt, Mycobacterium bovis subsp bovis AF2122/97
cguucccgccggc

SEQ ID NO: 3058213 - RNA, 15 nt, Mycobacterium bovis subsp bovis AF2122/97
cguucccgccggcuc

SEQ ID NO: 3058214 - RNA, 13 nt, Mycobacterium bovis subsp bovis AF2122/97
cguucccgcucgg

SEQ ID NO: 3058215 - RNA, 14 nt, Mycobacterium bovis subsp bovis AF2122/97
cguucccgcucggg

SEQ ID NO: 3058216 - RNA, 13 nt, Mycobacterium bovis subsp bovis AF2122/97
cguucccggcaga

SEQ ID NO: 3058217 - RNA, 13 nt, Mycobacterium bovis subsp bovis AF2122/97
cguuccgaucggc

SEQ ID NO: 3058218 - RNA, 13 nt, Mycobacterium bovis subsp bovis AF2122/97
cguuccgccgccu

SEQ ID NO: 3058219 - RNA, 13 nt, Mycobacterium bovis subsp bovis AF2122/97
cguuccgcucgag

SEQ ID NO: 3058220 - RNA, 14 nt, Mycobacterium bovis subsp bovis AF2122/97
cguuccgcucgccg

SEQ ID NO: 3058221 - RNA, 17 nt, Mycobacterium bovis subsp bovis AF2122/97
cguuccgcucgccguuu

SEQ ID NO: 3058222 - RNA, 18 nt, Mycobacterium bovis subsp bovis AF2122/97
cguuccgggccgaucacc

SEQ ID NO: 3058223 - RNA, 21 nt, Mycobacterium bovis subsp bovis AF2122/97
cguuccugaucgagcgccagc

SEQ ID NO: 3058224 - RNA, 23 nt, Mycobacterium bovis subsp bovis AF2122/97
cguuccugaucgagcgccagcgc

SEQ ID NO: 3058225 - RNA, 16 nt, Mycobacterium bovis subsp bovis AF2122/97
cguucgaaggccaccc

SEQ ID NO: 3058226 - RNA, 18 nt, Mycobacterium bovis subsp bovis AF2122/97
cguucgaaggccacccgc

SEQ ID NO: 3058227 - RNA, 15 nt, Mycobacterium bovis subsp bovis AF2122/97
cguucgagugcgguc

SEQ ID NO: 3058228 - RNA, 21 nt, Mycobacterium bovis subsp bovis AF2122/97
cguucgagugcggucgagagc

SEQ ID NO: 3058229 - RNA, 14 nt, Mycobacterium bovis subsp bovis AF2122/97
cguucgcccgcccg

SEQ ID NO: 3058230 - RNA, 21 nt, Mycobacterium bovis subsp bovis AF2122/97
cguucgcccuaauccgcuugc

SEQ ID NO: 3058231 - RNA, 15 nt, Mycobacterium bovis subsp bovis AF2122/97
cguucgccgcccggc

SEQ ID NO: 3058232 - RNA, 16 nt, Mycobacterium bovis subsp bovis AF2122/97
cguucgccgcccggcg

SEQ ID NO: 3058233 - RNA, 21 nt, Mycobacterium bovis subsp bovis AF2122/97
cguucgccggaauacaccagc

SEQ ID NO: 3058234 - RNA, 18 nt, Mycobacterium bovis subsp bovis AF2122/97
cguucgccgucggugaug

SEQ ID NO: 3058235 - RNA, 15 nt, Mycobacterium bovis subsp bovis AF2122/97
cguucgccuggucac

SEQ ID NO: 3058236 - RNA, 14 nt, Mycobacterium bovis subsp bovis AF2122/97
cguucgcgccguug

SEQ ID NO: 3058237 - RNA, 17 nt, Mycobacterium bovis subsp bovis AF2122/97
cguucgcgggcgucccg

SEQ ID NO: 3058238 - RNA, 21 nt, Mycobacterium bovis subsp bovis AF2122/97
cguucgcgggcgucccgcaua

SEQ ID NO: 3058239 - RNA, 20 nt, Mycobacterium bovis subsp bovis AF2122/97
cguucgcgggugcgcugcag

SEQ ID NO: 3058240 - RNA, 19 nt, Mycobacterium bovis subsp bovis AF2122/97
cguucgcgucacaccagcg

SEQ ID NO: 3058241 - RNA, 15 nt, Mycobacterium bovis subsp bovis AF2122/97
cguucgcgucgccga

SEQ ID NO: 3058242 - RNA, 18 nt, Mycobacterium bovis subsp bovis AF2122/97
cguucgcgugccagcgcc

SEQ ID NO: 3058243 - RNA, 21 nt, Mycobacterium bovis subsp bovis AF2122/97
cguucgcgugccagcgccccg

SEQ ID NO: 3058244 - RNA, 13 nt, Mycobacterium bovis subsp bovis AF2122/97
cguucggccgggc

SEQ ID NO: 3058245 - RNA, 14 nt, Mycobacterium bovis subsp bovis AF2122/97
cguucggccgggcc

SEQ ID NO: 3058246 - RNA, 15 nt, Mycobacterium bovis subsp bovis AF2122/97
cguucggccgggccg

SEQ ID NO: 3058247 - RNA, 15 nt, Mycobacterium bovis subsp bovis AF2122/97
cguucggcgacagcg

SEQ ID NO: 3058248 - RNA, 15 nt, Mycobacterium bovis subsp bovis AF2122/97
cguucggcgacgcgc

SEQ ID NO: 3058249 - RNA, 13 nt, Mycobacterium bovis subsp bovis AF2122/97
cguucggcgagca

SEQ ID NO: 3058250 - RNA, 17 nt, Mycobacterium bovis subsp bovis AF2122/97
cguucggcgcccgcucg

SEQ ID NO: 3058251 - RNA, 20 nt, Mycobacterium bovis subsp bovis AF2122/97
cguucggcgcccgcucggcc

SEQ ID NO: 3058252 - RNA, 23 nt, Mycobacterium bovis subsp bovis AF2122/97
cguucggcgcccgcucggccgca

SEQ ID NO: 3058253 - RNA, 19 nt, Mycobacterium bovis subsp bovis AF2122/97
cguucggcgcugaucgcgc

SEQ ID NO: 3058254 - RNA, 16 nt, Mycobacterium bovis subsp bovis AF2122/97
cguucggcgugucggg

SEQ ID NO: 3058255 - RNA, 21 nt, Mycobacterium bovis subsp bovis AF2122/97
cguucggcuaagccuucggug

SEQ ID NO: 3058256 - RNA, 15 nt, Mycobacterium bovis subsp bovis AF2122/97
cguucggcugccgcg

SEQ ID NO: 3058257 - RNA, 18 nt, Mycobacterium bovis subsp bovis AF2122/97
cguucgggcccguagccg

SEQ ID NO: 3058258 - RNA, 18 nt, Mycobacterium bovis subsp bovis AF2122/97
cguucgggccguccuccc

SEQ ID NO: 3058259 - RNA, 18 nt, Mycobacterium bovis subsp bovis AF2122/97
cguucggggccccgcggc

SEQ ID NO: 3058260 - RNA, 22 nt, Mycobacterium bovis subsp bovis AF2122/97
cguucggggccccgcggcgccg

SEQ ID NO: 3058261 - RNA, 15 nt, Mycobacterium bovis subsp bovis AF2122/97
cguucggugaucucg

SEQ ID NO: 3058262 - RNA, 17 nt, Mycobacterium bovis subsp bovis AF2122/97
cguucggugaucucgua

SEQ ID NO: 3058263 - RNA, 16 nt, Mycobacterium bovis subsp bovis AF2122/97
cguucgucaccacgau

SEQ ID NO: 3058264 - RNA, 14 nt, Mycobacterium bovis subsp bovis AF2122/97
cguucgugagcggc

SEQ ID NO: 3058265 - RNA, 15 nt, Mycobacterium bovis subsp bovis AF2122/97
cguucgugggcauug

SEQ ID NO: 3058266 - RNA, 22 nt, Mycobacterium bovis subsp bovis AF2122/97
cguucgugggcauugcggcgcg

SEQ ID NO: 3058267 - RNA, 21 nt, Mycobacterium bovis subsp bovis AF2122/97
cguucguucccgcucgggcaa

SEQ ID NO: 3058268 - RNA, 17 nt, Mycobacterium bovis subsp bovis AF2122/97
cguucucgauugucgcc

SEQ ID NO: 3058269 - RNA, 16 nt, Mycobacterium bovis subsp bovis AF2122/97
cguugccgccgucacc

SEQ ID NO: 3058270 - RNA, 15 nt, Mycobacterium bovis subsp bovis AF2122/97
cguugccgccguccc

SEQ ID NO: 3058271 - RNA, 23 nt, Mycobacterium bovis subsp bovis AF2122/97
cguugccgccguccccgccgacg

SEQ ID NO: 3058272 - RNA, 14 nt, Mycobacterium bovis subsp bovis AF2122/97
cguugccgccguua

SEQ ID NO: 3058273 - RNA, 21 nt, Mycobacterium bovis subsp bovis AF2122/97
cguugccgccguuaccgagcc

SEQ ID NO: 3058274 - RNA, 14 nt, Mycobacterium bovis subsp bovis AF2122/97
cguugccgccguug

SEQ ID NO: 3058275 - RNA, 18 nt, Mycobacterium bovis subsp bovis AF2122/97
cguugccgccguugccgc

SEQ ID NO: 3058276 - RNA, 20 nt, Mycobacterium bovis subsp bovis AF2122/97
cguugccgccguugccgccg

SEQ ID NO: 3058277 - RNA, 23 nt, Mycobacterium bovis subsp bovis AF2122/97
cguugccgccguugccgccgaag

SEQ ID NO: 3058278 - RNA, 23 nt, Mycobacterium bovis subsp bovis AF2122/97
cguugccgccguugccgccguua

SEQ ID NO: 3058279 - RNA, 19 nt, Mycobacterium bovis subsp bovis AF2122/97
cguugccgccguugccggc

SEQ ID NO: 3058280 - RNA, 21 nt, Mycobacterium bovis subsp bovis AF2122/97
cguugccgccguugccggcuu

SEQ ID NO: 3058281 - RNA, 14 nt, Mycobacterium bovis subsp bovis AF2122/97
cguugccggaguug

SEQ ID NO: 3058282 - RNA, 20 nt, Mycobacterium bovis subsp bovis AF2122/97
cguugccggaguugucgacg

SEQ ID NO: 3058283 - RNA, 13 nt, Mycobacterium bovis subsp bovis AF2122/97
cguugccggccac

SEQ ID NO: 3058284 - RNA, 14 nt, Mycobacterium bovis subsp bovis AF2122/97
cguugccggcguug

SEQ ID NO: 3058285 - RNA, 15 nt, Mycobacterium bovis subsp bovis AF2122/97
cguugccggcuuggc

SEQ ID NO: 3058286 - RNA, 22 nt, Mycobacterium bovis subsp bovis AF2122/97
cguugccgggguaggggucgag

SEQ ID NO: 3058287 - RNA, 14 nt, Mycobacterium bovis subsp bovis AF2122/97
cguugccgggguug

SEQ ID NO: 3058288 - RNA, 20 nt, Mycobacterium bovis subsp bovis AF2122/97
cguugccggucgcauggucg

SEQ ID NO: 3058289 - RNA, 16 nt, Mycobacterium bovis subsp bovis AF2122/97
cguugccggugccgcc

SEQ ID NO: 3058290 - RNA, 19 nt, Mycobacterium bovis subsp bovis AF2122/97
cguugccggugccgccgcg

SEQ ID NO: 3058291 - RNA, 20 nt, Mycobacterium bovis subsp bovis AF2122/97
cguugccggugccgccgcgg

SEQ ID NO: 3058292 - RNA, 17 nt, Mycobacterium bovis subsp bovis AF2122/97
cguugccgucggugaug

SEQ ID NO: 3058293 - RNA, 20 nt, Mycobacterium bovis subsp bovis AF2122/97
cguugccgucgucgccgucg

SEQ ID NO: 3058294 - RNA, 18 nt, Mycobacterium bovis subsp bovis AF2122/97
cguugccucgucgccgcg

SEQ ID NO: 3058295 - RNA, 19 nt, Mycobacterium bovis subsp bovis AF2122/97
cguugccucgucgccgcgg

SEQ ID NO: 3058296 - RNA, 18 nt, Mycobacterium bovis subsp bovis AF2122/97
cguugcgaggccgcacgu

SEQ ID NO: 3058297 - RNA, 21 nt, Mycobacterium bovis subsp bovis AF2122/97
cguugcgaggccgcacgucga

SEQ ID NO: 3058298 - RNA, 17 nt, Mycobacterium bovis subsp bovis AF2122/97
cguugcgcaagcuggua

SEQ ID NO: 3058299 - RNA, 13 nt, Mycobacterium bovis subsp bovis AF2122/97
cguugcgccagcg

SEQ ID NO: 3058300 - RNA, 19 nt, Mycobacterium bovis subsp bovis AF2122/97
cguugcgccucuuccuggc

SEQ ID NO: 3058301 - RNA, 17 nt, Mycobacterium bovis subsp bovis AF2122/97
cguugcgcugcgcgacg

SEQ ID NO: 3058302 - RNA, 18 nt, Mycobacterium bovis subsp bovis AF2122/97
cguugcguagcaggucga

SEQ ID NO: 3058303 - RNA, 22 nt, Mycobacterium bovis subsp bovis AF2122/97
cguugcguagcaggucgacggc

SEQ ID NO: 3058304 - RNA, 18 nt, Mycobacterium bovis subsp bovis AF2122/97
cguugcgucugcucggcg

SEQ ID NO: 3058305 - RNA, 19 nt, Mycobacterium bovis subsp bovis AF2122/97
cguugcuauucgccagcgc

SEQ ID NO: 3058306 - RNA, 17 nt, Mycobacterium bovis subsp bovis AF2122/97
cguugcucccacggcac

SEQ ID NO: 3058307 - RNA, 19 nt, Mycobacterium bovis subsp bovis AF2122/97
cguugcucccacggcaccc

SEQ ID NO: 3058308 - RNA, 21 nt, Mycobacterium bovis subsp bovis AF2122/97
cguugcucggucucgucgcgg

SEQ ID NO: 3058309 - RNA, 16 nt, Mycobacterium bovis subsp bovis AF2122/97
cguugcugcagcagcg

SEQ ID NO: 3058310 - RNA, 21 nt, Mycobacterium bovis subsp bovis AF2122/97
cguugcugcagcagcgcaguc

SEQ ID NO: 3058311 - RNA, 14 nt, Mycobacterium bovis subsp bovis AF2122/97
cguugcugccggcg

SEQ ID NO: 3058312 - RNA, 16 nt, Mycobacterium bovis subsp bovis AF2122/97
cguugcuggcggccag

SEQ ID NO: 3058313 - RNA, 21 nt, Mycobacterium bovis subsp bovis AF2122/97
cguugcuggcggccagcaucg

SEQ ID NO: 3058314 - RNA, 21 nt, Mycobacterium bovis subsp bovis AF2122/97
cguugcuggcuggguggcccc

SEQ ID NO: 3058315 - RNA, 16 nt, Mycobacterium bovis subsp bovis AF2122/97
cguugcuggucgccgu

SEQ ID NO: 3058316 - RNA, 21 nt, Mycobacterium bovis subsp bovis AF2122/97
cguuggaaaagucgggcacug

SEQ ID NO: 3058317 - RNA, 15 nt, Mycobacterium bovis subsp bovis AF2122/97
cguuggacggcaccg

SEQ ID NO: 3058318 - RNA, 14 nt, Mycobacterium bovis subsp bovis AF2122/97
cguuggagccgcca

SEQ ID NO: 3058319 - RNA, 18 nt, Mycobacterium bovis subsp bovis AF2122/97
cguuggauccacacccac

SEQ ID NO: 3058320 - RNA, 18 nt, Mycobacterium bovis subsp bovis AF2122/97
cguuggaugaagucgucg

SEQ ID NO: 3058321 - RNA, 21 nt, Mycobacterium bovis subsp bovis AF2122/97
cguuggaugaagucgucggca

SEQ ID NO: 3058322 - RNA, 23 nt, Mycobacterium bovis subsp bovis AF2122/97
cguuggauguuuuccgguccggc

SEQ ID NO: 3058323 - RNA, 18 nt, Mycobacterium bovis subsp bovis AF2122/97
cguuggcaaugaccccgg

SEQ ID NO: 3058324 - RNA, 19 nt, Mycobacterium bovis subsp bovis AF2122/97
cguuggcaaugaccccggc

SEQ ID NO: 3058325 - RNA, 23 nt, Mycobacterium bovis subsp bovis AF2122/97
cguuggcaaugaccccggcguug

SEQ ID NO: 3058326 - RNA, 16 nt, Mycobacterium bovis subsp bovis AF2122/97
cguuggcaucggcgga

SEQ ID NO: 3058327 - RNA, 13 nt, Mycobacterium bovis subsp bovis AF2122/97
cguuggccagcag

SEQ ID NO: 3058328 - RNA, 14 nt, Mycobacterium bovis subsp bovis AF2122/97
cguuggccagcagg

SEQ ID NO: 3058329 - RNA, 21 nt, Mycobacterium bovis subsp bovis AF2122/97
cguuggccgagcagggccggc

SEQ ID NO: 3058330 - RNA, 23 nt, Mycobacterium bovis subsp bovis AF2122/97
cguuggccgagcagggccggcac

SEQ ID NO: 3058331 - RNA, 14 nt, Mycobacterium bovis subsp bovis AF2122/97
cguuggcgaacagc

SEQ ID NO: 3058332 - RNA, 18 nt, Mycobacterium bovis subsp bovis AF2122/97
cguuggcgaacugguagc

SEQ ID NO: 3058333 - RNA, 17 nt, Mycobacterium bovis subsp bovis AF2122/97
cguuggcgaccaccgcg

SEQ ID NO: 3058334 - RNA, 18 nt, Mycobacterium bovis subsp bovis AF2122/97
cguuggcgaccaccgcgu

SEQ ID NO: 3058335 - RNA, 20 nt, Mycobacterium bovis subsp bovis AF2122/97
cguuggcgaccaccgcgucg

SEQ ID NO: 3058336 - RNA, 15 nt, Mycobacterium bovis subsp bovis AF2122/97
cguuggcgaucucga

SEQ ID NO: 3058337 - RNA, 19 nt, Mycobacterium bovis subsp bovis AF2122/97
cguuggcgaucucgacggc

SEQ ID NO: 3058338 - RNA, 16 nt, Mycobacterium bovis subsp bovis AF2122/97
cguuggcgccaccagu

SEQ ID NO: 3058339 - RNA, 15 nt, Mycobacterium bovis subsp bovis AF2122/97
cguuggcgcgguugc

SEQ ID NO: 3058340 - RNA, 17 nt, Mycobacterium bovis subsp bovis AF2122/97
cguuggcggaugcccgc

SEQ ID NO: 3058341 - RNA, 15 nt, Mycobacterium bovis subsp bovis AF2122/97
cguuggcggccagcg

SEQ ID NO: 3058342 - RNA, 14 nt, Mycobacterium bovis subsp bovis AF2122/97
cguuggcggcucgc

SEQ ID NO: 3058343 - RNA, 15 nt, Mycobacterium bovis subsp bovis AF2122/97
cguuggcggcucgcg

SEQ ID NO: 3058344 - RNA, 18 nt, Mycobacterium bovis subsp bovis AF2122/97
cguuggcgggagcaccga

SEQ ID NO: 3058345 - RNA, 13 nt, Mycobacterium bovis subsp bovis AF2122/97
cguuggcgguggu

SEQ ID NO: 3058346 - RNA, 17 nt, Mycobacterium bovis subsp bovis AF2122/97
cguuggcgugcaccgca

SEQ ID NO: 3058347 - RNA, 18 nt, Mycobacterium bovis subsp bovis AF2122/97
cguuggcgugcucaccau

SEQ ID NO: 3058348 - RNA, 12 nt, Mycobacterium bovis subsp bovis AF2122/97
cguuggcucgag

SEQ ID NO: 3058349 - RNA, 18 nt, Mycobacterium bovis subsp bovis AF2122/97
cguuggcucgagccgccc

SEQ ID NO: 3058350 - RNA, 19 nt, Mycobacterium bovis subsp bovis AF2122/97
cguuggcucgagccgcccg

SEQ ID NO: 3058351 - RNA, 21 nt, Mycobacterium bovis subsp bovis AF2122/97
cguuggcuucuucggucaccu

SEQ ID NO: 3058352 - RNA, 14 nt, Mycobacterium bovis subsp bovis AF2122/97
cguugggaaacauc

SEQ ID NO: 3058353 - RNA, 16 nt, Mycobacterium bovis subsp bovis AF2122/97
cguugggaaugucgaa

SEQ ID NO: 3058354 - RNA, 16 nt, Mycobacterium bovis subsp bovis AF2122/97
cguugggaccagugcg

SEQ ID NO: 3058355 - RNA, 21 nt, Mycobacterium bovis subsp bovis AF2122/97
cuaacuggacuggggcgccac

SEQ ID NO: 3058356 - RNA, 22 nt, Mycobacterium bovis subsp bovis AF2122/97
cuaaguccccgcuuggcgagcc

SEQ ID NO: 3058357 - RNA, 22 nt, Mycobacterium bovis subsp bovis AF2122/97
cuaaugugaccaacccggcucg

SEQ ID NO: 3058358 - RNA, 15 nt, Mycobacterium bovis subsp bovis AF2122/97
cuaauucgccucgcc

SEQ ID NO: 3058359 - RNA, 16 nt, Mycobacterium bovis subsp bovis AF2122/97
cuaauucggggccgcg

SEQ ID NO: 3058360 - RNA, 20 nt, Mycobacterium bovis subsp bovis AF2122/97
cuacacaggaagcguugucg

SEQ ID NO: 3058361 - RNA, 20 nt, Mycobacterium bovis subsp bovis AF2122/97
cuacacccguagaccuucga

SEQ ID NO: 3058362 - RNA, 18 nt, Mycobacterium bovis subsp bovis AF2122/97
cuacaggguuggcagcca

SEQ ID NO: 3058363 - RNA, 18 nt, Mycobacterium bovis subsp bovis AF2122/97
cuacaucgaucagaugcg

SEQ ID NO: 3058364 - RNA, 14 nt, Mycobacterium bovis subsp bovis AF2122/97
cuacaucggcggcg

SEQ ID NO: 3058365 - RNA, 19 nt, Mycobacterium bovis subsp bovis AF2122/97
cuacaucgucgagcgcggu

SEQ ID NO: 3058366 - RNA, 20 nt, Mycobacterium bovis subsp bovis AF2122/97
cuacaucgucgagcgcggug

SEQ ID NO: 3058367 - RNA, 22 nt, Mycobacterium bovis subsp bovis AF2122/97
cuacaugggggcguuggcgggc

SEQ ID NO: 3058368 - RNA, 18 nt, Mycobacterium bovis subsp bovis AF2122/97
cuaccaaaucgacacccu

SEQ ID NO: 3058369 - RNA, 17 nt, Mycobacterium bovis subsp bovis AF2122/97
cuaccaacaccgcccgc

SEQ ID NO: 3058370 - RNA, 20 nt, Mycobacterium bovis subsp bovis AF2122/97
cuaccaaccgguacuccugg

SEQ ID NO: 3058371 - RNA, 21 nt, Mycobacterium bovis subsp bovis AF2122/97
cuaccaacgcaacacgggcgc

SEQ ID NO: 3058372 - RNA, 22 nt, Mycobacterium bovis subsp bovis AF2122/97
cuaccacggaggguugccgccg

SEQ ID NO: 3058373 - RNA, 22 nt, Mycobacterium bovis subsp bovis AF2122/97
cuaccagccauagugcggcagc

SEQ ID NO: 3058374 - RNA, 12 nt, Mycobacterium bovis subsp bovis AF2122/97
cuaccagcucac

SEQ ID NO: 3058375 - RNA, 15 nt, Mycobacterium bovis subsp bovis AF2122/97
cuaccagcugggcga

SEQ ID NO: 3058376 - RNA, 13 nt, Mycobacterium bovis subsp bovis AF2122/97
cuaccaggcgcgg

SEQ ID NO: 3058377 - RNA, 16 nt, Mycobacterium bovis subsp bovis AF2122/97
cuaccaggcgcggccc

SEQ ID NO: 3058378 - RNA, 21 nt, Mycobacterium bovis subsp bovis AF2122/97
cuaccccagggagugccgcac

SEQ ID NO: 3058379 - RNA, 14 nt, Mycobacterium bovis subsp bovis AF2122/97
cuaccccggugaca

SEQ ID NO: 3058380 - RNA, 12 nt, Mycobacterium bovis subsp bovis AF2122/97
cuacccgggcca

SEQ ID NO: 3058381 - RNA, 13 nt, Mycobacterium bovis subsp bovis AF2122/97
cuacccgggccag

SEQ ID NO: 3058382 - RNA, 17 nt, Mycobacterium bovis subsp bovis AF2122/97
cuacccggucgccgguc

SEQ ID NO: 3058383 - RNA, 23 nt, Mycobacterium bovis subsp bovis AF2122/97
cuaccgaacaguaggccuccgcu

SEQ ID NO: 3058384 - RNA, 16 nt, Mycobacterium bovis subsp bovis AF2122/97
cuaccgagacgcccca

SEQ ID NO: 3058385 - RNA, 17 nt, Mycobacterium bovis subsp bovis AF2122/97
cuaccgagaucaccgcc

SEQ ID NO: 3058386 - RNA, 18 nt, Mycobacterium bovis subsp bovis AF2122/97
cuaccgagaucaccgcca

SEQ ID NO: 3058387 - RNA, 19 nt, Mycobacterium bovis subsp bovis AF2122/97
cuaccgagaucaccgccac

SEQ ID NO: 3058388 - RNA, 21 nt, Mycobacterium bovis subsp bovis AF2122/97
cuaccgagaucaccgccacca

SEQ ID NO: 3058389 - RNA, 22 nt, Mycobacterium bovis subsp bovis AF2122/97
cuaccgagaucaccgccaccac

SEQ ID NO: 3058390 - RNA, 15 nt, Mycobacterium bovis subsp bovis AF2122/97
cuaccgaucgccaag

SEQ ID NO: 3058391 - RNA, 15 nt, Mycobacterium bovis subsp bovis AF2122/97
cuaccgcccgcgcca

SEQ ID NO: 3058392 - RNA, 17 nt, Mycobacterium bovis subsp bovis AF2122/97
cuaccgcccgcgccacc

SEQ ID NO: 3058393 - RNA, 21 nt, Mycobacterium bovis subsp bovis AF2122/97
cuaccgccggcggcggccgca

SEQ ID NO: 3058394 - RNA, 22 nt, Mycobacterium bovis subsp bovis AF2122/97
cuaccgccggcggcggccgcag

SEQ ID NO: 3058395 - RNA, 23 nt, Mycobacterium bovis subsp bovis AF2122/97
cuaccgccggcggcggccgcagc

SEQ ID NO: 3058396 - RNA, 15 nt, Mycobacterium bovis subsp bovis AF2122/97
cuaccgccuugucgg

SEQ ID NO: 3058397 - RNA, 20 nt, Mycobacterium bovis subsp bovis AF2122/97
cuaccgccuugucggcgaug

SEQ ID NO: 3058398 - RNA, 17 nt, Mycobacterium bovis subsp bovis AF2122/97
cuaccgccuuugcccgc

SEQ ID NO: 3058399 - RNA, 19 nt, Mycobacterium bovis subsp bovis AF2122/97
cuaccgccuuugcccgccg

SEQ ID NO: 3058400 - RNA, 21 nt, Mycobacterium bovis subsp bovis AF2122/97
cuaccgcuucccccgguccgg

SEQ ID NO: 3058401 - RNA, 15 nt, Mycobacterium bovis subsp bovis AF2122/97
cuaccggccuuucca

SEQ ID NO: 3058402 - RNA, 17 nt, Mycobacterium bovis subsp bovis AF2122/97
cuaccggccuuuccagc

SEQ ID NO: 3058403 - RNA, 18 nt, Mycobacterium bovis subsp bovis AF2122/97
cuaccggccuuuccagca

SEQ ID NO: 3058404 - RNA, 20 nt, Mycobacterium bovis subsp bovis AF2122/97
cuaccggccuuuccagcacc

SEQ ID NO: 3058405 - RNA, 23 nt, Mycobacterium bovis subsp bovis AF2122/97
cuaccggccuuuccagcaccccg

SEQ ID NO: 3058406 - RNA, 16 nt, Mycobacterium bovis subsp bovis AF2122/97
cuaccggcgccgcgcg

SEQ ID NO: 3058407 - RNA, 17 nt, Mycobacterium bovis subsp bovis AF2122/97
cuaccggcgccgcgcgg

SEQ ID NO: 3058408 - RNA, 14 nt, Mycobacterium bovis subsp bovis AF2122/97
cuaccgggcccgcg

SEQ ID NO: 3058409 - RNA, 20 nt, Mycobacterium bovis subsp bovis AF2122/97
cuaccgguccgucaccaccg

SEQ ID NO: 3058410 - RNA, 17 nt, Mycobacterium bovis subsp bovis AF2122/97
cuaccggugguagcggc

SEQ ID NO: 3058411 - RNA, 20 nt, Mycobacterium bovis subsp bovis AF2122/97
cuaccggugguagcggcggu

SEQ ID NO: 3058412 - RNA, 19 nt, Mycobacterium bovis subsp bovis AF2122/97
cuaccgucaguagccacgc

SEQ ID NO: 3058413 - RNA, 14 nt, Mycobacterium bovis subsp bovis AF2122/97
cuaccgugcuggca

SEQ ID NO: 3058414 - RNA, 17 nt, Mycobacterium bovis subsp bovis AF2122/97
cuaccgugcuggcacca

SEQ ID NO: 3058415 - RNA, 15 nt, Mycobacterium bovis subsp bovis AF2122/97
cuaccuaacccgcgc

SEQ ID NO: 3058416 - RNA, 22 nt, Mycobacterium bovis subsp bovis AF2122/97
cuaccuaacccgcgccggccgc

SEQ ID NO: 3058417 - RNA, 14 nt, Mycobacterium bovis subsp bovis AF2122/97
cuaccuccgccacc

SEQ ID NO: 3058418 - RNA, 16 nt, Mycobacterium bovis subsp bovis AF2122/97
cuaccugcacccaggc

SEQ ID NO: 3058419 - RNA, 22 nt, Mycobacterium bovis subsp bovis AF2122/97
cuaccuuagcgccguugccgcc

SEQ ID NO: 3058420 - RNA, 12 nt, Mycobacterium bovis subsp bovis AF2122/97
cuaccuucuugg

SEQ ID NO: 3058421 - RNA, 21 nt, Mycobacterium bovis subsp bovis AF2122/97
cuacgaaggccuauucagcua

SEQ ID NO: 3058422 - RNA, 14 nt, Mycobacterium bovis subsp bovis AF2122/97
cuacgaccguuggg

SEQ ID NO: 3058423 - RNA, 13 nt, Mycobacterium bovis subsp bovis AF2122/97
cuacgacggcgcc

SEQ ID NO: 3058424 - RNA, 14 nt, Mycobacterium bovis subsp bovis AF2122/97
cuacgacggcgcca

SEQ ID NO: 3058425 - RNA, 20 nt, Mycobacterium bovis subsp bovis AF2122/97
cuacgacggcgccauuggcg

SEQ ID NO: 3058426 - RNA, 19 nt, Mycobacterium bovis subsp bovis AF2122/97
cuacgacgguccguucgcg

SEQ ID NO: 3058427 - RNA, 22 nt, Mycobacterium bovis subsp bovis AF2122/97
cuacgacgguccguucgcgccg

SEQ ID NO: 3058428 - RNA, 15 nt, Mycobacterium bovis subsp bovis AF2122/97
cuacgcagcgcggcu

SEQ ID NO: 3058429 - RNA, 14 nt, Mycobacterium bovis subsp bovis AF2122/97
cuacgccccacugc

SEQ ID NO: 3058430 - RNA, 15 nt, Mycobacterium bovis subsp bovis AF2122/97
cuacgccccacugcc

SEQ ID NO: 3058431 - RNA, 16 nt, Mycobacterium bovis subsp bovis AF2122/97
cuacgccccacugccg

SEQ ID NO: 3058432 - RNA, 19 nt, Mycobacterium bovis subsp bovis AF2122/97
cuacgcgaucagcugggca

SEQ ID NO: 3058433 - RNA, 15 nt, Mycobacterium bovis subsp bovis AF2122/97
cuacgcgcgcucgcu

SEQ ID NO: 3058434 - RNA, 17 nt, Mycobacterium bovis subsp bovis AF2122/97
cuacgcgcgcucgcuca

SEQ ID NO: 3058435 - RNA, 23 nt, Mycobacterium bovis subsp bovis AF2122/97
cuacgcggccgaggucacccggu

SEQ ID NO: 3058436 - RNA, 20 nt, Mycobacterium bovis subsp bovis AF2122/97
cuacggcgacacgccagccg

SEQ ID NO: 3058437 - RNA, 22 nt, Mycobacterium bovis subsp bovis AF2122/97
cuacggggaucuauuggaugcg

SEQ ID NO: 3058438 - RNA, 15 nt, Mycobacterium bovis subsp bovis AF2122/97
cuacggugcccugca

SEQ ID NO: 3058439 - RNA, 22 nt, Mycobacterium bovis subsp bovis AF2122/97
cuacggugcccugcauaggcgc

SEQ ID NO: 3058440 - RNA, 21 nt, Mycobacterium bovis subsp bovis AF2122/97
cuacgucggcucgucgcucga

SEQ ID NO: 3058441 - RNA, 16 nt, Mycobacterium bovis subsp bovis AF2122/97
cuaguccggcacugcg

SEQ ID NO: 3058442 - RNA, 17 nt, Mycobacterium bovis subsp bovis AF2122/97
cuaguccggcacugcgg

SEQ ID NO: 3058443 - RNA, 15 nt, Mycobacterium bovis subsp bovis AF2122/97
cuagugugaccguca

SEQ ID NO: 3058444 - RNA, 16 nt, Mycobacterium bovis subsp bovis AF2122/97
cuaguucgagcugcca

SEQ ID NO: 3058445 - RNA, 22 nt, Mycobacterium bovis subsp bovis AF2122/97
cuaguucgagcugccaggcccg

SEQ ID NO: 3058446 - RNA, 16 nt, Mycobacterium bovis subsp bovis AF2122/97
cuaguugacgcagccc

SEQ ID NO: 3058447 - RNA, 22 nt, Mycobacterium bovis subsp bovis AF2122/97
cuaguugcaacggguacacccg

SEQ ID NO: 3058448 - RNA, 17 nt, Mycobacterium bovis subsp bovis AF2122/97
cuaguugccaacacauu

SEQ ID NO: 3058449 - RNA, 21 nt, Mycobacterium bovis subsp bovis AF2122/97
cuaucagacgauucggcggcc

SEQ ID NO: 3058450 - RNA, 17 nt, Mycobacterium bovis subsp bovis AF2122/97
cuaucagugagccgcca

SEQ ID NO: 3058451 - RNA, 21 nt, Mycobacterium bovis subsp bovis AF2122/97
cuaucccaggggcaccgagcu

SEQ ID NO: 3058452 - RNA, 17 nt, Mycobacterium bovis subsp bovis AF2122/97
cuauccuugguuagccg

SEQ ID NO: 3058453 - RNA, 22 nt, Mycobacterium bovis subsp bovis AF2122/97
cuauccuugguuagccgcggcc

SEQ ID NO: 3058454 - RNA, 14 nt, Mycobacterium bovis subsp bovis AF2122/97
cuaucgacaacaug

SEQ ID NO: 3058455 - RNA, 16 nt, Mycobacterium bovis subsp bovis AF2122/97
cuaucggcgaacccgc

SEQ ID NO: 3058456 - RNA, 18 nt, Mycobacterium bovis subsp bovis AF2122/97
cuaucgggaagccgccgg

SEQ ID NO: 3058457 - RNA, 16 nt, Mycobacterium bovis subsp bovis AF2122/97
cuaucguugugcggac

SEQ ID NO: 3058458 - RNA, 22 nt, Mycobacterium bovis subsp bovis AF2122/97
cuaugccaacgacaggcgccca

SEQ ID NO: 3058459 - RNA, 15 nt, Mycobacterium bovis subsp bovis AF2122/97
cuaugcuggcagcuc

SEQ ID NO: 3058460 - RNA, 18 nt, Mycobacterium bovis subsp bovis AF2122/97
cuaugcuggcgcagcgcc

SEQ ID NO: 3058461 - RNA, 14 nt, Mycobacterium bovis subsp bovis AF2122/97
cuauggcccgggcc

SEQ ID NO: 3058462 - RNA, 15 nt, Mycobacterium bovis subsp bovis AF2122/97
cuauggcccgggccg

SEQ ID NO: 3058463 - RNA, 17 nt, Mycobacterium bovis subsp bovis AF2122/97
cuauggcgccgcggcug

SEQ ID NO: 3058464 - RNA, 20 nt, Mycobacterium bovis subsp bovis AF2122/97
cuaugggucguugucggggu

SEQ ID NO: 3058465 - RNA, 22 nt, Mycobacterium bovis subsp bovis AF2122/97
cuauggguucgcgguuguccuc

SEQ ID NO: 3058466 - RNA, 14 nt, Mycobacterium bovis subsp bovis AF2122/97
cuauggucaaccgc

SEQ ID NO: 3058467 - RNA, 16 nt, Mycobacterium bovis subsp bovis AF2122/97
cuauggucaaccgcgc

SEQ ID NO: 3058468 - RNA, 17 nt, Mycobacterium bovis subsp bovis AF2122/97
cuauggucaaccgcgcc

SEQ ID NO: 3058469 - RNA, 16 nt, Mycobacterium bovis subsp bovis AF2122/97
cuauuccgcggcacgc

SEQ ID NO: 3058470 - RNA, 15 nt, Mycobacterium bovis subsp bovis AF2122/97
cuauucgccagcgcc

SEQ ID NO: 3058471 - RNA, 19 nt, Mycobacterium bovis subsp bovis AF2122/97
cuauugcuauuccgcggca

SEQ ID NO: 3058472 - RNA, 20 nt, Mycobacterium bovis subsp bovis AF2122/97
cuauuggucgcucgcgguca

SEQ ID NO: 3058473 - RNA, 18 nt, Mycobacterium bovis subsp bovis AF2122/97
cuauuugccugccgcgca

SEQ ID NO: 3058474 - RNA, 17 nt, Mycobacterium bovis subsp bovis AF2122/97
cucaacaaucggugguc

SEQ ID NO: 3058475 - RNA, 12 nt, Mycobacterium bovis subsp bovis AF2122/97
cucaacaccagg

SEQ ID NO: 3058476 - RNA, 14 nt, Mycobacterium bovis subsp bovis AF2122/97
cucaacacccggcc

SEQ ID NO: 3058477 - RNA, 13 nt, Mycobacterium bovis subsp bovis AF2122/97
cucaaccagcaga

SEQ ID NO: 3058478 - RNA, 20 nt, Mycobacterium bovis subsp bovis AF2122/97
cucaaccagcagacgccgua

SEQ ID NO: 3058479 - RNA, 18 nt, Mycobacterium bovis subsp bovis AF2122/97
cucaacgacaccauaggc

SEQ ID NO: 3058480 - RNA, 16 nt, Mycobacterium bovis subsp bovis AF2122/97
cucaacgaucgcgccg

SEQ ID NO: 3058481 - RNA, 20 nt, Mycobacterium bovis subsp bovis AF2122/97
cucaacgaucgcgccgucgu

SEQ ID NO: 3058482 - RNA, 22 nt, Mycobacterium bovis subsp bovis AF2122/97
cucaacggcgacaucggcccga

SEQ ID NO: 3058483 - RNA, 20 nt, Mycobacterium bovis subsp bovis AF2122/97
cucaacgggaccgaucuugg

SEQ ID NO: 3058484 - RNA, 20 nt, Mycobacterium bovis subsp bovis AF2122/97
cucaagcaauggugcggucu

SEQ ID NO: 3058485 - RNA, 22 nt, Mycobacterium bovis subsp bovis AF2122/97
cucaagcaauggugcggucugg

SEQ ID NO: 3058486 - RNA, 18 nt, Mycobacterium bovis subsp bovis AF2122/97
cucaagcgcgucgucacg

SEQ ID NO: 3058487 - RNA, 19 nt, Mycobacterium bovis subsp bovis AF2122/97
cucaagcgcgucgucacga

SEQ ID NO: 3058488 - RNA, 19 nt, Mycobacterium bovis subsp bovis AF2122/97
cucaaggacgcaccgccag

SEQ ID NO: 3058489 - RNA, 13 nt, Mycobacterium bovis subsp bovis AF2122/97
cucaaggcuucgg

SEQ ID NO: 3058490 - RNA, 18 nt, Mycobacterium bovis subsp bovis AF2122/97
cucaaggcuucggcggcc

SEQ ID NO: 3058491 - RNA, 19 nt, Mycobacterium bovis subsp bovis AF2122/97
cucaagggacacccgcuuu

SEQ ID NO: 3058492 - RNA, 13 nt, Mycobacterium bovis subsp bovis AF2122/97
cucaagucucccg

SEQ ID NO: 3058493 - RNA, 13 nt, Mycobacterium bovis subsp bovis AF2122/97
cucaauuccaugc

SEQ ID NO: 3058494 - RNA, 16 nt, Mycobacterium bovis subsp bovis AF2122/97
cucaauuggcucggcg

SEQ ID NO: 3058495 - RNA, 12 nt, Mycobacterium bovis subsp bovis AF2122/97
cucacacuggcu

SEQ ID NO: 3058496 - RNA, 22 nt, Mycobacterium bovis subsp bovis AF2122/97
cucacauaagcgaggaucucgg

SEQ ID NO: 3058497 - RNA, 16 nt, Mycobacterium bovis subsp bovis AF2122/97
cucacauccugguuga

SEQ ID NO: 3058498 - RNA, 15 nt, Mycobacterium bovis subsp bovis AF2122/97
cucacaugcccggac

SEQ ID NO: 3058499 - RNA, 17 nt, Mycobacterium bovis subsp bovis AF2122/97
cucacaugcccggacga

SEQ ID NO: 3058500 - RNA, 17 nt, Mycobacterium bovis subsp bovis AF2122/97
cucaccaaggucggcga

SEQ ID NO: 3058501 - RNA, 20 nt, Mycobacterium bovis subsp bovis AF2122/97
cucaccaaucugcgggccgg

SEQ ID NO: 3058502 - RNA, 21 nt, Mycobacterium bovis subsp bovis AF2122/97
cucaccaaucugcgggccggu

SEQ ID NO: 3058503 - RNA, 18 nt, Mycobacterium bovis subsp bovis AF2122/97
cucaccacccgcacucca

SEQ ID NO: 3058504 - RNA, 14 nt, Mycobacterium bovis subsp bovis AF2122/97
cucaccaccgaccu

SEQ ID NO: 3058505 - RNA, 22 nt, Mycobacterium bovis subsp bovis AF2122/97
cucaccacgaggcuugcggcac

SEQ ID NO: 3058506 - RNA, 13 nt, Mycobacterium bovis subsp bovis AF2122/97
cucaccacgucga

SEQ ID NO: 3058507 - RNA, 18 nt, Mycobacterium bovis subsp bovis AF2122/97
cucaccacgucgaccgaa

SEQ ID NO: 3058508 - RNA, 13 nt, Mycobacterium bovis subsp bovis AF2122/97
cucaccagcuccu

SEQ ID NO: 3058509 - RNA, 12 nt, Mycobacterium bovis subsp bovis AF2122/97
cucaccaggcga

SEQ ID NO: 3058510 - RNA, 23 nt, Mycobacterium bovis subsp bovis AF2122/97
cucaccaggcgagccggcgcgca

SEQ ID NO: 3058511 - RNA, 13 nt, Mycobacterium bovis subsp bovis AF2122/97
cucacccacauga

SEQ ID NO: 3058512 - RNA, 18 nt, Mycobacterium bovis subsp bovis AF2122/97
cucacccacccgcaccgc

SEQ ID NO: 3058513 - RNA, 14 nt, Mycobacterium bovis subsp bovis AF2122/97
cucacccagcucgc

SEQ ID NO: 3058514 - RNA, 20 nt, Mycobacterium bovis subsp bovis AF2122/97
cucacccagcucgcgcaccc

SEQ ID NO: 3058515 - RNA, 20 nt, Mycobacterium bovis subsp bovis AF2122/97
cucaccccaacagggcggca

SEQ ID NO: 3058516 - RNA, 14 nt, Mycobacterium bovis subsp bovis AF2122/97
cucaccccggucga

SEQ ID NO: 3058517 - RNA, 13 nt, Mycobacterium bovis subsp bovis AF2122/97
cucacccgagcca

SEQ ID NO: 3058518 - RNA, 14 nt, Mycobacterium bovis subsp bovis AF2122/97
cucacccgcccgga

SEQ ID NO: 3058519 - RNA, 16 nt, Mycobacterium bovis subsp bovis AF2122/97
cucacccgggcagccu

SEQ ID NO: 3058520 - RNA, 17 nt, Mycobacterium bovis subsp bovis AF2122/97
cucacccgggcagccug

SEQ ID NO: 3058521 - RNA, 15 nt, Mycobacterium bovis subsp bovis AF2122/97
cucacccggucgcac

SEQ ID NO: 3058522 - RNA, 23 nt, Mycobacterium bovis subsp bovis AF2122/97
cucaccgaacgcgaugcgccauu

SEQ ID NO: 3058523 - RNA, 19 nt, Mycobacterium bovis subsp bovis AF2122/97
cucaccgaucucgaccagc

SEQ ID NO: 3058524 - RNA, 22 nt, Mycobacterium bovis subsp bovis AF2122/97
cucaccgcacaccugcgcggcg

SEQ ID NO: 3058525 - RNA, 13 nt, Mycobacterium bovis subsp bovis AF2122/97
cucaccgccgcua

SEQ ID NO: 3058526 - RNA, 16 nt, Mycobacterium bovis subsp bovis AF2122/97
cucaccgccgcuaccg

SEQ ID NO: 3058527 - RNA, 17 nt, Mycobacterium bovis subsp bovis AF2122/97
cucaccgccgcuaccgc

SEQ ID NO: 3058528 - RNA, 15 nt, Mycobacterium bovis subsp bovis AF2122/97
cucaguucacguucg

SEQ ID NO: 3058529 - RNA, 17 nt, Mycobacterium bovis subsp bovis AF2122/97
cucaguucacguucggc

SEQ ID NO: 3058530 - RNA, 16 nt, Mycobacterium bovis subsp bovis AF2122/97
cucaguuuggcgggug

SEQ ID NO: 3058531 - RNA, 16 nt, Mycobacterium bovis subsp bovis AF2122/97
cucaguuuuccccugu

SEQ ID NO: 3058532 - RNA, 17 nt, Mycobacterium bovis subsp bovis AF2122/97
cucauagagcggcacca

SEQ ID NO: 3058533 - RNA, 15 nt, Mycobacterium bovis subsp bovis AF2122/97
cucauagcgacggcg

SEQ ID NO: 3058534 - RNA, 14 nt, Mycobacterium bovis subsp bovis AF2122/97
cucauaggccggcg

SEQ ID NO: 3058535 - RNA, 20 nt, Mycobacterium bovis subsp bovis AF2122/97
cucauaggccugcagccgau

SEQ ID NO: 3058536 - RNA, 16 nt, Mycobacterium bovis subsp bovis AF2122/97
cucauagugcaggucg

SEQ ID NO: 3058537 - RNA, 14 nt, Mycobacterium bovis subsp bovis AF2122/97
cucaucaccucucc

SEQ ID NO: 3058538 - RNA, 22 nt, Mycobacterium bovis subsp bovis AF2122/97
cucaucccgacccuucgggcug

SEQ ID NO: 3058539 - RNA, 15 nt, Mycobacterium bovis subsp bovis AF2122/97
cucauccgccgggcc

SEQ ID NO: 3058540 - RNA, 16 nt, Mycobacterium bovis subsp bovis AF2122/97
cucauccgccgggcca

SEQ ID NO: 3058541 - RNA, 17 nt, Mycobacterium bovis subsp bovis AF2122/97
cucauccuccugcgccg

SEQ ID NO: 3058542 - RNA, 15 nt, Mycobacterium bovis subsp bovis AF2122/97
cucaucgaccgcggc

SEQ ID NO: 3058543 - RNA, 21 nt, Mycobacterium bovis subsp bovis AF2122/97
cucaucgauccucgcccgcac

SEQ ID NO: 3058544 - RNA, 13 nt, Mycobacterium bovis subsp bovis AF2122/97
cucaucgccgcua

SEQ ID NO: 3058545 - RNA, 12 nt, Mycobacterium bovis subsp bovis AF2122/97
cucaucgcggcg

SEQ ID NO: 3058546 - RNA, 14 nt, Mycobacterium bovis subsp bovis AF2122/97
cucaucgcggcgaa

SEQ ID NO: 3058547 - RNA, 14 nt, Mycobacterium bovis subsp bovis AF2122/97
cucaucgcggucgc

SEQ ID NO: 3058548 - RNA, 16 nt, Mycobacterium bovis subsp bovis AF2122/97
cucaucgcggucgcca

SEQ ID NO: 3058549 - RNA, 18 nt, Mycobacterium bovis subsp bovis AF2122/97
cucaucgcggucgccacc

SEQ ID NO: 3058550 - RNA, 21 nt, Mycobacterium bovis subsp bovis AF2122/97
cucaucggacagcgccuggcc

SEQ ID NO: 3058551 - RNA, 18 nt, Mycobacterium bovis subsp bovis AF2122/97
cucaucggcaaacuccug

SEQ ID NO: 3058552 - RNA, 19 nt, Mycobacterium bovis subsp bovis AF2122/97
cucaucguggggaucgacc

SEQ ID NO: 3058553 - RNA, 19 nt, Mycobacterium bovis subsp bovis AF2122/97
cucaucguuccacgagucg

SEQ ID NO: 3058554 - RNA, 14 nt, Mycobacterium bovis subsp bovis AF2122/97
cucaucuguaaccu

SEQ ID NO: 3058555 - RNA, 14 nt, Mycobacterium bovis subsp bovis AF2122/97
cucaucuucgguca

SEQ ID NO: 3058556 - RNA, 21 nt, Mycobacterium bovis subsp bovis AF2122/97
cucaucuuugacaccggucgg

SEQ ID NO: 3058557 - RNA, 24 nt, Mycobacterium bovis subsp bovis AF2122/97
cucaugaugccggacgccaugccc

SEQ ID NO: 3058558 - RNA, 15 nt, Mycobacterium bovis subsp bovis AF2122/97
cucaugcacccggua

SEQ ID NO: 3058559 - RNA, 15 nt, Mycobacterium bovis subsp bovis AF2122/97
cucaugcccgggaug

SEQ ID NO: 3058560 - RNA, 14 nt, Mycobacterium bovis subsp bovis AF2122/97
cucaugccgagcga

SEQ ID NO: 3058561 - RNA, 18 nt, Mycobacterium bovis subsp bovis AF2122/97
cucaugccgagcgaccgu

SEQ ID NO: 3058562 - RNA, 14 nt, Mycobacterium bovis subsp bovis AF2122/97
cucaugcgagucgu

SEQ ID NO: 3058563 - RNA, 18 nt, Mycobacterium bovis subsp bovis AF2122/97
cucaugcuaggccaccgg

SEQ ID NO: 3058564 - RNA, 14 nt, Mycobacterium bovis subsp bovis AF2122/97
cucaugggcgccau

SEQ ID NO: 3058565 - RNA, 16 nt, Mycobacterium bovis subsp bovis AF2122/97
cucauuaacgccaucu

SEQ ID NO: 3058566 - RNA, 17 nt, Mycobacterium bovis subsp bovis AF2122/97
cucauucgugcccgggc

SEQ ID NO: 3058567 - RNA, 20 nt, Mycobacterium bovis subsp bovis AF2122/97
cuccaaaagccucagccgcu

SEQ ID NO: 3058568 - RNA, 20 nt, Mycobacterium bovis subsp bovis AF2122/97
cuccaaaaucgcggccacac

SEQ ID NO: 3058569 - RNA, 22 nt, Mycobacterium bovis subsp bovis AF2122/97
cuccaaaucggcaucggcgacg

SEQ ID NO: 3058570 - RNA, 22 nt, Mycobacterium bovis subsp bovis AF2122/97
cuccaaauggugagcucgcgca

SEQ ID NO: 3058571 - RNA, 14 nt, Mycobacterium bovis subsp bovis AF2122/97
cuccaacaacucca

SEQ ID NO: 3058572 - RNA, 22 nt, Mycobacterium bovis subsp bovis AF2122/97
cuccaacaaugccagcuguugc

SEQ ID NO: 3058573 - RNA, 20 nt, Mycobacterium bovis subsp bovis AF2122/97
cuccaacagguaagccacau

SEQ ID NO: 3058574 - RNA, 13 nt, Mycobacterium bovis subsp bovis AF2122/97
cuccaagcaauuc

SEQ ID NO: 3058575 - RNA, 14 nt, Mycobacterium bovis subsp bovis AF2122/97
cuccaagcccgccg

SEQ ID NO: 3058576 - RNA, 15 nt, Mycobacterium bovis subsp bovis AF2122/97
cuccaaggcggucac

SEQ ID NO: 3058577 - RNA, 21 nt, Mycobacterium bovis subsp bovis AF2122/97
cuccaaggcggucaccaccgu

SEQ ID NO: 3058578 - RNA, 17 nt, Mycobacterium bovis subsp bovis AF2122/97
cuccaauugcggccgcg

SEQ ID NO: 3058579 - RNA, 13 nt, Mycobacterium bovis subsp bovis AF2122/97
cuccacagcggcc

SEQ ID NO: 3058580 - RNA, 14 nt, Mycobacterium bovis subsp bovis AF2122/97
cuccacagcggcca

SEQ ID NO: 3058581 - RNA, 18 nt, Mycobacterium bovis subsp bovis AF2122/97
cuccaccaccgucgagcc

SEQ ID NO: 3058582 - RNA, 17 nt, Mycobacterium bovis subsp bovis AF2122/97
cuccaccaggacguggu

SEQ ID NO: 3058583 - RNA, 15 nt, Mycobacterium bovis subsp bovis AF2122/97
cuccaccccacccag

SEQ ID NO: 3058584 - RNA, 19 nt, Mycobacterium bovis subsp bovis AF2122/97
cuccaccccacccagcgac

SEQ ID NO: 3058585 - RNA, 16 nt, Mycobacterium bovis subsp bovis AF2122/97
cuccaccccguuggcg

SEQ ID NO: 3058586 - RNA, 14 nt, Mycobacterium bovis subsp bovis AF2122/97
cuccacccgccacg

SEQ ID NO: 3058587 - RNA, 13 nt, Mycobacterium bovis subsp bovis AF2122/97
cuccacccgccgg

SEQ ID NO: 3058588 - RNA, 20 nt, Mycobacterium bovis subsp bovis AF2122/97
cuccaccgaaaaguccgccg

SEQ ID NO: 3058589 - RNA, 21 nt, Mycobacterium bovis subsp bovis AF2122/97
cuccaccgaaaaguccgccgc

SEQ ID NO: 3058590 - RNA, 13 nt, Mycobacterium bovis subsp bovis AF2122/97
cuccaccgccgcg

SEQ ID NO: 3058591 - RNA, 12 nt, Mycobacterium bovis subsp bovis AF2122/97
cuccaccgcgcc

SEQ ID NO: 3058592 - RNA, 19 nt, Mycobacterium bovis subsp bovis AF2122/97
cuccaccgcgccggcggca

SEQ ID NO: 3058593 - RNA, 19 nt, Mycobacterium bovis subsp bovis AF2122/97
cuccaccgcguccaggugc

SEQ ID NO: 3058594 - RNA, 20 nt, Mycobacterium bovis subsp bovis AF2122/97
cuccaccgcuggcccggcgc

SEQ ID NO: 3058595 - RNA, 13 nt, Mycobacterium bovis subsp bovis AF2122/97
cuccaccgggccc

SEQ ID NO: 3058596 - RNA, 18 nt, Mycobacterium bovis subsp bovis AF2122/97
cuccaccgggcccgccgg

SEQ ID NO: 3058597 - RNA, 11 nt, Mycobacterium bovis subsp bovis AF2122/97
cuccaccuucu

SEQ ID NO: 3058598 - RNA, 13 nt, Mycobacterium bovis subsp bovis AF2122/97
cuccaccuucugg

SEQ ID NO: 3058599 - RNA, 23 nt, Mycobacterium bovis subsp bovis AF2122/97
cuccaccuucugguccagcaccg

SEQ ID NO: 3058600 - RNA, 23 nt, Mycobacterium bovis subsp bovis AF2122/97
cuccacgagguugggccgguuga

SEQ ID NO: 3058601 - RNA, 19 nt, Mycobacterium bovis subsp bovis AF2122/97
cuccacgaucggcccagcc

SEQ ID NO: 3058602 - RNA, 20 nt, Mycobacterium bovis subsp bovis AF2122/97
cuccacgcagcccgucggcg

SEQ ID NO: 3058603 - RNA, 15 nt, Mycobacterium bovis subsp bovis AF2122/97
cuccacgcccuggcg

SEQ ID NO: 3058604 - RNA, 23 nt, Mycobacterium bovis subsp bovis AF2122/97
cuccacgcuggcgcccccgacga

SEQ ID NO: 3058605 - RNA, 12 nt, Mycobacterium bovis subsp bovis AF2122/97
cuccacggcggg

SEQ ID NO: 3058606 - RNA, 14 nt, Mycobacterium bovis subsp bovis AF2122/97
cuccacggucaggc

SEQ ID NO: 3058607 - RNA, 23 nt, Mycobacterium bovis subsp bovis AF2122/97
cuccacggucaggcguagguccu

SEQ ID NO: 3058608 - RNA, 19 nt, Mycobacterium bovis subsp bovis AF2122/97
cuccacgucaucuggcgcu

SEQ ID NO: 3058609 - RNA, 15 nt, Mycobacterium bovis subsp bovis AF2122/97
cuccacugaccaggu

SEQ ID NO: 3058610 - RNA, 16 nt, Mycobacterium bovis subsp bovis AF2122/97
cuccacuuggggcgcc

SEQ ID NO: 3058611 - RNA, 17 nt, Mycobacterium bovis subsp bovis AF2122/97
cuccacuuggggcgcca

SEQ ID NO: 3058612 - RNA, 20 nt, Mycobacterium bovis subsp bovis AF2122/97
cuccacuuggggcgccaggg

SEQ ID NO: 3058613 - RNA, 17 nt, Mycobacterium bovis subsp bovis AF2122/97
cuccacuuucugcgguc

SEQ ID NO: 3058614 - RNA, 18 nt, Mycobacterium bovis subsp bovis AF2122/97
cuccacuuuuccgccggc

SEQ ID NO: 3058615 - RNA, 16 nt, Mycobacterium bovis subsp bovis AF2122/97
cuccccgaccgcgccc

SEQ ID NO: 3058616 - RNA, 17 nt, Mycobacterium bovis subsp bovis AF2122/97
cuccccgaucagcaccg

SEQ ID NO: 3058617 - RNA, 19 nt, Mycobacterium bovis subsp bovis AF2122/97
cuccccgaucugcuccucg

SEQ ID NO: 3058618 - RNA, 13 nt, Mycobacterium bovis subsp bovis AF2122/97
cuccccgccggaa

SEQ ID NO: 3058619 - RNA, 14 nt, Mycobacterium bovis subsp bovis AF2122/97
cuccccgccgggca

SEQ ID NO: 3058620 - RNA, 20 nt, Mycobacterium bovis subsp bovis AF2122/97
cuccccgcuagcccaccacu

SEQ ID NO: 3058621 - RNA, 19 nt, Mycobacterium bovis subsp bovis AF2122/97
cuccccggcccgcucaacg

SEQ ID NO: 3058622 - RNA, 17 nt, Mycobacterium bovis subsp bovis AF2122/97
cuccccggucgccgcgu

SEQ ID NO: 3058623 - RNA, 15 nt, Mycobacterium bovis subsp bovis AF2122/97
cuccccguccugcca

SEQ ID NO: 3058624 - RNA, 16 nt, Mycobacterium bovis subsp bovis AF2122/97
cuccccguccugccag

SEQ ID NO: 3058625 - RNA, 22 nt, Mycobacterium bovis subsp bovis AF2122/97
cucccgaaaagcgccucggugg

SEQ ID NO: 3058626 - RNA, 15 nt, Mycobacterium bovis subsp bovis AF2122/97
cucccgaccgccgag

SEQ ID NO: 3058627 - RNA, 13 nt, Mycobacterium bovis subsp bovis AF2122/97
cucccgagccaca

SEQ ID NO: 3058628 - RNA, 15 nt, Mycobacterium bovis subsp bovis AF2122/97
cucccgagccacaaa

SEQ ID NO: 3058629 - RNA, 22 nt, Mycobacterium bovis subsp bovis AF2122/97
cucccgcaaugcgagcgcgccg

SEQ ID NO: 3058630 - RNA, 18 nt, Mycobacterium bovis subsp bovis AF2122/97
cucccgcaauucgcgguc

SEQ ID NO: 3058631 - RNA, 20 nt, Mycobacterium bovis subsp bovis AF2122/97
cucccgcacggccgggucga

SEQ ID NO: 3058632 - RNA, 13 nt, Mycobacterium bovis subsp bovis AF2122/97
cucccgcgccggc

SEQ ID NO: 3058633 - RNA, 14 nt, Mycobacterium bovis subsp bovis AF2122/97
cucccgcgcgggcg

SEQ ID NO: 3058634 - RNA, 15 nt, Mycobacterium bovis subsp bovis AF2122/97
cucccgcgcgggcgg

SEQ ID NO: 3058635 - RNA, 13 nt, Mycobacterium bovis subsp bovis AF2122/97
cucccgcggcacc

SEQ ID NO: 3058636 - RNA, 19 nt, Mycobacterium bovis subsp bovis AF2122/97
cucccggauauugccaucc

SEQ ID NO: 3058637 - RNA, 22 nt, Mycobacterium bovis subsp bovis AF2122/97
cucccggauauugccaucccuc

SEQ ID NO: 3058638 - RNA, 12 nt, Mycobacterium bovis subsp bovis AF2122/97
cucccggccgca

SEQ ID NO: 3058639 - RNA, 13 nt, Mycobacterium bovis subsp bovis AF2122/97
cucccggccgcac

SEQ ID NO: 3058640 - RNA, 14 nt, Mycobacterium bovis subsp bovis AF2122/97
cucccggccgcacc

SEQ ID NO: 3058641 - RNA, 13 nt, Mycobacterium bovis subsp bovis AF2122/97
cucccgggccgcc

SEQ ID NO: 3058642 - RNA, 14 nt, Mycobacterium bovis subsp bovis AF2122/97
cucccgggccgccg

SEQ ID NO: 3058643 - RNA, 18 nt, Mycobacterium bovis subsp bovis AF2122/97
cucccgggcgagccgugc

SEQ ID NO: 3058644 - RNA, 19 nt, Mycobacterium bovis subsp bovis AF2122/97
cucccgggcggcggccugg

SEQ ID NO: 3058645 - RNA, 22 nt, Mycobacterium bovis subsp bovis AF2122/97
cucccggggguuccacucccca

SEQ ID NO: 3058646 - RNA, 21 nt, Mycobacterium bovis subsp bovis AF2122/97
cucccgggugcgacgcgaccg

SEQ ID NO: 3058647 - RNA, 13 nt, Mycobacterium bovis subsp bovis AF2122/97
cucccguacgccg

SEQ ID NO: 3058648 - RNA, 22 nt, Mycobacterium bovis subsp bovis AF2122/97
cucccugcacccagccgugccc

SEQ ID NO: 3058649 - RNA, 14 nt, Mycobacterium bovis subsp bovis AF2122/97
cucccuuccgcgcu

SEQ ID NO: 3058650 - RNA, 14 nt, Mycobacterium bovis subsp bovis AF2122/97
cuccgaaaucguca

SEQ ID NO: 3058651 - RNA, 14 nt, Mycobacterium bovis subsp bovis AF2122/97
cuccgaaggccgcc

SEQ ID NO: 3058652 - RNA, 21 nt, Mycobacterium bovis subsp bovis AF2122/97
cuccgaaguccacgcaccacg

SEQ ID NO: 3058653 - RNA, 18 nt, Mycobacterium bovis subsp bovis AF2122/97
cuccgaaucugccggccg

SEQ ID NO: 3058654 - RNA, 19 nt, Mycobacterium bovis subsp bovis AF2122/97
cuccgaaucugccggccgg

SEQ ID NO: 3058655 - RNA, 13 nt, Mycobacterium bovis subsp bovis AF2122/97
cuccgacggcccg

SEQ ID NO: 3058656 - RNA, 14 nt, Mycobacterium bovis subsp bovis AF2122/97
cuccgacggccgcg

SEQ ID NO: 3058657 - RNA, 17 nt, Mycobacterium bovis subsp bovis AF2122/97
cuccgacggccgcggcg

SEQ ID NO: 3058658 - RNA, 21 nt, Mycobacterium bovis subsp bovis AF2122/97
cuccgagcacaggaucaccca

SEQ ID NO: 3058659 - RNA, 22 nt, Mycobacterium bovis subsp bovis AF2122/97
cuccgaggccgccaucgccgcc

SEQ ID NO: 3058660 - RNA, 14 nt, Mycobacterium bovis subsp bovis AF2122/97
cuccgaucgggccc

SEQ ID NO: 3058661 - RNA, 23 nt, Mycobacterium bovis subsp bovis AF2122/97
cuccgaugaccagggucugcuca

SEQ ID NO: 3058662 - RNA, 16 nt, Mycobacterium bovis subsp bovis AF2122/97
cuccgaugcaucggug

SEQ ID NO: 3058663 - RNA, 17 nt, Mycobacterium bovis subsp bovis AF2122/97
cuccgaugccgacggcg

SEQ ID NO: 3058664 - RNA, 24 nt, Mycobacterium bovis subsp bovis AF2122/97
cuccgaugugccgauuggccugcc

SEQ ID NO: 3058665 - RNA, 18 nt, Mycobacterium bovis subsp bovis AF2122/97
cuccgauuccgaacuggu

SEQ ID NO: 3058666 - RNA, 22 nt, Mycobacterium bovis subsp bovis AF2122/97
cuccgcagcgaagaccagcggc

SEQ ID NO: 3058667 - RNA, 21 nt, Mycobacterium bovis subsp bovis AF2122/97
cuccgcagcuauuucgcgacg

SEQ ID NO: 3058668 - RNA, 23 nt, Mycobacterium bovis subsp bovis AF2122/97
cuccgccaacaacuucucgucga

SEQ ID NO: 3058669 - RNA, 23 nt, Mycobacterium bovis subsp bovis AF2122/97
cuccgccaacaucuccgcgucgg

SEQ ID NO: 3058670 - RNA, 13 nt, Mycobacterium bovis subsp bovis AF2122/97
cuccgccaaccgg

SEQ ID NO: 3058671 - RNA, 14 nt, Mycobacterium bovis subsp bovis AF2122/97
cuccgccaaccggg

SEQ ID NO: 3058672 - RNA, 17 nt, Mycobacterium bovis subsp bovis AF2122/97
cuccgccaacucgucca

SEQ ID NO: 3058673 - RNA, 13 nt, Mycobacterium bovis subsp bovis AF2122/97
cuccgccaccauc

SEQ ID NO: 3058674 - RNA, 23 nt, Mycobacterium bovis subsp bovis AF2122/97
cuccgcccucaguucacguucgg

SEQ ID NO: 3058675 - RNA, 21 nt, Mycobacterium bovis subsp bovis AF2122/97
cuccgccgagcagacgcagaa

SEQ ID NO: 3058676 - RNA, 13 nt, Mycobacterium bovis subsp bovis AF2122/97
cuccgccgcccag

SEQ ID NO: 3058677 - RNA, 13 nt, Mycobacterium bovis subsp bovis AF2122/97
cuccgccgccgac

SEQ ID NO: 3058678 - RNA, 14 nt, Mycobacterium bovis subsp bovis AF2122/97
cuccgccgccgacg

SEQ ID NO: 3058679 - RNA, 21 nt, Mycobacterium bovis subsp bovis AF2122/97
cuccgccgcgaucuccuuggc

SEQ ID NO: 3058680 - RNA, 22 nt, Mycobacterium bovis subsp bovis AF2122/97
cuccgccgcgggcuccccggca

SEQ ID NO: 3058681 - RNA, 22 nt, Mycobacterium bovis subsp bovis AF2122/97
cuccgccggguuggcgccggcc

SEQ ID NO: 3058682 - RNA, 23 nt, Mycobacterium bovis subsp bovis AF2122/97
cuccgccggguuggcgccggcca

SEQ ID NO: 3058683 - RNA, 24 nt, Mycobacterium bovis subsp bovis AF2122/97
cuccgccggguuggcgccggccag

SEQ ID NO: 3058684 - RNA, 10 nt, Mycobacterium bovis subsp bovis AF2122/97
cuccgccguc

SEQ ID NO: 3058685 - RNA, 16 nt, Mycobacterium bovis subsp bovis AF2122/97
cuccgccgucgccacc

SEQ ID NO: 3058686 - RNA, 16 nt, Mycobacterium bovis subsp bovis AF2122/97
cuccgccgucgccgcc

SEQ ID NO: 3058687 - RNA, 20 nt, Mycobacterium bovis subsp bovis AF2122/97
cuccgccgucgccgccggcg

SEQ ID NO: 3058688 - RNA, 17 nt, Mycobacterium bovis subsp bovis AF2122/97
cuccgccguugacgccg

SEQ ID NO: 3058689 - RNA, 19 nt, Mycobacterium bovis subsp bovis AF2122/97
cuccgccguugacgccguu

SEQ ID NO: 3058690 - RNA, 14 nt, Mycobacterium bovis subsp bovis AF2122/97
cuccgccguugccg

SEQ ID NO: 3058691 - RNA, 18 nt, Mycobacterium bovis subsp bovis AF2122/97
cuccgccguugccgccgc

SEQ ID NO: 3058692 - RNA, 19 nt, Mycobacterium bovis subsp bovis AF2122/97
cuccgccguugccgccgcc

SEQ ID NO: 3058693 - RNA, 13 nt, Mycobacterium bovis subsp bovis AF2122/97
cuccgccugcccc

SEQ ID NO: 3058694 - RNA, 23 nt, Mycobacterium bovis subsp bovis AF2122/97
cuccgccugccccacccgcggcg

SEQ ID NO: 3058695 - RNA, 14 nt, Mycobacterium bovis subsp bovis AF2122/97
cuccgccugccgcu

SEQ ID NO: 3058696 - RNA, 23 nt, Mycobacterium bovis subsp bovis AF2122/97
cuccgccugccgcuggucgucga

SEQ ID NO: 3058697 - RNA, 18 nt, Mycobacterium bovis subsp bovis AF2122/97
cuccgcgagcccggccuc

SEQ ID NO: 3058698 - RNA, 23 nt, Mycobacterium bovis subsp bovis AF2122/97
cuccgcgagcccggccucggcga

SEQ ID NO: 3058699 - RNA, 16 nt, Mycobacterium bovis subsp bovis AF2122/97
cuccgcgccgaucagc

SEQ ID NO: 3058700 - RNA, 15 nt, Mycobacterium bovis subsp bovis AF2122/97
cuccgcgccgccccg

SEQ ID NO: 3058701 - RNA, 20 nt, Mycobacterium bovis subsp bovis AF2122/97
cuccgguggccaacaccgcc

SEQ ID NO: 3058702 - RNA, 21 nt, Mycobacterium bovis subsp bovis AF2122/97
cuccgguggccaacaccgcca

SEQ ID NO: 3058703 - RNA, 17 nt, Mycobacterium bovis subsp bovis AF2122/97
cuccggugugaucggcg

SEQ ID NO: 3058704 - RNA, 22 nt, Mycobacterium bovis subsp bovis AF2122/97
cuccguaaacgaggucgccgca

SEQ ID NO: 3058705 - RNA, 17 nt, Mycobacterium bovis subsp bovis AF2122/97
cuccguaacgccaagcu

SEQ ID NO: 3058706 - RNA, 22 nt, Mycobacterium bovis subsp bovis AF2122/97
cuccguaacgccaagcucggcc

SEQ ID NO: 3058707 - RNA, 13 nt, Mycobacterium bovis subsp bovis AF2122/97
cuccgucagcgcc

SEQ ID NO: 3058708 - RNA, 14 nt, Mycobacterium bovis subsp bovis AF2122/97
cuccgucagcgccg

SEQ ID NO: 3058709 - RNA, 18 nt, Mycobacterium bovis subsp bovis AF2122/97
cuccguccccgcagcgcc

SEQ ID NO: 3058710 - RNA, 14 nt, Mycobacterium bovis subsp bovis AF2122/97
cuccgucggccagg

SEQ ID NO: 3058711 - RNA, 16 nt, Mycobacterium bovis subsp bovis AF2122/97
cuccgucggccaggcc

SEQ ID NO: 3058712 - RNA, 14 nt, Mycobacterium bovis subsp bovis AF2122/97
cuccgucguaguug

SEQ ID NO: 3058713 - RNA, 17 nt, Mycobacterium bovis subsp bovis AF2122/97
cuccgugagccggaccg

SEQ ID NO: 3058714 - RNA, 16 nt, Mycobacterium bovis subsp bovis AF2122/97
cuccgugaucgaggcg

SEQ ID NO: 3058715 - RNA, 23 nt, Mycobacterium bovis subsp bovis AF2122/97
cuccgugcuuccauucgcggucc

SEQ ID NO: 3058716 - RNA, 19 nt, Mycobacterium bovis subsp bovis AF2122/97
cuccguggugcuagcgccg

SEQ ID NO: 3058717 - RNA, 21 nt, Mycobacterium bovis subsp bovis AF2122/97
cuccguggugcuagcgccgcc

SEQ ID NO: 3058718 - RNA, 22 nt, Mycobacterium bovis subsp bovis AF2122/97
cuccguggugcuagcgccgcca

SEQ ID NO: 3058719 - RNA, 14 nt, Mycobacterium bovis subsp bovis AF2122/97
cuccguugagguag

SEQ ID NO: 3058720 - RNA, 13 nt, Mycobacterium bovis subsp bovis AF2122/97
cuccguugccacc

SEQ ID NO: 3058721 - RNA, 16 nt, Mycobacterium bovis subsp bovis AF2122/97
cuccguuguccagcgc

SEQ ID NO: 3058722 - RNA, 24 nt, Mycobacterium bovis subsp bovis AF2122/97
cuccguuguccagcgcgacgucca

SEQ ID NO: 3058723 - RNA, 15 nt, Mycobacterium bovis subsp bovis AF2122/97
cuccguuuggcugcc

SEQ ID NO: 3058724 - RNA, 16 nt, Mycobacterium bovis subsp bovis AF2122/97
cuccguuuggcugccg

SEQ ID NO: 3058725 - RNA, 23 nt, Mycobacterium bovis subsp bovis AF2122/97
cuccuagccaacgagcgcgcugc

SEQ ID NO: 3058726 - RNA, 21 nt, Mycobacterium bovis subsp bovis AF2122/97
cuccuauggcaagcggccgcg

SEQ ID NO: 3058727 - RNA, 18 nt, Mycobacterium bovis subsp bovis AF2122/97
cuccucagccaccgcggu

SEQ ID NO: 3058728 - RNA, 23 nt, Mycobacterium bovis subsp bovis AF2122/97
cuccucagccaccgcggucagcu

SEQ ID NO: 3058729 - RNA, 16 nt, Mycobacterium bovis subsp bovis AF2122/97
cuccuccaccagugcc

SEQ ID NO: 3058730 - RNA, 14 nt, Mycobacterium bovis subsp bovis AF2122/97
cuccuccagagaca

SEQ ID NO: 3058731 - RNA, 20 nt, Mycobacterium bovis subsp bovis AF2122/97
cuccuccagagacagcgcca

SEQ ID NO: 3058732 - RNA, 16 nt, Mycobacterium bovis subsp bovis AF2122/97
cuccuccccgaccgcc

SEQ ID NO: 3058733 - RNA, 14 nt, Mycobacterium bovis subsp bovis AF2122/97
cuccuccggcacca

SEQ ID NO: 3058734 - RNA, 15 nt, Mycobacterium bovis subsp bovis AF2122/97
cuccuccggcaccaa

SEQ ID NO: 3058735 - RNA, 23 nt, Mycobacterium bovis subsp bovis AF2122/97
cuccuccgguaucggcgaccagc

SEQ ID NO: 3058736 - RNA, 23 nt, Mycobacterium bovis subsp bovis AF2122/97
cuccuccuugagccgggcaacca

SEQ ID NO: 3058737 - RNA, 22 nt, Mycobacterium bovis subsp bovis AF2122/97
cuccucgaaggcuucgcuggcu

SEQ ID NO: 3058738 - RNA, 22 nt, Mycobacterium bovis subsp bovis AF2122/97
cuccucgaccagagccgcgagc

SEQ ID NO: 3058739 - RNA, 17 nt, Mycobacterium bovis subsp bovis AF2122/97
cuccucgaccgcggccu

SEQ ID NO: 3058740 - RNA, 22 nt, Mycobacterium bovis subsp bovis AF2122/97
cuccucgaccguggcggccucc

SEQ ID NO: 3058741 - RNA, 20 nt, Mycobacterium bovis subsp bovis AF2122/97
cuccucgacgagucggcggg

SEQ ID NO: 3058742 - RNA, 17 nt, Mycobacterium bovis subsp bovis AF2122/97
cuccucgacgucggcga

SEQ ID NO: 3058743 - RNA, 19 nt, Mycobacterium bovis subsp bovis AF2122/97
cuccucgauagcggcgccu

SEQ ID NO: 3058744 - RNA, 21 nt, Mycobacterium bovis subsp bovis AF2122/97
cuccucgauagcggcgccuga

SEQ ID NO: 3058745 - RNA, 23 nt, Mycobacterium bovis subsp bovis AF2122/97
cuccucgaugaggcgcagcgcca

SEQ ID NO: 3058746 - RNA, 16 nt, Mycobacterium bovis subsp bovis AF2122/97
cuccucgcgcucgccg

SEQ ID NO: 3058747 - RNA, 12 nt, Mycobacterium bovis subsp bovis AF2122/97
cuccucgcuguc

SEQ ID NO: 3058748 - RNA, 15 nt, Mycobacterium bovis subsp bovis AF2122/97
cuccucggcaggccg

SEQ ID NO: 3058749 - RNA, 16 nt, Mycobacterium bovis subsp bovis AF2122/97
cuccucggcaggccga

SEQ ID NO: 3058750 - RNA, 14 nt, Mycobacterium bovis subsp bovis AF2122/97
cuccucggcgaugc

SEQ ID NO: 3058751 - RNA, 15 nt, Mycobacterium bovis subsp bovis AF2122/97
cuccucggucaccga

SEQ ID NO: 3058752 - RNA, 14 nt, Mycobacterium bovis subsp bovis AF2122/97
cuccucgguguaga

SEQ ID NO: 3058753 - RNA, 17 nt, Mycobacterium bovis subsp bovis AF2122/97
cuccucgucgacgucgg

SEQ ID NO: 3058754 - RNA, 14 nt, Mycobacterium bovis subsp bovis AF2122/97
cuccucgucgcucc

SEQ ID NO: 3058755 - RNA, 13 nt, Mycobacterium bovis subsp bovis AF2122/97
cuccugaguugcg

SEQ ID NO: 3058756 - RNA, 15 nt, Mycobacterium bovis subsp bovis AF2122/97
cuccugaguugcggu

SEQ ID NO: 3058757 - RNA, 18 nt, Mycobacterium bovis subsp bovis AF2122/97
cuccugaguugcggugug

SEQ ID NO: 3058758 - RNA, 16 nt, Mycobacterium bovis subsp bovis AF2122/97
cuccugcagcccgggc

SEQ ID NO: 3058759 - RNA, 23 nt, Mycobacterium bovis subsp bovis AF2122/97
cuccugcagcccgggcagcacca

SEQ ID NO: 3058760 - RNA, 13 nt, Mycobacterium bovis subsp bovis AF2122/97
cuccugcccuccg

SEQ ID NO: 3058761 - RNA, 15 nt, Mycobacterium bovis subsp bovis AF2122/97
cuccugcggcaccgc

SEQ ID NO: 3058762 - RNA, 11 nt, Mycobacterium bovis subsp bovis AF2122/97
cuccugcucgu

SEQ ID NO: 3058763 - RNA, 22 nt, Mycobacterium bovis subsp bovis AF2122/97
cuccugcucgucgagccgaccg

SEQ ID NO: 3058764 - RNA, 18 nt, Mycobacterium bovis subsp bovis AF2122/97
cuccugcuggcccugcuc

SEQ ID NO: 3058765 - RNA, 22 nt, Mycobacterium bovis subsp bovis AF2122/97
cuccuggaaguacacggcggcc

SEQ ID NO: 3058766 - RNA, 23 nt, Mycobacterium bovis subsp bovis AF2122/97
cuccuggcaaccgaauugaacug

SEQ ID NO: 3058767 - RNA, 18 nt, Mycobacterium bovis subsp bovis AF2122/97
cuccuggcgaaugucgcu

SEQ ID NO: 3058768 - RNA, 18 nt, Mycobacterium bovis subsp bovis AF2122/97
cuccuggguuugccgaug

SEQ ID NO: 3058769 - RNA, 14 nt, Mycobacterium bovis subsp bovis AF2122/97
cuccuggucaaccg

SEQ ID NO: 3058770 - RNA, 18 nt, Mycobacterium bovis subsp bovis AF2122/97
cuccuguggggauuccgc

SEQ ID NO: 3058771 - RNA, 22 nt, Mycobacterium bovis subsp bovis AF2122/97
cuccuugagcaaugacccgcgg

SEQ ID NO: 3058772 - RNA, 14 nt, Mycobacterium bovis subsp bovis AF2122/97
cuccuugaggucac

SEQ ID NO: 3058773 - RNA, 16 nt, Mycobacterium bovis subsp bovis AF2122/97
cuccuuggcccagcgg

SEQ ID NO: 3058774 - RNA, 22 nt, Mycobacterium bovis subsp bovis AF2122/97
cuccuuggcuaacaccgcaggc

SEQ ID NO: 3058775 - RNA, 19 nt, Mycobacterium bovis subsp bovis AF2122/97
cuccuugggcgacgcggcg

SEQ ID NO: 3058776 - RNA, 23 nt, Mycobacterium bovis subsp bovis AF2122/97
cuccuugggcgacgcggcgccgc

SEQ ID NO: 3058777 - RNA, 16 nt, Mycobacterium bovis subsp bovis AF2122/97
cuccuugugccugcug

SEQ ID NO: 3058778 - RNA, 21 nt, Mycobacterium bovis subsp bovis AF2122/97
cuccuuugcgggacuaggucc

SEQ ID NO: 3058779 - RNA, 19 nt, Mycobacterium bovis subsp bovis AF2122/97
cucgaaaccguggccaucg

SEQ ID NO: 3058780 - RNA, 21 nt, Mycobacterium bovis subsp bovis AF2122/97
cucgaaaccguggccaucgau

SEQ ID NO: 3058781 - RNA, 19 nt, Mycobacterium bovis subsp bovis AF2122/97
cucgaaacgcuuacccagc

SEQ ID NO: 3058782 - RNA, 17 nt, Mycobacterium bovis subsp bovis AF2122/97
cucgaaagcgucgauca

SEQ ID NO: 3058783 - RNA, 20 nt, Mycobacterium bovis subsp bovis AF2122/97
cucgaaauccugguggcaga

SEQ ID NO: 3058784 - RNA, 16 nt, Mycobacterium bovis subsp bovis AF2122/97
cucgaacaaccccggu

SEQ ID NO: 3058785 - RNA, 17 nt, Mycobacterium bovis subsp bovis AF2122/97
cucgaacagcucgauca

SEQ ID NO: 3058786 - RNA, 19 nt, Mycobacterium bovis subsp bovis AF2122/97
cucgaacagguuggccccg

SEQ ID NO: 3058787 - RNA, 21 nt, Mycobacterium bovis subsp bovis AF2122/97
cucgaacagguuggccccggc

SEQ ID NO: 3058788 - RNA, 21 nt, Mycobacterium bovis subsp bovis AF2122/97
cucgaacaucggaacgugacc

SEQ ID NO: 3058789 - RNA, 22 nt, Mycobacterium bovis subsp bovis AF2122/97
cucgaacaucggaacgugaccg

SEQ ID NO: 3058790 - RNA, 12 nt, Mycobacterium bovis subsp bovis AF2122/97
cucgaacgccgc

SEQ ID NO: 3058791 - RNA, 14 nt, Mycobacterium bovis subsp bovis AF2122/97
cucgaacgccgccc

SEQ ID NO: 3058792 - RNA, 17 nt, Mycobacterium bovis subsp bovis AF2122/97
cucgaacuccccggucg

SEQ ID NO: 3058793 - RNA, 22 nt, Mycobacterium bovis subsp bovis AF2122/97
cucgaacuccccggucgccgcg

SEQ ID NO: 3058794 - RNA, 19 nt, Mycobacterium bovis subsp bovis AF2122/97
cucgaacugggucggcacg

SEQ ID NO: 3058795 - RNA, 14 nt, Mycobacterium bovis subsp bovis AF2122/97
cucgaagcccagca

SEQ ID NO: 3058796 - RNA, 20 nt, Mycobacterium bovis subsp bovis AF2122/97
cucgaagcccagcaccacca

SEQ ID NO: 3058797 - RNA, 14 nt, Mycobacterium bovis subsp bovis AF2122/97
cucgaaggccgcca

SEQ ID NO: 3058798 - RNA, 20 nt, Mycobacterium bovis subsp bovis AF2122/97
cucgaaguccgcuugggcgg

SEQ ID NO: 3058799 - RNA, 13 nt, Mycobacterium bovis subsp bovis AF2122/97
cucgaagugcagg

SEQ ID NO: 3058800 - RNA, 17 nt, Mycobacterium bovis subsp bovis AF2122/97
cucgaauucggccggcg

SEQ ID NO: 3058801 - RNA, 22 nt, Mycobacterium bovis subsp bovis AF2122/97
cucgaauugguaaugcaccagg

SEQ ID NO: 3058802 - RNA, 18 nt, Mycobacterium bovis subsp bovis AF2122/97
cucgacaaagcggcugcc

SEQ ID NO: 3058803 - RNA, 16 nt, Mycobacterium bovis subsp bovis AF2122/97
cucgacacccagccgc

SEQ ID NO: 3058804 - RNA, 21 nt, Mycobacterium bovis subsp bovis AF2122/97
cucgacacccagccgcagccc

SEQ ID NO: 3058805 - RNA, 22 nt, Mycobacterium bovis subsp bovis AF2122/97
cucgacacccagccgcagcccg

SEQ ID NO: 3058806 - RNA, 12 nt, Mycobacterium bovis subsp bovis AF2122/97
cucgacaccgac

SEQ ID NO: 3058807 - RNA, 14 nt, Mycobacterium bovis subsp bovis AF2122/97
cucgacaccgacuc

SEQ ID NO: 3058808 - RNA, 19 nt, Mycobacterium bovis subsp bovis AF2122/97
cucgacacgccgugcgugc

SEQ ID NO: 3058809 - RNA, 14 nt, Mycobacterium bovis subsp bovis AF2122/97
cucgacacugcagu

SEQ ID NO: 3058810 - RNA, 16 nt, Mycobacterium bovis subsp bovis AF2122/97
cucgacagcggcaauc

SEQ ID NO: 3058811 - RNA, 16 nt, Mycobacterium bovis subsp bovis AF2122/97
cucgacaguggcgacg

SEQ ID NO: 3058812 - RNA, 18 nt, Mycobacterium bovis subsp bovis AF2122/97
cucgacaucggccagcuu

SEQ ID NO: 3058813 - RNA, 17 nt, Mycobacterium bovis subsp bovis AF2122/97
cucgaccaccgccggcc

SEQ ID NO: 3058814 - RNA, 19 nt, Mycobacterium bovis subsp bovis AF2122/97
cucgaccaccgccggcccg

SEQ ID NO: 3058815 - RNA, 16 nt, Mycobacterium bovis subsp bovis AF2122/97
cucgaccagacgcugc

SEQ ID NO: 3058816 - RNA, 21 nt, Mycobacterium bovis subsp bovis AF2122/97
cucgaccagacgcugcccaaa

SEQ ID NO: 3058817 - RNA, 16 nt, Mycobacterium bovis subsp bovis AF2122/97
cucgaccagagccgcg

SEQ ID NO: 3058818 - RNA, 14 nt, Mycobacterium bovis subsp bovis AF2122/97
cucgaccagcgccg

SEQ ID NO: 3058819 - RNA, 18 nt, Mycobacterium bovis subsp bovis AF2122/97
cucgaccaggaccggcug

SEQ ID NO: 3058820 - RNA, 18 nt, Mycobacterium bovis subsp bovis AF2122/97
cucgaccgacugcccgau

SEQ ID NO: 3058821 - RNA, 18 nt, Mycobacterium bovis subsp bovis AF2122/97
cucgaccgauagcuggcc

SEQ ID NO: 3058822 - RNA, 16 nt, Mycobacterium bovis subsp bovis AF2122/97
cucgaccgccagcccg

SEQ ID NO: 3058823 - RNA, 16 nt, Mycobacterium bovis subsp bovis AF2122/97
cucgaccgccagccgc

SEQ ID NO: 3058824 - RNA, 18 nt, Mycobacterium bovis subsp bovis AF2122/97
cucgaccgcccggcuagg

SEQ ID NO: 3058825 - RNA, 12 nt, Mycobacterium bovis subsp bovis AF2122/97
cucgaccgcgac

SEQ ID NO: 3058826 - RNA, 13 nt, Mycobacterium bovis subsp bovis AF2122/97
cucgaccgcgacg

SEQ ID NO: 3058827 - RNA, 14 nt, Mycobacterium bovis subsp bovis AF2122/97
cucgaccgcgacgg

SEQ ID NO: 3058828 - RNA, 20 nt, Mycobacterium bovis subsp bovis AF2122/97
cucgaccgcgccuggagcga

SEQ ID NO: 3058829 - RNA, 19 nt, Mycobacterium bovis subsp bovis AF2122/97
cucgaccgcggccuuggcg

SEQ ID NO: 3058830 - RNA, 18 nt, Mycobacterium bovis subsp bovis AF2122/97
cucgaccgcggggcagcg

SEQ ID NO: 3058831 - RNA, 12 nt, Mycobacterium bovis subsp bovis AF2122/97
cucgaccgcguc

SEQ ID NO: 3058832 - RNA, 20 nt, Mycobacterium bovis subsp bovis AF2122/97
cucgaccgucacgcguacgu

SEQ ID NO: 3058833 - RNA, 13 nt, Mycobacterium bovis subsp bovis AF2122/97
cucgaccguggcg

SEQ ID NO: 3058834 - RNA, 17 nt, Mycobacterium bovis subsp bovis AF2122/97
cucgaccucagacagcu

SEQ ID NO: 3058835 - RNA, 19 nt, Mycobacterium bovis subsp bovis AF2122/97
cucgaccucgucggccgac

SEQ ID NO: 3058836 - RNA, 22 nt, Mycobacterium bovis subsp bovis AF2122/97
cucgaccuggaugggcucgacg

SEQ ID NO: 3058837 - RNA, 16 nt, Mycobacterium bovis subsp bovis AF2122/97
cucgacgacgggcgcc

SEQ ID NO: 3058838 - RNA, 20 nt, Mycobacterium bovis subsp bovis AF2122/97
cucgacgaggagccucgacc

SEQ ID NO: 3058839 - RNA, 16 nt, Mycobacterium bovis subsp bovis AF2122/97
cucgacgaggccacgg

SEQ ID NO: 3058840 - RNA, 22 nt, Mycobacterium bovis subsp bovis AF2122/97
cucgacgagucggcgggcgaca

SEQ ID NO: 3058841 - RNA, 23 nt, Mycobacterium bovis subsp bovis AF2122/97
cucgacgagucggcgggcgacau

SEQ ID NO: 3058842 - RNA, 15 nt, Mycobacterium bovis subsp bovis AF2122/97
cucgacgaucagcac

SEQ ID NO: 3058843 - RNA, 13 nt, Mycobacterium bovis subsp bovis AF2122/97
cucgacgccccag

SEQ ID NO: 3058844 - RNA, 14 nt, Mycobacterium bovis subsp bovis AF2122/97
cucgacgcccgcca

SEQ ID NO: 3058845 - RNA, 23 nt, Mycobacterium bovis subsp bovis AF2122/97
cucgacgcccgcccuggcaacga

SEQ ID NO: 3058846 - RNA, 14 nt, Mycobacterium bovis subsp bovis AF2122/97
cucgacgccgcgca

SEQ ID NO: 3058847 - RNA, 17 nt, Mycobacterium bovis subsp bovis AF2122/97
cucgacgccgcgcagcc

SEQ ID NO: 3058848 - RNA, 19 nt, Mycobacterium bovis subsp bovis AF2122/97
cucgacgcgucgccggccg

SEQ ID NO: 3058849 - RNA, 16 nt, Mycobacterium bovis subsp bovis AF2122/97
cucgacggcccgccgu

SEQ ID NO: 3058850 - RNA, 15 nt, Mycobacterium bovis subsp bovis AF2122/97
cucgacggccucguc

SEQ ID NO: 3058851 - RNA, 17 nt, Mycobacterium bovis subsp bovis AF2122/97
cucgacggccucgucga

SEQ ID NO: 3058852 - RNA, 20 nt, Mycobacterium bovis subsp bovis AF2122/97
cucgacggccucgucgaugu

SEQ ID NO: 3058853 - RNA, 16 nt, Mycobacterium bovis subsp bovis AF2122/97
cucgacggcgccgccc

SEQ ID NO: 3058854 - RNA, 18 nt, Mycobacterium bovis subsp bovis AF2122/97
cucgacggcgccgcccac

SEQ ID NO: 3058855 - RNA, 19 nt, Mycobacterium bovis subsp bovis AF2122/97
cucgacggcgccgcccacg

SEQ ID NO: 3058856 - RNA, 16 nt, Mycobacterium bovis subsp bovis AF2122/97
cucgacggcggccgcg

SEQ ID NO: 3058857 - RNA, 12 nt, Mycobacterium bovis subsp bovis AF2122/97
cucgacggcucc

SEQ ID NO: 3058858 - RNA, 14 nt, Mycobacterium bovis subsp bovis AF2122/97
cucgacggucaucg

SEQ ID NO: 3058859 - RNA, 13 nt, Mycobacterium bovis subsp bovis AF2122/97
cucgacggugacg

SEQ ID NO: 3058860 - RNA, 14 nt, Mycobacterium bovis subsp bovis AF2122/97
cucgacguagucgc

SEQ ID NO: 3058861 - RNA, 20 nt, Mycobacterium bovis subsp bovis AF2122/97
cucgacguauuggcgcagca

SEQ ID NO: 3058862 - RNA, 13 nt, Mycobacterium bovis subsp bovis AF2122/97
cucgacgucggcg

SEQ ID NO: 3058863 - RNA, 22 nt, Mycobacterium bovis subsp bovis AF2122/97
cucgacgucgggcauggcggcg

SEQ ID NO: 3058864 - RNA, 15 nt, Mycobacterium bovis subsp bovis AF2122/97
cucgacugccaccgu

SEQ ID NO: 3058865 - RNA, 14 nt, Mycobacterium bovis subsp bovis AF2122/97
cucgacuugcuugg

SEQ ID NO: 3058866 - RNA, 15 nt, Mycobacterium bovis subsp bovis AF2122/97
cucgagaguggccuc

SEQ ID NO: 3058867 - RNA, 20 nt, Mycobacterium bovis subsp bovis AF2122/97
cucgagcaagaucaccuucg

SEQ ID NO: 3058868 - RNA, 21 nt, Mycobacterium bovis subsp bovis AF2122/97
cucgagcaccucggccucguc

SEQ ID NO: 3058869 - RNA, 16 nt, Mycobacterium bovis subsp bovis AF2122/97
cucgagcagcgcgccg

SEQ ID NO: 3058870 - RNA, 17 nt, Mycobacterium bovis subsp bovis AF2122/97
cucgagcagcgcgccgu

SEQ ID NO: 3058871 - RNA, 19 nt, Mycobacterium bovis subsp bovis AF2122/97
cucgagcaggaugcgaucg

SEQ ID NO: 3058872 - RNA, 16 nt, Mycobacterium bovis subsp bovis AF2122/97
cucgagcaggcgcacc

SEQ ID NO: 3058873 - RNA, 17 nt, Mycobacterium bovis subsp bovis AF2122/97
cucgagcaggcgcacca

SEQ ID NO: 3058874 - RNA, 14 nt, Mycobacterium bovis subsp bovis AF2122/97
cucgcaccaccacg

SEQ ID NO: 3058875 - RNA, 20 nt, Mycobacterium bovis subsp bovis AF2122/97
cucgcacccgcucggcgcgc

SEQ ID NO: 3058876 - RNA, 20 nt, Mycobacterium bovis subsp bovis AF2122/97
cucgcaccgcccgccgaacg

SEQ ID NO: 3058877 - RNA, 14 nt, Mycobacterium bovis subsp bovis AF2122/97
cucgcaccgcgccg

SEQ ID NO: 3058878 - RNA, 17 nt, Mycobacterium bovis subsp bovis AF2122/97
cucgcaccggauccacg

SEQ ID NO: 3058879 - RNA, 23 nt, Mycobacterium bovis subsp bovis AF2122/97
cucgcaccgugaguacucgguca

SEQ ID NO: 3058880 - RNA, 21 nt, Mycobacterium bovis subsp bovis AF2122/97
cucgcacgacaccucgaaggc

SEQ ID NO: 3058881 - RNA, 16 nt, Mycobacterium bovis subsp bovis AF2122/97
cucgcacucguugccg

SEQ ID NO: 3058882 - RNA, 20 nt, Mycobacterium bovis subsp bovis AF2122/97
cucgcagcgacacguuggcg

SEQ ID NO: 3058883 - RNA, 20 nt, Mycobacterium bovis subsp bovis AF2122/97
cucgcagcuccucgcccaga

SEQ ID NO: 3058884 - RNA, 21 nt, Mycobacterium bovis subsp bovis AF2122/97
cucgcaggaauucgccauagc

SEQ ID NO: 3058885 - RNA, 14 nt, Mycobacterium bovis subsp bovis AF2122/97
cucgcaggccggcg

SEQ ID NO: 3058886 - RNA, 17 nt, Mycobacterium bovis subsp bovis AF2122/97
cucgcaggccggcggcg

SEQ ID NO: 3058887 - RNA, 18 nt, Mycobacterium bovis subsp bovis AF2122/97
cucgcaguucaucgggca

SEQ ID NO: 3058888 - RNA, 19 nt, Mycobacterium bovis subsp bovis AF2122/97
cucgcauguucuccacgcc

SEQ ID NO: 3058889 - RNA, 21 nt, Mycobacterium bovis subsp bovis AF2122/97
cucgcauguucuccacgccga

SEQ ID NO: 3058890 - RNA, 18 nt, Mycobacterium bovis subsp bovis AF2122/97
cucgcauucggcgagccg

SEQ ID NO: 3058891 - RNA, 20 nt, Mycobacterium bovis subsp bovis AF2122/97
cucgccacacucccgcgccc

SEQ ID NO: 3058892 - RNA, 18 nt, Mycobacterium bovis subsp bovis AF2122/97
cucgccacauuucaccac

SEQ ID NO: 3058893 - RNA, 16 nt, Mycobacterium bovis subsp bovis AF2122/97
cucgccaccgcggcga

SEQ ID NO: 3058894 - RNA, 21 nt, Mycobacterium bovis subsp bovis AF2122/97
cucgccacggucgccgaccac

SEQ ID NO: 3058895 - RNA, 23 nt, Mycobacterium bovis subsp bovis AF2122/97
cucgccacucagcccgacaccga

SEQ ID NO: 3058896 - RNA, 11 nt, Mycobacterium bovis subsp bovis AF2122/97
cucgccagagu

SEQ ID NO: 3058897 - RNA, 19 nt, Mycobacterium bovis subsp bovis AF2122/97
cucgccagagucggagacc

SEQ ID NO: 3058898 - RNA, 14 nt, Mycobacterium bovis subsp bovis AF2122/97
cucgccaggcaagc

SEQ ID NO: 3058899 - RNA, 16 nt, Mycobacterium bovis subsp bovis AF2122/97
cucgccaggcaagcca

SEQ ID NO: 3058900 - RNA, 19 nt, Mycobacterium bovis subsp bovis AF2122/97
cucgccaggcaagccagca

SEQ ID NO: 3058901 - RNA, 18 nt, Mycobacterium bovis subsp bovis AF2122/97
cucgccaggccuaggccg

SEQ ID NO: 3058902 - RNA, 15 nt, Mycobacterium bovis subsp bovis AF2122/97
cucgcccacccgcug

SEQ ID NO: 3058903 - RNA, 21 nt, Mycobacterium bovis subsp bovis AF2122/97
cucgcccaccuccugguugac

SEQ ID NO: 3058904 - RNA, 14 nt, Mycobacterium bovis subsp bovis AF2122/97
cucgcccagcgagc

SEQ ID NO: 3058905 - RNA, 20 nt, Mycobacterium bovis subsp bovis AF2122/97
cucgcccagugaaucggacc

SEQ ID NO: 3058906 - RNA, 14 nt, Mycobacterium bovis subsp bovis AF2122/97
cucgccccagugcu

SEQ ID NO: 3058907 - RNA, 15 nt, Mycobacterium bovis subsp bovis AF2122/97
cucgcccgcaccagc

SEQ ID NO: 3058908 - RNA, 23 nt, Mycobacterium bovis subsp bovis AF2122/97
cucgcccgccgccaccagcugcg

SEQ ID NO: 3058909 - RNA, 22 nt, Mycobacterium bovis subsp bovis AF2122/97
cucgcccuauacgcaacaggcc

SEQ ID NO: 3058910 - RNA, 15 nt, Mycobacterium bovis subsp bovis AF2122/97
cucgcccucccgggc

SEQ ID NO: 3058911 - RNA, 18 nt, Mycobacterium bovis subsp bovis AF2122/97
cucgcccugacgucacgu

SEQ ID NO: 3058912 - RNA, 22 nt, Mycobacterium bovis subsp bovis AF2122/97
cucgcccugagaacacguucgg

SEQ ID NO: 3058913 - RNA, 16 nt, Mycobacterium bovis subsp bovis AF2122/97
cucgcccuugaccgaa

SEQ ID NO: 3058914 - RNA, 21 nt, Mycobacterium bovis subsp bovis AF2122/97
cucgccgaaaagggcgacagc

SEQ ID NO: 3058915 - RNA, 18 nt, Mycobacterium bovis subsp bovis AF2122/97
cucgccgaaaucggccag

SEQ ID NO: 3058916 - RNA, 19 nt, Mycobacterium bovis subsp bovis AF2122/97
cucgccgaaaucggccagc

SEQ ID NO: 3058917 - RNA, 20 nt, Mycobacterium bovis subsp bovis AF2122/97
cucgccgaaaucggccagcu

SEQ ID NO: 3058918 - RNA, 17 nt, Mycobacterium bovis subsp bovis AF2122/97
cucgccgaaucgcugac

SEQ ID NO: 3058919 - RNA, 14 nt, Mycobacterium bovis subsp bovis AF2122/97
cucgccgaccagcu

SEQ ID NO: 3058920 - RNA, 16 nt, Mycobacterium bovis subsp bovis AF2122/97
cucgccgaccuuggcg

SEQ ID NO: 3058921 - RNA, 19 nt, Mycobacterium bovis subsp bovis AF2122/97
cucgccgacggcaagggca

SEQ ID NO: 3058922 - RNA, 19 nt, Mycobacterium bovis subsp bovis AF2122/97
cucgccgacgucgacgccg

SEQ ID NO: 3058923 - RNA, 18 nt, Mycobacterium bovis subsp bovis AF2122/97
cucgccgagcagacacag

SEQ ID NO: 3058924 - RNA, 12 nt, Mycobacterium bovis subsp bovis AF2122/97
cucgccgagcug

SEQ ID NO: 3058925 - RNA, 24 nt, Mycobacterium bovis subsp bovis AF2122/97
cucgccgaggaaaucgcccucguc

SEQ ID NO: 3058926 - RNA, 23 nt, Mycobacterium bovis subsp bovis AF2122/97
cucgccgaggccuaccaggcgcg

SEQ ID NO: 3058927 - RNA, 16 nt, Mycobacterium bovis subsp bovis AF2122/97
cucgccgcacgccggc

SEQ ID NO: 3058928 - RNA, 18 nt, Mycobacterium bovis subsp bovis AF2122/97
cucgccgcacgccggcau

SEQ ID NO: 3058929 - RNA, 19 nt, Mycobacterium bovis subsp bovis AF2122/97
cucgccgcacgccggcaug

SEQ ID NO: 3058930 - RNA, 13 nt, Mycobacterium bovis subsp bovis AF2122/97
cucgccgccagcg

SEQ ID NO: 3058931 - RNA, 14 nt, Mycobacterium bovis subsp bovis AF2122/97
cucgccgccgcugu

SEQ ID NO: 3058932 - RNA, 17 nt, Mycobacterium bovis subsp bovis AF2122/97
cucgccgcgacugcacc

SEQ ID NO: 3058933 - RNA, 12 nt, Mycobacterium bovis subsp bovis AF2122/97
cucgccgcgcgu

SEQ ID NO: 3058934 - RNA, 21 nt, Mycobacterium bovis subsp bovis AF2122/97
cucgccggaaagcccgucguc

SEQ ID NO: 3058935 - RNA, 22 nt, Mycobacterium bovis subsp bovis AF2122/97
cucgccggacgggugcagcgca

SEQ ID NO: 3058936 - RNA, 22 nt, Mycobacterium bovis subsp bovis AF2122/97
cucgccggaucguucgcgugcc

SEQ ID NO: 3058937 - RNA, 16 nt, Mycobacterium bovis subsp bovis AF2122/97
cucgccggaucuugcc

SEQ ID NO: 3058938 - RNA, 17 nt, Mycobacterium bovis subsp bovis AF2122/97
cucgccggaucuugccg

SEQ ID NO: 3058939 - RNA, 13 nt, Mycobacterium bovis subsp bovis AF2122/97
cucgccggcacgc

SEQ ID NO: 3058940 - RNA, 16 nt, Mycobacterium bovis subsp bovis AF2122/97
cucgccggccacccgc

SEQ ID NO: 3058941 - RNA, 11 nt, Mycobacterium bovis subsp bovis AF2122/97
cucgccggccg

SEQ ID NO: 3058942 - RNA, 15 nt, Mycobacterium bovis subsp bovis AF2122/97
cucgccggccgucag

SEQ ID NO: 3058943 - RNA, 16 nt, Mycobacterium bovis subsp bovis AF2122/97
cucgccggcgaagacc

SEQ ID NO: 3058944 - RNA, 16 nt, Mycobacterium bovis subsp bovis AF2122/97
cucgccggcgcgcacc

SEQ ID NO: 3058945 - RNA, 23 nt, Mycobacterium bovis subsp bovis AF2122/97
cucgccggcgcgcagccgggcca

SEQ ID NO: 3058946 - RNA, 16 nt, Mycobacterium bovis subsp bovis AF2122/97
cucgccggcggacgcc

SEQ ID NO: 3058947 - RNA, 20 nt, Mycobacterium bovis subsp bovis AF2122/97
cucgccggcggacgcccggc

SEQ ID NO: 3058948 - RNA, 16 nt, Mycobacterium bovis subsp bovis AF2122/97
cucgccggcggcccgc

SEQ ID NO: 3058949 - RNA, 15 nt, Mycobacterium bovis subsp bovis AF2122/97
cucgccggcucggcg

SEQ ID NO: 3058950 - RNA, 22 nt, Mycobacterium bovis subsp bovis AF2122/97
cucgccgggaaacaccggcuug

SEQ ID NO: 3058951 - RNA, 13 nt, Mycobacterium bovis subsp bovis AF2122/97
cucgccgggcagc

SEQ ID NO: 3058952 - RNA, 15 nt, Mycobacterium bovis subsp bovis AF2122/97
cucgccgggcagcua

SEQ ID NO: 3058953 - RNA, 17 nt, Mycobacterium bovis subsp bovis AF2122/97
cucgccgggucagcccg

SEQ ID NO: 3058954 - RNA, 18 nt, Mycobacterium bovis subsp bovis AF2122/97
cucgccgguaggcggcca

SEQ ID NO: 3058955 - RNA, 19 nt, Mycobacterium bovis subsp bovis AF2122/97
cucgccgguaggcggccag

SEQ ID NO: 3058956 - RNA, 13 nt, Mycobacterium bovis subsp bovis AF2122/97
cucgccggugacg

SEQ ID NO: 3058957 - RNA, 14 nt, Mycobacterium bovis subsp bovis AF2122/97
cucgccggugacgg

SEQ ID NO: 3058958 - RNA, 17 nt, Mycobacterium bovis subsp bovis AF2122/97
cucgccggugagccgga

SEQ ID NO: 3058959 - RNA, 18 nt, Mycobacterium bovis subsp bovis AF2122/97
cucgccgguguccuuggc

SEQ ID NO: 3058960 - RNA, 16 nt, Mycobacterium bovis subsp bovis AF2122/97
cucggacacggcagcc

SEQ ID NO: 3058961 - RNA, 18 nt, Mycobacterium bovis subsp bovis AF2122/97
cucggaccagacccacga

SEQ ID NO: 3058962 - RNA, 20 nt, Mycobacterium bovis subsp bovis AF2122/97
cucggaccagacccacgaug

SEQ ID NO: 3058963 - RNA, 12 nt, Mycobacterium bovis subsp bovis AF2122/97
cucggacgcgcc

SEQ ID NO: 3058964 - RNA, 16 nt, Mycobacterium bovis subsp bovis AF2122/97
cucggagcgcacgaac

SEQ ID NO: 3058965 - RNA, 14 nt, Mycobacterium bovis subsp bovis AF2122/97
cucggaggcgauca

SEQ ID NO: 3058966 - RNA, 19 nt, Mycobacterium bovis subsp bovis AF2122/97
cucggaggcgaucaggaug

SEQ ID NO: 3058967 - RNA, 15 nt, Mycobacterium bovis subsp bovis AF2122/97
cucggaguugagcug

SEQ ID NO: 3058968 - RNA, 15 nt, Mycobacterium bovis subsp bovis AF2122/97
cucggaucgccaggc

SEQ ID NO: 3058969 - RNA, 16 nt, Mycobacterium bovis subsp bovis AF2122/97
cucggaucgccaggcc

SEQ ID NO: 3058970 - RNA, 21 nt, Mycobacterium bovis subsp bovis AF2122/97
cucggaucgccaggccgucgg

SEQ ID NO: 3058971 - RNA, 18 nt, Mycobacterium bovis subsp bovis AF2122/97
cucggaucggcucgccac

SEQ ID NO: 3058972 - RNA, 19 nt, Mycobacterium bovis subsp bovis AF2122/97
cucggaucuugacguucgc

SEQ ID NO: 3058973 - RNA, 18 nt, Mycobacterium bovis subsp bovis AF2122/97
cucggcaaaccaagcgcg

SEQ ID NO: 3058974 - RNA, 20 nt, Mycobacterium bovis subsp bovis AF2122/97
cucggcaaaccaagcgcgcc

SEQ ID NO: 3058975 - RNA, 15 nt, Mycobacterium bovis subsp bovis AF2122/97
cucggcaaccaccuc

SEQ ID NO: 3058976 - RNA, 19 nt, Mycobacterium bovis subsp bovis AF2122/97
cucggcaaccaccucgugg

SEQ ID NO: 3058977 - RNA, 17 nt, Mycobacterium bovis subsp bovis AF2122/97
cucggcaaccugcgacc

SEQ ID NO: 3058978 - RNA, 16 nt, Mycobacterium bovis subsp bovis AF2122/97
cucggcaagucgacgc

SEQ ID NO: 3058979 - RNA, 14 nt, Mycobacterium bovis subsp bovis AF2122/97
cucggcacccgccg

SEQ ID NO: 3058980 - RNA, 14 nt, Mycobacterium bovis subsp bovis AF2122/97
cucggcaccgcggc

SEQ ID NO: 3058981 - RNA, 15 nt, Mycobacterium bovis subsp bovis AF2122/97
cucggcacggaccgc

SEQ ID NO: 3058982 - RNA, 18 nt, Mycobacterium bovis subsp bovis AF2122/97
cucggcagcaucuccguc

SEQ ID NO: 3058983 - RNA, 20 nt, Mycobacterium bovis subsp bovis AF2122/97
cucggcagcaucuccgucgg

SEQ ID NO: 3058984 - RNA, 13 nt, Mycobacterium bovis subsp bovis AF2122/97
cucggcagccggc

SEQ ID NO: 3058985 - RNA, 14 nt, Mycobacterium bovis subsp bovis AF2122/97
cucggcagccggcu

SEQ ID NO: 3058986 - RNA, 15 nt, Mycobacterium bovis subsp bovis AF2122/97
cucggcagccggcuu

SEQ ID NO: 3058987 - RNA, 18 nt, Mycobacterium bovis subsp bovis AF2122/97
cucggcaggaaggacauc

SEQ ID NO: 3058988 - RNA, 19 nt, Mycobacterium bovis subsp bovis AF2122/97
cucggcaggaaggacaucg

SEQ ID NO: 3058989 - RNA, 22 nt, Mycobacterium bovis subsp bovis AF2122/97
cucggcaggcccggaggguucg

SEQ ID NO: 3058990 - RNA, 15 nt, Mycobacterium bovis subsp bovis AF2122/97
cucggcaggccgacc

SEQ ID NO: 3058991 - RNA, 16 nt, Mycobacterium bovis subsp bovis AF2122/97
cucggcauccaggcug

SEQ ID NO: 3058992 - RNA, 22 nt, Mycobacterium bovis subsp bovis AF2122/97
cucggcaugcagccccacuucg

SEQ ID NO: 3058993 - RNA, 18 nt, Mycobacterium bovis subsp bovis AF2122/97
cucggccaacgacggccg

SEQ ID NO: 3058994 - RNA, 20 nt, Mycobacterium bovis subsp bovis AF2122/97
cucggccaacgacggccgac

SEQ ID NO: 3058995 - RNA, 19 nt, Mycobacterium bovis subsp bovis AF2122/97
cucggccaauccggggccc

SEQ ID NO: 3058996 - RNA, 15 nt, Mycobacterium bovis subsp bovis AF2122/97
cucggccaccagcgc

SEQ ID NO: 3058997 - RNA, 18 nt, Mycobacterium bovis subsp bovis AF2122/97
cucggccaccagcgcccg

SEQ ID NO: 3058998 - RNA, 22 nt, Mycobacterium bovis subsp bovis AF2122/97
cucggccaccagcgcccggccc

SEQ ID NO: 3058999 - RNA, 23 nt, Mycobacterium bovis subsp bovis AF2122/97
cucggccacgaacccucagccgc

SEQ ID NO: 3059000 - RNA, 16 nt, Mycobacterium bovis subsp bovis AF2122/97
cucggccacggcgucg

SEQ ID NO: 3059001 - RNA, 15 nt, Mycobacterium bovis subsp bovis AF2122/97
cucggccagcacgcc

SEQ ID NO: 3059002 - RNA, 16 nt, Mycobacterium bovis subsp bovis AF2122/97
cucggccagcacgccg

SEQ ID NO: 3059003 - RNA, 19 nt, Mycobacterium bovis subsp bovis AF2122/97
cucggccagcacgccgccg

SEQ ID NO: 3059004 - RNA, 16 nt, Mycobacterium bovis subsp bovis AF2122/97
cucggccagccagcgg

SEQ ID NO: 3059005 - RNA, 18 nt, Mycobacterium bovis subsp bovis AF2122/97
cucggccagccagcgggc

SEQ ID NO: 3059006 - RNA, 20 nt, Mycobacterium bovis subsp bovis AF2122/97
cucggccagcgucagcuguu

SEQ ID NO: 3059007 - RNA, 21 nt, Mycobacterium bovis subsp bovis AF2122/97
cucggccagcuccgccugccg

SEQ ID NO: 3059008 - RNA, 20 nt, Mycobacterium bovis subsp bovis AF2122/97
cucggccagcuugcggagcc

SEQ ID NO: 3059009 - RNA, 14 nt, Mycobacterium bovis subsp bovis AF2122/97
cucggcccagcgcg

SEQ ID NO: 3059010 - RNA, 15 nt, Mycobacterium bovis subsp bovis AF2122/97
cucggcccagcgcgc

SEQ ID NO: 3059011 - RNA, 16 nt, Mycobacterium bovis subsp bovis AF2122/97
cucggcccagcgcgcc

SEQ ID NO: 3059012 - RNA, 17 nt, Mycobacterium bovis subsp bovis AF2122/97
cucggcccagcgcgcca

SEQ ID NO: 3059013 - RNA, 18 nt, Mycobacterium bovis subsp bovis AF2122/97
cucggcccagcgcgccag

SEQ ID NO: 3059014 - RNA, 14 nt, Mycobacterium bovis subsp bovis AF2122/97
cucggccccgccgc

SEQ ID NO: 3059015 - RNA, 16 nt, Mycobacterium bovis subsp bovis AF2122/97
cucggccccgccgccg

SEQ ID NO: 3059016 - RNA, 18 nt, Mycobacterium bovis subsp bovis AF2122/97
cucggcccggcaggacuu

SEQ ID NO: 3059017 - RNA, 13 nt, Mycobacterium bovis subsp bovis AF2122/97
cucggcccggccc

SEQ ID NO: 3059018 - RNA, 14 nt, Mycobacterium bovis subsp bovis AF2122/97
cucggcccggguga

SEQ ID NO: 3059019 - RNA, 14 nt, Mycobacterium bovis subsp bovis AF2122/97
cucggccgacgaga

SEQ ID NO: 3059020 - RNA, 13 nt, Mycobacterium bovis subsp bovis AF2122/97
cucggccgcagcc

SEQ ID NO: 3059021 - RNA, 11 nt, Mycobacterium bovis subsp bovis AF2122/97
cucggccgcau

SEQ ID NO: 3059022 - RNA, 15 nt, Mycobacterium bovis subsp bovis AF2122/97
cucggccgccagccc

SEQ ID NO: 3059023 - RNA, 17 nt, Mycobacterium bovis subsp bovis AF2122/97
cucggccgccagcccca

SEQ ID NO: 3059024 - RNA, 13 nt, Mycobacterium bovis subsp bovis AF2122/97
cucggccgcccgu

SEQ ID NO: 3059025 - RNA, 14 nt, Mycobacterium bovis subsp bovis AF2122/97
cucggccggcggcg

SEQ ID NO: 3059026 - RNA, 15 nt, Mycobacterium bovis subsp bovis AF2122/97
cucggccggcggcgc

SEQ ID NO: 3059027 - RNA, 16 nt, Mycobacterium bovis subsp bovis AF2122/97
cucggccgggcggucg

SEQ ID NO: 3059028 - RNA, 13 nt, Mycobacterium bovis subsp bovis AF2122/97
cucggccgugacc

SEQ ID NO: 3059029 - RNA, 17 nt, Mycobacterium bovis subsp bovis AF2122/97
cucggccgugaccgagc

SEQ ID NO: 3059030 - RNA, 14 nt, Mycobacterium bovis subsp bovis AF2122/97
cucggccuccgccg

SEQ ID NO: 3059031 - RNA, 19 nt, Mycobacterium bovis subsp bovis AF2122/97
cucggccucgucgugcacc

SEQ ID NO: 3059032 - RNA, 21 nt, Mycobacterium bovis subsp bovis AF2122/97
cucggccuugacgcacgacug

SEQ ID NO: 3059033 - RNA, 21 nt, Mycobacterium bovis subsp bovis AF2122/97
cucggccuugaucaccgugcg

SEQ ID NO: 3059034 - RNA, 22 nt, Mycobacterium bovis subsp bovis AF2122/97
cucggccuugaucaccgugcgg

SEQ ID NO: 3059035 - RNA, 13 nt, Mycobacterium bovis subsp bovis AF2122/97
cucggcgaacgcg

SEQ ID NO: 3059036 - RNA, 19 nt, Mycobacterium bovis subsp bovis AF2122/97
cucggcgaaggccgcgcgc

SEQ ID NO: 3059037 - RNA, 20 nt, Mycobacterium bovis subsp bovis AF2122/97
cucggcgaaggccgcgcgca

SEQ ID NO: 3059038 - RNA, 24 nt, Mycobacterium bovis subsp bovis AF2122/97
cucggcgaagucacgcacccggcg

SEQ ID NO: 3059039 - RNA, 20 nt, Mycobacterium bovis subsp bovis AF2122/97
cucggcgaaugcgauugccg

SEQ ID NO: 3059040 - RNA, 23 nt, Mycobacterium bovis subsp bovis AF2122/97
cucggcgaccaucugaucgggcc

SEQ ID NO: 3059041 - RNA, 13 nt, Mycobacterium bovis subsp bovis AF2122/97
cucggcgaccgac

SEQ ID NO: 3059042 - RNA, 19 nt, Mycobacterium bovis subsp bovis AF2122/97
cucggcgaccgacgccggu

SEQ ID NO: 3059043 - RNA, 16 nt, Mycobacterium bovis subsp bovis AF2122/97
cucggcgaccgcgucg

SEQ ID NO: 3059044 - RNA, 21 nt, Mycobacterium bovis subsp bovis AF2122/97
cucggcgaccugccggaccgc

SEQ ID NO: 3059045 - RNA, 14 nt, Mycobacterium bovis subsp bovis AF2122/97
cucggcgaccuggc

SEQ ID NO: 3059046 - RNA, 17 nt, Mycobacterium bovis subsp bovis AF2122/97
cucggcgaccuggcuca

SEQ ID NO: 3059047 - RNA, 16 nt, Mycobacterium bovis subsp bovis AF2122/97
cucgggcaggccccac

SEQ ID NO: 3059048 - RNA, 19 nt, Mycobacterium bovis subsp bovis AF2122/97
cucgggcaggcggccagcg

SEQ ID NO: 3059049 - RNA, 12 nt, Mycobacterium bovis subsp bovis AF2122/97
cucgggccagau

SEQ ID NO: 3059050 - RNA, 12 nt, Mycobacterium bovis subsp bovis AF2122/97
cucgggcgcccg

SEQ ID NO: 3059051 - RNA, 17 nt, Mycobacterium bovis subsp bovis AF2122/97
cucgggcgcgggugacc

SEQ ID NO: 3059052 - RNA, 22 nt, Mycobacterium bovis subsp bovis AF2122/97
cucgggcgcugaugcgcugggc

SEQ ID NO: 3059053 - RNA, 23 nt, Mycobacterium bovis subsp bovis AF2122/97
cucgggcgcugaugcgcugggcc

SEQ ID NO: 3059054 - RNA, 16 nt, Mycobacterium bovis subsp bovis AF2122/97
cucgggcgugaucccg

SEQ ID NO: 3059055 - RNA, 17 nt, Mycobacterium bovis subsp bovis AF2122/97
cucgggcugccgcaugc

SEQ ID NO: 3059056 - RNA, 15 nt, Mycobacterium bovis subsp bovis AF2122/97
cucggggaacaccgc

SEQ ID NO: 3059057 - RNA, 22 nt, Mycobacterium bovis subsp bovis AF2122/97
cucggggcucucgaguccaggc

SEQ ID NO: 3059058 - RNA, 14 nt, Mycobacterium bovis subsp bovis AF2122/97
cucgggggccgacc

SEQ ID NO: 3059059 - RNA, 16 nt, Mycobacterium bovis subsp bovis AF2122/97
cucggggugcacgaug

SEQ ID NO: 3059060 - RNA, 14 nt, Mycobacterium bovis subsp bovis AF2122/97
cucggggugguggu

SEQ ID NO: 3059061 - RNA, 20 nt, Mycobacterium bovis subsp bovis AF2122/97
cucgggguuguucggcagcc

SEQ ID NO: 3059062 - RNA, 23 nt, Mycobacterium bovis subsp bovis AF2122/97
cucggguacaucgaggccacgcc

SEQ ID NO: 3059063 - RNA, 23 nt, Mycobacterium bovis subsp bovis AF2122/97
cucgggucaucuugccaccgcug

SEQ ID NO: 3059064 - RNA, 20 nt, Mycobacterium bovis subsp bovis AF2122/97
cucgggugcauucugcggca

SEQ ID NO: 3059065 - RNA, 16 nt, Mycobacterium bovis subsp bovis AF2122/97
cucgggugcgcccggc

SEQ ID NO: 3059066 - RNA, 15 nt, Mycobacterium bovis subsp bovis AF2122/97
cucggguggccagcg

SEQ ID NO: 3059067 - RNA, 16 nt, Mycobacterium bovis subsp bovis AF2122/97
cucgguaccaccggca

SEQ ID NO: 3059068 - RNA, 22 nt, Mycobacterium bovis subsp bovis AF2122/97
cucgguaccaccggcacgguga

SEQ ID NO: 3059069 - RNA, 18 nt, Mycobacterium bovis subsp bovis AF2122/97
cucgguagcauccagcgc

SEQ ID NO: 3059070 - RNA, 19 nt, Mycobacterium bovis subsp bovis AF2122/97
cucgguagcauccagcgcg

SEQ ID NO: 3059071 - RNA, 16 nt, Mycobacterium bovis subsp bovis AF2122/97
cucgguaggccggcaa

SEQ ID NO: 3059072 - RNA, 14 nt, Mycobacterium bovis subsp bovis AF2122/97
cucgguaggcggug

SEQ ID NO: 3059073 - RNA, 15 nt, Mycobacterium bovis subsp bovis AF2122/97
cucggucaccacggc

SEQ ID NO: 3059074 - RNA, 19 nt, Mycobacterium bovis subsp bovis AF2122/97
cucggucaccacggcggcg

SEQ ID NO: 3059075 - RNA, 16 nt, Mycobacterium bovis subsp bovis AF2122/97
cucggucagccccaug

SEQ ID NO: 3059076 - RNA, 18 nt, Mycobacterium bovis subsp bovis AF2122/97
cucggucagcgucaggug

SEQ ID NO: 3059077 - RNA, 14 nt, Mycobacterium bovis subsp bovis AF2122/97
cucggucagcucgu

SEQ ID NO: 3059078 - RNA, 15 nt, Mycobacterium bovis subsp bovis AF2122/97
cucggucagcucguc

SEQ ID NO: 3059079 - RNA, 16 nt, Mycobacterium bovis subsp bovis AF2122/97
cucggucagcucgucg

SEQ ID NO: 3059080 - RNA, 18 nt, Mycobacterium bovis subsp bovis AF2122/97
cucggucaggcggcuggc

SEQ ID NO: 3059081 - RNA, 23 nt, Mycobacterium bovis subsp bovis AF2122/97
cucggucaggcggcuggcccgca

SEQ ID NO: 3059082 - RNA, 16 nt, Mycobacterium bovis subsp bovis AF2122/97
cucggucccguugccg

SEQ ID NO: 3059083 - RNA, 20 nt, Mycobacterium bovis subsp bovis AF2122/97
cucggucccguugccgccca

SEQ ID NO: 3059084 - RNA, 12 nt, Mycobacterium bovis subsp bovis AF2122/97
cucggucgacgg

SEQ ID NO: 3059085 - RNA, 24 nt, Mycobacterium bovis subsp bovis AF2122/97
cucggucgaguagccguagccgcc

SEQ ID NO: 3059086 - RNA, 12 nt, Mycobacterium bovis subsp bovis AF2122/97
cucggucgaugc

SEQ ID NO: 3059087 - RNA, 13 nt, Mycobacterium bovis subsp bovis AF2122/97
cucggucgaugcu

SEQ ID NO: 3059088 - RNA, 17 nt, Mycobacterium bovis subsp bovis AF2122/97
cucggucgccaccgccg

SEQ ID NO: 3059089 - RNA, 20 nt, Mycobacterium bovis subsp bovis AF2122/97
cucggucggcagcuccagca

SEQ ID NO: 3059090 - RNA, 15 nt, Mycobacterium bovis subsp bovis AF2122/97
cucggugaacgccgc

SEQ ID NO: 3059091 - RNA, 16 nt, Mycobacterium bovis subsp bovis AF2122/97
cucggugaacgccgcc

SEQ ID NO: 3059092 - RNA, 22 nt, Mycobacterium bovis subsp bovis AF2122/97
cucggugaagauuccaugcgac

SEQ ID NO: 3059093 - RNA, 17 nt, Mycobacterium bovis subsp bovis AF2122/97
cucggugaaguggcgca

SEQ ID NO: 3059094 - RNA, 23 nt, Mycobacterium bovis subsp bovis AF2122/97
cucggugaaguggcgcaccaccu

SEQ ID NO: 3059095 - RNA, 16 nt, Mycobacterium bovis subsp bovis AF2122/97
cucggugacaagcggc

SEQ ID NO: 3059096 - RNA, 21 nt, Mycobacterium bovis subsp bovis AF2122/97
cucggugacaagcggcccgcu

SEQ ID NO: 3059097 - RNA, 14 nt, Mycobacterium bovis subsp bovis AF2122/97
cucggugaccaggc

SEQ ID NO: 3059098 - RNA, 19 nt, Mycobacterium bovis subsp bovis AF2122/97
cucggugaccaggccggcc

SEQ ID NO: 3059099 - RNA, 22 nt, Mycobacterium bovis subsp bovis AF2122/97
cucggugaccaggccggcccgc

SEQ ID NO: 3059100 - RNA, 23 nt, Mycobacterium bovis subsp bovis AF2122/97
cucggugaccaggccggcccgca

SEQ ID NO: 3059101 - RNA, 13 nt, Mycobacterium bovis subsp bovis AF2122/97
cucggugacgaug

SEQ ID NO: 3059102 - RNA, 14 nt, Mycobacterium bovis subsp bovis AF2122/97
cucggugacgauga

SEQ ID NO: 3059103 - RNA, 20 nt, Mycobacterium bovis subsp bovis AF2122/97
cucggugagcagcucgguga

SEQ ID NO: 3059104 - RNA, 17 nt, Mycobacterium bovis subsp bovis AF2122/97
cucggugaucaccauga

SEQ ID NO: 3059105 - RNA, 18 nt, Mycobacterium bovis subsp bovis AF2122/97
cucggugaucgcgguggc

SEQ ID NO: 3059106 - RNA, 18 nt, Mycobacterium bovis subsp bovis AF2122/97
cucggugaugcccagcgc

SEQ ID NO: 3059107 - RNA, 23 nt, Mycobacterium bovis subsp bovis AF2122/97
cucggugauguagggcugcuccu

SEQ ID NO: 3059108 - RNA, 16 nt, Mycobacterium bovis subsp bovis AF2122/97
cucggugaugucggug

SEQ ID NO: 3059109 - RNA, 11 nt, Mycobacterium bovis subsp bovis AF2122/97
cucggugcacg

SEQ ID NO: 3059110 - RNA, 15 nt, Mycobacterium bovis subsp bovis AF2122/97
cucggugcagcagcg

SEQ ID NO: 3059111 - RNA, 19 nt, Mycobacterium bovis subsp bovis AF2122/97
cucggugcagcagcgcgcg

SEQ ID NO: 3059112 - RNA, 18 nt, Mycobacterium bovis subsp bovis AF2122/97
cucggugccacugccggu

SEQ ID NO: 3059113 - RNA, 13 nt, Mycobacterium bovis subsp bovis AF2122/97
cucggugccggcc

SEQ ID NO: 3059114 - RNA, 14 nt, Mycobacterium bovis subsp bovis AF2122/97
cucggugccggccg

SEQ ID NO: 3059115 - RNA, 16 nt, Mycobacterium bovis subsp bovis AF2122/97
cucggugccggccgca

SEQ ID NO: 3059116 - RNA, 19 nt, Mycobacterium bovis subsp bovis AF2122/97
cucggugccugucagaagg

SEQ ID NO: 3059117 - RNA, 15 nt, Mycobacterium bovis subsp bovis AF2122/97
cucggugcgccagau

SEQ ID NO: 3059118 - RNA, 23 nt, Mycobacterium bovis subsp bovis AF2122/97
cucggugcgccagaucaccgucg

SEQ ID NO: 3059119 - RNA, 18 nt, Mycobacterium bovis subsp bovis AF2122/97
cucggugcggaacaccgc

SEQ ID NO: 3059120 - RNA, 20 nt, Mycobacterium bovis subsp bovis AF2122/97
cucggugcggaacaccgccc

SEQ ID NO: 3059121 - RNA, 19 nt, Mycobacterium bovis subsp bovis AF2122/97
cucggugcggugauuccag

SEQ ID NO: 3059122 - RNA, 19 nt, Mycobacterium bovis subsp bovis AF2122/97
cucggugcugcgccgauac

SEQ ID NO: 3059123 - RNA, 14 nt, Mycobacterium bovis subsp bovis AF2122/97
cucggugcuggcga

SEQ ID NO: 3059124 - RNA, 16 nt, Mycobacterium bovis subsp bovis AF2122/97
cucgguggccuucugg

SEQ ID NO: 3059125 - RNA, 12 nt, Mycobacterium bovis subsp bovis AF2122/97
cucgguggcgcc

SEQ ID NO: 3059126 - RNA, 14 nt, Mycobacterium bovis subsp bovis AF2122/97
cucgguggcggacg

SEQ ID NO: 3059127 - RNA, 18 nt, Mycobacterium bovis subsp bovis AF2122/97
cucgguguccucgaccgu

SEQ ID NO: 3059128 - RNA, 17 nt, Mycobacterium bovis subsp bovis AF2122/97
cucggugucggccgcgu

SEQ ID NO: 3059129 - RNA, 16 nt, Mycobacterium bovis subsp bovis AF2122/97
cucgguuagcugcucu

SEQ ID NO: 3059130 - RNA, 13 nt, Mycobacterium bovis subsp bovis AF2122/97
cucgguucgcccc

SEQ ID NO: 3059131 - RNA, 22 nt, Mycobacterium bovis subsp bovis AF2122/97
cucgguucggagucacgcagcc

SEQ ID NO: 3059132 - RNA, 23 nt, Mycobacterium bovis subsp bovis AF2122/97
cucgguucggagucacgcagccg

SEQ ID NO: 3059133 - RNA, 19 nt, Mycobacterium bovis subsp bovis AF2122/97
cucgguugguccucggcgg

SEQ ID NO: 3059134 - RNA, 15 nt, Mycobacterium bovis subsp bovis AF2122/97
cugaagagcggagcc

SEQ ID NO: 3059135 - RNA, 12 nt, Mycobacterium bovis subsp bovis AF2122/97
cugaagccagcg

SEQ ID NO: 3059136 - RNA, 15 nt, Mycobacterium bovis subsp bovis AF2122/97
cugaagccagcgcaa

SEQ ID NO: 3059137 - RNA, 16 nt, Mycobacterium bovis subsp bovis AF2122/97
cugaagccccuuggcg

SEQ ID NO: 3059138 - RNA, 21 nt, Mycobacterium bovis subsp bovis AF2122/97
cugaagccccuuggcgccacc

SEQ ID NO: 3059139 - RNA, 13 nt, Mycobacterium bovis subsp bovis AF2122/97
cugaagccgcgcu

SEQ ID NO: 3059140 - RNA, 19 nt, Mycobacterium bovis subsp bovis AF2122/97
cugaagccgcgcugcgacu

SEQ ID NO: 3059141 - RNA, 22 nt, Mycobacterium bovis subsp bovis AF2122/97
cugaagcggacccgacagccgc

SEQ ID NO: 3059142 - RNA, 19 nt, Mycobacterium bovis subsp bovis AF2122/97
cugaagcuguaggcgacca

SEQ ID NO: 3059143 - RNA, 21 nt, Mycobacterium bovis subsp bovis AF2122/97
cugaagcuguaggcgaccaga

SEQ ID NO: 3059144 - RNA, 20 nt, Mycobacterium bovis subsp bovis AF2122/97
cugaagcuuguccagauauc

SEQ ID NO: 3059145 - RNA, 17 nt, Mycobacterium bovis subsp bovis AF2122/97
cugaaggacggcagcuu

SEQ ID NO: 3059146 - RNA, 13 nt, Mycobacterium bovis subsp bovis AF2122/97
cugaaggccagcc

SEQ ID NO: 3059147 - RNA, 12 nt, Mycobacterium bovis subsp bovis AF2122/97
cugaaggccggu

SEQ ID NO: 3059148 - RNA, 21 nt, Mycobacterium bovis subsp bovis AF2122/97
cugaaggccgguagcgcgggu

SEQ ID NO: 3059149 - RNA, 14 nt, Mycobacterium bovis subsp bovis AF2122/97
cugaaggcggcgau

SEQ ID NO: 3059150 - RNA, 13 nt, Mycobacterium bovis subsp bovis AF2122/97
cugaagggccgcc

SEQ ID NO: 3059151 - RNA, 16 nt, Mycobacterium bovis subsp bovis AF2122/97
cugaagguggcgaacc

SEQ ID NO: 3059152 - RNA, 20 nt, Mycobacterium bovis subsp bovis AF2122/97
cugaagguggcgaacccggu

SEQ ID NO: 3059153 - RNA, 19 nt, Mycobacterium bovis subsp bovis AF2122/97
cugaaguggcacaagcugg

SEQ ID NO: 3059154 - RNA, 22 nt, Mycobacterium bovis subsp bovis AF2122/97
cugaaucgguucggccagaacg

SEQ ID NO: 3059155 - RNA, 18 nt, Mycobacterium bovis subsp bovis AF2122/97
cugaauucggcgagcgcc

SEQ ID NO: 3059156 - RNA, 15 nt, Mycobacterium bovis subsp bovis AF2122/97
cugaauuggcgccga

SEQ ID NO: 3059157 - RNA, 18 nt, Mycobacterium bovis subsp bovis AF2122/97
cugacaacgacaacaccc

SEQ ID NO: 3059158 - RNA, 20 nt, Mycobacterium bovis subsp bovis AF2122/97
cugacaaggguucaggucgg

SEQ ID NO: 3059159 - RNA, 18 nt, Mycobacterium bovis subsp bovis AF2122/97
cugacacaacaccggcgu

SEQ ID NO: 3059160 - RNA, 15 nt, Mycobacterium bovis subsp bovis AF2122/97
cugacacccaucgac

SEQ ID NO: 3059161 - RNA, 21 nt, Mycobacterium bovis subsp bovis AF2122/97
cugacacccaucgaccgcccg

SEQ ID NO: 3059162 - RNA, 16 nt, Mycobacterium bovis subsp bovis AF2122/97
cugacacccgcagcug

SEQ ID NO: 3059163 - RNA, 17 nt, Mycobacterium bovis subsp bovis AF2122/97
cugacaccgaaccgccg

SEQ ID NO: 3059164 - RNA, 20 nt, Mycobacterium bovis subsp bovis AF2122/97
cugacaccgaaccgccgcug

SEQ ID NO: 3059165 - RNA, 18 nt, Mycobacterium bovis subsp bovis AF2122/97
cugacaccgauccggccg

SEQ ID NO: 3059166 - RNA, 15 nt, Mycobacterium bovis subsp bovis AF2122/97
cugacacgcccgcga

SEQ ID NO: 3059167 - RNA, 21 nt, Mycobacterium bovis subsp bovis AF2122/97
cugacagaccgggcaccagaa

SEQ ID NO: 3059168 - RNA, 14 nt, Mycobacterium bovis subsp bovis AF2122/97
cugacaucggccaa

SEQ ID NO: 3059169 - RNA, 13 nt, Mycobacterium bovis subsp bovis AF2122/97
cugacauuuccac

SEQ ID NO: 3059170 - RNA, 22 nt, Mycobacterium bovis subsp bovis AF2122/97
cugaccaacauguugucgucgc

SEQ ID NO: 3059171 - RNA, 21 nt, Mycobacterium bovis subsp bovis AF2122/97
cugaccaacucguggaacucc

SEQ ID NO: 3059172 - RNA, 24 nt, Mycobacterium bovis subsp bovis AF2122/97
cugaccagccuuaugcagugacag

SEQ ID NO: 3059173 - RNA, 20 nt, Mycobacterium bovis subsp bovis AF2122/97
cugaccaggucugcggugcu

SEQ ID NO: 3059174 - RNA, 12 nt, Mycobacterium bovis subsp bovis AF2122/97
cugaccaucaca

SEQ ID NO: 3059175 - RNA, 14 nt, Mycobacterium bovis subsp bovis AF2122/97
cugaccaugaccgg

SEQ ID NO: 3059176 - RNA, 19 nt, Mycobacterium bovis subsp bovis AF2122/97
cugaccaugaccgggcugg

SEQ ID NO: 3059177 - RNA, 13 nt, Mycobacterium bovis subsp bovis AF2122/97
cugacccaccgcc

SEQ ID NO: 3059178 - RNA, 14 nt, Mycobacterium bovis subsp bovis AF2122/97
cugacccaccgccc

SEQ ID NO: 3059179 - RNA, 18 nt, Mycobacterium bovis subsp bovis AF2122/97
cugacccaccgccccggc

SEQ ID NO: 3059180 - RNA, 20 nt, Mycobacterium bovis subsp bovis AF2122/97
cugacccaccgccccggcgg

SEQ ID NO: 3059181 - RNA, 16 nt, Mycobacterium bovis subsp bovis AF2122/97
cugaccccccgacccc

SEQ ID NO: 3059182 - RNA, 18 nt, Mycobacterium bovis subsp bovis AF2122/97
cugacccccugacggcau

SEQ ID NO: 3059183 - RNA, 14 nt, Mycobacterium bovis subsp bovis AF2122/97
cugaccccgccggc

SEQ ID NO: 3059184 - RNA, 16 nt, Mycobacterium bovis subsp bovis AF2122/97
cugaccccgccggcug

SEQ ID NO: 3059185 - RNA, 15 nt, Mycobacterium bovis subsp bovis AF2122/97
cugaccccggcagcg

SEQ ID NO: 3059186 - RNA, 15 nt, Mycobacterium bovis subsp bovis AF2122/97
cugacccgcauaccg

SEQ ID NO: 3059187 - RNA, 23 nt, Mycobacterium bovis subsp bovis AF2122/97
cugacccggagccgccaggugcu

SEQ ID NO: 3059188 - RNA, 16 nt, Mycobacterium bovis subsp bovis AF2122/97
cugaccgaagaagccc

SEQ ID NO: 3059189 - RNA, 18 nt, Mycobacterium bovis subsp bovis AF2122/97
cugaccgaagaagcccga

SEQ ID NO: 3059190 - RNA, 19 nt, Mycobacterium bovis subsp bovis AF2122/97
cugaccgaagaagcccgac

SEQ ID NO: 3059191 - RNA, 17 nt, Mycobacterium bovis subsp bovis AF2122/97
cugaccgaauggccgcc

SEQ ID NO: 3059192 - RNA, 19 nt, Mycobacterium bovis subsp bovis AF2122/97
cugaccgaauggccgccgc

SEQ ID NO: 3059193 - RNA, 20 nt, Mycobacterium bovis subsp bovis AF2122/97
cugaccgaauggccgccgca

SEQ ID NO: 3059194 - RNA, 11 nt, Mycobacterium bovis subsp bovis AF2122/97
cugaccgccac

SEQ ID NO: 3059195 - RNA, 14 nt, Mycobacterium bovis subsp bovis AF2122/97
cugaccgccacccc

SEQ ID NO: 3059196 - RNA, 13 nt, Mycobacterium bovis subsp bovis AF2122/97
cugaccgccaccg

SEQ ID NO: 3059197 - RNA, 14 nt, Mycobacterium bovis subsp bovis AF2122/97
cugaccgccaccgu

SEQ ID NO: 3059198 - RNA, 12 nt, Mycobacterium bovis subsp bovis AF2122/97
cugaccgccagc

SEQ ID NO: 3059199 - RNA, 14 nt, Mycobacterium bovis subsp bovis AF2122/97
cugaccgccagcgg

SEQ ID NO: 3059200 - RNA, 19 nt, Mycobacterium bovis subsp bovis AF2122/97
cugaccgcgaucgccgacg

SEQ ID NO: 3059201 - RNA, 22 nt, Mycobacterium bovis subsp bovis AF2122/97
cugaccgcuaccagcugggcga

SEQ ID NO: 3059202 - RNA, 13 nt, Mycobacterium bovis subsp bovis AF2122/97
cugaccggcuauu

SEQ ID NO: 3059203 - RNA, 16 nt, Mycobacterium bovis subsp bovis AF2122/97
cugaccggcucgccgg

SEQ ID NO: 3059204 - RNA, 22 nt, Mycobacterium bovis subsp bovis AF2122/97
cugaccggcucgccggcgcgca

SEQ ID NO: 3059205 - RNA, 13 nt, Mycobacterium bovis subsp bovis AF2122/97
cugaccggggcgc

SEQ ID NO: 3059206 - RNA, 17 nt, Mycobacterium bovis subsp bovis AF2122/97
cugaccggggcgcccgg

SEQ ID NO: 3059207 - RNA, 18 nt, Mycobacterium bovis subsp bovis AF2122/97
cugaccggggcgcccggc

SEQ ID NO: 3059208 - RNA, 21 nt, Mycobacterium bovis subsp bovis AF2122/97
cugaccgucugcgacccgggc

SEQ ID NO: 3059209 - RNA, 13 nt, Mycobacterium bovis subsp bovis AF2122/97
cugaccgugcuga

SEQ ID NO: 3059210 - RNA, 17 nt, Mycobacterium bovis subsp bovis AF2122/97
cugaccucauguccgcc

SEQ ID NO: 3059211 - RNA, 21 nt, Mycobacterium bovis subsp bovis AF2122/97
cugaccucgucaaucaccacc

SEQ ID NO: 3059212 - RNA, 15 nt, Mycobacterium bovis subsp bovis AF2122/97
cugaccuucaggccc

SEQ ID NO: 3059213 - RNA, 19 nt, Mycobacterium bovis subsp bovis AF2122/97
cugaccuucaggcccugcc

SEQ ID NO: 3059214 - RNA, 19 nt, Mycobacterium bovis subsp bovis AF2122/97
cugacgaaauccgccgggc

SEQ ID NO: 3059215 - RNA, 21 nt, Mycobacterium bovis subsp bovis AF2122/97
cugacgaaauccgccgggcgc

SEQ ID NO: 3059216 - RNA, 20 nt, Mycobacterium bovis subsp bovis AF2122/97
cugacgaaggucuccggcaa

SEQ ID NO: 3059217 - RNA, 21 nt, Mycobacterium bovis subsp bovis AF2122/97
cugacgaaggucuccggcaag

SEQ ID NO: 3059218 - RNA, 20 nt, Mycobacterium bovis subsp bovis AF2122/97
cugacgaaguccaccacgac

SEQ ID NO: 3059219 - RNA, 22 nt, Mycobacterium bovis subsp bovis AF2122/97
cugacgaaucgccuaccggccu

SEQ ID NO: 3059220 - RNA, 18 nt, Mycobacterium bovis subsp bovis AF2122/97
cugacgaccaaccaccga

SEQ ID NO: 3059221 - RNA, 15 nt, Mycobacterium bovis subsp bovis AF2122/97
cugagcugccgagcg

SEQ ID NO: 3059222 - RNA, 15 nt, Mycobacterium bovis subsp bovis AF2122/97
cugagcugcucgccg

SEQ ID NO: 3059223 - RNA, 17 nt, Mycobacterium bovis subsp bovis AF2122/97
cugagcugcucgccggc

SEQ ID NO: 3059224 - RNA, 18 nt, Mycobacterium bovis subsp bovis AF2122/97
cugagcugcucgccggcc

SEQ ID NO: 3059225 - RNA, 22 nt, Mycobacterium bovis subsp bovis AF2122/97
cugagcugcucgccggccaacu

SEQ ID NO: 3059226 - RNA, 22 nt, Mycobacterium bovis subsp bovis AF2122/97
cugagcuuggucgccgggcagu

SEQ ID NO: 3059227 - RNA, 14 nt, Mycobacterium bovis subsp bovis AF2122/97
cugaggaacgccgg

SEQ ID NO: 3059228 - RNA, 16 nt, Mycobacterium bovis subsp bovis AF2122/97
cugaggaacgccggca

SEQ ID NO: 3059229 - RNA, 17 nt, Mycobacterium bovis subsp bovis AF2122/97
cugaggaacgccggcau

SEQ ID NO: 3059230 - RNA, 22 nt, Mycobacterium bovis subsp bovis AF2122/97
cugaggaacgccggcaucgcgc

SEQ ID NO: 3059231 - RNA, 12 nt, Mycobacterium bovis subsp bovis AF2122/97
cugaggcaccuc

SEQ ID NO: 3059232 - RNA, 18 nt, Mycobacterium bovis subsp bovis AF2122/97
cugagggcucgguggcgc

SEQ ID NO: 3059233 - RNA, 23 nt, Mycobacterium bovis subsp bovis AF2122/97
cugagggcucgguggcgccgggg

SEQ ID NO: 3059234 - RNA, 22 nt, Mycobacterium bovis subsp bovis AF2122/97
cugagguaggacucacgcagcg

SEQ ID NO: 3059235 - RNA, 19 nt, Mycobacterium bovis subsp bovis AF2122/97
cugaguccccaggugggca

SEQ ID NO: 3059236 - RNA, 23 nt, Mycobacterium bovis subsp bovis AF2122/97
cugaguccccaggugggcagcag

SEQ ID NO: 3059237 - RNA, 14 nt, Mycobacterium bovis subsp bovis AF2122/97
cugaguccggcacg

SEQ ID NO: 3059238 - RNA, 19 nt, Mycobacterium bovis subsp bovis AF2122/97
cugagucgguucagccacg

SEQ ID NO: 3059239 - RNA, 22 nt, Mycobacterium bovis subsp bovis AF2122/97
cugagucgguucagccacgcag

SEQ ID NO: 3059240 - RNA, 16 nt, Mycobacterium bovis subsp bovis AF2122/97
cugaguggcgaguggc

SEQ ID NO: 3059241 - RNA, 18 nt, Mycobacterium bovis subsp bovis AF2122/97
cugaguugcgggcuuuga

SEQ ID NO: 3059242 - RNA, 16 nt, Mycobacterium bovis subsp bovis AF2122/97
cugaguugcggugugc

SEQ ID NO: 3059243 - RNA, 16 nt, Mycobacterium bovis subsp bovis AF2122/97
cugauaaagcccggcg

SEQ ID NO: 3059244 - RNA, 20 nt, Mycobacterium bovis subsp bovis AF2122/97
cugauaccaauccggcugcg

SEQ ID NO: 3059245 - RNA, 14 nt, Mycobacterium bovis subsp bovis AF2122/97
cugauaguggcgcg

SEQ ID NO: 3059246 - RNA, 22 nt, Mycobacterium bovis subsp bovis AF2122/97
cugaucaagugccagcguggug

SEQ ID NO: 3059247 - RNA, 16 nt, Mycobacterium bovis subsp bovis AF2122/97
cugaucacucacccgg

SEQ ID NO: 3059248 - RNA, 18 nt, Mycobacterium bovis subsp bovis AF2122/97
cugaucagcaugcggcca

SEQ ID NO: 3059249 - RNA, 19 nt, Mycobacterium bovis subsp bovis AF2122/97
cugaucaggccgaugacga

SEQ ID NO: 3059250 - RNA, 21 nt, Mycobacterium bovis subsp bovis AF2122/97
cugauccacgauaucgaugcg

SEQ ID NO: 3059251 - RNA, 17 nt, Mycobacterium bovis subsp bovis AF2122/97
cugaucccggccaggcc

SEQ ID NO: 3059252 - RNA, 16 nt, Mycobacterium bovis subsp bovis AF2122/97
cugauccgggcgccga

SEQ ID NO: 3059253 - RNA, 20 nt, Mycobacterium bovis subsp bovis AF2122/97
cugauccggguggcgucacc

SEQ ID NO: 3059254 - RNA, 17 nt, Mycobacterium bovis subsp bovis AF2122/97
cugauccggugccgcga

SEQ ID NO: 3059255 - RNA, 22 nt, Mycobacterium bovis subsp bovis AF2122/97
cugauccggugccgcgaucgcg

SEQ ID NO: 3059256 - RNA, 19 nt, Mycobacterium bovis subsp bovis AF2122/97
cugauccucgaugacaucg

SEQ ID NO: 3059257 - RNA, 20 nt, Mycobacterium bovis subsp bovis AF2122/97
cugaucgaccgccuccucga

SEQ ID NO: 3059258 - RNA, 16 nt, Mycobacterium bovis subsp bovis AF2122/97
cugaucgccacccggu

SEQ ID NO: 3059259 - RNA, 19 nt, Mycobacterium bovis subsp bovis AF2122/97
cugaucgcgauccacccgg

SEQ ID NO: 3059260 - RNA, 13 nt, Mycobacterium bovis subsp bovis AF2122/97
cugaucggcgcgg

SEQ ID NO: 3059261 - RNA, 15 nt, Mycobacterium bovis subsp bovis AF2122/97
cugaucggcuucuuc

SEQ ID NO: 3059262 - RNA, 23 nt, Mycobacterium bovis subsp bovis AF2122/97
cugaucggugggcgggugcgcga

SEQ ID NO: 3059263 - RNA, 22 nt, Mycobacterium bovis subsp bovis AF2122/97
cugaucgugaacacgucgcggu

SEQ ID NO: 3059264 - RNA, 17 nt, Mycobacterium bovis subsp bovis AF2122/97
cugaucugccgccgcgg

SEQ ID NO: 3059265 - RNA, 14 nt, Mycobacterium bovis subsp bovis AF2122/97
cugaucugcguugc

SEQ ID NO: 3059266 - RNA, 16 nt, Mycobacterium bovis subsp bovis AF2122/97
cugaucuggggcacca

SEQ ID NO: 3059267 - RNA, 18 nt, Mycobacterium bovis subsp bovis AF2122/97
cugaucuuccccucggcc

SEQ ID NO: 3059268 - RNA, 19 nt, Mycobacterium bovis subsp bovis AF2122/97
cugaucuuccccucggccg

SEQ ID NO: 3059269 - RNA, 19 nt, Mycobacterium bovis subsp bovis AF2122/97
cugaucuucgagccggcgg

SEQ ID NO: 3059270 - RNA, 23 nt, Mycobacterium bovis subsp bovis AF2122/97
cugaucuuggagaagguuucccg

SEQ ID NO: 3059271 - RNA, 19 nt, Mycobacterium bovis subsp bovis AF2122/97
cugaugaaccacggcaggc

SEQ ID NO: 3059272 - RNA, 21 nt, Mycobacterium bovis subsp bovis AF2122/97
cugaugaaccacggcaggcag

SEQ ID NO: 3059273 - RNA, 14 nt, Mycobacterium bovis subsp bovis AF2122/97
cugaugaagaugau

SEQ ID NO: 3059274 - RNA, 21 nt, Mycobacterium bovis subsp bovis AF2122/97
cugaugaccguauagccgacg

SEQ ID NO: 3059275 - RNA, 16 nt, Mycobacterium bovis subsp bovis AF2122/97
cugaugagcucaccgg

SEQ ID NO: 3059276 - RNA, 15 nt, Mycobacterium bovis subsp bovis AF2122/97
cugaugcagggcccg

SEQ ID NO: 3059277 - RNA, 16 nt, Mycobacterium bovis subsp bovis AF2122/97
cugaugcaucccaacg

SEQ ID NO: 3059278 - RNA, 12 nt, Mycobacterium bovis subsp bovis AF2122/97
cugaugccuggu

SEQ ID NO: 3059279 - RNA, 14 nt, Mycobacterium bovis subsp bovis AF2122/97
cugaugccuggucg

SEQ ID NO: 3059280 - RNA, 17 nt, Mycobacterium bovis subsp bovis AF2122/97
cugaugccuggucgcgg

SEQ ID NO: 3059281 - RNA, 16 nt, Mycobacterium bovis subsp bovis AF2122/97
cugaugcgcugggcca

SEQ ID NO: 3059282 - RNA, 23 nt, Mycobacterium bovis subsp bovis AF2122/97
cugaugcgguagucgccgagguc

SEQ ID NO: 3059283 - RNA, 21 nt, Mycobacterium bovis subsp bovis AF2122/97
cugaugcguugauacgcgucg

SEQ ID NO: 3059284 - RNA, 22 nt, Mycobacterium bovis subsp bovis AF2122/97
cugaugcguugauacgcgucga

SEQ ID NO: 3059285 - RNA, 14 nt, Mycobacterium bovis subsp bovis AF2122/97
cugaugcucuggga

SEQ ID NO: 3059286 - RNA, 12 nt, Mycobacterium bovis subsp bovis AF2122/97
cugaugcuggcc

SEQ ID NO: 3059287 - RNA, 14 nt, Mycobacterium bovis subsp bovis AF2122/97
cugauggacggugc

SEQ ID NO: 3059288 - RNA, 16 nt, Mycobacterium bovis subsp bovis AF2122/97
cugauggacggugcgc

SEQ ID NO: 3059289 - RNA, 17 nt, Mycobacterium bovis subsp bovis AF2122/97
cugauggcgcugcaccg

SEQ ID NO: 3059290 - RNA, 17 nt, Mycobacterium bovis subsp bovis AF2122/97
cugaugggcgaauugca

SEQ ID NO: 3059291 - RNA, 13 nt, Mycobacterium bovis subsp bovis AF2122/97
cugaugggucagg

SEQ ID NO: 3059292 - RNA, 19 nt, Mycobacterium bovis subsp bovis AF2122/97
cugaugggucaggccgacg

SEQ ID NO: 3059293 - RNA, 21 nt, Mycobacterium bovis subsp bovis AF2122/97
cugauggugccgaaccggcgc

SEQ ID NO: 3059294 - RNA, 22 nt, Mycobacterium bovis subsp bovis AF2122/97
cugauggugccgaaccggcgca

SEQ ID NO: 3059295 - RNA, 20 nt, Mycobacterium bovis subsp bovis AF2122/97
cugaugguguacacgucgcg

SEQ ID NO: 3059296 - RNA, 23 nt, Mycobacterium bovis subsp bovis AF2122/97
cugaugucgggaaggugacgcuc

SEQ ID NO: 3059297 - RNA, 17 nt, Mycobacterium bovis subsp bovis AF2122/97
cugaugugaguccagcc

SEQ ID NO: 3059298 - RNA, 19 nt, Mycobacterium bovis subsp bovis AF2122/97
cugaugugaguccagccgg

SEQ ID NO: 3059299 - RNA, 14 nt, Mycobacterium bovis subsp bovis AF2122/97
cugauguucugcgg

SEQ ID NO: 3059300 - RNA, 17 nt, Mycobacterium bovis subsp bovis AF2122/97
cugauuccacugggccu

SEQ ID NO: 3059301 - RNA, 21 nt, Mycobacterium bovis subsp bovis AF2122/97
cugauuccacugggccugcca

SEQ ID NO: 3059302 - RNA, 21 nt, Mycobacterium bovis subsp bovis AF2122/97
cugauucgcaggcucagcugg

SEQ ID NO: 3059303 - RNA, 14 nt, Mycobacterium bovis subsp bovis AF2122/97
cugauugaagcccc

SEQ ID NO: 3059304 - RNA, 19 nt, Mycobacterium bovis subsp bovis AF2122/97
cugauugagguagaccugg

SEQ ID NO: 3059305 - RNA, 16 nt, Mycobacterium bovis subsp bovis AF2122/97
cugauuggcccaccgc

SEQ ID NO: 3059306 - RNA, 17 nt, Mycobacterium bovis subsp bovis AF2122/97
cugauuggcccaccgcc

SEQ ID NO: 3059307 - RNA, 13 nt, Mycobacterium bovis subsp bovis AF2122/97
cugcaggcggccu

SEQ ID NO: 3059308 - RNA, 18 nt, Mycobacterium bovis subsp bovis AF2122/97
cugcaggcggccuugccg

SEQ ID NO: 3059309 - RNA, 21 nt, Mycobacterium bovis subsp bovis AF2122/97
cugcaggcugucgagucgguc

SEQ ID NO: 3059310 - RNA, 15 nt, Mycobacterium bovis subsp bovis AF2122/97
cugcagggccuggcc

SEQ ID NO: 3059311 - RNA, 13 nt, Mycobacterium bovis subsp bovis AF2122/97
cugcagggcguga

SEQ ID NO: 3059312 - RNA, 14 nt, Mycobacterium bovis subsp bovis AF2122/97
cugcagggcgugau

SEQ ID NO: 3059313 - RNA, 12 nt, Mycobacterium bovis subsp bovis AF2122/97
cugcagggucga

SEQ ID NO: 3059314 - RNA, 15 nt, Mycobacterium bovis subsp bovis AF2122/97
cugcagggucgaguu

SEQ ID NO: 3059315 - RNA, 16 nt, Mycobacterium bovis subsp bovis AF2122/97
cugcagguccagggug

SEQ ID NO: 3059316 - RNA, 20 nt, Mycobacterium bovis subsp bovis AF2122/97
cugcagguuaggguccaggu

SEQ ID NO: 3059317 - RNA, 22 nt, Mycobacterium bovis subsp bovis AF2122/97
cugcagguugguaauccgggca

SEQ ID NO: 3059318 - RNA, 20 nt, Mycobacterium bovis subsp bovis AF2122/97
cugcagguuguuucguucga

SEQ ID NO: 3059319 - RNA, 17 nt, Mycobacterium bovis subsp bovis AF2122/97
cugcagguuuccggccu

SEQ ID NO: 3059320 - RNA, 14 nt, Mycobacterium bovis subsp bovis AF2122/97
cugcaguacggcca

SEQ ID NO: 3059321 - RNA, 20 nt, Mycobacterium bovis subsp bovis AF2122/97
cugcaguaguagcgcaaccg

SEQ ID NO: 3059322 - RNA, 13 nt, Mycobacterium bovis subsp bovis AF2122/97
cugcagucagcuc

SEQ ID NO: 3059323 - RNA, 18 nt, Mycobacterium bovis subsp bovis AF2122/97
cugcagugacucgaucac

SEQ ID NO: 3059324 - RNA, 23 nt, Mycobacterium bovis subsp bovis AF2122/97
cugcagugacucgaucaccauga

SEQ ID NO: 3059325 - RNA, 13 nt, Mycobacterium bovis subsp bovis AF2122/97
cugcagugaucgu

SEQ ID NO: 3059326 - RNA, 15 nt, Mycobacterium bovis subsp bovis AF2122/97
cugcagugcagcgau

SEQ ID NO: 3059327 - RNA, 17 nt, Mycobacterium bovis subsp bovis AF2122/97
cugcagugccgugucca

SEQ ID NO: 3059328 - RNA, 16 nt, Mycobacterium bovis subsp bovis AF2122/97
cugcagugcggcguua

SEQ ID NO: 3059329 - RNA, 14 nt, Mycobacterium bovis subsp bovis AF2122/97
cugcauaggcgcgg

SEQ ID NO: 3059330 - RNA, 19 nt, Mycobacterium bovis subsp bovis AF2122/97
cugcauaggcgcggucacc

SEQ ID NO: 3059331 - RNA, 13 nt, Mycobacterium bovis subsp bovis AF2122/97
cugcauccuccuc

SEQ ID NO: 3059332 - RNA, 14 nt, Mycobacterium bovis subsp bovis AF2122/97
cugcauccuccucg

SEQ ID NO: 3059333 - RNA, 16 nt, Mycobacterium bovis subsp bovis AF2122/97
cugcauccuccucguc

SEQ ID NO: 3059334 - RNA, 18 nt, Mycobacterium bovis subsp bovis AF2122/97
cugcauccuccucgucga

SEQ ID NO: 3059335 - RNA, 20 nt, Mycobacterium bovis subsp bovis AF2122/97
cugcaugaacugcucgccga

SEQ ID NO: 3059336 - RNA, 13 nt, Mycobacterium bovis subsp bovis AF2122/97
cugcaugcccaga

SEQ ID NO: 3059337 - RNA, 17 nt, Mycobacterium bovis subsp bovis AF2122/97
cugcaugguggcgccga

SEQ ID NO: 3059338 - RNA, 20 nt, Mycobacterium bovis subsp bovis AF2122/97
cugccaaacuaacggcagcc

SEQ ID NO: 3059339 - RNA, 15 nt, Mycobacterium bovis subsp bovis AF2122/97
cugccaaggccuuca

SEQ ID NO: 3059340 - RNA, 18 nt, Mycobacterium bovis subsp bovis AF2122/97
cugccaaucugcacgcgc

SEQ ID NO: 3059341 - RNA, 18 nt, Mycobacterium bovis subsp bovis AF2122/97
cugccacacaggcgucca

SEQ ID NO: 3059342 - RNA, 13 nt, Mycobacterium bovis subsp bovis AF2122/97
cugccaccagaca

SEQ ID NO: 3059343 - RNA, 19 nt, Mycobacterium bovis subsp bovis AF2122/97
cugccaccagacaacgccg

SEQ ID NO: 3059344 - RNA, 23 nt, Mycobacterium bovis subsp bovis AF2122/97
cugccaccagacaacgccgucga

SEQ ID NO: 3059345 - RNA, 14 nt, Mycobacterium bovis subsp bovis AF2122/97
cugccacccagcac

SEQ ID NO: 3059346 - RNA, 20 nt, Mycobacterium bovis subsp bovis AF2122/97
cugccaccgcgggcggcauc

SEQ ID NO: 3059347 - RNA, 17 nt, Mycobacterium bovis subsp bovis AF2122/97
cugccaccgcgguggcg

SEQ ID NO: 3059348 - RNA, 17 nt, Mycobacterium bovis subsp bovis AF2122/97
cugccaccgugugcacg

SEQ ID NO: 3059349 - RNA, 19 nt, Mycobacterium bovis subsp bovis AF2122/97
cugccaccucuaccggugg

SEQ ID NO: 3059350 - RNA, 18 nt, Mycobacterium bovis subsp bovis AF2122/97
cugccacgaacgcuucca

SEQ ID NO: 3059351 - RNA, 20 nt, Mycobacterium bovis subsp bovis AF2122/97
cugccacgaacgcuuccagc

SEQ ID NO: 3059352 - RNA, 18 nt, Mycobacterium bovis subsp bovis AF2122/97
cugccacgaggcaucguc

SEQ ID NO: 3059353 - RNA, 22 nt, Mycobacterium bovis subsp bovis AF2122/97
cugccacuagcauugucgccgg

SEQ ID NO: 3059354 - RNA, 15 nt, Mycobacterium bovis subsp bovis AF2122/97
cugccagaaugggcg

SEQ ID NO: 3059355 - RNA, 19 nt, Mycobacterium bovis subsp bovis AF2122/97
cugccagagaucagcaccc

SEQ ID NO: 3059356 - RNA, 14 nt, Mycobacterium bovis subsp bovis AF2122/97
cugccagaucgguc

SEQ ID NO: 3059357 - RNA, 20 nt, Mycobacterium bovis subsp bovis AF2122/97
cugccagaucggucggccaa

SEQ ID NO: 3059358 - RNA, 24 nt, Mycobacterium bovis subsp bovis AF2122/97
cugccagcauugacccgacgaugc

SEQ ID NO: 3059359 - RNA, 13 nt, Mycobacterium bovis subsp bovis AF2122/97
cugccagccaugg

SEQ ID NO: 3059360 - RNA, 19 nt, Mycobacterium bovis subsp bovis AF2122/97
cugccagcgccgccgccga

SEQ ID NO: 3059361 - RNA, 21 nt, Mycobacterium bovis subsp bovis AF2122/97
cugccagcgccgccgccgacg

SEQ ID NO: 3059362 - RNA, 16 nt, Mycobacterium bovis subsp bovis AF2122/97
cugccagcggccgggc

SEQ ID NO: 3059363 - RNA, 22 nt, Mycobacterium bovis subsp bovis AF2122/97
cugccagcguugcggagaugcc

SEQ ID NO: 3059364 - RNA, 19 nt, Mycobacterium bovis subsp bovis AF2122/97
cugccagggugcgccgguc

SEQ ID NO: 3059365 - RNA, 15 nt, Mycobacterium bovis subsp bovis AF2122/97
cugccagugccgccc

SEQ ID NO: 3059366 - RNA, 16 nt, Mycobacterium bovis subsp bovis AF2122/97
cugccagugccgccca

SEQ ID NO: 3059367 - RNA, 16 nt, Mycobacterium bovis subsp bovis AF2122/97
cugccagugggccgac

SEQ ID NO: 3059368 - RNA, 17 nt, Mycobacterium bovis subsp bovis AF2122/97
cugccagugggccgacg

SEQ ID NO: 3059369 - RNA, 21 nt, Mycobacterium bovis subsp bovis AF2122/97
cugccagugggccgacgugac

SEQ ID NO: 3059370 - RNA, 14 nt, Mycobacterium bovis subsp bovis AF2122/97
cugccaucaacagg

SEQ ID NO: 3059371 - RNA, 19 nt, Mycobacterium bovis subsp bovis AF2122/97
cugccaucccgaucccggc

SEQ ID NO: 3059372 - RNA, 14 nt, Mycobacterium bovis subsp bovis AF2122/97
cugccaucggcacc

SEQ ID NO: 3059373 - RNA, 18 nt, Mycobacterium bovis subsp bovis AF2122/97
cugccaucuccggugugu

SEQ ID NO: 3059374 - RNA, 18 nt, Mycobacterium bovis subsp bovis AF2122/97
cugccaucuggguccguc

SEQ ID NO: 3059375 - RNA, 18 nt, Mycobacterium bovis subsp bovis AF2122/97
cugccauugccgcaugcu

SEQ ID NO: 3059376 - RNA, 13 nt, Mycobacterium bovis subsp bovis AF2122/97
cugccauugccug

SEQ ID NO: 3059377 - RNA, 16 nt, Mycobacterium bovis subsp bovis AF2122/97
cugccauugccugggc

SEQ ID NO: 3059378 - RNA, 21 nt, Mycobacterium bovis subsp bovis AF2122/97
cugccauugccugggcgaccg

SEQ ID NO: 3059379 - RNA, 18 nt, Mycobacterium bovis subsp bovis AF2122/97
cugcccaaaaggaagacc

SEQ ID NO: 3059380 - RNA, 22 nt, Mycobacterium bovis subsp bovis AF2122/97
cugcccaacggaagaccgcggg

SEQ ID NO: 3059381 - RNA, 11 nt, Mycobacterium bovis subsp bovis AF2122/97
cugcccaccau

SEQ ID NO: 3059382 - RNA, 13 nt, Mycobacterium bovis subsp bovis AF2122/97
cugcccaccaucc

SEQ ID NO: 3059383 - RNA, 23 nt, Mycobacterium bovis subsp bovis AF2122/97
cugcccacgcggauaucuugcgc

SEQ ID NO: 3059384 - RNA, 14 nt, Mycobacterium bovis subsp bovis AF2122/97
cugcccagcaccac

SEQ ID NO: 3059385 - RNA, 17 nt, Mycobacterium bovis subsp bovis AF2122/97
cugcccagcaccaccgc

SEQ ID NO: 3059386 - RNA, 16 nt, Mycobacterium bovis subsp bovis AF2122/97
cugcccagcacccccu

SEQ ID NO: 3059387 - RNA, 12 nt, Mycobacterium bovis subsp bovis AF2122/97
cugcccagcaga

SEQ ID NO: 3059388 - RNA, 17 nt, Mycobacterium bovis subsp bovis AF2122/97
cugcccagcagaccaag

SEQ ID NO: 3059389 - RNA, 22 nt, Mycobacterium bovis subsp bovis AF2122/97
cugcccagcgguugccgucugc

SEQ ID NO: 3059390 - RNA, 19 nt, Mycobacterium bovis subsp bovis AF2122/97
cugcccagcgucaucccga

SEQ ID NO: 3059391 - RNA, 20 nt, Mycobacterium bovis subsp bovis AF2122/97
cugcccaggcaaaccgauca

SEQ ID NO: 3059392 - RNA, 15 nt, Mycobacterium bovis subsp bovis AF2122/97
cugcccaugcggcag

SEQ ID NO: 3059393 - RNA, 13 nt, Mycobacterium bovis subsp bovis AF2122/97
cugccccagcaca

SEQ ID NO: 3059394 - RNA, 21 nt, Mycobacterium bovis subsp bovis AF2122/97
cugccgcgggcagcguguaac

SEQ ID NO: 3059395 - RNA, 22 nt, Mycobacterium bovis subsp bovis AF2122/97
cugccgcguagaacccaggccg

SEQ ID NO: 3059396 - RNA, 20 nt, Mycobacterium bovis subsp bovis AF2122/97
cugccgcucgaccccgcgcu

SEQ ID NO: 3059397 - RNA, 14 nt, Mycobacterium bovis subsp bovis AF2122/97
cugccgcucgccgg

SEQ ID NO: 3059398 - RNA, 19 nt, Mycobacterium bovis subsp bovis AF2122/97
cugccgcucgccgguaggc

SEQ ID NO: 3059399 - RNA, 23 nt, Mycobacterium bovis subsp bovis AF2122/97
cugccgcugccgaagcggccacc

SEQ ID NO: 3059400 - RNA, 13 nt, Mycobacterium bovis subsp bovis AF2122/97
cugccgcugcgcc

SEQ ID NO: 3059401 - RNA, 14 nt, Mycobacterium bovis subsp bovis AF2122/97
cugccgcugcgccg

SEQ ID NO: 3059402 - RNA, 12 nt, Mycobacterium bovis subsp bovis AF2122/97
cugccgcugguc

SEQ ID NO: 3059403 - RNA, 21 nt, Mycobacterium bovis subsp bovis AF2122/97
cugccgcuguucggucuugcc

SEQ ID NO: 3059404 - RNA, 15 nt, Mycobacterium bovis subsp bovis AF2122/97
cugccggaccgcgga

SEQ ID NO: 3059405 - RNA, 20 nt, Mycobacterium bovis subsp bovis AF2122/97
cugccggacuaccgccggcg

SEQ ID NO: 3059406 - RNA, 18 nt, Mycobacterium bovis subsp bovis AF2122/97
cugccggcaacagcucgc

SEQ ID NO: 3059407 - RNA, 12 nt, Mycobacterium bovis subsp bovis AF2122/97
cugccggcacca

SEQ ID NO: 3059408 - RNA, 19 nt, Mycobacterium bovis subsp bovis AF2122/97
cugccggcaccaaccaccg

SEQ ID NO: 3059409 - RNA, 12 nt, Mycobacterium bovis subsp bovis AF2122/97
cugccggcacgc

SEQ ID NO: 3059410 - RNA, 19 nt, Mycobacterium bovis subsp bovis AF2122/97
cugccggcagcgcccccgg

SEQ ID NO: 3059411 - RNA, 16 nt, Mycobacterium bovis subsp bovis AF2122/97
cugccggcagcggcga

SEQ ID NO: 3059412 - RNA, 22 nt, Mycobacterium bovis subsp bovis AF2122/97
cugccggcagcggcgcucggcg

SEQ ID NO: 3059413 - RNA, 21 nt, Mycobacterium bovis subsp bovis AF2122/97
cugccggcagcguccgaacca

SEQ ID NO: 3059414 - RNA, 15 nt, Mycobacterium bovis subsp bovis AF2122/97
cugccggccggcggg

SEQ ID NO: 3059415 - RNA, 14 nt, Mycobacterium bovis subsp bovis AF2122/97
cugccggcgccgcc

SEQ ID NO: 3059416 - RNA, 15 nt, Mycobacterium bovis subsp bovis AF2122/97
cugccggcgccgcca

SEQ ID NO: 3059417 - RNA, 16 nt, Mycobacterium bovis subsp bovis AF2122/97
cugccggcgccgccac

SEQ ID NO: 3059418 - RNA, 18 nt, Mycobacterium bovis subsp bovis AF2122/97
cugccggcugacgaccaa

SEQ ID NO: 3059419 - RNA, 14 nt, Mycobacterium bovis subsp bovis AF2122/97
cugccgguaccggc

SEQ ID NO: 3059420 - RNA, 22 nt, Mycobacterium bovis subsp bovis AF2122/97
cugccgguagcacagcagcaac

SEQ ID NO: 3059421 - RNA, 15 nt, Mycobacterium bovis subsp bovis AF2122/97
cugccggucgauguc

SEQ ID NO: 3059422 - RNA, 17 nt, Mycobacterium bovis subsp bovis AF2122/97
cugccggucgaugucgg

SEQ ID NO: 3059423 - RNA, 13 nt, Mycobacterium bovis subsp bovis AF2122/97
cugccggugcuga

SEQ ID NO: 3059424 - RNA, 18 nt, Mycobacterium bovis subsp bovis AF2122/97
cugccgguggcggcggcg

SEQ ID NO: 3059425 - RNA, 21 nt, Mycobacterium bovis subsp bovis AF2122/97
cugccgguggcggcggcggca

SEQ ID NO: 3059426 - RNA, 22 nt, Mycobacterium bovis subsp bovis AF2122/97
cugccgguggcggcggcggcaa

SEQ ID NO: 3059427 - RNA, 14 nt, Mycobacterium bovis subsp bovis AF2122/97
cugccggugggcgu

SEQ ID NO: 3059428 - RNA, 22 nt, Mycobacterium bovis subsp bovis AF2122/97
cugccggugggcguucccccgg

SEQ ID NO: 3059429 - RNA, 20 nt, Mycobacterium bovis subsp bovis AF2122/97
cugccggugugcggcguacu

SEQ ID NO: 3059430 - RNA, 16 nt, Mycobacterium bovis subsp bovis AF2122/97
cugccguggcggcagc

SEQ ID NO: 3059431 - RNA, 17 nt, Mycobacterium bovis subsp bovis AF2122/97
cugccguggcggcagcg

SEQ ID NO: 3059432 - RNA, 22 nt, Mycobacterium bovis subsp bovis AF2122/97
cugccguggcggcagcggugcu

SEQ ID NO: 3059433 - RNA, 15 nt, Mycobacterium bovis subsp bovis AF2122/97
cugccguucagcggc

SEQ ID NO: 3059434 - RNA, 19 nt, Mycobacterium bovis subsp bovis AF2122/97
cugccguuccagcaucggu

SEQ ID NO: 3059435 - RNA, 16 nt, Mycobacterium bovis subsp bovis AF2122/97
cugccguucggggcgc

SEQ ID NO: 3059436 - RNA, 23 nt, Mycobacterium bovis subsp bovis AF2122/97
cugccguucggggcgcgguaccg

SEQ ID NO: 3059437 - RNA, 19 nt, Mycobacterium bovis subsp bovis AF2122/97
cugccguugauucggccgc

SEQ ID NO: 3059438 - RNA, 23 nt, Mycobacterium bovis subsp bovis AF2122/97
cugccguugauucggccgccgac

SEQ ID NO: 3059439 - RNA, 16 nt, Mycobacterium bovis subsp bovis AF2122/97
cugccguugccgccgg

SEQ ID NO: 3059440 - RNA, 12 nt, Mycobacterium bovis subsp bovis AF2122/97
cugccucaccgc

SEQ ID NO: 3059441 - RNA, 17 nt, Mycobacterium bovis subsp bovis AF2122/97
cugccucaccgccgcua

SEQ ID NO: 3059442 - RNA, 15 nt, Mycobacterium bovis subsp bovis AF2122/97
cugccucagaccgga

SEQ ID NO: 3059443 - RNA, 18 nt, Mycobacterium bovis subsp bovis AF2122/97
cugccuccggaaggcucg

SEQ ID NO: 3059444 - RNA, 21 nt, Mycobacterium bovis subsp bovis AF2122/97
cugccucgccugcacgcccgg

SEQ ID NO: 3059445 - RNA, 18 nt, Mycobacterium bovis subsp bovis AF2122/97
cugccucucagcacgguu

SEQ ID NO: 3059446 - RNA, 13 nt, Mycobacterium bovis subsp bovis AF2122/97
cugccugcgcacg

SEQ ID NO: 3059447 - RNA, 12 nt, Mycobacterium bovis subsp bovis AF2122/97
cugccuggccgg

SEQ ID NO: 3059448 - RNA, 17 nt, Mycobacterium bovis subsp bovis AF2122/97
cugccuggccgggaccg

SEQ ID NO: 3059449 - RNA, 13 nt, Mycobacterium bovis subsp bovis AF2122/97
cugccuuacacgc

SEQ ID NO: 3059450 - RNA, 19 nt, Mycobacterium bovis subsp bovis AF2122/97
cugccuuacacgccuggcu

SEQ ID NO: 3059451 - RNA, 15 nt, Mycobacterium bovis subsp bovis AF2122/97
cugccuuaccaaccg

SEQ ID NO: 3059452 - RNA, 15 nt, Mycobacterium bovis subsp bovis AF2122/97
cugccuucuaccgaa

SEQ ID NO: 3059453 - RNA, 15 nt, Mycobacterium bovis subsp bovis AF2122/97
cugccuucuccagag

SEQ ID NO: 3059454 - RNA, 19 nt, Mycobacterium bovis subsp bovis AF2122/97
cugccuugauugccgcgua

SEQ ID NO: 3059455 - RNA, 13 nt, Mycobacterium bovis subsp bovis AF2122/97
cugccuuggccgg

SEQ ID NO: 3059456 - RNA, 18 nt, Mycobacterium bovis subsp bovis AF2122/97
cugccuuggccggcuugu

SEQ ID NO: 3059457 - RNA, 15 nt, Mycobacterium bovis subsp bovis AF2122/97
cugccuuggcgcggc

SEQ ID NO: 3059458 - RNA, 17 nt, Mycobacterium bovis subsp bovis AF2122/97
cugcgaaaauccgugcc

SEQ ID NO: 3059459 - RNA, 13 nt, Mycobacterium bovis subsp bovis AF2122/97
cugcgaaacgcca

SEQ ID NO: 3059460 - RNA, 16 nt, Mycobacterium bovis subsp bovis AF2122/97
cugcgaacccugcgca

SEQ ID NO: 3059461 - RNA, 16 nt, Mycobacterium bovis subsp bovis AF2122/97
cugcgaagucgcaugg

SEQ ID NO: 3059462 - RNA, 17 nt, Mycobacterium bovis subsp bovis AF2122/97
cugcgaaucuccgcgcg

SEQ ID NO: 3059463 - RNA, 18 nt, Mycobacterium bovis subsp bovis AF2122/97
cugcgaaucuccgcgcgg

SEQ ID NO: 3059464 - RNA, 16 nt, Mycobacterium bovis subsp bovis AF2122/97
cugcgaaugcugggcc

SEQ ID NO: 3059465 - RNA, 20 nt, Mycobacterium bovis subsp bovis AF2122/97
cugcgaaugcugggcccgcc

SEQ ID NO: 3059466 - RNA, 16 nt, Mycobacterium bovis subsp bovis AF2122/97
cugcgacaagaccggc

SEQ ID NO: 3059467 - RNA, 18 nt, Mycobacterium bovis subsp bovis AF2122/97
cugcgacaagaccggcgg

SEQ ID NO: 3059468 - RNA, 15 nt, Mycobacterium bovis subsp bovis AF2122/97
cugcgacacaacggg

SEQ ID NO: 3059469 - RNA, 13 nt, Mycobacterium bovis subsp bovis AF2122/97
cugcgacaccacg

SEQ ID NO: 3059470 - RNA, 17 nt, Mycobacterium bovis subsp bovis AF2122/97
cugcgacagcacgugcc

SEQ ID NO: 3059471 - RNA, 22 nt, Mycobacterium bovis subsp bovis AF2122/97
cugcgaccaggcgcggcgacaa

SEQ ID NO: 3059472 - RNA, 16 nt, Mycobacterium bovis subsp bovis AF2122/97
cugcgacccgggccgc

SEQ ID NO: 3059473 - RNA, 19 nt, Mycobacterium bovis subsp bovis AF2122/97
cugcgacccgggccgcggc

SEQ ID NO: 3059474 - RNA, 14 nt, Mycobacterium bovis subsp bovis AF2122/97
cugcgaccucgccg

SEQ ID NO: 3059475 - RNA, 22 nt, Mycobacterium bovis subsp bovis AF2122/97
cugcgaccucgccggacgggug

SEQ ID NO: 3059476 - RNA, 17 nt, Mycobacterium bovis subsp bovis AF2122/97
cugcgacgagcccaccg

SEQ ID NO: 3059477 - RNA, 16 nt, Mycobacterium bovis subsp bovis AF2122/97
cugcgacgaugccgcc

SEQ ID NO: 3059478 - RNA, 21 nt, Mycobacterium bovis subsp bovis AF2122/97
cugcgacgaugccgccuggug

SEQ ID NO: 3059479 - RNA, 16 nt, Mycobacterium bovis subsp bovis AF2122/97
cugcgacuggaucgcg

SEQ ID NO: 3059480 - RNA, 14 nt, Mycobacterium bovis subsp bovis AF2122/97
cugcgacuggugcc

SEQ ID NO: 3059481 - RNA, 23 nt, Mycobacterium bovis subsp bovis AF2122/97
cugcgccguucgcucccccgcua

SEQ ID NO: 3059482 - RNA, 14 nt, Mycobacterium bovis subsp bovis AF2122/97
cugcgccuaacccc

SEQ ID NO: 3059483 - RNA, 21 nt, Mycobacterium bovis subsp bovis AF2122/97
cugcgccucggcggccagcuc

SEQ ID NO: 3059484 - RNA, 22 nt, Mycobacterium bovis subsp bovis AF2122/97
cugcgccucggcggccagcucg

SEQ ID NO: 3059485 - RNA, 14 nt, Mycobacterium bovis subsp bovis AF2122/97
cugcgccuucgcca

SEQ ID NO: 3059486 - RNA, 18 nt, Mycobacterium bovis subsp bovis AF2122/97
cugcgccuucgccagcgg

SEQ ID NO: 3059487 - RNA, 18 nt, Mycobacterium bovis subsp bovis AF2122/97
cugcgccuugaagcggug

SEQ ID NO: 3059488 - RNA, 18 nt, Mycobacterium bovis subsp bovis AF2122/97
cugcgccuuggucgccgg

SEQ ID NO: 3059489 - RNA, 19 nt, Mycobacterium bovis subsp bovis AF2122/97
cugcgccuuggucgccggc

SEQ ID NO: 3059490 - RNA, 20 nt, Mycobacterium bovis subsp bovis AF2122/97
cugcgccuuggucgccggcg

SEQ ID NO: 3059491 - RNA, 16 nt, Mycobacterium bovis subsp bovis AF2122/97
cugcgcgaagccacca

SEQ ID NO: 3059492 - RNA, 21 nt, Mycobacterium bovis subsp bovis AF2122/97
cugcgcgaagccaccaggucg

SEQ ID NO: 3059493 - RNA, 16 nt, Mycobacterium bovis subsp bovis AF2122/97
cugcgcgaaggggacg

SEQ ID NO: 3059494 - RNA, 14 nt, Mycobacterium bovis subsp bovis AF2122/97
cugcgcgaccgacc

SEQ ID NO: 3059495 - RNA, 17 nt, Mycobacterium bovis subsp bovis AF2122/97
cugcgcgaccgaccagc

SEQ ID NO: 3059496 - RNA, 16 nt, Mycobacterium bovis subsp bovis AF2122/97
cugcgcgaggggccgg

SEQ ID NO: 3059497 - RNA, 16 nt, Mycobacterium bovis subsp bovis AF2122/97
cugcgcgagguuggcg

SEQ ID NO: 3059498 - RNA, 18 nt, Mycobacterium bovis subsp bovis AF2122/97
cugcgcgauccgcgcgca

SEQ ID NO: 3059499 - RNA, 14 nt, Mycobacterium bovis subsp bovis AF2122/97
cugcgcgaugcgau

SEQ ID NO: 3059500 - RNA, 15 nt, Mycobacterium bovis subsp bovis AF2122/97
cugcgcgauggccgu

SEQ ID NO: 3059501 - RNA, 20 nt, Mycobacterium bovis subsp bovis AF2122/97
cugcgcgauggccguugcca

SEQ ID NO: 3059502 - RNA, 22 nt, Mycobacterium bovis subsp bovis AF2122/97
cugcgcgaugucguucgcguca

SEQ ID NO: 3059503 - RNA, 23 nt, Mycobacterium bovis subsp bovis AF2122/97
cugcgcgccguucacccuggugg

SEQ ID NO: 3059504 - RNA, 13 nt, Mycobacterium bovis subsp bovis AF2122/97
cugcgcgcggccg

SEQ ID NO: 3059505 - RNA, 14 nt, Mycobacterium bovis subsp bovis AF2122/97
cugcgcgcggccgc

SEQ ID NO: 3059506 - RNA, 15 nt, Mycobacterium bovis subsp bovis AF2122/97
cugcgcgcggcggcc

SEQ ID NO: 3059507 - RNA, 18 nt, Mycobacterium bovis subsp bovis AF2122/97
cugcgcgcggcggccgcg

SEQ ID NO: 3059508 - RNA, 14 nt, Mycobacterium bovis subsp bovis AF2122/97
cugcgcgcucggcc

SEQ ID NO: 3059509 - RNA, 18 nt, Mycobacterium bovis subsp bovis AF2122/97
cugcgcgcucggccagca

SEQ ID NO: 3059510 - RNA, 12 nt, Mycobacterium bovis subsp bovis AF2122/97
cugcgcggcacu

SEQ ID NO: 3059511 - RNA, 16 nt, Mycobacterium bovis subsp bovis AF2122/97
cugcgcggccaccuca

SEQ ID NO: 3059512 - RNA, 13 nt, Mycobacterium bovis subsp bovis AF2122/97
cugcgcggcugcc

SEQ ID NO: 3059513 - RNA, 16 nt, Mycobacterium bovis subsp bovis AF2122/97
cugcgcggcugccguc

SEQ ID NO: 3059514 - RNA, 19 nt, Mycobacterium bovis subsp bovis AF2122/97
cugcgcggcuucgucgaca

SEQ ID NO: 3059515 - RNA, 22 nt, Mycobacterium bovis subsp bovis AF2122/97
cugcgcggcuugucgcggugcg

SEQ ID NO: 3059516 - RNA, 22 nt, Mycobacterium bovis subsp bovis AF2122/97
cugcgcgggucguagaccuucu

SEQ ID NO: 3059517 - RNA, 20 nt, Mycobacterium bovis subsp bovis AF2122/97
cugcgcggguguggcuacga

SEQ ID NO: 3059518 - RNA, 17 nt, Mycobacterium bovis subsp bovis AF2122/97
cugcgcggugccggccg

SEQ ID NO: 3059519 - RNA, 17 nt, Mycobacterium bovis subsp bovis AF2122/97
cugcgcgucgagcagca

SEQ ID NO: 3059520 - RNA, 19 nt, Mycobacterium bovis subsp bovis AF2122/97
cugcgcgucgagcagcacc

SEQ ID NO: 3059521 - RNA, 22 nt, Mycobacterium bovis subsp bovis AF2122/97
cugcgcguuugguuuucccggc

SEQ ID NO: 3059522 - RNA, 19 nt, Mycobacterium bovis subsp bovis AF2122/97
cugcgcucgggcugccgca

SEQ ID NO: 3059523 - RNA, 17 nt, Mycobacterium bovis subsp bovis AF2122/97
cugcgcuguucggcacg

SEQ ID NO: 3059524 - RNA, 17 nt, Mycobacterium bovis subsp bovis AF2122/97
cugcgcuuugcacagcg

SEQ ID NO: 3059525 - RNA, 22 nt, Mycobacterium bovis subsp bovis AF2122/97
cugcgcuuugcacagcggcauc

SEQ ID NO: 3059526 - RNA, 20 nt, Mycobacterium bovis subsp bovis AF2122/97
cugcggacaagucggcaccg

SEQ ID NO: 3059527 - RNA, 22 nt, Mycobacterium bovis subsp bovis AF2122/97
cugcggacaagucggcaccggu

SEQ ID NO: 3059528 - RNA, 23 nt, Mycobacterium bovis subsp bovis AF2122/97
cugcggacacguugcgacgucuc

SEQ ID NO: 3059529 - RNA, 15 nt, Mycobacterium bovis subsp bovis AF2122/97
cugcggaccggcgcg

SEQ ID NO: 3059530 - RNA, 22 nt, Mycobacterium bovis subsp bovis AF2122/97
cugcggacuggcauccgccccg

SEQ ID NO: 3059531 - RNA, 20 nt, Mycobacterium bovis subsp bovis AF2122/97
cugcggauacagccgccgcc

SEQ ID NO: 3059532 - RNA, 23 nt, Mycobacterium bovis subsp bovis AF2122/97
cugcggauacagccgccgccggc

SEQ ID NO: 3059533 - RNA, 20 nt, Mycobacterium bovis subsp bovis AF2122/97
cugcggauagugguugcggc

SEQ ID NO: 3059534 - RNA, 23 nt, Mycobacterium bovis subsp bovis AF2122/97
cugcggauagugguugcggccgu

SEQ ID NO: 3059535 - RNA, 14 nt, Mycobacterium bovis subsp bovis AF2122/97
cugcggauccacca

SEQ ID NO: 3059536 - RNA, 16 nt, Mycobacterium bovis subsp bovis AF2122/97
cugcggauccaccacg

SEQ ID NO: 3059537 - RNA, 22 nt, Mycobacterium bovis subsp bovis AF2122/97
cugcggauccaccacgcuggcc

SEQ ID NO: 3059538 - RNA, 21 nt, Mycobacterium bovis subsp bovis AF2122/97
cugcggaucggacaacacggc

SEQ ID NO: 3059539 - RNA, 18 nt, Mycobacterium bovis subsp bovis AF2122/97
cugcggaucguggcgccc

SEQ ID NO: 3059540 - RNA, 17 nt, Mycobacterium bovis subsp bovis AF2122/97
cugcggaugcgcggcgg

SEQ ID NO: 3059541 - RNA, 21 nt, Mycobacterium bovis subsp bovis AF2122/97
cugcggauuaagucggcggcc

SEQ ID NO: 3059542 - RNA, 23 nt, Mycobacterium bovis subsp bovis AF2122/97
cugcggauuaagucggcggccuu

SEQ ID NO: 3059543 - RNA, 22 nt, Mycobacterium bovis subsp bovis AF2122/97
cugcggcaacgaggucugcggc

SEQ ID NO: 3059544 - RNA, 11 nt, Mycobacterium bovis subsp bovis AF2122/97
cugcggcaccg

SEQ ID NO: 3059545 - RNA, 14 nt, Mycobacterium bovis subsp bovis AF2122/97
cugcggcaccggcu

SEQ ID NO: 3059546 - RNA, 15 nt, Mycobacterium bovis subsp bovis AF2122/97
cugcggcaccggcuc

SEQ ID NO: 3059547 - RNA, 12 nt, Mycobacterium bovis subsp bovis AF2122/97
cugcggcaccuc

SEQ ID NO: 3059548 - RNA, 15 nt, Mycobacterium bovis subsp bovis AF2122/97
cugcggcagcacccg

SEQ ID NO: 3059549 - RNA, 13 nt, Mycobacterium bovis subsp bovis AF2122/97
cugcggcagcgcg

SEQ ID NO: 3059550 - RNA, 14 nt, Mycobacterium bovis subsp bovis AF2122/97
cugcggcagcgcgg

SEQ ID NO: 3059551 - RNA, 17 nt, Mycobacterium bovis subsp bovis AF2122/97
cugcggcagcgcggcca

SEQ ID NO: 3059552 - RNA, 18 nt, Mycobacterium bovis subsp bovis AF2122/97
cugcggcagcgcggccaa

SEQ ID NO: 3059553 - RNA, 14 nt, Mycobacterium bovis subsp bovis AF2122/97
cugcggcagcggac

SEQ ID NO: 3059554 - RNA, 15 nt, Mycobacterium bovis subsp bovis AF2122/97
cugcggcagcggacc

SEQ ID NO: 3059555 - RNA, 20 nt, Mycobacterium bovis subsp bovis AF2122/97
cugcggcagcggaccgcugc

SEQ ID NO: 3059556 - RNA, 18 nt, Mycobacterium bovis subsp bovis AF2122/97
cugcggcaggucgaugcu

SEQ ID NO: 3059557 - RNA, 17 nt, Mycobacterium bovis subsp bovis AF2122/97
cugcggcauggcaggcg

SEQ ID NO: 3059558 - RNA, 23 nt, Mycobacterium bovis subsp bovis AF2122/97
cugcggccaauggugggcgagcu

SEQ ID NO: 3059559 - RNA, 21 nt, Mycobacterium bovis subsp bovis AF2122/97
cugcggccacgccgaugcggu

SEQ ID NO: 3059560 - RNA, 16 nt, Mycobacterium bovis subsp bovis AF2122/97
cugcggccagcgcggc

SEQ ID NO: 3059561 - RNA, 19 nt, Mycobacterium bovis subsp bovis AF2122/97
cugcggccagcgcggcgcg

SEQ ID NO: 3059562 - RNA, 19 nt, Mycobacterium bovis subsp bovis AF2122/97
cugcggcccacaccagcgc

SEQ ID NO: 3059563 - RNA, 20 nt, Mycobacterium bovis subsp bovis AF2122/97
cugcggcccacaccagcgca

SEQ ID NO: 3059564 - RNA, 17 nt, Mycobacterium bovis subsp bovis AF2122/97
cugcggcccaugaucuc

SEQ ID NO: 3059565 - RNA, 18 nt, Mycobacterium bovis subsp bovis AF2122/97
cugcggcccaugaucucg

SEQ ID NO: 3059566 - RNA, 16 nt, Mycobacterium bovis subsp bovis AF2122/97
cugcggccgauacaga

SEQ ID NO: 3059567 - RNA, 21 nt, Mycobacterium bovis subsp bovis AF2122/97
cugcuagcuuggcggccagcg

SEQ ID NO: 3059568 - RNA, 16 nt, Mycobacterium bovis subsp bovis AF2122/97
cugcuaguggucugcu

SEQ ID NO: 3059569 - RNA, 20 nt, Mycobacterium bovis subsp bovis AF2122/97
cugcuauugguugaggaggu

SEQ ID NO: 3059570 - RNA, 19 nt, Mycobacterium bovis subsp bovis AF2122/97
cugcucacgcagcagugcg

SEQ ID NO: 3059571 - RNA, 15 nt, Mycobacterium bovis subsp bovis AF2122/97
cugcucagcgcggcc

SEQ ID NO: 3059572 - RNA, 17 nt, Mycobacterium bovis subsp bovis AF2122/97
cugcucagcgcggcccc

SEQ ID NO: 3059573 - RNA, 18 nt, Mycobacterium bovis subsp bovis AF2122/97
cugcucaucgcgcccgcc

SEQ ID NO: 3059574 - RNA, 13 nt, Mycobacterium bovis subsp bovis AF2122/97
cugcuccaggcgc

SEQ ID NO: 3059575 - RNA, 19 nt, Mycobacterium bovis subsp bovis AF2122/97
cugcuccaggcgcgccgca

SEQ ID NO: 3059576 - RNA, 20 nt, Mycobacterium bovis subsp bovis AF2122/97
cugcucccgaaaagcgccuc

SEQ ID NO: 3059577 - RNA, 19 nt, Mycobacterium bovis subsp bovis AF2122/97
cugcuccgcagcagacucc

SEQ ID NO: 3059578 - RNA, 15 nt, Mycobacterium bovis subsp bovis AF2122/97
cugcuccgcugucac

SEQ ID NO: 3059579 - RNA, 21 nt, Mycobacterium bovis subsp bovis AF2122/97
cugcuccucauagagcggcac

SEQ ID NO: 3059580 - RNA, 17 nt, Mycobacterium bovis subsp bovis AF2122/97
cugcuccucgcgggcgg

SEQ ID NO: 3059581 - RNA, 18 nt, Mycobacterium bovis subsp bovis AF2122/97
cugcuccucgcgggcggc

SEQ ID NO: 3059582 - RNA, 20 nt, Mycobacterium bovis subsp bovis AF2122/97
cugcuccucgcgggcggcgu

SEQ ID NO: 3059583 - RNA, 14 nt, Mycobacterium bovis subsp bovis AF2122/97
cugcuccucggcca

SEQ ID NO: 3059584 - RNA, 20 nt, Mycobacterium bovis subsp bovis AF2122/97
cugcuccucggucagcgggg

SEQ ID NO: 3059585 - RNA, 15 nt, Mycobacterium bovis subsp bovis AF2122/97
cugcuccugcgucca

SEQ ID NO: 3059586 - RNA, 11 nt, Mycobacterium bovis subsp bovis AF2122/97
cugcuccugga

SEQ ID NO: 3059587 - RNA, 13 nt, Mycobacterium bovis subsp bovis AF2122/97
cugcuccuggaag

SEQ ID NO: 3059588 - RNA, 21 nt, Mycobacterium bovis subsp bovis AF2122/97
cugcuccuggaaguacacggc

SEQ ID NO: 3059589 - RNA, 13 nt, Mycobacterium bovis subsp bovis AF2122/97
cugcuccugguag

SEQ ID NO: 3059590 - RNA, 18 nt, Mycobacterium bovis subsp bovis AF2122/97
cugcucgagagcaugguc

SEQ ID NO: 3059591 - RNA, 20 nt, Mycobacterium bovis subsp bovis AF2122/97
cugcucgagcagaucagcac

SEQ ID NO: 3059592 - RNA, 17 nt, Mycobacterium bovis subsp bovis AF2122/97
cugcucgauacggcccu

SEQ ID NO: 3059593 - RNA, 23 nt, Mycobacterium bovis subsp bovis AF2122/97
cugcucgaucaucgggagccgca

SEQ ID NO: 3059594 - RNA, 14 nt, Mycobacterium bovis subsp bovis AF2122/97
cugcucgcacagca

SEQ ID NO: 3059595 - RNA, 16 nt, Mycobacterium bovis subsp bovis AF2122/97
cugcucgccaggcaag

SEQ ID NO: 3059596 - RNA, 15 nt, Mycobacterium bovis subsp bovis AF2122/97
cugcucgccaggccu

SEQ ID NO: 3059597 - RNA, 16 nt, Mycobacterium bovis subsp bovis AF2122/97
cugcucgccaggccua

SEQ ID NO: 3059598 - RNA, 15 nt, Mycobacterium bovis subsp bovis AF2122/97
cugcucgccgagcuc

SEQ ID NO: 3059599 - RNA, 14 nt, Mycobacterium bovis subsp bovis AF2122/97
cugcucgccggcca

SEQ ID NO: 3059600 - RNA, 13 nt, Mycobacterium bovis subsp bovis AF2122/97
cugcucgccgggg

SEQ ID NO: 3059601 - RNA, 17 nt, Mycobacterium bovis subsp bovis AF2122/97
cugcucgccguggugga

SEQ ID NO: 3059602 - RNA, 19 nt, Mycobacterium bovis subsp bovis AF2122/97
cugcucgcgcaaggcgccg

SEQ ID NO: 3059603 - RNA, 14 nt, Mycobacterium bovis subsp bovis AF2122/97
cugcucgcgcccgc

SEQ ID NO: 3059604 - RNA, 15 nt, Mycobacterium bovis subsp bovis AF2122/97
cugcucgcgcccgcu

SEQ ID NO: 3059605 - RNA, 15 nt, Mycobacterium bovis subsp bovis AF2122/97
cugcucgcgccgcua

SEQ ID NO: 3059606 - RNA, 13 nt, Mycobacterium bovis subsp bovis AF2122/97
cugcucgcgccgg

SEQ ID NO: 3059607 - RNA, 23 nt, Mycobacterium bovis subsp bovis AF2122/97
cugcucgcgguaguuaacccagg

SEQ ID NO: 3059608 - RNA, 16 nt, Mycobacterium bovis subsp bovis AF2122/97
cugcucgcuggugaac

SEQ ID NO: 3059609 - RNA, 22 nt, Mycobacterium bovis subsp bovis AF2122/97
cugcucggauccggccaggucg

SEQ ID NO: 3059610 - RNA, 14 nt, Mycobacterium bovis subsp bovis AF2122/97
cugcucggcaucga

SEQ ID NO: 3059611 - RNA, 15 nt, Mycobacterium bovis subsp bovis AF2122/97
cugcucggccgugca

SEQ ID NO: 3059612 - RNA, 13 nt, Mycobacterium bovis subsp bovis AF2122/97
cugcucggccugg

SEQ ID NO: 3059613 - RNA, 15 nt, Mycobacterium bovis subsp bovis AF2122/97
cugcucggccuggau

SEQ ID NO: 3059614 - RNA, 14 nt, Mycobacterium bovis subsp bovis AF2122/97
cugcucggcgaccg

SEQ ID NO: 3059615 - RNA, 18 nt, Mycobacterium bovis subsp bovis AF2122/97
cugcucggcgaccgucgg

SEQ ID NO: 3059616 - RNA, 15 nt, Mycobacterium bovis subsp bovis AF2122/97
cugcucggcgcagcu

SEQ ID NO: 3059617 - RNA, 18 nt, Mycobacterium bovis subsp bovis AF2122/97
cugcucggcgcagcuaac

SEQ ID NO: 3059618 - RNA, 15 nt, Mycobacterium bovis subsp bovis AF2122/97
cugcucggcgcgccg

SEQ ID NO: 3059619 - RNA, 16 nt, Mycobacterium bovis subsp bovis AF2122/97
cugcucggcgcgccgg

SEQ ID NO: 3059620 - RNA, 17 nt, Mycobacterium bovis subsp bovis AF2122/97
cugcucggcgcgccggu

SEQ ID NO: 3059621 - RNA, 12 nt, Mycobacterium bovis subsp bovis AF2122/97
cugcucggcgcu

SEQ ID NO: 3059622 - RNA, 17 nt, Mycobacterium bovis subsp bovis AF2122/97
cugcucggcggugccgc

SEQ ID NO: 3059623 - RNA, 14 nt, Mycobacterium bovis subsp bovis AF2122/97
cugcucgggggccg

SEQ ID NO: 3059624 - RNA, 19 nt, Mycobacterium bovis subsp bovis AF2122/97
cugcucguaggugccgaag

SEQ ID NO: 3059625 - RNA, 20 nt, Mycobacterium bovis subsp bovis AF2122/97
cugcucgucgagccgaccgc

SEQ ID NO: 3059626 - RNA, 14 nt, Mycobacterium bovis subsp bovis AF2122/97
cugcucgucggcca

SEQ ID NO: 3059627 - RNA, 17 nt, Mycobacterium bovis subsp bovis AF2122/97
cugcucgucggccaccg

SEQ ID NO: 3059628 - RNA, 18 nt, Mycobacterium bovis subsp bovis AF2122/97
cugcucgucggccaccgc

SEQ ID NO: 3059629 - RNA, 22 nt, Mycobacterium bovis subsp bovis AF2122/97
cugcucgucggccaccgcggcg

SEQ ID NO: 3059630 - RNA, 16 nt, Mycobacterium bovis subsp bovis AF2122/97
cugcucgucggcgccg

SEQ ID NO: 3059631 - RNA, 20 nt, Mycobacterium bovis subsp bovis AF2122/97
cugcucgucggcgccggcgg

SEQ ID NO: 3059632 - RNA, 23 nt, Mycobacterium bovis subsp bovis AF2122/97
cugcucgucggcgccggcggccg

SEQ ID NO: 3059633 - RNA, 13 nt, Mycobacterium bovis subsp bovis AF2122/97
cugcucgucgguc

SEQ ID NO: 3059634 - RNA, 23 nt, Mycobacterium bovis subsp bovis AF2122/97
cugcucgucggucaccgaaugcg

SEQ ID NO: 3059635 - RNA, 17 nt, Mycobacterium bovis subsp bovis AF2122/97
cugcucgucuuggcggc

SEQ ID NO: 3059636 - RNA, 20 nt, Mycobacterium bovis subsp bovis AF2122/97
cugcucgucuuggcggcggu

SEQ ID NO: 3059637 - RNA, 14 nt, Mycobacterium bovis subsp bovis AF2122/97
cugcucgugagccc

SEQ ID NO: 3059638 - RNA, 22 nt, Mycobacterium bovis subsp bovis AF2122/97
cugcucgugagccccagcgacg

SEQ ID NO: 3059639 - RNA, 21 nt, Mycobacterium bovis subsp bovis AF2122/97
cugcucuccgucgcgcacggc

SEQ ID NO: 3059640 - RNA, 17 nt, Mycobacterium bovis subsp bovis AF2122/97
cugcucugcgaccucgc

SEQ ID NO: 3059641 - RNA, 19 nt, Mycobacterium bovis subsp bovis AF2122/97
cugcucuuuuagccacaau

SEQ ID NO: 3059642 - RNA, 13 nt, Mycobacterium bovis subsp bovis AF2122/97
cugcugaacaacc

SEQ ID NO: 3059643 - RNA, 15 nt, Mycobacterium bovis subsp bovis AF2122/97
cugcugaacaaccag

SEQ ID NO: 3059644 - RNA, 15 nt, Mycobacterium bovis subsp bovis AF2122/97
cugcugaacaccggu

SEQ ID NO: 3059645 - RNA, 18 nt, Mycobacterium bovis subsp bovis AF2122/97
cugcugaacaccggugaa

SEQ ID NO: 3059646 - RNA, 23 nt, Mycobacterium bovis subsp bovis AF2122/97
cugcugaacaccggugaaacgau

SEQ ID NO: 3059647 - RNA, 19 nt, Mycobacterium bovis subsp bovis AF2122/97
cugcugaccaugaccgggc

SEQ ID NO: 3059648 - RNA, 13 nt, Mycobacterium bovis subsp bovis AF2122/97
cugcugagcugcu

SEQ ID NO: 3059649 - RNA, 18 nt, Mycobacterium bovis subsp bovis AF2122/97
cugcugagcugcucgccg

SEQ ID NO: 3059650 - RNA, 14 nt, Mycobacterium bovis subsp bovis AF2122/97
cugcugaucgagcg

SEQ ID NO: 3059651 - RNA, 22 nt, Mycobacterium bovis subsp bovis AF2122/97
cugcugcaaccgacuucgaugg

SEQ ID NO: 3059652 - RNA, 12 nt, Mycobacterium bovis subsp bovis AF2122/97
cugcugcagcaa

SEQ ID NO: 3059653 - RNA, 15 nt, Mycobacterium bovis subsp bovis AF2122/97
cugcugcagcaauug

SEQ ID NO: 3059654 - RNA, 19 nt, Mycobacterium bovis subsp bovis AF2122/97
cuggaguaggugugcggga

SEQ ID NO: 3059655 - RNA, 16 nt, Mycobacterium bovis subsp bovis AF2122/97
cuggagugaggcugug

SEQ ID NO: 3059656 - RNA, 23 nt, Mycobacterium bovis subsp bovis AF2122/97
cuggagugaggcugugccccagg

SEQ ID NO: 3059657 - RNA, 17 nt, Mycobacterium bovis subsp bovis AF2122/97
cuggaguucgucaccgu

SEQ ID NO: 3059658 - RNA, 18 nt, Mycobacterium bovis subsp bovis AF2122/97
cuggaguucgucaccguu

SEQ ID NO: 3059659 - RNA, 21 nt, Mycobacterium bovis subsp bovis AF2122/97
cuggaguucgucaccguuggc

SEQ ID NO: 3059660 - RNA, 19 nt, Mycobacterium bovis subsp bovis AF2122/97
cuggauacccagcgcccgg

SEQ ID NO: 3059661 - RNA, 14 nt, Mycobacterium bovis subsp bovis AF2122/97
cuggaucaacccgg

SEQ ID NO: 3059662 - RNA, 16 nt, Mycobacterium bovis subsp bovis AF2122/97
cuggaucagaucccgc

SEQ ID NO: 3059663 - RNA, 15 nt, Mycobacterium bovis subsp bovis AF2122/97
cuggaucgacuucgg

SEQ ID NO: 3059664 - RNA, 15 nt, Mycobacterium bovis subsp bovis AF2122/97
cuggaucgugagcuu

SEQ ID NO: 3059665 - RNA, 20 nt, Mycobacterium bovis subsp bovis AF2122/97
cuggauggcgcccugcgcca

SEQ ID NO: 3059666 - RNA, 16 nt, Mycobacterium bovis subsp bovis AF2122/97
cuggauggcucgccga

SEQ ID NO: 3059667 - RNA, 23 nt, Mycobacterium bovis subsp bovis AF2122/97
cuggauguaguuggcgaccugcg

SEQ ID NO: 3059668 - RNA, 21 nt, Mycobacterium bovis subsp bovis AF2122/97
cuggaugucgucgacgaucag

SEQ ID NO: 3059669 - RNA, 18 nt, Mycobacterium bovis subsp bovis AF2122/97
cuggauucuucagcgcgg

SEQ ID NO: 3059670 - RNA, 23 nt, Mycobacterium bovis subsp bovis AF2122/97
cuggauucuucagcgcggcacgg

SEQ ID NO: 3059671 - RNA, 22 nt, Mycobacterium bovis subsp bovis AF2122/97
cuggcaaaguaucgcagcaucu

SEQ ID NO: 3059672 - RNA, 16 nt, Mycobacterium bovis subsp bovis AF2122/97
cuggcaacgacacgcc

SEQ ID NO: 3059673 - RNA, 16 nt, Mycobacterium bovis subsp bovis AF2122/97
cuggcaacgccgcgcc

SEQ ID NO: 3059674 - RNA, 17 nt, Mycobacterium bovis subsp bovis AF2122/97
cuggcaacgccgcgccg

SEQ ID NO: 3059675 - RNA, 18 nt, Mycobacterium bovis subsp bovis AF2122/97
cuggcaacgccgcgccgu

SEQ ID NO: 3059676 - RNA, 22 nt, Mycobacterium bovis subsp bovis AF2122/97
cuggcacccggggugcccggcc

SEQ ID NO: 3059677 - RNA, 23 nt, Mycobacterium bovis subsp bovis AF2122/97
cuggcacccggggugcccggccg

SEQ ID NO: 3059678 - RNA, 17 nt, Mycobacterium bovis subsp bovis AF2122/97
cuggcaccgccagccac

SEQ ID NO: 3059679 - RNA, 18 nt, Mycobacterium bovis subsp bovis AF2122/97
cuggcaccucccgggcga

SEQ ID NO: 3059680 - RNA, 21 nt, Mycobacterium bovis subsp bovis AF2122/97
cuggcaccucccgggcgagcc

SEQ ID NO: 3059681 - RNA, 18 nt, Mycobacterium bovis subsp bovis AF2122/97
cuggcaccucgcccuccc

SEQ ID NO: 3059682 - RNA, 17 nt, Mycobacterium bovis subsp bovis AF2122/97
cuggcagaccaacgcuc

SEQ ID NO: 3059683 - RNA, 15 nt, Mycobacterium bovis subsp bovis AF2122/97
cuggcagcggccucc

SEQ ID NO: 3059684 - RNA, 18 nt, Mycobacterium bovis subsp bovis AF2122/97
cuggcagcggccuccggg

SEQ ID NO: 3059685 - RNA, 18 nt, Mycobacterium bovis subsp bovis AF2122/97
cuggcagcuccucgcgcu

SEQ ID NO: 3059686 - RNA, 23 nt, Mycobacterium bovis subsp bovis AF2122/97
cuggcagcuccucgcgcucgccg

SEQ ID NO: 3059687 - RNA, 22 nt, Mycobacterium bovis subsp bovis AF2122/97
cuggcaggauaccgaaaucacc

SEQ ID NO: 3059688 - RNA, 16 nt, Mycobacterium bovis subsp bovis AF2122/97
cuggcaggccagcaug

SEQ ID NO: 3059689 - RNA, 17 nt, Mycobacterium bovis subsp bovis AF2122/97
cuggcaggccgggcacc

SEQ ID NO: 3059690 - RNA, 19 nt, Mycobacterium bovis subsp bovis AF2122/97
cuggcaggcuuagcuuccg

SEQ ID NO: 3059691 - RNA, 22 nt, Mycobacterium bovis subsp bovis AF2122/97
cuggcagugugggggucagggg

SEQ ID NO: 3059692 - RNA, 16 nt, Mycobacterium bovis subsp bovis AF2122/97
cuggcauaggaucgcg

SEQ ID NO: 3059693 - RNA, 13 nt, Mycobacterium bovis subsp bovis AF2122/97
cuggcauaucccu

SEQ ID NO: 3059694 - RNA, 21 nt, Mycobacterium bovis subsp bovis AF2122/97
cuggcauaucccuugccgucc

SEQ ID NO: 3059695 - RNA, 23 nt, Mycobacterium bovis subsp bovis AF2122/97
cuggcauaucccuugccguccug

SEQ ID NO: 3059696 - RNA, 15 nt, Mycobacterium bovis subsp bovis AF2122/97
cuggcaucccgggca

SEQ ID NO: 3059697 - RNA, 20 nt, Mycobacterium bovis subsp bovis AF2122/97
cuggcaucccgggcagucca

SEQ ID NO: 3059698 - RNA, 14 nt, Mycobacterium bovis subsp bovis AF2122/97
cuggcauccgcccc

SEQ ID NO: 3059699 - RNA, 16 nt, Mycobacterium bovis subsp bovis AF2122/97
cuggcauccgccccgc

SEQ ID NO: 3059700 - RNA, 19 nt, Mycobacterium bovis subsp bovis AF2122/97
cuggcaugaccgcugccga

SEQ ID NO: 3059701 - RNA, 13 nt, Mycobacterium bovis subsp bovis AF2122/97
cuggcaugccggc

SEQ ID NO: 3059702 - RNA, 15 nt, Mycobacterium bovis subsp bovis AF2122/97
cuggccaacgccggg

SEQ ID NO: 3059703 - RNA, 16 nt, Mycobacterium bovis subsp bovis AF2122/97
cuggccaacuugaccc

SEQ ID NO: 3059704 - RNA, 21 nt, Mycobacterium bovis subsp bovis AF2122/97
cuggccaacuugacccgggga

SEQ ID NO: 3059705 - RNA, 19 nt, Mycobacterium bovis subsp bovis AF2122/97
cuggccacacucagcaccc

SEQ ID NO: 3059706 - RNA, 23 nt, Mycobacterium bovis subsp bovis AF2122/97
cuggccacccagaaugacaucgu

SEQ ID NO: 3059707 - RNA, 21 nt, Mycobacterium bovis subsp bovis AF2122/97
cuggccacggcuuugcggcgc

SEQ ID NO: 3059708 - RNA, 18 nt, Mycobacterium bovis subsp bovis AF2122/97
cuggccacucccagccaa

SEQ ID NO: 3059709 - RNA, 21 nt, Mycobacterium bovis subsp bovis AF2122/97
cuggccacucccagccaaccc

SEQ ID NO: 3059710 - RNA, 20 nt, Mycobacterium bovis subsp bovis AF2122/97
cuggccacuuucagaucgau

SEQ ID NO: 3059711 - RNA, 21 nt, Mycobacterium bovis subsp bovis AF2122/97
cuggccagcacaccgucgacg

SEQ ID NO: 3059712 - RNA, 18 nt, Mycobacterium bovis subsp bovis AF2122/97
cuggccagcacgcccgcg

SEQ ID NO: 3059713 - RNA, 19 nt, Mycobacterium bovis subsp bovis AF2122/97
cuggccagcagagcggcac

SEQ ID NO: 3059714 - RNA, 21 nt, Mycobacterium bovis subsp bovis AF2122/97
cuggccagcagagcggcacgc

SEQ ID NO: 3059715 - RNA, 17 nt, Mycobacterium bovis subsp bovis AF2122/97
cuggccagcccgagcuc

SEQ ID NO: 3059716 - RNA, 12 nt, Mycobacterium bovis subsp bovis AF2122/97
cuggccagcgaa

SEQ ID NO: 3059717 - RNA, 13 nt, Mycobacterium bovis subsp bovis AF2122/97
cuggccagcgcgc

SEQ ID NO: 3059718 - RNA, 18 nt, Mycobacterium bovis subsp bovis AF2122/97
cuggccagcugcggcucc

SEQ ID NO: 3059719 - RNA, 19 nt, Mycobacterium bovis subsp bovis AF2122/97
cuggccagguugccgucgg

SEQ ID NO: 3059720 - RNA, 19 nt, Mycobacterium bovis subsp bovis AF2122/97
cuggccaucgagggcaucg

SEQ ID NO: 3059721 - RNA, 21 nt, Mycobacterium bovis subsp bovis AF2122/97
cuggccaugguggcgccgacg

SEQ ID NO: 3059722 - RNA, 13 nt, Mycobacterium bovis subsp bovis AF2122/97
cuggcccaauugc

SEQ ID NO: 3059723 - RNA, 20 nt, Mycobacterium bovis subsp bovis AF2122/97
cuggcccaccuccucgccgg

SEQ ID NO: 3059724 - RNA, 15 nt, Mycobacterium bovis subsp bovis AF2122/97
cuggcccagcgacca

SEQ ID NO: 3059725 - RNA, 19 nt, Mycobacterium bovis subsp bovis AF2122/97
cuggcccaucuugaccaau

SEQ ID NO: 3059726 - RNA, 18 nt, Mycobacterium bovis subsp bovis AF2122/97
cuggccccgccagcggca

SEQ ID NO: 3059727 - RNA, 24 nt, Mycobacterium bovis subsp bovis AF2122/97
cuggccccgccagcggcagcggcg

SEQ ID NO: 3059728 - RNA, 23 nt, Mycobacterium bovis subsp bovis AF2122/97
cuggccccgguggugcugccgau

SEQ ID NO: 3059729 - RNA, 18 nt, Mycobacterium bovis subsp bovis AF2122/97
cuggcccgauaaaugccg

SEQ ID NO: 3059730 - RNA, 14 nt, Mycobacterium bovis subsp bovis AF2122/97
cuggcccgcaugcc

SEQ ID NO: 3059731 - RNA, 17 nt, Mycobacterium bovis subsp bovis AF2122/97
cuggcccgcaugccggc

SEQ ID NO: 3059732 - RNA, 20 nt, Mycobacterium bovis subsp bovis AF2122/97
cuggcccgcaugccggcgca

SEQ ID NO: 3059733 - RNA, 21 nt, Mycobacterium bovis subsp bovis AF2122/97
cuggcccgcaugccggcgcac

SEQ ID NO: 3059734 - RNA, 11 nt, Mycobacterium bovis subsp bovis AF2122/97
cuggcccgcca

SEQ ID NO: 3059735 - RNA, 13 nt, Mycobacterium bovis subsp bovis AF2122/97
cuggcccgccacg

SEQ ID NO: 3059736 - RNA, 23 nt, Mycobacterium bovis subsp bovis AF2122/97
cuggcccgcgacaucgggaaugu

SEQ ID NO: 3059737 - RNA, 19 nt, Mycobacterium bovis subsp bovis AF2122/97
cuggcccggcgcuccaacg

SEQ ID NO: 3059738 - RNA, 15 nt, Mycobacterium bovis subsp bovis AF2122/97
cuggcccggcuacga

SEQ ID NO: 3059739 - RNA, 20 nt, Mycobacterium bovis subsp bovis AF2122/97
cuggcccggcuacgacggcg

SEQ ID NO: 3059740 - RNA, 21 nt, Mycobacterium bovis subsp bovis AF2122/97
cuggcgccgaaguagccgacc

SEQ ID NO: 3059741 - RNA, 14 nt, Mycobacterium bovis subsp bovis AF2122/97
cuggcgccgccggu

SEQ ID NO: 3059742 - RNA, 18 nt, Mycobacterium bovis subsp bovis AF2122/97
cuggcgccgccggugcca

SEQ ID NO: 3059743 - RNA, 15 nt, Mycobacterium bovis subsp bovis AF2122/97
cuggcgccggccagc

SEQ ID NO: 3059744 - RNA, 17 nt, Mycobacterium bovis subsp bovis AF2122/97
cuggcgccggccagcca

SEQ ID NO: 3059745 - RNA, 17 nt, Mycobacterium bovis subsp bovis AF2122/97
cuggcgccggugccgcc

SEQ ID NO: 3059746 - RNA, 18 nt, Mycobacterium bovis subsp bovis AF2122/97
cuggcgccggugccgccg

SEQ ID NO: 3059747 - RNA, 15 nt, Mycobacterium bovis subsp bovis AF2122/97
cuggcgccguuagcg

SEQ ID NO: 3059748 - RNA, 21 nt, Mycobacterium bovis subsp bovis AF2122/97
cuggcgcgccugugccaccgc

SEQ ID NO: 3059749 - RNA, 20 nt, Mycobacterium bovis subsp bovis AF2122/97
cuggcgcgcgggguggcggc

SEQ ID NO: 3059750 - RNA, 22 nt, Mycobacterium bovis subsp bovis AF2122/97
cuggcgcucauaggccggcggu

SEQ ID NO: 3059751 - RNA, 17 nt, Mycobacterium bovis subsp bovis AF2122/97
cuggcgcugaugcuggc

SEQ ID NO: 3059752 - RNA, 19 nt, Mycobacterium bovis subsp bovis AF2122/97
cuggcgcugaugcuggcca

SEQ ID NO: 3059753 - RNA, 20 nt, Mycobacterium bovis subsp bovis AF2122/97
cuggcgcugaugcuggccau

SEQ ID NO: 3059754 - RNA, 15 nt, Mycobacterium bovis subsp bovis AF2122/97
cuggcgcugcuggca

SEQ ID NO: 3059755 - RNA, 19 nt, Mycobacterium bovis subsp bovis AF2122/97
cuggcgcugcuggcagacc

SEQ ID NO: 3059756 - RNA, 20 nt, Mycobacterium bovis subsp bovis AF2122/97
cuggcgcuuugggcugccgu

SEQ ID NO: 3059757 - RNA, 20 nt, Mycobacterium bovis subsp bovis AF2122/97
cuggcggaccgguaggcacc

SEQ ID NO: 3059758 - RNA, 16 nt, Mycobacterium bovis subsp bovis AF2122/97
cuggcggauggccgcc

SEQ ID NO: 3059759 - RNA, 18 nt, Mycobacterium bovis subsp bovis AF2122/97
cuggcggauggccgccuu

SEQ ID NO: 3059760 - RNA, 13 nt, Mycobacterium bovis subsp bovis AF2122/97
cuggcggccagca

SEQ ID NO: 3059761 - RNA, 15 nt, Mycobacterium bovis subsp bovis AF2122/97
cuggcggccucgccg

SEQ ID NO: 3059762 - RNA, 17 nt, Mycobacterium bovis subsp bovis AF2122/97
cuggcggccucgccggc

SEQ ID NO: 3059763 - RNA, 14 nt, Mycobacterium bovis subsp bovis AF2122/97
cuggcggcgccgca

SEQ ID NO: 3059764 - RNA, 23 nt, Mycobacterium bovis subsp bovis AF2122/97
cuggcggcgugcuuaacacaugc

SEQ ID NO: 3059765 - RNA, 16 nt, Mycobacterium bovis subsp bovis AF2122/97
cuggcggcguggcgcc

SEQ ID NO: 3059766 - RNA, 19 nt, Mycobacterium bovis subsp bovis AF2122/97
cuggcggcguggcgccggc

SEQ ID NO: 3059767 - RNA, 15 nt, Mycobacterium bovis subsp bovis AF2122/97
cuggcggcugcagcc

SEQ ID NO: 3059768 - RNA, 20 nt, Mycobacterium bovis subsp bovis AF2122/97
cuggcgggcacucagcaggg

SEQ ID NO: 3059769 - RNA, 20 nt, Mycobacterium bovis subsp bovis AF2122/97
cuggcgggcgaucgcggcga

SEQ ID NO: 3059770 - RNA, 13 nt, Mycobacterium bovis subsp bovis AF2122/97
cuggcgggcgccu

SEQ ID NO: 3059771 - RNA, 19 nt, Mycobacterium bovis subsp bovis AF2122/97
cuggcggggaucagcgagu

SEQ ID NO: 3059772 - RNA, 19 nt, Mycobacterium bovis subsp bovis AF2122/97
cuggcggguaagcgaccga

SEQ ID NO: 3059773 - RNA, 17 nt, Mycobacterium bovis subsp bovis AF2122/97
cuggcggguggcgauga

SEQ ID NO: 3059774 - RNA, 14 nt, Mycobacterium bovis subsp bovis AF2122/97
cuggcggucccgca

SEQ ID NO: 3059775 - RNA, 14 nt, Mycobacterium bovis subsp bovis AF2122/97
cuggcggugcagug

SEQ ID NO: 3059776 - RNA, 23 nt, Mycobacterium bovis subsp bovis AF2122/97
cuggcggugcagugccucggcgg

SEQ ID NO: 3059777 - RNA, 20 nt, Mycobacterium bovis subsp bovis AF2122/97
cuggcggugccggcggcgca

SEQ ID NO: 3059778 - RNA, 15 nt, Mycobacterium bovis subsp bovis AF2122/97
cuggcgguugcccga

SEQ ID NO: 3059779 - RNA, 23 nt, Mycobacterium bovis subsp bovis AF2122/97
cuggcgguugcccgagcggcuga

SEQ ID NO: 3059780 - RNA, 18 nt, Mycobacterium bovis subsp bovis AF2122/97
cuggcguagugcucgccg

SEQ ID NO: 3059781 - RNA, 20 nt, Mycobacterium bovis subsp bovis AF2122/97
cuggcguagugcucgccggc

SEQ ID NO: 3059782 - RNA, 22 nt, Mycobacterium bovis subsp bovis AF2122/97
cuggcguagugcucgccggcac

SEQ ID NO: 3059783 - RNA, 23 nt, Mycobacterium bovis subsp bovis AF2122/97
cuggcgucaccgcggguggaugu

SEQ ID NO: 3059784 - RNA, 23 nt, Mycobacterium bovis subsp bovis AF2122/97
cuggcgugcugcuagccagucgg

SEQ ID NO: 3059785 - RNA, 17 nt, Mycobacterium bovis subsp bovis AF2122/97
cuggcgugucgccgcca

SEQ ID NO: 3059786 - RNA, 19 nt, Mycobacterium bovis subsp bovis AF2122/97
cuggcgugucgccgccacc

SEQ ID NO: 3059787 - RNA, 20 nt, Mycobacterium bovis subsp bovis AF2122/97
cuggcguucagcggccagca

SEQ ID NO: 3059788 - RNA, 15 nt, Mycobacterium bovis subsp bovis AF2122/97
cuggcguugccaccg

SEQ ID NO: 3059789 - RNA, 16 nt, Mycobacterium bovis subsp bovis AF2122/97
cuggcguugccaccgg

SEQ ID NO: 3059790 - RNA, 22 nt, Mycobacterium bovis subsp bovis AF2122/97
cuggcguuguugacgaucaccc

SEQ ID NO: 3059791 - RNA, 14 nt, Mycobacterium bovis subsp bovis AF2122/97
cuggcuacccaccg

SEQ ID NO: 3059792 - RNA, 19 nt, Mycobacterium bovis subsp bovis AF2122/97
cuggcuacccaccggccgg

SEQ ID NO: 3059793 - RNA, 15 nt, Mycobacterium bovis subsp bovis AF2122/97
cuggcuacgggccgc

SEQ ID NO: 3059794 - RNA, 16 nt, Mycobacterium bovis subsp bovis AF2122/97
cuggcuacgggccgcu

SEQ ID NO: 3059795 - RNA, 24 nt, Mycobacterium bovis subsp bovis AF2122/97
cuggcuaguugggugggugcagca

SEQ ID NO: 3059796 - RNA, 13 nt, Mycobacterium bovis subsp bovis AF2122/97
cuggcugaccgaa

SEQ ID NO: 3059797 - RNA, 16 nt, Mycobacterium bovis subsp bovis AF2122/97
cuggcugaccgaaugg

SEQ ID NO: 3059798 - RNA, 21 nt, Mycobacterium bovis subsp bovis AF2122/97
cuggcugaccgaauggccgcc

SEQ ID NO: 3059799 - RNA, 18 nt, Mycobacterium bovis subsp bovis AF2122/97
cuggcuggaccacucgcc

SEQ ID NO: 3059800 - RNA, 21 nt, Mycobacterium bovis subsp bovis AF2122/97
cuggcuggaccacucgccggc

SEQ ID NO: 3059801 - RNA, 23 nt, Mycobacterium bovis subsp bovis AF2122/97
cuggcuggaccacucgccggcgg

SEQ ID NO: 3059802 - RNA, 16 nt, Mycobacterium bovis subsp bovis AF2122/97
cuggcuggccagcugc

SEQ ID NO: 3059803 - RNA, 15 nt, Mycobacterium bovis subsp bovis AF2122/97
cuggcuggugauggc

SEQ ID NO: 3059804 - RNA, 18 nt, Mycobacterium bovis subsp bovis AF2122/97
cuggcuggugauggccau

SEQ ID NO: 3059805 - RNA, 19 nt, Mycobacterium bovis subsp bovis AF2122/97
cuggcuggugauggccauc

SEQ ID NO: 3059806 - RNA, 15 nt, Mycobacterium bovis subsp bovis AF2122/97
cuggcuguaguccgc

SEQ ID NO: 3059807 - RNA, 16 nt, Mycobacterium bovis subsp bovis AF2122/97
cuggcuguccgcgggc

SEQ ID NO: 3059808 - RNA, 19 nt, Mycobacterium bovis subsp bovis AF2122/97
cuggcuguccgcgggccgc

SEQ ID NO: 3059809 - RNA, 21 nt, Mycobacterium bovis subsp bovis AF2122/97
cuggcuguggcugaacaccgc

SEQ ID NO: 3059810 - RNA, 17 nt, Mycobacterium bovis subsp bovis AF2122/97
cuggcuugucauccccg

SEQ ID NO: 3059811 - RNA, 16 nt, Mycobacterium bovis subsp bovis AF2122/97
cugggaaacugggucu

SEQ ID NO: 3059812 - RNA, 22 nt, Mycobacterium bovis subsp bovis AF2122/97
cugggaccccgcugcgacguua

SEQ ID NO: 3059813 - RNA, 15 nt, Mycobacterium bovis subsp bovis AF2122/97
cugggacgggcgcgu

SEQ ID NO: 3059814 - RNA, 13 nt, Mycobacterium bovis subsp bovis AF2122/97
cugggaucccgac

SEQ ID NO: 3059815 - RNA, 18 nt, Mycobacterium bovis subsp bovis AF2122/97
cugggaucccgacgaagg

SEQ ID NO: 3059816 - RNA, 16 nt, Mycobacterium bovis subsp bovis AF2122/97
cugggauucugggcga

SEQ ID NO: 3059817 - RNA, 19 nt, Mycobacterium bovis subsp bovis AF2122/97
cugggcaaugacuugcgac

SEQ ID NO: 3059818 - RNA, 23 nt, Mycobacterium bovis subsp bovis AF2122/97
cugggcaaugacuugcgacccgu

SEQ ID NO: 3059819 - RNA, 14 nt, Mycobacterium bovis subsp bovis AF2122/97
cugggcaccggcgg

SEQ ID NO: 3059820 - RNA, 20 nt, Mycobacterium bovis subsp bovis AF2122/97
cugggcaccggcggucugca

SEQ ID NO: 3059821 - RNA, 20 nt, Mycobacterium bovis subsp bovis AF2122/97
cugggcacucggcccggccc

SEQ ID NO: 3059822 - RNA, 22 nt, Mycobacterium bovis subsp bovis AF2122/97
cugggcaucaccgacgcgucgg

SEQ ID NO: 3059823 - RNA, 14 nt, Mycobacterium bovis subsp bovis AF2122/97
cugggcaucaccgc

SEQ ID NO: 3059824 - RNA, 16 nt, Mycobacterium bovis subsp bovis AF2122/97
cugggcaucaccgccg

SEQ ID NO: 3059825 - RNA, 18 nt, Mycobacterium bovis subsp bovis AF2122/97
cugggcaucaccgccgcg

SEQ ID NO: 3059826 - RNA, 17 nt, Mycobacterium bovis subsp bovis AF2122/97
cugguaaggccggccgg

SEQ ID NO: 3059827 - RNA, 18 nt, Mycobacterium bovis subsp bovis AF2122/97
cugguaaggccggccggu

SEQ ID NO: 3059828 - RNA, 15 nt, Mycobacterium bovis subsp bovis AF2122/97
cugguaagucagcuc

SEQ ID NO: 3059829 - RNA, 14 nt, Mycobacterium bovis subsp bovis AF2122/97
cugguaccgcggug

SEQ ID NO: 3059830 - RNA, 15 nt, Mycobacterium bovis subsp bovis AF2122/97
cugguaccgcggugu

SEQ ID NO: 3059831 - RNA, 21 nt, Mycobacterium bovis subsp bovis AF2122/97
cugguagcacccacggcgaga

SEQ ID NO: 3059832 - RNA, 13 nt, Mycobacterium bovis subsp bovis AF2122/97
cugguagcgcacc

SEQ ID NO: 3059833 - RNA, 16 nt, Mycobacterium bovis subsp bovis AF2122/97
cugguaggugucgugg

SEQ ID NO: 3059834 - RNA, 21 nt, Mycobacterium bovis subsp bovis AF2122/97
cugguauagcucacgguggcc

SEQ ID NO: 3059835 - RNA, 18 nt, Mycobacterium bovis subsp bovis AF2122/97
cugguaucgagcaccccg

SEQ ID NO: 3059836 - RNA, 21 nt, Mycobacterium bovis subsp bovis AF2122/97
cugguaucgagcaccccgacg

SEQ ID NO: 3059837 - RNA, 17 nt, Mycobacterium bovis subsp bovis AF2122/97
cugguauucaugcccgu

SEQ ID NO: 3059838 - RNA, 21 nt, Mycobacterium bovis subsp bovis AF2122/97
cugguauucaugcccguccug

SEQ ID NO: 3059839 - RNA, 12 nt, Mycobacterium bovis subsp bovis AF2122/97
cuggucaacagc

SEQ ID NO: 3059840 - RNA, 15 nt, Mycobacterium bovis subsp bovis AF2122/97
cuggucaacagcggc

SEQ ID NO: 3059841 - RNA, 16 nt, Mycobacterium bovis subsp bovis AF2122/97
cuggucaacagcggca

SEQ ID NO: 3059842 - RNA, 15 nt, Mycobacterium bovis subsp bovis AF2122/97
cuggucaagacccgc

SEQ ID NO: 3059843 - RNA, 16 nt, Mycobacterium bovis subsp bovis AF2122/97
cuggucaagguugacg

SEQ ID NO: 3059844 - RNA, 14 nt, Mycobacterium bovis subsp bovis AF2122/97
cuggucacugcccu

SEQ ID NO: 3059845 - RNA, 15 nt, Mycobacterium bovis subsp bovis AF2122/97
cuggucagccgcggc

SEQ ID NO: 3059846 - RNA, 17 nt, Mycobacterium bovis subsp bovis AF2122/97
cuggucagccgcggcgg

SEQ ID NO: 3059847 - RNA, 16 nt, Mycobacterium bovis subsp bovis AF2122/97
cuggucagccgugccg

SEQ ID NO: 3059848 - RNA, 17 nt, Mycobacterium bovis subsp bovis AF2122/97
cuggucagccgugccgu

SEQ ID NO: 3059849 - RNA, 16 nt, Mycobacterium bovis subsp bovis AF2122/97
cugguccaacgaucag

SEQ ID NO: 3059850 - RNA, 14 nt, Mycobacterium bovis subsp bovis AF2122/97
cugguccacccgug

SEQ ID NO: 3059851 - RNA, 11 nt, Mycobacterium bovis subsp bovis AF2122/97
cugguccagca

SEQ ID NO: 3059852 - RNA, 14 nt, Mycobacterium bovis subsp bovis AF2122/97
cugguccagcaccg

SEQ ID NO: 3059853 - RNA, 19 nt, Mycobacterium bovis subsp bovis AF2122/97
cugguccagccggugacgu

SEQ ID NO: 3059854 - RNA, 19 nt, Mycobacterium bovis subsp bovis AF2122/97
cugguccaggcccuggcca

SEQ ID NO: 3059855 - RNA, 22 nt, Mycobacterium bovis subsp bovis AF2122/97
cugguccaggcccuggccagcc

SEQ ID NO: 3059856 - RNA, 16 nt, Mycobacterium bovis subsp bovis AF2122/97
cuggucccacaccucc

SEQ ID NO: 3059857 - RNA, 21 nt, Mycobacterium bovis subsp bovis AF2122/97
cugguccgggugccggugcgc

SEQ ID NO: 3059858 - RNA, 23 nt, Mycobacterium bovis subsp bovis AF2122/97
cuggucgaaacgguacgccgccg

SEQ ID NO: 3059859 - RNA, 15 nt, Mycobacterium bovis subsp bovis AF2122/97
cuggucgaccggcgu

SEQ ID NO: 3059860 - RNA, 16 nt, Mycobacterium bovis subsp bovis AF2122/97
cuggucgaccggcguu

SEQ ID NO: 3059861 - RNA, 20 nt, Mycobacterium bovis subsp bovis AF2122/97
cuggucgagcacgcugcugc

SEQ ID NO: 3059862 - RNA, 22 nt, Mycobacterium bovis subsp bovis AF2122/97
cuggucgauggcguacagcacc

SEQ ID NO: 3059863 - RNA, 14 nt, Mycobacterium bovis subsp bovis AF2122/97
cuggucgcaauggu

SEQ ID NO: 3059864 - RNA, 21 nt, Mycobacterium bovis subsp bovis AF2122/97
cuggucgccaacgccagcacc

SEQ ID NO: 3059865 - RNA, 12 nt, Mycobacterium bovis subsp bovis AF2122/97
cuggucgccgcg

SEQ ID NO: 3059866 - RNA, 14 nt, Mycobacterium bovis subsp bovis AF2122/97
cuggucgccgcggc

SEQ ID NO: 3059867 - RNA, 17 nt, Mycobacterium bovis subsp bovis AF2122/97
cuggucgccgcggcagc

SEQ ID NO: 3059868 - RNA, 14 nt, Mycobacterium bovis subsp bovis AF2122/97
cuggucgccgucga

SEQ ID NO: 3059869 - RNA, 18 nt, Mycobacterium bovis subsp bovis AF2122/97
cuggucgccgucgaagcg

SEQ ID NO: 3059870 - RNA, 19 nt, Mycobacterium bovis subsp bovis AF2122/97
cuggucgccgugggccugu

SEQ ID NO: 3059871 - RNA, 14 nt, Mycobacterium bovis subsp bovis AF2122/97
cuggucgcggcgcu

SEQ ID NO: 3059872 - RNA, 13 nt, Mycobacterium bovis subsp bovis AF2122/97
cuggucgcgucca

SEQ ID NO: 3059873 - RNA, 15 nt, Mycobacterium bovis subsp bovis AF2122/97
cuggucgcguccacc

SEQ ID NO: 3059874 - RNA, 14 nt, Mycobacterium bovis subsp bovis AF2122/97
cuggucgcugcugc

SEQ ID NO: 3059875 - RNA, 15 nt, Mycobacterium bovis subsp bovis AF2122/97
cuggucgcugcugcg

SEQ ID NO: 3059876 - RNA, 17 nt, Mycobacterium bovis subsp bovis AF2122/97
cuggucgcugcugcgau

SEQ ID NO: 3059877 - RNA, 15 nt, Mycobacterium bovis subsp bovis AF2122/97
cuggucgcuggugca

SEQ ID NO: 3059878 - RNA, 20 nt, Mycobacterium bovis subsp bovis AF2122/97
cuggucgcuggugcacggcu

SEQ ID NO: 3059879 - RNA, 14 nt, Mycobacterium bovis subsp bovis AF2122/97
cuggucggccaggu

SEQ ID NO: 3059880 - RNA, 13 nt, Mycobacterium bovis subsp bovis AF2122/97
cuggucggccgca

SEQ ID NO: 3059881 - RNA, 22 nt, Mycobacterium bovis subsp bovis AF2122/97
cuggucggccgcaaggcgccga

SEQ ID NO: 3059882 - RNA, 19 nt, Mycobacterium bovis subsp bovis AF2122/97
cuggucggcuaccgccgac

SEQ ID NO: 3059883 - RNA, 13 nt, Mycobacterium bovis subsp bovis AF2122/97
cuggucggcuucg

SEQ ID NO: 3059884 - RNA, 15 nt, Mycobacterium bovis subsp bovis AF2122/97
cuggucgggucgcac

SEQ ID NO: 3059885 - RNA, 21 nt, Mycobacterium bovis subsp bovis AF2122/97
cuggucgggucgcaccccggc

SEQ ID NO: 3059886 - RNA, 22 nt, Mycobacterium bovis subsp bovis AF2122/97
cuggucggucaauucggugcgc

SEQ ID NO: 3059887 - RNA, 13 nt, Mycobacterium bovis subsp bovis AF2122/97
cuggucggugggc

SEQ ID NO: 3059888 - RNA, 23 nt, Mycobacterium bovis subsp bovis AF2122/97
cuggucgucgaacggcagcccgg

SEQ ID NO: 3059889 - RNA, 14 nt, Mycobacterium bovis subsp bovis AF2122/97
cuggucgugggcca

SEQ ID NO: 3059890 - RNA, 17 nt, Mycobacterium bovis subsp bovis AF2122/97
cuggucgugggccacca

SEQ ID NO: 3059891 - RNA, 20 nt, Mycobacterium bovis subsp bovis AF2122/97
cuggucuacccgcggcgcga

SEQ ID NO: 3059892 - RNA, 18 nt, Mycobacterium bovis subsp bovis AF2122/97
cuggucugcaggcggccu

SEQ ID NO: 3059893 - RNA, 15 nt, Mycobacterium bovis subsp bovis AF2122/97
cuggucuugacucca

SEQ ID NO: 3059894 - RNA, 22 nt, Mycobacterium bovis subsp bovis AF2122/97
cuggucuugacuccauugccgg

SEQ ID NO: 3059895 - RNA, 16 nt, Mycobacterium bovis subsp bovis AF2122/97
cuggucuugccgugca

SEQ ID NO: 3059896 - RNA, 19 nt, Mycobacterium bovis subsp bovis AF2122/97
cuggugaucagcucaguga

SEQ ID NO: 3059897 - RNA, 18 nt, Mycobacterium bovis subsp bovis AF2122/97
cuggugaucugcugggca

SEQ ID NO: 3059898 - RNA, 19 nt, Mycobacterium bovis subsp bovis AF2122/97
cuggugaucugcugggcaa

SEQ ID NO: 3059899 - RNA, 19 nt, Mycobacterium bovis subsp bovis AF2122/97
cuggugcaaccgugccgca

SEQ ID NO: 3059900 - RNA, 19 nt, Mycobacterium bovis subsp bovis AF2122/97
cuggugcagaauucggcgc

SEQ ID NO: 3059901 - RNA, 16 nt, Mycobacterium bovis subsp bovis AF2122/97
cuggugcccgacccgc

SEQ ID NO: 3059902 - RNA, 18 nt, Mycobacterium bovis subsp bovis AF2122/97
cuggugcccgacccgccg

SEQ ID NO: 3059903 - RNA, 21 nt, Mycobacterium bovis subsp bovis AF2122/97
cuggugcccgacccgccgaug

SEQ ID NO: 3059904 - RNA, 14 nt, Mycobacterium bovis subsp bovis AF2122/97
cuggugccugccgc

SEQ ID NO: 3059905 - RNA, 15 nt, Mycobacterium bovis subsp bovis AF2122/97
cuggugccugccgca

SEQ ID NO: 3059906 - RNA, 15 nt, Mycobacterium bovis subsp bovis AF2122/97
cuggugccuuaccac

SEQ ID NO: 3059907 - RNA, 22 nt, Mycobacterium bovis subsp bovis AF2122/97
cuggugccuuaccaccgucucc

SEQ ID NO: 3059908 - RNA, 17 nt, Mycobacterium bovis subsp bovis AF2122/97
cuggugcgccacgccac

SEQ ID NO: 3059909 - RNA, 23 nt, Mycobacterium bovis subsp bovis AF2122/97
cuggugcgccacgccaccgcggu

SEQ ID NO: 3059910 - RNA, 15 nt, Mycobacterium bovis subsp bovis AF2122/97
cuggugcgcccgacg

SEQ ID NO: 3059911 - RNA, 14 nt, Mycobacterium bovis subsp bovis AF2122/97
cuggugcgggacgc

SEQ ID NO: 3059912 - RNA, 15 nt, Mycobacterium bovis subsp bovis AF2122/97
cuggugcgggacgcc

SEQ ID NO: 3059913 - RNA, 20 nt, Mycobacterium bovis subsp bovis AF2122/97
cugucccugcaguccacuga

SEQ ID NO: 3059914 - RNA, 17 nt, Mycobacterium bovis subsp bovis AF2122/97
cuguccgaccucgccgc

SEQ ID NO: 3059915 - RNA, 19 nt, Mycobacterium bovis subsp bovis AF2122/97
cuguccgacuucuccaggc

SEQ ID NO: 3059916 - RNA, 15 nt, Mycobacterium bovis subsp bovis AF2122/97
cuguccggcauaccg

SEQ ID NO: 3059917 - RNA, 15 nt, Mycobacterium bovis subsp bovis AF2122/97
cuguccggcgccgag

SEQ ID NO: 3059918 - RNA, 22 nt, Mycobacterium bovis subsp bovis AF2122/97
cuguccggguagcggcgccgcc

SEQ ID NO: 3059919 - RNA, 20 nt, Mycobacterium bovis subsp bovis AF2122/97
cuguccgguggaauccacca

SEQ ID NO: 3059920 - RNA, 14 nt, Mycobacterium bovis subsp bovis AF2122/97
cuguccucgcgggc

SEQ ID NO: 3059921 - RNA, 16 nt, Mycobacterium bovis subsp bovis AF2122/97
cugucgagccggugcc

SEQ ID NO: 3059922 - RNA, 22 nt, Mycobacterium bovis subsp bovis AF2122/97
cugucgagguggucgacccggc

SEQ ID NO: 3059923 - RNA, 20 nt, Mycobacterium bovis subsp bovis AF2122/97
cugucgauggacaaggugug

SEQ ID NO: 3059924 - RNA, 17 nt, Mycobacterium bovis subsp bovis AF2122/97
cugucgauuucgccguc

SEQ ID NO: 3059925 - RNA, 17 nt, Mycobacterium bovis subsp bovis AF2122/97
cugucgcaacgcaucga

SEQ ID NO: 3059926 - RNA, 16 nt, Mycobacterium bovis subsp bovis AF2122/97
cugucgcccucgaucg

SEQ ID NO: 3059927 - RNA, 21 nt, Mycobacterium bovis subsp bovis AF2122/97
cugucgcccucgaucgccacg

SEQ ID NO: 3059928 - RNA, 23 nt, Mycobacterium bovis subsp bovis AF2122/97
cugucgcccucgaucgccacgac

SEQ ID NO: 3059929 - RNA, 22 nt, Mycobacterium bovis subsp bovis AF2122/97
cugucgccuuugagggcgacga

SEQ ID NO: 3059930 - RNA, 12 nt, Mycobacterium bovis subsp bovis AF2122/97
cugucgcgccgg

SEQ ID NO: 3059931 - RNA, 14 nt, Mycobacterium bovis subsp bovis AF2122/97
cugucgcgggccac

SEQ ID NO: 3059932 - RNA, 13 nt, Mycobacterium bovis subsp bovis AF2122/97
cugucggcaugcc

SEQ ID NO: 3059933 - RNA, 17 nt, Mycobacterium bovis subsp bovis AF2122/97
cugucggcaugccgguc

SEQ ID NO: 3059934 - RNA, 15 nt, Mycobacterium bovis subsp bovis AF2122/97
cugucggcuuccucc

SEQ ID NO: 3059935 - RNA, 17 nt, Mycobacterium bovis subsp bovis AF2122/97
cugucggcuuccuccuc

SEQ ID NO: 3059936 - RNA, 15 nt, Mycobacterium bovis subsp bovis AF2122/97
cugucguaccgcgga

SEQ ID NO: 3059937 - RNA, 19 nt, Mycobacterium bovis subsp bovis AF2122/97
cugucguaccgcggaucgg

SEQ ID NO: 3059938 - RNA, 20 nt, Mycobacterium bovis subsp bovis AF2122/97
cugucgucuuggcgaucggg

SEQ ID NO: 3059939 - RNA, 21 nt, Mycobacterium bovis subsp bovis AF2122/97
cugucgucuuggcgaucgggu

SEQ ID NO: 3059940 - RNA, 21 nt, Mycobacterium bovis subsp bovis AF2122/97
cugucgugauacagcucggug

SEQ ID NO: 3059941 - RNA, 16 nt, Mycobacterium bovis subsp bovis AF2122/97
cugucgugccucucgg

SEQ ID NO: 3059942 - RNA, 20 nt, Mycobacterium bovis subsp bovis AF2122/97
cugucuggucggcuacggcc

SEQ ID NO: 3059943 - RNA, 21 nt, Mycobacterium bovis subsp bovis AF2122/97
cugugaaucucacgacgccuu

SEQ ID NO: 3059944 - RNA, 20 nt, Mycobacterium bovis subsp bovis AF2122/97
cugugacacccgagggccug

SEQ ID NO: 3059945 - RNA, 23 nt, Mycobacterium bovis subsp bovis AF2122/97
cugugacacccgagggccugacg

SEQ ID NO: 3059946 - RNA, 18 nt, Mycobacterium bovis subsp bovis AF2122/97
cugugacgccgggcuggg

SEQ ID NO: 3059947 - RNA, 23 nt, Mycobacterium bovis subsp bovis AF2122/97
cugugauagcgccguacagcggc

SEQ ID NO: 3059948 - RNA, 18 nt, Mycobacterium bovis subsp bovis AF2122/97
cugugauccgacaguggc

SEQ ID NO: 3059949 - RNA, 15 nt, Mycobacterium bovis subsp bovis AF2122/97
cugugaucgagucgc

SEQ ID NO: 3059950 - RNA, 15 nt, Mycobacterium bovis subsp bovis AF2122/97
cugugccaccgcugg

SEQ ID NO: 3059951 - RNA, 15 nt, Mycobacterium bovis subsp bovis AF2122/97
cugugccagcagcag

SEQ ID NO: 3059952 - RNA, 16 nt, Mycobacterium bovis subsp bovis AF2122/97
cugugccagcagcagc

SEQ ID NO: 3059953 - RNA, 22 nt, Mycobacterium bovis subsp bovis AF2122/97
cugugccagcagcagcgccgcg

SEQ ID NO: 3059954 - RNA, 16 nt, Mycobacterium bovis subsp bovis AF2122/97
cugugccccagggcag

SEQ ID NO: 3059955 - RNA, 20 nt, Mycobacterium bovis subsp bovis AF2122/97
cugugccccagggcagugcg

SEQ ID NO: 3059956 - RNA, 16 nt, Mycobacterium bovis subsp bovis AF2122/97
cugugcccgaucagcc

SEQ ID NO: 3059957 - RNA, 21 nt, Mycobacterium bovis subsp bovis AF2122/97
cugugcccucaacgucccagc

SEQ ID NO: 3059958 - RNA, 15 nt, Mycobacterium bovis subsp bovis AF2122/97
cugugccgagaugcc

SEQ ID NO: 3059959 - RNA, 18 nt, Mycobacterium bovis subsp bovis AF2122/97
cugugccgagaugccggc

SEQ ID NO: 3059960 - RNA, 17 nt, Mycobacterium bovis subsp bovis AF2122/97
cugugccgcccccggca

SEQ ID NO: 3059961 - RNA, 12 nt, Mycobacterium bovis subsp bovis AF2122/97
cugugccgccgg

SEQ ID NO: 3059962 - RNA, 16 nt, Mycobacterium bovis subsp bovis AF2122/97
cugugccgccggcgcc

SEQ ID NO: 3059963 - RNA, 21 nt, Mycobacterium bovis subsp bovis AF2122/97
cugugccgcugcauccgcagc

SEQ ID NO: 3059964 - RNA, 18 nt, Mycobacterium bovis subsp bovis AF2122/97
cugugccgugcgaucacc

SEQ ID NO: 3059965 - RNA, 15 nt, Mycobacterium bovis subsp bovis AF2122/97
cugugcgcaaggccg

SEQ ID NO: 3059966 - RNA, 15 nt, Mycobacterium bovis subsp bovis AF2122/97
cugugcgcagacauc

SEQ ID NO: 3059967 - RNA, 17 nt, Mycobacterium bovis subsp bovis AF2122/97
cugugcgcagacaucgg

SEQ ID NO: 3059968 - RNA, 16 nt, Mycobacterium bovis subsp bovis AF2122/97
cugugcgguaucgguc

SEQ ID NO: 3059969 - RNA, 23 nt, Mycobacterium bovis subsp bovis AF2122/97
cugugcguccgcaacagguaggg

SEQ ID NO: 3059970 - RNA, 15 nt, Mycobacterium bovis subsp bovis AF2122/97
cugugcguuccugau

SEQ ID NO: 3059971 - RNA, 16 nt, Mycobacterium bovis subsp bovis AF2122/97
cugugcucacggcggc

SEQ ID NO: 3059972 - RNA, 17 nt, Mycobacterium bovis subsp bovis AF2122/97
cugugcucacggcggcg

SEQ ID NO: 3059973 - RNA, 13 nt, Mycobacterium bovis subsp bovis AF2122/97
cuguggaagcccg

SEQ ID NO: 3059974 - RNA, 15 nt, Mycobacterium bovis subsp bovis AF2122/97
cuguggacacggcgc

SEQ ID NO: 3059975 - RNA, 20 nt, Mycobacterium bovis subsp bovis AF2122/97
cuguggaucgacaccgacgc

SEQ ID NO: 3059976 - RNA, 17 nt, Mycobacterium bovis subsp bovis AF2122/97
cuguggaugccgacggc

SEQ ID NO: 3059977 - RNA, 22 nt, Mycobacterium bovis subsp bovis AF2122/97
cuguggccccaagcgugcugcc

SEQ ID NO: 3059978 - RNA, 14 nt, Mycobacterium bovis subsp bovis AF2122/97
cuguggccgcgucg

SEQ ID NO: 3059979 - RNA, 16 nt, Mycobacterium bovis subsp bovis AF2122/97
cuguggcgccgccggc

SEQ ID NO: 3059980 - RNA, 19 nt, Mycobacterium bovis subsp bovis AF2122/97
cuguggcgccgccggcacc

SEQ ID NO: 3059981 - RNA, 13 nt, Mycobacterium bovis subsp bovis AF2122/97
cugugggauuugc

SEQ ID NO: 3059982 - RNA, 18 nt, Mycobacterium bovis subsp bovis AF2122/97
cugugggauuugcacuac

SEQ ID NO: 3059983 - RNA, 15 nt, Mycobacterium bovis subsp bovis AF2122/97
cugugggcgaucggc

SEQ ID NO: 3059984 - RNA, 15 nt, Mycobacterium bovis subsp bovis AF2122/97
cugugggggcgcacc

SEQ ID NO: 3059985 - RNA, 21 nt, Mycobacterium bovis subsp bovis AF2122/97
cuguggucggugccagcacca

SEQ ID NO: 3059986 - RNA, 13 nt, Mycobacterium bovis subsp bovis AF2122/97
cuguggugacaga

SEQ ID NO: 3059987 - RNA, 21 nt, Mycobacterium bovis subsp bovis AF2122/97
cuguggugacagauccgcccc

SEQ ID NO: 3059988 - RNA, 16 nt, Mycobacterium bovis subsp bovis AF2122/97
cugugguggugauggg

SEQ ID NO: 3059989 - RNA, 16 nt, Mycobacterium bovis subsp bovis AF2122/97
cugugucguacccggc

SEQ ID NO: 3059990 - RNA, 17 nt, Mycobacterium bovis subsp bovis AF2122/97
cugugucguacccggca

SEQ ID NO: 3059991 - RNA, 17 nt, Mycobacterium bovis subsp bovis AF2122/97
cugugucugcucgcgcc

SEQ ID NO: 3059992 - RNA, 19 nt, Mycobacterium bovis subsp bovis AF2122/97
cugugucugcucggcgagc

SEQ ID NO: 3059993 - RNA, 21 nt, Mycobacterium bovis subsp bovis AF2122/97
cuguuacuccgacggcccggu

SEQ ID NO: 3059994 - RNA, 13 nt, Mycobacterium bovis subsp bovis AF2122/97
cuguucaacuccg

SEQ ID NO: 3059995 - RNA, 19 nt, Mycobacterium bovis subsp bovis AF2122/97
cuguuccagaaggccgcac

SEQ ID NO: 3059996 - RNA, 14 nt, Mycobacterium bovis subsp bovis AF2122/97
cuguucccacaucg

SEQ ID NO: 3059997 - RNA, 18 nt, Mycobacterium bovis subsp bovis AF2122/97
cuguucgagaucgccgag

SEQ ID NO: 3059998 - RNA, 16 nt, Mycobacterium bovis subsp bovis AF2122/97
cuguucgccgacgcga

SEQ ID NO: 3059999 - RNA, 17 nt, Mycobacterium bovis subsp bovis AF2122/97
cuuccaacucggcggcc

SEQ ID NO: 3060000 - RNA, 23 nt, Mycobacterium bovis subsp bovis AF2122/97
cuuccaauugauaggccccgagg

SEQ ID NO: 3060001 - RNA, 22 nt, Mycobacterium bovis subsp bovis AF2122/97
cuuccacacgggaagccgcgcc

SEQ ID NO: 3060002 - RNA, 22 nt, Mycobacterium bovis subsp bovis AF2122/97
cuuccacggcguggucggcaaa

SEQ ID NO: 3060003 - RNA, 17 nt, Mycobacterium bovis subsp bovis AF2122/97
cuuccagccacagcccg

SEQ ID NO: 3060004 - RNA, 19 nt, Mycobacterium bovis subsp bovis AF2122/97
cuuccagccacagcccggc

SEQ ID NO: 3060005 - RNA, 12 nt, Mycobacterium bovis subsp bovis AF2122/97
cuuccagcccgg

SEQ ID NO: 3060006 - RNA, 15 nt, Mycobacterium bovis subsp bovis AF2122/97
cuuccaggagcgccg

SEQ ID NO: 3060007 - RNA, 16 nt, Mycobacterium bovis subsp bovis AF2122/97
cuuccaggagcgccgu

SEQ ID NO: 3060008 - RNA, 13 nt, Mycobacterium bovis subsp bovis AF2122/97
cuuccauaacgac

SEQ ID NO: 3060009 - RNA, 13 nt, Mycobacterium bovis subsp bovis AF2122/97
cuuccaucgccac

SEQ ID NO: 3060010 - RNA, 19 nt, Mycobacterium bovis subsp bovis AF2122/97
cuuccauucauggccgcga

SEQ ID NO: 3060011 - RNA, 12 nt, Mycobacterium bovis subsp bovis AF2122/97
cuucccacccgg

SEQ ID NO: 3060012 - RNA, 14 nt, Mycobacterium bovis subsp bovis AF2122/97
cuucccacccggcc

SEQ ID NO: 3060013 - RNA, 19 nt, Mycobacterium bovis subsp bovis AF2122/97
cuucccaggauccggcugc

SEQ ID NO: 3060014 - RNA, 23 nt, Mycobacterium bovis subsp bovis AF2122/97
cuucccaguagaucgccucgacg

SEQ ID NO: 3060015 - RNA, 17 nt, Mycobacterium bovis subsp bovis AF2122/97
cuucccauuucggcaaa

SEQ ID NO: 3060016 - RNA, 22 nt, Mycobacterium bovis subsp bovis AF2122/97
cuuccccagcaguucgccgcgc

SEQ ID NO: 3060017 - RNA, 15 nt, Mycobacterium bovis subsp bovis AF2122/97
cuucccccgguccgg

SEQ ID NO: 3060018 - RNA, 19 nt, Mycobacterium bovis subsp bovis AF2122/97
cuuccccucggccgcccgu

SEQ ID NO: 3060019 - RNA, 16 nt, Mycobacterium bovis subsp bovis AF2122/97
cuucccgcuugagcag

SEQ ID NO: 3060020 - RNA, 21 nt, Mycobacterium bovis subsp bovis AF2122/97
cuucccggaagcgccggccca

SEQ ID NO: 3060021 - RNA, 17 nt, Mycobacterium bovis subsp bovis AF2122/97
cuucccggauagacggc

SEQ ID NO: 3060022 - RNA, 23 nt, Mycobacterium bovis subsp bovis AF2122/97
cuucccuccagauaccaccgccg

SEQ ID NO: 3060023 - RNA, 16 nt, Mycobacterium bovis subsp bovis AF2122/97
cuuccgacgaccaggu

SEQ ID NO: 3060024 - RNA, 13 nt, Mycobacterium bovis subsp bovis AF2122/97
cuuccgccgccgc

SEQ ID NO: 3060025 - RNA, 23 nt, Mycobacterium bovis subsp bovis AF2122/97
cuuccgcgacgcucgcugcagca

SEQ ID NO: 3060026 - RNA, 23 nt, Mycobacterium bovis subsp bovis AF2122/97
cuuccgcgcgcagaugagcgcgg

SEQ ID NO: 3060027 - RNA, 22 nt, Mycobacterium bovis subsp bovis AF2122/97
cuuccgcgcuucacagccacca

SEQ ID NO: 3060028 - RNA, 23 nt, Mycobacterium bovis subsp bovis AF2122/97
cuuccggauucggacucgccgac

SEQ ID NO: 3060029 - RNA, 15 nt, Mycobacterium bovis subsp bovis AF2122/97
cuuccggcguggccc

SEQ ID NO: 3060030 - RNA, 16 nt, Mycobacterium bovis subsp bovis AF2122/97
cuuccggcguggcccc

SEQ ID NO: 3060031 - RNA, 17 nt, Mycobacterium bovis subsp bovis AF2122/97
cuuccggcguggcccca

SEQ ID NO: 3060032 - RNA, 17 nt, Mycobacterium bovis subsp bovis AF2122/97
cuuccgggacuaccacc

SEQ ID NO: 3060033 - RNA, 19 nt, Mycobacterium bovis subsp bovis AF2122/97
cuuccgggcagcugggcag

SEQ ID NO: 3060034 - RNA, 13 nt, Mycobacterium bovis subsp bovis AF2122/97
cuuccgguccagc

SEQ ID NO: 3060035 - RNA, 17 nt, Mycobacterium bovis subsp bovis AF2122/97
cuuccuccucggcgcga

SEQ ID NO: 3060036 - RNA, 19 nt, Mycobacterium bovis subsp bovis AF2122/97
cuuccucggauugcagcgc

SEQ ID NO: 3060037 - RNA, 13 nt, Mycobacterium bovis subsp bovis AF2122/97
cuuccucggcaag

SEQ ID NO: 3060038 - RNA, 13 nt, Mycobacterium bovis subsp bovis AF2122/97
cuuccucggccac

SEQ ID NO: 3060039 - RNA, 14 nt, Mycobacterium bovis subsp bovis AF2122/97
cuuccucggccacc

SEQ ID NO: 3060040 - RNA, 15 nt, Mycobacterium bovis subsp bovis AF2122/97
cuuccucggccaccc

SEQ ID NO: 3060041 - RNA, 17 nt, Mycobacterium bovis subsp bovis AF2122/97
cuuccucggccacccgc

SEQ ID NO: 3060042 - RNA, 23 nt, Mycobacterium bovis subsp bovis AF2122/97
cuuccucggggcucucgagucca

SEQ ID NO: 3060043 - RNA, 21 nt, Mycobacterium bovis subsp bovis AF2122/97
cuuccucguaggcguacacca

SEQ ID NO: 3060044 - RNA, 14 nt, Mycobacterium bovis subsp bovis AF2122/97
cuuccugaggguuu

SEQ ID NO: 3060045 - RNA, 21 nt, Mycobacterium bovis subsp bovis AF2122/97
cuuccugauuucaacggucaa

SEQ ID NO: 3060046 - RNA, 14 nt, Mycobacterium bovis subsp bovis AF2122/97
cuuccuggcgugag

SEQ ID NO: 3060047 - RNA, 19 nt, Mycobacterium bovis subsp bovis AF2122/97
cuuccuggguuggcaucca

SEQ ID NO: 3060048 - RNA, 23 nt, Mycobacterium bovis subsp bovis AF2122/97
cuuccuggguugugccgcccugg

SEQ ID NO: 3060049 - RNA, 14 nt, Mycobacterium bovis subsp bovis AF2122/97
cuuccuguacaacc

SEQ ID NO: 3060050 - RNA, 15 nt, Mycobacterium bovis subsp bovis AF2122/97
cuuccuugccagggu

SEQ ID NO: 3060051 - RNA, 21 nt, Mycobacterium bovis subsp bovis AF2122/97
cuucgaaccguuucgccggcg

SEQ ID NO: 3060052 - RNA, 17 nt, Mycobacterium bovis subsp bovis AF2122/97
cuucgaagcgaucgccg

SEQ ID NO: 3060053 - RNA, 21 nt, Mycobacterium bovis subsp bovis AF2122/97
cuucgaagcgaucgccggccg

SEQ ID NO: 3060054 - RNA, 17 nt, Mycobacterium bovis subsp bovis AF2122/97
cuucgaaugccgugccg

SEQ ID NO: 3060055 - RNA, 14 nt, Mycobacterium bovis subsp bovis AF2122/97
cuucgacagcgcgc

SEQ ID NO: 3060056 - RNA, 16 nt, Mycobacterium bovis subsp bovis AF2122/97
cuucgacaggccaccg

SEQ ID NO: 3060057 - RNA, 13 nt, Mycobacterium bovis subsp bovis AF2122/97
cuucgaccgccgu

SEQ ID NO: 3060058 - RNA, 14 nt, Mycobacterium bovis subsp bovis AF2122/97
cuucgaccucaccc

SEQ ID NO: 3060059 - RNA, 16 nt, Mycobacterium bovis subsp bovis AF2122/97
cuucgacgcgcauucg

SEQ ID NO: 3060060 - RNA, 17 nt, Mycobacterium bovis subsp bovis AF2122/97
cuucgacgcggcgaccg

SEQ ID NO: 3060061 - RNA, 15 nt, Mycobacterium bovis subsp bovis AF2122/97
cuucgacggcggcca

SEQ ID NO: 3060062 - RNA, 16 nt, Mycobacterium bovis subsp bovis AF2122/97
cuucgacgucggcgac

SEQ ID NO: 3060063 - RNA, 15 nt, Mycobacterium bovis subsp bovis AF2122/97
cuucgacguugcgga

SEQ ID NO: 3060064 - RNA, 12 nt, Mycobacterium bovis subsp bovis AF2122/97
cuucgagcaccg

SEQ ID NO: 3060065 - RNA, 21 nt, Mycobacterium bovis subsp bovis AF2122/97
cuucgagcaccgacaccggcc

SEQ ID NO: 3060066 - RNA, 22 nt, Mycobacterium bovis subsp bovis AF2122/97
cuucgagcaccgacaccggccg

SEQ ID NO: 3060067 - RNA, 20 nt, Mycobacterium bovis subsp bovis AF2122/97
cuucgauaaccucagcgcgg

SEQ ID NO: 3060068 - RNA, 15 nt, Mycobacterium bovis subsp bovis AF2122/97
cuucgauaccgaccg

SEQ ID NO: 3060069 - RNA, 20 nt, Mycobacterium bovis subsp bovis AF2122/97
cuucgaucaucgaccuggcc

SEQ ID NO: 3060070 - RNA, 22 nt, Mycobacterium bovis subsp bovis AF2122/97
cuucgaucaucgaccuggccac

SEQ ID NO: 3060071 - RNA, 21 nt, Mycobacterium bovis subsp bovis AF2122/97
cuucgauggguagcgagucga

SEQ ID NO: 3060072 - RNA, 22 nt, Mycobacterium bovis subsp bovis AF2122/97
cuucgauggugugcccgcaccg

SEQ ID NO: 3060073 - RNA, 16 nt, Mycobacterium bovis subsp bovis AF2122/97
cuucgaugucgccgcu

SEQ ID NO: 3060074 - RNA, 16 nt, Mycobacterium bovis subsp bovis AF2122/97
cuucgcaagucaucca

SEQ ID NO: 3060075 - RNA, 22 nt, Mycobacterium bovis subsp bovis AF2122/97
cuucgcaguugagggugugagg

SEQ ID NO: 3060076 - RNA, 18 nt, Mycobacterium bovis subsp bovis AF2122/97
cuucgccaacugcggcag

SEQ ID NO: 3060077 - RNA, 14 nt, Mycobacterium bovis subsp bovis AF2122/97
cuucgccacaccau

SEQ ID NO: 3060078 - RNA, 18 nt, Mycobacterium bovis subsp bovis AF2122/97
cuucgccagcgccacugg

SEQ ID NO: 3060079 - RNA, 13 nt, Mycobacterium bovis subsp bovis AF2122/97
cuucgccagcggc

SEQ ID NO: 3060080 - RNA, 14 nt, Mycobacterium bovis subsp bovis AF2122/97
cuucgccagcggcg

SEQ ID NO: 3060081 - RNA, 23 nt, Mycobacterium bovis subsp bovis AF2122/97
cuucgcccagagccgcugcggca

SEQ ID NO: 3060082 - RNA, 14 nt, Mycobacterium bovis subsp bovis AF2122/97
cuucgcccgggccg

SEQ ID NO: 3060083 - RNA, 16 nt, Mycobacterium bovis subsp bovis AF2122/97
cuucgcccgggccgcg

SEQ ID NO: 3060084 - RNA, 22 nt, Mycobacterium bovis subsp bovis AF2122/97
cuucgccgaagcgccgcuuggc

SEQ ID NO: 3060085 - RNA, 23 nt, Mycobacterium bovis subsp bovis AF2122/97
cuucuccguccccgcagcgccua

SEQ ID NO: 3060086 - RNA, 14 nt, Mycobacterium bovis subsp bovis AF2122/97
cuucuccuccagag

SEQ ID NO: 3060087 - RNA, 14 nt, Mycobacterium bovis subsp bovis AF2122/97
cuucuccucgucgg

SEQ ID NO: 3060088 - RNA, 17 nt, Mycobacterium bovis subsp bovis AF2122/97
cuucucgagccgccgga

SEQ ID NO: 3060089 - RNA, 14 nt, Mycobacterium bovis subsp bovis AF2122/97
cuucucgccgccgc

SEQ ID NO: 3060090 - RNA, 22 nt, Mycobacterium bovis subsp bovis AF2122/97
cuucucgcggaccucggcgacc

SEQ ID NO: 3060091 - RNA, 18 nt, Mycobacterium bovis subsp bovis AF2122/97
cuucucggacacgcugua

SEQ ID NO: 3060092 - RNA, 18 nt, Mycobacterium bovis subsp bovis AF2122/97
cuucucggcgggucaggc

SEQ ID NO: 3060093 - RNA, 20 nt, Mycobacterium bovis subsp bovis AF2122/97
cuucucggcgggucaggcca

SEQ ID NO: 3060094 - RNA, 19 nt, Mycobacterium bovis subsp bovis AF2122/97
cuucucgucggugcgcgcg

SEQ ID NO: 3060095 - RNA, 22 nt, Mycobacterium bovis subsp bovis AF2122/97
cuucucgucggugcgcgcggcg

SEQ ID NO: 3060096 - RNA, 15 nt, Mycobacterium bovis subsp bovis AF2122/97
cuucugacgcggccg

SEQ ID NO: 3060097 - RNA, 14 nt, Mycobacterium bovis subsp bovis AF2122/97
cuucugagacugcc

SEQ ID NO: 3060098 - RNA, 18 nt, Mycobacterium bovis subsp bovis AF2122/97
cuucugagacugccgccg

SEQ ID NO: 3060099 - RNA, 13 nt, Mycobacterium bovis subsp bovis AF2122/97
cuucugccgggag

SEQ ID NO: 3060100 - RNA, 22 nt, Mycobacterium bovis subsp bovis AF2122/97
cuucugccgggagacgcugcgc

SEQ ID NO: 3060101 - RNA, 16 nt, Mycobacterium bovis subsp bovis AF2122/97
cuucugccuuggccgg

SEQ ID NO: 3060102 - RNA, 17 nt, Mycobacterium bovis subsp bovis AF2122/97
cuucugcgucugcucgc

SEQ ID NO: 3060103 - RNA, 13 nt, Mycobacterium bovis subsp bovis AF2122/97
cuucugcuacccg

SEQ ID NO: 3060104 - RNA, 17 nt, Mycobacterium bovis subsp bovis AF2122/97
cuucugcuacccgagcc

SEQ ID NO: 3060105 - RNA, 18 nt, Mycobacterium bovis subsp bovis AF2122/97
cuucuggcaggugaacug

SEQ ID NO: 3060106 - RNA, 16 nt, Mycobacterium bovis subsp bovis AF2122/97
cuucugguccagcacc

SEQ ID NO: 3060107 - RNA, 18 nt, Mycobacterium bovis subsp bovis AF2122/97
cuucuuaccgcgggccgc

SEQ ID NO: 3060108 - RNA, 20 nt, Mycobacterium bovis subsp bovis AF2122/97
cuucuucaccgccuugguca

SEQ ID NO: 3060109 - RNA, 14 nt, Mycobacterium bovis subsp bovis AF2122/97
cuucuucacuggcg

SEQ ID NO: 3060110 - RNA, 19 nt, Mycobacterium bovis subsp bovis AF2122/97
cuucuucacuggcgaacca

SEQ ID NO: 3060111 - RNA, 16 nt, Mycobacterium bovis subsp bovis AF2122/97
cuucuucgcuaccuuc

SEQ ID NO: 3060112 - RNA, 17 nt, Mycobacterium bovis subsp bovis AF2122/97
cuucuucgcuaccuucu

SEQ ID NO: 3060113 - RNA, 21 nt, Mycobacterium bovis subsp bovis AF2122/97
cuucuucgcuaccuucuuggc

SEQ ID NO: 3060114 - RNA, 19 nt, Mycobacterium bovis subsp bovis AF2122/97
cuucuucggacagcagccg

SEQ ID NO: 3060115 - RNA, 22 nt, Mycobacterium bovis subsp bovis AF2122/97
cuucuugacacccaccucgcca

SEQ ID NO: 3060116 - RNA, 19 nt, Mycobacterium bovis subsp bovis AF2122/97
cuucuugcgccgagaucga

SEQ ID NO: 3060117 - RNA, 19 nt, Mycobacterium bovis subsp bovis AF2122/97
cuucuuggcaggugccuuc

SEQ ID NO: 3060118 - RNA, 19 nt, Mycobacterium bovis subsp bovis AF2122/97
cuucuuggcggccuuuguc

SEQ ID NO: 3060119 - RNA, 17 nt, Mycobacterium bovis subsp bovis AF2122/97
cuugaaacccaggccgu

SEQ ID NO: 3060120 - RNA, 16 nt, Mycobacterium bovis subsp bovis AF2122/97
cuugaagguucgaucg

SEQ ID NO: 3060121 - RNA, 23 nt, Mycobacterium bovis subsp bovis AF2122/97
cuugacagcuuucuuggcgggcg

SEQ ID NO: 3060122 - RNA, 20 nt, Mycobacterium bovis subsp bovis AF2122/97
cuugaccacagcggagacga

SEQ ID NO: 3060123 - RNA, 23 nt, Mycobacterium bovis subsp bovis AF2122/97
cuugaccacagcggagacgaucg

SEQ ID NO: 3060124 - RNA, 13 nt, Mycobacterium bovis subsp bovis AF2122/97
cuugaccagagca

SEQ ID NO: 3060125 - RNA, 17 nt, Mycobacterium bovis subsp bovis AF2122/97
cuugaccagcagcugaa

SEQ ID NO: 3060126 - RNA, 15 nt, Mycobacterium bovis subsp bovis AF2122/97
cuugaccccgccgaa

SEQ ID NO: 3060127 - RNA, 15 nt, Mycobacterium bovis subsp bovis AF2122/97
cuugaccccuggccg

SEQ ID NO: 3060128 - RNA, 21 nt, Mycobacterium bovis subsp bovis AF2122/97
cuugaccccuggccgccggcg

SEQ ID NO: 3060129 - RNA, 12 nt, Mycobacterium bovis subsp bovis AF2122/97
cuugaccgcacc

SEQ ID NO: 3060130 - RNA, 23 nt, Mycobacterium bovis subsp bovis AF2122/97
cuugaccgcggucuucuucaccg

SEQ ID NO: 3060131 - RNA, 21 nt, Mycobacterium bovis subsp bovis AF2122/97
cuugaccgcggugacucggcc

SEQ ID NO: 3060132 - RNA, 21 nt, Mycobacterium bovis subsp bovis AF2122/97
cuugaccgggucgaugacgcc

SEQ ID NO: 3060133 - RNA, 15 nt, Mycobacterium bovis subsp bovis AF2122/97
cuugaccguccaccg

SEQ ID NO: 3060134 - RNA, 17 nt, Mycobacterium bovis subsp bovis AF2122/97
cuugacgcgcaacgccg

SEQ ID NO: 3060135 - RNA, 22 nt, Mycobacterium bovis subsp bovis AF2122/97
cuugacgcggccacauaccacc

SEQ ID NO: 3060136 - RNA, 16 nt, Mycobacterium bovis subsp bovis AF2122/97
cuugacggcgccaggc

SEQ ID NO: 3060137 - RNA, 14 nt, Mycobacterium bovis subsp bovis AF2122/97
cuugacuccgcgcg

SEQ ID NO: 3060138 - RNA, 21 nt, Mycobacterium bovis subsp bovis AF2122/97
cuugacuccgcgcgcugggcc

SEQ ID NO: 3060139 - RNA, 15 nt, Mycobacterium bovis subsp bovis AF2122/97
cuugacugcacacca

SEQ ID NO: 3060140 - RNA, 14 nt, Mycobacterium bovis subsp bovis AF2122/97
cuugagaaacccga

SEQ ID NO: 3060141 - RNA, 13 nt, Mycobacterium bovis subsp bovis AF2122/97
cuugagacgccgg

SEQ ID NO: 3060142 - RNA, 17 nt, Mycobacterium bovis subsp bovis AF2122/97
cuugagcacuccgucgu

SEQ ID NO: 3060143 - RNA, 16 nt, Mycobacterium bovis subsp bovis AF2122/97
cuugagccgcagcacc

SEQ ID NO: 3060144 - RNA, 24 nt, Mycobacterium bovis subsp bovis AF2122/97
cuugagccggacguucuggaucgu

SEQ ID NO: 3060145 - RNA, 19 nt, Mycobacterium bovis subsp bovis AF2122/97
cuugagccgggcaaccagc

SEQ ID NO: 3060146 - RNA, 21 nt, Mycobacterium bovis subsp bovis AF2122/97
cuugagccgggcaaccagcag

SEQ ID NO: 3060147 - RNA, 16 nt, Mycobacterium bovis subsp bovis AF2122/97
cuugagcgaguugcag

SEQ ID NO: 3060148 - RNA, 20 nt, Mycobacterium bovis subsp bovis AF2122/97
cuugagcucgcugaucaggu

SEQ ID NO: 3060149 - RNA, 20 nt, Mycobacterium bovis subsp bovis AF2122/97
cuugaggauccgcaccacgc

SEQ ID NO: 3060150 - RNA, 14 nt, Mycobacterium bovis subsp bovis AF2122/97
cuugaggucaccca

SEQ ID NO: 3060151 - RNA, 17 nt, Mycobacterium bovis subsp bovis AF2122/97
cuugagguccgucgcgc

SEQ ID NO: 3060152 - RNA, 19 nt, Mycobacterium bovis subsp bovis AF2122/97
cuugaucaaggugucgacg

SEQ ID NO: 3060153 - RNA, 12 nt, Mycobacterium bovis subsp bovis AF2122/97
cuugaucagccg

SEQ ID NO: 3060154 - RNA, 19 nt, Mycobacterium bovis subsp bovis AF2122/97
cuugaucagccgccaaccg

SEQ ID NO: 3060155 - RNA, 13 nt, Mycobacterium bovis subsp bovis AF2122/97
cuugaucgagcag

SEQ ID NO: 3060156 - RNA, 13 nt, Mycobacterium bovis subsp bovis AF2122/97
cuugaucggcaca

SEQ ID NO: 3060157 - RNA, 22 nt, Mycobacterium bovis subsp bovis AF2122/97
cuugaugccggccaaguugacc

SEQ ID NO: 3060158 - RNA, 15 nt, Mycobacterium bovis subsp bovis AF2122/97
cuugaugcucgaugc

SEQ ID NO: 3060159 - RNA, 17 nt, Mycobacterium bovis subsp bovis AF2122/97
cuugauggucuccacca

SEQ ID NO: 3060160 - RNA, 15 nt, Mycobacterium bovis subsp bovis AF2122/97
cuugauguccgcgac

SEQ ID NO: 3060161 - RNA, 16 nt, Mycobacterium bovis subsp bovis AF2122/97
cuugauguccgcgacg

SEQ ID NO: 3060162 - RNA, 14 nt, Mycobacterium bovis subsp bovis AF2122/97
cuugauuucgaucg

SEQ ID NO: 3060163 - RNA, 22 nt, Mycobacterium bovis subsp bovis AF2122/97
cuugcaacaccccgagccgcag

SEQ ID NO: 3060164 - RNA, 21 nt, Mycobacterium bovis subsp bovis AF2122/97
cuugcaccggccgaaggcgcu

SEQ ID NO: 3060165 - RNA, 14 nt, Mycobacterium bovis subsp bovis AF2122/97
cuugcagcgcguuc

SEQ ID NO: 3060166 - RNA, 16 nt, Mycobacterium bovis subsp bovis AF2122/97
cuugcagcgcguucgg

SEQ ID NO: 3060167 - RNA, 17 nt, Mycobacterium bovis subsp bovis AF2122/97
cuugcaggcgucccagc

SEQ ID NO: 3060168 - RNA, 21 nt, Mycobacterium bovis subsp bovis AF2122/97
cuugcaguaacuucaccggcu

SEQ ID NO: 3060169 - RNA, 15 nt, Mycobacterium bovis subsp bovis AF2122/97
cuugcagugagguca

SEQ ID NO: 3060170 - RNA, 15 nt, Mycobacterium bovis subsp bovis AF2122/97
cuugcauccggccca

SEQ ID NO: 3060171 - RNA, 20 nt, Mycobacterium bovis subsp bovis AF2122/97
cuuggcaguccagccgggug

SEQ ID NO: 3060172 - RNA, 14 nt, Mycobacterium bovis subsp bovis AF2122/97
cuuggccaccaucg

SEQ ID NO: 3060173 - RNA, 19 nt, Mycobacterium bovis subsp bovis AF2122/97
cuuggccaccaucgccgcc

SEQ ID NO: 3060174 - RNA, 18 nt, Mycobacterium bovis subsp bovis AF2122/97
cuuggccagacccaccac

SEQ ID NO: 3060175 - RNA, 21 nt, Mycobacterium bovis subsp bovis AF2122/97
cuuggccagcagcagcgcuuc

SEQ ID NO: 3060176 - RNA, 16 nt, Mycobacterium bovis subsp bovis AF2122/97
cuuggccagcagcgcg

SEQ ID NO: 3060177 - RNA, 16 nt, Mycobacterium bovis subsp bovis AF2122/97
cuuggccagccacucc

SEQ ID NO: 3060178 - RNA, 17 nt, Mycobacterium bovis subsp bovis AF2122/97
cuuggccaugcugguca

SEQ ID NO: 3060179 - RNA, 17 nt, Mycobacterium bovis subsp bovis AF2122/97
cuuggcccgggcccgcg

SEQ ID NO: 3060180 - RNA, 18 nt, Mycobacterium bovis subsp bovis AF2122/97
cuuggccgccccggccgc

SEQ ID NO: 3060181 - RNA, 15 nt, Mycobacterium bovis subsp bovis AF2122/97
cuuggccgccgccac

SEQ ID NO: 3060182 - RNA, 14 nt, Mycobacterium bovis subsp bovis AF2122/97
cuuggccgcugccu

SEQ ID NO: 3060183 - RNA, 17 nt, Mycobacterium bovis subsp bovis AF2122/97
cuuggccggcaggucca

SEQ ID NO: 3060184 - RNA, 20 nt, Mycobacterium bovis subsp bovis AF2122/97
cuuggccggcuugucgacca

SEQ ID NO: 3060185 - RNA, 15 nt, Mycobacterium bovis subsp bovis AF2122/97
cuuggccgggucgaa

SEQ ID NO: 3060186 - RNA, 21 nt, Mycobacterium bovis subsp bovis AF2122/97
cuuggccguaggcggcgaccc

SEQ ID NO: 3060187 - RNA, 16 nt, Mycobacterium bovis subsp bovis AF2122/97
cuuggccucagccacc

SEQ ID NO: 3060188 - RNA, 22 nt, Mycobacterium bovis subsp bovis AF2122/97
cuuggccugcgcuucguccagc

SEQ ID NO: 3060189 - RNA, 18 nt, Mycobacterium bovis subsp bovis AF2122/97
cuuggcgaacgccacggc

SEQ ID NO: 3060190 - RNA, 19 nt, Mycobacterium bovis subsp bovis AF2122/97
cuuggcgacaugcagcgcc

SEQ ID NO: 3060191 - RNA, 20 nt, Mycobacterium bovis subsp bovis AF2122/97
cuuggcgaucucaccuggag

SEQ ID NO: 3060192 - RNA, 14 nt, Mycobacterium bovis subsp bovis AF2122/97
cuuggcgcccgccg

SEQ ID NO: 3060193 - RNA, 19 nt, Mycobacterium bovis subsp bovis AF2122/97
cuuggcgcccgccggcaac

SEQ ID NO: 3060194 - RNA, 18 nt, Mycobacterium bovis subsp bovis AF2122/97
cuuggcgccgaugccggc

SEQ ID NO: 3060195 - RNA, 22 nt, Mycobacterium bovis subsp bovis AF2122/97
cuuggcggaacaagguauggcc

SEQ ID NO: 3060196 - RNA, 23 nt, Mycobacterium bovis subsp bovis AF2122/97
cuuggcggccaacggcuccgggc

SEQ ID NO: 3060197 - RNA, 15 nt, Mycobacterium bovis subsp bovis AF2122/97
cuuggcggccagccg

SEQ ID NO: 3060198 - RNA, 12 nt, Mycobacterium bovis subsp bovis AF2122/97
cuuggcggccuu

SEQ ID NO: 3060199 - RNA, 18 nt, Mycobacterium bovis subsp bovis AF2122/97
cuuggcggccuuugucgc

SEQ ID NO: 3060200 - RNA, 21 nt, Mycobacterium bovis subsp bovis AF2122/97
cuuggcgggagccuugguagc

SEQ ID NO: 3060201 - RNA, 13 nt, Mycobacterium bovis subsp bovis AF2122/97
cuuggcgggcgcc

SEQ ID NO: 3060202 - RNA, 19 nt, Mycobacterium bovis subsp bovis AF2122/97
cuuggcgggcgccuugguc

SEQ ID NO: 3060203 - RNA, 16 nt, Mycobacterium bovis subsp bovis AF2122/97
cuuggcggucugcgcc

SEQ ID NO: 3060204 - RNA, 17 nt, Mycobacterium bovis subsp bovis AF2122/97
cuuggcgguggcccgau

SEQ ID NO: 3060205 - RNA, 12 nt, Mycobacterium bovis subsp bovis AF2122/97
cuuggcgucgac

SEQ ID NO: 3060206 - RNA, 23 nt, Mycobacterium bovis subsp bovis AF2122/97
cuuggcgucgacaucggugacgg

SEQ ID NO: 3060207 - RNA, 19 nt, Mycobacterium bovis subsp bovis AF2122/97
cuuggcgucgaugcgggcc

SEQ ID NO: 3060208 - RNA, 23 nt, Mycobacterium bovis subsp bovis AF2122/97
cuuggcguugaccagcacgacug

SEQ ID NO: 3060209 - RNA, 17 nt, Mycobacterium bovis subsp bovis AF2122/97
cuuggcuaacaccgcag

SEQ ID NO: 3060210 - RNA, 13 nt, Mycobacterium bovis subsp bovis AF2122/97
cuuggcugcgaga

SEQ ID NO: 3060211 - RNA, 18 nt, Mycobacterium bovis subsp bovis AF2122/97
cuuggcugcgagagcacc

SEQ ID NO: 3060212 - RNA, 17 nt, Mycobacterium bovis subsp bovis AF2122/97
cuuggcugggcccgccg

SEQ ID NO: 3060213 - RNA, 14 nt, Mycobacterium bovis subsp bovis AF2122/97
cuugggaaacccgg

SEQ ID NO: 3060214 - RNA, 20 nt, Mycobacterium bovis subsp bovis AF2122/97
cuugggaaacccggccagcu

SEQ ID NO: 3060215 - RNA, 17 nt, Mycobacterium bovis subsp bovis AF2122/97
cuugggaccgacuugcc

SEQ ID NO: 3060216 - RNA, 14 nt, Mycobacterium bovis subsp bovis AF2122/97
cuugggaccgcgcc

SEQ ID NO: 3060217 - RNA, 15 nt, Mycobacterium bovis subsp bovis AF2122/97
cuugggaccgcgcca

SEQ ID NO: 3060218 - RNA, 15 nt, Mycobacterium bovis subsp bovis AF2122/97
cuugggacugcggac

SEQ ID NO: 3060219 - RNA, 19 nt, Mycobacterium bovis subsp bovis AF2122/97
cuugggauugcgggccugc

SEQ ID NO: 3060220 - RNA, 23 nt, Mycobacterium bovis subsp bovis AF2122/97
cuugggcagauauugccugccac

SEQ ID NO: 3060221 - RNA, 17 nt, Mycobacterium bovis subsp bovis AF2122/97
cuugggccagcgcaucu

SEQ ID NO: 3060222 - RNA, 12 nt, Mycobacterium bovis subsp bovis AF2122/97
cuugggccaggc

SEQ ID NO: 3060223 - RNA, 15 nt, Mycobacterium bovis subsp bovis AF2122/97
cuugggccaggccca

SEQ ID NO: 3060224 - RNA, 13 nt, Mycobacterium bovis subsp bovis AF2122/97
cuugggcccgcug

SEQ ID NO: 3060225 - RNA, 20 nt, Mycobacterium bovis subsp bovis AF2122/97
cuugggcgacgcggcgccgc

SEQ ID NO: 3060226 - RNA, 22 nt, Mycobacterium bovis subsp bovis AF2122/97
cuugggcgacgcggcgccgcca

SEQ ID NO: 3060227 - RNA, 13 nt, Mycobacterium bovis subsp bovis AF2122/97
cuugggcggcacu

SEQ ID NO: 3060228 - RNA, 21 nt, Mycobacterium bovis subsp bovis AF2122/97
cuugggcggcacuggauccgg

SEQ ID NO: 3060229 - RNA, 18 nt, Mycobacterium bovis subsp bovis AF2122/97
cuugggcgguagccgacg

SEQ ID NO: 3060230 - RNA, 20 nt, Mycobacterium bovis subsp bovis AF2122/97
cuugggcgguagccgacgac

SEQ ID NO: 3060231 - RNA, 18 nt, Mycobacterium bovis subsp bovis AF2122/97
cuugggcguacucggcgc

SEQ ID NO: 3060232 - RNA, 23 nt, Mycobacterium bovis subsp bovis AF2122/97
cuugggcgucgucuugaccgcuu

SEQ ID NO: 3060233 - RNA, 19 nt, Mycobacterium bovis subsp bovis AF2122/97
cuugggcucgaaaacaugu

SEQ ID NO: 3060234 - RNA, 12 nt, Mycobacterium bovis subsp bovis AF2122/97
cuugggcuucga

SEQ ID NO: 3060235 - RNA, 17 nt, Mycobacterium bovis subsp bovis AF2122/97
cuugggcuugcgccgga

SEQ ID NO: 3060236 - RNA, 22 nt, Mycobacterium bovis subsp bovis AF2122/97
cuuggguaggcaauggcgugcg

SEQ ID NO: 3060237 - RNA, 17 nt, Mycobacterium bovis subsp bovis AF2122/97
cuugggucggucacgac

SEQ ID NO: 3060238 - RNA, 14 nt, Mycobacterium bovis subsp bovis AF2122/97
cuugggucuccgga

SEQ ID NO: 3060239 - RNA, 18 nt, Mycobacterium bovis subsp bovis AF2122/97
cuuggguugauuggcccc

SEQ ID NO: 3060240 - RNA, 15 nt, Mycobacterium bovis subsp bovis AF2122/97
cuugguagccggccg

SEQ ID NO: 3060241 - RNA, 16 nt, Mycobacterium bovis subsp bovis AF2122/97
cuugguagccggccgc

SEQ ID NO: 3060242 - RNA, 20 nt, Mycobacterium bovis subsp bovis AF2122/97
cuuggucaaaaagcucggcc

SEQ ID NO: 3060243 - RNA, 17 nt, Mycobacterium bovis subsp bovis AF2122/97
cuuggucaccuucuugg

SEQ ID NO: 3060244 - RNA, 19 nt, Mycobacterium bovis subsp bovis AF2122/97
cuugguccugcggucgcgg

SEQ ID NO: 3060245 - RNA, 17 nt, Mycobacterium bovis subsp bovis AF2122/97
cuuggucgaccgccgag

SEQ ID NO: 3060246 - RNA, 15 nt, Mycobacterium bovis subsp bovis AF2122/97
cuuggucgcccagcc

SEQ ID NO: 3060247 - RNA, 23 nt, Mycobacterium bovis subsp bovis AF2122/97
cuuggucgccgccuuacgcaccg

SEQ ID NO: 3060248 - RNA, 18 nt, Mycobacterium bovis subsp bovis AF2122/97
cuuggucgccgccuucuu

SEQ ID NO: 3060249 - RNA, 17 nt, Mycobacterium bovis subsp bovis AF2122/97
cuuggucuugaacccga

SEQ ID NO: 3060250 - RNA, 16 nt, Mycobacterium bovis subsp bovis AF2122/97
cuuggugaaccgcgcg

SEQ ID NO: 3060251 - RNA, 15 nt, Mycobacterium bovis subsp bovis AF2122/97
cuuggugccauucga

SEQ ID NO: 3060252 - RNA, 17 nt, Mycobacterium bovis subsp bovis AF2122/97
cuuggugcgcgucagcc

SEQ ID NO: 3060253 - RNA, 14 nt, Mycobacterium bovis subsp bovis AF2122/97
cuugguggccagcc

SEQ ID NO: 3060254 - RNA, 19 nt, Mycobacterium bovis subsp bovis AF2122/97
cuugguggucuuggccggu

SEQ ID NO: 3060255 - RNA, 20 nt, Mycobacterium bovis subsp bovis AF2122/97
cuugguuagccgcggcccgc

SEQ ID NO: 3060256 - RNA, 17 nt, Mycobacterium bovis subsp bovis AF2122/97
cuuguaaacgaagaacu

SEQ ID NO: 3060257 - RNA, 17 nt, Mycobacterium bovis subsp bovis AF2122/97
cuuugucacgcaccgcg

SEQ ID NO: 3060258 - RNA, 16 nt, Mycobacterium bovis subsp bovis AF2122/97
cuuugucgccuucuug

SEQ ID NO: 3060259 - RNA, 18 nt, Mycobacterium bovis subsp bovis AF2122/97
cuuugucgccuucuuggc

SEQ ID NO: 3060260 - RNA, 15 nt, Mycobacterium bovis subsp bovis AF2122/97
cuuuuccggcguucc

SEQ ID NO: 3060261 - RNA, 15 nt, Mycobacterium bovis subsp bovis AF2122/97
cuuuugauugaccaa

SEQ ID NO: 3060262 - RNA, 16 nt, Mycobacterium bovis subsp bovis AF2122/97
cuuuugauugaccaac

SEQ ID NO: 3060263 - RNA, 16 nt, Mycobacterium bovis subsp bovis AF2122/97
cuuuugcgcccagcac

SEQ ID NO: 3060264 - RNA, 19 nt, Mycobacterium bovis subsp bovis AF2122/97
cuuuugcgucugcucgcca

SEQ ID NO: 3060265 - RNA, 19 nt, Mycobacterium bovis subsp bovis AF2122/97
cuuuugucacaggcgacac

SEQ ID NO: 3060266 - RNA, 15 nt, Mycobacterium bovis subsp bovis AF2122/97
gaaaaacaccagcga

SEQ ID NO: 3060267 - RNA, 21 nt, Mycobacterium bovis subsp bovis AF2122/97
gaaaaacgcccgcgcugccga

SEQ ID NO: 3060268 - RNA, 14 nt, Mycobacterium bovis subsp bovis AF2122/97
gaaaaagaccgaca

SEQ ID NO: 3060269 - RNA, 13 nt, Mycobacterium bovis subsp bovis AF2122/97
gaaaaagcccgac

SEQ ID NO: 3060270 - RNA, 14 nt, Mycobacterium bovis subsp bovis AF2122/97
gaaaaagcccgaca

SEQ ID NO: 3060271 - RNA, 13 nt, Mycobacterium bovis subsp bovis AF2122/97
gaaaaagccgcgu

SEQ ID NO: 3060272 - RNA, 17 nt, Mycobacterium bovis subsp bovis AF2122/97
gaaaaccccggccacca

SEQ ID NO: 3060273 - RNA, 17 nt, Mycobacterium bovis subsp bovis AF2122/97
gaaaacccggucggcga

SEQ ID NO: 3060274 - RNA, 22 nt, Mycobacterium bovis subsp bovis AF2122/97
gaaaaccuaugauucagccggc

SEQ ID NO: 3060275 - RNA, 19 nt, Mycobacterium bovis subsp bovis AF2122/97
gaaaaccucggacugcagc

SEQ ID NO: 3060276 - RNA, 20 nt, Mycobacterium bovis subsp bovis AF2122/97
gaaaaccucggacugcagcg

SEQ ID NO: 3060277 - RNA, 20 nt, Mycobacterium bovis subsp bovis AF2122/97
gaaaacggaugugucggcga

SEQ ID NO: 3060278 - RNA, 14 nt, Mycobacterium bovis subsp bovis AF2122/97
gaaaacggcggcgc

SEQ ID NO: 3060279 - RNA, 21 nt, Mycobacterium bovis subsp bovis AF2122/97
gaaaagccacggcugcccaug

SEQ ID NO: 3060280 - RNA, 18 nt, Mycobacterium bovis subsp bovis AF2122/97
gaaaagcccggaaucgcg

SEQ ID NO: 3060281 - RNA, 23 nt, Mycobacterium bovis subsp bovis AF2122/97
gaaaaguuggcuugcgcgcaggu

SEQ ID NO: 3060282 - RNA, 22 nt, Mycobacterium bovis subsp bovis AF2122/97
gaaaauccggggggauccagca

SEQ ID NO: 3060283 - RNA, 23 nt, Mycobacterium bovis subsp bovis AF2122/97
gaaaaucugcuagcuuggcggcc

SEQ ID NO: 3060284 - RNA, 15 nt, Mycobacterium bovis subsp bovis AF2122/97
gaaaaugccgcccag

SEQ ID NO: 3060285 - RNA, 17 nt, Mycobacterium bovis subsp bovis AF2122/97
gaaaauucgucgcgucg

SEQ ID NO: 3060286 - RNA, 22 nt, Mycobacterium bovis subsp bovis AF2122/97
gaaaauucgucgcgucggaccg

SEQ ID NO: 3060287 - RNA, 23 nt, Mycobacterium bovis subsp bovis AF2122/97
gaaaauugacccccuagaccggg

SEQ ID NO: 3060288 - RNA, 16 nt, Mycobacterium bovis subsp bovis AF2122/97
gaaaauugcuccacca

SEQ ID NO: 3060289 - RNA, 19 nt, Mycobacterium bovis subsp bovis AF2122/97
gaaacaacgucgccgcggc

SEQ ID NO: 3060290 - RNA, 15 nt, Mycobacterium bovis subsp bovis AF2122/97
gaaacaccgacgacg

SEQ ID NO: 3060291 - RNA, 14 nt, Mycobacterium bovis subsp bovis AF2122/97
gaaacacgacagcc

SEQ ID NO: 3060292 - RNA, 17 nt, Mycobacterium bovis subsp bovis AF2122/97
gaaacacgacagccagu

SEQ ID NO: 3060293 - RNA, 16 nt, Mycobacterium bovis subsp bovis AF2122/97
gaaacagccgcagcgg

SEQ ID NO: 3060294 - RNA, 17 nt, Mycobacterium bovis subsp bovis AF2122/97
gaaacagccgcagcggc

SEQ ID NO: 3060295 - RNA, 15 nt, Mycobacterium bovis subsp bovis AF2122/97
gaaacagcuugcugc

SEQ ID NO: 3060296 - RNA, 17 nt, Mycobacterium bovis subsp bovis AF2122/97
gaaacagguaagcagcc

SEQ ID NO: 3060297 - RNA, 18 nt, Mycobacterium bovis subsp bovis AF2122/97
gaaacagucgaccgaggc

SEQ ID NO: 3060298 - RNA, 21 nt, Mycobacterium bovis subsp bovis AF2122/97
gaaacaucucggcgcagccgg

SEQ ID NO: 3060299 - RNA, 22 nt, Mycobacterium bovis subsp bovis AF2122/97
gaaacaucucggcgcagccggu

SEQ ID NO: 3060300 - RNA, 14 nt, Mycobacterium bovis subsp bovis AF2122/97
gaaaccacagcgcc

SEQ ID NO: 3060301 - RNA, 14 nt, Mycobacterium bovis subsp bovis AF2122/97
gaaaccaccggccg

SEQ ID NO: 3060302 - RNA, 20 nt, Mycobacterium bovis subsp bovis AF2122/97
gaaaccaccggccgucccgc

SEQ ID NO: 3060303 - RNA, 17 nt, Mycobacterium bovis subsp bovis AF2122/97
gaaaccacugcacccga

SEQ ID NO: 3060304 - RNA, 19 nt, Mycobacterium bovis subsp bovis AF2122/97
gaaaccacuggauggcucg

SEQ ID NO: 3060305 - RNA, 14 nt, Mycobacterium bovis subsp bovis AF2122/97
gaaaccaucgccag

SEQ ID NO: 3060306 - RNA, 15 nt, Mycobacterium bovis subsp bovis AF2122/97
gaaaccaucgccagc

SEQ ID NO: 3060307 - RNA, 21 nt, Mycobacterium bovis subsp bovis AF2122/97
gaaaccaucgccagccggcga

SEQ ID NO: 3060308 - RNA, 16 nt, Mycobacterium bovis subsp bovis AF2122/97
gaaaccaugccgccga

SEQ ID NO: 3060309 - RNA, 15 nt, Mycobacterium bovis subsp bovis AF2122/97
gaaaccauucggcga

SEQ ID NO: 3060310 - RNA, 15 nt, Mycobacterium bovis subsp bovis AF2122/97
gaaacccgccgcgau

SEQ ID NO: 3060311 - RNA, 16 nt, Mycobacterium bovis subsp bovis AF2122/97
gaaacccggccgccga

SEQ ID NO: 3060312 - RNA, 14 nt, Mycobacterium bovis subsp bovis AF2122/97
gaaacccggcgacc

SEQ ID NO: 3060313 - RNA, 20 nt, Mycobacterium bovis subsp bovis AF2122/97
gaaacccugcacccgacccg

SEQ ID NO: 3060314 - RNA, 22 nt, Mycobacterium bovis subsp bovis AF2122/97
gaaaccgaccuacugcggucgc

SEQ ID NO: 3060315 - RNA, 15 nt, Mycobacterium bovis subsp bovis AF2122/97
gaaaccgcagucgcg

SEQ ID NO: 3060316 - RNA, 11 nt, Mycobacterium bovis subsp bovis AF2122/97
gaaaccgccgu

SEQ ID NO: 3060317 - RNA, 17 nt, Mycobacterium bovis subsp bovis AF2122/97
gaaaccgccgucccggc

SEQ ID NO: 3060318 - RNA, 20 nt, Mycobacterium bovis subsp bovis AF2122/97
gaaaccgccgucccggcucg

SEQ ID NO: 3060319 - RNA, 21 nt, Mycobacterium bovis subsp bovis AF2122/97
gaaaccgcuagucgucggcgc

SEQ ID NO: 3060320 - RNA, 15 nt, Mycobacterium bovis subsp bovis AF2122/97
gaaaccggucagcac

SEQ ID NO: 3060321 - RNA, 21 nt, Mycobacterium bovis subsp bovis AF2122/97
gaaaccguggccaucgauccc

SEQ ID NO: 3060322 - RNA, 15 nt, Mycobacterium bovis subsp bovis AF2122/97
gaaaccuguaccgcc

SEQ ID NO: 3060323 - RNA, 14 nt, Mycobacterium bovis subsp bovis AF2122/97
gaaacgagccggug

SEQ ID NO: 3060324 - RNA, 23 nt, Mycobacterium bovis subsp bovis AF2122/97
gaaacgauugcugcggcuuucag

SEQ ID NO: 3060325 - RNA, 14 nt, Mycobacterium bovis subsp bovis AF2122/97
gaaacgccauacgu

SEQ ID NO: 3060326 - RNA, 18 nt, Mycobacterium bovis subsp bovis AF2122/97
gaaacgccauacgucgcc

SEQ ID NO: 3060327 - RNA, 19 nt, Mycobacterium bovis subsp bovis AF2122/97
gaaacgcccgggcggcguc

SEQ ID NO: 3060328 - RNA, 16 nt, Mycobacterium bovis subsp bovis AF2122/97
gaaacgccgaccgcgc

SEQ ID NO: 3060329 - RNA, 20 nt, Mycobacterium bovis subsp bovis AF2122/97
gaaacgccggguucgccgga

SEQ ID NO: 3060330 - RNA, 17 nt, Mycobacterium bovis subsp bovis AF2122/97
gaaacgcgaugguggcc

SEQ ID NO: 3060331 - RNA, 21 nt, Mycobacterium bovis subsp bovis AF2122/97
gaaacgcgaugguggccgcca

SEQ ID NO: 3060332 - RNA, 21 nt, Mycobacterium bovis subsp bovis AF2122/97
gaaacggaccuccucgcccau

SEQ ID NO: 3060333 - RNA, 17 nt, Mycobacterium bovis subsp bovis AF2122/97
gaaacggauuggucgac

SEQ ID NO: 3060334 - RNA, 14 nt, Mycobacterium bovis subsp bovis AF2122/97
gaaacggccgggca

SEQ ID NO: 3060335 - RNA, 17 nt, Mycobacterium bovis subsp bovis AF2122/97
gaaacgguacgccgccg

SEQ ID NO: 3060336 - RNA, 18 nt, Mycobacterium bovis subsp bovis AF2122/97
gaaacgguacgccgccgc

SEQ ID NO: 3060337 - RNA, 17 nt, Mycobacterium bovis subsp bovis AF2122/97
gaaacguaugacgccca

SEQ ID NO: 3060338 - RNA, 18 nt, Mycobacterium bovis subsp bovis AF2122/97
gaaacguaugacgcccac

SEQ ID NO: 3060339 - RNA, 21 nt, Mycobacterium bovis subsp bovis AF2122/97
gaaacguaugacgcccaccga

SEQ ID NO: 3060340 - RNA, 17 nt, Mycobacterium bovis subsp bovis AF2122/97
gaaacuacucccccgcg

SEQ ID NO: 3060341 - RNA, 17 nt, Mycobacterium bovis subsp bovis AF2122/97
gaaacucacccgagcca

SEQ ID NO: 3060342 - RNA, 14 nt, Mycobacterium bovis subsp bovis AF2122/97
gaaacuccgcggcg

SEQ ID NO: 3060343 - RNA, 21 nt, Mycobacterium bovis subsp bovis AF2122/97
gaacacguuauucaugcccau

SEQ ID NO: 3060344 - RNA, 22 nt, Mycobacterium bovis subsp bovis AF2122/97
gaacacguugacucgucgcauc

SEQ ID NO: 3060345 - RNA, 19 nt, Mycobacterium bovis subsp bovis AF2122/97
gaacagacggggucgcccg

SEQ ID NO: 3060346 - RNA, 13 nt, Mycobacterium bovis subsp bovis AF2122/97
gaacagcaccgcc

SEQ ID NO: 3060347 - RNA, 15 nt, Mycobacterium bovis subsp bovis AF2122/97
gaacagcaccgccgg

SEQ ID NO: 3060348 - RNA, 16 nt, Mycobacterium bovis subsp bovis AF2122/97
gaacagcaccgccggc

SEQ ID NO: 3060349 - RNA, 15 nt, Mycobacterium bovis subsp bovis AF2122/97
gaacagcaggccucc

SEQ ID NO: 3060350 - RNA, 16 nt, Mycobacterium bovis subsp bovis AF2122/97
gaacagcagguuggcg

SEQ ID NO: 3060351 - RNA, 15 nt, Mycobacterium bovis subsp bovis AF2122/97
gaacagcaugauccg

SEQ ID NO: 3060352 - RNA, 15 nt, Mycobacterium bovis subsp bovis AF2122/97
gaacagccgagccag

SEQ ID NO: 3060353 - RNA, 13 nt, Mycobacterium bovis subsp bovis AF2122/97
gaacagcgaaccg

SEQ ID NO: 3060354 - RNA, 17 nt, Mycobacterium bovis subsp bovis AF2122/97
gaacagcgaaccgccgg

SEQ ID NO: 3060355 - RNA, 19 nt, Mycobacterium bovis subsp bovis AF2122/97
gaacagcgaaccgccggca

SEQ ID NO: 3060356 - RNA, 20 nt, Mycobacterium bovis subsp bovis AF2122/97
gaacagcgaaccgccggcac

SEQ ID NO: 3060357 - RNA, 16 nt, Mycobacterium bovis subsp bovis AF2122/97
gaacagcgaaccggcu

SEQ ID NO: 3060358 - RNA, 20 nt, Mycobacterium bovis subsp bovis AF2122/97
gaacagcgggggcagcgcga

SEQ ID NO: 3060359 - RNA, 19 nt, Mycobacterium bovis subsp bovis AF2122/97
gaacagcgguccagccacc

SEQ ID NO: 3060360 - RNA, 19 nt, Mycobacterium bovis subsp bovis AF2122/97
gaacagcucgaucagccgg

SEQ ID NO: 3060361 - RNA, 17 nt, Mycobacterium bovis subsp bovis AF2122/97
gaacagcugaucccaga

SEQ ID NO: 3060362 - RNA, 11 nt, Mycobacterium bovis subsp bovis AF2122/97
gaacagcugga

SEQ ID NO: 3060363 - RNA, 18 nt, Mycobacterium bovis subsp bovis AF2122/97
gaacagcuucgcgcagcc

SEQ ID NO: 3060364 - RNA, 23 nt, Mycobacterium bovis subsp bovis AF2122/97
gaacaggaucagcgacuugcugg

SEQ ID NO: 3060365 - RNA, 20 nt, Mycobacterium bovis subsp bovis AF2122/97
gaacaggcaaaguacgcccu

SEQ ID NO: 3060366 - RNA, 15 nt, Mycobacterium bovis subsp bovis AF2122/97
gaacaggccgaggcg

SEQ ID NO: 3060367 - RNA, 13 nt, Mycobacterium bovis subsp bovis AF2122/97
gaacaggccggcc

SEQ ID NO: 3060368 - RNA, 23 nt, Mycobacterium bovis subsp bovis AF2122/97
gaacaggccggccgcgauccagc

SEQ ID NO: 3060369 - RNA, 15 nt, Mycobacterium bovis subsp bovis AF2122/97
gaacagggacuccca

SEQ ID NO: 3060370 - RNA, 17 nt, Mycobacterium bovis subsp bovis AF2122/97
gaacagggaggucgccg

SEQ ID NO: 3060371 - RNA, 20 nt, Mycobacterium bovis subsp bovis AF2122/97
gaacagggaggucgccgcau

SEQ ID NO: 3060372 - RNA, 17 nt, Mycobacterium bovis subsp bovis AF2122/97
gaacagguuggccccgg

SEQ ID NO: 3060373 - RNA, 15 nt, Mycobacterium bovis subsp bovis AF2122/97
gaacaguaucgccgg

SEQ ID NO: 3060374 - RNA, 14 nt, Mycobacterium bovis subsp bovis AF2122/97
gaacagucgcagcc

SEQ ID NO: 3060375 - RNA, 16 nt, Mycobacterium bovis subsp bovis AF2122/97
gaacagugccucgcgu

SEQ ID NO: 3060376 - RNA, 21 nt, Mycobacterium bovis subsp bovis AF2122/97
gaacaguggggguccggcggc

SEQ ID NO: 3060377 - RNA, 21 nt, Mycobacterium bovis subsp bovis AF2122/97
gaacaguucggcgagcacaug

SEQ ID NO: 3060378 - RNA, 15 nt, Mycobacterium bovis subsp bovis AF2122/97
gaacaucagaucgcc

SEQ ID NO: 3060379 - RNA, 18 nt, Mycobacterium bovis subsp bovis AF2122/97
gaacaucagaucgccgac

SEQ ID NO: 3060380 - RNA, 21 nt, Mycobacterium bovis subsp bovis AF2122/97
gaacauccgccgcccccgccc

SEQ ID NO: 3060381 - RNA, 13 nt, Mycobacterium bovis subsp bovis AF2122/97
gaacaugcucacg

SEQ ID NO: 3060382 - RNA, 24 nt, Mycobacterium bovis subsp bovis AF2122/97
gaacauggccagcaucagcgccag

SEQ ID NO: 3060383 - RNA, 18 nt, Mycobacterium bovis subsp bovis AF2122/97
gaacauucccaugcgggu

SEQ ID NO: 3060384 - RNA, 14 nt, Mycobacterium bovis subsp bovis AF2122/97
gaaccaaaccgcaa

SEQ ID NO: 3060385 - RNA, 23 nt, Mycobacterium bovis subsp bovis AF2122/97
gaaccaaccucggaucgccaggc

SEQ ID NO: 3060386 - RNA, 24 nt, Mycobacterium bovis subsp bovis AF2122/97
gaaccaaucgcacgccagcuuggc

SEQ ID NO: 3060387 - RNA, 15 nt, Mycobacterium bovis subsp bovis AF2122/97
gaaccaccaccggca

SEQ ID NO: 3060388 - RNA, 16 nt, Mycobacterium bovis subsp bovis AF2122/97
gaaccaccaccggcaa

SEQ ID NO: 3060389 - RNA, 12 nt, Mycobacterium bovis subsp bovis AF2122/97
gaaccaccagca

SEQ ID NO: 3060390 - RNA, 18 nt, Mycobacterium bovis subsp bovis AF2122/97
gaaccaccagcacggcga

SEQ ID NO: 3060391 - RNA, 19 nt, Mycobacterium bovis subsp bovis AF2122/97
gaaccaccagcacggcgau

SEQ ID NO: 3060392 - RNA, 19 nt, Mycobacterium bovis subsp bovis AF2122/97
gaaccaccaguaccaccgg

SEQ ID NO: 3060393 - RNA, 21 nt, Mycobacterium bovis subsp bovis AF2122/97
gaaccaccaguaccaccggca

SEQ ID NO: 3060394 - RNA, 20 nt, Mycobacterium bovis subsp bovis AF2122/97
gaaccaccgcguuggccaca

SEQ ID NO: 3060395 - RNA, 15 nt, Mycobacterium bovis subsp bovis AF2122/97
gaaccaccggcgccg

SEQ ID NO: 3060396 - RNA, 19 nt, Mycobacterium bovis subsp bovis AF2122/97
gaaccaccggcgccgccgg

SEQ ID NO: 3060397 - RNA, 23 nt, Mycobacterium bovis subsp bovis AF2122/97
gaaccacgacguugcgaggccgc

SEQ ID NO: 3060398 - RNA, 15 nt, Mycobacterium bovis subsp bovis AF2122/97
gaaccacgcgcccgc

SEQ ID NO: 3060399 - RNA, 23 nt, Mycobacterium bovis subsp bovis AF2122/97
gaaccacgcgcccgcaccaccgg

SEQ ID NO: 3060400 - RNA, 14 nt, Mycobacterium bovis subsp bovis AF2122/97
gaaccacggcagcc

SEQ ID NO: 3060401 - RNA, 15 nt, Mycobacterium bovis subsp bovis AF2122/97
gaaccacggcaggca

SEQ ID NO: 3060402 - RNA, 17 nt, Mycobacterium bovis subsp bovis AF2122/97
gaaccacggcaggcagg

SEQ ID NO: 3060403 - RNA, 21 nt, Mycobacterium bovis subsp bovis AF2122/97
gaaccacucggugauguaggg

SEQ ID NO: 3060404 - RNA, 20 nt, Mycobacterium bovis subsp bovis AF2122/97
gaaccagaggucacgcagca

SEQ ID NO: 3060405 - RNA, 23 nt, Mycobacterium bovis subsp bovis AF2122/97
gaaccagaggucacgcagcaccc

SEQ ID NO: 3060406 - RNA, 20 nt, Mycobacterium bovis subsp bovis AF2122/97
gaaccagaugggugacccgc

SEQ ID NO: 3060407 - RNA, 15 nt, Mycobacterium bovis subsp bovis AF2122/97
gaaccagcccgccga

SEQ ID NO: 3060408 - RNA, 17 nt, Mycobacterium bovis subsp bovis AF2122/97
gaaccagcccgccgauc

SEQ ID NO: 3060409 - RNA, 12 nt, Mycobacterium bovis subsp bovis AF2122/97
gaaccagcccgg

SEQ ID NO: 3060410 - RNA, 13 nt, Mycobacterium bovis subsp bovis AF2122/97
gaaccagccgcgg

SEQ ID NO: 3060411 - RNA, 14 nt, Mycobacterium bovis subsp bovis AF2122/97
gaaccagcgcgugg

SEQ ID NO: 3060412 - RNA, 15 nt, Mycobacterium bovis subsp bovis AF2122/97
gaaccagcggucggc

SEQ ID NO: 3060413 - RNA, 19 nt, Mycobacterium bovis subsp bovis AF2122/97
gaaccagcggucggcgacc

SEQ ID NO: 3060414 - RNA, 21 nt, Mycobacterium bovis subsp bovis AF2122/97
gaaccagcguaucggccggca

SEQ ID NO: 3060415 - RNA, 23 nt, Mycobacterium bovis subsp bovis AF2122/97
gaaccagcguaucggccggcaga

SEQ ID NO: 3060416 - RNA, 19 nt, Mycobacterium bovis subsp bovis AF2122/97
gaaccagcugagccgucgg

SEQ ID NO: 3060417 - RNA, 20 nt, Mycobacterium bovis subsp bovis AF2122/97
gaaccagcuugcgccgcagc

SEQ ID NO: 3060418 - RNA, 21 nt, Mycobacterium bovis subsp bovis AF2122/97
gaaccagcuugcgccgcagcg

SEQ ID NO: 3060419 - RNA, 19 nt, Mycobacterium bovis subsp bovis AF2122/97
gaaccaggcggccgcgucg

SEQ ID NO: 3060420 - RNA, 22 nt, Mycobacterium bovis subsp bovis AF2122/97
gaaccagguaaucaccuggcug

SEQ ID NO: 3060421 - RNA, 17 nt, Mycobacterium bovis subsp bovis AF2122/97
gaaccauugcccgacga

SEQ ID NO: 3060422 - RNA, 12 nt, Mycobacterium bovis subsp bovis AF2122/97
gaacccacccau

SEQ ID NO: 3060423 - RNA, 13 nt, Mycobacterium bovis subsp bovis AF2122/97
gaacccagcacug

SEQ ID NO: 3060424 - RNA, 15 nt, Mycobacterium bovis subsp bovis AF2122/97
gaacccagcacuggg

SEQ ID NO: 3060425 - RNA, 17 nt, Mycobacterium bovis subsp bovis AF2122/97
gaacccaggccgucgcg

SEQ ID NO: 3060426 - RNA, 18 nt, Mycobacterium bovis subsp bovis AF2122/97
gaacccccagcugcaggg

SEQ ID NO: 3060427 - RNA, 20 nt, Mycobacterium bovis subsp bovis AF2122/97
gaaccccgaauagucggcau

SEQ ID NO: 3060428 - RNA, 22 nt, Mycobacterium bovis subsp bovis AF2122/97
gaaccccgaauagucggcaucg

SEQ ID NO: 3060429 - RNA, 15 nt, Mycobacterium bovis subsp bovis AF2122/97
gaacgcaacagccga

SEQ ID NO: 3060430 - RNA, 18 nt, Mycobacterium bovis subsp bovis AF2122/97
gaacgcaaccgagggcau

SEQ ID NO: 3060431 - RNA, 17 nt, Mycobacterium bovis subsp bovis AF2122/97
gaacgcaagcagcgcga

SEQ ID NO: 3060432 - RNA, 20 nt, Mycobacterium bovis subsp bovis AF2122/97
gaacgcaccgaaacgccgac

SEQ ID NO: 3060433 - RNA, 22 nt, Mycobacterium bovis subsp bovis AF2122/97
gaacgcacucaucgccggaccg

SEQ ID NO: 3060434 - RNA, 14 nt, Mycobacterium bovis subsp bovis AF2122/97
gaacgcagccagcg

SEQ ID NO: 3060435 - RNA, 16 nt, Mycobacterium bovis subsp bovis AF2122/97
gaacgcagccagcgcc

SEQ ID NO: 3060436 - RNA, 18 nt, Mycobacterium bovis subsp bovis AF2122/97
gaacgcagccagcgccau

SEQ ID NO: 3060437 - RNA, 19 nt, Mycobacterium bovis subsp bovis AF2122/97
gaacgcauacagcgcccgg

SEQ ID NO: 3060438 - RNA, 24 nt, Mycobacterium bovis subsp bovis AF2122/97
gaacgcaugcgagaacgucgagac

SEQ ID NO: 3060439 - RNA, 16 nt, Mycobacterium bovis subsp bovis AF2122/97
gaacgccaccaccucc

SEQ ID NO: 3060440 - RNA, 22 nt, Mycobacterium bovis subsp bovis AF2122/97
gaacgccaccaccuccgcgucg

SEQ ID NO: 3060441 - RNA, 14 nt, Mycobacterium bovis subsp bovis AF2122/97
gaacgccaccccca

SEQ ID NO: 3060442 - RNA, 16 nt, Mycobacterium bovis subsp bovis AF2122/97
gaacgccacggcaucg

SEQ ID NO: 3060443 - RNA, 22 nt, Mycobacterium bovis subsp bovis AF2122/97
gaacgccacggcaucggccacc

SEQ ID NO: 3060444 - RNA, 16 nt, Mycobacterium bovis subsp bovis AF2122/97
gaacgccagaccgccg

SEQ ID NO: 3060445 - RNA, 22 nt, Mycobacterium bovis subsp bovis AF2122/97
gaacgcccgcaggacgcugccg

SEQ ID NO: 3060446 - RNA, 18 nt, Mycobacterium bovis subsp bovis AF2122/97
gaacgcccgcugcagacg

SEQ ID NO: 3060447 - RNA, 20 nt, Mycobacterium bovis subsp bovis AF2122/97
gaacgcccgcuucagcacgg

SEQ ID NO: 3060448 - RNA, 22 nt, Mycobacterium bovis subsp bovis AF2122/97
gaacgccgaacaccgccgcguc

SEQ ID NO: 3060449 - RNA, 18 nt, Mycobacterium bovis subsp bovis AF2122/97
gaacgccgccagcgcggu

SEQ ID NO: 3060450 - RNA, 14 nt, Mycobacterium bovis subsp bovis AF2122/97
gaacgccggcaccg

SEQ ID NO: 3060451 - RNA, 14 nt, Mycobacterium bovis subsp bovis AF2122/97
gaacgccggcaucg

SEQ ID NO: 3060452 - RNA, 16 nt, Mycobacterium bovis subsp bovis AF2122/97
gaacgccggcaucgcg

SEQ ID NO: 3060453 - RNA, 22 nt, Mycobacterium bovis subsp bovis AF2122/97
gaacgccggcaucgcgcgcggc

SEQ ID NO: 3060454 - RNA, 12 nt, Mycobacterium bovis subsp bovis AF2122/97
gaacgccggggc

SEQ ID NO: 3060455 - RNA, 18 nt, Mycobacterium bovis subsp bovis AF2122/97
gaacgccggugcgcugga

SEQ ID NO: 3060456 - RNA, 23 nt, Mycobacterium bovis subsp bovis AF2122/97
gaacgccgucagaacaccggcca

SEQ ID NO: 3060457 - RNA, 13 nt, Mycobacterium bovis subsp bovis AF2122/97
gaacgccgucgac

SEQ ID NO: 3060458 - RNA, 18 nt, Mycobacterium bovis subsp bovis AF2122/97
gaacgccucgccggccac

SEQ ID NO: 3060459 - RNA, 17 nt, Mycobacterium bovis subsp bovis AF2122/97
gaacgccugcgggaagu

SEQ ID NO: 3060460 - RNA, 13 nt, Mycobacterium bovis subsp bovis AF2122/97
gaacgccugcugg

SEQ ID NO: 3060461 - RNA, 15 nt, Mycobacterium bovis subsp bovis AF2122/97
gaacgccugcuggua

SEQ ID NO: 3060462 - RNA, 20 nt, Mycobacterium bovis subsp bovis AF2122/97
gaacgcgaauaccagaccgg

SEQ ID NO: 3060463 - RNA, 22 nt, Mycobacterium bovis subsp bovis AF2122/97
gaacgcgaauaccagaccggcc

SEQ ID NO: 3060464 - RNA, 23 nt, Mycobacterium bovis subsp bovis AF2122/97
gaacgcgacagccaccucgacgg

SEQ ID NO: 3060465 - RNA, 14 nt, Mycobacterium bovis subsp bovis AF2122/97
gaacgcgagcgcua

SEQ ID NO: 3060466 - RNA, 18 nt, Mycobacterium bovis subsp bovis AF2122/97
gaacgcgaucgaccuugg

SEQ ID NO: 3060467 - RNA, 22 nt, Mycobacterium bovis subsp bovis AF2122/97
gaacgcgcgcguggucgccccg

SEQ ID NO: 3060468 - RNA, 16 nt, Mycobacterium bovis subsp bovis AF2122/97
gaacgcgcgugcagcc

SEQ ID NO: 3060469 - RNA, 16 nt, Mycobacterium bovis subsp bovis AF2122/97
gaacgcggaagccgcc

SEQ ID NO: 3060470 - RNA, 20 nt, Mycobacterium bovis subsp bovis AF2122/97
gaacgcggccaccacaacgc

SEQ ID NO: 3060471 - RNA, 19 nt, Mycobacterium bovis subsp bovis AF2122/97
gaacgcggccaccgaccgc

SEQ ID NO: 3060472 - RNA, 13 nt, Mycobacterium bovis subsp bovis AF2122/97
gaacgcggccucg

SEQ ID NO: 3060473 - RNA, 18 nt, Mycobacterium bovis subsp bovis AF2122/97
gaacgcggccucgucgag

SEQ ID NO: 3060474 - RNA, 12 nt, Mycobacterium bovis subsp bovis AF2122/97
gaacgcggcgaa

SEQ ID NO: 3060475 - RNA, 15 nt, Mycobacterium bovis subsp bovis AF2122/97
gaacgcguagagccg

SEQ ID NO: 3060476 - RNA, 17 nt, Mycobacterium bovis subsp bovis AF2122/97
gaacgcguagagccgau

SEQ ID NO: 3060477 - RNA, 22 nt, Mycobacterium bovis subsp bovis AF2122/97
gaacgcguagucgcgggugcgg

SEQ ID NO: 3060478 - RNA, 16 nt, Mycobacterium bovis subsp bovis AF2122/97
gaacgcguccagcgcg

SEQ ID NO: 3060479 - RNA, 23 nt, Mycobacterium bovis subsp bovis AF2122/97
gaacgcuagcgccaaauccggcu

SEQ ID NO: 3060480 - RNA, 22 nt, Mycobacterium bovis subsp bovis AF2122/97
gaacgcuaggcgauccagacgg

SEQ ID NO: 3060481 - RNA, 16 nt, Mycobacterium bovis subsp bovis AF2122/97
gaacgcugcccaacgg

SEQ ID NO: 3060482 - RNA, 20 nt, Mycobacterium bovis subsp bovis AF2122/97
gaacgcuucaccucgucgac

SEQ ID NO: 3060483 - RNA, 13 nt, Mycobacterium bovis subsp bovis AF2122/97
gaacgcuuccagc

SEQ ID NO: 3060484 - RNA, 19 nt, Mycobacterium bovis subsp bovis AF2122/97
gaacggaauucagcgacgc

SEQ ID NO: 3060485 - RNA, 16 nt, Mycobacterium bovis subsp bovis AF2122/97
gaacggaccucggcgg

SEQ ID NO: 3060486 - RNA, 14 nt, Mycobacterium bovis subsp bovis AF2122/97
gaacggaugccggu

SEQ ID NO: 3060487 - RNA, 17 nt, Mycobacterium bovis subsp bovis AF2122/97
gaacggaugccggucgg

SEQ ID NO: 3060488 - RNA, 22 nt, Mycobacterium bovis subsp bovis AF2122/97
gaacggauucccgcccagcagc

SEQ ID NO: 3060489 - RNA, 16 nt, Mycobacterium bovis subsp bovis AF2122/97
gaacggcaaggucgcg

SEQ ID NO: 3060490 - RNA, 12 nt, Mycobacterium bovis subsp bovis AF2122/97
gaacggcagcac

SEQ ID NO: 3060491 - RNA, 14 nt, Mycobacterium bovis subsp bovis AF2122/97
gaacggcagcccgg

SEQ ID NO: 3060492 - RNA, 17 nt, Mycobacterium bovis subsp bovis AF2122/97
gaacggcagcccgggcg

SEQ ID NO: 3060493 - RNA, 22 nt, Mycobacterium bovis subsp bovis AF2122/97
gaacggccaggacaacgcaccg

SEQ ID NO: 3060494 - RNA, 16 nt, Mycobacterium bovis subsp bovis AF2122/97
gaacggcgcaguuggc

SEQ ID NO: 3060495 - RNA, 17 nt, Mycobacterium bovis subsp bovis AF2122/97
gaacggcgcaguuggca

SEQ ID NO: 3060496 - RNA, 21 nt, Mycobacterium bovis subsp bovis AF2122/97
gaacggcgggcgauuucggcg

SEQ ID NO: 3060497 - RNA, 15 nt, Mycobacterium bovis subsp bovis AF2122/97
gaacggcgguguggu

SEQ ID NO: 3060498 - RNA, 11 nt, Mycobacterium bovis subsp bovis AF2122/97
gaacggcgucg

SEQ ID NO: 3060499 - RNA, 14 nt, Mycobacterium bovis subsp bovis AF2122/97
gaacggcgucgaau

SEQ ID NO: 3060500 - RNA, 19 nt, Mycobacterium bovis subsp bovis AF2122/97
gaacggcguugcggaauca

SEQ ID NO: 3060501 - RNA, 13 nt, Mycobacterium bovis subsp bovis AF2122/97
gaacggcucggcc

SEQ ID NO: 3060502 - RNA, 16 nt, Mycobacterium bovis subsp bovis AF2122/97
gaacggcucggccgga

SEQ ID NO: 3060503 - RNA, 17 nt, Mycobacterium bovis subsp bovis AF2122/97
gaacggcucggccggag

SEQ ID NO: 3060504 - RNA, 23 nt, Mycobacterium bovis subsp bovis AF2122/97
gaacggcucgggaacuucgccga

SEQ ID NO: 3060505 - RNA, 22 nt, Mycobacterium bovis subsp bovis AF2122/97
gaacggcuugcgauuggcuggg

SEQ ID NO: 3060506 - RNA, 14 nt, Mycobacterium bovis subsp bovis AF2122/97
gaacgggaucgacc

SEQ ID NO: 3060507 - RNA, 17 nt, Mycobacterium bovis subsp bovis AF2122/97
gaacgggaucgacccgc

SEQ ID NO: 3060508 - RNA, 17 nt, Mycobacterium bovis subsp bovis AF2122/97
gaacgggucggcgacca

SEQ ID NO: 3060509 - RNA, 19 nt, Mycobacterium bovis subsp bovis AF2122/97
gaacgggucgggacgcugc

SEQ ID NO: 3060510 - RNA, 20 nt, Mycobacterium bovis subsp bovis AF2122/97
gaacgggucguugccggaca

SEQ ID NO: 3060511 - RNA, 19 nt, Mycobacterium bovis subsp bovis AF2122/97
gaacgguagcacugucgag

SEQ ID NO: 3060512 - RNA, 19 nt, Mycobacterium bovis subsp bovis AF2122/97
gaacggugcacagcaguga

SEQ ID NO: 3060513 - RNA, 14 nt, Mycobacterium bovis subsp bovis AF2122/97
gaacggugccgauc

SEQ ID NO: 3060514 - RNA, 19 nt, Mycobacterium bovis subsp bovis AF2122/97
gaacgguucggccggggcg

SEQ ID NO: 3060515 - RNA, 17 nt, Mycobacterium bovis subsp bovis AF2122/97
gaacugguuucgcaccg

SEQ ID NO: 3060516 - RNA, 21 nt, Mycobacterium bovis subsp bovis AF2122/97
gaacugugcggcagcccccgg

SEQ ID NO: 3060517 - RNA, 13 nt, Mycobacterium bovis subsp bovis AF2122/97
gaacuucgccgaa

SEQ ID NO: 3060518 - RNA, 12 nt, Mycobacterium bovis subsp bovis AF2122/97
gaacuucuccac

SEQ ID NO: 3060519 - RNA, 18 nt, Mycobacterium bovis subsp bovis AF2122/97
gaacuucuccaccagcgu

SEQ ID NO: 3060520 - RNA, 19 nt, Mycobacterium bovis subsp bovis AF2122/97
gaacuugacgaacucgccg

SEQ ID NO: 3060521 - RNA, 19 nt, Mycobacterium bovis subsp bovis AF2122/97
gaacuuguugaccuccucc

SEQ ID NO: 3060522 - RNA, 15 nt, Mycobacterium bovis subsp bovis AF2122/97
gaagaaaacgaaccc

SEQ ID NO: 3060523 - RNA, 19 nt, Mycobacterium bovis subsp bovis AF2122/97
gaagaaaccgcagucgcgg

SEQ ID NO: 3060524 - RNA, 17 nt, Mycobacterium bovis subsp bovis AF2122/97
gaagaacaucaccucga

SEQ ID NO: 3060525 - RNA, 14 nt, Mycobacterium bovis subsp bovis AF2122/97
gaagaaccugagca

SEQ ID NO: 3060526 - RNA, 18 nt, Mycobacterium bovis subsp bovis AF2122/97
gaagaacgacgccaccgc

SEQ ID NO: 3060527 - RNA, 17 nt, Mycobacterium bovis subsp bovis AF2122/97
gaagaacucggcgucgu

SEQ ID NO: 3060528 - RNA, 18 nt, Mycobacterium bovis subsp bovis AF2122/97
gaagaacucggcgucgug

SEQ ID NO: 3060529 - RNA, 14 nt, Mycobacterium bovis subsp bovis AF2122/97
gaagaacucggugc

SEQ ID NO: 3060530 - RNA, 18 nt, Mycobacterium bovis subsp bovis AF2122/97
gaagaacugggcaaugac

SEQ ID NO: 3060531 - RNA, 15 nt, Mycobacterium bovis subsp bovis AF2122/97
gaagaagccgaagca

SEQ ID NO: 3060532 - RNA, 23 nt, Mycobacterium bovis subsp bovis AF2122/97
gaagaaguacaucugccggucga

SEQ ID NO: 3060533 - RNA, 16 nt, Mycobacterium bovis subsp bovis AF2122/97
gaagaaugccgucuga

SEQ ID NO: 3060534 - RNA, 23 nt, Mycobacterium bovis subsp bovis AF2122/97
gaagaauggacugaacaccaaau

SEQ ID NO: 3060535 - RNA, 22 nt, Mycobacterium bovis subsp bovis AF2122/97
gaagaaugggauggcaccaccc

SEQ ID NO: 3060536 - RNA, 16 nt, Mycobacterium bovis subsp bovis AF2122/97
gaagacaagugguggu

SEQ ID NO: 3060537 - RNA, 12 nt, Mycobacterium bovis subsp bovis AF2122/97
gaagacaccagg

SEQ ID NO: 3060538 - RNA, 14 nt, Mycobacterium bovis subsp bovis AF2122/97
gaagacaccaggcc

SEQ ID NO: 3060539 - RNA, 17 nt, Mycobacterium bovis subsp bovis AF2122/97
gaagacaccaggcccgg

SEQ ID NO: 3060540 - RNA, 16 nt, Mycobacterium bovis subsp bovis AF2122/97
gaagacaccggcgucg

SEQ ID NO: 3060541 - RNA, 15 nt, Mycobacterium bovis subsp bovis AF2122/97
gaagaccaccgccca

SEQ ID NO: 3060542 - RNA, 16 nt, Mycobacterium bovis subsp bovis AF2122/97
gaagaccaccgcccac

SEQ ID NO: 3060543 - RNA, 23 nt, Mycobacterium bovis subsp bovis AF2122/97
gaagaccaccgcccacagcaacg

SEQ ID NO: 3060544 - RNA, 12 nt, Mycobacterium bovis subsp bovis AF2122/97
gaagacccguga

SEQ ID NO: 3060545 - RNA, 15 nt, Mycobacterium bovis subsp bovis AF2122/97
gaagaccgccgggau

SEQ ID NO: 3060546 - RNA, 16 nt, Mycobacterium bovis subsp bovis AF2122/97
gaagaccgccuccacc

SEQ ID NO: 3060547 - RNA, 19 nt, Mycobacterium bovis subsp bovis AF2122/97
gaagaccgccuccaccgcc

SEQ ID NO: 3060548 - RNA, 14 nt, Mycobacterium bovis subsp bovis AF2122/97
gaagaccggaucgc

SEQ ID NO: 3060549 - RNA, 14 nt, Mycobacterium bovis subsp bovis AF2122/97
gaagaccucgucgc

SEQ ID NO: 3060550 - RNA, 15 nt, Mycobacterium bovis subsp bovis AF2122/97
gaagaccucgucgcg

SEQ ID NO: 3060551 - RNA, 17 nt, Mycobacterium bovis subsp bovis AF2122/97
gaagaccucgucgcguc

SEQ ID NO: 3060552 - RNA, 21 nt, Mycobacterium bovis subsp bovis AF2122/97
gaagaccucgucgcgucgcca

SEQ ID NO: 3060553 - RNA, 18 nt, Mycobacterium bovis subsp bovis AF2122/97
gaagaccuggccugcggc

SEQ ID NO: 3060554 - RNA, 18 nt, Mycobacterium bovis subsp bovis AF2122/97
gaagacggcaagucuggc

SEQ ID NO: 3060555 - RNA, 14 nt, Mycobacterium bovis subsp bovis AF2122/97
gaagacggccaccg

SEQ ID NO: 3060556 - RNA, 16 nt, Mycobacterium bovis subsp bovis AF2122/97
gaagacggccaccggg

SEQ ID NO: 3060557 - RNA, 23 nt, Mycobacterium bovis subsp bovis AF2122/97
gaagacggccaccggggucaccu

SEQ ID NO: 3060558 - RNA, 15 nt, Mycobacterium bovis subsp bovis AF2122/97
gaagacggugcgggc

SEQ ID NO: 3060559 - RNA, 15 nt, Mycobacterium bovis subsp bovis AF2122/97
gaagagcaauggcgc

SEQ ID NO: 3060560 - RNA, 14 nt, Mycobacterium bovis subsp bovis AF2122/97
gaagagcaggccca

SEQ ID NO: 3060561 - RNA, 18 nt, Mycobacterium bovis subsp bovis AF2122/97
gaagagcggagccggcgc

SEQ ID NO: 3060562 - RNA, 13 nt, Mycobacterium bovis subsp bovis AF2122/97
gaagagcuccguc

SEQ ID NO: 3060563 - RNA, 18 nt, Mycobacterium bovis subsp bovis AF2122/97
gaagagcuccgucgcggc

SEQ ID NO: 3060564 - RNA, 16 nt, Mycobacterium bovis subsp bovis AF2122/97
gaagagggcgccgcgc

SEQ ID NO: 3060565 - RNA, 19 nt, Mycobacterium bovis subsp bovis AF2122/97
gaagaucaccucccgcggc

SEQ ID NO: 3060566 - RNA, 18 nt, Mycobacterium bovis subsp bovis AF2122/97
gaagauccagcgcaccgg

SEQ ID NO: 3060567 - RNA, 21 nt, Mycobacterium bovis subsp bovis AF2122/97
gaagauccagcgcaccggcgu

SEQ ID NO: 3060568 - RNA, 19 nt, Mycobacterium bovis subsp bovis AF2122/97
gaagaucgcgugccacagc

SEQ ID NO: 3060569 - RNA, 20 nt, Mycobacterium bovis subsp bovis AF2122/97
gaagaucgcgugccacagca

SEQ ID NO: 3060570 - RNA, 20 nt, Mycobacterium bovis subsp bovis AF2122/97
gaagaucucguagccgccgu

SEQ ID NO: 3060571 - RNA, 20 nt, Mycobacterium bovis subsp bovis AF2122/97
gaagaugccugcuagcagca

SEQ ID NO: 3060572 - RNA, 19 nt, Mycobacterium bovis subsp bovis AF2122/97
gaagaugccuggaaucgcg

SEQ ID NO: 3060573 - RNA, 20 nt, Mycobacterium bovis subsp bovis AF2122/97
gaagauggcaccgcccccgu

SEQ ID NO: 3060574 - RNA, 19 nt, Mycobacterium bovis subsp bovis AF2122/97
gaagaugucuuccugcgcc

SEQ ID NO: 3060575 - RNA, 18 nt, Mycobacterium bovis subsp bovis AF2122/97
gaagauuuucucggugcu

SEQ ID NO: 3060576 - RNA, 19 nt, Mycobacterium bovis subsp bovis AF2122/97
gaagauuuugggcgccgac

SEQ ID NO: 3060577 - RNA, 18 nt, Mycobacterium bovis subsp bovis AF2122/97
gaagcaagggcgaugguc

SEQ ID NO: 3060578 - RNA, 12 nt, Mycobacterium bovis subsp bovis AF2122/97
gaagcacacugu

SEQ ID NO: 3060579 - RNA, 19 nt, Mycobacterium bovis subsp bovis AF2122/97
gaagcacacuguucccaca

SEQ ID NO: 3060580 - RNA, 17 nt, Mycobacterium bovis subsp bovis AF2122/97
gaagcacaugcucggcc

SEQ ID NO: 3060581 - RNA, 13 nt, Mycobacterium bovis subsp bovis AF2122/97
gaagcaccucccg

SEQ ID NO: 3060582 - RNA, 12 nt, Mycobacterium bovis subsp bovis AF2122/97
gaagcacgucgu

SEQ ID NO: 3060583 - RNA, 16 nt, Mycobacterium bovis subsp bovis AF2122/97
gaagcacgucgucgcg

SEQ ID NO: 3060584 - RNA, 18 nt, Mycobacterium bovis subsp bovis AF2122/97
gaagcagggauucuggau

SEQ ID NO: 3060585 - RNA, 23 nt, Mycobacterium bovis subsp bovis AF2122/97
gaagcaucgcguuguaggcuucc

SEQ ID NO: 3060586 - RNA, 18 nt, Mycobacterium bovis subsp bovis AF2122/97
gaagcaugauuggcucgg

SEQ ID NO: 3060587 - RNA, 16 nt, Mycobacterium bovis subsp bovis AF2122/97
gaagccaaaugcgcug

SEQ ID NO: 3060588 - RNA, 16 nt, Mycobacterium bovis subsp bovis AF2122/97
gaagccaagcgacucg

SEQ ID NO: 3060589 - RNA, 20 nt, Mycobacterium bovis subsp bovis AF2122/97
gaagccaagcgacucgccgg

SEQ ID NO: 3060590 - RNA, 13 nt, Mycobacterium bovis subsp bovis AF2122/97
gaagccaccaggu

SEQ ID NO: 3060591 - RNA, 17 nt, Mycobacterium bovis subsp bovis AF2122/97
gaagccagaucagccgc

SEQ ID NO: 3060592 - RNA, 20 nt, Mycobacterium bovis subsp bovis AF2122/97
gaagccagaucagccgccgc

SEQ ID NO: 3060593 - RNA, 12 nt, Mycobacterium bovis subsp bovis AF2122/97
gaagccagcgca

SEQ ID NO: 3060594 - RNA, 15 nt, Mycobacterium bovis subsp bovis AF2122/97
gaagccagcgcaagg

SEQ ID NO: 3060595 - RNA, 17 nt, Mycobacterium bovis subsp bovis AF2122/97
gaagccagcgcagcacc

SEQ ID NO: 3060596 - RNA, 20 nt, Mycobacterium bovis subsp bovis AF2122/97
gaagcccacgaucgcgucgg

SEQ ID NO: 3060597 - RNA, 16 nt, Mycobacterium bovis subsp bovis AF2122/97
gaagcccagaucuugc

SEQ ID NO: 3060598 - RNA, 18 nt, Mycobacterium bovis subsp bovis AF2122/97
gaagcccagaucuugcag

SEQ ID NO: 3060599 - RNA, 19 nt, Mycobacterium bovis subsp bovis AF2122/97
gaagcccccaaaccggcgg

SEQ ID NO: 3060600 - RNA, 19 nt, Mycobacterium bovis subsp bovis AF2122/97
gaagccccccgagcugugg

SEQ ID NO: 3060601 - RNA, 20 nt, Mycobacterium bovis subsp bovis AF2122/97
gaagcccccgacguugcugg

SEQ ID NO: 3060602 - RNA, 14 nt, Mycobacterium bovis subsp bovis AF2122/97
gaaggccagcgcgc

SEQ ID NO: 3060603 - RNA, 15 nt, Mycobacterium bovis subsp bovis AF2122/97
gaaggccagcgcgcc

SEQ ID NO: 3060604 - RNA, 16 nt, Mycobacterium bovis subsp bovis AF2122/97
gaaggccagcgcgccc

SEQ ID NO: 3060605 - RNA, 14 nt, Mycobacterium bovis subsp bovis AF2122/97
gaaggccgcaccgc

SEQ ID NO: 3060606 - RNA, 20 nt, Mycobacterium bovis subsp bovis AF2122/97
gaaggccgcgcgcagggcgu

SEQ ID NO: 3060607 - RNA, 22 nt, Mycobacterium bovis subsp bovis AF2122/97
gaaggccgcgcgcagggcgucg

SEQ ID NO: 3060608 - RNA, 15 nt, Mycobacterium bovis subsp bovis AF2122/97
gaaggccggcgaccg

SEQ ID NO: 3060609 - RNA, 23 nt, Mycobacterium bovis subsp bovis AF2122/97
gaaggcgacaucaccaccgaccu

SEQ ID NO: 3060610 - RNA, 16 nt, Mycobacterium bovis subsp bovis AF2122/97
gaaggcgauggcaccg

SEQ ID NO: 3060611 - RNA, 22 nt, Mycobacterium bovis subsp bovis AF2122/97
gaaggcgcugccuucuaccgaa

SEQ ID NO: 3060612 - RNA, 16 nt, Mycobacterium bovis subsp bovis AF2122/97
gaaggcggcuccaccg

SEQ ID NO: 3060613 - RNA, 15 nt, Mycobacterium bovis subsp bovis AF2122/97
gaaggcguggguguc

SEQ ID NO: 3060614 - RNA, 16 nt, Mycobacterium bovis subsp bovis AF2122/97
gaaggcguucgacucg

SEQ ID NO: 3060615 - RNA, 20 nt, Mycobacterium bovis subsp bovis AF2122/97
gaaggcguucgacucgaccg

SEQ ID NO: 3060616 - RNA, 22 nt, Mycobacterium bovis subsp bovis AF2122/97
gaaggcugucaguucccgcuug

SEQ ID NO: 3060617 - RNA, 20 nt, Mycobacterium bovis subsp bovis AF2122/97
gaaggcuucggugacccggg

SEQ ID NO: 3060618 - RNA, 19 nt, Mycobacterium bovis subsp bovis AF2122/97
gaagggcuaucguggcggc

SEQ ID NO: 3060619 - RNA, 21 nt, Mycobacterium bovis subsp bovis AF2122/97
gaagggcuaucguggcggcgu

SEQ ID NO: 3060620 - RNA, 17 nt, Mycobacterium bovis subsp bovis AF2122/97
gaagggcuugucgccgg

SEQ ID NO: 3060621 - RNA, 18 nt, Mycobacterium bovis subsp bovis AF2122/97
gaagggcuugucgccggc

SEQ ID NO: 3060622 - RNA, 12 nt, Mycobacterium bovis subsp bovis AF2122/97
gaaggggcucag

SEQ ID NO: 3060623 - RNA, 19 nt, Mycobacterium bovis subsp bovis AF2122/97
gaaggggcucagcgguggc

SEQ ID NO: 3060624 - RNA, 16 nt, Mycobacterium bovis subsp bovis AF2122/97
gaagguaacgacgguu

SEQ ID NO: 3060625 - RNA, 17 nt, Mycobacterium bovis subsp bovis AF2122/97
gaaggucagcagggccg

SEQ ID NO: 3060626 - RNA, 22 nt, Mycobacterium bovis subsp bovis AF2122/97
gaaggucagcgacuugcggugc

SEQ ID NO: 3060627 - RNA, 22 nt, Mycobacterium bovis subsp bovis AF2122/97
gaagguccgugccgaugccggc

SEQ ID NO: 3060628 - RNA, 20 nt, Mycobacterium bovis subsp bovis AF2122/97
gaaggucucgaaagccgcgg

SEQ ID NO: 3060629 - RNA, 20 nt, Mycobacterium bovis subsp bovis AF2122/97
gaaggucuggccugccccag

SEQ ID NO: 3060630 - RNA, 22 nt, Mycobacterium bovis subsp bovis AF2122/97
gaaggugaccaggcggacgccg

SEQ ID NO: 3060631 - RNA, 16 nt, Mycobacterium bovis subsp bovis AF2122/97
gaaggugcugcgcggg

SEQ ID NO: 3060632 - RNA, 12 nt, Mycobacterium bovis subsp bovis AF2122/97
gaaggugcuggu

SEQ ID NO: 3060633 - RNA, 19 nt, Mycobacterium bovis subsp bovis AF2122/97
gaagguggcauucgucgag

SEQ ID NO: 3060634 - RNA, 20 nt, Mycobacterium bovis subsp bovis AF2122/97
gaaggugguggcguuggcga

SEQ ID NO: 3060635 - RNA, 15 nt, Mycobacterium bovis subsp bovis AF2122/97
gaagguguccuccag

SEQ ID NO: 3060636 - RNA, 20 nt, Mycobacterium bovis subsp bovis AF2122/97
gaagguucgaucgcggugac

SEQ ID NO: 3060637 - RNA, 18 nt, Mycobacterium bovis subsp bovis AF2122/97
gaagguugaacgccgcca

SEQ ID NO: 3060638 - RNA, 15 nt, Mycobacterium bovis subsp bovis AF2122/97
gaaguaauagcuguu

SEQ ID NO: 3060639 - RNA, 16 nt, Mycobacterium bovis subsp bovis AF2122/97
gaaguaauagcuguug

SEQ ID NO: 3060640 - RNA, 17 nt, Mycobacterium bovis subsp bovis AF2122/97
gaaguaauggaacggcu

SEQ ID NO: 3060641 - RNA, 13 nt, Mycobacterium bovis subsp bovis AF2122/97
gaaguacacggcg

SEQ ID NO: 3060642 - RNA, 14 nt, Mycobacterium bovis subsp bovis AF2122/97
gaaguacacggcgg

SEQ ID NO: 3060643 - RNA, 15 nt, Mycobacterium bovis subsp bovis AF2122/97
gaaguacaucugccg

SEQ ID NO: 3060644 - RNA, 18 nt, Mycobacterium bovis subsp bovis AF2122/97
gaaguacgcgacgggccg

SEQ ID NO: 3060645 - RNA, 13 nt, Mycobacterium bovis subsp bovis AF2122/97
gaaguacgugcac

SEQ ID NO: 3060646 - RNA, 16 nt, Mycobacterium bovis subsp bovis AF2122/97
gaaguacuccauggca

SEQ ID NO: 3060647 - RNA, 21 nt, Mycobacterium bovis subsp bovis AF2122/97
gaaguagccgacgucgccgga

SEQ ID NO: 3060648 - RNA, 14 nt, Mycobacterium bovis subsp bovis AF2122/97
gaaguagccgagcc

SEQ ID NO: 3060649 - RNA, 20 nt, Mycobacterium bovis subsp bovis AF2122/97
gaaguagguuuucggcggcu

SEQ ID NO: 3060650 - RNA, 14 nt, Mycobacterium bovis subsp bovis AF2122/97
gaaguagucggcgc

SEQ ID NO: 3060651 - RNA, 18 nt, Mycobacterium bovis subsp bovis AF2122/97
gaaguagugcucgcagcc

SEQ ID NO: 3060652 - RNA, 21 nt, Mycobacterium bovis subsp bovis AF2122/97
gaagucccgccguugccgccg

SEQ ID NO: 3060653 - RNA, 20 nt, Mycobacterium bovis subsp bovis AF2122/97
gaagucccgggcaccgucgg

SEQ ID NO: 3060654 - RNA, 17 nt, Mycobacterium bovis subsp bovis AF2122/97
gaaguccgagacgucgg

SEQ ID NO: 3060655 - RNA, 23 nt, Mycobacterium bovis subsp bovis AF2122/97
gaagucgacgaacucgcccaggg

SEQ ID NO: 3060656 - RNA, 15 nt, Mycobacterium bovis subsp bovis AF2122/97
gaagucgacucgcca

SEQ ID NO: 3060657 - RNA, 16 nt, Mycobacterium bovis subsp bovis AF2122/97
gaagucgacucgccac

SEQ ID NO: 3060658 - RNA, 15 nt, Mycobacterium bovis subsp bovis AF2122/97
gaagucgaucgccga

SEQ ID NO: 3060659 - RNA, 22 nt, Mycobacterium bovis subsp bovis AF2122/97
gaagucgaugaugcccauccgg

SEQ ID NO: 3060660 - RNA, 17 nt, Mycobacterium bovis subsp bovis AF2122/97
gaagucgcccaguccca

SEQ ID NO: 3060661 - RNA, 21 nt, Mycobacterium bovis subsp bovis AF2122/97
gaagucgcggacgucgccccg

SEQ ID NO: 3060662 - RNA, 12 nt, Mycobacterium bovis subsp bovis AF2122/97
gaagucgggccg

SEQ ID NO: 3060663 - RNA, 17 nt, Mycobacterium bovis subsp bovis AF2122/97
gaagucggucugcgggg

SEQ ID NO: 3060664 - RNA, 16 nt, Mycobacterium bovis subsp bovis AF2122/97
gaagucguugcgcggu

SEQ ID NO: 3060665 - RNA, 16 nt, Mycobacterium bovis subsp bovis AF2122/97
gaagugaaagacagug

SEQ ID NO: 3060666 - RNA, 20 nt, Mycobacterium bovis subsp bovis AF2122/97
gaagugaaagacaguggcgc

SEQ ID NO: 3060667 - RNA, 15 nt, Mycobacterium bovis subsp bovis AF2122/97
gaagugagcucggcu

SEQ ID NO: 3060668 - RNA, 15 nt, Mycobacterium bovis subsp bovis AF2122/97
gaagugcacugcgaa

SEQ ID NO: 3060669 - RNA, 17 nt, Mycobacterium bovis subsp bovis AF2122/97
gaagugccuuccucggc

SEQ ID NO: 3060670 - RNA, 21 nt, Mycobacterium bovis subsp bovis AF2122/97
gaagugccuuccucggcaagu

SEQ ID NO: 3060671 - RNA, 22 nt, Mycobacterium bovis subsp bovis AF2122/97
gaaguggagccccgacugcuga

SEQ ID NO: 3060672 - RNA, 19 nt, Mycobacterium bovis subsp bovis AF2122/97
gaaguggaucuggcgcagc

SEQ ID NO: 3060673 - RNA, 17 nt, Mycobacterium bovis subsp bovis AF2122/97
gaaguggcgccuugggu

SEQ ID NO: 3060674 - RNA, 18 nt, Mycobacterium bovis subsp bovis AF2122/97
gaagugggcguuggcggc

SEQ ID NO: 3060675 - RNA, 19 nt, Mycobacterium bovis subsp bovis AF2122/97
gaaguggucuccggcaccg

SEQ ID NO: 3060676 - RNA, 17 nt, Mycobacterium bovis subsp bovis AF2122/97
gaaguggugaccgacgc

SEQ ID NO: 3060677 - RNA, 13 nt, Mycobacterium bovis subsp bovis AF2122/97
gaaguuccagccg

SEQ ID NO: 3060678 - RNA, 17 nt, Mycobacterium bovis subsp bovis AF2122/97
gaaguucgggcaacggc

SEQ ID NO: 3060679 - RNA, 21 nt, Mycobacterium bovis subsp bovis AF2122/97
gaaguucuccucgugcagcac

SEQ ID NO: 3060680 - RNA, 14 nt, Mycobacterium bovis subsp bovis AF2122/97
gaaguucucggugc

SEQ ID NO: 3060681 - RNA, 13 nt, Mycobacterium bovis subsp bovis AF2122/97
gaaguugaagaag

SEQ ID NO: 3060682 - RNA, 15 nt, Mycobacterium bovis subsp bovis AF2122/97
gaaguugaagaagcc

SEQ ID NO: 3060683 - RNA, 16 nt, Mycobacterium bovis subsp bovis AF2122/97
gaaguugaagaagcca

SEQ ID NO: 3060684 - RNA, 13 nt, Mycobacterium bovis subsp bovis AF2122/97
gaaguugaucuug

SEQ ID NO: 3060685 - RNA, 18 nt, Mycobacterium bovis subsp bovis AF2122/97
gaaguugccggucaggca

SEQ ID NO: 3060686 - RNA, 20 nt, Mycobacterium bovis subsp bovis AF2122/97
gaaguugggaagugcgguga

SEQ ID NO: 3060687 - RNA, 13 nt, Mycobacterium bovis subsp bovis AF2122/97
gaauacaacagcu

SEQ ID NO: 3060688 - RNA, 22 nt, Mycobacterium bovis subsp bovis AF2122/97
gaauacagcuugaucgccgagg

SEQ ID NO: 3060689 - RNA, 18 nt, Mycobacterium bovis subsp bovis AF2122/97
gaaugcgguccucgaucg

SEQ ID NO: 3060690 - RNA, 14 nt, Mycobacterium bovis subsp bovis AF2122/97
gaaugcugggcccg

SEQ ID NO: 3060691 - RNA, 20 nt, Mycobacterium bovis subsp bovis AF2122/97
gaaugcugggcccgccagcc

SEQ ID NO: 3060692 - RNA, 17 nt, Mycobacterium bovis subsp bovis AF2122/97
gaaugcuggggccuggu

SEQ ID NO: 3060693 - RNA, 23 nt, Mycobacterium bovis subsp bovis AF2122/97
gaaugcuggggccuggucccacc

SEQ ID NO: 3060694 - RNA, 23 nt, Mycobacterium bovis subsp bovis AF2122/97
gaaugcugugccgagaugccggc

SEQ ID NO: 3060695 - RNA, 14 nt, Mycobacterium bovis subsp bovis AF2122/97
gaauggcagcacga

SEQ ID NO: 3060696 - RNA, 19 nt, Mycobacterium bovis subsp bovis AF2122/97
gaauggcccuugcucgucc

SEQ ID NO: 3060697 - RNA, 23 nt, Mycobacterium bovis subsp bovis AF2122/97
gaauggcccuugcucguccaggu

SEQ ID NO: 3060698 - RNA, 20 nt, Mycobacterium bovis subsp bovis AF2122/97
gaauggccgaaccguucggc

SEQ ID NO: 3060699 - RNA, 13 nt, Mycobacterium bovis subsp bovis AF2122/97
gaauggccgccgc

SEQ ID NO: 3060700 - RNA, 13 nt, Mycobacterium bovis subsp bovis AF2122/97
gaauggccgccuu

SEQ ID NO: 3060701 - RNA, 14 nt, Mycobacterium bovis subsp bovis AF2122/97
gaauggcgccggcc

SEQ ID NO: 3060702 - RNA, 19 nt, Mycobacterium bovis subsp bovis AF2122/97
gaauggcgccggccggcgc

SEQ ID NO: 3060703 - RNA, 19 nt, Mycobacterium bovis subsp bovis AF2122/97
gaauggcggacagggcggc

SEQ ID NO: 3060704 - RNA, 14 nt, Mycobacterium bovis subsp bovis AF2122/97
gaaugggcgccaca

SEQ ID NO: 3060705 - RNA, 13 nt, Mycobacterium bovis subsp bovis AF2122/97
gaaugggcggcau

SEQ ID NO: 3060706 - RNA, 18 nt, Mycobacterium bovis subsp bovis AF2122/97
gaauggggccaacaccuc

SEQ ID NO: 3060707 - RNA, 20 nt, Mycobacterium bovis subsp bovis AF2122/97
gaaugggggcuggucgccgu

SEQ ID NO: 3060708 - RNA, 16 nt, Mycobacterium bovis subsp bovis AF2122/97
gaaugguggugucggc

SEQ ID NO: 3060709 - RNA, 22 nt, Mycobacterium bovis subsp bovis AF2122/97
gaaugucccgguguccagccac

SEQ ID NO: 3060710 - RNA, 22 nt, Mycobacterium bovis subsp bovis AF2122/97
gaaugucgaaacccacguacgc

SEQ ID NO: 3060711 - RNA, 16 nt, Mycobacterium bovis subsp bovis AF2122/97
gaaugucuuuggucgc

SEQ ID NO: 3060712 - RNA, 19 nt, Mycobacterium bovis subsp bovis AF2122/97
gaaugucuuuggucgccgg

SEQ ID NO: 3060713 - RNA, 23 nt, Mycobacterium bovis subsp bovis AF2122/97
gaaugugucgaccuucucgaugc

SEQ ID NO: 3060714 - RNA, 15 nt, Mycobacterium bovis subsp bovis AF2122/97
gaauguugccgccgc

SEQ ID NO: 3060715 - RNA, 20 nt, Mycobacterium bovis subsp bovis AF2122/97
gaauguugccgccgcggcgc

SEQ ID NO: 3060716 - RNA, 21 nt, Mycobacterium bovis subsp bovis AF2122/97
gaauguugcgaucugcggcgc

SEQ ID NO: 3060717 - RNA, 18 nt, Mycobacterium bovis subsp bovis AF2122/97
gaauguugguuugccggc

SEQ ID NO: 3060718 - RNA, 20 nt, Mycobacterium bovis subsp bovis AF2122/97
gaauguugguuugccggcgg

SEQ ID NO: 3060719 - RNA, 20 nt, Mycobacterium bovis subsp bovis AF2122/97
gaauuaaagccaccagaauc

SEQ ID NO: 3060720 - RNA, 23 nt, Mycobacterium bovis subsp bovis AF2122/97
gaauuacgcaccgaggccgccga

SEQ ID NO: 3060721 - RNA, 20 nt, Mycobacterium bovis subsp bovis AF2122/97
gaauuaguuucguccccaga

SEQ ID NO: 3060722 - RNA, 21 nt, Mycobacterium bovis subsp bovis AF2122/97
gaauucaccacuccggcguug

SEQ ID NO: 3060723 - RNA, 15 nt, Mycobacterium bovis subsp bovis AF2122/97
gaauucacgaugcuc

SEQ ID NO: 3060724 - RNA, 19 nt, Mycobacterium bovis subsp bovis AF2122/97
gaauucauccgggcucgca

SEQ ID NO: 3060725 - RNA, 22 nt, Mycobacterium bovis subsp bovis AF2122/97
gaauuccagccagccgcccuga

SEQ ID NO: 3060726 - RNA, 18 nt, Mycobacterium bovis subsp bovis AF2122/97
gaauucccaugcugcgca

SEQ ID NO: 3060727 - RNA, 19 nt, Mycobacterium bovis subsp bovis AF2122/97
gaauucccaugcugcgcaa

SEQ ID NO: 3060728 - RNA, 17 nt, Mycobacterium bovis subsp bovis AF2122/97
gaauuccccagccgcau

SEQ ID NO: 3060729 - RNA, 22 nt, Mycobacterium bovis subsp bovis AF2122/97
gaauuccggcggagcgggccag

SEQ ID NO: 3060730 - RNA, 14 nt, Mycobacterium bovis subsp bovis AF2122/97
gaauuccggcugcu

SEQ ID NO: 3060731 - RNA, 19 nt, Mycobacterium bovis subsp bovis AF2122/97
gaauucgaccacucgccgc

SEQ ID NO: 3060732 - RNA, 14 nt, Mycobacterium bovis subsp bovis AF2122/97
gaauucggcgucgu

SEQ ID NO: 3060733 - RNA, 18 nt, Mycobacterium bovis subsp bovis AF2122/97
gaauugcguucgccgccc

SEQ ID NO: 3060734 - RNA, 18 nt, Mycobacterium bovis subsp bovis AF2122/97
gaauuucgaugagguggc

SEQ ID NO: 3060735 - RNA, 14 nt, Mycobacterium bovis subsp bovis AF2122/97
gacaaaagccaggg

SEQ ID NO: 3060736 - RNA, 13 nt, Mycobacterium bovis subsp bovis AF2122/97
gacaaacagcgcc

SEQ ID NO: 3060737 - RNA, 18 nt, Mycobacterium bovis subsp bovis AF2122/97
gacaaacggcgacccagc

SEQ ID NO: 3060738 - RNA, 19 nt, Mycobacterium bovis subsp bovis AF2122/97
gacaaacggcgacccagcg

SEQ ID NO: 3060739 - RNA, 21 nt, Mycobacterium bovis subsp bovis AF2122/97
gacaaacguguugaccggguc

SEQ ID NO: 3060740 - RNA, 21 nt, Mycobacterium bovis subsp bovis AF2122/97
gacaaagaaguggucggcccg

SEQ ID NO: 3060741 - RNA, 14 nt, Mycobacterium bovis subsp bovis AF2122/97
gacaaagccgaacg

SEQ ID NO: 3060742 - RNA, 23 nt, Mycobacterium bovis subsp bovis AF2122/97
gacaaagcgcgcuggcuacccac

SEQ ID NO: 3060743 - RNA, 14 nt, Mycobacterium bovis subsp bovis AF2122/97
gacaaagcggcugc

SEQ ID NO: 3060744 - RNA, 21 nt, Mycobacterium bovis subsp bovis AF2122/97
gacaaagcggcugcccgagau

SEQ ID NO: 3060745 - RNA, 15 nt, Mycobacterium bovis subsp bovis AF2122/97
gacaaaggugccgac

SEQ ID NO: 3060746 - RNA, 19 nt, Mycobacterium bovis subsp bovis AF2122/97
gacaaaucgaugaccgucg

SEQ ID NO: 3060747 - RNA, 22 nt, Mycobacterium bovis subsp bovis AF2122/97
gacaaaucgaugaccgucgcac

SEQ ID NO: 3060748 - RNA, 14 nt, Mycobacterium bovis subsp bovis AF2122/97
gacaaaucggcggu

SEQ ID NO: 3060749 - RNA, 23 nt, Mycobacterium bovis subsp bovis AF2122/97
gacaacaaacccggccucgguga

SEQ ID NO: 3060750 - RNA, 14 nt, Mycobacterium bovis subsp bovis AF2122/97
gacaacaccacggu

SEQ ID NO: 3060751 - RNA, 16 nt, Mycobacterium bovis subsp bovis AF2122/97
gacaacacgccgucga

SEQ ID NO: 3060752 - RNA, 22 nt, Mycobacterium bovis subsp bovis AF2122/97
gacaacacgccgucgaccggcg

SEQ ID NO: 3060753 - RNA, 23 nt, Mycobacterium bovis subsp bovis AF2122/97
gacaacacgccgucgaccggcgg

SEQ ID NO: 3060754 - RNA, 20 nt, Mycobacterium bovis subsp bovis AF2122/97
gacaacacggcgaaccggcc

SEQ ID NO: 3060755 - RNA, 12 nt, Mycobacterium bovis subsp bovis AF2122/97
gacaacagcaag

SEQ ID NO: 3060756 - RNA, 22 nt, Mycobacterium bovis subsp bovis AF2122/97
gacaacagcaagauuauggcga

SEQ ID NO: 3060757 - RNA, 13 nt, Mycobacterium bovis subsp bovis AF2122/97
gacaacagccagc

SEQ ID NO: 3060758 - RNA, 21 nt, Mycobacterium bovis subsp bovis AF2122/97
gacaacaggccgucgaugauc

SEQ ID NO: 3060759 - RNA, 21 nt, Mycobacterium bovis subsp bovis AF2122/97
gacaacaucgaaucagcucgc

SEQ ID NO: 3060760 - RNA, 18 nt, Mycobacterium bovis subsp bovis AF2122/97
gacaaccccuugccuucc

SEQ ID NO: 3060761 - RNA, 18 nt, Mycobacterium bovis subsp bovis AF2122/97
gacaacccgcucggcggu

SEQ ID NO: 3060762 - RNA, 20 nt, Mycobacterium bovis subsp bovis AF2122/97
gacaacccgcucggcggucg

SEQ ID NO: 3060763 - RNA, 19 nt, Mycobacterium bovis subsp bovis AF2122/97
gacaaccggccagauggug

SEQ ID NO: 3060764 - RNA, 13 nt, Mycobacterium bovis subsp bovis AF2122/97
gacaaccgggcgg

SEQ ID NO: 3060765 - RNA, 18 nt, Mycobacterium bovis subsp bovis AF2122/97
gacaaccucgucgaucuc

SEQ ID NO: 3060766 - RNA, 14 nt, Mycobacterium bovis subsp bovis AF2122/97
gacaaccuuggcga

SEQ ID NO: 3060767 - RNA, 22 nt, Mycobacterium bovis subsp bovis AF2122/97
gacaacgacugcguuccgaucg

SEQ ID NO: 3060768 - RNA, 15 nt, Mycobacterium bovis subsp bovis AF2122/97
gacaacgaucgcgcg

SEQ ID NO: 3060769 - RNA, 16 nt, Mycobacterium bovis subsp bovis AF2122/97
gacaacgaucgcgcga

SEQ ID NO: 3060770 - RNA, 15 nt, Mycobacterium bovis subsp bovis AF2122/97
gacaacgaugucacc

SEQ ID NO: 3060771 - RNA, 23 nt, Mycobacterium bovis subsp bovis AF2122/97
gacaacgaugucacccucccgca

SEQ ID NO: 3060772 - RNA, 17 nt, Mycobacterium bovis subsp bovis AF2122/97
gacaacgcugggcggcu

SEQ ID NO: 3060773 - RNA, 13 nt, Mycobacterium bovis subsp bovis AF2122/97
gacaacggcgguc

SEQ ID NO: 3060774 - RNA, 22 nt, Mycobacterium bovis subsp bovis AF2122/97
gacaacgggccuucagcucacc

SEQ ID NO: 3060775 - RNA, 20 nt, Mycobacterium bovis subsp bovis AF2122/97
gacaccguggaucggcagcc

SEQ ID NO: 3060776 - RNA, 17 nt, Mycobacterium bovis subsp bovis AF2122/97
gacaccuccgucagcgc

SEQ ID NO: 3060777 - RNA, 22 nt, Mycobacterium bovis subsp bovis AF2122/97
gacaccugcugcaccgucagcc

SEQ ID NO: 3060778 - RNA, 18 nt, Mycobacterium bovis subsp bovis AF2122/97
gacaccuuucuccacacu

SEQ ID NO: 3060779 - RNA, 15 nt, Mycobacterium bovis subsp bovis AF2122/97
gacacgacgugcagg

SEQ ID NO: 3060780 - RNA, 19 nt, Mycobacterium bovis subsp bovis AF2122/97
gacacgagucgccagaccg

SEQ ID NO: 3060781 - RNA, 22 nt, Mycobacterium bovis subsp bovis AF2122/97
gacacgaucgcgucggcuaccu

SEQ ID NO: 3060782 - RNA, 19 nt, Mycobacterium bovis subsp bovis AF2122/97
gacacgcccuaacccugcc

SEQ ID NO: 3060783 - RNA, 15 nt, Mycobacterium bovis subsp bovis AF2122/97
gacacgccgaugccg

SEQ ID NO: 3060784 - RNA, 19 nt, Mycobacterium bovis subsp bovis AF2122/97
gacacgccgaugccgaacu

SEQ ID NO: 3060785 - RNA, 22 nt, Mycobacterium bovis subsp bovis AF2122/97
gacacgccgauucgccgucgug

SEQ ID NO: 3060786 - RNA, 16 nt, Mycobacterium bovis subsp bovis AF2122/97
gacacgcugcaggcgg

SEQ ID NO: 3060787 - RNA, 18 nt, Mycobacterium bovis subsp bovis AF2122/97
gacacgcugcaggcggcc

SEQ ID NO: 3060788 - RNA, 20 nt, Mycobacterium bovis subsp bovis AF2122/97
gacacgcugcaggcggccga

SEQ ID NO: 3060789 - RNA, 22 nt, Mycobacterium bovis subsp bovis AF2122/97
gacacggccauccguaucacgg

SEQ ID NO: 3060790 - RNA, 15 nt, Mycobacterium bovis subsp bovis AF2122/97
gacacggugaucuuc

SEQ ID NO: 3060791 - RNA, 17 nt, Mycobacterium bovis subsp bovis AF2122/97
gacacgucgcgccaggc

SEQ ID NO: 3060792 - RNA, 22 nt, Mycobacterium bovis subsp bovis AF2122/97
gacacgucgcgccaggcgcgau

SEQ ID NO: 3060793 - RNA, 21 nt, Mycobacterium bovis subsp bovis AF2122/97
gacacguugcagcucgauccg

SEQ ID NO: 3060794 - RNA, 22 nt, Mycobacterium bovis subsp bovis AF2122/97
gacacguuguucaccgacgcga

SEQ ID NO: 3060795 - RNA, 23 nt, Mycobacterium bovis subsp bovis AF2122/97
gacacguuucacguggucggcau

SEQ ID NO: 3060796 - RNA, 23 nt, Mycobacterium bovis subsp bovis AF2122/97
gacacucccgggugcgacgcgac

SEQ ID NO: 3060797 - RNA, 14 nt, Mycobacterium bovis subsp bovis AF2122/97
gacacugcagugau

SEQ ID NO: 3060798 - RNA, 22 nt, Mycobacterium bovis subsp bovis AF2122/97
gacacugccuuaaccgagccga

SEQ ID NO: 3060799 - RNA, 18 nt, Mycobacterium bovis subsp bovis AF2122/97
gacacugcugcggcagcg

SEQ ID NO: 3060800 - RNA, 14 nt, Mycobacterium bovis subsp bovis AF2122/97
gacacuggccgucg

SEQ ID NO: 3060801 - RNA, 15 nt, Mycobacterium bovis subsp bovis AF2122/97
gacacuggccgucgg

SEQ ID NO: 3060802 - RNA, 17 nt, Mycobacterium bovis subsp bovis AF2122/97
gacacuggccgucggcg

SEQ ID NO: 3060803 - RNA, 17 nt, Mycobacterium bovis subsp bovis AF2122/97
gacacuggggugcugcg

SEQ ID NO: 3060804 - RNA, 19 nt, Mycobacterium bovis subsp bovis AF2122/97
gacacuggggugcugcgcg

SEQ ID NO: 3060805 - RNA, 20 nt, Mycobacterium bovis subsp bovis AF2122/97
gacacuggggugcugcgcgc

SEQ ID NO: 3060806 - RNA, 21 nt, Mycobacterium bovis subsp bovis AF2122/97
gacacuggucgcggcgcuggc

SEQ ID NO: 3060807 - RNA, 12 nt, Mycobacterium bovis subsp bovis AF2122/97
gacagacacagc

SEQ ID NO: 3060808 - RNA, 16 nt, Mycobacterium bovis subsp bovis AF2122/97
gacagacacagcaccg

SEQ ID NO: 3060809 - RNA, 14 nt, Mycobacterium bovis subsp bovis AF2122/97
gacagacagcaccg

SEQ ID NO: 3060810 - RNA, 18 nt, Mycobacterium bovis subsp bovis AF2122/97
gacagacagcaccgccgg

SEQ ID NO: 3060811 - RNA, 13 nt, Mycobacterium bovis subsp bovis AF2122/97
gacagacaggauu

SEQ ID NO: 3060812 - RNA, 20 nt, Mycobacterium bovis subsp bovis AF2122/97
gacagagcggguucgacguu

SEQ ID NO: 3060813 - RNA, 19 nt, Mycobacterium bovis subsp bovis AF2122/97
gacagauagacuagccgau

SEQ ID NO: 3060814 - RNA, 16 nt, Mycobacterium bovis subsp bovis AF2122/97
gacagaugcauccagc

SEQ ID NO: 3060815 - RNA, 14 nt, Mycobacterium bovis subsp bovis AF2122/97
gacagaugccgggc

SEQ ID NO: 3060816 - RNA, 12 nt, Mycobacterium bovis subsp bovis AF2122/97
gacagcacccgg

SEQ ID NO: 3060817 - RNA, 14 nt, Mycobacterium bovis subsp bovis AF2122/97
gacagcacccggcc

SEQ ID NO: 3060818 - RNA, 24 nt, Mycobacterium bovis subsp bovis AF2122/97
gacagcaccgaauuacgcaccgag

SEQ ID NO: 3060819 - RNA, 15 nt, Mycobacterium bovis subsp bovis AF2122/97
gacagcagccgccgg

SEQ ID NO: 3060820 - RNA, 16 nt, Mycobacterium bovis subsp bovis AF2122/97
gacagcagccgccggc

SEQ ID NO: 3060821 - RNA, 13 nt, Mycobacterium bovis subsp bovis AF2122/97
gacagcagccggc

SEQ ID NO: 3060822 - RNA, 21 nt, Mycobacterium bovis subsp bovis AF2122/97
gacagcagccggugccggucg

SEQ ID NO: 3060823 - RNA, 15 nt, Mycobacterium bovis subsp bovis AF2122/97
gacagcagcgcgaca

SEQ ID NO: 3060824 - RNA, 21 nt, Mycobacterium bovis subsp bovis AF2122/97
gacagcaucacgcccacgaua

SEQ ID NO: 3060825 - RNA, 21 nt, Mycobacterium bovis subsp bovis AF2122/97
gacagcauguuccccgucgcc

SEQ ID NO: 3060826 - RNA, 12 nt, Mycobacterium bovis subsp bovis AF2122/97
gacagccaccgc

SEQ ID NO: 3060827 - RNA, 14 nt, Mycobacterium bovis subsp bovis AF2122/97
gacagccaccucga

SEQ ID NO: 3060828 - RNA, 16 nt, Mycobacterium bovis subsp bovis AF2122/97
gacagccacgcacaau

SEQ ID NO: 3060829 - RNA, 16 nt, Mycobacterium bovis subsp bovis AF2122/97
gacagccccgccgccc

SEQ ID NO: 3060830 - RNA, 14 nt, Mycobacterium bovis subsp bovis AF2122/97
gacagccccgcggc

SEQ ID NO: 3060831 - RNA, 18 nt, Mycobacterium bovis subsp bovis AF2122/97
gacagccccgcggccagc

SEQ ID NO: 3060832 - RNA, 16 nt, Mycobacterium bovis subsp bovis AF2122/97
gacagcccgaacgagg

SEQ ID NO: 3060833 - RNA, 16 nt, Mycobacterium bovis subsp bovis AF2122/97
gacagcccgccggcgu

SEQ ID NO: 3060834 - RNA, 22 nt, Mycobacterium bovis subsp bovis AF2122/97
gacagcccuaucagccgagaca

SEQ ID NO: 3060835 - RNA, 15 nt, Mycobacterium bovis subsp bovis AF2122/97
gacagccguggcgcg

SEQ ID NO: 3060836 - RNA, 13 nt, Mycobacterium bovis subsp bovis AF2122/97
gacagccugcgcc

SEQ ID NO: 3060837 - RNA, 14 nt, Mycobacterium bovis subsp bovis AF2122/97
gacagccugcgcca

SEQ ID NO: 3060838 - RNA, 12 nt, Mycobacterium bovis subsp bovis AF2122/97
gacagcgagcga

SEQ ID NO: 3060839 - RNA, 21 nt, Mycobacterium bovis subsp bovis AF2122/97
gacagcgagcgacguuaauga

SEQ ID NO: 3060840 - RNA, 13 nt, Mycobacterium bovis subsp bovis AF2122/97
gacagcgcaucca

SEQ ID NO: 3060841 - RNA, 16 nt, Mycobacterium bovis subsp bovis AF2122/97
gacagcgccaugcccu

SEQ ID NO: 3060842 - RNA, 22 nt, Mycobacterium bovis subsp bovis AF2122/97
gacagcgccaugcccucggcgc

SEQ ID NO: 3060843 - RNA, 14 nt, Mycobacterium bovis subsp bovis AF2122/97
gacagcgccuggcc

SEQ ID NO: 3060844 - RNA, 17 nt, Mycobacterium bovis subsp bovis AF2122/97
gacagcgccuuguuggc

SEQ ID NO: 3060845 - RNA, 14 nt, Mycobacterium bovis subsp bovis AF2122/97
gacagcgcggcggu

SEQ ID NO: 3060846 - RNA, 15 nt, Mycobacterium bovis subsp bovis AF2122/97
gacagcgcggcgguc

SEQ ID NO: 3060847 - RNA, 21 nt, Mycobacterium bovis subsp bovis AF2122/97
gacagcgcggcggucgagcga

SEQ ID NO: 3060848 - RNA, 19 nt, Mycobacterium bovis subsp bovis AF2122/97
gacagcgcgggacacgucg

SEQ ID NO: 3060849 - RNA, 22 nt, Mycobacterium bovis subsp bovis AF2122/97
gacagcggcaaucgggucugga

SEQ ID NO: 3060850 - RNA, 19 nt, Mycobacterium bovis subsp bovis AF2122/97
gacagcgggcuaaugcgac

SEQ ID NO: 3060851 - RNA, 17 nt, Mycobacterium bovis subsp bovis AF2122/97
gacagcgucucggaggc

SEQ ID NO: 3060852 - RNA, 16 nt, Mycobacterium bovis subsp bovis AF2122/97
gacagcgugccgaaca

SEQ ID NO: 3060853 - RNA, 20 nt, Mycobacterium bovis subsp bovis AF2122/97
gacagcgugccgaacaggga

SEQ ID NO: 3060854 - RNA, 22 nt, Mycobacterium bovis subsp bovis AF2122/97
gacagcucacgcugaagccgcu

SEQ ID NO: 3060855 - RNA, 20 nt, Mycobacterium bovis subsp bovis AF2122/97
gacagcuccuuggcuaacac

SEQ ID NO: 3060856 - RNA, 19 nt, Mycobacterium bovis subsp bovis AF2122/97
gacagcugguugugcuggg

SEQ ID NO: 3060857 - RNA, 15 nt, Mycobacterium bovis subsp bovis AF2122/97
gacaggaacggcccg

SEQ ID NO: 3060858 - RNA, 15 nt, Mycobacterium bovis subsp bovis AF2122/97
gacaggaccgguggg

SEQ ID NO: 3060859 - RNA, 14 nt, Mycobacterium bovis subsp bovis AF2122/97
gacaggacgucggc

SEQ ID NO: 3060860 - RNA, 12 nt, Mycobacterium bovis subsp bovis AF2122/97
gacaggccaccg

SEQ ID NO: 3060861 - RNA, 18 nt, Mycobacterium bovis subsp bovis AF2122/97
gacaggccggccaccagu

SEQ ID NO: 3060862 - RNA, 21 nt, Mycobacterium bovis subsp bovis AF2122/97
gaccaagugucgccgcucggu

SEQ ID NO: 3060863 - RNA, 20 nt, Mycobacterium bovis subsp bovis AF2122/97
gaccaaugucagugccccgc

SEQ ID NO: 3060864 - RNA, 21 nt, Mycobacterium bovis subsp bovis AF2122/97
gaccaaugucagugccccgcc

SEQ ID NO: 3060865 - RNA, 22 nt, Mycobacterium bovis subsp bovis AF2122/97
gaccaaugucagugccccgccc

SEQ ID NO: 3060866 - RNA, 16 nt, Mycobacterium bovis subsp bovis AF2122/97
gaccaauucgaccgcg

SEQ ID NO: 3060867 - RNA, 21 nt, Mycobacterium bovis subsp bovis AF2122/97
gaccaauucgcaaucggcguu

SEQ ID NO: 3060868 - RNA, 17 nt, Mycobacterium bovis subsp bovis AF2122/97
gaccacaacgccucgcc

SEQ ID NO: 3060869 - RNA, 19 nt, Mycobacterium bovis subsp bovis AF2122/97
gaccacaccacgauggcgg

SEQ ID NO: 3060870 - RNA, 18 nt, Mycobacterium bovis subsp bovis AF2122/97
gaccacaccgucaccgag

SEQ ID NO: 3060871 - RNA, 21 nt, Mycobacterium bovis subsp bovis AF2122/97
gaccacaccgucaccgagccc

SEQ ID NO: 3060872 - RNA, 14 nt, Mycobacterium bovis subsp bovis AF2122/97
gaccacagccgcgc

SEQ ID NO: 3060873 - RNA, 15 nt, Mycobacterium bovis subsp bovis AF2122/97
gaccacagccgcgcc

SEQ ID NO: 3060874 - RNA, 20 nt, Mycobacterium bovis subsp bovis AF2122/97
gaccacagccgcgccgaccu

SEQ ID NO: 3060875 - RNA, 22 nt, Mycobacterium bovis subsp bovis AF2122/97
gaccacagccgcgccgaccuca

SEQ ID NO: 3060876 - RNA, 21 nt, Mycobacterium bovis subsp bovis AF2122/97
gaccacagcggagacgaucgc

SEQ ID NO: 3060877 - RNA, 22 nt, Mycobacterium bovis subsp bovis AF2122/97
gaccacagcggagacgaucgcc

SEQ ID NO: 3060878 - RNA, 13 nt, Mycobacterium bovis subsp bovis AF2122/97
gaccacaggcauc

SEQ ID NO: 3060879 - RNA, 13 nt, Mycobacterium bovis subsp bovis AF2122/97
gaccaccaccgcc

SEQ ID NO: 3060880 - RNA, 16 nt, Mycobacterium bovis subsp bovis AF2122/97
gaccaccaccgccgcc

SEQ ID NO: 3060881 - RNA, 23 nt, Mycobacterium bovis subsp bovis AF2122/97
gaccaccaccgccgccgaagcga

SEQ ID NO: 3060882 - RNA, 14 nt, Mycobacterium bovis subsp bovis AF2122/97
gaccaccacgauga

SEQ ID NO: 3060883 - RNA, 22 nt, Mycobacterium bovis subsp bovis AF2122/97
gaccaccacuaggucgccggcc

SEQ ID NO: 3060884 - RNA, 19 nt, Mycobacterium bovis subsp bovis AF2122/97
gaccaccagagcgucgaac

SEQ ID NO: 3060885 - RNA, 15 nt, Mycobacterium bovis subsp bovis AF2122/97
gaccaccagcgccga

SEQ ID NO: 3060886 - RNA, 22 nt, Mycobacterium bovis subsp bovis AF2122/97
gaccaccagcgccgacccguac

SEQ ID NO: 3060887 - RNA, 13 nt, Mycobacterium bovis subsp bovis AF2122/97
gaccaccagcgcu

SEQ ID NO: 3060888 - RNA, 13 nt, Mycobacterium bovis subsp bovis AF2122/97
gaccacccggcgc

SEQ ID NO: 3060889 - RNA, 14 nt, Mycobacterium bovis subsp bovis AF2122/97
gaccacccggcgcg

SEQ ID NO: 3060890 - RNA, 19 nt, Mycobacterium bovis subsp bovis AF2122/97
gaccaccgaaauacccagc

SEQ ID NO: 3060891 - RNA, 18 nt, Mycobacterium bovis subsp bovis AF2122/97
gaccaccgauauggccgg

SEQ ID NO: 3060892 - RNA, 14 nt, Mycobacterium bovis subsp bovis AF2122/97
gaccaccgccgaca

SEQ ID NO: 3060893 - RNA, 16 nt, Mycobacterium bovis subsp bovis AF2122/97
gaccaccgccggcccg

SEQ ID NO: 3060894 - RNA, 20 nt, Mycobacterium bovis subsp bovis AF2122/97
gaccaccgccggcccgcggg

SEQ ID NO: 3060895 - RNA, 18 nt, Mycobacterium bovis subsp bovis AF2122/97
gaccaccgcgaaagcacc

SEQ ID NO: 3060896 - RNA, 23 nt, Mycobacterium bovis subsp bovis AF2122/97
gaccaccgcgaaagcaccgagca

SEQ ID NO: 3060897 - RNA, 20 nt, Mycobacterium bovis subsp bovis AF2122/97
gaccaccgcggcaugugaca

SEQ ID NO: 3060898 - RNA, 16 nt, Mycobacterium bovis subsp bovis AF2122/97
gaccaccgcgucgggc

SEQ ID NO: 3060899 - RNA, 13 nt, Mycobacterium bovis subsp bovis AF2122/97
gaccaccgcugcg

SEQ ID NO: 3060900 - RNA, 18 nt, Mycobacterium bovis subsp bovis AF2122/97
gaccaccggcagcgcgau

SEQ ID NO: 3060901 - RNA, 13 nt, Mycobacterium bovis subsp bovis AF2122/97
gaccaccgggcgc

SEQ ID NO: 3060902 - RNA, 19 nt, Mycobacterium bovis subsp bovis AF2122/97
gaccaccggguagccggcg

SEQ ID NO: 3060903 - RNA, 23 nt, Mycobacterium bovis subsp bovis AF2122/97
gaccaccggguagccggcgugca

SEQ ID NO: 3060904 - RNA, 16 nt, Mycobacterium bovis subsp bovis AF2122/97
gaccaccugcaugugu

SEQ ID NO: 3060905 - RNA, 14 nt, Mycobacterium bovis subsp bovis AF2122/97
gaccaccugcugca

SEQ ID NO: 3060906 - RNA, 16 nt, Mycobacterium bovis subsp bovis AF2122/97
gaccaccugcugcacg

SEQ ID NO: 3060907 - RNA, 13 nt, Mycobacterium bovis subsp bovis AF2122/97
gaccaccugguuu

SEQ ID NO: 3060908 - RNA, 21 nt, Mycobacterium bovis subsp bovis AF2122/97
gaccaccuucugacgcggccg

SEQ ID NO: 3060909 - RNA, 16 nt, Mycobacterium bovis subsp bovis AF2122/97
gaccacgaacgcgcgc

SEQ ID NO: 3060910 - RNA, 20 nt, Mycobacterium bovis subsp bovis AF2122/97
gaccacgaauggggccaaca

SEQ ID NO: 3060911 - RNA, 12 nt, Mycobacterium bovis subsp bovis AF2122/97
gaccacgacgug

SEQ ID NO: 3060912 - RNA, 17 nt, Mycobacterium bovis subsp bovis AF2122/97
gaccacgacguucgacg

SEQ ID NO: 3060913 - RNA, 13 nt, Mycobacterium bovis subsp bovis AF2122/97
gaccacgcaccgc

SEQ ID NO: 3060914 - RNA, 14 nt, Mycobacterium bovis subsp bovis AF2122/97
gaccacgcaccgcc

SEQ ID NO: 3060915 - RNA, 16 nt, Mycobacterium bovis subsp bovis AF2122/97
gaccacgcaccgcccc

SEQ ID NO: 3060916 - RNA, 18 nt, Mycobacterium bovis subsp bovis AF2122/97
gaccacgcaccgccccgc

SEQ ID NO: 3060917 - RNA, 22 nt, Mycobacterium bovis subsp bovis AF2122/97
gaccacgcaccgccccgccguu

SEQ ID NO: 3060918 - RNA, 14 nt, Mycobacterium bovis subsp bovis AF2122/97
gaccacgccgacga

SEQ ID NO: 3060919 - RNA, 14 nt, Mycobacterium bovis subsp bovis AF2122/97
gaccacgccgacgu

SEQ ID NO: 3060920 - RNA, 17 nt, Mycobacterium bovis subsp bovis AF2122/97
gaccacgccgccggcgc

SEQ ID NO: 3060921 - RNA, 19 nt, Mycobacterium bovis subsp bovis AF2122/97
gaccacgccgccggcgcug

SEQ ID NO: 3060922 - RNA, 20 nt, Mycobacterium bovis subsp bovis AF2122/97
gaccacgccgccggcgcuga

SEQ ID NO: 3060923 - RNA, 15 nt, Mycobacterium bovis subsp bovis AF2122/97
gaccacgccguggcc

SEQ ID NO: 3060924 - RNA, 22 nt, Mycobacterium bovis subsp bovis AF2122/97
gaccacgguagacaagucggcg

SEQ ID NO: 3060925 - RNA, 17 nt, Mycobacterium bovis subsp bovis AF2122/97
gaccacggugaguuggc

SEQ ID NO: 3060926 - RNA, 19 nt, Mycobacterium bovis subsp bovis AF2122/97
gaccacgucgagguccacc

SEQ ID NO: 3060927 - RNA, 20 nt, Mycobacterium bovis subsp bovis AF2122/97
gaccacgucgagguccacca

SEQ ID NO: 3060928 - RNA, 23 nt, Mycobacterium bovis subsp bovis AF2122/97
gaccacgucgagguccaccaccc

SEQ ID NO: 3060929 - RNA, 13 nt, Mycobacterium bovis subsp bovis AF2122/97
gaccacgucggcg

SEQ ID NO: 3060930 - RNA, 22 nt, Mycobacterium bovis subsp bovis AF2122/97
gaccacgugaucgacgaccguc

SEQ ID NO: 3060931 - RNA, 23 nt, Mycobacterium bovis subsp bovis AF2122/97
gaccacucaagauaacggcgacc

SEQ ID NO: 3060932 - RNA, 17 nt, Mycobacterium bovis subsp bovis AF2122/97
gaccacuccacgcagcc

SEQ ID NO: 3060933 - RNA, 14 nt, Mycobacterium bovis subsp bovis AF2122/97
gaccacucgagcgc

SEQ ID NO: 3060934 - RNA, 17 nt, Mycobacterium bovis subsp bovis AF2122/97
gaccacucgagcgcuca

SEQ ID NO: 3060935 - RNA, 13 nt, Mycobacterium bovis subsp bovis AF2122/97
gaccacucgccgg

SEQ ID NO: 3060936 - RNA, 14 nt, Mycobacterium bovis subsp bovis AF2122/97
gaccacugcccggg

SEQ ID NO: 3060937 - RNA, 21 nt, Mycobacterium bovis subsp bovis AF2122/97
gaccacugcccgggguccauc

SEQ ID NO: 3060938 - RNA, 20 nt, Mycobacterium bovis subsp bovis AF2122/97
gaccacuguuggugccgcca

SEQ ID NO: 3060939 - RNA, 16 nt, Mycobacterium bovis subsp bovis AF2122/97
gaccacuuagcuggcg

SEQ ID NO: 3060940 - RNA, 23 nt, Mycobacterium bovis subsp bovis AF2122/97
gaccacuucgcuuucccgucggc

SEQ ID NO: 3060941 - RNA, 21 nt, Mycobacterium bovis subsp bovis AF2122/97
gaccagaaccuggagccgugc

SEQ ID NO: 3060942 - RNA, 19 nt, Mycobacterium bovis subsp bovis AF2122/97
gaccagaacgacgccgcgg

SEQ ID NO: 3060943 - RNA, 14 nt, Mycobacterium bovis subsp bovis AF2122/97
gaccagagccgcga

SEQ ID NO: 3060944 - RNA, 16 nt, Mycobacterium bovis subsp bovis AF2122/97
gaccagagcuucgccg

SEQ ID NO: 3060945 - RNA, 17 nt, Mycobacterium bovis subsp bovis AF2122/97
gaccagaggaugucgau

SEQ ID NO: 3060946 - RNA, 20 nt, Mycobacterium bovis subsp bovis AF2122/97
gaccagaggaugucgauggg

SEQ ID NO: 3060947 - RNA, 16 nt, Mycobacterium bovis subsp bovis AF2122/97
gaccagauguaccuca

SEQ ID NO: 3060948 - RNA, 14 nt, Mycobacterium bovis subsp bovis AF2122/97
gacccacccgcacc

SEQ ID NO: 3060949 - RNA, 15 nt, Mycobacterium bovis subsp bovis AF2122/97
gacccacccgcaccg

SEQ ID NO: 3060950 - RNA, 17 nt, Mycobacterium bovis subsp bovis AF2122/97
gacccacccgcaccgcc

SEQ ID NO: 3060951 - RNA, 19 nt, Mycobacterium bovis subsp bovis AF2122/97
gacccacccgcaccgccgg

SEQ ID NO: 3060952 - RNA, 20 nt, Mycobacterium bovis subsp bovis AF2122/97
gacccacccgcaccgccggc

SEQ ID NO: 3060953 - RNA, 21 nt, Mycobacterium bovis subsp bovis AF2122/97
gacccacccgcaccgccggca

SEQ ID NO: 3060954 - RNA, 23 nt, Mycobacterium bovis subsp bovis AF2122/97
gacccacccgcaccgccggcaau

SEQ ID NO: 3060955 - RNA, 15 nt, Mycobacterium bovis subsp bovis AF2122/97
gacccaccgccccgg

SEQ ID NO: 3060956 - RNA, 17 nt, Mycobacterium bovis subsp bovis AF2122/97
gacccaccgucaccccc

SEQ ID NO: 3060957 - RNA, 18 nt, Mycobacterium bovis subsp bovis AF2122/97
gacccaccgucacccccg

SEQ ID NO: 3060958 - RNA, 20 nt, Mycobacterium bovis subsp bovis AF2122/97
gacccacucaucagagcgcu

SEQ ID NO: 3060959 - RNA, 20 nt, Mycobacterium bovis subsp bovis AF2122/97
gacccacucggggacggcga

SEQ ID NO: 3060960 - RNA, 14 nt, Mycobacterium bovis subsp bovis AF2122/97
gacccacugcaggc

SEQ ID NO: 3060961 - RNA, 12 nt, Mycobacterium bovis subsp bovis AF2122/97
gacccagcaccc

SEQ ID NO: 3060962 - RNA, 14 nt, Mycobacterium bovis subsp bovis AF2122/97
gacccagccagcug

SEQ ID NO: 3060963 - RNA, 16 nt, Mycobacterium bovis subsp bovis AF2122/97
gacccagcgcggcaac

SEQ ID NO: 3060964 - RNA, 16 nt, Mycobacterium bovis subsp bovis AF2122/97
gacccagcucgucgac

SEQ ID NO: 3060965 - RNA, 20 nt, Mycobacterium bovis subsp bovis AF2122/97
gacccagcucgucgacgucg

SEQ ID NO: 3060966 - RNA, 15 nt, Mycobacterium bovis subsp bovis AF2122/97
gacccauacgaacuc

SEQ ID NO: 3060967 - RNA, 15 nt, Mycobacterium bovis subsp bovis AF2122/97
gacccaucaccagcg

SEQ ID NO: 3060968 - RNA, 15 nt, Mycobacterium bovis subsp bovis AF2122/97
gacccaucgccagca

SEQ ID NO: 3060969 - RNA, 23 nt, Mycobacterium bovis subsp bovis AF2122/97
gacccaugagcccgugacauucu

SEQ ID NO: 3060970 - RNA, 18 nt, Mycobacterium bovis subsp bovis AF2122/97
gacccauucucggccggc

SEQ ID NO: 3060971 - RNA, 21 nt, Mycobacterium bovis subsp bovis AF2122/97
gacccauucucggccggcggc

SEQ ID NO: 3060972 - RNA, 22 nt, Mycobacterium bovis subsp bovis AF2122/97
gacccauucucggccggcggcg

SEQ ID NO: 3060973 - RNA, 23 nt, Mycobacterium bovis subsp bovis AF2122/97
gacccauucucggccggcggcgc

SEQ ID NO: 3060974 - RNA, 19 nt, Mycobacterium bovis subsp bovis AF2122/97
gacccauuggaccgagacu

SEQ ID NO: 3060975 - RNA, 14 nt, Mycobacterium bovis subsp bovis AF2122/97
gaccccaaucgacc

SEQ ID NO: 3060976 - RNA, 16 nt, Mycobacterium bovis subsp bovis AF2122/97
gacccccagcagggug

SEQ ID NO: 3060977 - RNA, 17 nt, Mycobacterium bovis subsp bovis AF2122/97
gacccccagcgcccgcc

SEQ ID NO: 3060978 - RNA, 19 nt, Mycobacterium bovis subsp bovis AF2122/97
gaccccccgaccccgacgg

SEQ ID NO: 3060979 - RNA, 17 nt, Mycobacterium bovis subsp bovis AF2122/97
gacccccgcaucggcgc

SEQ ID NO: 3060980 - RNA, 19 nt, Mycobacterium bovis subsp bovis AF2122/97
gacccccgcaucggcgcca

SEQ ID NO: 3060981 - RNA, 15 nt, Mycobacterium bovis subsp bovis AF2122/97
gacccccugacggca

SEQ ID NO: 3060982 - RNA, 14 nt, Mycobacterium bovis subsp bovis AF2122/97
gacccccugccaca

SEQ ID NO: 3060983 - RNA, 18 nt, Mycobacterium bovis subsp bovis AF2122/97
gaccccgaacauccgccg

SEQ ID NO: 3060984 - RNA, 16 nt, Mycobacterium bovis subsp bovis AF2122/97
gaccccgacgaugcgc

SEQ ID NO: 3060985 - RNA, 21 nt, Mycobacterium bovis subsp bovis AF2122/97
gaccccgacgaugcgcacucc

SEQ ID NO: 3060986 - RNA, 13 nt, Mycobacterium bovis subsp bovis AF2122/97
gaccccgccagcc

SEQ ID NO: 3060987 - RNA, 16 nt, Mycobacterium bovis subsp bovis AF2122/97
gaccccgccagccgga

SEQ ID NO: 3060988 - RNA, 13 nt, Mycobacterium bovis subsp bovis AF2122/97
gaccccgccgcca

SEQ ID NO: 3060989 - RNA, 23 nt, Mycobacterium bovis subsp bovis AF2122/97
gaccccgcgcgcuugggcacuuc

SEQ ID NO: 3060990 - RNA, 17 nt, Mycobacterium bovis subsp bovis AF2122/97
gaccccgcugcgacguu

SEQ ID NO: 3060991 - RNA, 22 nt, Mycobacterium bovis subsp bovis AF2122/97
gaccccgcuuuuucccggcggc

SEQ ID NO: 3060992 - RNA, 18 nt, Mycobacterium bovis subsp bovis AF2122/97
gaccccggaacgacccca

SEQ ID NO: 3060993 - RNA, 16 nt, Mycobacterium bovis subsp bovis AF2122/97
gaccccggcagcgccc

SEQ ID NO: 3060994 - RNA, 16 nt, Mycobacterium bovis subsp bovis AF2122/97
gaccccggcugcgcuu

SEQ ID NO: 3060995 - RNA, 17 nt, Mycobacterium bovis subsp bovis AF2122/97
gaccccgguggucuggu

SEQ ID NO: 3060996 - RNA, 17 nt, Mycobacterium bovis subsp bovis AF2122/97
gaccccguaggcgccga

SEQ ID NO: 3060997 - RNA, 18 nt, Mycobacterium bovis subsp bovis AF2122/97
gaccccguaggcgccgaa

SEQ ID NO: 3060998 - RNA, 19 nt, Mycobacterium bovis subsp bovis AF2122/97
gaccccguaggcgccgaac

SEQ ID NO: 3060999 - RNA, 20 nt, Mycobacterium bovis subsp bovis AF2122/97
gaccccguaggcgccgaacc

SEQ ID NO: 3061000 - RNA, 19 nt, Mycobacterium bovis subsp bovis AF2122/97
gaccccgucagcgggcagc

SEQ ID NO: 3061001 - RNA, 23 nt, Mycobacterium bovis subsp bovis AF2122/97
gaccccgucagcgggcagcaggc

SEQ ID NO: 3061002 - RNA, 16 nt, Mycobacterium bovis subsp bovis AF2122/97
gaccccucacccagcu

SEQ ID NO: 3061003 - RNA, 15 nt, Mycobacterium bovis subsp bovis AF2122/97
gaccccuggccgccg

SEQ ID NO: 3061004 - RNA, 16 nt, Mycobacterium bovis subsp bovis AF2122/97
gaccccuggccgccgg

SEQ ID NO: 3061005 - RNA, 17 nt, Mycobacterium bovis subsp bovis AF2122/97
gaccccuggccgccggc

SEQ ID NO: 3061006 - RNA, 20 nt, Mycobacterium bovis subsp bovis AF2122/97
gaccccuggccgccggcgcc

SEQ ID NO: 3061007 - RNA, 21 nt, Mycobacterium bovis subsp bovis AF2122/97
gaccccuggccgccggcgccg

SEQ ID NO: 3061008 - RNA, 16 nt, Mycobacterium bovis subsp bovis AF2122/97
gacccgaauccaccag

SEQ ID NO: 3061009 - RNA, 17 nt, Mycobacterium bovis subsp bovis AF2122/97
gacccgaauccaccagc

SEQ ID NO: 3061010 - RNA, 18 nt, Mycobacterium bovis subsp bovis AF2122/97
gacccgacaugguccgac

SEQ ID NO: 3061011 - RNA, 20 nt, Mycobacterium bovis subsp bovis AF2122/97
gacccgacaugguccgacca

SEQ ID NO: 3061012 - RNA, 14 nt, Mycobacterium bovis subsp bovis AF2122/97
gacccgaccgucgu

SEQ ID NO: 3061013 - RNA, 15 nt, Mycobacterium bovis subsp bovis AF2122/97
gacccgacgaugccg

SEQ ID NO: 3061014 - RNA, 15 nt, Mycobacterium bovis subsp bovis AF2122/97
gacccgacgcugguc

SEQ ID NO: 3061015 - RNA, 18 nt, Mycobacterium bovis subsp bovis AF2122/97
gacccgaucacgcugggu

SEQ ID NO: 3061016 - RNA, 13 nt, Mycobacterium bovis subsp bovis AF2122/97
gacccgaucgcgc

SEQ ID NO: 3061017 - RNA, 15 nt, Mycobacterium bovis subsp bovis AF2122/97
gacccgaugacccac

SEQ ID NO: 3061018 - RNA, 18 nt, Mycobacterium bovis subsp bovis AF2122/97
gacccgcauccacgucgc

SEQ ID NO: 3061019 - RNA, 14 nt, Mycobacterium bovis subsp bovis AF2122/97
gacccgcauggcgc

SEQ ID NO: 3061020 - RNA, 12 nt, Mycobacterium bovis subsp bovis AF2122/97
gacccgccaggg

SEQ ID NO: 3061021 - RNA, 20 nt, Mycobacterium bovis subsp bovis AF2122/97
gacccgccagggcacguggc

SEQ ID NO: 3061022 - RNA, 19 nt, Mycobacterium bovis subsp bovis AF2122/97
gacccgccgacgccgccgg

SEQ ID NO: 3061023 - RNA, 22 nt, Mycobacterium bovis subsp bovis AF2122/97
gacccgccgaugaugcggcgca

SEQ ID NO: 3061024 - RNA, 12 nt, Mycobacterium bovis subsp bovis AF2122/97
gacccgccgccc

SEQ ID NO: 3061025 - RNA, 12 nt, Mycobacterium bovis subsp bovis AF2122/97
gacccgccgcgg

SEQ ID NO: 3061026 - RNA, 15 nt, Mycobacterium bovis subsp bovis AF2122/97
gacccgccggcgacu

SEQ ID NO: 3061027 - RNA, 15 nt, Mycobacterium bovis subsp bovis AF2122/97
gacccgcgcgccggc

SEQ ID NO: 3061028 - RNA, 17 nt, Mycobacterium bovis subsp bovis AF2122/97
gacccgcgcgccggcga

SEQ ID NO: 3061029 - RNA, 17 nt, Mycobacterium bovis subsp bovis AF2122/97
gacccgcgcgucgccca

SEQ ID NO: 3061030 - RNA, 21 nt, Mycobacterium bovis subsp bovis AF2122/97
gacccgcgcgucgcccagugc

SEQ ID NO: 3061031 - RNA, 13 nt, Mycobacterium bovis subsp bovis AF2122/97
gacccgcggaccg

SEQ ID NO: 3061032 - RNA, 20 nt, Mycobacterium bovis subsp bovis AF2122/97
gacccgcgguagcggaccug

SEQ ID NO: 3061033 - RNA, 19 nt, Mycobacterium bovis subsp bovis AF2122/97
gacccgcuauucggcggca

SEQ ID NO: 3061034 - RNA, 15 nt, Mycobacterium bovis subsp bovis AF2122/97
gacccgcugccaccc

SEQ ID NO: 3061035 - RNA, 14 nt, Mycobacterium bovis subsp bovis AF2122/97
gaccgaccuggucg

SEQ ID NO: 3061036 - RNA, 14 nt, Mycobacterium bovis subsp bovis AF2122/97
gaccgacgccggug

SEQ ID NO: 3061037 - RNA, 16 nt, Mycobacterium bovis subsp bovis AF2122/97
gaccgacgccgguguc

SEQ ID NO: 3061038 - RNA, 23 nt, Mycobacterium bovis subsp bovis AF2122/97
gaccgacgggucguaggacacca

SEQ ID NO: 3061039 - RNA, 14 nt, Mycobacterium bovis subsp bovis AF2122/97
gaccgacgucgccc

SEQ ID NO: 3061040 - RNA, 17 nt, Mycobacterium bovis subsp bovis AF2122/97
gaccgagacggcgucgg

SEQ ID NO: 3061041 - RNA, 14 nt, Mycobacterium bovis subsp bovis AF2122/97
gaccgagacuugcu

SEQ ID NO: 3061042 - RNA, 20 nt, Mycobacterium bovis subsp bovis AF2122/97
gaccgagaucgucgcgaccu

SEQ ID NO: 3061043 - RNA, 18 nt, Mycobacterium bovis subsp bovis AF2122/97
gaccgaggcacgucgaaa

SEQ ID NO: 3061044 - RNA, 15 nt, Mycobacterium bovis subsp bovis AF2122/97
gaccgauaacacccg

SEQ ID NO: 3061045 - RNA, 22 nt, Mycobacterium bovis subsp bovis AF2122/97
gaccgauaacacccgggccauc

SEQ ID NO: 3061046 - RNA, 17 nt, Mycobacterium bovis subsp bovis AF2122/97
gaccgauaaguucggcu

SEQ ID NO: 3061047 - RNA, 18 nt, Mycobacterium bovis subsp bovis AF2122/97
gaccgauaaguucggcug

SEQ ID NO: 3061048 - RNA, 18 nt, Mycobacterium bovis subsp bovis AF2122/97
gaccgaucggcaggccgc

SEQ ID NO: 3061049 - RNA, 13 nt, Mycobacterium bovis subsp bovis AF2122/97
gaccgaucggcgc

SEQ ID NO: 3061050 - RNA, 18 nt, Mycobacterium bovis subsp bovis AF2122/97
gaccgaucuuggccaccg

SEQ ID NO: 3061051 - RNA, 14 nt, Mycobacterium bovis subsp bovis AF2122/97
gaccgaugacgauc

SEQ ID NO: 3061052 - RNA, 17 nt, Mycobacterium bovis subsp bovis AF2122/97
gaccgaugacgaucggc

SEQ ID NO: 3061053 - RNA, 21 nt, Mycobacterium bovis subsp bovis AF2122/97
gaccgaugacgaucggcggcg

SEQ ID NO: 3061054 - RNA, 18 nt, Mycobacterium bovis subsp bovis AF2122/97
gaccgauugucggcaacg

SEQ ID NO: 3061055 - RNA, 19 nt, Mycobacterium bovis subsp bovis AF2122/97
gaccgauugucggcaacga

SEQ ID NO: 3061056 - RNA, 18 nt, Mycobacterium bovis subsp bovis AF2122/97
gaccgcaacgacggccgu

SEQ ID NO: 3061057 - RNA, 13 nt, Mycobacterium bovis subsp bovis AF2122/97
gaccgcaccgacc

SEQ ID NO: 3061058 - RNA, 18 nt, Mycobacterium bovis subsp bovis AF2122/97
gaccgcaccgaccugagu

SEQ ID NO: 3061059 - RNA, 13 nt, Mycobacterium bovis subsp bovis AF2122/97
gaccgcaccgugc

SEQ ID NO: 3061060 - RNA, 17 nt, Mycobacterium bovis subsp bovis AF2122/97
gaccgcaccgugccgac

SEQ ID NO: 3061061 - RNA, 15 nt, Mycobacterium bovis subsp bovis AF2122/97
gaccgcacgaccagc

SEQ ID NO: 3061062 - RNA, 17 nt, Mycobacterium bovis subsp bovis AF2122/97
gaccgcagucgcugggu

SEQ ID NO: 3061063 - RNA, 21 nt, Mycobacterium bovis subsp bovis AF2122/97
gaccgcauccggucucggccg

SEQ ID NO: 3061064 - RNA, 22 nt, Mycobacterium bovis subsp bovis AF2122/97
gaccgcaucgguggggcgccgg

SEQ ID NO: 3061065 - RNA, 19 nt, Mycobacterium bovis subsp bovis AF2122/97
gaccgcaucgucgagccac

SEQ ID NO: 3061066 - RNA, 16 nt, Mycobacterium bovis subsp bovis AF2122/97
gaccgcaugaucgcac

SEQ ID NO: 3061067 - RNA, 16 nt, Mycobacterium bovis subsp bovis AF2122/97
gaccgccacacggggc

SEQ ID NO: 3061068 - RNA, 21 nt, Mycobacterium bovis subsp bovis AF2122/97
gaccgccacacggggccgcca

SEQ ID NO: 3061069 - RNA, 22 nt, Mycobacterium bovis subsp bovis AF2122/97
gaccgccacacggggccgccag

SEQ ID NO: 3061070 - RNA, 11 nt, Mycobacterium bovis subsp bovis AF2122/97
gaccgccaccc

SEQ ID NO: 3061071 - RNA, 12 nt, Mycobacterium bovis subsp bovis AF2122/97
gaccgccacccc

SEQ ID NO: 3061072 - RNA, 13 nt, Mycobacterium bovis subsp bovis AF2122/97
gaccgccacccca

SEQ ID NO: 3061073 - RNA, 13 nt, Mycobacterium bovis subsp bovis AF2122/97
gaccgccaccccg

SEQ ID NO: 3061074 - RNA, 19 nt, Mycobacterium bovis subsp bovis AF2122/97
gaccgccaccccugucggg

SEQ ID NO: 3061075 - RNA, 13 nt, Mycobacterium bovis subsp bovis AF2122/97
gaccgccaccgcc

SEQ ID NO: 3061076 - RNA, 20 nt, Mycobacterium bovis subsp bovis AF2122/97
gaccgccaccgccagcgucg

SEQ ID NO: 3061077 - RNA, 21 nt, Mycobacterium bovis subsp bovis AF2122/97
gaccgccaccgccagcgucga

SEQ ID NO: 3061078 - RNA, 22 nt, Mycobacterium bovis subsp bovis AF2122/97
gaccgccaccgucauggcgggu

SEQ ID NO: 3061079 - RNA, 17 nt, Mycobacterium bovis subsp bovis AF2122/97
gaccgccagcagcaggc

SEQ ID NO: 3061080 - RNA, 14 nt, Mycobacterium bovis subsp bovis AF2122/97
gaccgccagcccgg

SEQ ID NO: 3061081 - RNA, 14 nt, Mycobacterium bovis subsp bovis AF2122/97
gaccgccagccgcg

SEQ ID NO: 3061082 - RNA, 17 nt, Mycobacterium bovis subsp bovis AF2122/97
gaccgccagccgcgagc

SEQ ID NO: 3061083 - RNA, 19 nt, Mycobacterium bovis subsp bovis AF2122/97
gaccgccagccgcgagccg

SEQ ID NO: 3061084 - RNA, 18 nt, Mycobacterium bovis subsp bovis AF2122/97
gaccgccagcggccgcuc

SEQ ID NO: 3061085 - RNA, 22 nt, Mycobacterium bovis subsp bovis AF2122/97
gaccgccauccuucggggugaa

SEQ ID NO: 3061086 - RNA, 14 nt, Mycobacterium bovis subsp bovis AF2122/97
gaccgccaucgcca

SEQ ID NO: 3061087 - RNA, 17 nt, Mycobacterium bovis subsp bovis AF2122/97
gaccgccaucgccaaca

SEQ ID NO: 3061088 - RNA, 23 nt, Mycobacterium bovis subsp bovis AF2122/97
gaccgccaucgccaacaccaacc

SEQ ID NO: 3061089 - RNA, 17 nt, Mycobacterium bovis subsp bovis AF2122/97
gaccgccauuucgcccg

SEQ ID NO: 3061090 - RNA, 18 nt, Mycobacterium bovis subsp bovis AF2122/97
gaccgccauuucgcccga

SEQ ID NO: 3061091 - RNA, 19 nt, Mycobacterium bovis subsp bovis AF2122/97
gaccgcccgagucucgucg

SEQ ID NO: 3061092 - RNA, 14 nt, Mycobacterium bovis subsp bovis AF2122/97
gaccgcccgccagc

SEQ ID NO: 3061093 - RNA, 16 nt, Mycobacterium bovis subsp bovis AF2122/97
gaccgcccgccagcga

SEQ ID NO: 3061094 - RNA, 14 nt, Mycobacterium bovis subsp bovis AF2122/97
gaccgcccgugccg

SEQ ID NO: 3061095 - RNA, 20 nt, Mycobacterium bovis subsp bovis AF2122/97
gaccgcccgugccgucgccc

SEQ ID NO: 3061096 - RNA, 21 nt, Mycobacterium bovis subsp bovis AF2122/97
gaccgcccuagcgagcggcac

SEQ ID NO: 3061097 - RNA, 18 nt, Mycobacterium bovis subsp bovis AF2122/97
gaccgccgaagaagguga

SEQ ID NO: 3061098 - RNA, 14 nt, Mycobacterium bovis subsp bovis AF2122/97
gaccgccgacgccg

SEQ ID NO: 3061099 - RNA, 15 nt, Mycobacterium bovis subsp bovis AF2122/97
gaccgccgacgccgu

SEQ ID NO: 3061100 - RNA, 16 nt, Mycobacterium bovis subsp bovis AF2122/97
gaccgccgacgccguu

SEQ ID NO: 3061101 - RNA, 17 nt, Mycobacterium bovis subsp bovis AF2122/97
gaccgccgacgccguug

SEQ ID NO: 3061102 - RNA, 14 nt, Mycobacterium bovis subsp bovis AF2122/97
gaccgccgaugccc

SEQ ID NO: 3061103 - RNA, 14 nt, Mycobacterium bovis subsp bovis AF2122/97
gaccgccgcgagca

SEQ ID NO: 3061104 - RNA, 16 nt, Mycobacterium bovis subsp bovis AF2122/97
gaccgccgcgagcaga

SEQ ID NO: 3061105 - RNA, 21 nt, Mycobacterium bovis subsp bovis AF2122/97
gaccgccgcgagcagaaacaa

SEQ ID NO: 3061106 - RNA, 18 nt, Mycobacterium bovis subsp bovis AF2122/97
gaccgccgcgccggcacg

SEQ ID NO: 3061107 - RNA, 21 nt, Mycobacterium bovis subsp bovis AF2122/97
gaccgccgcuaccccagccgg

SEQ ID NO: 3061108 - RNA, 18 nt, Mycobacterium bovis subsp bovis AF2122/97
gaccgccgcugccgccga

SEQ ID NO: 3061109 - RNA, 14 nt, Mycobacterium bovis subsp bovis AF2122/97
gaccgccgcugggu

SEQ ID NO: 3061110 - RNA, 13 nt, Mycobacterium bovis subsp bovis AF2122/97
gaccgccggaccg

SEQ ID NO: 3061111 - RNA, 18 nt, Mycobacterium bovis subsp bovis AF2122/97
gaccgccggaccgccgca

SEQ ID NO: 3061112 - RNA, 21 nt, Mycobacterium bovis subsp bovis AF2122/97
gaccgccgggauaucgucgac

SEQ ID NO: 3061113 - RNA, 23 nt, Mycobacterium bovis subsp bovis AF2122/97
gaccgccgggauaucgucgacgc

SEQ ID NO: 3061114 - RNA, 22 nt, Mycobacterium bovis subsp bovis AF2122/97
gaccgccuccaccgccgcgcgg

SEQ ID NO: 3061115 - RNA, 14 nt, Mycobacterium bovis subsp bovis AF2122/97
gaccgccuccucga

SEQ ID NO: 3061116 - RNA, 22 nt, Mycobacterium bovis subsp bovis AF2122/97
gaccgccuccucgauagcggcg

SEQ ID NO: 3061117 - RNA, 23 nt, Mycobacterium bovis subsp bovis AF2122/97
gaccgccuccucgauagcggcgc

SEQ ID NO: 3061118 - RNA, 13 nt, Mycobacterium bovis subsp bovis AF2122/97
gaccgccucgccg

SEQ ID NO: 3061119 - RNA, 13 nt, Mycobacterium bovis subsp bovis AF2122/97
gaccgccucgucg

SEQ ID NO: 3061120 - RNA, 17 nt, Mycobacterium bovis subsp bovis AF2122/97
gaccgccugcgcggcug

SEQ ID NO: 3061121 - RNA, 19 nt, Mycobacterium bovis subsp bovis AF2122/97
gaccgccugcuggccgcgg

SEQ ID NO: 3061122 - RNA, 17 nt, Mycobacterium bovis subsp bovis AF2122/97
gaccggaucugacggcg

SEQ ID NO: 3061123 - RNA, 18 nt, Mycobacterium bovis subsp bovis AF2122/97
gaccggaucugacggcgc

SEQ ID NO: 3061124 - RNA, 18 nt, Mycobacterium bovis subsp bovis AF2122/97
gaccggcaacgcggccuu

SEQ ID NO: 3061125 - RNA, 14 nt, Mycobacterium bovis subsp bovis AF2122/97
gaccggcaauuccg

SEQ ID NO: 3061126 - RNA, 20 nt, Mycobacterium bovis subsp bovis AF2122/97
gaccggcaauuccguuaggc

SEQ ID NO: 3061127 - RNA, 22 nt, Mycobacterium bovis subsp bovis AF2122/97
gaccggcaauuuucugcugcug

SEQ ID NO: 3061128 - RNA, 23 nt, Mycobacterium bovis subsp bovis AF2122/97
gaccggcaauuuucugcugcuga

SEQ ID NO: 3061129 - RNA, 20 nt, Mycobacterium bovis subsp bovis AF2122/97
gaccggcaggccggcgucga

SEQ ID NO: 3061130 - RNA, 22 nt, Mycobacterium bovis subsp bovis AF2122/97
gaccggcaggccggcgucgauc

SEQ ID NO: 3061131 - RNA, 14 nt, Mycobacterium bovis subsp bovis AF2122/97
gaccggcaucgauc

SEQ ID NO: 3061132 - RNA, 13 nt, Mycobacterium bovis subsp bovis AF2122/97
gaccggccacgac

SEQ ID NO: 3061133 - RNA, 14 nt, Mycobacterium bovis subsp bovis AF2122/97
gaccggccacgacc

SEQ ID NO: 3061134 - RNA, 18 nt, Mycobacterium bovis subsp bovis AF2122/97
gaccggccacgaccucgg

SEQ ID NO: 3061135 - RNA, 15 nt, Mycobacterium bovis subsp bovis AF2122/97
gaccggccaguccgg

SEQ ID NO: 3061136 - RNA, 22 nt, Mycobacterium bovis subsp bovis AF2122/97
gaccggcccccggucgagcucg

SEQ ID NO: 3061137 - RNA, 13 nt, Mycobacterium bovis subsp bovis AF2122/97
gaccggccgacgu

SEQ ID NO: 3061138 - RNA, 15 nt, Mycobacterium bovis subsp bovis AF2122/97
gaccggccgacguga

SEQ ID NO: 3061139 - RNA, 16 nt, Mycobacterium bovis subsp bovis AF2122/97
gaccggccggccgcgg

SEQ ID NO: 3061140 - RNA, 13 nt, Mycobacterium bovis subsp bovis AF2122/97
gaccggccugcga

SEQ ID NO: 3061141 - RNA, 18 nt, Mycobacterium bovis subsp bovis AF2122/97
gaccggccugcgacgagc

SEQ ID NO: 3061142 - RNA, 18 nt, Mycobacterium bovis subsp bovis AF2122/97
gaccggccuggcucgucc

SEQ ID NO: 3061143 - RNA, 18 nt, Mycobacterium bovis subsp bovis AF2122/97
gaccggcgaccggcgagc

SEQ ID NO: 3061144 - RNA, 16 nt, Mycobacterium bovis subsp bovis AF2122/97
gaccggcgccguagcc

SEQ ID NO: 3061145 - RNA, 20 nt, Mycobacterium bovis subsp bovis AF2122/97
gaccggcgccguagccgauc

SEQ ID NO: 3061146 - RNA, 21 nt, Mycobacterium bovis subsp bovis AF2122/97
gaccggcggcuacggcugccc

SEQ ID NO: 3061147 - RNA, 14 nt, Mycobacterium bovis subsp bovis AF2122/97
gaccggcgggaccg

SEQ ID NO: 3061148 - RNA, 17 nt, Mycobacterium bovis subsp bovis AF2122/97
gaccggcgggaugcgcg

SEQ ID NO: 3061149 - RNA, 22 nt, Mycobacterium bovis subsp bovis AF2122/97
gaccggcgggaugcgcgcccga

SEQ ID NO: 3061150 - RNA, 17 nt, Mycobacterium bovis subsp bovis AF2122/97
gaccggcguaaccggca

SEQ ID NO: 3061151 - RNA, 19 nt, Mycobacterium bovis subsp bovis AF2122/97
gaccggcguaaccggcagc

SEQ ID NO: 3061152 - RNA, 19 nt, Mycobacterium bovis subsp bovis AF2122/97
gaccggcuaccggcguguc

SEQ ID NO: 3061153 - RNA, 16 nt, Mycobacterium bovis subsp bovis AF2122/97
gaccggcucgaucucg

SEQ ID NO: 3061154 - RNA, 17 nt, Mycobacterium bovis subsp bovis AF2122/97
gaccggcucgccggcgc

SEQ ID NO: 3061155 - RNA, 17 nt, Mycobacterium bovis subsp bovis AF2122/97
gaccggcucggcggugc

SEQ ID NO: 3061156 - RNA, 15 nt, Mycobacterium bovis subsp bovis AF2122/97
gaccggcucgucggg

SEQ ID NO: 3061157 - RNA, 17 nt, Mycobacterium bovis subsp bovis AF2122/97
gaccggcuuccccagca

SEQ ID NO: 3061158 - RNA, 19 nt, Mycobacterium bovis subsp bovis AF2122/97
gaccggcuuccccagcagu

SEQ ID NO: 3061159 - RNA, 21 nt, Mycobacterium bovis subsp bovis AF2122/97
gaccggcuugcccuccgggua

SEQ ID NO: 3061160 - RNA, 20 nt, Mycobacterium bovis subsp bovis AF2122/97
gaccgggaucggcuccgccg

SEQ ID NO: 3061161 - RNA, 12 nt, Mycobacterium bovis subsp bovis AF2122/97
gaccgggcccgg

SEQ ID NO: 3061162 - RNA, 17 nt, Mycobacterium bovis subsp bovis AF2122/97
gaccgggcccggcgaac

SEQ ID NO: 3061163 - RNA, 16 nt, Mycobacterium bovis subsp bovis AF2122/97
gaccgggcucuggcca

SEQ ID NO: 3061164 - RNA, 17 nt, Mycobacterium bovis subsp bovis AF2122/97
gaccgggcucuggccag

SEQ ID NO: 3061165 - RNA, 17 nt, Mycobacterium bovis subsp bovis AF2122/97
gaccgggcuggccagcg

SEQ ID NO: 3061166 - RNA, 19 nt, Mycobacterium bovis subsp bovis AF2122/97
gaccgggcuggccagcgcg

SEQ ID NO: 3061167 - RNA, 13 nt, Mycobacterium bovis subsp bovis AF2122/97
gaccggggacagc

SEQ ID NO: 3061168 - RNA, 17 nt, Mycobacterium bovis subsp bovis AF2122/97
gaccggggaucggggca

SEQ ID NO: 3061169 - RNA, 18 nt, Mycobacterium bovis subsp bovis AF2122/97
gaccggggaucggggcac

SEQ ID NO: 3061170 - RNA, 14 nt, Mycobacterium bovis subsp bovis AF2122/97
gaccggggcgcccg

SEQ ID NO: 3061171 - RNA, 15 nt, Mycobacterium bovis subsp bovis AF2122/97
gaccggggcgcccgg

SEQ ID NO: 3061172 - RNA, 16 nt, Mycobacterium bovis subsp bovis AF2122/97
gaccggggcuuggguu

SEQ ID NO: 3061173 - RNA, 18 nt, Mycobacterium bovis subsp bovis AF2122/97
gaccggggucggccugcg

SEQ ID NO: 3061174 - RNA, 21 nt, Mycobacterium bovis subsp bovis AF2122/97
gaccggggucggccugcggca

SEQ ID NO: 3061175 - RNA, 16 nt, Mycobacterium bovis subsp bovis AF2122/97
gaccgggucgaucacc

SEQ ID NO: 3061176 - RNA, 19 nt, Mycobacterium bovis subsp bovis AF2122/97
gaccgggucgaucaccgac

SEQ ID NO: 3061177 - RNA, 20 nt, Mycobacterium bovis subsp bovis AF2122/97
gaccgggucgaucaccgaca

SEQ ID NO: 3061178 - RNA, 15 nt, Mycobacterium bovis subsp bovis AF2122/97
gaccgggucgccgau

SEQ ID NO: 3061179 - RNA, 16 nt, Mycobacterium bovis subsp bovis AF2122/97
gaccgggucgccgaug

SEQ ID NO: 3061180 - RNA, 17 nt, Mycobacterium bovis subsp bovis AF2122/97
gaccgggucgccgauga

SEQ ID NO: 3061181 - RNA, 23 nt, Mycobacterium bovis subsp bovis AF2122/97
gaccgggucgucauacagcgccc

SEQ ID NO: 3061182 - RNA, 22 nt, Mycobacterium bovis subsp bovis AF2122/97
gaccgguaauccguugccguug

SEQ ID NO: 3061183 - RNA, 20 nt, Mycobacterium bovis subsp bovis AF2122/97
gaccggucggugaugguuuc

SEQ ID NO: 3061184 - RNA, 18 nt, Mycobacterium bovis subsp bovis AF2122/97
gaccggucuggcgaugac

SEQ ID NO: 3061185 - RNA, 15 nt, Mycobacterium bovis subsp bovis AF2122/97
gaccggugccagcag

SEQ ID NO: 3061186 - RNA, 15 nt, Mycobacterium bovis subsp bovis AF2122/97
gaccggugcugucga

SEQ ID NO: 3061187 - RNA, 14 nt, Mycobacterium bovis subsp bovis AF2122/97
gaccgguggcaccg

SEQ ID NO: 3061188 - RNA, 19 nt, Mycobacterium bovis subsp bovis AF2122/97
gaccgguggcaccggcggc

SEQ ID NO: 3061189 - RNA, 20 nt, Mycobacterium bovis subsp bovis AF2122/97
gaccgguggcaccggcggcg

SEQ ID NO: 3061190 - RNA, 21 nt, Mycobacterium bovis subsp bovis AF2122/97
gaccgguggccaucgcgcgga

SEQ ID NO: 3061191 - RNA, 19 nt, Mycobacterium bovis subsp bovis AF2122/97
gaccgguguuccgcccagc

SEQ ID NO: 3061192 - RNA, 21 nt, Mycobacterium bovis subsp bovis AF2122/97
gaccgguuucuucggccagcu

SEQ ID NO: 3061193 - RNA, 16 nt, Mycobacterium bovis subsp bovis AF2122/97
gaccguaccgauccag

SEQ ID NO: 3061194 - RNA, 17 nt, Mycobacterium bovis subsp bovis AF2122/97
gaccguauagccgacgc

SEQ ID NO: 3061195 - RNA, 16 nt, Mycobacterium bovis subsp bovis AF2122/97
gaccguauuucgucca

SEQ ID NO: 3061196 - RNA, 23 nt, Mycobacterium bovis subsp bovis AF2122/97
gaccgucacaagucgacacgccg

SEQ ID NO: 3061197 - RNA, 19 nt, Mycobacterium bovis subsp bovis AF2122/97
gaccgucacgcguacgucg

SEQ ID NO: 3061198 - RNA, 16 nt, Mycobacterium bovis subsp bovis AF2122/97
gaccguccaccgacgu

SEQ ID NO: 3061199 - RNA, 17 nt, Mycobacterium bovis subsp bovis AF2122/97
gaccguccagcaacagc

SEQ ID NO: 3061200 - RNA, 14 nt, Mycobacterium bovis subsp bovis AF2122/97
gaccguccgacggc

SEQ ID NO: 3061201 - RNA, 17 nt, Mycobacterium bovis subsp bovis AF2122/97
gaccguccgacggcgga

SEQ ID NO: 3061202 - RNA, 13 nt, Mycobacterium bovis subsp bovis AF2122/97
gaccguccggguc

SEQ ID NO: 3061203 - RNA, 23 nt, Mycobacterium bovis subsp bovis AF2122/97
gaccgucgauccgucggcggaga

SEQ ID NO: 3061204 - RNA, 12 nt, Mycobacterium bovis subsp bovis AF2122/97
gaccgucgcacc

SEQ ID NO: 3061205 - RNA, 17 nt, Mycobacterium bovis subsp bovis AF2122/97
gaccgucgcgcugccgg

SEQ ID NO: 3061206 - RNA, 21 nt, Mycobacterium bovis subsp bovis AF2122/97
gaccgucgcgcugccggccgc

SEQ ID NO: 3061207 - RNA, 14 nt, Mycobacterium bovis subsp bovis AF2122/97
gaccgucgggguca

SEQ ID NO: 3061208 - RNA, 19 nt, Mycobacterium bovis subsp bovis AF2122/97
gaccugcgcgagguuggcg

SEQ ID NO: 3061209 - RNA, 14 nt, Mycobacterium bovis subsp bovis AF2122/97
gaccugcucgcugg

SEQ ID NO: 3061210 - RNA, 16 nt, Mycobacterium bovis subsp bovis AF2122/97
gaccugcucgcuggug

SEQ ID NO: 3061211 - RNA, 20 nt, Mycobacterium bovis subsp bovis AF2122/97
gaccuggaacugcauggugg

SEQ ID NO: 3061212 - RNA, 19 nt, Mycobacterium bovis subsp bovis AF2122/97
gaccuggacaaccucgucg

SEQ ID NO: 3061213 - RNA, 19 nt, Mycobacterium bovis subsp bovis AF2122/97
gaccuggaugggcucgacg

SEQ ID NO: 3061214 - RNA, 14 nt, Mycobacterium bovis subsp bovis AF2122/97
gaccuggccgcccg

SEQ ID NO: 3061215 - RNA, 20 nt, Mycobacterium bovis subsp bovis AF2122/97
gaccuggccgcccgcugcgg

SEQ ID NO: 3061216 - RNA, 21 nt, Mycobacterium bovis subsp bovis AF2122/97
gaccuggccgcccgcugcggc

SEQ ID NO: 3061217 - RNA, 22 nt, Mycobacterium bovis subsp bovis AF2122/97
gaccuggccgcccgcugcggcg

SEQ ID NO: 3061218 - RNA, 15 nt, Mycobacterium bovis subsp bovis AF2122/97
gaccuggccgucgcu

SEQ ID NO: 3061219 - RNA, 15 nt, Mycobacterium bovis subsp bovis AF2122/97
gaccuggcggcggua

SEQ ID NO: 3061220 - RNA, 19 nt, Mycobacterium bovis subsp bovis AF2122/97
gaccuggcggugccggcgg

SEQ ID NO: 3061221 - RNA, 24 nt, Mycobacterium bovis subsp bovis AF2122/97
gaccuggcggugccggcggcgcau

SEQ ID NO: 3061222 - RNA, 18 nt, Mycobacterium bovis subsp bovis AF2122/97
gaccugggacaguucgcg

SEQ ID NO: 3061223 - RNA, 17 nt, Mycobacterium bovis subsp bovis AF2122/97
gaccuggguggcgucgc

SEQ ID NO: 3061224 - RNA, 16 nt, Mycobacterium bovis subsp bovis AF2122/97
gaccuggucgcuggug

SEQ ID NO: 3061225 - RNA, 21 nt, Mycobacterium bovis subsp bovis AF2122/97
gaccugguuauucgacucggc

SEQ ID NO: 3061226 - RNA, 20 nt, Mycobacterium bovis subsp bovis AF2122/97
gaccugguucccgacgucgg

SEQ ID NO: 3061227 - RNA, 21 nt, Mycobacterium bovis subsp bovis AF2122/97
gaccugguucccgacgucggc

SEQ ID NO: 3061228 - RNA, 23 nt, Mycobacterium bovis subsp bovis AF2122/97
gaccuguagaucagcagcggcga

SEQ ID NO: 3061229 - RNA, 16 nt, Mycobacterium bovis subsp bovis AF2122/97
gaccuguccggugauc

SEQ ID NO: 3061230 - RNA, 12 nt, Mycobacterium bovis subsp bovis AF2122/97
gaccugucggua

SEQ ID NO: 3061231 - RNA, 15 nt, Mycobacterium bovis subsp bovis AF2122/97
gaccugucgguaccg

SEQ ID NO: 3061232 - RNA, 18 nt, Mycobacterium bovis subsp bovis AF2122/97
gaccugugcggccgacgg

SEQ ID NO: 3061233 - RNA, 20 nt, Mycobacterium bovis subsp bovis AF2122/97
gaccuguuuggggcugugca

SEQ ID NO: 3061234 - RNA, 23 nt, Mycobacterium bovis subsp bovis AF2122/97
gaccuguuuggggcugugcaggc

SEQ ID NO: 3061235 - RNA, 14 nt, Mycobacterium bovis subsp bovis AF2122/97
gaccuucaccugga

SEQ ID NO: 3061236 - RNA, 15 nt, Mycobacterium bovis subsp bovis AF2122/97
gaccuucgagccgca

SEQ ID NO: 3061237 - RNA, 22 nt, Mycobacterium bovis subsp bovis AF2122/97
gaccuucgagccgcacaaacgg

SEQ ID NO: 3061238 - RNA, 22 nt, Mycobacterium bovis subsp bovis AF2122/97
gaccuucgcuauggcggcuucg

SEQ ID NO: 3061239 - RNA, 23 nt, Mycobacterium bovis subsp bovis AF2122/97
gaccuucgcuauggcggcuucga

SEQ ID NO: 3061240 - RNA, 13 nt, Mycobacterium bovis subsp bovis AF2122/97
gaccuucggcccg

SEQ ID NO: 3061241 - RNA, 22 nt, Mycobacterium bovis subsp bovis AF2122/97
gaccuucucgaugcugacgaac

SEQ ID NO: 3061242 - RNA, 22 nt, Mycobacterium bovis subsp bovis AF2122/97
gaccuucucgccgccgcuguug

SEQ ID NO: 3061243 - RNA, 15 nt, Mycobacterium bovis subsp bovis AF2122/97
gaccuucucgucggc

SEQ ID NO: 3061244 - RNA, 23 nt, Mycobacterium bovis subsp bovis AF2122/97
gaccuucuugacacccaccucgc

SEQ ID NO: 3061245 - RNA, 15 nt, Mycobacterium bovis subsp bovis AF2122/97
gaccuugcaccggcc

SEQ ID NO: 3061246 - RNA, 16 nt, Mycobacterium bovis subsp bovis AF2122/97
gaccuugcaccggccg

SEQ ID NO: 3061247 - RNA, 14 nt, Mycobacterium bovis subsp bovis AF2122/97
gaccuugccggugg

SEQ ID NO: 3061248 - RNA, 15 nt, Mycobacterium bovis subsp bovis AF2122/97
gaccuuggccgugcc

SEQ ID NO: 3061249 - RNA, 14 nt, Mycobacterium bovis subsp bovis AF2122/97
gaccuuggcgucga

SEQ ID NO: 3061250 - RNA, 17 nt, Mycobacterium bovis subsp bovis AF2122/97
gaccuuggugcccagca

SEQ ID NO: 3061251 - RNA, 21 nt, Mycobacterium bovis subsp bovis AF2122/97
gaccuugguguggggcggcuu

SEQ ID NO: 3061252 - RNA, 18 nt, Mycobacterium bovis subsp bovis AF2122/97
gaccuuguugaccaccac

SEQ ID NO: 3061253 - RNA, 23 nt, Mycobacterium bovis subsp bovis AF2122/97
gaccuuguuggccauguccacca

SEQ ID NO: 3061254 - RNA, 15 nt, Mycobacterium bovis subsp bovis AF2122/97
gaccuuuucccgcag

SEQ ID NO: 3061255 - RNA, 21 nt, Mycobacterium bovis subsp bovis AF2122/97
gaccuuuugcggcaagcgcac

SEQ ID NO: 3061256 - RNA, 17 nt, Mycobacterium bovis subsp bovis AF2122/97
gacgaaaaaaucgugcg

SEQ ID NO: 3061257 - RNA, 18 nt, Mycobacterium bovis subsp bovis AF2122/97
gacgaaaaaaucgugcgg

SEQ ID NO: 3061258 - RNA, 17 nt, Mycobacterium bovis subsp bovis AF2122/97
gacgaaacggccgggca

SEQ ID NO: 3061259 - RNA, 12 nt, Mycobacterium bovis subsp bovis AF2122/97
gacgaaaggcuc

SEQ ID NO: 3061260 - RNA, 18 nt, Mycobacterium bovis subsp bovis AF2122/97
gacgaaagguugccgauc

SEQ ID NO: 3061261 - RNA, 19 nt, Mycobacterium bovis subsp bovis AF2122/97
gacgaaauccgccgggcgc

SEQ ID NO: 3061262 - RNA, 20 nt, Mycobacterium bovis subsp bovis AF2122/97
gacgaaauccgccgggcgcc

SEQ ID NO: 3061263 - RNA, 15 nt, Mycobacterium bovis subsp bovis AF2122/97
gacgaaaucggcggc

SEQ ID NO: 3061264 - RNA, 20 nt, Mycobacterium bovis subsp bovis AF2122/97
gacgaacaacgcgacgaagc

SEQ ID NO: 3061265 - RNA, 15 nt, Mycobacterium bovis subsp bovis AF2122/97
gacgaacacaccggu

SEQ ID NO: 3061266 - RNA, 17 nt, Mycobacterium bovis subsp bovis AF2122/97
gacgaacaccagcgcgc

SEQ ID NO: 3061267 - RNA, 13 nt, Mycobacterium bovis subsp bovis AF2122/97
gacgaacccgaca

SEQ ID NO: 3061268 - RNA, 22 nt, Mycobacterium bovis subsp bovis AF2122/97
gacgaacccgacaauggcgcca

SEQ ID NO: 3061269 - RNA, 20 nt, Mycobacterium bovis subsp bovis AF2122/97
gacgaaccggaucaucgccg

SEQ ID NO: 3061270 - RNA, 20 nt, Mycobacterium bovis subsp bovis AF2122/97
gacgaacgaaccgccgccgc

SEQ ID NO: 3061271 - RNA, 13 nt, Mycobacterium bovis subsp bovis AF2122/97
gacgaacgacggg

SEQ ID NO: 3061272 - RNA, 14 nt, Mycobacterium bovis subsp bovis AF2122/97
gacgaacgccgucg

SEQ ID NO: 3061273 - RNA, 15 nt, Mycobacterium bovis subsp bovis AF2122/97
gacgaacgccgucga

SEQ ID NO: 3061274 - RNA, 21 nt, Mycobacterium bovis subsp bovis AF2122/97
gacgaacgccgucgacgcggc

SEQ ID NO: 3061275 - RNA, 22 nt, Mycobacterium bovis subsp bovis AF2122/97
gacgaacgccucaccgacgucg

SEQ ID NO: 3061276 - RNA, 13 nt, Mycobacterium bovis subsp bovis AF2122/97
gacgaacgcgccg

SEQ ID NO: 3061277 - RNA, 15 nt, Mycobacterium bovis subsp bovis AF2122/97
gacgaacgcugucgu

SEQ ID NO: 3061278 - RNA, 20 nt, Mycobacterium bovis subsp bovis AF2122/97
gacgaacuagguucagcgac

SEQ ID NO: 3061279 - RNA, 23 nt, Mycobacterium bovis subsp bovis AF2122/97
gacgaacugcugaugaaacgccg

SEQ ID NO: 3061280 - RNA, 14 nt, Mycobacterium bovis subsp bovis AF2122/97
gacgaagaagaacu

SEQ ID NO: 3061281 - RNA, 17 nt, Mycobacterium bovis subsp bovis AF2122/97
gacgaagagcaccgcgc

SEQ ID NO: 3061282 - RNA, 21 nt, Mycobacterium bovis subsp bovis AF2122/97
gacgaagaucuucaccggccg

SEQ ID NO: 3061283 - RNA, 20 nt, Mycobacterium bovis subsp bovis AF2122/97
gacgaaggucuccggcaagc

SEQ ID NO: 3061284 - RNA, 21 nt, Mycobacterium bovis subsp bovis AF2122/97
gacgaaguagccgaccauggu

SEQ ID NO: 3061285 - RNA, 15 nt, Mycobacterium bovis subsp bovis AF2122/97
gacgaaguucuccag

SEQ ID NO: 3061286 - RNA, 22 nt, Mycobacterium bovis subsp bovis AF2122/97
gacgaauccacuggucaacggg

SEQ ID NO: 3061287 - RNA, 18 nt, Mycobacterium bovis subsp bovis AF2122/97
gacgaaucccgcgcccgg

SEQ ID NO: 3061288 - RNA, 17 nt, Mycobacterium bovis subsp bovis AF2122/97
gacgaaucgccuaccgg

SEQ ID NO: 3061289 - RNA, 13 nt, Mycobacterium bovis subsp bovis AF2122/97
gacgaaugcagca

SEQ ID NO: 3061290 - RNA, 16 nt, Mycobacterium bovis subsp bovis AF2122/97
gacgacaaacggcgac

SEQ ID NO: 3061291 - RNA, 16 nt, Mycobacterium bovis subsp bovis AF2122/97
gacgacaacagccagc

SEQ ID NO: 3061292 - RNA, 14 nt, Mycobacterium bovis subsp bovis AF2122/97
gacgacaacaggcc

SEQ ID NO: 3061293 - RNA, 16 nt, Mycobacterium bovis subsp bovis AF2122/97
gacgacaacaggccgu

SEQ ID NO: 3061294 - RNA, 20 nt, Mycobacterium bovis subsp bovis AF2122/97
gacgauccagcccaacucgg

SEQ ID NO: 3061295 - RNA, 15 nt, Mycobacterium bovis subsp bovis AF2122/97
gacgauccggucggc

SEQ ID NO: 3061296 - RNA, 19 nt, Mycobacterium bovis subsp bovis AF2122/97
gacgauccggucggcgggc

SEQ ID NO: 3061297 - RNA, 15 nt, Mycobacterium bovis subsp bovis AF2122/97
gacgaucgccaggcc

SEQ ID NO: 3061298 - RNA, 22 nt, Mycobacterium bovis subsp bovis AF2122/97
gacgaucgccaggccgagcccg

SEQ ID NO: 3061299 - RNA, 15 nt, Mycobacterium bovis subsp bovis AF2122/97
gacgaucgcggcggg

SEQ ID NO: 3061300 - RNA, 16 nt, Mycobacterium bovis subsp bovis AF2122/97
gacgaucgcggcgggc

SEQ ID NO: 3061301 - RNA, 19 nt, Mycobacterium bovis subsp bovis AF2122/97
gacgaucgcgucgggcucg

SEQ ID NO: 3061302 - RNA, 21 nt, Mycobacterium bovis subsp bovis AF2122/97
gacgaucggcggcgcgccgau

SEQ ID NO: 3061303 - RNA, 16 nt, Mycobacterium bovis subsp bovis AF2122/97
gacgaucucgccgcca

SEQ ID NO: 3061304 - RNA, 17 nt, Mycobacterium bovis subsp bovis AF2122/97
gacgaucucgccgccag

SEQ ID NO: 3061305 - RNA, 18 nt, Mycobacterium bovis subsp bovis AF2122/97
gacgaucucgccggcgaa

SEQ ID NO: 3061306 - RNA, 19 nt, Mycobacterium bovis subsp bovis AF2122/97
gacgaucucgccggcgaag

SEQ ID NO: 3061307 - RNA, 14 nt, Mycobacterium bovis subsp bovis AF2122/97
gacgaucucggcgg

SEQ ID NO: 3061308 - RNA, 15 nt, Mycobacterium bovis subsp bovis AF2122/97
gacgaucucggcggc

SEQ ID NO: 3061309 - RNA, 15 nt, Mycobacterium bovis subsp bovis AF2122/97
gacgaucugcagcac

SEQ ID NO: 3061310 - RNA, 17 nt, Mycobacterium bovis subsp bovis AF2122/97
gacgaucuggcagccga

SEQ ID NO: 3061311 - RNA, 17 nt, Mycobacterium bovis subsp bovis AF2122/97
gacgaugacgcgcgaaa

SEQ ID NO: 3061312 - RNA, 15 nt, Mycobacterium bovis subsp bovis AF2122/97
gacgaugcaggugac

SEQ ID NO: 3061313 - RNA, 22 nt, Mycobacterium bovis subsp bovis AF2122/97
gacgaugcccuccucgaccgcg

SEQ ID NO: 3061314 - RNA, 16 nt, Mycobacterium bovis subsp bovis AF2122/97
gacgaugccgccuggu

SEQ ID NO: 3061315 - RNA, 20 nt, Mycobacterium bovis subsp bovis AF2122/97
gacgaugccggcccgcaggc

SEQ ID NO: 3061316 - RNA, 18 nt, Mycobacterium bovis subsp bovis AF2122/97
gacgaugccucggcggcc

SEQ ID NO: 3061317 - RNA, 23 nt, Mycobacterium bovis subsp bovis AF2122/97
gacgaugcgcacucccggcucgg

SEQ ID NO: 3061318 - RNA, 21 nt, Mycobacterium bovis subsp bovis AF2122/97
gacgaugcgggcgaucucgau

SEQ ID NO: 3061319 - RNA, 14 nt, Mycobacterium bovis subsp bovis AF2122/97
gacgaugcuggcgg

SEQ ID NO: 3061320 - RNA, 16 nt, Mycobacterium bovis subsp bovis AF2122/97
gacgaugcuggcggcc

SEQ ID NO: 3061321 - RNA, 17 nt, Mycobacterium bovis subsp bovis AF2122/97
gacgaugcuggcggccu

SEQ ID NO: 3061322 - RNA, 19 nt, Mycobacterium bovis subsp bovis AF2122/97
gacgaugcuggcggccucg

SEQ ID NO: 3061323 - RNA, 13 nt, Mycobacterium bovis subsp bovis AF2122/97
gacgauggccagg

SEQ ID NO: 3061324 - RNA, 15 nt, Mycobacterium bovis subsp bovis AF2122/97
gacgauggccgccgc

SEQ ID NO: 3061325 - RNA, 15 nt, Mycobacterium bovis subsp bovis AF2122/97
gacgauggcgucggc

SEQ ID NO: 3061326 - RNA, 22 nt, Mycobacterium bovis subsp bovis AF2122/97
gacgaugguguacugcugcuug

SEQ ID NO: 3061327 - RNA, 14 nt, Mycobacterium bovis subsp bovis AF2122/97
gacgauguccugga

SEQ ID NO: 3061328 - RNA, 17 nt, Mycobacterium bovis subsp bovis AF2122/97
gacgauguccuggaagc

SEQ ID NO: 3061329 - RNA, 16 nt, Mycobacterium bovis subsp bovis AF2122/97
gacgaugucggucgga

SEQ ID NO: 3061330 - RNA, 23 nt, Mycobacterium bovis subsp bovis AF2122/97
gacgaugucggucggaucggcgc

SEQ ID NO: 3061331 - RNA, 23 nt, Mycobacterium bovis subsp bovis AF2122/97
gacgauucccgcggacagcccgg

SEQ ID NO: 3061332 - RNA, 17 nt, Mycobacterium bovis subsp bovis AF2122/97
gacgauuccgcccacau

SEQ ID NO: 3061333 - RNA, 21 nt, Mycobacterium bovis subsp bovis AF2122/97
gacgauucgagcaacugcucg

SEQ ID NO: 3061334 - RNA, 15 nt, Mycobacterium bovis subsp bovis AF2122/97
gacgauucggcggcc

SEQ ID NO: 3061335 - RNA, 18 nt, Mycobacterium bovis subsp bovis AF2122/97
gacgauucggcggccgug

SEQ ID NO: 3061336 - RNA, 13 nt, Mycobacterium bovis subsp bovis AF2122/97
gacgauucucgag

SEQ ID NO: 3061337 - RNA, 20 nt, Mycobacterium bovis subsp bovis AF2122/97
gacgcaaaagccaccgcacg

SEQ ID NO: 3061338 - RNA, 24 nt, Mycobacterium bovis subsp bovis AF2122/97
gacgcaaaagccaccgcacguucg

SEQ ID NO: 3061339 - RNA, 20 nt, Mycobacterium bovis subsp bovis AF2122/97
gacgcaaaagcccccuaaac

SEQ ID NO: 3061340 - RNA, 18 nt, Mycobacterium bovis subsp bovis AF2122/97
gacgcaaaauccccucgc

SEQ ID NO: 3061341 - RNA, 21 nt, Mycobacterium bovis subsp bovis AF2122/97
gacgcaaaauccccucgcaac

SEQ ID NO: 3061342 - RNA, 16 nt, Mycobacterium bovis subsp bovis AF2122/97
gacgcaaaaucgccca

SEQ ID NO: 3061343 - RNA, 20 nt, Mycobacterium bovis subsp bovis AF2122/97
gacgcaaaaucgcccaauuu

SEQ ID NO: 3061344 - RNA, 19 nt, Mycobacterium bovis subsp bovis AF2122/97
gacgcaaaaucgcccauuu

SEQ ID NO: 3061345 - RNA, 16 nt, Mycobacterium bovis subsp bovis AF2122/97
gacgcaaaaucgcccg

SEQ ID NO: 3061346 - RNA, 15 nt, Mycobacterium bovis subsp bovis AF2122/97
gacgcaaagcagcgc

SEQ ID NO: 3061347 - RNA, 13 nt, Mycobacterium bovis subsp bovis AF2122/97
gacgcaacacccg

SEQ ID NO: 3061348 - RNA, 13 nt, Mycobacterium bovis subsp bovis AF2122/97
gacgcacagcagc

SEQ ID NO: 3061349 - RNA, 14 nt, Mycobacterium bovis subsp bovis AF2122/97
gacgcacagcagca

SEQ ID NO: 3061350 - RNA, 20 nt, Mycobacterium bovis subsp bovis AF2122/97
gacgcacagcagcaccgcga

SEQ ID NO: 3061351 - RNA, 16 nt, Mycobacterium bovis subsp bovis AF2122/97
gacgcacaggcgacgg

SEQ ID NO: 3061352 - RNA, 22 nt, Mycobacterium bovis subsp bovis AF2122/97
gacgcaccgccaguuccgguga

SEQ ID NO: 3061353 - RNA, 16 nt, Mycobacterium bovis subsp bovis AF2122/97
gacgcaccuaugguca

SEQ ID NO: 3061354 - RNA, 21 nt, Mycobacterium bovis subsp bovis AF2122/97
gacgcacgacugugcgccgca

SEQ ID NO: 3061355 - RNA, 24 nt, Mycobacterium bovis subsp bovis AF2122/97
gacgcacgacugugcgccgcagcc

SEQ ID NO: 3061356 - RNA, 13 nt, Mycobacterium bovis subsp bovis AF2122/97
gacgcacggccac

SEQ ID NO: 3061357 - RNA, 15 nt, Mycobacterium bovis subsp bovis AF2122/97
gacgcagaagccccc

SEQ ID NO: 3061358 - RNA, 18 nt, Mycobacterium bovis subsp bovis AF2122/97
gacgcagaagcccccaaa

SEQ ID NO: 3061359 - RNA, 19 nt, Mycobacterium bovis subsp bovis AF2122/97
gacgcagaaucgcacgcgg

SEQ ID NO: 3061360 - RNA, 15 nt, Mycobacterium bovis subsp bovis AF2122/97
gacgcagaaucgcau

SEQ ID NO: 3061361 - RNA, 16 nt, Mycobacterium bovis subsp bovis AF2122/97
gacgcagaaucgccca

SEQ ID NO: 3061362 - RNA, 17 nt, Mycobacterium bovis subsp bovis AF2122/97
gacgcagaccguccagc

SEQ ID NO: 3061363 - RNA, 23 nt, Mycobacterium bovis subsp bovis AF2122/97
gacgcagagucgcacugcgccgg

SEQ ID NO: 3061364 - RNA, 20 nt, Mycobacterium bovis subsp bovis AF2122/97
gacgcagccacgucucgcga

SEQ ID NO: 3061365 - RNA, 16 nt, Mycobacterium bovis subsp bovis AF2122/97
gacgcaggaucacacu

SEQ ID NO: 3061366 - RNA, 19 nt, Mycobacterium bovis subsp bovis AF2122/97
gacgcaggugaacgccggu

SEQ ID NO: 3061367 - RNA, 21 nt, Mycobacterium bovis subsp bovis AF2122/97
gacgcaggugaacgccggugc

SEQ ID NO: 3061368 - RNA, 15 nt, Mycobacterium bovis subsp bovis AF2122/97
gacgcauaaccggcg

SEQ ID NO: 3061369 - RNA, 16 nt, Mycobacterium bovis subsp bovis AF2122/97
gacgcauaaccggcgc

SEQ ID NO: 3061370 - RNA, 17 nt, Mycobacterium bovis subsp bovis AF2122/97
gacgcauaaccggcgcg

SEQ ID NO: 3061371 - RNA, 17 nt, Mycobacterium bovis subsp bovis AF2122/97
gacgcauaagcccccga

SEQ ID NO: 3061372 - RNA, 21 nt, Mycobacterium bovis subsp bovis AF2122/97
gacgcauaagcccccgacacg

SEQ ID NO: 3061373 - RNA, 20 nt, Mycobacterium bovis subsp bovis AF2122/97
gacgcauaagcccccgcacg

SEQ ID NO: 3061374 - RNA, 19 nt, Mycobacterium bovis subsp bovis AF2122/97
gacgcaugcgugacccgac

SEQ ID NO: 3061375 - RNA, 19 nt, Mycobacterium bovis subsp bovis AF2122/97
gacgcaugggucauggcgc

SEQ ID NO: 3061376 - RNA, 16 nt, Mycobacterium bovis subsp bovis AF2122/97
gacgccaaaucggcca

SEQ ID NO: 3061377 - RNA, 15 nt, Mycobacterium bovis subsp bovis AF2122/97
gacgccaacgccagc

SEQ ID NO: 3061378 - RNA, 18 nt, Mycobacterium bovis subsp bovis AF2122/97
gacgccaacgccagcggg

SEQ ID NO: 3061379 - RNA, 21 nt, Mycobacterium bovis subsp bovis AF2122/97
gacgccaacgugacgccggcc

SEQ ID NO: 3061380 - RNA, 23 nt, Mycobacterium bovis subsp bovis AF2122/97
gacgccgugcugggugacaccgg

SEQ ID NO: 3061381 - RNA, 15 nt, Mycobacterium bovis subsp bovis AF2122/97
gacgccgugugcauc

SEQ ID NO: 3061382 - RNA, 16 nt, Mycobacterium bovis subsp bovis AF2122/97
gacgccguugccgccg

SEQ ID NO: 3061383 - RNA, 19 nt, Mycobacterium bovis subsp bovis AF2122/97
gacgccguugccgccguug

SEQ ID NO: 3061384 - RNA, 12 nt, Mycobacterium bovis subsp bovis AF2122/97
gacgccucgaca

SEQ ID NO: 3061385 - RNA, 21 nt, Mycobacterium bovis subsp bovis AF2122/97
gacgccuuccagcccgagcag

SEQ ID NO: 3061386 - RNA, 16 nt, Mycobacterium bovis subsp bovis AF2122/97
gacgccuugaucggcg

SEQ ID NO: 3061387 - RNA, 16 nt, Mycobacterium bovis subsp bovis AF2122/97
gacgccuugcacaagc

SEQ ID NO: 3061388 - RNA, 19 nt, Mycobacterium bovis subsp bovis AF2122/97
gacgccuugcacaagcuga

SEQ ID NO: 3061389 - RNA, 20 nt, Mycobacterium bovis subsp bovis AF2122/97
gacgcgaaauccccugcgcu

SEQ ID NO: 3061390 - RNA, 22 nt, Mycobacterium bovis subsp bovis AF2122/97
gacgcgaacccauacgccaagu

SEQ ID NO: 3061391 - RNA, 20 nt, Mycobacterium bovis subsp bovis AF2122/97
gacgcgaacgcggccaccac

SEQ ID NO: 3061392 - RNA, 18 nt, Mycobacterium bovis subsp bovis AF2122/97
gacgcgacacacgccgcc

SEQ ID NO: 3061393 - RNA, 19 nt, Mycobacterium bovis subsp bovis AF2122/97
gacgcgacacacgccgccg

SEQ ID NO: 3061394 - RNA, 20 nt, Mycobacterium bovis subsp bovis AF2122/97
gacgcgacacacgccgccgg

SEQ ID NO: 3061395 - RNA, 16 nt, Mycobacterium bovis subsp bovis AF2122/97
gacgcgacacgccggc

SEQ ID NO: 3061396 - RNA, 17 nt, Mycobacterium bovis subsp bovis AF2122/97
gacgcgacacgccggcg

SEQ ID NO: 3061397 - RNA, 18 nt, Mycobacterium bovis subsp bovis AF2122/97
gacgcgacacgccggcgg

SEQ ID NO: 3061398 - RNA, 15 nt, Mycobacterium bovis subsp bovis AF2122/97
gacgcgacucggcgg

SEQ ID NO: 3061399 - RNA, 22 nt, Mycobacterium bovis subsp bovis AF2122/97
gacgcgacucggcggucuuggc

SEQ ID NO: 3061400 - RNA, 19 nt, Mycobacterium bovis subsp bovis AF2122/97
gacgcgagugcgugaucug

SEQ ID NO: 3061401 - RNA, 13 nt, Mycobacterium bovis subsp bovis AF2122/97
gacgcgaucggcg

SEQ ID NO: 3061402 - RNA, 14 nt, Mycobacterium bovis subsp bovis AF2122/97
gacgcgaucggcgu

SEQ ID NO: 3061403 - RNA, 15 nt, Mycobacterium bovis subsp bovis AF2122/97
gacgcgaucuguccg

SEQ ID NO: 3061404 - RNA, 20 nt, Mycobacterium bovis subsp bovis AF2122/97
gacgcgaucuguccgcgaac

SEQ ID NO: 3061405 - RNA, 20 nt, Mycobacterium bovis subsp bovis AF2122/97
gacgcgcagcaucggcgaca

SEQ ID NO: 3061406 - RNA, 16 nt, Mycobacterium bovis subsp bovis AF2122/97
gacgcgcaucgcacgg

SEQ ID NO: 3061407 - RNA, 23 nt, Mycobacterium bovis subsp bovis AF2122/97
gacgcgcaucgcacgggccacca

SEQ ID NO: 3061408 - RNA, 18 nt, Mycobacterium bovis subsp bovis AF2122/97
gacgcgcauucgccgggc

SEQ ID NO: 3061409 - RNA, 19 nt, Mycobacterium bovis subsp bovis AF2122/97
gacgcgccccaguucgacg

SEQ ID NO: 3061410 - RNA, 20 nt, Mycobacterium bovis subsp bovis AF2122/97
gacgcgccgguucagacggu

SEQ ID NO: 3061411 - RNA, 12 nt, Mycobacterium bovis subsp bovis AF2122/97
gacgcgcggcca

SEQ ID NO: 3061412 - RNA, 14 nt, Mycobacterium bovis subsp bovis AF2122/97
gacgcgcggccagc

SEQ ID NO: 3061413 - RNA, 18 nt, Mycobacterium bovis subsp bovis AF2122/97
gacgcgcggccagcccac

SEQ ID NO: 3061414 - RNA, 18 nt, Mycobacterium bovis subsp bovis AF2122/97
gacgcggaaucgcaccgu

SEQ ID NO: 3061415 - RNA, 19 nt, Mycobacterium bovis subsp bovis AF2122/97
gacgcggccaauggccgcg

SEQ ID NO: 3061416 - RNA, 16 nt, Mycobacterium bovis subsp bovis AF2122/97
gacgcggccagcggca

SEQ ID NO: 3061417 - RNA, 19 nt, Mycobacterium bovis subsp bovis AF2122/97
gacgcggccggccgcccgc

SEQ ID NO: 3061418 - RNA, 22 nt, Mycobacterium bovis subsp bovis AF2122/97
gacgcggccggccgcccgcucg

SEQ ID NO: 3061419 - RNA, 13 nt, Mycobacterium bovis subsp bovis AF2122/97
gacgcggccgggc

SEQ ID NO: 3061420 - RNA, 15 nt, Mycobacterium bovis subsp bovis AF2122/97
gacgcggccgggcgu

SEQ ID NO: 3061421 - RNA, 16 nt, Mycobacterium bovis subsp bovis AF2122/97
gacgcggcgccgccau

SEQ ID NO: 3061422 - RNA, 20 nt, Mycobacterium bovis subsp bovis AF2122/97
gacgcggcggacaugcaccu

SEQ ID NO: 3061423 - RNA, 13 nt, Mycobacterium bovis subsp bovis AF2122/97
gacgcgggccgcg

SEQ ID NO: 3061424 - RNA, 16 nt, Mycobacterium bovis subsp bovis AF2122/97
gacgcgggccgcgaaa

SEQ ID NO: 3061425 - RNA, 20 nt, Mycobacterium bovis subsp bovis AF2122/97
gacgcggggcucaaccccgu

SEQ ID NO: 3061426 - RNA, 15 nt, Mycobacterium bovis subsp bovis AF2122/97
gacgcgggucuuggc

SEQ ID NO: 3061427 - RNA, 21 nt, Mycobacterium bovis subsp bovis AF2122/97
gacgcggucaucgagcugacc

SEQ ID NO: 3061428 - RNA, 20 nt, Mycobacterium bovis subsp bovis AF2122/97
gacgcgguccucgagccgau

SEQ ID NO: 3061429 - RNA, 14 nt, Mycobacterium bovis subsp bovis AF2122/97
gacgcggucgacga

SEQ ID NO: 3061430 - RNA, 14 nt, Mycobacterium bovis subsp bovis AF2122/97
gacgcgucagcggc

SEQ ID NO: 3061431 - RNA, 15 nt, Mycobacterium bovis subsp bovis AF2122/97
gacgcgucagcggcg

SEQ ID NO: 3061432 - RNA, 16 nt, Mycobacterium bovis subsp bovis AF2122/97
gacgcgucagcggcga

SEQ ID NO: 3061433 - RNA, 18 nt, Mycobacterium bovis subsp bovis AF2122/97
gacgcgucagcggcgagc

SEQ ID NO: 3061434 - RNA, 19 nt, Mycobacterium bovis subsp bovis AF2122/97
gacgcgucagcggcgagca

SEQ ID NO: 3061435 - RNA, 14 nt, Mycobacterium bovis subsp bovis AF2122/97
gacgcguccggugc

SEQ ID NO: 3061436 - RNA, 13 nt, Mycobacterium bovis subsp bovis AF2122/97
gacgcgucggcga

SEQ ID NO: 3061437 - RNA, 20 nt, Mycobacterium bovis subsp bovis AF2122/97
gacgcguggcauccagcagc

SEQ ID NO: 3061438 - RNA, 17 nt, Mycobacterium bovis subsp bovis AF2122/97
gacgcguugcucgaaac

SEQ ID NO: 3061439 - RNA, 14 nt, Mycobacterium bovis subsp bovis AF2122/97
gacgcguuucgucg

SEQ ID NO: 3061440 - RNA, 16 nt, Mycobacterium bovis subsp bovis AF2122/97
gacgcguuucgucgac

SEQ ID NO: 3061441 - RNA, 16 nt, Mycobacterium bovis subsp bovis AF2122/97
gacgcuaacgucgauc

SEQ ID NO: 3061442 - RNA, 16 nt, Mycobacterium bovis subsp bovis AF2122/97
gacgcuccaguggcgc

SEQ ID NO: 3061443 - RNA, 15 nt, Mycobacterium bovis subsp bovis AF2122/97
gacgcucgaccugcc

SEQ ID NO: 3061444 - RNA, 16 nt, Mycobacterium bovis subsp bovis AF2122/97
gacgcucgcugcagca

SEQ ID NO: 3061445 - RNA, 20 nt, Mycobacterium bovis subsp bovis AF2122/97
gacgcucgcugcagcagggc

SEQ ID NO: 3061446 - RNA, 12 nt, Mycobacterium bovis subsp bovis AF2122/97
gacgcucugcga

SEQ ID NO: 3061447 - RNA, 12 nt, Mycobacterium bovis subsp bovis AF2122/97
gacgcugccgca

SEQ ID NO: 3061448 - RNA, 14 nt, Mycobacterium bovis subsp bovis AF2122/97
gacgcugcgcgcca

SEQ ID NO: 3061449 - RNA, 18 nt, Mycobacterium bovis subsp bovis AF2122/97
gacgcugcgcgccagaca

SEQ ID NO: 3061450 - RNA, 22 nt, Mycobacterium bovis subsp bovis AF2122/97
gacgcugcgcgccagacacaac

SEQ ID NO: 3061451 - RNA, 22 nt, Mycobacterium bovis subsp bovis AF2122/97
gacgcugcucuggacggucauc

SEQ ID NO: 3061452 - RNA, 15 nt, Mycobacterium bovis subsp bovis AF2122/97
gacgcuggccacgau

SEQ ID NO: 3061453 - RNA, 22 nt, Mycobacterium bovis subsp bovis AF2122/97
gacgcuggcgguguagccgcgg

SEQ ID NO: 3061454 - RNA, 23 nt, Mycobacterium bovis subsp bovis AF2122/97
gacgcuggcgguguagccgcggu

SEQ ID NO: 3061455 - RNA, 13 nt, Mycobacterium bovis subsp bovis AF2122/97
gacgcuggucggc

SEQ ID NO: 3061456 - RNA, 18 nt, Mycobacterium bovis subsp bovis AF2122/97
gacgcuguggcucgacga

SEQ ID NO: 3061457 - RNA, 18 nt, Mycobacterium bovis subsp bovis AF2122/97
gacgcuuggccaggucau

SEQ ID NO: 3061458 - RNA, 20 nt, Mycobacterium bovis subsp bovis AF2122/97
gacgcuuggguagccugacc

SEQ ID NO: 3061459 - RNA, 16 nt, Mycobacterium bovis subsp bovis AF2122/97
gacgcuuuccgccgca

SEQ ID NO: 3061460 - RNA, 20 nt, Mycobacterium bovis subsp bovis AF2122/97
gacgcuuuccgccgcaccgg

SEQ ID NO: 3061461 - RNA, 15 nt, Mycobacterium bovis subsp bovis AF2122/97
gacggaaucgucggc

SEQ ID NO: 3061462 - RNA, 17 nt, Mycobacterium bovis subsp bovis AF2122/97
gacggaaucgucggcgc

SEQ ID NO: 3061463 - RNA, 18 nt, Mycobacterium bovis subsp bovis AF2122/97
gacggaaucgucggcgcg

SEQ ID NO: 3061464 - RNA, 20 nt, Mycobacterium bovis subsp bovis AF2122/97
gacggaaucgucggcgcggc

SEQ ID NO: 3061465 - RNA, 17 nt, Mycobacterium bovis subsp bovis AF2122/97
gacggaaugucagccgg

SEQ ID NO: 3061466 - RNA, 20 nt, Mycobacterium bovis subsp bovis AF2122/97
gacggaauucgguuggcucg

SEQ ID NO: 3061467 - RNA, 17 nt, Mycobacterium bovis subsp bovis AF2122/97
gacggcgcuguggcggg

SEQ ID NO: 3061468 - RNA, 15 nt, Mycobacterium bovis subsp bovis AF2122/97
gacggcggagucgcg

SEQ ID NO: 3061469 - RNA, 14 nt, Mycobacterium bovis subsp bovis AF2122/97
gacggcggcaacgg

SEQ ID NO: 3061470 - RNA, 18 nt, Mycobacterium bovis subsp bovis AF2122/97
gacggcggcaacggcggu

SEQ ID NO: 3061471 - RNA, 13 nt, Mycobacterium bovis subsp bovis AF2122/97
gacggcggcaagg

SEQ ID NO: 3061472 - RNA, 21 nt, Mycobacterium bovis subsp bovis AF2122/97
gacggcggcaagggcggcaac

SEQ ID NO: 3061473 - RNA, 22 nt, Mycobacterium bovis subsp bovis AF2122/97
gacggcggcaagggcggcaacg

SEQ ID NO: 3061474 - RNA, 12 nt, Mycobacterium bovis subsp bovis AF2122/97
gacggcggcagu

SEQ ID NO: 3061475 - RNA, 14 nt, Mycobacterium bovis subsp bovis AF2122/97
gacggcggcaucgg

SEQ ID NO: 3061476 - RNA, 12 nt, Mycobacterium bovis subsp bovis AF2122/97
gacggcggccaa

SEQ ID NO: 3061477 - RNA, 21 nt, Mycobacterium bovis subsp bovis AF2122/97
gacggcggccacguggucggc

SEQ ID NO: 3061478 - RNA, 22 nt, Mycobacterium bovis subsp bovis AF2122/97
gacggcggccacguggucggcg

SEQ ID NO: 3061479 - RNA, 15 nt, Mycobacterium bovis subsp bovis AF2122/97
gacggcggccgcgau

SEQ ID NO: 3061480 - RNA, 14 nt, Mycobacterium bovis subsp bovis AF2122/97
gacggcggccuucg

SEQ ID NO: 3061481 - RNA, 14 nt, Mycobacterium bovis subsp bovis AF2122/97
gacggcggcgaggc

SEQ ID NO: 3061482 - RNA, 18 nt, Mycobacterium bovis subsp bovis AF2122/97
gacggcggcgaggcgguc

SEQ ID NO: 3061483 - RNA, 23 nt, Mycobacterium bovis subsp bovis AF2122/97
gacggcggcgaggcggucgccga

SEQ ID NO: 3061484 - RNA, 17 nt, Mycobacterium bovis subsp bovis AF2122/97
gacggcgggccgcgcgg

SEQ ID NO: 3061485 - RNA, 18 nt, Mycobacterium bovis subsp bovis AF2122/97
gacggcgggccgcgcggc

SEQ ID NO: 3061486 - RNA, 17 nt, Mycobacterium bovis subsp bovis AF2122/97
gacggcggggcggcggu

SEQ ID NO: 3061487 - RNA, 21 nt, Mycobacterium bovis subsp bovis AF2122/97
gacggcggggcggcggugggc

SEQ ID NO: 3061488 - RNA, 21 nt, Mycobacterium bovis subsp bovis AF2122/97
gacggcggguuuucucgccgu

SEQ ID NO: 3061489 - RNA, 14 nt, Mycobacterium bovis subsp bovis AF2122/97
gacggcgucacccg

SEQ ID NO: 3061490 - RNA, 22 nt, Mycobacterium bovis subsp bovis AF2122/97
gacggcgucgaguaguucgucg

SEQ ID NO: 3061491 - RNA, 12 nt, Mycobacterium bovis subsp bovis AF2122/97
gacggcgucggg

SEQ ID NO: 3061492 - RNA, 17 nt, Mycobacterium bovis subsp bovis AF2122/97
gacggcgucugcggugg

SEQ ID NO: 3061493 - RNA, 18 nt, Mycobacterium bovis subsp bovis AF2122/97
gacggcgucugcgguggc

SEQ ID NO: 3061494 - RNA, 23 nt, Mycobacterium bovis subsp bovis AF2122/97
gacggcguugauccgcaccccau

SEQ ID NO: 3061495 - RNA, 15 nt, Mycobacterium bovis subsp bovis AF2122/97
gacggcguugucgac

SEQ ID NO: 3061496 - RNA, 18 nt, Mycobacterium bovis subsp bovis AF2122/97
gacggcguugucgacgaa

SEQ ID NO: 3061497 - RNA, 15 nt, Mycobacterium bovis subsp bovis AF2122/97
gacggcuaccaccgc

SEQ ID NO: 3061498 - RNA, 22 nt, Mycobacterium bovis subsp bovis AF2122/97
gacggcuaccaccgcaccugcg

SEQ ID NO: 3061499 - RNA, 15 nt, Mycobacterium bovis subsp bovis AF2122/97
gacggcucagcgugc

SEQ ID NO: 3061500 - RNA, 20 nt, Mycobacterium bovis subsp bovis AF2122/97
gacggcucagcgugcgcugg

SEQ ID NO: 3061501 - RNA, 13 nt, Mycobacterium bovis subsp bovis AF2122/97
gacggcugagaca

SEQ ID NO: 3061502 - RNA, 19 nt, Mycobacterium bovis subsp bovis AF2122/97
gacggcugagacagaccgg

SEQ ID NO: 3061503 - RNA, 22 nt, Mycobacterium bovis subsp bovis AF2122/97
gacggcugagacagaccgggcc

SEQ ID NO: 3061504 - RNA, 16 nt, Mycobacterium bovis subsp bovis AF2122/97
gacggcugccgucagc

SEQ ID NO: 3061505 - RNA, 17 nt, Mycobacterium bovis subsp bovis AF2122/97
gacggcugccgucagcc

SEQ ID NO: 3061506 - RNA, 22 nt, Mycobacterium bovis subsp bovis AF2122/97
gacggcugccgucagccguucg

SEQ ID NO: 3061507 - RNA, 16 nt, Mycobacterium bovis subsp bovis AF2122/97
gacggcugcgccgaac

SEQ ID NO: 3061508 - RNA, 21 nt, Mycobacterium bovis subsp bovis AF2122/97
gacggcugcgccgaacaccac

SEQ ID NO: 3061509 - RNA, 15 nt, Mycobacterium bovis subsp bovis AF2122/97
gacggcuucggcagc

SEQ ID NO: 3061510 - RNA, 16 nt, Mycobacterium bovis subsp bovis AF2122/97
gacggcuucggcagcc

SEQ ID NO: 3061511 - RNA, 18 nt, Mycobacterium bovis subsp bovis AF2122/97
gacggcuucggcagccgc

SEQ ID NO: 3061512 - RNA, 17 nt, Mycobacterium bovis subsp bovis AF2122/97
gacggcuugagccgcag

SEQ ID NO: 3061513 - RNA, 18 nt, Mycobacterium bovis subsp bovis AF2122/97
gacggcuugagccgcagc

SEQ ID NO: 3061514 - RNA, 19 nt, Mycobacterium bovis subsp bovis AF2122/97
gacggcuugagccgcagca

SEQ ID NO: 3061515 - RNA, 17 nt, Mycobacterium bovis subsp bovis AF2122/97
gacgggaaacuccgcgg

SEQ ID NO: 3061516 - RNA, 19 nt, Mycobacterium bovis subsp bovis AF2122/97
gacgggaaacuccgcggcg

SEQ ID NO: 3061517 - RNA, 23 nt, Mycobacterium bovis subsp bovis AF2122/97
gacgggaaacuccgcggcgcgca

SEQ ID NO: 3061518 - RNA, 17 nt, Mycobacterium bovis subsp bovis AF2122/97
gacgggcacaaccagau

SEQ ID NO: 3061519 - RNA, 20 nt, Mycobacterium bovis subsp bovis AF2122/97
gacgggcacccgagccgcac

SEQ ID NO: 3061520 - RNA, 21 nt, Mycobacterium bovis subsp bovis AF2122/97
gacgggcacccgagccgcaca

SEQ ID NO: 3061521 - RNA, 15 nt, Mycobacterium bovis subsp bovis AF2122/97
gacgggccacgaugc

SEQ ID NO: 3061522 - RNA, 22 nt, Mycobacterium bovis subsp bovis AF2122/97
gacgggccacgaugcgcacacc

SEQ ID NO: 3061523 - RNA, 12 nt, Mycobacterium bovis subsp bovis AF2122/97
gacgggccgucg

SEQ ID NO: 3061524 - RNA, 13 nt, Mycobacterium bovis subsp bovis AF2122/97
gacgggcgccaac

SEQ ID NO: 3061525 - RNA, 18 nt, Mycobacterium bovis subsp bovis AF2122/97
gacgggcgccaacgggcu

SEQ ID NO: 3061526 - RNA, 22 nt, Mycobacterium bovis subsp bovis AF2122/97
gacgggcgcguccucgccgcac

SEQ ID NO: 3061527 - RNA, 15 nt, Mycobacterium bovis subsp bovis AF2122/97
gacgggcgcgucggc

SEQ ID NO: 3061528 - RNA, 16 nt, Mycobacterium bovis subsp bovis AF2122/97
gacgggcgcgucggcg

SEQ ID NO: 3061529 - RNA, 21 nt, Mycobacterium bovis subsp bovis AF2122/97
gacggggaacguccgcgccga

SEQ ID NO: 3061530 - RNA, 16 nt, Mycobacterium bovis subsp bovis AF2122/97
gacggggaagcccggc

SEQ ID NO: 3061531 - RNA, 23 nt, Mycobacterium bovis subsp bovis AF2122/97
gacggggaugggggagccgguga

SEQ ID NO: 3061532 - RNA, 15 nt, Mycobacterium bovis subsp bovis AF2122/97
gacggggcaaaggag

SEQ ID NO: 3061533 - RNA, 16 nt, Mycobacterium bovis subsp bovis AF2122/97
gacggggcaaaggagc

SEQ ID NO: 3061534 - RNA, 20 nt, Mycobacterium bovis subsp bovis AF2122/97
gacggggcaaaggagccguu

SEQ ID NO: 3061535 - RNA, 21 nt, Mycobacterium bovis subsp bovis AF2122/97
gacggggcaaaggagccguug

SEQ ID NO: 3061536 - RNA, 12 nt, Mycobacterium bovis subsp bovis AF2122/97
gacggggcgagc

SEQ ID NO: 3061537 - RNA, 16 nt, Mycobacterium bovis subsp bovis AF2122/97
gacggggcugaccgcc

SEQ ID NO: 3061538 - RNA, 20 nt, Mycobacterium bovis subsp bovis AF2122/97
gacggggcugaccgccaccc

SEQ ID NO: 3061539 - RNA, 23 nt, Mycobacterium bovis subsp bovis AF2122/97
gacggggcugaccgccaccccgc

SEQ ID NO: 3061540 - RNA, 21 nt, Mycobacterium bovis subsp bovis AF2122/97
gacgggggucgggcgugucgg

SEQ ID NO: 3061541 - RNA, 22 nt, Mycobacterium bovis subsp bovis AF2122/97
gacgggggucgggcgugucggg

SEQ ID NO: 3061542 - RNA, 13 nt, Mycobacterium bovis subsp bovis AF2122/97
gacggggucgcga

SEQ ID NO: 3061543 - RNA, 22 nt, Mycobacterium bovis subsp bovis AF2122/97
gacggggucgcgaugcucaaug

SEQ ID NO: 3061544 - RNA, 17 nt, Mycobacterium bovis subsp bovis AF2122/97
gacggggugagccgacc

SEQ ID NO: 3061545 - RNA, 16 nt, Mycobacterium bovis subsp bovis AF2122/97
gacgggguugaccgcc

SEQ ID NO: 3061546 - RNA, 23 nt, Mycobacterium bovis subsp bovis AF2122/97
gacgggguuguggucgaguugaa

SEQ ID NO: 3061547 - RNA, 23 nt, Mycobacterium bovis subsp bovis AF2122/97
gacggguccgggccaaugccguu

SEQ ID NO: 3061548 - RNA, 15 nt, Mycobacterium bovis subsp bovis AF2122/97
gacgggucgccgcca

SEQ ID NO: 3061549 - RNA, 13 nt, Mycobacterium bovis subsp bovis AF2122/97
gacgggucggcgc

SEQ ID NO: 3061550 - RNA, 16 nt, Mycobacterium bovis subsp bovis AF2122/97
gacgggucggcgccga

SEQ ID NO: 3061551 - RNA, 18 nt, Mycobacterium bovis subsp bovis AF2122/97
gacgggucggcgccgagc

SEQ ID NO: 3061552 - RNA, 20 nt, Mycobacterium bovis subsp bovis AF2122/97
gacgggucguaggacaccac

SEQ ID NO: 3061553 - RNA, 16 nt, Mycobacterium bovis subsp bovis AF2122/97
gacgucaccguucuug

SEQ ID NO: 3061554 - RNA, 15 nt, Mycobacterium bovis subsp bovis AF2122/97
gacgucacguucggc

SEQ ID NO: 3061555 - RNA, 17 nt, Mycobacterium bovis subsp bovis AF2122/97
gacgucacguucggcgc

SEQ ID NO: 3061556 - RNA, 18 nt, Mycobacterium bovis subsp bovis AF2122/97
gacgucaugcggauagca

SEQ ID NO: 3061557 - RNA, 14 nt, Mycobacterium bovis subsp bovis AF2122/97
gacguccaacagcg

SEQ ID NO: 3061558 - RNA, 14 nt, Mycobacterium bovis subsp bovis AF2122/97
gacguccaccagcc

SEQ ID NO: 3061559 - RNA, 17 nt, Mycobacterium bovis subsp bovis AF2122/97
gacguccaccagccggu

SEQ ID NO: 3061560 - RNA, 18 nt, Mycobacterium bovis subsp bovis AF2122/97
gacguccaccagccgguu

SEQ ID NO: 3061561 - RNA, 20 nt, Mycobacterium bovis subsp bovis AF2122/97
gacguccagggccacgaucu

SEQ ID NO: 3061562 - RNA, 22 nt, Mycobacterium bovis subsp bovis AF2122/97
gacguccagggccacgaucugu

SEQ ID NO: 3061563 - RNA, 13 nt, Mycobacterium bovis subsp bovis AF2122/97
gacguccaucccg

SEQ ID NO: 3061564 - RNA, 13 nt, Mycobacterium bovis subsp bovis AF2122/97
gacguccgcgacu

SEQ ID NO: 3061565 - RNA, 16 nt, Mycobacterium bovis subsp bovis AF2122/97
gacguccucgacgauc

SEQ ID NO: 3061566 - RNA, 14 nt, Mycobacterium bovis subsp bovis AF2122/97
gacguccuucgcug

SEQ ID NO: 3061567 - RNA, 23 nt, Mycobacterium bovis subsp bovis AF2122/97
gacgucgacaaucaguagcagcg

SEQ ID NO: 3061568 - RNA, 18 nt, Mycobacterium bovis subsp bovis AF2122/97
gacgucgaccacugcccg

SEQ ID NO: 3061569 - RNA, 14 nt, Mycobacterium bovis subsp bovis AF2122/97
gacgucgaccgugu

SEQ ID NO: 3061570 - RNA, 15 nt, Mycobacterium bovis subsp bovis AF2122/97
gacgucgaccguguc

SEQ ID NO: 3061571 - RNA, 13 nt, Mycobacterium bovis subsp bovis AF2122/97
gacgucgaccugu

SEQ ID NO: 3061572 - RNA, 19 nt, Mycobacterium bovis subsp bovis AF2122/97
gacgucgacgccggccagc

SEQ ID NO: 3061573 - RNA, 17 nt, Mycobacterium bovis subsp bovis AF2122/97
gacgucgauuucggcga

SEQ ID NO: 3061574 - RNA, 18 nt, Mycobacterium bovis subsp bovis AF2122/97
gacgucgauuucggcgac

SEQ ID NO: 3061575 - RNA, 19 nt, Mycobacterium bovis subsp bovis AF2122/97
gacgucgauuucggcgacc

SEQ ID NO: 3061576 - RNA, 13 nt, Mycobacterium bovis subsp bovis AF2122/97
gacgucgccgccg

SEQ ID NO: 3061577 - RNA, 14 nt, Mycobacterium bovis subsp bovis AF2122/97
gacgucgccgccgc

SEQ ID NO: 3061578 - RNA, 21 nt, Mycobacterium bovis subsp bovis AF2122/97
gacgucgccggacgacaacag

SEQ ID NO: 3061579 - RNA, 21 nt, Mycobacterium bovis subsp bovis AF2122/97
gacgucgcggaguagccgcag

SEQ ID NO: 3061580 - RNA, 22 nt, Mycobacterium bovis subsp bovis AF2122/97
gacgucgcggaguagccgcagc

SEQ ID NO: 3061581 - RNA, 19 nt, Mycobacterium bovis subsp bovis AF2122/97
gacgucgcggauugccgcg

SEQ ID NO: 3061582 - RNA, 24 nt, Mycobacterium bovis subsp bovis AF2122/97
gacgucgcggauugccgcgcgcaa

SEQ ID NO: 3061583 - RNA, 23 nt, Mycobacterium bovis subsp bovis AF2122/97
gacgucgcuagaucccaguccga

SEQ ID NO: 3061584 - RNA, 20 nt, Mycobacterium bovis subsp bovis AF2122/97
gacgucggaccagcugccgg

SEQ ID NO: 3061585 - RNA, 23 nt, Mycobacterium bovis subsp bovis AF2122/97
gacgucggaccagcugccggcga

SEQ ID NO: 3061586 - RNA, 18 nt, Mycobacterium bovis subsp bovis AF2122/97
gacgucggcaaucucgau

SEQ ID NO: 3061587 - RNA, 19 nt, Mycobacterium bovis subsp bovis AF2122/97
gacgucggcaucggcggcg

SEQ ID NO: 3061588 - RNA, 12 nt, Mycobacterium bovis subsp bovis AF2122/97
gacgucggccgc

SEQ ID NO: 3061589 - RNA, 13 nt, Mycobacterium bovis subsp bovis AF2122/97
gacgucggcggcc

SEQ ID NO: 3061590 - RNA, 13 nt, Mycobacterium bovis subsp bovis AF2122/97
gacgucggcguag

SEQ ID NO: 3061591 - RNA, 16 nt, Mycobacterium bovis subsp bovis AF2122/97
gacgucggcguggucg

SEQ ID NO: 3061592 - RNA, 22 nt, Mycobacterium bovis subsp bovis AF2122/97
gacgucggcguggucgcgcggc

SEQ ID NO: 3061593 - RNA, 16 nt, Mycobacterium bovis subsp bovis AF2122/97
gacgucgggaucgcca

SEQ ID NO: 3061594 - RNA, 19 nt, Mycobacterium bovis subsp bovis AF2122/97
gacgucgggcauggcggcg

SEQ ID NO: 3061595 - RNA, 23 nt, Mycobacterium bovis subsp bovis AF2122/97
gacgucgguaagcgccaaggcga

SEQ ID NO: 3061596 - RNA, 13 nt, Mycobacterium bovis subsp bovis AF2122/97
gacgucggugaaa

SEQ ID NO: 3061597 - RNA, 20 nt, Mycobacterium bovis subsp bovis AF2122/97
gacgucguagacaccuucga

SEQ ID NO: 3061598 - RNA, 20 nt, Mycobacterium bovis subsp bovis AF2122/97
gacgucgucgaauccugccg

SEQ ID NO: 3061599 - RNA, 22 nt, Mycobacterium bovis subsp bovis AF2122/97
gacgucgugaccggcgggaccg

SEQ ID NO: 3061600 - RNA, 15 nt, Mycobacterium bovis subsp bovis AF2122/97
gacgucguggcgcuc

SEQ ID NO: 3061601 - RNA, 22 nt, Mycobacterium bovis subsp bovis AF2122/97
gacgucguggcgcucggcgagc

SEQ ID NO: 3061602 - RNA, 15 nt, Mycobacterium bovis subsp bovis AF2122/97
gacgucguuacugga

SEQ ID NO: 3061603 - RNA, 20 nt, Mycobacterium bovis subsp bovis AF2122/97
gacgucguuacuggagauac

SEQ ID NO: 3061604 - RNA, 23 nt, Mycobacterium bovis subsp bovis AF2122/97
gacgucguuacuggagauaccga

SEQ ID NO: 3061605 - RNA, 17 nt, Mycobacterium bovis subsp bovis AF2122/97
gacgucguugccgucca

SEQ ID NO: 3061606 - RNA, 18 nt, Mycobacterium bovis subsp bovis AF2122/97
gacgucucuggugcaggu

SEQ ID NO: 3061607 - RNA, 12 nt, Mycobacterium bovis subsp bovis AF2122/97
gacgucugccag

SEQ ID NO: 3061608 - RNA, 14 nt, Mycobacterium bovis subsp bovis AF2122/97
gacgucugccaggc

SEQ ID NO: 3061609 - RNA, 22 nt, Mycobacterium bovis subsp bovis AF2122/97
gacgucuucgggcucguccagc

SEQ ID NO: 3061610 - RNA, 17 nt, Mycobacterium bovis subsp bovis AF2122/97
gacgugaagaugcccuu

SEQ ID NO: 3061611 - RNA, 15 nt, Mycobacterium bovis subsp bovis AF2122/97
gacgugaaugguggu

SEQ ID NO: 3061612 - RNA, 23 nt, Mycobacterium bovis subsp bovis AF2122/97
gacgugaaugguggugucggcga

SEQ ID NO: 3061613 - RNA, 18 nt, Mycobacterium bovis subsp bovis AF2122/97
gacgugacaacugcgccg

SEQ ID NO: 3061614 - RNA, 22 nt, Mycobacterium bovis subsp bovis AF2122/97
gacgugacaacugcgccggugc

SEQ ID NO: 3061615 - RNA, 23 nt, Mycobacterium bovis subsp bovis AF2122/97
gacgugacaacugcgccggugcc

SEQ ID NO: 3061616 - RNA, 17 nt, Mycobacterium bovis subsp bovis AF2122/97
gacgugaccagcuucgg

SEQ ID NO: 3061617 - RNA, 20 nt, Mycobacterium bovis subsp bovis AF2122/97
gacgugagggucaugucgau

SEQ ID NO: 3061618 - RNA, 18 nt, Mycobacterium bovis subsp bovis AF2122/97
gacgugaguuucaccacu

SEQ ID NO: 3061619 - RNA, 16 nt, Mycobacterium bovis subsp bovis AF2122/97
gacgugaucgcggucc

SEQ ID NO: 3061620 - RNA, 18 nt, Mycobacterium bovis subsp bovis AF2122/97
gacgugcagccgcaggug

SEQ ID NO: 3061621 - RNA, 15 nt, Mycobacterium bovis subsp bovis AF2122/97
gacgugcaggaacac

SEQ ID NO: 3061622 - RNA, 18 nt, Mycobacterium bovis subsp bovis AF2122/97
gacgugcaggaacaccca

SEQ ID NO: 3061623 - RNA, 15 nt, Mycobacterium bovis subsp bovis AF2122/97
gacgugcccugacgc

SEQ ID NO: 3061624 - RNA, 12 nt, Mycobacterium bovis subsp bovis AF2122/97
gacgugccgggu

SEQ ID NO: 3061625 - RNA, 21 nt, Mycobacterium bovis subsp bovis AF2122/97
gacgugcgcgccaaguggcgc

SEQ ID NO: 3061626 - RNA, 12 nt, Mycobacterium bovis subsp bovis AF2122/97
gacgugcgcggc

SEQ ID NO: 3061627 - RNA, 13 nt, Mycobacterium bovis subsp bovis AF2122/97
gacgugcgcggca

SEQ ID NO: 3061628 - RNA, 14 nt, Mycobacterium bovis subsp bovis AF2122/97
gacgugcgcggcau

SEQ ID NO: 3061629 - RNA, 19 nt, Mycobacterium bovis subsp bovis AF2122/97
gacgugcggcgcggcgaca

SEQ ID NO: 3061630 - RNA, 14 nt, Mycobacterium bovis subsp bovis AF2122/97
gacgugcggcggcc

SEQ ID NO: 3061631 - RNA, 19 nt, Mycobacterium bovis subsp bovis AF2122/97
gacguggaacugcagcggc

SEQ ID NO: 3061632 - RNA, 15 nt, Mycobacterium bovis subsp bovis AF2122/97
gacguggaugguggu

SEQ ID NO: 3061633 - RNA, 20 nt, Mycobacterium bovis subsp bovis AF2122/97
gacguggcugcguucgccgg

SEQ ID NO: 3061634 - RNA, 21 nt, Mycobacterium bovis subsp bovis AF2122/97
gacguggcugcguucgccgga

SEQ ID NO: 3061635 - RNA, 23 nt, Mycobacterium bovis subsp bovis AF2122/97
gacgugggcgcuggugcgcccau

SEQ ID NO: 3061636 - RNA, 22 nt, Mycobacterium bovis subsp bovis AF2122/97
gacgugguguaucgacggcggc

SEQ ID NO: 3061637 - RNA, 23 nt, Mycobacterium bovis subsp bovis AF2122/97
gacgugguguaucgacggcggcc

SEQ ID NO: 3061638 - RNA, 21 nt, Mycobacterium bovis subsp bovis AF2122/97
gacgugugagggccggguggc

SEQ ID NO: 3061639 - RNA, 19 nt, Mycobacterium bovis subsp bovis AF2122/97
gacucguggcgccacggca

SEQ ID NO: 3061640 - RNA, 18 nt, Mycobacterium bovis subsp bovis AF2122/97
gacucgugucugccucgg

SEQ ID NO: 3061641 - RNA, 23 nt, Mycobacterium bovis subsp bovis AF2122/97
gacucucaucaacucgacccggc

SEQ ID NO: 3061642 - RNA, 17 nt, Mycobacterium bovis subsp bovis AF2122/97
gacucugccacccagca

SEQ ID NO: 3061643 - RNA, 19 nt, Mycobacterium bovis subsp bovis AF2122/97
gacucugccacccagcacg

SEQ ID NO: 3061644 - RNA, 20 nt, Mycobacterium bovis subsp bovis AF2122/97
gacucugccacccagcacgc

SEQ ID NO: 3061645 - RNA, 19 nt, Mycobacterium bovis subsp bovis AF2122/97
gacucugcguccaccacgc

SEQ ID NO: 3061646 - RNA, 20 nt, Mycobacterium bovis subsp bovis AF2122/97
gacucugcguccaccacgca

SEQ ID NO: 3061647 - RNA, 18 nt, Mycobacterium bovis subsp bovis AF2122/97
gacucugcgucugcucac

SEQ ID NO: 3061648 - RNA, 18 nt, Mycobacterium bovis subsp bovis AF2122/97
gacucuucggaccggcuc

SEQ ID NO: 3061649 - RNA, 14 nt, Mycobacterium bovis subsp bovis AF2122/97
gacugaacaccaaa

SEQ ID NO: 3061650 - RNA, 21 nt, Mycobacterium bovis subsp bovis AF2122/97
gacugaacaguugcacaccgg

SEQ ID NO: 3061651 - RNA, 14 nt, Mycobacterium bovis subsp bovis AF2122/97
gacugaaucgaccg

SEQ ID NO: 3061652 - RNA, 16 nt, Mycobacterium bovis subsp bovis AF2122/97
gacugaaucgaccgga

SEQ ID NO: 3061653 - RNA, 17 nt, Mycobacterium bovis subsp bovis AF2122/97
gacugaccgucugcgac

SEQ ID NO: 3061654 - RNA, 12 nt, Mycobacterium bovis subsp bovis AF2122/97
gacugacgguca

SEQ ID NO: 3061655 - RNA, 18 nt, Mycobacterium bovis subsp bovis AF2122/97
gacugauccucgaugaca

SEQ ID NO: 3061656 - RNA, 19 nt, Mycobacterium bovis subsp bovis AF2122/97
gacugauccucgaugacau

SEQ ID NO: 3061657 - RNA, 15 nt, Mycobacterium bovis subsp bovis AF2122/97
gacugaucgccaccc

SEQ ID NO: 3061658 - RNA, 17 nt, Mycobacterium bovis subsp bovis AF2122/97
gacugaucgcgauccac

SEQ ID NO: 3061659 - RNA, 18 nt, Mycobacterium bovis subsp bovis AF2122/97
gacugaucuguggguggu

SEQ ID NO: 3061660 - RNA, 14 nt, Mycobacterium bovis subsp bovis AF2122/97
gacugcacaccacc

SEQ ID NO: 3061661 - RNA, 15 nt, Mycobacterium bovis subsp bovis AF2122/97
gacugcacaccaccg

SEQ ID NO: 3061662 - RNA, 22 nt, Mycobacterium bovis subsp bovis AF2122/97
gacugcacaccaccgccgaaca

SEQ ID NO: 3061663 - RNA, 13 nt, Mycobacterium bovis subsp bovis AF2122/97
gacugcaccuggc

SEQ ID NO: 3061664 - RNA, 18 nt, Mycobacterium bovis subsp bovis AF2122/97
gacugcagaaacagccgc

SEQ ID NO: 3061665 - RNA, 22 nt, Mycobacterium bovis subsp bovis AF2122/97
gacugcagaaacagccgcagcg

SEQ ID NO: 3061666 - RNA, 13 nt, Mycobacterium bovis subsp bovis AF2122/97
gacugcagcccgu

SEQ ID NO: 3061667 - RNA, 17 nt, Mycobacterium bovis subsp bovis AF2122/97
gacugcagcccugcgca

SEQ ID NO: 3061668 - RNA, 15 nt, Mycobacterium bovis subsp bovis AF2122/97
gacugcagcgaagcc

SEQ ID NO: 3061669 - RNA, 15 nt, Mycobacterium bovis subsp bovis AF2122/97
gacugcagcgccucg

SEQ ID NO: 3061670 - RNA, 17 nt, Mycobacterium bovis subsp bovis AF2122/97
gacugcagcgcggccgg

SEQ ID NO: 3061671 - RNA, 16 nt, Mycobacterium bovis subsp bovis AF2122/97
gacugcagcgcggugg

SEQ ID NO: 3061672 - RNA, 17 nt, Mycobacterium bovis subsp bovis AF2122/97
gacugcagcgcgguggu

SEQ ID NO: 3061673 - RNA, 13 nt, Mycobacterium bovis subsp bovis AF2122/97
gacugcagcggcg

SEQ ID NO: 3061674 - RNA, 16 nt, Mycobacterium bovis subsp bovis AF2122/97
gacugcagcggcgcau

SEQ ID NO: 3061675 - RNA, 21 nt, Mycobacterium bovis subsp bovis AF2122/97
gacugcaguaguagcgcaacc

SEQ ID NO: 3061676 - RNA, 12 nt, Mycobacterium bovis subsp bovis AF2122/97
gacugccgccgc

SEQ ID NO: 3061677 - RNA, 17 nt, Mycobacterium bovis subsp bovis AF2122/97
gacugccguucagcggc

SEQ ID NO: 3061678 - RNA, 20 nt, Mycobacterium bovis subsp bovis AF2122/97
gacugccguucagcggcggg

SEQ ID NO: 3061679 - RNA, 14 nt, Mycobacterium bovis subsp bovis AF2122/97
gacugcgccaccgg

SEQ ID NO: 3061680 - RNA, 12 nt, Mycobacterium bovis subsp bovis AF2122/97
gacugcgcccau

SEQ ID NO: 3061681 - RNA, 13 nt, Mycobacterium bovis subsp bovis AF2122/97
gacugcgccgccg

SEQ ID NO: 3061682 - RNA, 14 nt, Mycobacterium bovis subsp bovis AF2122/97
gacugcgccgccgg

SEQ ID NO: 3061683 - RNA, 12 nt, Mycobacterium bovis subsp bovis AF2122/97
gacugcgcggca

SEQ ID NO: 3061684 - RNA, 15 nt, Mycobacterium bovis subsp bovis AF2122/97
gacugcgcggcacuu

SEQ ID NO: 3061685 - RNA, 16 nt, Mycobacterium bovis subsp bovis AF2122/97
gacugcggguucgccg

SEQ ID NO: 3061686 - RNA, 14 nt, Mycobacterium bovis subsp bovis AF2122/97
gacugcggucugga

SEQ ID NO: 3061687 - RNA, 14 nt, Mycobacterium bovis subsp bovis AF2122/97
gacugcgucggcgg

SEQ ID NO: 3061688 - RNA, 16 nt, Mycobacterium bovis subsp bovis AF2122/97
gacugcgucggcggcu

SEQ ID NO: 3061689 - RNA, 17 nt, Mycobacterium bovis subsp bovis AF2122/97
gacugcguuccgaucgg

SEQ ID NO: 3061690 - RNA, 14 nt, Mycobacterium bovis subsp bovis AF2122/97
gacugcuggggguc

SEQ ID NO: 3061691 - RNA, 15 nt, Mycobacterium bovis subsp bovis AF2122/97
gacuggaaggcgggc

SEQ ID NO: 3061692 - RNA, 15 nt, Mycobacterium bovis subsp bovis AF2122/97
gacuggaucgcgaug

SEQ ID NO: 3061693 - RNA, 15 nt, Mycobacterium bovis subsp bovis AF2122/97
gacuggcaccgccag

SEQ ID NO: 3061694 - RNA, 16 nt, Mycobacterium bovis subsp bovis AF2122/97
gacuggcaccgccagc

SEQ ID NO: 3061695 - RNA, 12 nt, Mycobacterium bovis subsp bovis AF2122/97
gacuggccgccc

SEQ ID NO: 3061696 - RNA, 14 nt, Mycobacterium bovis subsp bovis AF2122/97
gacuggccgcccgg

SEQ ID NO: 3061697 - RNA, 15 nt, Mycobacterium bovis subsp bovis AF2122/97
gacuggccgcccggc

SEQ ID NO: 3061698 - RNA, 16 nt, Mycobacterium bovis subsp bovis AF2122/97
gacuggccguuucggc

SEQ ID NO: 3061699 - RNA, 14 nt, Mycobacterium bovis subsp bovis AF2122/97
gacugggacgacgc

SEQ ID NO: 3061700 - RNA, 16 nt, Mycobacterium bovis subsp bovis AF2122/97
gacugggacgacgcca

SEQ ID NO: 3061701 - RNA, 17 nt, Mycobacterium bovis subsp bovis AF2122/97
gacugggcaaacccgga

SEQ ID NO: 3061702 - RNA, 18 nt, Mycobacterium bovis subsp bovis AF2122/97
gacugggccaggucggcg

SEQ ID NO: 3061703 - RNA, 19 nt, Mycobacterium bovis subsp bovis AF2122/97
gacugggccaggucggcga

SEQ ID NO: 3061704 - RNA, 13 nt, Mycobacterium bovis subsp bovis AF2122/97
gacugggcgcugg

SEQ ID NO: 3061705 - RNA, 15 nt, Mycobacterium bovis subsp bovis AF2122/97
gacugggcgcuggag

SEQ ID NO: 3061706 - RNA, 15 nt, Mycobacterium bovis subsp bovis AF2122/97
gacuggggcgccacc

SEQ ID NO: 3061707 - RNA, 16 nt, Mycobacterium bovis subsp bovis AF2122/97
gacuggucacugcccu

SEQ ID NO: 3061708 - RNA, 23 nt, Mycobacterium bovis subsp bovis AF2122/97
gacuggugccugccgcacguucg

SEQ ID NO: 3061709 - RNA, 10 nt, Mycobacterium bovis subsp bovis AF2122/97
gacuguccca

SEQ ID NO: 3061710 - RNA, 16 nt, Mycobacterium bovis subsp bovis AF2122/97
gacugucccaccaggu

SEQ ID NO: 3061711 - RNA, 17 nt, Mycobacterium bovis subsp bovis AF2122/97
gacugucccaccaggua

SEQ ID NO: 3061712 - RNA, 21 nt, Mycobacterium bovis subsp bovis AF2122/97
gacugucccaccagguacgcg

SEQ ID NO: 3061713 - RNA, 17 nt, Mycobacterium bovis subsp bovis AF2122/97
gacugucuggucggcua

SEQ ID NO: 3061714 - RNA, 20 nt, Mycobacterium bovis subsp bovis AF2122/97
gacugugaaucucacgacgc

SEQ ID NO: 3061715 - RNA, 22 nt, Mycobacterium bovis subsp bovis AF2122/97
gacugugaaucugacgacgcga

SEQ ID NO: 3061716 - RNA, 12 nt, Mycobacterium bovis subsp bovis AF2122/97
gacuguggcgcc

SEQ ID NO: 3061717 - RNA, 22 nt, Mycobacterium bovis subsp bovis AF2122/97
gacuuagcgggugccagcccgu

SEQ ID NO: 3061718 - RNA, 15 nt, Mycobacterium bovis subsp bovis AF2122/97
gacuucacucguuga

SEQ ID NO: 3061719 - RNA, 21 nt, Mycobacterium bovis subsp bovis AF2122/97
gacuucagcaggcccagcgga

SEQ ID NO: 3061720 - RNA, 13 nt, Mycobacterium bovis subsp bovis AF2122/97
gacuucagcggcc

SEQ ID NO: 3061721 - RNA, 16 nt, Mycobacterium bovis subsp bovis AF2122/97
gacuucccgcgcgagc

SEQ ID NO: 3061722 - RNA, 16 nt, Mycobacterium bovis subsp bovis AF2122/97
gacuuccgcgucgccg

SEQ ID NO: 3061723 - RNA, 19 nt, Mycobacterium bovis subsp bovis AF2122/97
gacuuccgcgucgccggcc

SEQ ID NO: 3061724 - RNA, 18 nt, Mycobacterium bovis subsp bovis AF2122/97
gacuucgacgcggcgacc

SEQ ID NO: 3061725 - RNA, 19 nt, Mycobacterium bovis subsp bovis AF2122/97
gacuucgacgcggcgaccg

SEQ ID NO: 3061726 - RNA, 17 nt, Mycobacterium bovis subsp bovis AF2122/97
gacuucgagauugccga

SEQ ID NO: 3061727 - RNA, 13 nt, Mycobacterium bovis subsp bovis AF2122/97
gacuucggcgucg

SEQ ID NO: 3061728 - RNA, 18 nt, Mycobacterium bovis subsp bovis AF2122/97
gacuucgggaacgcucgu

SEQ ID NO: 3061729 - RNA, 21 nt, Mycobacterium bovis subsp bovis AF2122/97
gacuucgggaacgcucgucga

SEQ ID NO: 3061730 - RNA, 18 nt, Mycobacterium bovis subsp bovis AF2122/97
gacuucggggucaccggc

SEQ ID NO: 3061731 - RNA, 19 nt, Mycobacterium bovis subsp bovis AF2122/97
gacuucgguguagcccagc

SEQ ID NO: 3061732 - RNA, 14 nt, Mycobacterium bovis subsp bovis AF2122/97
gacuugauuucgau

SEQ ID NO: 3061733 - RNA, 18 nt, Mycobacterium bovis subsp bovis AF2122/97
gacuugauuucgaucgcg

SEQ ID NO: 3061734 - RNA, 21 nt, Mycobacterium bovis subsp bovis AF2122/97
gacuugauuucgaucgcggca

SEQ ID NO: 3061735 - RNA, 23 nt, Mycobacterium bovis subsp bovis AF2122/97
gacuugauuucgaucgcggcaau

SEQ ID NO: 3061736 - RNA, 14 nt, Mycobacterium bovis subsp bovis AF2122/97
gacuugcaggcguc

SEQ ID NO: 3061737 - RNA, 18 nt, Mycobacterium bovis subsp bovis AF2122/97
gacuugcaggcgucccag

SEQ ID NO: 3061738 - RNA, 19 nt, Mycobacterium bovis subsp bovis AF2122/97
gacuugcgacccgucgaac

SEQ ID NO: 3061739 - RNA, 21 nt, Mycobacterium bovis subsp bovis AF2122/97
gacuuggcaucgcgagccagc

SEQ ID NO: 3061740 - RNA, 17 nt, Mycobacterium bovis subsp bovis AF2122/97
gacuuggccaugcuggu

SEQ ID NO: 3061741 - RNA, 14 nt, Mycobacterium bovis subsp bovis AF2122/97
gacuuggcggucgg

SEQ ID NO: 3061742 - RNA, 19 nt, Mycobacterium bovis subsp bovis AF2122/97
gacuuggugauccgagacc

SEQ ID NO: 3061743 - RNA, 17 nt, Mycobacterium bovis subsp bovis AF2122/97
gacuugguugccgccuu

SEQ ID NO: 3061744 - RNA, 15 nt, Mycobacterium bovis subsp bovis AF2122/97
gacuuugggucggcg

SEQ ID NO: 3061745 - RNA, 16 nt, Mycobacterium bovis subsp bovis AF2122/97
gacuuugggucggcga

SEQ ID NO: 3061746 - RNA, 17 nt, Mycobacterium bovis subsp bovis AF2122/97
gacuuugggucggcgau

SEQ ID NO: 3061747 - RNA, 23 nt, Mycobacterium bovis subsp bovis AF2122/97
gacuuugggucggcgauggcggc

SEQ ID NO: 3061748 - RNA, 23 nt, Mycobacterium bovis subsp bovis AF2122/97
gagaaaacggcggcgccgguggu

SEQ ID NO: 3061749 - RNA, 23 nt, Mycobacterium bovis subsp bovis AF2122/97
gagaaaagcgcgcuacgcggccg

SEQ ID NO: 3061750 - RNA, 14 nt, Mycobacterium bovis subsp bovis AF2122/97
gagaaacacgacag

SEQ ID NO: 3061751 - RNA, 18 nt, Mycobacterium bovis subsp bovis AF2122/97
gagaaacccgaaguagaa

SEQ ID NO: 3061752 - RNA, 14 nt, Mycobacterium bovis subsp bovis AF2122/97
gagaaauggcccga

SEQ ID NO: 3061753 - RNA, 18 nt, Mycobacterium bovis subsp bovis AF2122/97
gagaacacguucggcguc

SEQ ID NO: 3061754 - RNA, 19 nt, Mycobacterium bovis subsp bovis AF2122/97
gagaacacguucggcgucg

SEQ ID NO: 3061755 - RNA, 17 nt, Mycobacterium bovis subsp bovis AF2122/97
gagaacgauguccgcgc

SEQ ID NO: 3061756 - RNA, 15 nt, Mycobacterium bovis subsp bovis AF2122/97
gagaacguagggugg

SEQ ID NO: 3061757 - RNA, 20 nt, Mycobacterium bovis subsp bovis AF2122/97
gagaacucaauaguguguuu

SEQ ID NO: 3061758 - RNA, 17 nt, Mycobacterium bovis subsp bovis AF2122/97
gagaacuccgccaccau

SEQ ID NO: 3061759 - RNA, 13 nt, Mycobacterium bovis subsp bovis AF2122/97
gagaacuccggga

SEQ ID NO: 3061760 - RNA, 17 nt, Mycobacterium bovis subsp bovis AF2122/97
gagaacucugcgagaug

SEQ ID NO: 3061761 - RNA, 15 nt, Mycobacterium bovis subsp bovis AF2122/97
gagaagaagcccagg

SEQ ID NO: 3061762 - RNA, 15 nt, Mycobacterium bovis subsp bovis AF2122/97
gagaagacaccgcgc

SEQ ID NO: 3061763 - RNA, 17 nt, Mycobacterium bovis subsp bovis AF2122/97
gagaagguuucccgcuu

SEQ ID NO: 3061764 - RNA, 19 nt, Mycobacterium bovis subsp bovis AF2122/97
gagaaugcugacggugcag

SEQ ID NO: 3061765 - RNA, 21 nt, Mycobacterium bovis subsp bovis AF2122/97
gagaaugcugacggugcagga

SEQ ID NO: 3061766 - RNA, 14 nt, Mycobacterium bovis subsp bovis AF2122/97
gagaauuccccagc

SEQ ID NO: 3061767 - RNA, 17 nt, Mycobacterium bovis subsp bovis AF2122/97
gagacagcagcguucgg

SEQ ID NO: 3061768 - RNA, 23 nt, Mycobacterium bovis subsp bovis AF2122/97
gagacagcgccaugcccucggcg

SEQ ID NO: 3061769 - RNA, 19 nt, Mycobacterium bovis subsp bovis AF2122/97
gagacaugucgcugccgcc

SEQ ID NO: 3061770 - RNA, 22 nt, Mycobacterium bovis subsp bovis AF2122/97
gagacaugucgcugccgccgcc

SEQ ID NO: 3061771 - RNA, 18 nt, Mycobacterium bovis subsp bovis AF2122/97
gagacauugacgaggcga

SEQ ID NO: 3061772 - RNA, 14 nt, Mycobacterium bovis subsp bovis AF2122/97
gagaccaugccgac

SEQ ID NO: 3061773 - RNA, 12 nt, Mycobacterium bovis subsp bovis AF2122/97
gagaccccgcgc

SEQ ID NO: 3061774 - RNA, 21 nt, Mycobacterium bovis subsp bovis AF2122/97
gagaccgccucgucgaugccu

SEQ ID NO: 3061775 - RNA, 16 nt, Mycobacterium bovis subsp bovis AF2122/97
gagaccgcgagcagca

SEQ ID NO: 3061776 - RNA, 20 nt, Mycobacterium bovis subsp bovis AF2122/97
gagaccggccgggugaacca

SEQ ID NO: 3061777 - RNA, 22 nt, Mycobacterium bovis subsp bovis AF2122/97
gagaccuagcagggugccggcg

SEQ ID NO: 3061778 - RNA, 18 nt, Mycobacterium bovis subsp bovis AF2122/97
gagaccuucgggguaguu

SEQ ID NO: 3061779 - RNA, 16 nt, Mycobacterium bovis subsp bovis AF2122/97
gagacgaaccgccgac

SEQ ID NO: 3061780 - RNA, 17 nt, Mycobacterium bovis subsp bovis AF2122/97
gagacgaaccgccgacg

SEQ ID NO: 3061781 - RNA, 21 nt, Mycobacterium bovis subsp bovis AF2122/97
gagacgaucaucucgucgucg

SEQ ID NO: 3061782 - RNA, 13 nt, Mycobacterium bovis subsp bovis AF2122/97
gagacgaucgcca

SEQ ID NO: 3061783 - RNA, 15 nt, Mycobacterium bovis subsp bovis AF2122/97
gagacgaucgccagg

SEQ ID NO: 3061784 - RNA, 15 nt, Mycobacterium bovis subsp bovis AF2122/97
gagacgcaaaaucgc

SEQ ID NO: 3061785 - RNA, 17 nt, Mycobacterium bovis subsp bovis AF2122/97
gagacgcaaaaucgccc

SEQ ID NO: 3061786 - RNA, 18 nt, Mycobacterium bovis subsp bovis AF2122/97
gagacgcaaaaucgcccg

SEQ ID NO: 3061787 - RNA, 17 nt, Mycobacterium bovis subsp bovis AF2122/97
gagacgcacggccaccg

SEQ ID NO: 3061788 - RNA, 22 nt, Mycobacterium bovis subsp bovis AF2122/97
gagacgcaugucgggccaggcg

SEQ ID NO: 3061789 - RNA, 13 nt, Mycobacterium bovis subsp bovis AF2122/97
gagacgccgucga

SEQ ID NO: 3061790 - RNA, 16 nt, Mycobacterium bovis subsp bovis AF2122/97
gagacgcuccaguggc

SEQ ID NO: 3061791 - RNA, 20 nt, Mycobacterium bovis subsp bovis AF2122/97
gagacgcuccaguggcgcca

SEQ ID NO: 3061792 - RNA, 21 nt, Mycobacterium bovis subsp bovis AF2122/97
gagacgcuuuccgccgcaccg

SEQ ID NO: 3061793 - RNA, 18 nt, Mycobacterium bovis subsp bovis AF2122/97
gagacgguguugccuaag

SEQ ID NO: 3061794 - RNA, 17 nt, Mycobacterium bovis subsp bovis AF2122/97
gagacguaaccgcuggc

SEQ ID NO: 3061795 - RNA, 23 nt, Mycobacterium bovis subsp bovis AF2122/97
gagacguuaucgguucgcucggg

SEQ ID NO: 3061796 - RNA, 15 nt, Mycobacterium bovis subsp bovis AF2122/97
gagacguuuugcggc

SEQ ID NO: 3061797 - RNA, 18 nt, Mycobacterium bovis subsp bovis AF2122/97
gagacguuuugcggcccg

SEQ ID NO: 3061798 - RNA, 19 nt, Mycobacterium bovis subsp bovis AF2122/97
gagacguuuugcggcccgg

SEQ ID NO: 3061799 - RNA, 14 nt, Mycobacterium bovis subsp bovis AF2122/97
gagacuccagcaag

SEQ ID NO: 3061800 - RNA, 12 nt, Mycobacterium bovis subsp bovis AF2122/97
gagacugccgcc

SEQ ID NO: 3061801 - RNA, 22 nt, Mycobacterium bovis subsp bovis AF2122/97
gagagaucgucgacccaccaug

SEQ ID NO: 3061802 - RNA, 16 nt, Mycobacterium bovis subsp bovis AF2122/97
gagagauggucgggcg

SEQ ID NO: 3061803 - RNA, 15 nt, Mycobacterium bovis subsp bovis AF2122/97
gagagcaccgcucgg

SEQ ID NO: 3061804 - RNA, 12 nt, Mycobacterium bovis subsp bovis AF2122/97
gagagcacuggg

SEQ ID NO: 3061805 - RNA, 22 nt, Mycobacterium bovis subsp bovis AF2122/97
gagagcacugggcuggccagca

SEQ ID NO: 3061806 - RNA, 18 nt, Mycobacterium bovis subsp bovis AF2122/97
gagagcagccagccaccg

SEQ ID NO: 3061807 - RNA, 18 nt, Mycobacterium bovis subsp bovis AF2122/97
gagagcaguacgucugcg

SEQ ID NO: 3061808 - RNA, 21 nt, Mycobacterium bovis subsp bovis AF2122/97
gagagcaguacgucugcgucc

SEQ ID NO: 3061809 - RNA, 19 nt, Mycobacterium bovis subsp bovis AF2122/97
gagagccaaaggcggcuug

SEQ ID NO: 3061810 - RNA, 13 nt, Mycobacterium bovis subsp bovis AF2122/97
gagagccggcggc

SEQ ID NO: 3061811 - RNA, 13 nt, Mycobacterium bovis subsp bovis AF2122/97
gagagccucggcc

SEQ ID NO: 3061812 - RNA, 14 nt, Mycobacterium bovis subsp bovis AF2122/97
gagcaccugggcgc

SEQ ID NO: 3061813 - RNA, 16 nt, Mycobacterium bovis subsp bovis AF2122/97
gagcaccugggcgcgc

SEQ ID NO: 3061814 - RNA, 18 nt, Mycobacterium bovis subsp bovis AF2122/97
gagcacgacgacgucggg

SEQ ID NO: 3061815 - RNA, 14 nt, Mycobacterium bovis subsp bovis AF2122/97
gagcacgccgacca

SEQ ID NO: 3061816 - RNA, 17 nt, Mycobacterium bovis subsp bovis AF2122/97
gagcacggcgcggcgga

SEQ ID NO: 3061817 - RNA, 21 nt, Mycobacterium bovis subsp bovis AF2122/97
gagcacggcgcggcggagugc

SEQ ID NO: 3061818 - RNA, 20 nt, Mycobacterium bovis subsp bovis AF2122/97
gagcacggguagcguccagg

SEQ ID NO: 3061819 - RNA, 16 nt, Mycobacterium bovis subsp bovis AF2122/97
gagcacguucaccgcg

SEQ ID NO: 3061820 - RNA, 21 nt, Mycobacterium bovis subsp bovis AF2122/97
gagcacguucaccgcgcgcuc

SEQ ID NO: 3061821 - RNA, 23 nt, Mycobacterium bovis subsp bovis AF2122/97
gagcacguucaccgcgcgcucgc

SEQ ID NO: 3061822 - RNA, 13 nt, Mycobacterium bovis subsp bovis AF2122/97
gagcacuacccca

SEQ ID NO: 3061823 - RNA, 15 nt, Mycobacterium bovis subsp bovis AF2122/97
gagcacucccugguu

SEQ ID NO: 3061824 - RNA, 14 nt, Mycobacterium bovis subsp bovis AF2122/97
gagcacuccggagc

SEQ ID NO: 3061825 - RNA, 16 nt, Mycobacterium bovis subsp bovis AF2122/97
gagcacuccgucguag

SEQ ID NO: 3061826 - RNA, 21 nt, Mycobacterium bovis subsp bovis AF2122/97
gagcacugggcuggccagcac

SEQ ID NO: 3061827 - RNA, 20 nt, Mycobacterium bovis subsp bovis AF2122/97
gagcagaaacaacgucgccg

SEQ ID NO: 3061828 - RNA, 14 nt, Mycobacterium bovis subsp bovis AF2122/97
gagcagaaggccag

SEQ ID NO: 3061829 - RNA, 21 nt, Mycobacterium bovis subsp bovis AF2122/97
gagcagacacagaaucgcacg

SEQ ID NO: 3061830 - RNA, 21 nt, Mycobacterium bovis subsp bovis AF2122/97
gagcagacacagaaucgccca

SEQ ID NO: 3061831 - RNA, 18 nt, Mycobacterium bovis subsp bovis AF2122/97
gagcagacacuaaagccc

SEQ ID NO: 3061832 - RNA, 20 nt, Mycobacterium bovis subsp bovis AF2122/97
gagcagacacuaaagcccuc

SEQ ID NO: 3061833 - RNA, 21 nt, Mycobacterium bovis subsp bovis AF2122/97
gagcagacccaguccgguagc

SEQ ID NO: 3061834 - RNA, 17 nt, Mycobacterium bovis subsp bovis AF2122/97
gagcagacgcaaaagcc

SEQ ID NO: 3061835 - RNA, 20 nt, Mycobacterium bovis subsp bovis AF2122/97
gagcagacgcaaaagccacc

SEQ ID NO: 3061836 - RNA, 21 nt, Mycobacterium bovis subsp bovis AF2122/97
gagcagacgcaaaagcccccu

SEQ ID NO: 3061837 - RNA, 15 nt, Mycobacterium bovis subsp bovis AF2122/97
gagcagacgcaaaau

SEQ ID NO: 3061838 - RNA, 20 nt, Mycobacterium bovis subsp bovis AF2122/97
gagcagacgcaaaauccccu

SEQ ID NO: 3061839 - RNA, 21 nt, Mycobacterium bovis subsp bovis AF2122/97
gagcagacgcaaaaucgccca

SEQ ID NO: 3061840 - RNA, 19 nt, Mycobacterium bovis subsp bovis AF2122/97
gagcagacgcagaagcccc

SEQ ID NO: 3061841 - RNA, 21 nt, Mycobacterium bovis subsp bovis AF2122/97
gagcagacgcagaagccccca

SEQ ID NO: 3061842 - RNA, 21 nt, Mycobacterium bovis subsp bovis AF2122/97
gagcagacgcagaaucgcacg

SEQ ID NO: 3061843 - RNA, 21 nt, Mycobacterium bovis subsp bovis AF2122/97
gagcagacgcagaaucgccca

SEQ ID NO: 3061844 - RNA, 23 nt, Mycobacterium bovis subsp bovis AF2122/97
gagcagacgcagagucgcacugc

SEQ ID NO: 3061845 - RNA, 18 nt, Mycobacterium bovis subsp bovis AF2122/97
gagcagacgcauaagccc

SEQ ID NO: 3061846 - RNA, 20 nt, Mycobacterium bovis subsp bovis AF2122/97
gagcagacgcauaagccccc

SEQ ID NO: 3061847 - RNA, 21 nt, Mycobacterium bovis subsp bovis AF2122/97
gagcagacgcauaagcccccg

SEQ ID NO: 3061848 - RNA, 12 nt, Mycobacterium bovis subsp bovis AF2122/97
gagcagacgcga

SEQ ID NO: 3061849 - RNA, 20 nt, Mycobacterium bovis subsp bovis AF2122/97
gagcagacgcgaaagcaccc

SEQ ID NO: 3061850 - RNA, 22 nt, Mycobacterium bovis subsp bovis AF2122/97
gagcagacgcgaaagcacccca

SEQ ID NO: 3061851 - RNA, 20 nt, Mycobacterium bovis subsp bovis AF2122/97
gagcagacgcgaaauccccc

SEQ ID NO: 3061852 - RNA, 21 nt, Mycobacterium bovis subsp bovis AF2122/97
gagcagacgcggaaucgcacc

SEQ ID NO: 3061853 - RNA, 22 nt, Mycobacterium bovis subsp bovis AF2122/97
gagcagacgcggaaucgcaucg

SEQ ID NO: 3061854 - RNA, 18 nt, Mycobacterium bovis subsp bovis AF2122/97
gagcagacgcuaaagccc

SEQ ID NO: 3061855 - RNA, 19 nt, Mycobacterium bovis subsp bovis AF2122/97
gagcagacgcuaaagcccc

SEQ ID NO: 3061856 - RNA, 21 nt, Mycobacterium bovis subsp bovis AF2122/97
gagcagacgcuaaagcccccg

SEQ ID NO: 3061857 - RNA, 17 nt, Mycobacterium bovis subsp bovis AF2122/97
gagcagacguaaaagcc

SEQ ID NO: 3061858 - RNA, 21 nt, Mycobacterium bovis subsp bovis AF2122/97
gagcagacguaaaagccccca

SEQ ID NO: 3061859 - RNA, 17 nt, Mycobacterium bovis subsp bovis AF2122/97
gagcagagaaaccgcga

SEQ ID NO: 3061860 - RNA, 16 nt, Mycobacterium bovis subsp bovis AF2122/97
gagcagaucagcacgu

SEQ ID NO: 3061861 - RNA, 18 nt, Mycobacterium bovis subsp bovis AF2122/97
gagcagcaagaccgcgcc

SEQ ID NO: 3061862 - RNA, 14 nt, Mycobacterium bovis subsp bovis AF2122/97
gagcagcaagccgc

SEQ ID NO: 3061863 - RNA, 15 nt, Mycobacterium bovis subsp bovis AF2122/97
gagcagcaagccgcc

SEQ ID NO: 3061864 - RNA, 18 nt, Mycobacterium bovis subsp bovis AF2122/97
gagcagcaagccgccggu

SEQ ID NO: 3061865 - RNA, 23 nt, Mycobacterium bovis subsp bovis AF2122/97
gagcagcaauccaaggcucagca

SEQ ID NO: 3061866 - RNA, 23 nt, Mycobacterium bovis subsp bovis AF2122/97
gagcagcacagcauuguccggcg

SEQ ID NO: 3061867 - RNA, 14 nt, Mycobacterium bovis subsp bovis AF2122/97
gagcagcacgucga

SEQ ID NO: 3061868 - RNA, 16 nt, Mycobacterium bovis subsp bovis AF2122/97
gagcagcacgucgaac

SEQ ID NO: 3061869 - RNA, 20 nt, Mycobacterium bovis subsp bovis AF2122/97
gagcagcacgucgaacucgu

SEQ ID NO: 3061870 - RNA, 20 nt, Mycobacterium bovis subsp bovis AF2122/97
gagcagcagaaacggcgacu

SEQ ID NO: 3061871 - RNA, 12 nt, Mycobacterium bovis subsp bovis AF2122/97
gagcagccagcc

SEQ ID NO: 3061872 - RNA, 16 nt, Mycobacterium bovis subsp bovis AF2122/97
gagcagccagccaccg

SEQ ID NO: 3061873 - RNA, 13 nt, Mycobacterium bovis subsp bovis AF2122/97
gagcagcccgcgg

SEQ ID NO: 3061874 - RNA, 18 nt, Mycobacterium bovis subsp bovis AF2122/97
gagcagcccggcgaauac

SEQ ID NO: 3061875 - RNA, 15 nt, Mycobacterium bovis subsp bovis AF2122/97
gagcagccgaaccgg

SEQ ID NO: 3061876 - RNA, 18 nt, Mycobacterium bovis subsp bovis AF2122/97
gagcagccgaaccggcac

SEQ ID NO: 3061877 - RNA, 22 nt, Mycobacterium bovis subsp bovis AF2122/97
gagcagccgaaccggcaccagc

SEQ ID NO: 3061878 - RNA, 13 nt, Mycobacterium bovis subsp bovis AF2122/97
gagcagccgaugc

SEQ ID NO: 3061879 - RNA, 22 nt, Mycobacterium bovis subsp bovis AF2122/97
gagcagccggaccguguacugg

SEQ ID NO: 3061880 - RNA, 11 nt, Mycobacterium bovis subsp bovis AF2122/97
gagcagcgcac

SEQ ID NO: 3061881 - RNA, 13 nt, Mycobacterium bovis subsp bovis AF2122/97
gagcagcgcggcc

SEQ ID NO: 3061882 - RNA, 15 nt, Mycobacterium bovis subsp bovis AF2122/97
gagcagcgcggccag

SEQ ID NO: 3061883 - RNA, 16 nt, Mycobacterium bovis subsp bovis AF2122/97
gagcagcgcggccaga

SEQ ID NO: 3061884 - RNA, 18 nt, Mycobacterium bovis subsp bovis AF2122/97
gagcagcgugggaagagc

SEQ ID NO: 3061885 - RNA, 20 nt, Mycobacterium bovis subsp bovis AF2122/97
gagcagcucggugacaagcg

SEQ ID NO: 3061886 - RNA, 14 nt, Mycobacterium bovis subsp bovis AF2122/97
gagcagcuggacca

SEQ ID NO: 3061887 - RNA, 24 nt, Mycobacterium bovis subsp bovis AF2122/97
gagcagcuuagucagggccgaggu

SEQ ID NO: 3061888 - RNA, 18 nt, Mycobacterium bovis subsp bovis AF2122/97
gagcaggcgcaccaggcg

SEQ ID NO: 3061889 - RNA, 17 nt, Mycobacterium bovis subsp bovis AF2122/97
gagcagggccggcaccg

SEQ ID NO: 3061890 - RNA, 19 nt, Mycobacterium bovis subsp bovis AF2122/97
gagcagggccggcaccgca

SEQ ID NO: 3061891 - RNA, 21 nt, Mycobacterium bovis subsp bovis AF2122/97
gagcagggccggcaccgcagc

SEQ ID NO: 3061892 - RNA, 11 nt, Mycobacterium bovis subsp bovis AF2122/97
gagcagggcgg

SEQ ID NO: 3061893 - RNA, 23 nt, Mycobacterium bovis subsp bovis AF2122/97
gagcaggggaguugcuugcaggg

SEQ ID NO: 3061894 - RNA, 15 nt, Mycobacterium bovis subsp bovis AF2122/97
gagcagguaggcgcg

SEQ ID NO: 3061895 - RNA, 16 nt, Mycobacterium bovis subsp bovis AF2122/97
gagcagguuccgcacg

SEQ ID NO: 3061896 - RNA, 22 nt, Mycobacterium bovis subsp bovis AF2122/97
gagcagguuccgcacgaucggg

SEQ ID NO: 3061897 - RNA, 14 nt, Mycobacterium bovis subsp bovis AF2122/97
gagcagugccucgg

SEQ ID NO: 3061898 - RNA, 13 nt, Mycobacterium bovis subsp bovis AF2122/97
gagccgccccggc

SEQ ID NO: 3061899 - RNA, 13 nt, Mycobacterium bovis subsp bovis AF2122/97
gagccgccgacuc

SEQ ID NO: 3061900 - RNA, 16 nt, Mycobacterium bovis subsp bovis AF2122/97
gagccgccgcgacggc

SEQ ID NO: 3061901 - RNA, 11 nt, Mycobacterium bovis subsp bovis AF2122/97
gagccgccgga

SEQ ID NO: 3061902 - RNA, 15 nt, Mycobacterium bovis subsp bovis AF2122/97
gagccgccggaucgc

SEQ ID NO: 3061903 - RNA, 11 nt, Mycobacterium bovis subsp bovis AF2122/97
gagccgccggc

SEQ ID NO: 3061904 - RNA, 15 nt, Mycobacterium bovis subsp bovis AF2122/97
gagccgccggccccg

SEQ ID NO: 3061905 - RNA, 22 nt, Mycobacterium bovis subsp bovis AF2122/97
gagccgccggccccgccagcgc

SEQ ID NO: 3061906 - RNA, 19 nt, Mycobacterium bovis subsp bovis AF2122/97
gagccgccguugccgccgg

SEQ ID NO: 3061907 - RNA, 20 nt, Mycobacterium bovis subsp bovis AF2122/97
gagccgccguugccgccggc

SEQ ID NO: 3061908 - RNA, 18 nt, Mycobacterium bovis subsp bovis AF2122/97
gagccgcgagcacgucgg

SEQ ID NO: 3061909 - RNA, 18 nt, Mycobacterium bovis subsp bovis AF2122/97
gagccgcgauguggugga

SEQ ID NO: 3061910 - RNA, 14 nt, Mycobacterium bovis subsp bovis AF2122/97
gagccgcgcgccgg

SEQ ID NO: 3061911 - RNA, 16 nt, Mycobacterium bovis subsp bovis AF2122/97
gagccgcgcgccgguu

SEQ ID NO: 3061912 - RNA, 19 nt, Mycobacterium bovis subsp bovis AF2122/97
gagccgcgcgccgguuggc

SEQ ID NO: 3061913 - RNA, 18 nt, Mycobacterium bovis subsp bovis AF2122/97
gagccgcggucaccccgg

SEQ ID NO: 3061914 - RNA, 19 nt, Mycobacterium bovis subsp bovis AF2122/97
gagccgcggucaccccggc

SEQ ID NO: 3061915 - RNA, 22 nt, Mycobacterium bovis subsp bovis AF2122/97
gagccgcguucgcgcaaaugcc

SEQ ID NO: 3061916 - RNA, 17 nt, Mycobacterium bovis subsp bovis AF2122/97
gagccgcuaggacggcg

SEQ ID NO: 3061917 - RNA, 22 nt, Mycobacterium bovis subsp bovis AF2122/97
gagccgcuaggacggcgcgagc

SEQ ID NO: 3061918 - RNA, 17 nt, Mycobacterium bovis subsp bovis AF2122/97
gagccgcugcggcaccg

SEQ ID NO: 3061919 - RNA, 23 nt, Mycobacterium bovis subsp bovis AF2122/97
gagccgcuuucccggcuggggcc

SEQ ID NO: 3061920 - RNA, 18 nt, Mycobacterium bovis subsp bovis AF2122/97
gagccggacguucuggau

SEQ ID NO: 3061921 - RNA, 18 nt, Mycobacterium bovis subsp bovis AF2122/97
gagccggcacgcgcgcuu

SEQ ID NO: 3061922 - RNA, 24 nt, Mycobacterium bovis subsp bovis AF2122/97
gagccggcacgcgcgcuucaugag

SEQ ID NO: 3061923 - RNA, 13 nt, Mycobacterium bovis subsp bovis AF2122/97
gagccggccaccu

SEQ ID NO: 3061924 - RNA, 16 nt, Mycobacterium bovis subsp bovis AF2122/97
gagccggccaccucgg

SEQ ID NO: 3061925 - RNA, 16 nt, Mycobacterium bovis subsp bovis AF2122/97
gagccggcccugcucg

SEQ ID NO: 3061926 - RNA, 21 nt, Mycobacterium bovis subsp bovis AF2122/97
gagccggcccugcucgccguc

SEQ ID NO: 3061927 - RNA, 12 nt, Mycobacterium bovis subsp bovis AF2122/97
gagccggcgccg

SEQ ID NO: 3061928 - RNA, 15 nt, Mycobacterium bovis subsp bovis AF2122/97
gagccggcgccgggu

SEQ ID NO: 3061929 - RNA, 17 nt, Mycobacterium bovis subsp bovis AF2122/97
gagccggcgccgggucg

SEQ ID NO: 3061930 - RNA, 11 nt, Mycobacterium bovis subsp bovis AF2122/97
gagccggcggc

SEQ ID NO: 3061931 - RNA, 12 nt, Mycobacterium bovis subsp bovis AF2122/97
gagccggcggcc

SEQ ID NO: 3061932 - RNA, 17 nt, Mycobacterium bovis subsp bovis AF2122/97
gagccggcuguuaggcg

SEQ ID NO: 3061933 - RNA, 18 nt, Mycobacterium bovis subsp bovis AF2122/97
gagccgggaccauagucg

SEQ ID NO: 3061934 - RNA, 19 nt, Mycobacterium bovis subsp bovis AF2122/97
gagccgggcaaccagcagc

SEQ ID NO: 3061935 - RNA, 16 nt, Mycobacterium bovis subsp bovis AF2122/97
gagccgggccguccgg

SEQ ID NO: 3061936 - RNA, 18 nt, Mycobacterium bovis subsp bovis AF2122/97
gagccgggcuauccgcgg

SEQ ID NO: 3061937 - RNA, 15 nt, Mycobacterium bovis subsp bovis AF2122/97
gagccgggcucgucg

SEQ ID NO: 3061938 - RNA, 22 nt, Mycobacterium bovis subsp bovis AF2122/97
gagccgggugcgagcgacaccg

SEQ ID NO: 3061939 - RNA, 17 nt, Mycobacterium bovis subsp bovis AF2122/97
gagccgguaaccgcguc

SEQ ID NO: 3061940 - RNA, 17 nt, Mycobacterium bovis subsp bovis AF2122/97
gagccgguagaucagcg

SEQ ID NO: 3061941 - RNA, 18 nt, Mycobacterium bovis subsp bovis AF2122/97
gagccgguauacccggcc

SEQ ID NO: 3061942 - RNA, 20 nt, Mycobacterium bovis subsp bovis AF2122/97
gagccggucuugcaucgcca

SEQ ID NO: 3061943 - RNA, 10 nt, Mycobacterium bovis subsp bovis AF2122/97
gagccgguga

SEQ ID NO: 3061944 - RNA, 15 nt, Mycobacterium bovis subsp bovis AF2122/97
gagccggugacggug

SEQ ID NO: 3061945 - RNA, 20 nt, Mycobacterium bovis subsp bovis AF2122/97
gagccggugauccggucgua

SEQ ID NO: 3061946 - RNA, 14 nt, Mycobacterium bovis subsp bovis AF2122/97
gagccggugccacu

SEQ ID NO: 3061947 - RNA, 13 nt, Mycobacterium bovis subsp bovis AF2122/97
gagccggugccga

SEQ ID NO: 3061948 - RNA, 16 nt, Mycobacterium bovis subsp bovis AF2122/97
gagccggugccgacgg

SEQ ID NO: 3061949 - RNA, 19 nt, Mycobacterium bovis subsp bovis AF2122/97
gagccggugccgacggcgc

SEQ ID NO: 3061950 - RNA, 15 nt, Mycobacterium bovis subsp bovis AF2122/97
gagccggugccgcgg

SEQ ID NO: 3061951 - RNA, 16 nt, Mycobacterium bovis subsp bovis AF2122/97
gagccggugccgcggu

SEQ ID NO: 3061952 - RNA, 14 nt, Mycobacterium bovis subsp bovis AF2122/97
gagccgguggcccg

SEQ ID NO: 3061953 - RNA, 18 nt, Mycobacterium bovis subsp bovis AF2122/97
gagccgguggcccgccgg

SEQ ID NO: 3061954 - RNA, 19 nt, Mycobacterium bovis subsp bovis AF2122/97
gagccgguggcccgccggc

SEQ ID NO: 3061955 - RNA, 20 nt, Mycobacterium bovis subsp bovis AF2122/97
gagccgguggcccgccggca

SEQ ID NO: 3061956 - RNA, 17 nt, Mycobacterium bovis subsp bovis AF2122/97
gagccguagugucggcg

SEQ ID NO: 3061957 - RNA, 19 nt, Mycobacterium bovis subsp bovis AF2122/97
gagccguagugucggcguc

SEQ ID NO: 3061958 - RNA, 16 nt, Mycobacterium bovis subsp bovis AF2122/97
gagccgucaccgacug

SEQ ID NO: 3061959 - RNA, 17 nt, Mycobacterium bovis subsp bovis AF2122/97
gagccgucacgccggau

SEQ ID NO: 3061960 - RNA, 20 nt, Mycobacterium bovis subsp bovis AF2122/97
gagccguccaauuccgcaga

SEQ ID NO: 3061961 - RNA, 18 nt, Mycobacterium bovis subsp bovis AF2122/97
gagccgucggcgccucgg

SEQ ID NO: 3061962 - RNA, 14 nt, Mycobacterium bovis subsp bovis AF2122/97
gagccgugccagca

SEQ ID NO: 3061963 - RNA, 13 nt, Mycobacterium bovis subsp bovis AF2122/97
gagccgugccucg

SEQ ID NO: 3061964 - RNA, 22 nt, Mycobacterium bovis subsp bovis AF2122/97
gagccgugccucgaggacggcg

SEQ ID NO: 3061965 - RNA, 16 nt, Mycobacterium bovis subsp bovis AF2122/97
gagccgugcggucgcg

SEQ ID NO: 3061966 - RNA, 17 nt, Mycobacterium bovis subsp bovis AF2122/97
gagccgugcggucgcgc

SEQ ID NO: 3061967 - RNA, 22 nt, Mycobacterium bovis subsp bovis AF2122/97
gagccgugcuacccauucggcg

SEQ ID NO: 3061968 - RNA, 14 nt, Mycobacterium bovis subsp bovis AF2122/97
gagccuccauggcc

SEQ ID NO: 3061969 - RNA, 20 nt, Mycobacterium bovis subsp bovis AF2122/97
gagccucggccaucugcucg

SEQ ID NO: 3061970 - RNA, 14 nt, Mycobacterium bovis subsp bovis AF2122/97
gagccucuugguca

SEQ ID NO: 3061971 - RNA, 16 nt, Mycobacterium bovis subsp bovis AF2122/97
gagccugauaaagccc

SEQ ID NO: 3061972 - RNA, 16 nt, Mycobacterium bovis subsp bovis AF2122/97
gagccugcaggccgcc

SEQ ID NO: 3061973 - RNA, 20 nt, Mycobacterium bovis subsp bovis AF2122/97
gagccugcaggccgccggcc

SEQ ID NO: 3061974 - RNA, 19 nt, Mycobacterium bovis subsp bovis AF2122/97
gagccugcucgcagcgggc

SEQ ID NO: 3061975 - RNA, 21 nt, Mycobacterium bovis subsp bovis AF2122/97
gagccugcucgcagcgggcga

SEQ ID NO: 3061976 - RNA, 10 nt, Mycobacterium bovis subsp bovis AF2122/97
gagccuuggu

SEQ ID NO: 3061977 - RNA, 18 nt, Mycobacterium bovis subsp bovis AF2122/97
gagcgaacccccgccgcg

SEQ ID NO: 3061978 - RNA, 13 nt, Mycobacterium bovis subsp bovis AF2122/97
gagcgaacggcgc

SEQ ID NO: 3061979 - RNA, 16 nt, Mycobacterium bovis subsp bovis AF2122/97
gagcgaacggcgcagu

SEQ ID NO: 3061980 - RNA, 22 nt, Mycobacterium bovis subsp bovis AF2122/97
gagcgaacgggcuuccgacaug

SEQ ID NO: 3061981 - RNA, 22 nt, Mycobacterium bovis subsp bovis AF2122/97
gagcgaccccacacgccgaacg

SEQ ID NO: 3061982 - RNA, 17 nt, Mycobacterium bovis subsp bovis AF2122/97
gagcgacccccagcgcc

SEQ ID NO: 3061983 - RNA, 20 nt, Mycobacterium bovis subsp bovis AF2122/97
gagcgaccgcgagggccagc

SEQ ID NO: 3061984 - RNA, 23 nt, Mycobacterium bovis subsp bovis AF2122/97
gagcgaccgucccagcgccgcag

SEQ ID NO: 3061985 - RNA, 16 nt, Mycobacterium bovis subsp bovis AF2122/97
gagcggccguggcaug

SEQ ID NO: 3061986 - RNA, 20 nt, Mycobacterium bovis subsp bovis AF2122/97
gagcggccuccagcacccgg

SEQ ID NO: 3061987 - RNA, 18 nt, Mycobacterium bovis subsp bovis AF2122/97
gagcggccucgggacucc

SEQ ID NO: 3061988 - RNA, 15 nt, Mycobacterium bovis subsp bovis AF2122/97
gagcggcgcgggggu

SEQ ID NO: 3061989 - RNA, 16 nt, Mycobacterium bovis subsp bovis AF2122/97
gagcggcgcgggggug

SEQ ID NO: 3061990 - RNA, 11 nt, Mycobacterium bovis subsp bovis AF2122/97
gagcggcggca

SEQ ID NO: 3061991 - RNA, 14 nt, Mycobacterium bovis subsp bovis AF2122/97
gagcggcggcacug

SEQ ID NO: 3061992 - RNA, 15 nt, Mycobacterium bovis subsp bovis AF2122/97
gagcggcggcacugg

SEQ ID NO: 3061993 - RNA, 16 nt, Mycobacterium bovis subsp bovis AF2122/97
gagcggcgugucguug

SEQ ID NO: 3061994 - RNA, 16 nt, Mycobacterium bovis subsp bovis AF2122/97
gagcgggccagcaccc

SEQ ID NO: 3061995 - RNA, 22 nt, Mycobacterium bovis subsp bovis AF2122/97
gagcgggcgggccugcgcgauc

SEQ ID NO: 3061996 - RNA, 16 nt, Mycobacterium bovis subsp bovis AF2122/97
gagcgggcuccggcuc

SEQ ID NO: 3061997 - RNA, 20 nt, Mycobacterium bovis subsp bovis AF2122/97
gagcgggugcauucgcaugu

SEQ ID NO: 3061998 - RNA, 16 nt, Mycobacterium bovis subsp bovis AF2122/97
gagcggguggccggga

SEQ ID NO: 3061999 - RNA, 15 nt, Mycobacterium bovis subsp bovis AF2122/97
gagcgguacccccca

SEQ ID NO: 3062000 - RNA, 17 nt, Mycobacterium bovis subsp bovis AF2122/97
gagcgguaccccccagc

SEQ ID NO: 3062001 - RNA, 23 nt, Mycobacterium bovis subsp bovis AF2122/97
gagcggucagcgucgaucgugcg

SEQ ID NO: 3062002 - RNA, 16 nt, Mycobacterium bovis subsp bovis AF2122/97
gagcggucgacguguu

SEQ ID NO: 3062003 - RNA, 24 nt, Mycobacterium bovis subsp bovis AF2122/97
gagcggugauugcaagcgggcacc

SEQ ID NO: 3062004 - RNA, 15 nt, Mycobacterium bovis subsp bovis AF2122/97
gagcggugccgacgg

SEQ ID NO: 3062005 - RNA, 19 nt, Mycobacterium bovis subsp bovis AF2122/97
gagcggugccgacggugau

SEQ ID NO: 3062006 - RNA, 14 nt, Mycobacterium bovis subsp bovis AF2122/97
gagcggugccggcg

SEQ ID NO: 3062007 - RNA, 20 nt, Mycobacterium bovis subsp bovis AF2122/97
gagcgguggcgucgucggcg

SEQ ID NO: 3062008 - RNA, 14 nt, Mycobacterium bovis subsp bovis AF2122/97
gagcgguggugagu

SEQ ID NO: 3062009 - RNA, 15 nt, Mycobacterium bovis subsp bovis AF2122/97
gagcgguugaucgcg

SEQ ID NO: 3062010 - RNA, 21 nt, Mycobacterium bovis subsp bovis AF2122/97
gagcgguugccuucuuggcgg

SEQ ID NO: 3062011 - RNA, 22 nt, Mycobacterium bovis subsp bovis AF2122/97
gagcguaaugcugcugcagcaa

SEQ ID NO: 3062012 - RNA, 19 nt, Mycobacterium bovis subsp bovis AF2122/97
gagcguaguucaccaacgc

SEQ ID NO: 3062013 - RNA, 17 nt, Mycobacterium bovis subsp bovis AF2122/97
gagcgucaaccacggcc

SEQ ID NO: 3062014 - RNA, 19 nt, Mycobacterium bovis subsp bovis AF2122/97
gagcgucaaccacggccgc

SEQ ID NO: 3062015 - RNA, 20 nt, Mycobacterium bovis subsp bovis AF2122/97
gagcgucaaccacggccgcc

SEQ ID NO: 3062016 - RNA, 20 nt, Mycobacterium bovis subsp bovis AF2122/97
gagcgugaaccuggcgacgc

SEQ ID NO: 3062017 - RNA, 19 nt, Mycobacterium bovis subsp bovis AF2122/97
gagcgugaagucacggcgg

SEQ ID NO: 3062018 - RNA, 19 nt, Mycobacterium bovis subsp bovis AF2122/97
gagcgugagccaugccgcu

SEQ ID NO: 3062019 - RNA, 17 nt, Mycobacterium bovis subsp bovis AF2122/97
gagcgugcccgucucgu

SEQ ID NO: 3062020 - RNA, 19 nt, Mycobacterium bovis subsp bovis AF2122/97
gagcgugccgcagcggcgg

SEQ ID NO: 3062021 - RNA, 22 nt, Mycobacterium bovis subsp bovis AF2122/97
gagcgugccgcagcggcggcaa

SEQ ID NO: 3062022 - RNA, 20 nt, Mycobacterium bovis subsp bovis AF2122/97
gagcgugcgcugguggcggc

SEQ ID NO: 3062023 - RNA, 16 nt, Mycobacterium bovis subsp bovis AF2122/97
gagcguggcaacgagc

SEQ ID NO: 3062024 - RNA, 19 nt, Mycobacterium bovis subsp bovis AF2122/97
gagcguggcaacgagcagg

SEQ ID NO: 3062025 - RNA, 21 nt, Mycobacterium bovis subsp bovis AF2122/97
gagcguggccaauccggcggc

SEQ ID NO: 3062026 - RNA, 22 nt, Mycobacterium bovis subsp bovis AF2122/97
gagcguggccaauccggcggcg

SEQ ID NO: 3062027 - RNA, 17 nt, Mycobacterium bovis subsp bovis AF2122/97
gagcguggcguuggcgg

SEQ ID NO: 3062028 - RNA, 18 nt, Mycobacterium bovis subsp bovis AF2122/97
gagcgugucuggcgaaca

SEQ ID NO: 3062029 - RNA, 14 nt, Mycobacterium bovis subsp bovis AF2122/97
gagcguucagcacg

SEQ ID NO: 3062030 - RNA, 19 nt, Mycobacterium bovis subsp bovis AF2122/97
gagcuaccgcuucccccgg

SEQ ID NO: 3062031 - RNA, 21 nt, Mycobacterium bovis subsp bovis AF2122/97
gagcuacgaccguugggauga

SEQ ID NO: 3062032 - RNA, 13 nt, Mycobacterium bovis subsp bovis AF2122/97
gagcuacgacgag

SEQ ID NO: 3062033 - RNA, 16 nt, Mycobacterium bovis subsp bovis AF2122/97
gagcuacucacgguga

SEQ ID NO: 3062034 - RNA, 14 nt, Mycobacterium bovis subsp bovis AF2122/97
gagcuagccguucg

SEQ ID NO: 3062035 - RNA, 19 nt, Mycobacterium bovis subsp bovis AF2122/97
gagcuagccguucggcugc

SEQ ID NO: 3062036 - RNA, 23 nt, Mycobacterium bovis subsp bovis AF2122/97
gagcuagccguucggcugccgcg

SEQ ID NO: 3062037 - RNA, 20 nt, Mycobacterium bovis subsp bovis AF2122/97
gagcuauucggugucgccac

SEQ ID NO: 3062038 - RNA, 14 nt, Mycobacterium bovis subsp bovis AF2122/97
gagcucaccgcaca

SEQ ID NO: 3062039 - RNA, 17 nt, Mycobacterium bovis subsp bovis AF2122/97
gagcucaccgcacaccu

SEQ ID NO: 3062040 - RNA, 22 nt, Mycobacterium bovis subsp bovis AF2122/97
gagcucaccgcacaccugcgcg

SEQ ID NO: 3062041 - RNA, 13 nt, Mycobacterium bovis subsp bovis AF2122/97
gagcucaccgggg

SEQ ID NO: 3062042 - RNA, 15 nt, Mycobacterium bovis subsp bovis AF2122/97
gagcucaccgucgag

SEQ ID NO: 3062043 - RNA, 13 nt, Mycobacterium bovis subsp bovis AF2122/97
gagcucacgccgg

SEQ ID NO: 3062044 - RNA, 14 nt, Mycobacterium bovis subsp bovis AF2122/97
gagcucaucgacga

SEQ ID NO: 3062045 - RNA, 16 nt, Mycobacterium bovis subsp bovis AF2122/97
gagcucaucuucgguc

SEQ ID NO: 3062046 - RNA, 13 nt, Mycobacterium bovis subsp bovis AF2122/97
gagcucccgccgg

SEQ ID NO: 3062047 - RNA, 15 nt, Mycobacterium bovis subsp bovis AF2122/97
gagcucccgccggga

SEQ ID NO: 3062048 - RNA, 14 nt, Mycobacterium bovis subsp bovis AF2122/97
gagcuccgucgcgg

SEQ ID NO: 3062049 - RNA, 16 nt, Mycobacterium bovis subsp bovis AF2122/97
gagcuccgucgcggcc

SEQ ID NO: 3062050 - RNA, 22 nt, Mycobacterium bovis subsp bovis AF2122/97
gagcuccgucgcggccgagacg

SEQ ID NO: 3062051 - RNA, 15 nt, Mycobacterium bovis subsp bovis AF2122/97
gagcucgaagcccgg

SEQ ID NO: 3062052 - RNA, 16 nt, Mycobacterium bovis subsp bovis AF2122/97
gagcucgaaguuggcu

SEQ ID NO: 3062053 - RNA, 22 nt, Mycobacterium bovis subsp bovis AF2122/97
gagcucgaaguuggcuuucggu

SEQ ID NO: 3062054 - RNA, 15 nt, Mycobacterium bovis subsp bovis AF2122/97
gagcucgaggcccgg

SEQ ID NO: 3062055 - RNA, 18 nt, Mycobacterium bovis subsp bovis AF2122/97
gagcucgaugucagcggc

SEQ ID NO: 3062056 - RNA, 19 nt, Mycobacterium bovis subsp bovis AF2122/97
gagcucgaugucagcggcc

SEQ ID NO: 3062057 - RNA, 21 nt, Mycobacterium bovis subsp bovis AF2122/97
gagcucgaugucagcggccgc

SEQ ID NO: 3062058 - RNA, 12 nt, Mycobacterium bovis subsp bovis AF2122/97
gagcucgcgcag

SEQ ID NO: 3062059 - RNA, 13 nt, Mycobacterium bovis subsp bovis AF2122/97
gagcucgcgcaga

SEQ ID NO: 3062060 - RNA, 17 nt, Mycobacterium bovis subsp bovis AF2122/97
gagcucggccccgccgc

SEQ ID NO: 3062061 - RNA, 16 nt, Mycobacterium bovis subsp bovis AF2122/97
gagcucggcgcccagc

SEQ ID NO: 3062062 - RNA, 14 nt, Mycobacterium bovis subsp bovis AF2122/97
gagcucggcugcuc

SEQ ID NO: 3062063 - RNA, 17 nt, Mycobacterium bovis subsp bovis AF2122/97
gagcucggcugcucgac

SEQ ID NO: 3062064 - RNA, 16 nt, Mycobacterium bovis subsp bovis AF2122/97
gagcucguugaccagg

SEQ ID NO: 3062065 - RNA, 17 nt, Mycobacterium bovis subsp bovis AF2122/97
gagcucuaucgggaagc

SEQ ID NO: 3062066 - RNA, 17 nt, Mycobacterium bovis subsp bovis AF2122/97
gagcucuugcgggcagc

SEQ ID NO: 3062067 - RNA, 22 nt, Mycobacterium bovis subsp bovis AF2122/97
gagcucuugcgggcagccgccc

SEQ ID NO: 3062068 - RNA, 17 nt, Mycobacterium bovis subsp bovis AF2122/97
gagcugacgauggccag

SEQ ID NO: 3062069 - RNA, 20 nt, Mycobacterium bovis subsp bovis AF2122/97
gagcugacgauggccaggcc

SEQ ID NO: 3062070 - RNA, 19 nt, Mycobacterium bovis subsp bovis AF2122/97
gagcugagcggccagcauc

SEQ ID NO: 3062071 - RNA, 21 nt, Mycobacterium bovis subsp bovis AF2122/97
gagcugauccggguggcguca

SEQ ID NO: 3062072 - RNA, 21 nt, Mycobacterium bovis subsp bovis AF2122/97
gaggccgcacgucgaccucgg

SEQ ID NO: 3062073 - RNA, 24 nt, Mycobacterium bovis subsp bovis AF2122/97
gaggccgcacgucgaccucggcaa

SEQ ID NO: 3062074 - RNA, 18 nt, Mycobacterium bovis subsp bovis AF2122/97
gaggccgccaucgccgcc

SEQ ID NO: 3062075 - RNA, 15 nt, Mycobacterium bovis subsp bovis AF2122/97
gaggccgccgcgccg

SEQ ID NO: 3062076 - RNA, 15 nt, Mycobacterium bovis subsp bovis AF2122/97
gaggccgcugccagc

SEQ ID NO: 3062077 - RNA, 17 nt, Mycobacterium bovis subsp bovis AF2122/97
gaggccgcugccagggu

SEQ ID NO: 3062078 - RNA, 22 nt, Mycobacterium bovis subsp bovis AF2122/97
gaggccggcuaccgcgcucccg

SEQ ID NO: 3062079 - RNA, 14 nt, Mycobacterium bovis subsp bovis AF2122/97
gaggccggugaacg

SEQ ID NO: 3062080 - RNA, 18 nt, Mycobacterium bovis subsp bovis AF2122/97
gaggccggugaacggcag

SEQ ID NO: 3062081 - RNA, 23 nt, Mycobacterium bovis subsp bovis AF2122/97
gaggccggugaacggcagcacgg

SEQ ID NO: 3062082 - RNA, 21 nt, Mycobacterium bovis subsp bovis AF2122/97
gaggccuaccaggcgcggccc

SEQ ID NO: 3062083 - RNA, 15 nt, Mycobacterium bovis subsp bovis AF2122/97
gaggccucggccagc

SEQ ID NO: 3062084 - RNA, 15 nt, Mycobacterium bovis subsp bovis AF2122/97
gaggccucggcggcc

SEQ ID NO: 3062085 - RNA, 19 nt, Mycobacterium bovis subsp bovis AF2122/97
gaggccucgucccacaacu

SEQ ID NO: 3062086 - RNA, 19 nt, Mycobacterium bovis subsp bovis AF2122/97
gaggcgaccacgucggcga

SEQ ID NO: 3062087 - RNA, 11 nt, Mycobacterium bovis subsp bovis AF2122/97
gaggcgagcgg

SEQ ID NO: 3062088 - RNA, 13 nt, Mycobacterium bovis subsp bovis AF2122/97
gaggcgagcggcc

SEQ ID NO: 3062089 - RNA, 16 nt, Mycobacterium bovis subsp bovis AF2122/97
gaggcgagcggccagu

SEQ ID NO: 3062090 - RNA, 20 nt, Mycobacterium bovis subsp bovis AF2122/97
gaggcgcaagaaugccgccg

SEQ ID NO: 3062091 - RNA, 21 nt, Mycobacterium bovis subsp bovis AF2122/97
gaggcgcaagaaugccgccga

SEQ ID NO: 3062092 - RNA, 16 nt, Mycobacterium bovis subsp bovis AF2122/97
gaggcgcagcgccagc

SEQ ID NO: 3062093 - RNA, 19 nt, Mycobacterium bovis subsp bovis AF2122/97
gaggcgcccagcgacaaca

SEQ ID NO: 3062094 - RNA, 13 nt, Mycobacterium bovis subsp bovis AF2122/97
gaggcgcggucga

SEQ ID NO: 3062095 - RNA, 16 nt, Mycobacterium bovis subsp bovis AF2122/97
gaggcgcucacccgcc

SEQ ID NO: 3062096 - RNA, 19 nt, Mycobacterium bovis subsp bovis AF2122/97
gaggcgcucacccgccgcg

SEQ ID NO: 3062097 - RNA, 22 nt, Mycobacterium bovis subsp bovis AF2122/97
gaggcgcucucguguaucgagc

SEQ ID NO: 3062098 - RNA, 17 nt, Mycobacterium bovis subsp bovis AF2122/97
gaggcggcccccggcag

SEQ ID NO: 3062099 - RNA, 15 nt, Mycobacterium bovis subsp bovis AF2122/97
gaggcggcgccgcac

SEQ ID NO: 3062100 - RNA, 12 nt, Mycobacterium bovis subsp bovis AF2122/97
gaggcggcuggc

SEQ ID NO: 3062101 - RNA, 14 nt, Mycobacterium bovis subsp bovis AF2122/97
gaggcggucgccga

SEQ ID NO: 3062102 - RNA, 20 nt, Mycobacterium bovis subsp bovis AF2122/97
gaggcggugacgaagccgac

SEQ ID NO: 3062103 - RNA, 15 nt, Mycobacterium bovis subsp bovis AF2122/97
gaggcgucaccccgg

SEQ ID NO: 3062104 - RNA, 14 nt, Mycobacterium bovis subsp bovis AF2122/97
gaggcguccggcuc

SEQ ID NO: 3062105 - RNA, 15 nt, Mycobacterium bovis subsp bovis AF2122/97
gaggcguucaccacg

SEQ ID NO: 3062106 - RNA, 16 nt, Mycobacterium bovis subsp bovis AF2122/97
gaggcuccuggucgcc

SEQ ID NO: 3062107 - RNA, 18 nt, Mycobacterium bovis subsp bovis AF2122/97
gaggcuccuggucgccgu

SEQ ID NO: 3062108 - RNA, 15 nt, Mycobacterium bovis subsp bovis AF2122/97
gaggcucgggccgca

SEQ ID NO: 3062109 - RNA, 17 nt, Mycobacterium bovis subsp bovis AF2122/97
gaggcucggucggcagc

SEQ ID NO: 3062110 - RNA, 15 nt, Mycobacterium bovis subsp bovis AF2122/97
gaggcucguggcgac

SEQ ID NO: 3062111 - RNA, 20 nt, Mycobacterium bovis subsp bovis AF2122/97
gaggcucguggcgacggcgu

SEQ ID NO: 3062112 - RNA, 21 nt, Mycobacterium bovis subsp bovis AF2122/97
gaggcugaccguggcgccggu

SEQ ID NO: 3062113 - RNA, 17 nt, Mycobacterium bovis subsp bovis AF2122/97
gaggcugccgaaguuga

SEQ ID NO: 3062114 - RNA, 16 nt, Mycobacterium bovis subsp bovis AF2122/97
gaggcuggcaucccgg

SEQ ID NO: 3062115 - RNA, 19 nt, Mycobacterium bovis subsp bovis AF2122/97
gaggcuggucugcaggcgg

SEQ ID NO: 3062116 - RNA, 17 nt, Mycobacterium bovis subsp bovis AF2122/97
gaggcuuacaugcccug

SEQ ID NO: 3062117 - RNA, 14 nt, Mycobacterium bovis subsp bovis AF2122/97
gagggaaucuccgg

SEQ ID NO: 3062118 - RNA, 14 nt, Mycobacterium bovis subsp bovis AF2122/97
gagggagcgccgca

SEQ ID NO: 3062119 - RNA, 15 nt, Mycobacterium bovis subsp bovis AF2122/97
gagggagcgccgcag

SEQ ID NO: 3062120 - RNA, 19 nt, Mycobacterium bovis subsp bovis AF2122/97
gagggagcgccgcaggguc

SEQ ID NO: 3062121 - RNA, 22 nt, Mycobacterium bovis subsp bovis AF2122/97
gagggagcgccgcagggucccg

SEQ ID NO: 3062122 - RNA, 14 nt, Mycobacterium bovis subsp bovis AF2122/97
gagggaucacgcca

SEQ ID NO: 3062123 - RNA, 23 nt, Mycobacterium bovis subsp bovis AF2122/97
gagggauguagugcugcucgaca

SEQ ID NO: 3062124 - RNA, 15 nt, Mycobacterium bovis subsp bovis AF2122/97
gagggauugccgugc

SEQ ID NO: 3062125 - RNA, 12 nt, Mycobacterium bovis subsp bovis AF2122/97
gagggcagccgc

SEQ ID NO: 3062126 - RNA, 13 nt, Mycobacterium bovis subsp bovis AF2122/97
gagggcagccgcc

SEQ ID NO: 3062127 - RNA, 15 nt, Mycobacterium bovis subsp bovis AF2122/97
gagggcaucgggccu

SEQ ID NO: 3062128 - RNA, 13 nt, Mycobacterium bovis subsp bovis AF2122/97
gagggccacggcu

SEQ ID NO: 3062129 - RNA, 21 nt, Mycobacterium bovis subsp bovis AF2122/97
gagggccacguagcagcagac

SEQ ID NO: 3062130 - RNA, 17 nt, Mycobacterium bovis subsp bovis AF2122/97
gagggcccggccggacg

SEQ ID NO: 3062131 - RNA, 22 nt, Mycobacterium bovis subsp bovis AF2122/97
gagggccgucacaggccgccug

SEQ ID NO: 3062132 - RNA, 19 nt, Mycobacterium bovis subsp bovis AF2122/97
gagggccugacgcgucagc

SEQ ID NO: 3062133 - RNA, 16 nt, Mycobacterium bovis subsp bovis AF2122/97
gagggcgagcaacucg

SEQ ID NO: 3062134 - RNA, 17 nt, Mycobacterium bovis subsp bovis AF2122/97
gagggcgccgggggcgc

SEQ ID NO: 3062135 - RNA, 21 nt, Mycobacterium bovis subsp bovis AF2122/97
gagggcgccgggggcgccgcc

SEQ ID NO: 3062136 - RNA, 22 nt, Mycobacterium bovis subsp bovis AF2122/97
gagggcgccgggggcgccgccg

SEQ ID NO: 3062137 - RNA, 14 nt, Mycobacterium bovis subsp bovis AF2122/97
gagggcggcgucga

SEQ ID NO: 3062138 - RNA, 15 nt, Mycobacterium bovis subsp bovis AF2122/97
gagggcgggacccgu

SEQ ID NO: 3062139 - RNA, 18 nt, Mycobacterium bovis subsp bovis AF2122/97
gagggcggucagcggcca

SEQ ID NO: 3062140 - RNA, 14 nt, Mycobacterium bovis subsp bovis AF2122/97
gagggcgucgccgc

SEQ ID NO: 3062141 - RNA, 14 nt, Mycobacterium bovis subsp bovis AF2122/97
gagggcgucgucga

SEQ ID NO: 3062142 - RNA, 19 nt, Mycobacterium bovis subsp bovis AF2122/97
gagggcuaccggcgccgcg

SEQ ID NO: 3062143 - RNA, 12 nt, Mycobacterium bovis subsp bovis AF2122/97
gagggcucggug

SEQ ID NO: 3062144 - RNA, 16 nt, Mycobacterium bovis subsp bovis AF2122/97
gagggcucgguggcgc

SEQ ID NO: 3062145 - RNA, 23 nt, Mycobacterium bovis subsp bovis AF2122/97
gagggcuguugacgccacgacgc

SEQ ID NO: 3062146 - RNA, 20 nt, Mycobacterium bovis subsp bovis AF2122/97
gagggcuuguggugagcgga

SEQ ID NO: 3062147 - RNA, 20 nt, Mycobacterium bovis subsp bovis AF2122/97
gagggcuuuagugucugcuc

SEQ ID NO: 3062148 - RNA, 19 nt, Mycobacterium bovis subsp bovis AF2122/97
gaggggacccagcggcggu

SEQ ID NO: 3062149 - RNA, 15 nt, Mycobacterium bovis subsp bovis AF2122/97
gaggggguggucgaa

SEQ ID NO: 3062150 - RNA, 17 nt, Mycobacterium bovis subsp bovis AF2122/97
gaggguaccaggcgccg

SEQ ID NO: 3062151 - RNA, 23 nt, Mycobacterium bovis subsp bovis AF2122/97
gagggucaugucgaucagcgcga

SEQ ID NO: 3062152 - RNA, 20 nt, Mycobacterium bovis subsp bovis AF2122/97
gagggucccacggcgguugc

SEQ ID NO: 3062153 - RNA, 14 nt, Mycobacterium bovis subsp bovis AF2122/97
gagggugcguugga

SEQ ID NO: 3062154 - RNA, 12 nt, Mycobacterium bovis subsp bovis AF2122/97
gagggugucgcc

SEQ ID NO: 3062155 - RNA, 19 nt, Mycobacterium bovis subsp bovis AF2122/97
gaggguucggacggcuggu

SEQ ID NO: 3062156 - RNA, 17 nt, Mycobacterium bovis subsp bovis AF2122/97
gagguaauccgcggggu

SEQ ID NO: 3062157 - RNA, 23 nt, Mycobacterium bovis subsp bovis AF2122/97
gagguacccaucgucgagccgcc

SEQ ID NO: 3062158 - RNA, 16 nt, Mycobacterium bovis subsp bovis AF2122/97
gagguacccccagcac

SEQ ID NO: 3062159 - RNA, 18 nt, Mycobacterium bovis subsp bovis AF2122/97
gaguccggccgacccgga

SEQ ID NO: 3062160 - RNA, 19 nt, Mycobacterium bovis subsp bovis AF2122/97
gaguccgucgacaccgcgg

SEQ ID NO: 3062161 - RNA, 23 nt, Mycobacterium bovis subsp bovis AF2122/97
gaguccgucggggacauccgcuu

SEQ ID NO: 3062162 - RNA, 19 nt, Mycobacterium bovis subsp bovis AF2122/97
gaguccugguaccccagca

SEQ ID NO: 3062163 - RNA, 17 nt, Mycobacterium bovis subsp bovis AF2122/97
gaguccuuaaacgucgu

SEQ ID NO: 3062164 - RNA, 17 nt, Mycobacterium bovis subsp bovis AF2122/97
gagucgaacaucaccgg

SEQ ID NO: 3062165 - RNA, 22 nt, Mycobacterium bovis subsp bovis AF2122/97
gagucgaacccgcgagcaucga

SEQ ID NO: 3062166 - RNA, 12 nt, Mycobacterium bovis subsp bovis AF2122/97
gagucgagcaca

SEQ ID NO: 3062167 - RNA, 14 nt, Mycobacterium bovis subsp bovis AF2122/97
gagucgaucagcuu

SEQ ID NO: 3062168 - RNA, 16 nt, Mycobacterium bovis subsp bovis AF2122/97
gagucgcacugcgccg

SEQ ID NO: 3062169 - RNA, 18 nt, Mycobacterium bovis subsp bovis AF2122/97
gagucgcagcacggguga

SEQ ID NO: 3062170 - RNA, 14 nt, Mycobacterium bovis subsp bovis AF2122/97
gagucgccagaccg

SEQ ID NO: 3062171 - RNA, 13 nt, Mycobacterium bovis subsp bovis AF2122/97
gagucgcccgcac

SEQ ID NO: 3062172 - RNA, 14 nt, Mycobacterium bovis subsp bovis AF2122/97
gagucgcccgcaca

SEQ ID NO: 3062173 - RNA, 15 nt, Mycobacterium bovis subsp bovis AF2122/97
gagucgcccgcacac

SEQ ID NO: 3062174 - RNA, 17 nt, Mycobacterium bovis subsp bovis AF2122/97
gagucgcgaacucaugc

SEQ ID NO: 3062175 - RNA, 15 nt, Mycobacterium bovis subsp bovis AF2122/97
gagucggcgggcgac

SEQ ID NO: 3062176 - RNA, 19 nt, Mycobacterium bovis subsp bovis AF2122/97
gagucggcggggcggacuc

SEQ ID NO: 3062177 - RNA, 13 nt, Mycobacterium bovis subsp bovis AF2122/97
gagucggcgucga

SEQ ID NO: 3062178 - RNA, 17 nt, Mycobacterium bovis subsp bovis AF2122/97
gagucggcugguccucc

SEQ ID NO: 3062179 - RNA, 15 nt, Mycobacterium bovis subsp bovis AF2122/97
gagucgggggccgcg

SEQ ID NO: 3062180 - RNA, 18 nt, Mycobacterium bovis subsp bovis AF2122/97
gagucggucuggaucaga

SEQ ID NO: 3062181 - RNA, 19 nt, Mycobacterium bovis subsp bovis AF2122/97
gagucggugaaaugacggc

SEQ ID NO: 3062182 - RNA, 22 nt, Mycobacterium bovis subsp bovis AF2122/97
gagucgguucagccacgcagca

SEQ ID NO: 3062183 - RNA, 16 nt, Mycobacterium bovis subsp bovis AF2122/97
gagucgucccaguccc

SEQ ID NO: 3062184 - RNA, 21 nt, Mycobacterium bovis subsp bovis AF2122/97
gagucgucccagucccgcguc

SEQ ID NO: 3062185 - RNA, 22 nt, Mycobacterium bovis subsp bovis AF2122/97
gagucgucggcaugggccggcg

SEQ ID NO: 3062186 - RNA, 21 nt, Mycobacterium bovis subsp bovis AF2122/97
gagucgucguccgacgggccg

SEQ ID NO: 3062187 - RNA, 15 nt, Mycobacterium bovis subsp bovis AF2122/97
gagucgugacaacca

SEQ ID NO: 3062188 - RNA, 19 nt, Mycobacterium bovis subsp bovis AF2122/97
gagucguuggacggcaccg

SEQ ID NO: 3062189 - RNA, 22 nt, Mycobacterium bovis subsp bovis AF2122/97
gagucugcgcagaaauguauug

SEQ ID NO: 3062190 - RNA, 17 nt, Mycobacterium bovis subsp bovis AF2122/97
gagucugcugaucgagc

SEQ ID NO: 3062191 - RNA, 21 nt, Mycobacterium bovis subsp bovis AF2122/97
gagucugcugaucgagcgggu

SEQ ID NO: 3062192 - RNA, 13 nt, Mycobacterium bovis subsp bovis AF2122/97
gagugaauccggc

SEQ ID NO: 3062193 - RNA, 19 nt, Mycobacterium bovis subsp bovis AF2122/97
gagugaccacgcugcuggu

SEQ ID NO: 3062194 - RNA, 21 nt, Mycobacterium bovis subsp bovis AF2122/97
gagugaccacgcugcugguga

SEQ ID NO: 3062195 - RNA, 20 nt, Mycobacterium bovis subsp bovis AF2122/97
gagugagcucagcaaguucg

SEQ ID NO: 3062196 - RNA, 19 nt, Mycobacterium bovis subsp bovis AF2122/97
gagugaggcgcuggcccgc

SEQ ID NO: 3062197 - RNA, 22 nt, Mycobacterium bovis subsp bovis AF2122/97
gagugaggcgcuggcccgccag

SEQ ID NO: 3062198 - RNA, 18 nt, Mycobacterium bovis subsp bovis AF2122/97
gagugcacagacacggca

SEQ ID NO: 3062199 - RNA, 16 nt, Mycobacterium bovis subsp bovis AF2122/97
gagugcccauagccgg

SEQ ID NO: 3062200 - RNA, 15 nt, Mycobacterium bovis subsp bovis AF2122/97
gagugccgccaccgc

SEQ ID NO: 3062201 - RNA, 15 nt, Mycobacterium bovis subsp bovis AF2122/97
gagugccgccgucgc

SEQ ID NO: 3062202 - RNA, 20 nt, Mycobacterium bovis subsp bovis AF2122/97
gagugccgcgucaaccgauc

SEQ ID NO: 3062203 - RNA, 17 nt, Mycobacterium bovis subsp bovis AF2122/97
gagugcgacggcgacgu

SEQ ID NO: 3062204 - RNA, 13 nt, Mycobacterium bovis subsp bovis AF2122/97
gagugcgauaccu

SEQ ID NO: 3062205 - RNA, 22 nt, Mycobacterium bovis subsp bovis AF2122/97
gagugcggacuucgccgcccgc

SEQ ID NO: 3062206 - RNA, 17 nt, Mycobacterium bovis subsp bovis AF2122/97
gagugcggcacgaucgc

SEQ ID NO: 3062207 - RNA, 17 nt, Mycobacterium bovis subsp bovis AF2122/97
gagugcgggcaugccgg

SEQ ID NO: 3062208 - RNA, 17 nt, Mycobacterium bovis subsp bovis AF2122/97
gagugcggguggugagc

SEQ ID NO: 3062209 - RNA, 19 nt, Mycobacterium bovis subsp bovis AF2122/97
gagugcggguggugagcug

SEQ ID NO: 3062210 - RNA, 20 nt, Mycobacterium bovis subsp bovis AF2122/97
gagugcgucucgguggcugc

SEQ ID NO: 3062211 - RNA, 22 nt, Mycobacterium bovis subsp bovis AF2122/97
gagugcgucucgguggcugcgc

SEQ ID NO: 3062212 - RNA, 19 nt, Mycobacterium bovis subsp bovis AF2122/97
gaguggaugcgccgcacgg

SEQ ID NO: 3062213 - RNA, 20 nt, Mycobacterium bovis subsp bovis AF2122/97
gaguggaugcgccgcacggc

SEQ ID NO: 3062214 - RNA, 22 nt, Mycobacterium bovis subsp bovis AF2122/97
gaguggaugcgccgcacggcga

SEQ ID NO: 3062215 - RNA, 20 nt, Mycobacterium bovis subsp bovis AF2122/97
gaguggccaguuggccggcc

SEQ ID NO: 3062216 - RNA, 11 nt, Mycobacterium bovis subsp bovis AF2122/97
gaguggccggg

SEQ ID NO: 3062217 - RNA, 14 nt, Mycobacterium bovis subsp bovis AF2122/97
gaguggccgguggg

SEQ ID NO: 3062218 - RNA, 21 nt, Mycobacterium bovis subsp bovis AF2122/97
gaguggcgauuucggcgccug

SEQ ID NO: 3062219 - RNA, 21 nt, Mycobacterium bovis subsp bovis AF2122/97
gaguggucccguucgcccgcc

SEQ ID NO: 3062220 - RNA, 15 nt, Mycobacterium bovis subsp bovis AF2122/97
gagugucagcgccac

SEQ ID NO: 3062221 - RNA, 16 nt, Mycobacterium bovis subsp bovis AF2122/97
gaguguccccccgcgc

SEQ ID NO: 3062222 - RNA, 19 nt, Mycobacterium bovis subsp bovis AF2122/97
gaguguccccggcugccag

SEQ ID NO: 3062223 - RNA, 21 nt, Mycobacterium bovis subsp bovis AF2122/97
gagugucccgaugguggccgc

SEQ ID NO: 3062224 - RNA, 23 nt, Mycobacterium bovis subsp bovis AF2122/97
gagugucccgaugguggccgcgc

SEQ ID NO: 3062225 - RNA, 20 nt, Mycobacterium bovis subsp bovis AF2122/97
gagugucgaugcgcgccggc

SEQ ID NO: 3062226 - RNA, 20 nt, Mycobacterium bovis subsp bovis AF2122/97
gagugucuuagccagcagca

SEQ ID NO: 3062227 - RNA, 23 nt, Mycobacterium bovis subsp bovis AF2122/97
gagugucuuagccagcagcacau

SEQ ID NO: 3062228 - RNA, 20 nt, Mycobacterium bovis subsp bovis AF2122/97
gagugugaaucgcacgacgc

SEQ ID NO: 3062229 - RNA, 22 nt, Mycobacterium bovis subsp bovis AF2122/97
gagugugaaucgcacgacgcga

SEQ ID NO: 3062230 - RNA, 18 nt, Mycobacterium bovis subsp bovis AF2122/97
gaguucccgaaacccgau

SEQ ID NO: 3062231 - RNA, 23 nt, Mycobacterium bovis subsp bovis AF2122/97
gaguuccuugaugcggccgcgga

SEQ ID NO: 3062232 - RNA, 14 nt, Mycobacterium bovis subsp bovis AF2122/97
gaguucgcgcgccg

SEQ ID NO: 3062233 - RNA, 16 nt, Mycobacterium bovis subsp bovis AF2122/97
gaguucgcgcgccgcg

SEQ ID NO: 3062234 - RNA, 16 nt, Mycobacterium bovis subsp bovis AF2122/97
gaguucggcagcgggc

SEQ ID NO: 3062235 - RNA, 13 nt, Mycobacterium bovis subsp bovis AF2122/97
gaguucggccagc

SEQ ID NO: 3062236 - RNA, 15 nt, Mycobacterium bovis subsp bovis AF2122/97
gaguucggcccgcaa

SEQ ID NO: 3062237 - RNA, 22 nt, Mycobacterium bovis subsp bovis AF2122/97
gaguucggcccgcaaacagucg

SEQ ID NO: 3062238 - RNA, 23 nt, Mycobacterium bovis subsp bovis AF2122/97
gaguucggcccgcaaacagucgg

SEQ ID NO: 3062239 - RNA, 14 nt, Mycobacterium bovis subsp bovis AF2122/97
gaguucggccgcgg

SEQ ID NO: 3062240 - RNA, 22 nt, Mycobacterium bovis subsp bovis AF2122/97
gaguucggcguagaugcgcccg

SEQ ID NO: 3062241 - RNA, 18 nt, Mycobacterium bovis subsp bovis AF2122/97
gaguucggggugcgccca

SEQ ID NO: 3062242 - RNA, 19 nt, Mycobacterium bovis subsp bovis AF2122/97
gaguucggggugcgcccag

SEQ ID NO: 3062243 - RNA, 12 nt, Mycobacterium bovis subsp bovis AF2122/97
gaguucggugcu

SEQ ID NO: 3062244 - RNA, 22 nt, Mycobacterium bovis subsp bovis AF2122/97
gaguucgguugcccccagggcc

SEQ ID NO: 3062245 - RNA, 20 nt, Mycobacterium bovis subsp bovis AF2122/97
gauacgugaggucccggcug

SEQ ID NO: 3062246 - RNA, 23 nt, Mycobacterium bovis subsp bovis AF2122/97
gauacgugaggucccggcuggga

SEQ ID NO: 3062247 - RNA, 21 nt, Mycobacterium bovis subsp bovis AF2122/97
gauacucgaguggcgaacggg

SEQ ID NO: 3062248 - RNA, 14 nt, Mycobacterium bovis subsp bovis AF2122/97
gauacucggcgacu

SEQ ID NO: 3062249 - RNA, 16 nt, Mycobacterium bovis subsp bovis AF2122/97
gauacucggcgacugc

SEQ ID NO: 3062250 - RNA, 12 nt, Mycobacterium bovis subsp bovis AF2122/97
gauacucgucgu

SEQ ID NO: 3062251 - RNA, 19 nt, Mycobacterium bovis subsp bovis AF2122/97
gauagaacguagcgcccac

SEQ ID NO: 3062252 - RNA, 21 nt, Mycobacterium bovis subsp bovis AF2122/97
gauagaagaucuugucgagca

SEQ ID NO: 3062253 - RNA, 15 nt, Mycobacterium bovis subsp bovis AF2122/97
gauagacccuggggu

SEQ ID NO: 3062254 - RNA, 18 nt, Mycobacterium bovis subsp bovis AF2122/97
gauagaccuuggugccca

SEQ ID NO: 3062255 - RNA, 14 nt, Mycobacterium bovis subsp bovis AF2122/97
gauagacgacccgg

SEQ ID NO: 3062256 - RNA, 15 nt, Mycobacterium bovis subsp bovis AF2122/97
gauagacggcgacga

SEQ ID NO: 3062257 - RNA, 23 nt, Mycobacterium bovis subsp bovis AF2122/97
gauagaugcgugcggcagugcca

SEQ ID NO: 3062258 - RNA, 19 nt, Mycobacterium bovis subsp bovis AF2122/97
gauagcaacgaagccggcg

SEQ ID NO: 3062259 - RNA, 20 nt, Mycobacterium bovis subsp bovis AF2122/97
gauagcaacgaagccggcgc

SEQ ID NO: 3062260 - RNA, 14 nt, Mycobacterium bovis subsp bovis AF2122/97
gauagcaccggaau

SEQ ID NO: 3062261 - RNA, 19 nt, Mycobacterium bovis subsp bovis AF2122/97
gauagcaccggcacccgca

SEQ ID NO: 3062262 - RNA, 20 nt, Mycobacterium bovis subsp bovis AF2122/97
gauagcaccggcacccgcac

SEQ ID NO: 3062263 - RNA, 19 nt, Mycobacterium bovis subsp bovis AF2122/97
gauagcagugcagcaacac

SEQ ID NO: 3062264 - RNA, 12 nt, Mycobacterium bovis subsp bovis AF2122/97
gauagccgacca

SEQ ID NO: 3062265 - RNA, 15 nt, Mycobacterium bovis subsp bovis AF2122/97
gauagccguucggca

SEQ ID NO: 3062266 - RNA, 19 nt, Mycobacterium bovis subsp bovis AF2122/97
gauagccucggcggcgccg

SEQ ID NO: 3062267 - RNA, 13 nt, Mycobacterium bovis subsp bovis AF2122/97
gauagccugcggc

SEQ ID NO: 3062268 - RNA, 16 nt, Mycobacterium bovis subsp bovis AF2122/97
gauagccugcggcggc

SEQ ID NO: 3062269 - RNA, 13 nt, Mycobacterium bovis subsp bovis AF2122/97
gauagcgaccgcg

SEQ ID NO: 3062270 - RNA, 14 nt, Mycobacterium bovis subsp bovis AF2122/97
gauagcgccguaca

SEQ ID NO: 3062271 - RNA, 15 nt, Mycobacterium bovis subsp bovis AF2122/97
gauagcgcggcacca

SEQ ID NO: 3062272 - RNA, 23 nt, Mycobacterium bovis subsp bovis AF2122/97
gauagcggauucacgcaccggcg

SEQ ID NO: 3062273 - RNA, 18 nt, Mycobacterium bovis subsp bovis AF2122/97
gauagcggcaaagccggg

SEQ ID NO: 3062274 - RNA, 19 nt, Mycobacterium bovis subsp bovis AF2122/97
gauagcggcccgaucacca

SEQ ID NO: 3062275 - RNA, 20 nt, Mycobacterium bovis subsp bovis AF2122/97
gauagcggcccgaucaccag

SEQ ID NO: 3062276 - RNA, 18 nt, Mycobacterium bovis subsp bovis AF2122/97
gauagcggcgcagcguga

SEQ ID NO: 3062277 - RNA, 18 nt, Mycobacterium bovis subsp bovis AF2122/97
gauagcggcggcggcacg

SEQ ID NO: 3062278 - RNA, 15 nt, Mycobacterium bovis subsp bovis AF2122/97
gauagcggucgguca

SEQ ID NO: 3062279 - RNA, 18 nt, Mycobacterium bovis subsp bovis AF2122/97
gauagcggucggucacca

SEQ ID NO: 3062280 - RNA, 23 nt, Mycobacterium bovis subsp bovis AF2122/97
gauagcggucggucaccauggcg

SEQ ID NO: 3062281 - RNA, 21 nt, Mycobacterium bovis subsp bovis AF2122/97
gauaggccaaccgguucgucg

SEQ ID NO: 3062282 - RNA, 14 nt, Mycobacterium bovis subsp bovis AF2122/97
gauaggccccgagg

SEQ ID NO: 3062283 - RNA, 20 nt, Mycobacterium bovis subsp bovis AF2122/97
gauaggcccggucuugggcg

SEQ ID NO: 3062284 - RNA, 14 nt, Mycobacterium bovis subsp bovis AF2122/97
gauaggccgcgcgg

SEQ ID NO: 3062285 - RNA, 16 nt, Mycobacterium bovis subsp bovis AF2122/97
gauaggccgcgcggcg

SEQ ID NO: 3062286 - RNA, 14 nt, Mycobacterium bovis subsp bovis AF2122/97
gauagucggccggc

SEQ ID NO: 3062287 - RNA, 20 nt, Mycobacterium bovis subsp bovis AF2122/97
gauagugcuccacguccggc

SEQ ID NO: 3062288 - RNA, 23 nt, Mycobacterium bovis subsp bovis AF2122/97
gauagugcuccacguccggcgga

SEQ ID NO: 3062289 - RNA, 21 nt, Mycobacterium bovis subsp bovis AF2122/97
gauaguggcgcgcggcgccgc

SEQ ID NO: 3062290 - RNA, 15 nt, Mycobacterium bovis subsp bovis AF2122/97
gauagugguugcggc

SEQ ID NO: 3062291 - RNA, 13 nt, Mycobacterium bovis subsp bovis AF2122/97
gauaguucaccac

SEQ ID NO: 3062292 - RNA, 23 nt, Mycobacterium bovis subsp bovis AF2122/97
gauaguucaccacaugggagccg

SEQ ID NO: 3062293 - RNA, 14 nt, Mycobacterium bovis subsp bovis AF2122/97
gauauagccgccgg

SEQ ID NO: 3062294 - RNA, 15 nt, Mycobacterium bovis subsp bovis AF2122/97
gauauagccgccggu

SEQ ID NO: 3062295 - RNA, 17 nt, Mycobacterium bovis subsp bovis AF2122/97
gauauagggcuccucgu

SEQ ID NO: 3062296 - RNA, 16 nt, Mycobacterium bovis subsp bovis AF2122/97
gauaucacgacgccga

SEQ ID NO: 3062297 - RNA, 19 nt, Mycobacterium bovis subsp bovis AF2122/97
gauaucagagggccgcggu

SEQ ID NO: 3062298 - RNA, 23 nt, Mycobacterium bovis subsp bovis AF2122/97
gauaucagcacguaacgccgcuc

SEQ ID NO: 3062299 - RNA, 17 nt, Mycobacterium bovis subsp bovis AF2122/97
gauaucgaucggaucga

SEQ ID NO: 3062300 - RNA, 18 nt, Mycobacterium bovis subsp bovis AF2122/97
gauaucgaugcggcgacc

SEQ ID NO: 3062301 - RNA, 15 nt, Mycobacterium bovis subsp bovis AF2122/97
gauaucgcccggaac

SEQ ID NO: 3062302 - RNA, 21 nt, Mycobacterium bovis subsp bovis AF2122/97
gauaucgccgagaaccagcga

SEQ ID NO: 3062303 - RNA, 14 nt, Mycobacterium bovis subsp bovis AF2122/97
gauaucggcggcuu

SEQ ID NO: 3062304 - RNA, 17 nt, Mycobacterium bovis subsp bovis AF2122/97
gauaucgggagcggcug

SEQ ID NO: 3062305 - RNA, 16 nt, Mycobacterium bovis subsp bovis AF2122/97
gauaucgggcucagcg

SEQ ID NO: 3062306 - RNA, 16 nt, Mycobacterium bovis subsp bovis AF2122/97
gauaucuauggaugac

SEQ ID NO: 3062307 - RNA, 20 nt, Mycobacterium bovis subsp bovis AF2122/97
gauaugacggcagaccaugg

SEQ ID NO: 3062308 - RNA, 15 nt, Mycobacterium bovis subsp bovis AF2122/97
gauaugcacccgcac

SEQ ID NO: 3062309 - RNA, 18 nt, Mycobacterium bovis subsp bovis AF2122/97
gauaugcacccgcaccgg

SEQ ID NO: 3062310 - RNA, 20 nt, Mycobacterium bovis subsp bovis AF2122/97
gauaugcgucgauugccgcg

SEQ ID NO: 3062311 - RNA, 18 nt, Mycobacterium bovis subsp bovis AF2122/97
gauauggaccgccgccga

SEQ ID NO: 3062312 - RNA, 17 nt, Mycobacterium bovis subsp bovis AF2122/97
gauauggguugccagcg

SEQ ID NO: 3062313 - RNA, 21 nt, Mycobacterium bovis subsp bovis AF2122/97
gauauggguugccagcgacgc

SEQ ID NO: 3062314 - RNA, 17 nt, Mycobacterium bovis subsp bovis AF2122/97
gauauggucaccaagac

SEQ ID NO: 3062315 - RNA, 12 nt, Mycobacterium bovis subsp bovis AF2122/97
gauauugccauc

SEQ ID NO: 3062316 - RNA, 14 nt, Mycobacterium bovis subsp bovis AF2122/97
gauauugccugcca

SEQ ID NO: 3062317 - RNA, 21 nt, Mycobacterium bovis subsp bovis AF2122/97
gauauuggacgcgcaugcccc

SEQ ID NO: 3062318 - RNA, 22 nt, Mycobacterium bovis subsp bovis AF2122/97
gauauuggacgcgcaugccccg

SEQ ID NO: 3062319 - RNA, 15 nt, Mycobacterium bovis subsp bovis AF2122/97
gauauuugucggcgc

SEQ ID NO: 3062320 - RNA, 15 nt, Mycobacterium bovis subsp bovis AF2122/97
gaucaaaccggcggc

SEQ ID NO: 3062321 - RNA, 16 nt, Mycobacterium bovis subsp bovis AF2122/97
gaucaaagccagcacc

SEQ ID NO: 3062322 - RNA, 18 nt, Mycobacterium bovis subsp bovis AF2122/97
gaucaacaggccggcucg

SEQ ID NO: 3062323 - RNA, 15 nt, Mycobacterium bovis subsp bovis AF2122/97
gaucaacaugccggu

SEQ ID NO: 3062324 - RNA, 14 nt, Mycobacterium bovis subsp bovis AF2122/97
gaucaaccccccgg

SEQ ID NO: 3062325 - RNA, 17 nt, Mycobacterium bovis subsp bovis AF2122/97
gaucaacccgguccagc

SEQ ID NO: 3062326 - RNA, 13 nt, Mycobacterium bovis subsp bovis AF2122/97
gaucaaccggguc

SEQ ID NO: 3062327 - RNA, 20 nt, Mycobacterium bovis subsp bovis AF2122/97
gaucaacucgggcagcgcgg

SEQ ID NO: 3062328 - RNA, 21 nt, Mycobacterium bovis subsp bovis AF2122/97
gaucaacucgggcagcgcggc

SEQ ID NO: 3062329 - RNA, 16 nt, Mycobacterium bovis subsp bovis AF2122/97
gaucaagaaggccagc

SEQ ID NO: 3062330 - RNA, 19 nt, Mycobacterium bovis subsp bovis AF2122/97
gaucaagaaggccagcgcg

SEQ ID NO: 3062331 - RNA, 23 nt, Mycobacterium bovis subsp bovis AF2122/97
gaucaagaaggccagcgcgcccg

SEQ ID NO: 3062332 - RNA, 19 nt, Mycobacterium bovis subsp bovis AF2122/97
gaucagcgaaccaccggcg

SEQ ID NO: 3062333 - RNA, 21 nt, Mycobacterium bovis subsp bovis AF2122/97
gaucagcgaaccaccggcgcc

SEQ ID NO: 3062334 - RNA, 22 nt, Mycobacterium bovis subsp bovis AF2122/97
gaucagcgacuugcuggcguag

SEQ ID NO: 3062335 - RNA, 23 nt, Mycobacterium bovis subsp bovis AF2122/97
gaucagcgaggaauuccgcuacc

SEQ ID NO: 3062336 - RNA, 15 nt, Mycobacterium bovis subsp bovis AF2122/97
gaucagcgccggauc

SEQ ID NO: 3062337 - RNA, 13 nt, Mycobacterium bovis subsp bovis AF2122/97
gaucagcgcggcg

SEQ ID NO: 3062338 - RNA, 16 nt, Mycobacterium bovis subsp bovis AF2122/97
gaucagcgcggcgccc

SEQ ID NO: 3062339 - RNA, 11 nt, Mycobacterium bovis subsp bovis AF2122/97
gaucagcggca

SEQ ID NO: 3062340 - RNA, 17 nt, Mycobacterium bovis subsp bovis AF2122/97
gaucagcggcagcaccg

SEQ ID NO: 3062341 - RNA, 18 nt, Mycobacterium bovis subsp bovis AF2122/97
gaucagcggcagcaccgc

SEQ ID NO: 3062342 - RNA, 23 nt, Mycobacterium bovis subsp bovis AF2122/97
gaucagcguauuggacgcugccg

SEQ ID NO: 3062343 - RNA, 19 nt, Mycobacterium bovis subsp bovis AF2122/97
gaucagcgugaucugcagg

SEQ ID NO: 3062344 - RNA, 19 nt, Mycobacterium bovis subsp bovis AF2122/97
gaucagcguggcgcccgug

SEQ ID NO: 3062345 - RNA, 24 nt, Mycobacterium bovis subsp bovis AF2122/97
gaucagcguggcgcccgugccgcc

SEQ ID NO: 3062346 - RNA, 17 nt, Mycobacterium bovis subsp bovis AF2122/97
gaucagcgugucgccga

SEQ ID NO: 3062347 - RNA, 16 nt, Mycobacterium bovis subsp bovis AF2122/97
gaucagcuccuccgac

SEQ ID NO: 3062348 - RNA, 19 nt, Mycobacterium bovis subsp bovis AF2122/97
gaucagcuugugggcgacg

SEQ ID NO: 3062349 - RNA, 15 nt, Mycobacterium bovis subsp bovis AF2122/97
gaucaggccccacac

SEQ ID NO: 3062350 - RNA, 18 nt, Mycobacterium bovis subsp bovis AF2122/97
gaucaggccgacgucgac

SEQ ID NO: 3062351 - RNA, 15 nt, Mycobacterium bovis subsp bovis AF2122/97
gaucagggcucgcuc

SEQ ID NO: 3062352 - RNA, 18 nt, Mycobacterium bovis subsp bovis AF2122/97
gaucagggcucgcucgcc

SEQ ID NO: 3062353 - RNA, 21 nt, Mycobacterium bovis subsp bovis AF2122/97
gaucagggcucgcucgccgag

SEQ ID NO: 3062354 - RNA, 16 nt, Mycobacterium bovis subsp bovis AF2122/97
gaucagggucagcgcc

SEQ ID NO: 3062355 - RNA, 14 nt, Mycobacterium bovis subsp bovis AF2122/97
gaucaggguggcgc

SEQ ID NO: 3062356 - RNA, 16 nt, Mycobacterium bovis subsp bovis AF2122/97
gaucaggguggcgcgg

SEQ ID NO: 3062357 - RNA, 22 nt, Mycobacterium bovis subsp bovis AF2122/97
gaucagggugucgaagagcagg

SEQ ID NO: 3062358 - RNA, 23 nt, Mycobacterium bovis subsp bovis AF2122/97
gaucagggugucgaagagcaggc

SEQ ID NO: 3062359 - RNA, 22 nt, Mycobacterium bovis subsp bovis AF2122/97
gaucagguacgccaggugcagc

SEQ ID NO: 3062360 - RNA, 16 nt, Mycobacterium bovis subsp bovis AF2122/97
gaucaggucgccgaga

SEQ ID NO: 3062361 - RNA, 18 nt, Mycobacterium bovis subsp bovis AF2122/97
gaucaggucuucgauggc

SEQ ID NO: 3062362 - RNA, 16 nt, Mycobacterium bovis subsp bovis AF2122/97
gaucagguuggcggcu

SEQ ID NO: 3062363 - RNA, 22 nt, Mycobacterium bovis subsp bovis AF2122/97
gaucagguuggcggcugcacgc

SEQ ID NO: 3062364 - RNA, 15 nt, Mycobacterium bovis subsp bovis AF2122/97
gaucagugcaagacc

SEQ ID NO: 3062365 - RNA, 21 nt, Mycobacterium bovis subsp bovis AF2122/97
gaucagugcaagaccgcaucg

SEQ ID NO: 3062366 - RNA, 20 nt, Mycobacterium bovis subsp bovis AF2122/97
gaucaguucguggcuggcau

SEQ ID NO: 3062367 - RNA, 21 nt, Mycobacterium bovis subsp bovis AF2122/97
gaucaguuugccaucgggacc

SEQ ID NO: 3062368 - RNA, 17 nt, Mycobacterium bovis subsp bovis AF2122/97
gaucauauggccgccga

SEQ ID NO: 3062369 - RNA, 15 nt, Mycobacterium bovis subsp bovis AF2122/97
gaucaucaccggcau

SEQ ID NO: 3062370 - RNA, 21 nt, Mycobacterium bovis subsp bovis AF2122/97
gaucaucauauccgccccagc

SEQ ID NO: 3062371 - RNA, 13 nt, Mycobacterium bovis subsp bovis AF2122/97
gaucaucccggcg

SEQ ID NO: 3062372 - RNA, 14 nt, Mycobacterium bovis subsp bovis AF2122/97
gaucaucccggcgc

SEQ ID NO: 3062373 - RNA, 20 nt, Mycobacterium bovis subsp bovis AF2122/97
gaucauccuucgccggcgcc

SEQ ID NO: 3062374 - RNA, 21 nt, Mycobacterium bovis subsp bovis AF2122/97
gaucaucgacgauuccaggua

SEQ ID NO: 3062375 - RNA, 15 nt, Mycobacterium bovis subsp bovis AF2122/97
gaucaucggccccga

SEQ ID NO: 3062376 - RNA, 17 nt, Mycobacterium bovis subsp bovis AF2122/97
gaucaucgggagccgca

SEQ ID NO: 3062377 - RNA, 23 nt, Mycobacterium bovis subsp bovis AF2122/97
gaucaucgggguggccaccagcg

SEQ ID NO: 3062378 - RNA, 17 nt, Mycobacterium bovis subsp bovis AF2122/97
gaucaucuggcugguga

SEQ ID NO: 3062379 - RNA, 21 nt, Mycobacterium bovis subsp bovis AF2122/97
gaucaugaccaucugcugugg

SEQ ID NO: 3062380 - RNA, 17 nt, Mycobacterium bovis subsp bovis AF2122/97
gaucaugagcagcacgu

SEQ ID NO: 3062381 - RNA, 13 nt, Mycobacterium bovis subsp bovis AF2122/97
gaucaugccggcg

SEQ ID NO: 3062382 - RNA, 15 nt, Mycobacterium bovis subsp bovis AF2122/97
gaucaugccggcgaa

SEQ ID NO: 3062383 - RNA, 16 nt, Mycobacterium bovis subsp bovis AF2122/97
gaucauggcgagcguu

SEQ ID NO: 3062384 - RNA, 21 nt, Mycobacterium bovis subsp bovis AF2122/97
gaucauguccaucgcgcggcu

SEQ ID NO: 3062385 - RNA, 23 nt, Mycobacterium bovis subsp bovis AF2122/97
gaucaugucggccggggccaccc

SEQ ID NO: 3062386 - RNA, 22 nt, Mycobacterium bovis subsp bovis AF2122/97
gaucaugugguggcgccggccg

SEQ ID NO: 3062387 - RNA, 16 nt, Mycobacterium bovis subsp bovis AF2122/97
gaucauguucggccac

SEQ ID NO: 3062388 - RNA, 17 nt, Mycobacterium bovis subsp bovis AF2122/97
gaucauguucggccacc

SEQ ID NO: 3062389 - RNA, 18 nt, Mycobacterium bovis subsp bovis AF2122/97
gaucauguucggccacca

SEQ ID NO: 3062390 - RNA, 17 nt, Mycobacterium bovis subsp bovis AF2122/97
gaucauucugcggccua

SEQ ID NO: 3062391 - RNA, 19 nt, Mycobacterium bovis subsp bovis AF2122/97
gaucauugcacccaccccg

SEQ ID NO: 3062392 - RNA, 22 nt, Mycobacterium bovis subsp bovis AF2122/97
gaucauuucgguaauggccgcc

SEQ ID NO: 3062393 - RNA, 20 nt, Mycobacterium bovis subsp bovis AF2122/97
gauccacauggugaccaugg

SEQ ID NO: 3062394 - RNA, 22 nt, Mycobacterium bovis subsp bovis AF2122/97
gauccacauggugaccauggcc

SEQ ID NO: 3062395 - RNA, 16 nt, Mycobacterium bovis subsp bovis AF2122/97
gauccaccaagcucgc

SEQ ID NO: 3062396 - RNA, 15 nt, Mycobacterium bovis subsp bovis AF2122/97
gauccaccagaucca

SEQ ID NO: 3062397 - RNA, 15 nt, Mycobacterium bovis subsp bovis AF2122/97
gauccacccagugcc

SEQ ID NO: 3062398 - RNA, 13 nt, Mycobacterium bovis subsp bovis AF2122/97
gauccacgccaga

SEQ ID NO: 3062399 - RNA, 15 nt, Mycobacterium bovis subsp bovis AF2122/97
gauccacgccagagc

SEQ ID NO: 3062400 - RNA, 17 nt, Mycobacterium bovis subsp bovis AF2122/97
gauccacgccagagcgg

SEQ ID NO: 3062401 - RNA, 13 nt, Mycobacterium bovis subsp bovis AF2122/97
gauccacgccgac

SEQ ID NO: 3062402 - RNA, 14 nt, Mycobacterium bovis subsp bovis AF2122/97
gauccacgccgacc

SEQ ID NO: 3062403 - RNA, 16 nt, Mycobacterium bovis subsp bovis AF2122/97
gauccacgccgaccau

SEQ ID NO: 3062404 - RNA, 14 nt, Mycobacterium bovis subsp bovis AF2122/97
gauccacuccggcg

SEQ ID NO: 3062405 - RNA, 20 nt, Mycobacterium bovis subsp bovis AF2122/97
gauccacugccgcgcgcccg

SEQ ID NO: 3062406 - RNA, 17 nt, Mycobacterium bovis subsp bovis AF2122/97
gauccagaacaacggcg

SEQ ID NO: 3062407 - RNA, 20 nt, Mycobacterium bovis subsp bovis AF2122/97
gauccagaacaacggcgcgg

SEQ ID NO: 3062408 - RNA, 17 nt, Mycobacterium bovis subsp bovis AF2122/97
gauccagaacgcaucgg

SEQ ID NO: 3062409 - RNA, 13 nt, Mycobacterium bovis subsp bovis AF2122/97
gauccagccaugc

SEQ ID NO: 3062410 - RNA, 21 nt, Mycobacterium bovis subsp bovis AF2122/97
gauccagcccaacucggccag

SEQ ID NO: 3062411 - RNA, 17 nt, Mycobacterium bovis subsp bovis AF2122/97
gauccagcccaugcgcc

SEQ ID NO: 3062412 - RNA, 18 nt, Mycobacterium bovis subsp bovis AF2122/97
gauccagcccaugcgcca

SEQ ID NO: 3062413 - RNA, 20 nt, Mycobacterium bovis subsp bovis AF2122/97
gauccagcccaugcgccacg

SEQ ID NO: 3062414 - RNA, 13 nt, Mycobacterium bovis subsp bovis AF2122/97
gauccagcccgac

SEQ ID NO: 3062415 - RNA, 15 nt, Mycobacterium bovis subsp bovis AF2122/97
gauccagcguuugcu

SEQ ID NO: 3062416 - RNA, 19 nt, Mycobacterium bovis subsp bovis AF2122/97
gauccagcguuugcuggcg

SEQ ID NO: 3062417 - RNA, 12 nt, Mycobacterium bovis subsp bovis AF2122/97
gauccagcugua

SEQ ID NO: 3062418 - RNA, 23 nt, Mycobacterium bovis subsp bovis AF2122/97
gauccucgaugacaucggucagc

SEQ ID NO: 3062419 - RNA, 20 nt, Mycobacterium bovis subsp bovis AF2122/97
gauccugcaguacggccaac

SEQ ID NO: 3062420 - RNA, 15 nt, Mycobacterium bovis subsp bovis AF2122/97
gauccugcccaccau

SEQ ID NO: 3062421 - RNA, 19 nt, Mycobacterium bovis subsp bovis AF2122/97
gauccugcccaccaucccg

SEQ ID NO: 3062422 - RNA, 17 nt, Mycobacterium bovis subsp bovis AF2122/97
gauccuggccgauggcg

SEQ ID NO: 3062423 - RNA, 16 nt, Mycobacterium bovis subsp bovis AF2122/97
gauccugggugucgcg

SEQ ID NO: 3062424 - RNA, 14 nt, Mycobacterium bovis subsp bovis AF2122/97
gauccuucgcguug

SEQ ID NO: 3062425 - RNA, 15 nt, Mycobacterium bovis subsp bovis AF2122/97
gaucgaaccgcugcu

SEQ ID NO: 3062426 - RNA, 17 nt, Mycobacterium bovis subsp bovis AF2122/97
gaucgaacgcagccagc

SEQ ID NO: 3062427 - RNA, 15 nt, Mycobacterium bovis subsp bovis AF2122/97
gaucgaacugggggc

SEQ ID NO: 3062428 - RNA, 17 nt, Mycobacterium bovis subsp bovis AF2122/97
gaucgaagaccagcaac

SEQ ID NO: 3062429 - RNA, 15 nt, Mycobacterium bovis subsp bovis AF2122/97
gaucgaauacaccug

SEQ ID NO: 3062430 - RNA, 19 nt, Mycobacterium bovis subsp bovis AF2122/97
gaucgaauugcguucgccg

SEQ ID NO: 3062431 - RNA, 16 nt, Mycobacterium bovis subsp bovis AF2122/97
gaucgacaccagggcg

SEQ ID NO: 3062432 - RNA, 18 nt, Mycobacterium bovis subsp bovis AF2122/97
gaucgacacccgcucggc

SEQ ID NO: 3062433 - RNA, 15 nt, Mycobacterium bovis subsp bovis AF2122/97
gaucgacaccgagcc

SEQ ID NO: 3062434 - RNA, 16 nt, Mycobacterium bovis subsp bovis AF2122/97
gaucgacaccgugacc

SEQ ID NO: 3062435 - RNA, 22 nt, Mycobacterium bovis subsp bovis AF2122/97
gaucgacagccccgcggccagc

SEQ ID NO: 3062436 - RNA, 13 nt, Mycobacterium bovis subsp bovis AF2122/97
gaucgacagcggg

SEQ ID NO: 3062437 - RNA, 19 nt, Mycobacterium bovis subsp bovis AF2122/97
gaucgacaguugcgccagc

SEQ ID NO: 3062438 - RNA, 22 nt, Mycobacterium bovis subsp bovis AF2122/97
gaucgacauaguuggcgcccga

SEQ ID NO: 3062439 - RNA, 22 nt, Mycobacterium bovis subsp bovis AF2122/97
gaucgacaucaccaccgccggg

SEQ ID NO: 3062440 - RNA, 14 nt, Mycobacterium bovis subsp bovis AF2122/97
gaucgaccgccagc

SEQ ID NO: 3062441 - RNA, 21 nt, Mycobacterium bovis subsp bovis AF2122/97
gaucgaccgccuccucgauag

SEQ ID NO: 3062442 - RNA, 16 nt, Mycobacterium bovis subsp bovis AF2122/97
gaucgaccgcuggauc

SEQ ID NO: 3062443 - RNA, 18 nt, Mycobacterium bovis subsp bovis AF2122/97
gaucgaccgcuggaucgc

SEQ ID NO: 3062444 - RNA, 22 nt, Mycobacterium bovis subsp bovis AF2122/97
gaucgacgccgccacccggcgg

SEQ ID NO: 3062445 - RNA, 14 nt, Mycobacterium bovis subsp bovis AF2122/97
gaucgacgcucggc

SEQ ID NO: 3062446 - RNA, 22 nt, Mycobacterium bovis subsp bovis AF2122/97
gaucgacggccaucgugcggca

SEQ ID NO: 3062447 - RNA, 14 nt, Mycobacterium bovis subsp bovis AF2122/97
gaucgacggucguu

SEQ ID NO: 3062448 - RNA, 13 nt, Mycobacterium bovis subsp bovis AF2122/97
gaucgacgguguc

SEQ ID NO: 3062449 - RNA, 20 nt, Mycobacterium bovis subsp bovis AF2122/97
gaucgacggugucaugaacg

SEQ ID NO: 3062450 - RNA, 18 nt, Mycobacterium bovis subsp bovis AF2122/97
gaucgacuucggcgucgg

SEQ ID NO: 3062451 - RNA, 15 nt, Mycobacterium bovis subsp bovis AF2122/97
gaucgacuucggugg

SEQ ID NO: 3062452 - RNA, 18 nt, Mycobacterium bovis subsp bovis AF2122/97
gaucgagagccgaccggg

SEQ ID NO: 3062453 - RNA, 14 nt, Mycobacterium bovis subsp bovis AF2122/97
gaucgagcaggagg

SEQ ID NO: 3062454 - RNA, 17 nt, Mycobacterium bovis subsp bovis AF2122/97
gaucgagcaggccgccc

SEQ ID NO: 3062455 - RNA, 17 nt, Mycobacterium bovis subsp bovis AF2122/97
gaucgagcagggugacc

SEQ ID NO: 3062456 - RNA, 19 nt, Mycobacterium bovis subsp bovis AF2122/97
gaucgagcaguuccagcuc

SEQ ID NO: 3062457 - RNA, 15 nt, Mycobacterium bovis subsp bovis AF2122/97
gaucgagcggguguc

SEQ ID NO: 3062458 - RNA, 23 nt, Mycobacterium bovis subsp bovis AF2122/97
gaucgaggaguuggugcagcgac

SEQ ID NO: 3062459 - RNA, 13 nt, Mycobacterium bovis subsp bovis AF2122/97
gaucgaggcggcg

SEQ ID NO: 3062460 - RNA, 22 nt, Mycobacterium bovis subsp bovis AF2122/97
gaucgaggcgucggcaacccac

SEQ ID NO: 3062461 - RNA, 17 nt, Mycobacterium bovis subsp bovis AF2122/97
gaucgaggggacgggua

SEQ ID NO: 3062462 - RNA, 20 nt, Mycobacterium bovis subsp bovis AF2122/97
gaucgagggggacgcugauc

SEQ ID NO: 3062463 - RNA, 24 nt, Mycobacterium bovis subsp bovis AF2122/97
gaucgaggugacggugacgaucag

SEQ ID NO: 3062464 - RNA, 18 nt, Mycobacterium bovis subsp bovis AF2122/97
gaucgagguugacgucag

SEQ ID NO: 3062465 - RNA, 21 nt, Mycobacterium bovis subsp bovis AF2122/97
gaucgagguugacgucaggcu

SEQ ID NO: 3062466 - RNA, 14 nt, Mycobacterium bovis subsp bovis AF2122/97
gaucgaucgcggcg

SEQ ID NO: 3062467 - RNA, 20 nt, Mycobacterium bovis subsp bovis AF2122/97
gaucgaucugcgggcggguc

SEQ ID NO: 3062468 - RNA, 14 nt, Mycobacterium bovis subsp bovis AF2122/97
gaucgauuccgccg

SEQ ID NO: 3062469 - RNA, 19 nt, Mycobacterium bovis subsp bovis AF2122/97
gaucgauuuggaucggcug

SEQ ID NO: 3062470 - RNA, 21 nt, Mycobacterium bovis subsp bovis AF2122/97
gaucgcacaccaacaccgcgg

SEQ ID NO: 3062471 - RNA, 21 nt, Mycobacterium bovis subsp bovis AF2122/97
gaucgcaccgagguugcgcgg

SEQ ID NO: 3062472 - RNA, 22 nt, Mycobacterium bovis subsp bovis AF2122/97
gaucgcagggaucaccccggcc

SEQ ID NO: 3062473 - RNA, 17 nt, Mycobacterium bovis subsp bovis AF2122/97
gaucgcagugagcagcc

SEQ ID NO: 3062474 - RNA, 18 nt, Mycobacterium bovis subsp bovis AF2122/97
gaucgcaucgacgugcgc

SEQ ID NO: 3062475 - RNA, 19 nt, Mycobacterium bovis subsp bovis AF2122/97
gaucgcaucgacgugcgcg

SEQ ID NO: 3062476 - RNA, 23 nt, Mycobacterium bovis subsp bovis AF2122/97
gaucgccaacgacucacccaccc

SEQ ID NO: 3062477 - RNA, 13 nt, Mycobacterium bovis subsp bovis AF2122/97
gaucgccacccgg

SEQ ID NO: 3062478 - RNA, 20 nt, Mycobacterium bovis subsp bovis AF2122/97
gaucgccaggccgagcccgg

SEQ ID NO: 3062479 - RNA, 18 nt, Mycobacterium bovis subsp bovis AF2122/97
gaucgccaggccgucggg

SEQ ID NO: 3062480 - RNA, 16 nt, Mycobacterium bovis subsp bovis AF2122/97
gaucgcccgcugagca

SEQ ID NO: 3062481 - RNA, 12 nt, Mycobacterium bovis subsp bovis AF2122/97
gaucgcccggcc

SEQ ID NO: 3062482 - RNA, 17 nt, Mycobacterium bovis subsp bovis AF2122/97
gaucgcccgguucagcg

SEQ ID NO: 3062483 - RNA, 20 nt, Mycobacterium bovis subsp bovis AF2122/97
gaucgcccgguucagcgcug

SEQ ID NO: 3062484 - RNA, 21 nt, Mycobacterium bovis subsp bovis AF2122/97
gaucgcccgguucagcgcugg

SEQ ID NO: 3062485 - RNA, 17 nt, Mycobacterium bovis subsp bovis AF2122/97
gaucgcccugacaccca

SEQ ID NO: 3062486 - RNA, 16 nt, Mycobacterium bovis subsp bovis AF2122/97
gaucgccgaaucggca

SEQ ID NO: 3062487 - RNA, 17 nt, Mycobacterium bovis subsp bovis AF2122/97
gaucgccgagcgugaac

SEQ ID NO: 3062488 - RNA, 16 nt, Mycobacterium bovis subsp bovis AF2122/97
gaucgccgaggccucg

SEQ ID NO: 3062489 - RNA, 22 nt, Mycobacterium bovis subsp bovis AF2122/97
gaucgccgaggccucggccagc

SEQ ID NO: 3062490 - RNA, 13 nt, Mycobacterium bovis subsp bovis AF2122/97
gaucgccgccggc

SEQ ID NO: 3062491 - RNA, 15 nt, Mycobacterium bovis subsp bovis AF2122/97
gaucgccgccggcgc

SEQ ID NO: 3062492 - RNA, 16 nt, Mycobacterium bovis subsp bovis AF2122/97
gaucgccgccggcgcc

SEQ ID NO: 3062493 - RNA, 22 nt, Mycobacterium bovis subsp bovis AF2122/97
gaucgccgcgaagcgcucggca

SEQ ID NO: 3062494 - RNA, 13 nt, Mycobacterium bovis subsp bovis AF2122/97
gaucgccgcgcug

SEQ ID NO: 3062495 - RNA, 14 nt, Mycobacterium bovis subsp bovis AF2122/97
gaucgccggccgcg

SEQ ID NO: 3062496 - RNA, 16 nt, Mycobacterium bovis subsp bovis AF2122/97
gaucgccggccgcgug

SEQ ID NO: 3062497 - RNA, 20 nt, Mycobacterium bovis subsp bovis AF2122/97
gaucgccggccugcucggcg

SEQ ID NO: 3062498 - RNA, 21 nt, Mycobacterium bovis subsp bovis AF2122/97
gaucgccggccugcucggcga

SEQ ID NO: 3062499 - RNA, 17 nt, Mycobacterium bovis subsp bovis AF2122/97
gaucgccggcuucgccc

SEQ ID NO: 3062500 - RNA, 23 nt, Mycobacterium bovis subsp bovis AF2122/97
gaucgccggcuucgcccagagcc

SEQ ID NO: 3062501 - RNA, 22 nt, Mycobacterium bovis subsp bovis AF2122/97
gaucgccgggcuuggccgcgcc

SEQ ID NO: 3062502 - RNA, 21 nt, Mycobacterium bovis subsp bovis AF2122/97
gaucgccggggacgccgcggc

SEQ ID NO: 3062503 - RNA, 14 nt, Mycobacterium bovis subsp bovis AF2122/97
gaucgccguccagc

SEQ ID NO: 3062504 - RNA, 23 nt, Mycobacterium bovis subsp bovis AF2122/97
gaucggcaggguggccagcaggc

SEQ ID NO: 3062505 - RNA, 13 nt, Mycobacterium bovis subsp bovis AF2122/97
gaucggccaccau

SEQ ID NO: 3062506 - RNA, 14 nt, Mycobacterium bovis subsp bovis AF2122/97
gaucggccaccauc

SEQ ID NO: 3062507 - RNA, 20 nt, Mycobacterium bovis subsp bovis AF2122/97
gaucggccaccaucgccccg

SEQ ID NO: 3062508 - RNA, 15 nt, Mycobacterium bovis subsp bovis AF2122/97
gaucggcccagcccu

SEQ ID NO: 3062509 - RNA, 20 nt, Mycobacterium bovis subsp bovis AF2122/97
gaucggccgguauuucggcg

SEQ ID NO: 3062510 - RNA, 12 nt, Mycobacterium bovis subsp bovis AF2122/97
gaucggcgacgc

SEQ ID NO: 3062511 - RNA, 13 nt, Mycobacterium bovis subsp bovis AF2122/97
gaucggcgcccgg

SEQ ID NO: 3062512 - RNA, 15 nt, Mycobacterium bovis subsp bovis AF2122/97
gaucggcgccgcaua

SEQ ID NO: 3062513 - RNA, 15 nt, Mycobacterium bovis subsp bovis AF2122/97
gaucggcgcgccgau

SEQ ID NO: 3062514 - RNA, 16 nt, Mycobacterium bovis subsp bovis AF2122/97
gaucggcgcgccgauc

SEQ ID NO: 3062515 - RNA, 17 nt, Mycobacterium bovis subsp bovis AF2122/97
gaucggcgcgccgaucg

SEQ ID NO: 3062516 - RNA, 13 nt, Mycobacterium bovis subsp bovis AF2122/97
gaucggcgcggcc

SEQ ID NO: 3062517 - RNA, 17 nt, Mycobacterium bovis subsp bovis AF2122/97
gaucggcgcggccguag

SEQ ID NO: 3062518 - RNA, 21 nt, Mycobacterium bovis subsp bovis AF2122/97
gaucggcgcggccguagugca

SEQ ID NO: 3062519 - RNA, 19 nt, Mycobacterium bovis subsp bovis AF2122/97
gaucggcggauagucgcgg

SEQ ID NO: 3062520 - RNA, 22 nt, Mycobacterium bovis subsp bovis AF2122/97
gaucggcggauagucgcgggcc

SEQ ID NO: 3062521 - RNA, 17 nt, Mycobacterium bovis subsp bovis AF2122/97
gaucggcggcaaccgcc

SEQ ID NO: 3062522 - RNA, 20 nt, Mycobacterium bovis subsp bovis AF2122/97
gaucggcggcaaccgccgcc

SEQ ID NO: 3062523 - RNA, 21 nt, Mycobacterium bovis subsp bovis AF2122/97
gaucggcggcaaccgccgcca

SEQ ID NO: 3062524 - RNA, 13 nt, Mycobacterium bovis subsp bovis AF2122/97
gaucggcggccgc

SEQ ID NO: 3062525 - RNA, 17 nt, Mycobacterium bovis subsp bovis AF2122/97
gaucggcggccgcgacc

SEQ ID NO: 3062526 - RNA, 18 nt, Mycobacterium bovis subsp bovis AF2122/97
gaucggcggccgcgacca

SEQ ID NO: 3062527 - RNA, 16 nt, Mycobacterium bovis subsp bovis AF2122/97
gaucggcggccggcac

SEQ ID NO: 3062528 - RNA, 19 nt, Mycobacterium bovis subsp bovis AF2122/97
gaucggcggcgcgccgauc

SEQ ID NO: 3062529 - RNA, 11 nt, Mycobacterium bovis subsp bovis AF2122/97
gaucggcguca

SEQ ID NO: 3062530 - RNA, 20 nt, Mycobacterium bovis subsp bovis AF2122/97
gaucggcuaccuaacccgca

SEQ ID NO: 3062531 - RNA, 21 nt, Mycobacterium bovis subsp bovis AF2122/97
gaucggcuaccuaacccgcac

SEQ ID NO: 3062532 - RNA, 21 nt, Mycobacterium bovis subsp bovis AF2122/97
gaucggcucaccgaacgcgau

SEQ ID NO: 3062533 - RNA, 15 nt, Mycobacterium bovis subsp bovis AF2122/97
gaucggcucgccacc

SEQ ID NO: 3062534 - RNA, 20 nt, Mycobacterium bovis subsp bovis AF2122/97
gaucggcugcgcgcucggcc

SEQ ID NO: 3062535 - RNA, 22 nt, Mycobacterium bovis subsp bovis AF2122/97
gaucggcugcgcgcucggccag

SEQ ID NO: 3062536 - RNA, 23 nt, Mycobacterium bovis subsp bovis AF2122/97
gaucggcugcgcgcucggccagc

SEQ ID NO: 3062537 - RNA, 19 nt, Mycobacterium bovis subsp bovis AF2122/97
gaucggcuugccugcgccg

SEQ ID NO: 3062538 - RNA, 18 nt, Mycobacterium bovis subsp bovis AF2122/97
gaucggcuugggaaaccc

SEQ ID NO: 3062539 - RNA, 22 nt, Mycobacterium bovis subsp bovis AF2122/97
gaucgggaauuucgucggccau

SEQ ID NO: 3062540 - RNA, 21 nt, Mycobacterium bovis subsp bovis AF2122/97
gaucgggcaccccgaccacca

SEQ ID NO: 3062541 - RNA, 21 nt, Mycobacterium bovis subsp bovis AF2122/97
gaucgggcagcacgccagccc

SEQ ID NO: 3062542 - RNA, 14 nt, Mycobacterium bovis subsp bovis AF2122/97
gaucgggcccaccg

SEQ ID NO: 3062543 - RNA, 13 nt, Mycobacterium bovis subsp bovis AF2122/97
gaucgggccgauc

SEQ ID NO: 3062544 - RNA, 16 nt, Mycobacterium bovis subsp bovis AF2122/97
gaucgggccggccgcc

SEQ ID NO: 3062545 - RNA, 13 nt, Mycobacterium bovis subsp bovis AF2122/97
gaucgggccggcg

SEQ ID NO: 3062546 - RNA, 14 nt, Mycobacterium bovis subsp bovis AF2122/97
gaucgggccggcgc

SEQ ID NO: 3062547 - RNA, 16 nt, Mycobacterium bovis subsp bovis AF2122/97
gaucgggccggcgcgg

SEQ ID NO: 3062548 - RNA, 13 nt, Mycobacterium bovis subsp bovis AF2122/97
gaucgggcuucgg

SEQ ID NO: 3062549 - RNA, 18 nt, Mycobacterium bovis subsp bovis AF2122/97
gaucgggcuucggccaga

SEQ ID NO: 3062550 - RNA, 22 nt, Mycobacterium bovis subsp bovis AF2122/97
gaucgggucguuggcggcgguc

SEQ ID NO: 3062551 - RNA, 15 nt, Mycobacterium bovis subsp bovis AF2122/97
gaucggguggcgggu

SEQ ID NO: 3062552 - RNA, 20 nt, Mycobacterium bovis subsp bovis AF2122/97
gaucgguaccgacggcacca

SEQ ID NO: 3062553 - RNA, 17 nt, Mycobacterium bovis subsp bovis AF2122/97
gaucggucaacucgaac

SEQ ID NO: 3062554 - RNA, 18 nt, Mycobacterium bovis subsp bovis AF2122/97
gaucggucaacucgaacg

SEQ ID NO: 3062555 - RNA, 16 nt, Mycobacterium bovis subsp bovis AF2122/97
gaucgguccggcgaac

SEQ ID NO: 3062556 - RNA, 22 nt, Mycobacterium bovis subsp bovis AF2122/97
gaucggucuuggcgauccaggc

SEQ ID NO: 3062557 - RNA, 19 nt, Mycobacterium bovis subsp bovis AF2122/97
gaucggugccagaaugccg

SEQ ID NO: 3062558 - RNA, 17 nt, Mycobacterium bovis subsp bovis AF2122/97
gaucggugccagcacuc

SEQ ID NO: 3062559 - RNA, 21 nt, Mycobacterium bovis subsp bovis AF2122/97
gaucggugcccaacccacucg

SEQ ID NO: 3062560 - RNA, 17 nt, Mycobacterium bovis subsp bovis AF2122/97
gaucggugcgggcgccg

SEQ ID NO: 3062561 - RNA, 15 nt, Mycobacterium bovis subsp bovis AF2122/97
gaucgguggcggcac

SEQ ID NO: 3062562 - RNA, 13 nt, Mycobacterium bovis subsp bovis AF2122/97
gaucggugggcgg

SEQ ID NO: 3062563 - RNA, 17 nt, Mycobacterium bovis subsp bovis AF2122/97
gaucgguugaucggcca

SEQ ID NO: 3062564 - RNA, 17 nt, Mycobacterium bovis subsp bovis AF2122/97
gaucguagggacgccga

SEQ ID NO: 3062565 - RNA, 18 nt, Mycobacterium bovis subsp bovis AF2122/97
gaucguagugcgcgccaa

SEQ ID NO: 3062566 - RNA, 23 nt, Mycobacterium bovis subsp bovis AF2122/97
gaucgucacaccaguagcaccag

SEQ ID NO: 3062567 - RNA, 12 nt, Mycobacterium bovis subsp bovis AF2122/97
gaucguccaccg

SEQ ID NO: 3062568 - RNA, 16 nt, Mycobacterium bovis subsp bovis AF2122/97
gaucguccaccgccga

SEQ ID NO: 3062569 - RNA, 16 nt, Mycobacterium bovis subsp bovis AF2122/97
gaucguccagcccaga

SEQ ID NO: 3062570 - RNA, 19 nt, Mycobacterium bovis subsp bovis AF2122/97
gaucgucgaacagcaccgc

SEQ ID NO: 3062571 - RNA, 20 nt, Mycobacterium bovis subsp bovis AF2122/97
gaucgucgaacagcaccgcc

SEQ ID NO: 3062572 - RNA, 16 nt, Mycobacterium bovis subsp bovis AF2122/97
gaucgucgacucggcg

SEQ ID NO: 3062573 - RNA, 19 nt, Mycobacterium bovis subsp bovis AF2122/97
gaucgucgacucggcggcg

SEQ ID NO: 3062574 - RNA, 16 nt, Mycobacterium bovis subsp bovis AF2122/97
gaucgucgccgaucau

SEQ ID NO: 3062575 - RNA, 15 nt, Mycobacterium bovis subsp bovis AF2122/97
gaucgucgcgaccuu

SEQ ID NO: 3062576 - RNA, 14 nt, Mycobacterium bovis subsp bovis AF2122/97
gaucgucgggagca

SEQ ID NO: 3062577 - RNA, 20 nt, Mycobacterium bovis subsp bovis AF2122/97
gaucgucgucaacccggugu

SEQ ID NO: 3062578 - RNA, 21 nt, Mycobacterium bovis subsp bovis AF2122/97
gaucgucgucaacccgguguc

SEQ ID NO: 3062579 - RNA, 17 nt, Mycobacterium bovis subsp bovis AF2122/97
gaucgucgugcacggcg

SEQ ID NO: 3062580 - RNA, 20 nt, Mycobacterium bovis subsp bovis AF2122/97
gaucgucgugcacggcggcc

SEQ ID NO: 3062581 - RNA, 23 nt, Mycobacterium bovis subsp bovis AF2122/97
gaucgucgugcacggcggccagg

SEQ ID NO: 3062582 - RNA, 21 nt, Mycobacterium bovis subsp bovis AF2122/97
gaucgucguugucagcgaacg

SEQ ID NO: 3062583 - RNA, 17 nt, Mycobacterium bovis subsp bovis AF2122/97
gaucgucucgcgcaccu

SEQ ID NO: 3062584 - RNA, 23 nt, Mycobacterium bovis subsp bovis AF2122/97
gaucgucuuccauuucggaacgc

SEQ ID NO: 3062585 - RNA, 19 nt, Mycobacterium bovis subsp bovis AF2122/97
gaucgugaacacgucgcgg

SEQ ID NO: 3062586 - RNA, 15 nt, Mycobacterium bovis subsp bovis AF2122/97
gaucgugagacgccg

SEQ ID NO: 3062587 - RNA, 19 nt, Mycobacterium bovis subsp bovis AF2122/97
gaucgugcacaaucgguug

SEQ ID NO: 3062588 - RNA, 14 nt, Mycobacterium bovis subsp bovis AF2122/97
gaucgugccggcga

SEQ ID NO: 3062589 - RNA, 14 nt, Mycobacterium bovis subsp bovis AF2122/97
gaucgugccgggac

SEQ ID NO: 3062590 - RNA, 19 nt, Mycobacterium bovis subsp bovis AF2122/97
gaucugggcugcggccgcg

SEQ ID NO: 3062591 - RNA, 15 nt, Mycobacterium bovis subsp bovis AF2122/97
gaucugggcuggcag

SEQ ID NO: 3062592 - RNA, 17 nt, Mycobacterium bovis subsp bovis AF2122/97
gaucuggggcaccacgc

SEQ ID NO: 3062593 - RNA, 23 nt, Mycobacterium bovis subsp bovis AF2122/97
gaucuggguaagggacaccagcu

SEQ ID NO: 3062594 - RNA, 15 nt, Mycobacterium bovis subsp bovis AF2122/97
gaucugguccagugg

SEQ ID NO: 3062595 - RNA, 14 nt, Mycobacterium bovis subsp bovis AF2122/97
gaucuggucggcgg

SEQ ID NO: 3062596 - RNA, 16 nt, Mycobacterium bovis subsp bovis AF2122/97
gaucuggucggcggcc

SEQ ID NO: 3062597 - RNA, 18 nt, Mycobacterium bovis subsp bovis AF2122/97
gaucuggucggcggccuc

SEQ ID NO: 3062598 - RNA, 14 nt, Mycobacterium bovis subsp bovis AF2122/97
gaucuggugcgcgg

SEQ ID NO: 3062599 - RNA, 14 nt, Mycobacterium bovis subsp bovis AF2122/97
gaucugucagcgcg

SEQ ID NO: 3062600 - RNA, 23 nt, Mycobacterium bovis subsp bovis AF2122/97
gaucuguggaagcccgucgcggc

SEQ ID NO: 3062601 - RNA, 19 nt, Mycobacterium bovis subsp bovis AF2122/97
gaucuguuccucggugacu

SEQ ID NO: 3062602 - RNA, 19 nt, Mycobacterium bovis subsp bovis AF2122/97
gaucuucaccggccggugc

SEQ ID NO: 3062603 - RNA, 18 nt, Mycobacterium bovis subsp bovis AF2122/97
gaucuuccccucggccgc

SEQ ID NO: 3062604 - RNA, 18 nt, Mycobacterium bovis subsp bovis AF2122/97
gaucuucgacaggccacc

SEQ ID NO: 3062605 - RNA, 14 nt, Mycobacterium bovis subsp bovis AF2122/97
gaucuucgccgaga

SEQ ID NO: 3062606 - RNA, 15 nt, Mycobacterium bovis subsp bovis AF2122/97
gaucuucggccgcac

SEQ ID NO: 3062607 - RNA, 16 nt, Mycobacterium bovis subsp bovis AF2122/97
gaucuugccgcggcgc

SEQ ID NO: 3062608 - RNA, 13 nt, Mycobacterium bovis subsp bovis AF2122/97
gaucuuggccagc

SEQ ID NO: 3062609 - RNA, 14 nt, Mycobacterium bovis subsp bovis AF2122/97
gaucuuggccagca

SEQ ID NO: 3062610 - RNA, 20 nt, Mycobacterium bovis subsp bovis AF2122/97
gaucuuggcgcccgccggca

SEQ ID NO: 3062611 - RNA, 15 nt, Mycobacterium bovis subsp bovis AF2122/97
gaucuugguguuggu

SEQ ID NO: 3062612 - RNA, 14 nt, Mycobacterium bovis subsp bovis AF2122/97
gaugaaacgccguc

SEQ ID NO: 3062613 - RNA, 21 nt, Mycobacterium bovis subsp bovis AF2122/97
gaugaaagugccagugcgcag

SEQ ID NO: 3062614 - RNA, 15 nt, Mycobacterium bovis subsp bovis AF2122/97
gaugaacaccggcgc

SEQ ID NO: 3062615 - RNA, 17 nt, Mycobacterium bovis subsp bovis AF2122/97
gaugaaccacggcaggc

SEQ ID NO: 3062616 - RNA, 12 nt, Mycobacterium bovis subsp bovis AF2122/97
gaugaaccaggc

SEQ ID NO: 3062617 - RNA, 13 nt, Mycobacterium bovis subsp bovis AF2122/97
gaugaaccaggcg

SEQ ID NO: 3062618 - RNA, 18 nt, Mycobacterium bovis subsp bovis AF2122/97
gaugaacggaaucuuguu

SEQ ID NO: 3062619 - RNA, 22 nt, Mycobacterium bovis subsp bovis AF2122/97
gaugaacgggaucgacccgccc

SEQ ID NO: 3062620 - RNA, 12 nt, Mycobacterium bovis subsp bovis AF2122/97
gaugaagcuggu

SEQ ID NO: 3062621 - RNA, 20 nt, Mycobacterium bovis subsp bovis AF2122/97
gaugaaggugacgacgaggg

SEQ ID NO: 3062622 - RNA, 22 nt, Mycobacterium bovis subsp bovis AF2122/97
gaugaaguguuuggcguugggc

SEQ ID NO: 3062623 - RNA, 21 nt, Mycobacterium bovis subsp bovis AF2122/97
gaugaauucauguggcgcggg

SEQ ID NO: 3062624 - RNA, 22 nt, Mycobacterium bovis subsp bovis AF2122/97
gaugaauuucauaaaccgcaca

SEQ ID NO: 3062625 - RNA, 20 nt, Mycobacterium bovis subsp bovis AF2122/97
gaugacacgucuaucggcga

SEQ ID NO: 3062626 - RNA, 18 nt, Mycobacterium bovis subsp bovis AF2122/97
gaugaccagcacaccgcc

SEQ ID NO: 3062627 - RNA, 19 nt, Mycobacterium bovis subsp bovis AF2122/97
gaugaccagcacaccgccc

SEQ ID NO: 3062628 - RNA, 18 nt, Mycobacterium bovis subsp bovis AF2122/97
gaugaccagggucugcuc

SEQ ID NO: 3062629 - RNA, 17 nt, Mycobacterium bovis subsp bovis AF2122/97
gaugaccaggucgguca

SEQ ID NO: 3062630 - RNA, 13 nt, Mycobacterium bovis subsp bovis AF2122/97
gaugaccagugau

SEQ ID NO: 3062631 - RNA, 18 nt, Mycobacterium bovis subsp bovis AF2122/97
gaugaccaugaugaccgg

SEQ ID NO: 3062632 - RNA, 19 nt, Mycobacterium bovis subsp bovis AF2122/97
gaugaccaugaugaccggc

SEQ ID NO: 3062633 - RNA, 20 nt, Mycobacterium bovis subsp bovis AF2122/97
gaugaccaugaugaccggca

SEQ ID NO: 3062634 - RNA, 14 nt, Mycobacterium bovis subsp bovis AF2122/97
gaugacccacugca

SEQ ID NO: 3062635 - RNA, 16 nt, Mycobacterium bovis subsp bovis AF2122/97
gaugacccacugcagg

SEQ ID NO: 3062636 - RNA, 17 nt, Mycobacterium bovis subsp bovis AF2122/97
gaugacccacugcaggc

SEQ ID NO: 3062637 - RNA, 15 nt, Mycobacterium bovis subsp bovis AF2122/97
gaugaccccgguggu

SEQ ID NO: 3062638 - RNA, 15 nt, Mycobacterium bovis subsp bovis AF2122/97
gaugacccggaaucc

SEQ ID NO: 3062639 - RNA, 20 nt, Mycobacterium bovis subsp bovis AF2122/97
gaugacccggaaucccgagu

SEQ ID NO: 3062640 - RNA, 24 nt, Mycobacterium bovis subsp bovis AF2122/97
gaugacccggaaucccgagucugc

SEQ ID NO: 3062641 - RNA, 19 nt, Mycobacterium bovis subsp bovis AF2122/97
gaugaccgaaccuggucuu

SEQ ID NO: 3062642 - RNA, 14 nt, Mycobacterium bovis subsp bovis AF2122/97
gaugaccgcaaccg

SEQ ID NO: 3062643 - RNA, 13 nt, Mycobacterium bovis subsp bovis AF2122/97
gaugaccgccgcc

SEQ ID NO: 3062644 - RNA, 13 nt, Mycobacterium bovis subsp bovis AF2122/97
gaugaccggacgc

SEQ ID NO: 3062645 - RNA, 21 nt, Mycobacterium bovis subsp bovis AF2122/97
gaugaccgguauuaccgccgu

SEQ ID NO: 3062646 - RNA, 24 nt, Mycobacterium bovis subsp bovis AF2122/97
gaugaccgguauuaccgccguggc

SEQ ID NO: 3062647 - RNA, 20 nt, Mycobacterium bovis subsp bovis AF2122/97
gaugaccguauagccgacgc

SEQ ID NO: 3062648 - RNA, 12 nt, Mycobacterium bovis subsp bovis AF2122/97
gaugaccgucgc

SEQ ID NO: 3062649 - RNA, 14 nt, Mycobacterium bovis subsp bovis AF2122/97
gaugaccgucgcac

SEQ ID NO: 3062650 - RNA, 16 nt, Mycobacterium bovis subsp bovis AF2122/97
gaugaccucggcgaug

SEQ ID NO: 3062651 - RNA, 22 nt, Mycobacterium bovis subsp bovis AF2122/97
gaugaccucggcgaugucgcgc

SEQ ID NO: 3062652 - RNA, 15 nt, Mycobacterium bovis subsp bovis AF2122/97
gaugaccucgucaag

SEQ ID NO: 3062653 - RNA, 13 nt, Mycobacterium bovis subsp bovis AF2122/97
gaugaccuucccg

SEQ ID NO: 3062654 - RNA, 17 nt, Mycobacterium bovis subsp bovis AF2122/97
gaugaccuugcccacca

SEQ ID NO: 3062655 - RNA, 18 nt, Mycobacterium bovis subsp bovis AF2122/97
gaugaccuugggaccacc

SEQ ID NO: 3062656 - RNA, 21 nt, Mycobacterium bovis subsp bovis AF2122/97
gaugaccuugggaccaccggg

SEQ ID NO: 3062657 - RNA, 21 nt, Mycobacterium bovis subsp bovis AF2122/97
gaugacgaacaagaaaagcag

SEQ ID NO: 3062658 - RNA, 18 nt, Mycobacterium bovis subsp bovis AF2122/97
gaugacgaucgcguccgc

SEQ ID NO: 3062659 - RNA, 18 nt, Mycobacterium bovis subsp bovis AF2122/97
gaugacgaucggcggcgc

SEQ ID NO: 3062660 - RNA, 16 nt, Mycobacterium bovis subsp bovis AF2122/97
gaugacgaucugguca

SEQ ID NO: 3062661 - RNA, 23 nt, Mycobacterium bovis subsp bovis AF2122/97
gaugacgcccagggcgucggcga

SEQ ID NO: 3062662 - RNA, 23 nt, Mycobacterium bovis subsp bovis AF2122/97
gaugacgccgucagcggccaagu

SEQ ID NO: 3062663 - RNA, 17 nt, Mycobacterium bovis subsp bovis AF2122/97
gaugacgccgucggcgc

SEQ ID NO: 3062664 - RNA, 19 nt, Mycobacterium bovis subsp bovis AF2122/97
gaugacgccgucggcgcgc

SEQ ID NO: 3062665 - RNA, 22 nt, Mycobacterium bovis subsp bovis AF2122/97
gaugacgcguucaacaccgccg

SEQ ID NO: 3062666 - RNA, 14 nt, Mycobacterium bovis subsp bovis AF2122/97
gaugacggugccga

SEQ ID NO: 3062667 - RNA, 17 nt, Mycobacterium bovis subsp bovis AF2122/97
gaugacguugcagccgg

SEQ ID NO: 3062668 - RNA, 19 nt, Mycobacterium bovis subsp bovis AF2122/97
gaugacguugcagccggca

SEQ ID NO: 3062669 - RNA, 18 nt, Mycobacterium bovis subsp bovis AF2122/97
gaugagcaacgccacgcc

SEQ ID NO: 3062670 - RNA, 19 nt, Mycobacterium bovis subsp bovis AF2122/97
gaugagcaacgccacgccg

SEQ ID NO: 3062671 - RNA, 19 nt, Mycobacterium bovis subsp bovis AF2122/97
gaugagcaugcccagcgca

SEQ ID NO: 3062672 - RNA, 15 nt, Mycobacterium bovis subsp bovis AF2122/97
gaugagccgcagaug

SEQ ID NO: 3062673 - RNA, 23 nt, Mycobacterium bovis subsp bovis AF2122/97
gaugagccgcagaugcaccugcg

SEQ ID NO: 3062674 - RNA, 17 nt, Mycobacterium bovis subsp bovis AF2122/97
gaugagccugcaggccg

SEQ ID NO: 3062675 - RNA, 23 nt, Mycobacterium bovis subsp bovis AF2122/97
gaugagccugcaggccgccggcc

SEQ ID NO: 3062676 - RNA, 15 nt, Mycobacterium bovis subsp bovis AF2122/97
gaugccgcgcagcgc

SEQ ID NO: 3062677 - RNA, 16 nt, Mycobacterium bovis subsp bovis AF2122/97
gaugccgcgcagcgcg

SEQ ID NO: 3062678 - RNA, 18 nt, Mycobacterium bovis subsp bovis AF2122/97
gaugccggacagcucgcg

SEQ ID NO: 3062679 - RNA, 19 nt, Mycobacterium bovis subsp bovis AF2122/97
gaugccggacagcucgcgc

SEQ ID NO: 3062680 - RNA, 12 nt, Mycobacterium bovis subsp bovis AF2122/97
gaugccggacgc

SEQ ID NO: 3062681 - RNA, 15 nt, Mycobacterium bovis subsp bovis AF2122/97
gaugccggacgccau

SEQ ID NO: 3062682 - RNA, 20 nt, Mycobacterium bovis subsp bovis AF2122/97
gaugccggacgccaugcccg

SEQ ID NO: 3062683 - RNA, 13 nt, Mycobacterium bovis subsp bovis AF2122/97
gaugccggcaagc

SEQ ID NO: 3062684 - RNA, 19 nt, Mycobacterium bovis subsp bovis AF2122/97
gaugccggcgaaggccagc

SEQ ID NO: 3062685 - RNA, 20 nt, Mycobacterium bovis subsp bovis AF2122/97
gaugccggcgaaggccagca

SEQ ID NO: 3062686 - RNA, 17 nt, Mycobacterium bovis subsp bovis AF2122/97
gaugccggcgagcaggc

SEQ ID NO: 3062687 - RNA, 19 nt, Mycobacterium bovis subsp bovis AF2122/97
gaugccggcgagcaggccg

SEQ ID NO: 3062688 - RNA, 13 nt, Mycobacterium bovis subsp bovis AF2122/97
gaugccggcguug

SEQ ID NO: 3062689 - RNA, 22 nt, Mycobacterium bovis subsp bovis AF2122/97
gaugccggcuagauaacccaac

SEQ ID NO: 3062690 - RNA, 22 nt, Mycobacterium bovis subsp bovis AF2122/97
gaugccgggcugaggcggcgac

SEQ ID NO: 3062691 - RNA, 15 nt, Mycobacterium bovis subsp bovis AF2122/97
gaugccgggucgcgg

SEQ ID NO: 3062692 - RNA, 14 nt, Mycobacterium bovis subsp bovis AF2122/97
gaugccgggugugu

SEQ ID NO: 3062693 - RNA, 15 nt, Mycobacterium bovis subsp bovis AF2122/97
gaugccggucggcgu

SEQ ID NO: 3062694 - RNA, 18 nt, Mycobacterium bovis subsp bovis AF2122/97
gaugccggucggcgucga

SEQ ID NO: 3062695 - RNA, 22 nt, Mycobacterium bovis subsp bovis AF2122/97
gaugccguaggcggccaguugc

SEQ ID NO: 3062696 - RNA, 21 nt, Mycobacterium bovis subsp bovis AF2122/97
gaugccguaguaaggagccgg

SEQ ID NO: 3062697 - RNA, 20 nt, Mycobacterium bovis subsp bovis AF2122/97
gaugccgucuuugucacgca

SEQ ID NO: 3062698 - RNA, 23 nt, Mycobacterium bovis subsp bovis AF2122/97
gaugccgucuuugucacgcaccg

SEQ ID NO: 3062699 - RNA, 13 nt, Mycobacterium bovis subsp bovis AF2122/97
gaugccgugcccg

SEQ ID NO: 3062700 - RNA, 14 nt, Mycobacterium bovis subsp bovis AF2122/97
gaugccgugcccgg

SEQ ID NO: 3062701 - RNA, 17 nt, Mycobacterium bovis subsp bovis AF2122/97
gaugccgugccgggcca

SEQ ID NO: 3062702 - RNA, 20 nt, Mycobacterium bovis subsp bovis AF2122/97
gaugccgugcugggccgacg

SEQ ID NO: 3062703 - RNA, 14 nt, Mycobacterium bovis subsp bovis AF2122/97
gaugccugacacga

SEQ ID NO: 3062704 - RNA, 14 nt, Mycobacterium bovis subsp bovis AF2122/97
gaugccugccaccc

SEQ ID NO: 3062705 - RNA, 18 nt, Mycobacterium bovis subsp bovis AF2122/97
gaugccugcuagcagcag

SEQ ID NO: 3062706 - RNA, 22 nt, Mycobacterium bovis subsp bovis AF2122/97
gaugccugcuagcagcagcccg

SEQ ID NO: 3062707 - RNA, 14 nt, Mycobacterium bovis subsp bovis AF2122/97
gaugccuuccgacg

SEQ ID NO: 3062708 - RNA, 16 nt, Mycobacterium bovis subsp bovis AF2122/97
gaugccuuccucggca

SEQ ID NO: 3062709 - RNA, 18 nt, Mycobacterium bovis subsp bovis AF2122/97
gaugccuucguagcggcc

SEQ ID NO: 3062710 - RNA, 20 nt, Mycobacterium bovis subsp bovis AF2122/97
gaugccuucguagcggccgc

SEQ ID NO: 3062711 - RNA, 14 nt, Mycobacterium bovis subsp bovis AF2122/97
gaugcgacccgcag

SEQ ID NO: 3062712 - RNA, 17 nt, Mycobacterium bovis subsp bovis AF2122/97
gaugcgacgaaccucgg

SEQ ID NO: 3062713 - RNA, 22 nt, Mycobacterium bovis subsp bovis AF2122/97
gaugcgacgaaccucggcggga

SEQ ID NO: 3062714 - RNA, 16 nt, Mycobacterium bovis subsp bovis AF2122/97
gaugcgaucgacgauc

SEQ ID NO: 3062715 - RNA, 16 nt, Mycobacterium bovis subsp bovis AF2122/97
gaugcgaugcgcgccg

SEQ ID NO: 3062716 - RNA, 17 nt, Mycobacterium bovis subsp bovis AF2122/97
gaugcgauggccgacgc

SEQ ID NO: 3062717 - RNA, 18 nt, Mycobacterium bovis subsp bovis AF2122/97
gaugcgauuccgcgucug

SEQ ID NO: 3062718 - RNA, 20 nt, Mycobacterium bovis subsp bovis AF2122/97
gaugcgauuccgcgucugcu

SEQ ID NO: 3062719 - RNA, 20 nt, Mycobacterium bovis subsp bovis AF2122/97
gaugcgauucugcgucugcu

SEQ ID NO: 3062720 - RNA, 23 nt, Mycobacterium bovis subsp bovis AF2122/97
gaugcgcaacuucuucagcagcg

SEQ ID NO: 3062721 - RNA, 20 nt, Mycobacterium bovis subsp bovis AF2122/97
gaugcgcacaccgacccgcu

SEQ ID NO: 3062722 - RNA, 14 nt, Mycobacterium bovis subsp bovis AF2122/97
gaugcgcaccagcg

SEQ ID NO: 3062723 - RNA, 16 nt, Mycobacterium bovis subsp bovis AF2122/97
gaugcgcaccagcggc

SEQ ID NO: 3062724 - RNA, 22 nt, Mycobacterium bovis subsp bovis AF2122/97
gaugcgcacucccggcucggcc

SEQ ID NO: 3062725 - RNA, 20 nt, Mycobacterium bovis subsp bovis AF2122/97
gaugcgcagcccgucggugg

SEQ ID NO: 3062726 - RNA, 16 nt, Mycobacterium bovis subsp bovis AF2122/97
gaugcgccaccggcgc

SEQ ID NO: 3062727 - RNA, 15 nt, Mycobacterium bovis subsp bovis AF2122/97
gaugcgcccggcgug

SEQ ID NO: 3062728 - RNA, 18 nt, Mycobacterium bovis subsp bovis AF2122/97
gaugcgccgcacggcgac

SEQ ID NO: 3062729 - RNA, 20 nt, Mycobacterium bovis subsp bovis AF2122/97
gaugcgccgcacggcgacgc

SEQ ID NO: 3062730 - RNA, 16 nt, Mycobacterium bovis subsp bovis AF2122/97
gaugcgccggaccagc

SEQ ID NO: 3062731 - RNA, 17 nt, Mycobacterium bovis subsp bovis AF2122/97
gaugcgcgcggcgcgau

SEQ ID NO: 3062732 - RNA, 13 nt, Mycobacterium bovis subsp bovis AF2122/97
gaugcgcggcggg

SEQ ID NO: 3062733 - RNA, 17 nt, Mycobacterium bovis subsp bovis AF2122/97
gaugcgcgggugguuca

SEQ ID NO: 3062734 - RNA, 17 nt, Mycobacterium bovis subsp bovis AF2122/97
gaugcgcgucucgagcg

SEQ ID NO: 3062735 - RNA, 15 nt, Mycobacterium bovis subsp bovis AF2122/97
gaugcgcucggccug

SEQ ID NO: 3062736 - RNA, 22 nt, Mycobacterium bovis subsp bovis AF2122/97
gaugcgcugcucacgcagcagu

SEQ ID NO: 3062737 - RNA, 18 nt, Mycobacterium bovis subsp bovis AF2122/97
gaugcgcuuccaucgcca

SEQ ID NO: 3062738 - RNA, 21 nt, Mycobacterium bovis subsp bovis AF2122/97
gaugcggaaaucggacgacuc

SEQ ID NO: 3062739 - RNA, 18 nt, Mycobacterium bovis subsp bovis AF2122/97
gaugcggaacgccgagca

SEQ ID NO: 3062740 - RNA, 22 nt, Mycobacterium bovis subsp bovis AF2122/97
gaugcggaccacaccgucaccg

SEQ ID NO: 3062741 - RNA, 18 nt, Mycobacterium bovis subsp bovis AF2122/97
gaugcggaugucgucgac

SEQ ID NO: 3062742 - RNA, 21 nt, Mycobacterium bovis subsp bovis AF2122/97
gaugcggccccaugcgccagc

SEQ ID NO: 3062743 - RNA, 20 nt, Mycobacterium bovis subsp bovis AF2122/97
gaugcggcccgggcucggcg

SEQ ID NO: 3062744 - RNA, 17 nt, Mycobacterium bovis subsp bovis AF2122/97
gaugcggccgcggcagc

SEQ ID NO: 3062745 - RNA, 18 nt, Mycobacterium bovis subsp bovis AF2122/97
gaugcggcgcagcgacgc

SEQ ID NO: 3062746 - RNA, 19 nt, Mycobacterium bovis subsp bovis AF2122/97
gaugcggcugaauucggcg

SEQ ID NO: 3062747 - RNA, 22 nt, Mycobacterium bovis subsp bovis AF2122/97
gaugcggcugaauucggcgagc

SEQ ID NO: 3062748 - RNA, 17 nt, Mycobacterium bovis subsp bovis AF2122/97
gaugcgggccgccaggc

SEQ ID NO: 3062749 - RNA, 19 nt, Mycobacterium bovis subsp bovis AF2122/97
gaugcgggccgccaggcgg

SEQ ID NO: 3062750 - RNA, 14 nt, Mycobacterium bovis subsp bovis AF2122/97
gaugcgggcgacga

SEQ ID NO: 3062751 - RNA, 13 nt, Mycobacterium bovis subsp bovis AF2122/97
gaugcgggcggca

SEQ ID NO: 3062752 - RNA, 23 nt, Mycobacterium bovis subsp bovis AF2122/97
gaugcgggcggcaagcucgacga

SEQ ID NO: 3062753 - RNA, 22 nt, Mycobacterium bovis subsp bovis AF2122/97
gaugcgggcugugaacagcgcg

SEQ ID NO: 3062754 - RNA, 18 nt, Mycobacterium bovis subsp bovis AF2122/97
gaugcgguaucggucgac

SEQ ID NO: 3062755 - RNA, 17 nt, Mycobacterium bovis subsp bovis AF2122/97
gaugcgguauugcccgg

SEQ ID NO: 3062756 - RNA, 22 nt, Mycobacterium bovis subsp bovis AF2122/97
gaugcggucgacgggcucguca

SEQ ID NO: 3062757 - RNA, 13 nt, Mycobacterium bovis subsp bovis AF2122/97
gaugcggucgcgg

SEQ ID NO: 3062758 - RNA, 16 nt, Mycobacterium bovis subsp bovis AF2122/97
gaugcggucgucacgg

SEQ ID NO: 3062759 - RNA, 18 nt, Mycobacterium bovis subsp bovis AF2122/97
gaugcggugcggaucaga

SEQ ID NO: 3062760 - RNA, 22 nt, Mycobacterium bovis subsp bovis AF2122/97
gaugcggugguaggacgccagc

SEQ ID NO: 3062761 - RNA, 19 nt, Mycobacterium bovis subsp bovis AF2122/97
gaugcgguguagggcggcg

SEQ ID NO: 3062762 - RNA, 14 nt, Mycobacterium bovis subsp bovis AF2122/97
gaugucgggaaggu

SEQ ID NO: 3062763 - RNA, 13 nt, Mycobacterium bovis subsp bovis AF2122/97
gaugucggggccg

SEQ ID NO: 3062764 - RNA, 18 nt, Mycobacterium bovis subsp bovis AF2122/97
gaugucggggccgucguc

SEQ ID NO: 3062765 - RNA, 20 nt, Mycobacterium bovis subsp bovis AF2122/97
gaugucggucggaucggcgc

SEQ ID NO: 3062766 - RNA, 22 nt, Mycobacterium bovis subsp bovis AF2122/97
gaugucggugaucacggucggc

SEQ ID NO: 3062767 - RNA, 20 nt, Mycobacterium bovis subsp bovis AF2122/97
gaugucggugcguccggugc

SEQ ID NO: 3062768 - RNA, 20 nt, Mycobacterium bovis subsp bovis AF2122/97
gaugucgucaccgugggccu

SEQ ID NO: 3062769 - RNA, 18 nt, Mycobacterium bovis subsp bovis AF2122/97
gaugucgucgaccaggcc

SEQ ID NO: 3062770 - RNA, 14 nt, Mycobacterium bovis subsp bovis AF2122/97
gaugucgugcgggc

SEQ ID NO: 3062771 - RNA, 15 nt, Mycobacterium bovis subsp bovis AF2122/97
gaugucguucgcguc

SEQ ID NO: 3062772 - RNA, 19 nt, Mycobacterium bovis subsp bovis AF2122/97
gaugucguuggccaccucg

SEQ ID NO: 3062773 - RNA, 15 nt, Mycobacterium bovis subsp bovis AF2122/97
gaugucucggcacca

SEQ ID NO: 3062774 - RNA, 16 nt, Mycobacterium bovis subsp bovis AF2122/97
gaugucucggcaccac

SEQ ID NO: 3062775 - RNA, 17 nt, Mycobacterium bovis subsp bovis AF2122/97
gaugucucggcaccaca

SEQ ID NO: 3062776 - RNA, 24 nt, Mycobacterium bovis subsp bovis AF2122/97
gaugucucggcaccacagugaaau

SEQ ID NO: 3062777 - RNA, 13 nt, Mycobacterium bovis subsp bovis AF2122/97
gaugucuuccugc

SEQ ID NO: 3062778 - RNA, 19 nt, Mycobacterium bovis subsp bovis AF2122/97
gaugugacuuauccggcca

SEQ ID NO: 3062779 - RNA, 21 nt, Mycobacterium bovis subsp bovis AF2122/97
gaugugacuuauccggccagu

SEQ ID NO: 3062780 - RNA, 22 nt, Mycobacterium bovis subsp bovis AF2122/97
gaugugagcacaccgacagcac

SEQ ID NO: 3062781 - RNA, 15 nt, Mycobacterium bovis subsp bovis AF2122/97
gaugugaguccagcc

SEQ ID NO: 3062782 - RNA, 22 nt, Mycobacterium bovis subsp bovis AF2122/97
gaugugcacggugugcacggcg

SEQ ID NO: 3062783 - RNA, 14 nt, Mycobacterium bovis subsp bovis AF2122/97
gaugugcagcgagu

SEQ ID NO: 3062784 - RNA, 20 nt, Mycobacterium bovis subsp bovis AF2122/97
gaugugccgauuggccugcc

SEQ ID NO: 3062785 - RNA, 13 nt, Mycobacterium bovis subsp bovis AF2122/97
gaugugcgccacc

SEQ ID NO: 3062786 - RNA, 20 nt, Mycobacterium bovis subsp bovis AF2122/97
gaugugcgccaccucgacgc

SEQ ID NO: 3062787 - RNA, 20 nt, Mycobacterium bovis subsp bovis AF2122/97
gaugugcucaggucgcagac

SEQ ID NO: 3062788 - RNA, 22 nt, Mycobacterium bovis subsp bovis AF2122/97
gaugugcucaggucgcagacca

SEQ ID NO: 3062789 - RNA, 14 nt, Mycobacterium bovis subsp bovis AF2122/97
gaugugcucgguac

SEQ ID NO: 3062790 - RNA, 14 nt, Mycobacterium bovis subsp bovis AF2122/97
gauguggaugccgu

SEQ ID NO: 3062791 - RNA, 17 nt, Mycobacterium bovis subsp bovis AF2122/97
gauguggcgcuccggcg

SEQ ID NO: 3062792 - RNA, 22 nt, Mycobacterium bovis subsp bovis AF2122/97
gauguggcgcuguuguugucgg

SEQ ID NO: 3062793 - RNA, 16 nt, Mycobacterium bovis subsp bovis AF2122/97
gaugugggcgcucgca

SEQ ID NO: 3062794 - RNA, 23 nt, Mycobacterium bovis subsp bovis AF2122/97
gauguguagguggggcacuucca

SEQ ID NO: 3062795 - RNA, 21 nt, Mycobacterium bovis subsp bovis AF2122/97
gaugugucggcgagggcgcgc

SEQ ID NO: 3062796 - RNA, 16 nt, Mycobacterium bovis subsp bovis AF2122/97
gauguguucuccugcc

SEQ ID NO: 3062797 - RNA, 14 nt, Mycobacterium bovis subsp bovis AF2122/97
gauguucacgccgc

SEQ ID NO: 3062798 - RNA, 16 nt, Mycobacterium bovis subsp bovis AF2122/97
gauguucacgccgccg

SEQ ID NO: 3062799 - RNA, 20 nt, Mycobacterium bovis subsp bovis AF2122/97
gauguugcagaacucgcgua

SEQ ID NO: 3062800 - RNA, 18 nt, Mycobacterium bovis subsp bovis AF2122/97
gauguugccggaguugaa

SEQ ID NO: 3062801 - RNA, 22 nt, Mycobacterium bovis subsp bovis AF2122/97
gauguuuuccgguccggcgucg

SEQ ID NO: 3062802 - RNA, 18 nt, Mycobacterium bovis subsp bovis AF2122/97
gauguuuuuggccgcggu

SEQ ID NO: 3062803 - RNA, 16 nt, Mycobacterium bovis subsp bovis AF2122/97
gauuaagucggcggcc

SEQ ID NO: 3062804 - RNA, 18 nt, Mycobacterium bovis subsp bovis AF2122/97
gauuaagucggcggccuu

SEQ ID NO: 3062805 - RNA, 19 nt, Mycobacterium bovis subsp bovis AF2122/97
gauuacaugucacacccac

SEQ ID NO: 3062806 - RNA, 16 nt, Mycobacterium bovis subsp bovis AF2122/97
gauuaccagcggcacc

SEQ ID NO: 3062807 - RNA, 19 nt, Mycobacterium bovis subsp bovis AF2122/97
gauuaccagcggcaccgcg

SEQ ID NO: 3062808 - RNA, 13 nt, Mycobacterium bovis subsp bovis AF2122/97
gauuacggccagu

SEQ ID NO: 3062809 - RNA, 14 nt, Mycobacterium bovis subsp bovis AF2122/97
gauuauucgcggua

SEQ ID NO: 3062810 - RNA, 19 nt, Mycobacterium bovis subsp bovis AF2122/97
gauucacacucgggcggcu

SEQ ID NO: 3062811 - RNA, 12 nt, Mycobacterium bovis subsp bovis AF2122/97
gauucauggcgg

SEQ ID NO: 3062812 - RNA, 13 nt, Mycobacterium bovis subsp bovis AF2122/97
gauucauggcggc

SEQ ID NO: 3062813 - RNA, 22 nt, Mycobacterium bovis subsp bovis AF2122/97
gauuccaauugggcgaugcggc

SEQ ID NO: 3062814 - RNA, 19 nt, Mycobacterium bovis subsp bovis AF2122/97
gauuccaccuuggccagac

SEQ ID NO: 3062815 - RNA, 15 nt, Mycobacterium bovis subsp bovis AF2122/97
gauuccagcagccug

SEQ ID NO: 3062816 - RNA, 15 nt, Mycobacterium bovis subsp bovis AF2122/97
gauucccaguccagg

SEQ ID NO: 3062817 - RNA, 13 nt, Mycobacterium bovis subsp bovis AF2122/97
gauucccgagacu

SEQ ID NO: 3062818 - RNA, 19 nt, Mycobacterium bovis subsp bovis AF2122/97
gauucccgcccagcagcac

SEQ ID NO: 3062819 - RNA, 20 nt, Mycobacterium bovis subsp bovis AF2122/97
gauucccgcccagcagcacc

SEQ ID NO: 3062820 - RNA, 16 nt, Mycobacterium bovis subsp bovis AF2122/97
gauucccgcggacagc

SEQ ID NO: 3062821 - RNA, 23 nt, Mycobacterium bovis subsp bovis AF2122/97
gauuccgcccacaugcgcucgcg

SEQ ID NO: 3062822 - RNA, 20 nt, Mycobacterium bovis subsp bovis AF2122/97
gauuccgcgucugcucggcg

SEQ ID NO: 3062823 - RNA, 22 nt, Mycobacterium bovis subsp bovis AF2122/97
gauuccgcucacgaagaccgcg

SEQ ID NO: 3062824 - RNA, 13 nt, Mycobacterium bovis subsp bovis AF2122/97
gauuccggcggcc

SEQ ID NO: 3062825 - RNA, 21 nt, Mycobacterium bovis subsp bovis AF2122/97
gauuccggcggccacgccggc

SEQ ID NO: 3062826 - RNA, 22 nt, Mycobacterium bovis subsp bovis AF2122/97
gauuccggcggccacgccggcg

SEQ ID NO: 3062827 - RNA, 15 nt, Mycobacterium bovis subsp bovis AF2122/97
gauuccgggucggcg

SEQ ID NO: 3062828 - RNA, 18 nt, Mycobacterium bovis subsp bovis AF2122/97
gauuccgggugcgaucgc

SEQ ID NO: 3062829 - RNA, 17 nt, Mycobacterium bovis subsp bovis AF2122/97
gauuccucuucaggccc

SEQ ID NO: 3062830 - RNA, 16 nt, Mycobacterium bovis subsp bovis AF2122/97
gauucgaaggcaccua

SEQ ID NO: 3062831 - RNA, 21 nt, Mycobacterium bovis subsp bovis AF2122/97
gauucgagcaacugcucgacg

SEQ ID NO: 3062832 - RNA, 15 nt, Mycobacterium bovis subsp bovis AF2122/97
gauucgagccacaug

SEQ ID NO: 3062833 - RNA, 13 nt, Mycobacterium bovis subsp bovis AF2122/97
gauucgaucaggc

SEQ ID NO: 3062834 - RNA, 18 nt, Mycobacterium bovis subsp bovis AF2122/97
gauucgauguccucgaca

SEQ ID NO: 3062835 - RNA, 15 nt, Mycobacterium bovis subsp bovis AF2122/97
gauucgcccgggcgu

SEQ ID NO: 3062836 - RNA, 15 nt, Mycobacterium bovis subsp bovis AF2122/97
gauucgcgcagcgcg

SEQ ID NO: 3062837 - RNA, 14 nt, Mycobacterium bovis subsp bovis AF2122/97
gauucgcgcugcuu

SEQ ID NO: 3062838 - RNA, 15 nt, Mycobacterium bovis subsp bovis AF2122/97
gauucgcggcagccg

SEQ ID NO: 3062839 - RNA, 17 nt, Mycobacterium bovis subsp bovis AF2122/97
gauucggacucgccgac

SEQ ID NO: 3062840 - RNA, 24 nt, Mycobacterium bovis subsp bovis AF2122/97
gauucggcacgccgggcaucggcg

SEQ ID NO: 3062841 - RNA, 18 nt, Mycobacterium bovis subsp bovis AF2122/97
gauucggcagcggcgcgg

SEQ ID NO: 3062842 - RNA, 13 nt, Mycobacterium bovis subsp bovis AF2122/97
gauucggccagac

SEQ ID NO: 3062843 - RNA, 14 nt, Mycobacterium bovis subsp bovis AF2122/97
gauucggccagcgc

SEQ ID NO: 3062844 - RNA, 14 nt, Mycobacterium bovis subsp bovis AF2122/97
gauucggcccaucu

SEQ ID NO: 3062845 - RNA, 14 nt, Mycobacterium bovis subsp bovis AF2122/97
gauucggccgccga

SEQ ID NO: 3062846 - RNA, 19 nt, Mycobacterium bovis subsp bovis AF2122/97
gauucggccugagcggcca

SEQ ID NO: 3062847 - RNA, 21 nt, Mycobacterium bovis subsp bovis AF2122/97
gauucggccugagcggccauc

SEQ ID NO: 3062848 - RNA, 14 nt, Mycobacterium bovis subsp bovis AF2122/97
gauuuuggcugcag

SEQ ID NO: 3062849 - RNA, 20 nt, Mycobacterium bovis subsp bovis AF2122/97
gauuuugggaucgugccggc

SEQ ID NO: 3062850 - RNA, 13 nt, Mycobacterium bovis subsp bovis AF2122/97
gcaaaacacaccg

SEQ ID NO: 3062851 - RNA, 15 nt, Mycobacterium bovis subsp bovis AF2122/97
gcaaaagccaccgca

SEQ ID NO: 3062852 - RNA, 13 nt, Mycobacterium bovis subsp bovis AF2122/97
gcaaaagccgcga

SEQ ID NO: 3062853 - RNA, 13 nt, Mycobacterium bovis subsp bovis AF2122/97
gcaaaaucgccca

SEQ ID NO: 3062854 - RNA, 19 nt, Mycobacterium bovis subsp bovis AF2122/97
gcaaaaucgcccaauucgg

SEQ ID NO: 3062855 - RNA, 20 nt, Mycobacterium bovis subsp bovis AF2122/97
gcaaaaucgcccaauucggc

SEQ ID NO: 3062856 - RNA, 18 nt, Mycobacterium bovis subsp bovis AF2122/97
gcaaaaucgucagcgccg

SEQ ID NO: 3062857 - RNA, 19 nt, Mycobacterium bovis subsp bovis AF2122/97
gcaaaaucgucagcgccgc

SEQ ID NO: 3062858 - RNA, 18 nt, Mycobacterium bovis subsp bovis AF2122/97
gcaaacaagaucagaccc

SEQ ID NO: 3062859 - RNA, 20 nt, Mycobacterium bovis subsp bovis AF2122/97
gcaaacaagaucagacccag

SEQ ID NO: 3062860 - RNA, 17 nt, Mycobacterium bovis subsp bovis AF2122/97
gcaaacaccagcccggc

SEQ ID NO: 3062861 - RNA, 20 nt, Mycobacterium bovis subsp bovis AF2122/97
gcaaacacgccucgccgaag

SEQ ID NO: 3062862 - RNA, 23 nt, Mycobacterium bovis subsp bovis AF2122/97
gcaaacagauucggugccagcag

SEQ ID NO: 3062863 - RNA, 14 nt, Mycobacterium bovis subsp bovis AF2122/97
gcaaacaucgcagg

SEQ ID NO: 3062864 - RNA, 15 nt, Mycobacterium bovis subsp bovis AF2122/97
gcaaaccaagcgcgc

SEQ ID NO: 3062865 - RNA, 14 nt, Mycobacterium bovis subsp bovis AF2122/97
gcaaaccacccgca

SEQ ID NO: 3062866 - RNA, 13 nt, Mycobacterium bovis subsp bovis AF2122/97
gcaaaccauugcg

SEQ ID NO: 3062867 - RNA, 18 nt, Mycobacterium bovis subsp bovis AF2122/97
gcaaaccccggaccaucg

SEQ ID NO: 3062868 - RNA, 12 nt, Mycobacterium bovis subsp bovis AF2122/97
gcaaacccgccg

SEQ ID NO: 3062869 - RNA, 14 nt, Mycobacterium bovis subsp bovis AF2122/97
gcaaacccgccgac

SEQ ID NO: 3062870 - RNA, 18 nt, Mycobacterium bovis subsp bovis AF2122/97
gcaaaccgaucaauccgc

SEQ ID NO: 3062871 - RNA, 23 nt, Mycobacterium bovis subsp bovis AF2122/97
gcaaaccgcgcagaacgaucgcg

SEQ ID NO: 3062872 - RNA, 22 nt, Mycobacterium bovis subsp bovis AF2122/97
gcaaaccgcugcgcgaaucgcg

SEQ ID NO: 3062873 - RNA, 18 nt, Mycobacterium bovis subsp bovis AF2122/97
gcaaaccgguccgggucg

SEQ ID NO: 3062874 - RNA, 17 nt, Mycobacterium bovis subsp bovis AF2122/97
gcaaaccugaguccggc

SEQ ID NO: 3062875 - RNA, 15 nt, Mycobacterium bovis subsp bovis AF2122/97
gcaaacgcggcgucg

SEQ ID NO: 3062876 - RNA, 18 nt, Mycobacterium bovis subsp bovis AF2122/97
gcaaacguaccgucaugg

SEQ ID NO: 3062877 - RNA, 22 nt, Mycobacterium bovis subsp bovis AF2122/97
gcaaacuccagcuugccgaccu

SEQ ID NO: 3062878 - RNA, 17 nt, Mycobacterium bovis subsp bovis AF2122/97
gcaaacuucgcgcacgc

SEQ ID NO: 3062879 - RNA, 20 nt, Mycobacterium bovis subsp bovis AF2122/97
gcaaacuucgcgcacgcccu

SEQ ID NO: 3062880 - RNA, 15 nt, Mycobacterium bovis subsp bovis AF2122/97
gcaaagaacagccgg

SEQ ID NO: 3062881 - RNA, 15 nt, Mycobacterium bovis subsp bovis AF2122/97
gcaaagacagcgcgg

SEQ ID NO: 3062882 - RNA, 13 nt, Mycobacterium bovis subsp bovis AF2122/97
gcaaagcagcgca

SEQ ID NO: 3062883 - RNA, 16 nt, Mycobacterium bovis subsp bovis AF2122/97
gcaaagccagcgcagc

SEQ ID NO: 3062884 - RNA, 21 nt, Mycobacterium bovis subsp bovis AF2122/97
gcaaagccagcgcagccaggc

SEQ ID NO: 3062885 - RNA, 16 nt, Mycobacterium bovis subsp bovis AF2122/97
gcaaagcccuccucga

SEQ ID NO: 3062886 - RNA, 13 nt, Mycobacterium bovis subsp bovis AF2122/97
gcaaaggacgucg

SEQ ID NO: 3062887 - RNA, 18 nt, Mycobacterium bovis subsp bovis AF2122/97
gcaaaggagccguuggca

SEQ ID NO: 3062888 - RNA, 19 nt, Mycobacterium bovis subsp bovis AF2122/97
gcaaaggagccguuggcaa

SEQ ID NO: 3062889 - RNA, 23 nt, Mycobacterium bovis subsp bovis AF2122/97
gcaaaggaucaguacgcugcggc

SEQ ID NO: 3062890 - RNA, 23 nt, Mycobacterium bovis subsp bovis AF2122/97
gcaaaggaugaugaacagacgcc

SEQ ID NO: 3062891 - RNA, 14 nt, Mycobacterium bovis subsp bovis AF2122/97
gcaaaggcgccguc

SEQ ID NO: 3062892 - RNA, 13 nt, Mycobacterium bovis subsp bovis AF2122/97
gcaaaucaagcac

SEQ ID NO: 3062893 - RNA, 16 nt, Mycobacterium bovis subsp bovis AF2122/97
gcaaaucaagcacagc

SEQ ID NO: 3062894 - RNA, 21 nt, Mycobacterium bovis subsp bovis AF2122/97
gcaaaucaagcacagcccggc

SEQ ID NO: 3062895 - RNA, 19 nt, Mycobacterium bovis subsp bovis AF2122/97
gcaacaaagguaccgcugg

SEQ ID NO: 3062896 - RNA, 15 nt, Mycobacterium bovis subsp bovis AF2122/97
gcaacaaagucgcca

SEQ ID NO: 3062897 - RNA, 22 nt, Mycobacterium bovis subsp bovis AF2122/97
gcaacaaccgguuggcgauccg

SEQ ID NO: 3062898 - RNA, 20 nt, Mycobacterium bovis subsp bovis AF2122/97
gcaacaacgccgcgacgugg

SEQ ID NO: 3062899 - RNA, 21 nt, Mycobacterium bovis subsp bovis AF2122/97
gcaacaacgucugcagccucg

SEQ ID NO: 3062900 - RNA, 14 nt, Mycobacterium bovis subsp bovis AF2122/97
gcaacaacguucgg

SEQ ID NO: 3062901 - RNA, 23 nt, Mycobacterium bovis subsp bovis AF2122/97
gcaacacaccgcggaaggccagc

SEQ ID NO: 3062902 - RNA, 22 nt, Mycobacterium bovis subsp bovis AF2122/97
gcaacacauuucuuugggcggc

SEQ ID NO: 3062903 - RNA, 23 nt, Mycobacterium bovis subsp bovis AF2122/97
gcaacaccccccguccaccguca

SEQ ID NO: 3062904 - RNA, 18 nt, Mycobacterium bovis subsp bovis AF2122/97
gcaacacccgggcgaccu

SEQ ID NO: 3062905 - RNA, 20 nt, Mycobacterium bovis subsp bovis AF2122/97
gcaacaccggugucggccag

SEQ ID NO: 3062906 - RNA, 23 nt, Mycobacterium bovis subsp bovis AF2122/97
gcaacaccggugucggccagcaa

SEQ ID NO: 3062907 - RNA, 15 nt, Mycobacterium bovis subsp bovis AF2122/97
gcaacaccgucggca

SEQ ID NO: 3062908 - RNA, 21 nt, Mycobacterium bovis subsp bovis AF2122/97
gcaacaccgucggcagcagcg

SEQ ID NO: 3062909 - RNA, 19 nt, Mycobacterium bovis subsp bovis AF2122/97
gcaacaccucaccgcggau

SEQ ID NO: 3062910 - RNA, 19 nt, Mycobacterium bovis subsp bovis AF2122/97
gcaacacgauaucgggcuc

SEQ ID NO: 3062911 - RNA, 17 nt, Mycobacterium bovis subsp bovis AF2122/97
gcaacacgccggcccgg

SEQ ID NO: 3062912 - RNA, 19 nt, Mycobacterium bovis subsp bovis AF2122/97
gcaacacgccggcccggug

SEQ ID NO: 3062913 - RNA, 17 nt, Mycobacterium bovis subsp bovis AF2122/97
gcaacacgggcgccgga

SEQ ID NO: 3062914 - RNA, 12 nt, Mycobacterium bovis subsp bovis AF2122/97
gcaacagcgcca

SEQ ID NO: 3062915 - RNA, 23 nt, Mycobacterium bovis subsp bovis AF2122/97
gcaacagcggggugugcgguugc

SEQ ID NO: 3062916 - RNA, 14 nt, Mycobacterium bovis subsp bovis AF2122/97
gcaacaggaggucg

SEQ ID NO: 3062917 - RNA, 19 nt, Mycobacterium bovis subsp bovis AF2122/97
gcaacaggcccacggcgac

SEQ ID NO: 3062918 - RNA, 21 nt, Mycobacterium bovis subsp bovis AF2122/97
gcaacaggcccacggcgacca

SEQ ID NO: 3062919 - RNA, 15 nt, Mycobacterium bovis subsp bovis AF2122/97
gcaacaucagcagga

SEQ ID NO: 3062920 - RNA, 16 nt, Mycobacterium bovis subsp bovis AF2122/97
gcaacaucagcaggac

SEQ ID NO: 3062921 - RNA, 21 nt, Mycobacterium bovis subsp bovis AF2122/97
gcaacaucagcaggaccaacg

SEQ ID NO: 3062922 - RNA, 20 nt, Mycobacterium bovis subsp bovis AF2122/97
gcaacaucgaauaugacugc

SEQ ID NO: 3062923 - RNA, 20 nt, Mycobacterium bovis subsp bovis AF2122/97
gcaacaucggaugaccagug

SEQ ID NO: 3062924 - RNA, 14 nt, Mycobacterium bovis subsp bovis AF2122/97
gcaacaucgggucg

SEQ ID NO: 3062925 - RNA, 18 nt, Mycobacterium bovis subsp bovis AF2122/97
gcaacaucuugccgucgg

SEQ ID NO: 3062926 - RNA, 22 nt, Mycobacterium bovis subsp bovis AF2122/97
gcaacaugagcgucgcugaccg

SEQ ID NO: 3062927 - RNA, 16 nt, Mycobacterium bovis subsp bovis AF2122/97
gcaacaugucaccugc

SEQ ID NO: 3062928 - RNA, 17 nt, Mycobacterium bovis subsp bovis AF2122/97
gcaacauuuucgcccgc

SEQ ID NO: 3062929 - RNA, 16 nt, Mycobacterium bovis subsp bovis AF2122/97
gcaaccaaagcgacga

SEQ ID NO: 3062930 - RNA, 14 nt, Mycobacterium bovis subsp bovis AF2122/97
gcaaccaaccgcgc

SEQ ID NO: 3062931 - RNA, 13 nt, Mycobacterium bovis subsp bovis AF2122/97
gcaaccaccggcc

SEQ ID NO: 3062932 - RNA, 15 nt, Mycobacterium bovis subsp bovis AF2122/97
gcaaccaccggccgc

SEQ ID NO: 3062933 - RNA, 17 nt, Mycobacterium bovis subsp bovis AF2122/97
gcaaccaccggccgcgc

SEQ ID NO: 3062934 - RNA, 21 nt, Mycobacterium bovis subsp bovis AF2122/97
gcaacgcuucggcagcucccg

SEQ ID NO: 3062935 - RNA, 15 nt, Mycobacterium bovis subsp bovis AF2122/97
gcaacggagcgagcu

SEQ ID NO: 3062936 - RNA, 18 nt, Mycobacterium bovis subsp bovis AF2122/97
gcaacggaggugccggcg

SEQ ID NO: 3062937 - RNA, 19 nt, Mycobacterium bovis subsp bovis AF2122/97
gcaacggaggugccggcgc

SEQ ID NO: 3062938 - RNA, 22 nt, Mycobacterium bovis subsp bovis AF2122/97
gcaacggaggugccggcgccac

SEQ ID NO: 3062939 - RNA, 23 nt, Mycobacterium bovis subsp bovis AF2122/97
gcaacggaggugccggcgccacc

SEQ ID NO: 3062940 - RNA, 21 nt, Mycobacterium bovis subsp bovis AF2122/97
gcaacggauuggugggccagc

SEQ ID NO: 3062941 - RNA, 21 nt, Mycobacterium bovis subsp bovis AF2122/97
gcaacggcacuagcccgaccg

SEQ ID NO: 3062942 - RNA, 15 nt, Mycobacterium bovis subsp bovis AF2122/97
gcaacggcagcgagg

SEQ ID NO: 3062943 - RNA, 18 nt, Mycobacterium bovis subsp bovis AF2122/97
gcaacggccagcgcugcu

SEQ ID NO: 3062944 - RNA, 14 nt, Mycobacterium bovis subsp bovis AF2122/97
gcaacggcggcaac

SEQ ID NO: 3062945 - RNA, 17 nt, Mycobacterium bovis subsp bovis AF2122/97
gcaacggcggcaacggc

SEQ ID NO: 3062946 - RNA, 20 nt, Mycobacterium bovis subsp bovis AF2122/97
gcaacggcggcaacggcggc

SEQ ID NO: 3062947 - RNA, 17 nt, Mycobacterium bovis subsp bovis AF2122/97
gcaacggcggcaggccg

SEQ ID NO: 3062948 - RNA, 24 nt, Mycobacterium bovis subsp bovis AF2122/97
gcaacggcggcaggccggccaccg

SEQ ID NO: 3062949 - RNA, 14 nt, Mycobacterium bovis subsp bovis AF2122/97
gcaacggcggcauc

SEQ ID NO: 3062950 - RNA, 17 nt, Mycobacterium bovis subsp bovis AF2122/97
gcaacggcggcaucggc

SEQ ID NO: 3062951 - RNA, 19 nt, Mycobacterium bovis subsp bovis AF2122/97
gcaacggcggcaucggcgg

SEQ ID NO: 3062952 - RNA, 20 nt, Mycobacterium bovis subsp bovis AF2122/97
gcaacggcggcaucggcggc

SEQ ID NO: 3062953 - RNA, 14 nt, Mycobacterium bovis subsp bovis AF2122/97
gcaacggcggcgac

SEQ ID NO: 3062954 - RNA, 15 nt, Mycobacterium bovis subsp bovis AF2122/97
gcaacggcggcgacg

SEQ ID NO: 3062955 - RNA, 15 nt, Mycobacterium bovis subsp bovis AF2122/97
gcaacggcggcgucg

SEQ ID NO: 3062956 - RNA, 14 nt, Mycobacterium bovis subsp bovis AF2122/97
gcaacggcggggcc

SEQ ID NO: 3062957 - RNA, 20 nt, Mycobacterium bovis subsp bovis AF2122/97
gcaacggcggggccggcggc

SEQ ID NO: 3062958 - RNA, 21 nt, Mycobacterium bovis subsp bovis AF2122/97
gcaacggcguuggcgccguua

SEQ ID NO: 3062959 - RNA, 23 nt, Mycobacterium bovis subsp bovis AF2122/97
gcaacggcguuuucaauuucacu

SEQ ID NO: 3062960 - RNA, 16 nt, Mycobacterium bovis subsp bovis AF2122/97
gcaacgggacgucacc

SEQ ID NO: 3062961 - RNA, 17 nt, Mycobacterium bovis subsp bovis AF2122/97
gcaacgggacgucaccg

SEQ ID NO: 3062962 - RNA, 14 nt, Mycobacterium bovis subsp bovis AF2122/97
gcaacgggcgaacu

SEQ ID NO: 3062963 - RNA, 21 nt, Mycobacterium bovis subsp bovis AF2122/97
gcaacggguacacccgcucgc

SEQ ID NO: 3062964 - RNA, 22 nt, Mycobacterium bovis subsp bovis AF2122/97
gcaacgggucgguccacuucag

SEQ ID NO: 3062965 - RNA, 14 nt, Mycobacterium bovis subsp bovis AF2122/97
gcaacgguacgcgc

SEQ ID NO: 3062966 - RNA, 17 nt, Mycobacterium bovis subsp bovis AF2122/97
gcaacgguagcggcggg

SEQ ID NO: 3062967 - RNA, 20 nt, Mycobacterium bovis subsp bovis AF2122/97
gcaacguagccagcagcggc

SEQ ID NO: 3062968 - RNA, 21 nt, Mycobacterium bovis subsp bovis AF2122/97
gcaacguagccagcagcggcu

SEQ ID NO: 3062969 - RNA, 22 nt, Mycobacterium bovis subsp bovis AF2122/97
gcaacguagccagcagcggcuc

SEQ ID NO: 3062970 - RNA, 18 nt, Mycobacterium bovis subsp bovis AF2122/97
gcaacgucacgucgacgg

SEQ ID NO: 3062971 - RNA, 19 nt, Mycobacterium bovis subsp bovis AF2122/97
gcaacgucacgucgacggc

SEQ ID NO: 3062972 - RNA, 20 nt, Mycobacterium bovis subsp bovis AF2122/97
gcaacgucacgucgacggcg

SEQ ID NO: 3062973 - RNA, 20 nt, Mycobacterium bovis subsp bovis AF2122/97
gcaacgucgcugaaaucggu

SEQ ID NO: 3062974 - RNA, 18 nt, Mycobacterium bovis subsp bovis AF2122/97
gcaacgugugcaccauca

SEQ ID NO: 3062975 - RNA, 21 nt, Mycobacterium bovis subsp bovis AF2122/97
gcaacgugugcaccaucauca

SEQ ID NO: 3062976 - RNA, 23 nt, Mycobacterium bovis subsp bovis AF2122/97
gcaacguuuguaucugcugccga

SEQ ID NO: 3062977 - RNA, 15 nt, Mycobacterium bovis subsp bovis AF2122/97
gcaacuaucgcaccu

SEQ ID NO: 3062978 - RNA, 20 nt, Mycobacterium bovis subsp bovis AF2122/97
gcaacuccggucaacacccg

SEQ ID NO: 3062979 - RNA, 23 nt, Mycobacterium bovis subsp bovis AF2122/97
gcaacuccggucaacacccgccc

SEQ ID NO: 3062980 - RNA, 15 nt, Mycobacterium bovis subsp bovis AF2122/97
gcaacuccucgaccg

SEQ ID NO: 3062981 - RNA, 16 nt, Mycobacterium bovis subsp bovis AF2122/97
gcaacuccucgaccgu

SEQ ID NO: 3062982 - RNA, 20 nt, Mycobacterium bovis subsp bovis AF2122/97
gcaacucgccgaaaucggcc

SEQ ID NO: 3062983 - RNA, 21 nt, Mycobacterium bovis subsp bovis AF2122/97
gcaacucgccgaaaucggcca

SEQ ID NO: 3062984 - RNA, 22 nt, Mycobacterium bovis subsp bovis AF2122/97
gcaacucgccgaaaucggccag

SEQ ID NO: 3062985 - RNA, 12 nt, Mycobacterium bovis subsp bovis AF2122/97
gcaacucggcag

SEQ ID NO: 3062986 - RNA, 14 nt, Mycobacterium bovis subsp bovis AF2122/97
gcaacucggccacg

SEQ ID NO: 3062987 - RNA, 23 nt, Mycobacterium bovis subsp bovis AF2122/97
gcaacucggccacggcgucggcc

SEQ ID NO: 3062988 - RNA, 15 nt, Mycobacterium bovis subsp bovis AF2122/97
gcaacucguccagca

SEQ ID NO: 3062989 - RNA, 16 nt, Mycobacterium bovis subsp bovis AF2122/97
gcaacucguccagcag

SEQ ID NO: 3062990 - RNA, 18 nt, Mycobacterium bovis subsp bovis AF2122/97
gcaacucguccagcagug

SEQ ID NO: 3062991 - RNA, 23 nt, Mycobacterium bovis subsp bovis AF2122/97
gcaacugcagguucuugaccagc

SEQ ID NO: 3062992 - RNA, 17 nt, Mycobacterium bovis subsp bovis AF2122/97
gcaacugccgcacccgg

SEQ ID NO: 3062993 - RNA, 15 nt, Mycobacterium bovis subsp bovis AF2122/97
gcaacugcucgacga

SEQ ID NO: 3062994 - RNA, 14 nt, Mycobacterium bovis subsp bovis AF2122/97
gcaacugggcggcc

SEQ ID NO: 3062995 - RNA, 12 nt, Mycobacterium bovis subsp bovis AF2122/97
gcaacuucagca

SEQ ID NO: 3062996 - RNA, 14 nt, Mycobacterium bovis subsp bovis AF2122/97
gcaagaacccggua

SEQ ID NO: 3062997 - RNA, 12 nt, Mycobacterium bovis subsp bovis AF2122/97
gcaagaaucagc

SEQ ID NO: 3062998 - RNA, 15 nt, Mycobacterium bovis subsp bovis AF2122/97
gcaagaaugccgccg

SEQ ID NO: 3062999 - RNA, 17 nt, Mycobacterium bovis subsp bovis AF2122/97
gcaagaaugccgccgac

SEQ ID NO: 3063000 - RNA, 19 nt, Mycobacterium bovis subsp bovis AF2122/97
gcaagaaugccgccgacgg

SEQ ID NO: 3063001 - RNA, 16 nt, Mycobacterium bovis subsp bovis AF2122/97
gcaagaccgaacagcg

SEQ ID NO: 3063002 - RNA, 21 nt, Mycobacterium bovis subsp bovis AF2122/97
gcaagaccgcgccaacuccga

SEQ ID NO: 3063003 - RNA, 20 nt, Mycobacterium bovis subsp bovis AF2122/97
gcaagaccguuacaccauca

SEQ ID NO: 3063004 - RNA, 14 nt, Mycobacterium bovis subsp bovis AF2122/97
gcaagacgaugaca

SEQ ID NO: 3063005 - RNA, 18 nt, Mycobacterium bovis subsp bovis AF2122/97
gcaagacgcggucgacga

SEQ ID NO: 3063006 - RNA, 14 nt, Mycobacterium bovis subsp bovis AF2122/97
gcaagagccgcagc

SEQ ID NO: 3063007 - RNA, 15 nt, Mycobacterium bovis subsp bovis AF2122/97
gcaagagccgcagcc

SEQ ID NO: 3063008 - RNA, 21 nt, Mycobacterium bovis subsp bovis AF2122/97
gcaagaucaccuucgucgcgg

SEQ ID NO: 3063009 - RNA, 18 nt, Mycobacterium bovis subsp bovis AF2122/97
gcaagauuauggcgagcg

SEQ ID NO: 3063010 - RNA, 21 nt, Mycobacterium bovis subsp bovis AF2122/97
gcaagauuauggcgagcgcgc

SEQ ID NO: 3063011 - RNA, 13 nt, Mycobacterium bovis subsp bovis AF2122/97
gcaagcaaauucu

SEQ ID NO: 3063012 - RNA, 19 nt, Mycobacterium bovis subsp bovis AF2122/97
gcaagcacaccgccagcgg

SEQ ID NO: 3063013 - RNA, 20 nt, Mycobacterium bovis subsp bovis AF2122/97
gcaagcacaccgccagcggc

SEQ ID NO: 3063014 - RNA, 15 nt, Mycobacterium bovis subsp bovis AF2122/97
gcaagcacgcgacgg

SEQ ID NO: 3063015 - RNA, 17 nt, Mycobacterium bovis subsp bovis AF2122/97
gcaagcacgcgacggcg

SEQ ID NO: 3063016 - RNA, 23 nt, Mycobacterium bovis subsp bovis AF2122/97
gcaagcacggcgucgaugucguc

SEQ ID NO: 3063017 - RNA, 17 nt, Mycobacterium bovis subsp bovis AF2122/97
gcaagcagcgcgaucug

SEQ ID NO: 3063018 - RNA, 14 nt, Mycobacterium bovis subsp bovis AF2122/97
gcaagccacgccgg

SEQ ID NO: 3063019 - RNA, 20 nt, Mycobacterium bovis subsp bovis AF2122/97
gcaagccgaacaccgucagc

SEQ ID NO: 3063020 - RNA, 19 nt, Mycobacterium bovis subsp bovis AF2122/97
gcaaucgcucugugucgcc

SEQ ID NO: 3063021 - RNA, 22 nt, Mycobacterium bovis subsp bovis AF2122/97
gcaaucgcucugugucgccgau

SEQ ID NO: 3063022 - RNA, 22 nt, Mycobacterium bovis subsp bovis AF2122/97
gcaaucggcggcacccgggugg

SEQ ID NO: 3063023 - RNA, 16 nt, Mycobacterium bovis subsp bovis AF2122/97
gcaaucgugguucggc

SEQ ID NO: 3063024 - RNA, 16 nt, Mycobacterium bovis subsp bovis AF2122/97
gcaaucucaugcccgg

SEQ ID NO: 3063025 - RNA, 14 nt, Mycobacterium bovis subsp bovis AF2122/97
gcaaucucccgaau

SEQ ID NO: 3063026 - RNA, 23 nt, Mycobacterium bovis subsp bovis AF2122/97
gcaaugaccccggcguugccgcc

SEQ ID NO: 3063027 - RNA, 17 nt, Mycobacterium bovis subsp bovis AF2122/97
gcaaugacccgcgggug

SEQ ID NO: 3063028 - RNA, 16 nt, Mycobacterium bovis subsp bovis AF2122/97
gcaaugaccugcagcg

SEQ ID NO: 3063029 - RNA, 12 nt, Mycobacterium bovis subsp bovis AF2122/97
gcaaugaccugg

SEQ ID NO: 3063030 - RNA, 15 nt, Mycobacterium bovis subsp bovis AF2122/97
gcaaugacggccugc

SEQ ID NO: 3063031 - RNA, 19 nt, Mycobacterium bovis subsp bovis AF2122/97
gcaaugacguacggggucg

SEQ ID NO: 3063032 - RNA, 15 nt, Mycobacterium bovis subsp bovis AF2122/97
gcaaugacuugcgac

SEQ ID NO: 3063033 - RNA, 17 nt, Mycobacterium bovis subsp bovis AF2122/97
gcaaugcaucgcggcgg

SEQ ID NO: 3063034 - RNA, 14 nt, Mycobacterium bovis subsp bovis AF2122/97
gcaaugccaacggu

SEQ ID NO: 3063035 - RNA, 23 nt, Mycobacterium bovis subsp bovis AF2122/97
gcaaugcccgaccggucuggcga

SEQ ID NO: 3063036 - RNA, 23 nt, Mycobacterium bovis subsp bovis AF2122/97
gcaaugccgacucaggucggugc

SEQ ID NO: 3063037 - RNA, 12 nt, Mycobacterium bovis subsp bovis AF2122/97
gcaaugccgcgg

SEQ ID NO: 3063038 - RNA, 18 nt, Mycobacterium bovis subsp bovis AF2122/97
gcaaugcgcgcgauggcg

SEQ ID NO: 3063039 - RNA, 13 nt, Mycobacterium bovis subsp bovis AF2122/97
gcaaugcggcccg

SEQ ID NO: 3063040 - RNA, 21 nt, Mycobacterium bovis subsp bovis AF2122/97
gcaaugcggggcaauccccug

SEQ ID NO: 3063041 - RNA, 22 nt, Mycobacterium bovis subsp bovis AF2122/97
gcaaugcgguaccaaccugcgc

SEQ ID NO: 3063042 - RNA, 21 nt, Mycobacterium bovis subsp bovis AF2122/97
gcaaugcguugaccgauacgc

SEQ ID NO: 3063043 - RNA, 16 nt, Mycobacterium bovis subsp bovis AF2122/97
gcaaugcuggcggcgc

SEQ ID NO: 3063044 - RNA, 21 nt, Mycobacterium bovis subsp bovis AF2122/97
gcaauggaccgaacgacucga

SEQ ID NO: 3063045 - RNA, 12 nt, Mycobacterium bovis subsp bovis AF2122/97
gcaauggccagc

SEQ ID NO: 3063046 - RNA, 13 nt, Mycobacterium bovis subsp bovis AF2122/97
gcaauggcggccu

SEQ ID NO: 3063047 - RNA, 15 nt, Mycobacterium bovis subsp bovis AF2122/97
gcaauggcggccuug

SEQ ID NO: 3063048 - RNA, 16 nt, Mycobacterium bovis subsp bovis AF2122/97
gcaauggcggccuugc

SEQ ID NO: 3063049 - RNA, 16 nt, Mycobacterium bovis subsp bovis AF2122/97
gcaaugguucgugcac

SEQ ID NO: 3063050 - RNA, 17 nt, Mycobacterium bovis subsp bovis AF2122/97
gcaaugucgacaccggc

SEQ ID NO: 3063051 - RNA, 22 nt, Mycobacterium bovis subsp bovis AF2122/97
gcaaugucggcagggcccccag

SEQ ID NO: 3063052 - RNA, 23 nt, Mycobacterium bovis subsp bovis AF2122/97
gcaaugucggcagggcccccagu

SEQ ID NO: 3063053 - RNA, 17 nt, Mycobacterium bovis subsp bovis AF2122/97
gcaaugugggcgcgucg

SEQ ID NO: 3063054 - RNA, 20 nt, Mycobacterium bovis subsp bovis AF2122/97
gcaauuccaccgccgagaug

SEQ ID NO: 3063055 - RNA, 16 nt, Mycobacterium bovis subsp bovis AF2122/97
gcaauuccacgaucgg

SEQ ID NO: 3063056 - RNA, 18 nt, Mycobacterium bovis subsp bovis AF2122/97
gcaauucccaucggccug

SEQ ID NO: 3063057 - RNA, 14 nt, Mycobacterium bovis subsp bovis AF2122/97
gcaauuccgccgag

SEQ ID NO: 3063058 - RNA, 15 nt, Mycobacterium bovis subsp bovis AF2122/97
gcaauuccgccgagc

SEQ ID NO: 3063059 - RNA, 18 nt, Mycobacterium bovis subsp bovis AF2122/97
gcaauuccggugaucgcg

SEQ ID NO: 3063060 - RNA, 19 nt, Mycobacterium bovis subsp bovis AF2122/97
gcaauuccguuaggcucca

SEQ ID NO: 3063061 - RNA, 22 nt, Mycobacterium bovis subsp bovis AF2122/97
gcaauucgggcauggucgccgg

SEQ ID NO: 3063062 - RNA, 14 nt, Mycobacterium bovis subsp bovis AF2122/97
gcaauugccugcgc

SEQ ID NO: 3063063 - RNA, 20 nt, Mycobacterium bovis subsp bovis AF2122/97
gcaauugcucguagcccagg

SEQ ID NO: 3063064 - RNA, 20 nt, Mycobacterium bovis subsp bovis AF2122/97
gcaauuggcguagcaaccca

SEQ ID NO: 3063065 - RNA, 23 nt, Mycobacterium bovis subsp bovis AF2122/97
gcaauuucagccuuguugccgcc

SEQ ID NO: 3063066 - RNA, 15 nt, Mycobacterium bovis subsp bovis AF2122/97
gcaauuuucugcugc

SEQ ID NO: 3063067 - RNA, 19 nt, Mycobacterium bovis subsp bovis AF2122/97
gcacaaaauacuccgcgag

SEQ ID NO: 3063068 - RNA, 17 nt, Mycobacterium bovis subsp bovis AF2122/97
gcacaaacauacgccac

SEQ ID NO: 3063069 - RNA, 14 nt, Mycobacterium bovis subsp bovis AF2122/97
gcacaaacccaguu

SEQ ID NO: 3063070 - RNA, 13 nt, Mycobacterium bovis subsp bovis AF2122/97
gcacaaccagauc

SEQ ID NO: 3063071 - RNA, 18 nt, Mycobacterium bovis subsp bovis AF2122/97
gcacaacccgucgagccg

SEQ ID NO: 3063072 - RNA, 18 nt, Mycobacterium bovis subsp bovis AF2122/97
gcacaacccgugcaggau

SEQ ID NO: 3063073 - RNA, 21 nt, Mycobacterium bovis subsp bovis AF2122/97
gcacaacccgugcaggaucgg

SEQ ID NO: 3063074 - RNA, 14 nt, Mycobacterium bovis subsp bovis AF2122/97
gcacaacgcccacc

SEQ ID NO: 3063075 - RNA, 16 nt, Mycobacterium bovis subsp bovis AF2122/97
gcacaacgcccaccac

SEQ ID NO: 3063076 - RNA, 16 nt, Mycobacterium bovis subsp bovis AF2122/97
gcacaacgcgacgccg

SEQ ID NO: 3063077 - RNA, 17 nt, Mycobacterium bovis subsp bovis AF2122/97
gcacaacgcgacgccgc

SEQ ID NO: 3063078 - RNA, 22 nt, Mycobacterium bovis subsp bovis AF2122/97
gcacaacgcgacgccgcucccg

SEQ ID NO: 3063079 - RNA, 23 nt, Mycobacterium bovis subsp bovis AF2122/97
gcacaacgcgacgccgcucccgc

SEQ ID NO: 3063080 - RNA, 18 nt, Mycobacterium bovis subsp bovis AF2122/97
gcacaagauccgccacgc

SEQ ID NO: 3063081 - RNA, 20 nt, Mycobacterium bovis subsp bovis AF2122/97
gcacaagcuggggaacagca

SEQ ID NO: 3063082 - RNA, 17 nt, Mycobacterium bovis subsp bovis AF2122/97
gcacaaguucuucgaca

SEQ ID NO: 3063083 - RNA, 22 nt, Mycobacterium bovis subsp bovis AF2122/97
gcacaaguucuucgacagcgcg

SEQ ID NO: 3063084 - RNA, 21 nt, Mycobacterium bovis subsp bovis AF2122/97
gcacaauacggucagcagacu

SEQ ID NO: 3063085 - RNA, 22 nt, Mycobacterium bovis subsp bovis AF2122/97
gcacaaucgguugcacccgcgc

SEQ ID NO: 3063086 - RNA, 14 nt, Mycobacterium bovis subsp bovis AF2122/97
gcacaauggcggcg

SEQ ID NO: 3063087 - RNA, 19 nt, Mycobacterium bovis subsp bovis AF2122/97
gcacaauggcggcgccguc

SEQ ID NO: 3063088 - RNA, 19 nt, Mycobacterium bovis subsp bovis AF2122/97
gcacacaacacccaacgca

SEQ ID NO: 3063089 - RNA, 12 nt, Mycobacterium bovis subsp bovis AF2122/97
gcacacagaccg

SEQ ID NO: 3063090 - RNA, 13 nt, Mycobacterium bovis subsp bovis AF2122/97
gcacacagaccgu

SEQ ID NO: 3063091 - RNA, 17 nt, Mycobacterium bovis subsp bovis AF2122/97
gcacacagaccgugacg

SEQ ID NO: 3063092 - RNA, 22 nt, Mycobacterium bovis subsp bovis AF2122/97
gcacacagaggucggucagcca

SEQ ID NO: 3063093 - RNA, 17 nt, Mycobacterium bovis subsp bovis AF2122/97
gcacacagguccugcgc

SEQ ID NO: 3063094 - RNA, 14 nt, Mycobacterium bovis subsp bovis AF2122/97
gcacaccaacaccg

SEQ ID NO: 3063095 - RNA, 20 nt, Mycobacterium bovis subsp bovis AF2122/97
gcacaccaacaccgcggcgc

SEQ ID NO: 3063096 - RNA, 15 nt, Mycobacterium bovis subsp bovis AF2122/97
gcacaccaccgccga

SEQ ID NO: 3063097 - RNA, 17 nt, Mycobacterium bovis subsp bovis AF2122/97
gcacacccaucaccgcc

SEQ ID NO: 3063098 - RNA, 18 nt, Mycobacterium bovis subsp bovis AF2122/97
gcacacccaucaccgcca

SEQ ID NO: 3063099 - RNA, 20 nt, Mycobacterium bovis subsp bovis AF2122/97
gcacacccaucaccgccagc

SEQ ID NO: 3063100 - RNA, 16 nt, Mycobacterium bovis subsp bovis AF2122/97
gcacacccgcaccgga

SEQ ID NO: 3063101 - RNA, 20 nt, Mycobacterium bovis subsp bovis AF2122/97
gcacacccgguuggccccca

SEQ ID NO: 3063102 - RNA, 20 nt, Mycobacterium bovis subsp bovis AF2122/97
gcacacccgucaugcccacc

SEQ ID NO: 3063103 - RNA, 22 nt, Mycobacterium bovis subsp bovis AF2122/97
gcacacccgucaugcccaccgc

SEQ ID NO: 3063104 - RNA, 17 nt, Mycobacterium bovis subsp bovis AF2122/97
gcacacccuccacagcg

SEQ ID NO: 3063105 - RNA, 17 nt, Mycobacterium bovis subsp bovis AF2122/97
gcacaccgacagcaccc

SEQ ID NO: 3063106 - RNA, 18 nt, Mycobacterium bovis subsp bovis AF2122/97
gcacaugcugccgcugcg

SEQ ID NO: 3063107 - RNA, 20 nt, Mycobacterium bovis subsp bovis AF2122/97
gcacaugcugccgcugcgaa

SEQ ID NO: 3063108 - RNA, 21 nt, Mycobacterium bovis subsp bovis AF2122/97
gcacauggugggucgacgauc

SEQ ID NO: 3063109 - RNA, 15 nt, Mycobacterium bovis subsp bovis AF2122/97
gcacauucagcgccg

SEQ ID NO: 3063110 - RNA, 21 nt, Mycobacterium bovis subsp bovis AF2122/97
gcacauucugcagcgucuccu

SEQ ID NO: 3063111 - RNA, 21 nt, Mycobacterium bovis subsp bovis AF2122/97
gcacauugaucgacggccagc

SEQ ID NO: 3063112 - RNA, 21 nt, Mycobacterium bovis subsp bovis AF2122/97
gcacauugguguccaccaccg

SEQ ID NO: 3063113 - RNA, 22 nt, Mycobacterium bovis subsp bovis AF2122/97
gcacauugguguccaccaccgg

SEQ ID NO: 3063114 - RNA, 16 nt, Mycobacterium bovis subsp bovis AF2122/97
gcaccaacaccagcgc

SEQ ID NO: 3063115 - RNA, 14 nt, Mycobacterium bovis subsp bovis AF2122/97
gcaccaaccaccga

SEQ ID NO: 3063116 - RNA, 21 nt, Mycobacterium bovis subsp bovis AF2122/97
gcaccaacgccaccgucgcug

SEQ ID NO: 3063117 - RNA, 15 nt, Mycobacterium bovis subsp bovis AF2122/97
gcaccaacucucgcg

SEQ ID NO: 3063118 - RNA, 20 nt, Mycobacterium bovis subsp bovis AF2122/97
gcaccaacugaauggcaccg

SEQ ID NO: 3063119 - RNA, 14 nt, Mycobacterium bovis subsp bovis AF2122/97
gcaccaaggccgcc

SEQ ID NO: 3063120 - RNA, 15 nt, Mycobacterium bovis subsp bovis AF2122/97
gcaccaaggccgccu

SEQ ID NO: 3063121 - RNA, 16 nt, Mycobacterium bovis subsp bovis AF2122/97
gcaccaaggccgccug

SEQ ID NO: 3063122 - RNA, 21 nt, Mycobacterium bovis subsp bovis AF2122/97
gcaccaaggccgccugcaaca

SEQ ID NO: 3063123 - RNA, 19 nt, Mycobacterium bovis subsp bovis AF2122/97
gcaccaaggucuucaggcc

SEQ ID NO: 3063124 - RNA, 23 nt, Mycobacterium bovis subsp bovis AF2122/97
gcaccaaggucuucaggccgcgc

SEQ ID NO: 3063125 - RNA, 20 nt, Mycobacterium bovis subsp bovis AF2122/97
gcaccacaaacaccccacac

SEQ ID NO: 3063126 - RNA, 20 nt, Mycobacterium bovis subsp bovis AF2122/97
gcaccacaacgucggcaccg

SEQ ID NO: 3063127 - RNA, 14 nt, Mycobacterium bovis subsp bovis AF2122/97
gcaccacaauccac

SEQ ID NO: 3063128 - RNA, 19 nt, Mycobacterium bovis subsp bovis AF2122/97
gcaccacaauccacgcacu

SEQ ID NO: 3063129 - RNA, 23 nt, Mycobacterium bovis subsp bovis AF2122/97
gcaccacaauccacgcacucguc

SEQ ID NO: 3063130 - RNA, 14 nt, Mycobacterium bovis subsp bovis AF2122/97
gcaccacaccacgg

SEQ ID NO: 3063131 - RNA, 18 nt, Mycobacterium bovis subsp bovis AF2122/97
gcaccacaccacgguggc

SEQ ID NO: 3063132 - RNA, 19 nt, Mycobacterium bovis subsp bovis AF2122/97
gcaccacaccacgguggcc

SEQ ID NO: 3063133 - RNA, 22 nt, Mycobacterium bovis subsp bovis AF2122/97
gcaccacaccacgguggccgcu

SEQ ID NO: 3063134 - RNA, 20 nt, Mycobacterium bovis subsp bovis AF2122/97
gcaccacaccgugggcgacg

SEQ ID NO: 3063135 - RNA, 21 nt, Mycobacterium bovis subsp bovis AF2122/97
gcaccacaccgugggcgacgg

SEQ ID NO: 3063136 - RNA, 22 nt, Mycobacterium bovis subsp bovis AF2122/97
gcaccacagugaaauccgagcc

SEQ ID NO: 3063137 - RNA, 14 nt, Mycobacterium bovis subsp bovis AF2122/97
gcaccacagugcca

SEQ ID NO: 3063138 - RNA, 22 nt, Mycobacterium bovis subsp bovis AF2122/97
gcaccacauccaucuccauguu

SEQ ID NO: 3063139 - RNA, 18 nt, Mycobacterium bovis subsp bovis AF2122/97
gcaccacaucggugccac

SEQ ID NO: 3063140 - RNA, 23 nt, Mycobacterium bovis subsp bovis AF2122/97
gcaccacauuggcgaucagcagc

SEQ ID NO: 3063141 - RNA, 14 nt, Mycobacterium bovis subsp bovis AF2122/97
gcaccaccacaccg

SEQ ID NO: 3063142 - RNA, 19 nt, Mycobacterium bovis subsp bovis AF2122/97
gcaccaccacaccggagcc

SEQ ID NO: 3063143 - RNA, 16 nt, Mycobacterium bovis subsp bovis AF2122/97
gcaccaccacgccgac

SEQ ID NO: 3063144 - RNA, 14 nt, Mycobacterium bovis subsp bovis AF2122/97
gcaccaccagcagc

SEQ ID NO: 3063145 - RNA, 20 nt, Mycobacterium bovis subsp bovis AF2122/97
gcaccaccccagcggccacc

SEQ ID NO: 3063146 - RNA, 21 nt, Mycobacterium bovis subsp bovis AF2122/97
gcaccaccccagcggccaccg

SEQ ID NO: 3063147 - RNA, 14 nt, Mycobacterium bovis subsp bovis AF2122/97
gcaccacccggcga

SEQ ID NO: 3063148 - RNA, 17 nt, Mycobacterium bovis subsp bovis AF2122/97
gcaccacccgggccucg

SEQ ID NO: 3063149 - RNA, 23 nt, Mycobacterium bovis subsp bovis AF2122/97
gcaccacccgggccucggcgccg

SEQ ID NO: 3063150 - RNA, 19 nt, Mycobacterium bovis subsp bovis AF2122/97
gcaccacccuugccgauga

SEQ ID NO: 3063151 - RNA, 13 nt, Mycobacterium bovis subsp bovis AF2122/97
gcaccaccgagcc

SEQ ID NO: 3063152 - RNA, 22 nt, Mycobacterium bovis subsp bovis AF2122/97
gcaccaccgccccgcgcccaac

SEQ ID NO: 3063153 - RNA, 15 nt, Mycobacterium bovis subsp bovis AF2122/97
gcaccaccgcgaccu

SEQ ID NO: 3063154 - RNA, 15 nt, Mycobacterium bovis subsp bovis AF2122/97
gcaccaccgcggcgg

SEQ ID NO: 3063155 - RNA, 16 nt, Mycobacterium bovis subsp bovis AF2122/97
gcaccaccgcggcggc

SEQ ID NO: 3063156 - RNA, 15 nt, Mycobacterium bovis subsp bovis AF2122/97
gcaccaccgcggugu

SEQ ID NO: 3063157 - RNA, 12 nt, Mycobacterium bovis subsp bovis AF2122/97
gcaccaccggcc

SEQ ID NO: 3063158 - RNA, 15 nt, Mycobacterium bovis subsp bovis AF2122/97
gcaccaccggcccca

SEQ ID NO: 3063159 - RNA, 16 nt, Mycobacterium bovis subsp bovis AF2122/97
gcaccaccggccccac

SEQ ID NO: 3063160 - RNA, 17 nt, Mycobacterium bovis subsp bovis AF2122/97
gcaccaccggccccacc

SEQ ID NO: 3063161 - RNA, 18 nt, Mycobacterium bovis subsp bovis AF2122/97
gcaccaccggccccaccg

SEQ ID NO: 3063162 - RNA, 13 nt, Mycobacterium bovis subsp bovis AF2122/97
gcaccaccggcuc

SEQ ID NO: 3063163 - RNA, 21 nt, Mycobacterium bovis subsp bovis AF2122/97
gcaccaccggcucccgggggc

SEQ ID NO: 3063164 - RNA, 18 nt, Mycobacterium bovis subsp bovis AF2122/97
gcaccaccgucucgccgc

SEQ ID NO: 3063165 - RNA, 20 nt, Mycobacterium bovis subsp bovis AF2122/97
gcaccaccgucucgccgcgc

SEQ ID NO: 3063166 - RNA, 16 nt, Mycobacterium bovis subsp bovis AF2122/97
gcaccaccugggcggc

SEQ ID NO: 3063167 - RNA, 17 nt, Mycobacterium bovis subsp bovis AF2122/97
gcaccaccugggcggca

SEQ ID NO: 3063168 - RNA, 13 nt, Mycobacterium bovis subsp bovis AF2122/97
gcaccacgaccga

SEQ ID NO: 3063169 - RNA, 15 nt, Mycobacterium bovis subsp bovis AF2122/97
gcaccacgagcagcc

SEQ ID NO: 3063170 - RNA, 14 nt, Mycobacterium bovis subsp bovis AF2122/97
gcaccacgcccgac

SEQ ID NO: 3063171 - RNA, 19 nt, Mycobacterium bovis subsp bovis AF2122/97
gcaccacgcugugcucgac

SEQ ID NO: 3063172 - RNA, 14 nt, Mycobacterium bovis subsp bovis AF2122/97
gcaccacggccagc

SEQ ID NO: 3063173 - RNA, 13 nt, Mycobacterium bovis subsp bovis AF2122/97
gcaccacggcgcg

SEQ ID NO: 3063174 - RNA, 17 nt, Mycobacterium bovis subsp bovis AF2122/97
gcaccacggcgcgcgcg

SEQ ID NO: 3063175 - RNA, 13 nt, Mycobacterium bovis subsp bovis AF2122/97
gcaccacggcggc

SEQ ID NO: 3063176 - RNA, 15 nt, Mycobacterium bovis subsp bovis AF2122/97
gcaccacggcggcca

SEQ ID NO: 3063177 - RNA, 22 nt, Mycobacterium bovis subsp bovis AF2122/97
gcaccacggcggccaccugcug

SEQ ID NO: 3063178 - RNA, 23 nt, Mycobacterium bovis subsp bovis AF2122/97
gcaccacggcggucaacggucuc

SEQ ID NO: 3063179 - RNA, 16 nt, Mycobacterium bovis subsp bovis AF2122/97
gcaccacgucgaccaa

SEQ ID NO: 3063180 - RNA, 16 nt, Mycobacterium bovis subsp bovis AF2122/97
gcaccacgugcgccac

SEQ ID NO: 3063181 - RNA, 22 nt, Mycobacterium bovis subsp bovis AF2122/97
gcaccagaaaugguucgcacac

SEQ ID NO: 3063182 - RNA, 21 nt, Mycobacterium bovis subsp bovis AF2122/97
gcaccagauagaucgugaucg

SEQ ID NO: 3063183 - RNA, 13 nt, Mycobacterium bovis subsp bovis AF2122/97
gcaccagaucagg

SEQ ID NO: 3063184 - RNA, 16 nt, Mycobacterium bovis subsp bovis AF2122/97
gcaccagaucagguga

SEQ ID NO: 3063185 - RNA, 19 nt, Mycobacterium bovis subsp bovis AF2122/97
gcaccagaucgucgggcac

SEQ ID NO: 3063186 - RNA, 21 nt, Mycobacterium bovis subsp bovis AF2122/97
gcaccagaucuucgagcgcau

SEQ ID NO: 3063187 - RNA, 14 nt, Mycobacterium bovis subsp bovis AF2122/97
gcaccagcacaccc

SEQ ID NO: 3063188 - RNA, 16 nt, Mycobacterium bovis subsp bovis AF2122/97
gcaccagcacacccgu

SEQ ID NO: 3063189 - RNA, 18 nt, Mycobacterium bovis subsp bovis AF2122/97
gcaccagcauucucgccg

SEQ ID NO: 3063190 - RNA, 20 nt, Mycobacterium bovis subsp bovis AF2122/97
gcaccagcauucucgccgac

SEQ ID NO: 3063191 - RNA, 20 nt, Mycobacterium bovis subsp bovis AF2122/97
gcaccagccaaaucagccag

SEQ ID NO: 3063192 - RNA, 19 nt, Mycobacterium bovis subsp bovis AF2122/97
gcaccccgccgggggcacc

SEQ ID NO: 3063193 - RNA, 15 nt, Mycobacterium bovis subsp bovis AF2122/97
gcaccccgcgguagc

SEQ ID NO: 3063194 - RNA, 20 nt, Mycobacterium bovis subsp bovis AF2122/97
gcaccccgcgguagccgacc

SEQ ID NO: 3063195 - RNA, 12 nt, Mycobacterium bovis subsp bovis AF2122/97
gcaccccggcau

SEQ ID NO: 3063196 - RNA, 20 nt, Mycobacterium bovis subsp bovis AF2122/97
gcaccccguuccacgaucac

SEQ ID NO: 3063197 - RNA, 16 nt, Mycobacterium bovis subsp bovis AF2122/97
gcacccgaauagccag

SEQ ID NO: 3063198 - RNA, 19 nt, Mycobacterium bovis subsp bovis AF2122/97
gcacccgaauuugucggcg

SEQ ID NO: 3063199 - RNA, 20 nt, Mycobacterium bovis subsp bovis AF2122/97
gcacccgaauuugucggcga

SEQ ID NO: 3063200 - RNA, 21 nt, Mycobacterium bovis subsp bovis AF2122/97
gcacccgaauuugucggcgaa

SEQ ID NO: 3063201 - RNA, 17 nt, Mycobacterium bovis subsp bovis AF2122/97
gcacccgacccgaugcg

SEQ ID NO: 3063202 - RNA, 15 nt, Mycobacterium bovis subsp bovis AF2122/97
gcacccgacucgucg

SEQ ID NO: 3063203 - RNA, 18 nt, Mycobacterium bovis subsp bovis AF2122/97
gcacccgacucgucggcc

SEQ ID NO: 3063204 - RNA, 18 nt, Mycobacterium bovis subsp bovis AF2122/97
gcacccgagccgcacagc

SEQ ID NO: 3063205 - RNA, 16 nt, Mycobacterium bovis subsp bovis AF2122/97
gcacccgagcgaugcg

SEQ ID NO: 3063206 - RNA, 23 nt, Mycobacterium bovis subsp bovis AF2122/97
gcacccgaguuauagaagccgac

SEQ ID NO: 3063207 - RNA, 21 nt, Mycobacterium bovis subsp bovis AF2122/97
gcacccgauaguucuggcccg

SEQ ID NO: 3063208 - RNA, 16 nt, Mycobacterium bovis subsp bovis AF2122/97
gcacccgaucgacgac

SEQ ID NO: 3063209 - RNA, 13 nt, Mycobacterium bovis subsp bovis AF2122/97
gcacccgcaccgg

SEQ ID NO: 3063210 - RNA, 18 nt, Mycobacterium bovis subsp bovis AF2122/97
gcacccgcaccggugacg

SEQ ID NO: 3063211 - RNA, 18 nt, Mycobacterium bovis subsp bovis AF2122/97
gcacccgcacggccuccg

SEQ ID NO: 3063212 - RNA, 14 nt, Mycobacterium bovis subsp bovis AF2122/97
gcacccgcagccgc

SEQ ID NO: 3063213 - RNA, 18 nt, Mycobacterium bovis subsp bovis AF2122/97
gcacccgcaguggucggc

SEQ ID NO: 3063214 - RNA, 18 nt, Mycobacterium bovis subsp bovis AF2122/97
gcacccgccagggcggca

SEQ ID NO: 3063215 - RNA, 21 nt, Mycobacterium bovis subsp bovis AF2122/97
gcacccgccggauucgcccgg

SEQ ID NO: 3063216 - RNA, 14 nt, Mycobacterium bovis subsp bovis AF2122/97
gcacccgcgccagu

SEQ ID NO: 3063217 - RNA, 14 nt, Mycobacterium bovis subsp bovis AF2122/97
gcacccgcgcgacg

SEQ ID NO: 3063218 - RNA, 22 nt, Mycobacterium bovis subsp bovis AF2122/97
gcacccgcgcgacgccguccuc

SEQ ID NO: 3063219 - RNA, 23 nt, Mycobacterium bovis subsp bovis AF2122/97
gcacccgcgucgagugccgccac

SEQ ID NO: 3063220 - RNA, 19 nt, Mycobacterium bovis subsp bovis AF2122/97
gcacccgcuccagcucggc

SEQ ID NO: 3063221 - RNA, 20 nt, Mycobacterium bovis subsp bovis AF2122/97
gcacccgcuccagcucggcg

SEQ ID NO: 3063222 - RNA, 22 nt, Mycobacterium bovis subsp bovis AF2122/97
gcacccgcuccauaucgucggg

SEQ ID NO: 3063223 - RNA, 14 nt, Mycobacterium bovis subsp bovis AF2122/97
gcacccgcucggcc

SEQ ID NO: 3063224 - RNA, 18 nt, Mycobacterium bovis subsp bovis AF2122/97
gcacccgcucggccgccg

SEQ ID NO: 3063225 - RNA, 19 nt, Mycobacterium bovis subsp bovis AF2122/97
gcacccgcucggccgccgg

SEQ ID NO: 3063226 - RNA, 15 nt, Mycobacterium bovis subsp bovis AF2122/97
gcacccgcucggcgc

SEQ ID NO: 3063227 - RNA, 17 nt, Mycobacterium bovis subsp bovis AF2122/97
gcacccgcucggcgcgc

SEQ ID NO: 3063228 - RNA, 14 nt, Mycobacterium bovis subsp bovis AF2122/97
gcacccgcucgucg

SEQ ID NO: 3063229 - RNA, 14 nt, Mycobacterium bovis subsp bovis AF2122/97
gcacccgcugcacg

SEQ ID NO: 3063230 - RNA, 15 nt, Mycobacterium bovis subsp bovis AF2122/97
gcacccgcugcacgc

SEQ ID NO: 3063231 - RNA, 17 nt, Mycobacterium bovis subsp bovis AF2122/97
gcacccgcuggcgguaa

SEQ ID NO: 3063232 - RNA, 24 nt, Mycobacterium bovis subsp bovis AF2122/97
gcacccgcuggucgagcagugccu

SEQ ID NO: 3063233 - RNA, 14 nt, Mycobacterium bovis subsp bovis AF2122/97
gcacccggccaccg

SEQ ID NO: 3063234 - RNA, 16 nt, Mycobacterium bovis subsp bovis AF2122/97
gcacccggccaccgga

SEQ ID NO: 3063235 - RNA, 18 nt, Mycobacterium bovis subsp bovis AF2122/97
gcacccggcuguucucgc

SEQ ID NO: 3063236 - RNA, 21 nt, Mycobacterium bovis subsp bovis AF2122/97
gcacccggcuguucucgccga

SEQ ID NO: 3063237 - RNA, 22 nt, Mycobacterium bovis subsp bovis AF2122/97
gcacccggcuguucucgccgaa

SEQ ID NO: 3063238 - RNA, 13 nt, Mycobacterium bovis subsp bovis AF2122/97
gcacccggcuucg

SEQ ID NO: 3063239 - RNA, 18 nt, Mycobacterium bovis subsp bovis AF2122/97
gcacccggcuucgccgcg

SEQ ID NO: 3063240 - RNA, 19 nt, Mycobacterium bovis subsp bovis AF2122/97
gcacccggcuucgccgcgc

SEQ ID NO: 3063241 - RNA, 21 nt, Mycobacterium bovis subsp bovis AF2122/97
gcacccggcuucgccgcgcuu

SEQ ID NO: 3063242 - RNA, 22 nt, Mycobacterium bovis subsp bovis AF2122/97
gcacccgggccacgucgagcac

SEQ ID NO: 3063243 - RNA, 18 nt, Mycobacterium bovis subsp bovis AF2122/97
gcacccgggccugggacg

SEQ ID NO: 3063244 - RNA, 23 nt, Mycobacterium bovis subsp bovis AF2122/97
gcacccgggccugggacggcggc

SEQ ID NO: 3063245 - RNA, 17 nt, Mycobacterium bovis subsp bovis AF2122/97
gcacccggggggccucg

SEQ ID NO: 3063246 - RNA, 20 nt, Mycobacterium bovis subsp bovis AF2122/97
gcacccggggggccucguug

SEQ ID NO: 3063247 - RNA, 13 nt, Mycobacterium bovis subsp bovis AF2122/97
gcacccggggugc

SEQ ID NO: 3063248 - RNA, 21 nt, Mycobacterium bovis subsp bovis AF2122/97
gcacccggucggccauccacc

SEQ ID NO: 3063249 - RNA, 22 nt, Mycobacterium bovis subsp bovis AF2122/97
gcacccggucggccauccaccg

SEQ ID NO: 3063250 - RNA, 17 nt, Mycobacterium bovis subsp bovis AF2122/97
gcacccggucggcggca

SEQ ID NO: 3063251 - RNA, 19 nt, Mycobacterium bovis subsp bovis AF2122/97
gcacccggugagaagaagc

SEQ ID NO: 3063252 - RNA, 20 nt, Mycobacterium bovis subsp bovis AF2122/97
gcacccggugagaagaagcc

SEQ ID NO: 3063253 - RNA, 18 nt, Mycobacterium bovis subsp bovis AF2122/97
gcacccgguugugcgcgc

SEQ ID NO: 3063254 - RNA, 14 nt, Mycobacterium bovis subsp bovis AF2122/97
gcacccguccgccg

SEQ ID NO: 3063255 - RNA, 22 nt, Mycobacterium bovis subsp bovis AF2122/97
gcacccguccgccgcagacgcc

SEQ ID NO: 3063256 - RNA, 13 nt, Mycobacterium bovis subsp bovis AF2122/97
gcacccguccggc

SEQ ID NO: 3063257 - RNA, 21 nt, Mycobacterium bovis subsp bovis AF2122/97
gcacccguucgugagcggcca

SEQ ID NO: 3063258 - RNA, 23 nt, Mycobacterium bovis subsp bovis AF2122/97
gcacccguucgugagcggccagg

SEQ ID NO: 3063259 - RNA, 17 nt, Mycobacterium bovis subsp bovis AF2122/97
gcacccguugcgacacc

SEQ ID NO: 3063260 - RNA, 20 nt, Mycobacterium bovis subsp bovis AF2122/97
gcacccguugcgacaccucc

SEQ ID NO: 3063261 - RNA, 14 nt, Mycobacterium bovis subsp bovis AF2122/97
gcacccugcggcac

SEQ ID NO: 3063262 - RNA, 15 nt, Mycobacterium bovis subsp bovis AF2122/97
gcacccugcgggccg

SEQ ID NO: 3063263 - RNA, 16 nt, Mycobacterium bovis subsp bovis AF2122/97
gcacccugcgugcggc

SEQ ID NO: 3063264 - RNA, 17 nt, Mycobacterium bovis subsp bovis AF2122/97
gcacccuugccgauucc

SEQ ID NO: 3063265 - RNA, 19 nt, Mycobacterium bovis subsp bovis AF2122/97
gcaccgaaaaacaccagcg

SEQ ID NO: 3063266 - RNA, 23 nt, Mycobacterium bovis subsp bovis AF2122/97
gcaccgaaaaacaccagcgaggc

SEQ ID NO: 3063267 - RNA, 19 nt, Mycobacterium bovis subsp bovis AF2122/97
gcaccgaaacgccgaccuu

SEQ ID NO: 3063268 - RNA, 14 nt, Mycobacterium bovis subsp bovis AF2122/97
gcaccgaacccgcc

SEQ ID NO: 3063269 - RNA, 22 nt, Mycobacterium bovis subsp bovis AF2122/97
gcaccgaacccgccaccgcgac

SEQ ID NO: 3063270 - RNA, 14 nt, Mycobacterium bovis subsp bovis AF2122/97
gcaccgaagauggc

SEQ ID NO: 3063271 - RNA, 16 nt, Mycobacterium bovis subsp bovis AF2122/97
gcaccgaagauggcca

SEQ ID NO: 3063272 - RNA, 17 nt, Mycobacterium bovis subsp bovis AF2122/97
gcaccgaagauggccag

SEQ ID NO: 3063273 - RNA, 13 nt, Mycobacterium bovis subsp bovis AF2122/97
gcaccgaagugca

SEQ ID NO: 3063274 - RNA, 18 nt, Mycobacterium bovis subsp bovis AF2122/97
gcaccgaauuacgcaccg

SEQ ID NO: 3063275 - RNA, 13 nt, Mycobacterium bovis subsp bovis AF2122/97
gcaccgacaccgg

SEQ ID NO: 3063276 - RNA, 20 nt, Mycobacterium bovis subsp bovis AF2122/97
gcaccgacaccggccgcgac

SEQ ID NO: 3063277 - RNA, 17 nt, Mycobacterium bovis subsp bovis AF2122/97
gcaccgacagcaguuuc

SEQ ID NO: 3063278 - RNA, 14 nt, Mycobacterium bovis subsp bovis AF2122/97
gcaccgcgccgcgc

SEQ ID NO: 3063279 - RNA, 16 nt, Mycobacterium bovis subsp bovis AF2122/97
gcaccgcgccgcgccg

SEQ ID NO: 3063280 - RNA, 14 nt, Mycobacterium bovis subsp bovis AF2122/97
gcaccgcgccgugg

SEQ ID NO: 3063281 - RNA, 14 nt, Mycobacterium bovis subsp bovis AF2122/97
gcaccgcgcgcucc

SEQ ID NO: 3063282 - RNA, 14 nt, Mycobacterium bovis subsp bovis AF2122/97
gcaccgcggccagc

SEQ ID NO: 3063283 - RNA, 15 nt, Mycobacterium bovis subsp bovis AF2122/97
gcaccgcggccagcg

SEQ ID NO: 3063284 - RNA, 20 nt, Mycobacterium bovis subsp bovis AF2122/97
gcaccgcggccagcgggaac

SEQ ID NO: 3063285 - RNA, 23 nt, Mycobacterium bovis subsp bovis AF2122/97
gcaccgcggccagcgggaacaca

SEQ ID NO: 3063286 - RNA, 14 nt, Mycobacterium bovis subsp bovis AF2122/97
gcaccgcggccgcg

SEQ ID NO: 3063287 - RNA, 20 nt, Mycobacterium bovis subsp bovis AF2122/97
gcaccgcgggaucgguggcg

SEQ ID NO: 3063288 - RNA, 21 nt, Mycobacterium bovis subsp bovis AF2122/97
gcaccgcgguacgccggucgg

SEQ ID NO: 3063289 - RNA, 19 nt, Mycobacterium bovis subsp bovis AF2122/97
gcaccgcgguggggucgac

SEQ ID NO: 3063290 - RNA, 21 nt, Mycobacterium bovis subsp bovis AF2122/97
gcaccgcgguggggucgacgc

SEQ ID NO: 3063291 - RNA, 20 nt, Mycobacterium bovis subsp bovis AF2122/97
gcaccgcguaauucgacuuc

SEQ ID NO: 3063292 - RNA, 14 nt, Mycobacterium bovis subsp bovis AF2122/97
gcaccgcgucguag

SEQ ID NO: 3063293 - RNA, 16 nt, Mycobacterium bovis subsp bovis AF2122/97
gcaccgcgucguagcc

SEQ ID NO: 3063294 - RNA, 20 nt, Mycobacterium bovis subsp bovis AF2122/97
gcaccgcgucguagccacgc

SEQ ID NO: 3063295 - RNA, 17 nt, Mycobacterium bovis subsp bovis AF2122/97
gcaccgcuacgaccaau

SEQ ID NO: 3063296 - RNA, 18 nt, Mycobacterium bovis subsp bovis AF2122/97
gcaccgcucgguccagcc

SEQ ID NO: 3063297 - RNA, 20 nt, Mycobacterium bovis subsp bovis AF2122/97
gcaccgcugaccccggcagc

SEQ ID NO: 3063298 - RNA, 22 nt, Mycobacterium bovis subsp bovis AF2122/97
gcaccgcugaccccggcagcgc

SEQ ID NO: 3063299 - RNA, 24 nt, Mycobacterium bovis subsp bovis AF2122/97
gcaccgcugaccccggcagcgccc

SEQ ID NO: 3063300 - RNA, 17 nt, Mycobacterium bovis subsp bovis AF2122/97
gcaccgcugaccgcaac

SEQ ID NO: 3063301 - RNA, 18 nt, Mycobacterium bovis subsp bovis AF2122/97
gcaccgcugccgcugccg

SEQ ID NO: 3063302 - RNA, 22 nt, Mycobacterium bovis subsp bovis AF2122/97
gcaccgcugccgcugccgaagc

SEQ ID NO: 3063303 - RNA, 16 nt, Mycobacterium bovis subsp bovis AF2122/97
gcaccgcuggcagcga

SEQ ID NO: 3063304 - RNA, 14 nt, Mycobacterium bovis subsp bovis AF2122/97
gcaccgcuguugca

SEQ ID NO: 3063305 - RNA, 20 nt, Mycobacterium bovis subsp bovis AF2122/97
gcaccgcuguugcaucgccg

SEQ ID NO: 3063306 - RNA, 21 nt, Mycobacterium bovis subsp bovis AF2122/97
gcaccgcuguugcaucgccgc

SEQ ID NO: 3063307 - RNA, 18 nt, Mycobacterium bovis subsp bovis AF2122/97
gcaccgcuucaggcgcca

SEQ ID NO: 3063308 - RNA, 16 nt, Mycobacterium bovis subsp bovis AF2122/97
gcaccggauacagcca

SEQ ID NO: 3063309 - RNA, 18 nt, Mycobacterium bovis subsp bovis AF2122/97
gcaccggaucaccgcgcc

SEQ ID NO: 3063310 - RNA, 14 nt, Mycobacterium bovis subsp bovis AF2122/97
gcaccggaucgccg

SEQ ID NO: 3063311 - RNA, 14 nt, Mycobacterium bovis subsp bovis AF2122/97
gcaccggaucggcu

SEQ ID NO: 3063312 - RNA, 19 nt, Mycobacterium bovis subsp bovis AF2122/97
gcaccggaucggcuaccua

SEQ ID NO: 3063313 - RNA, 15 nt, Mycobacterium bovis subsp bovis AF2122/97
gcaccggccgaaggc

SEQ ID NO: 3063314 - RNA, 21 nt, Mycobacterium bovis subsp bovis AF2122/97
gcaccggccgaaggcgcugcc

SEQ ID NO: 3063315 - RNA, 15 nt, Mycobacterium bovis subsp bovis AF2122/97
gcaccggccgugccg

SEQ ID NO: 3063316 - RNA, 14 nt, Mycobacterium bovis subsp bovis AF2122/97
gcaccggcgaucgu

SEQ ID NO: 3063317 - RNA, 15 nt, Mycobacterium bovis subsp bovis AF2122/97
gcaccggcgaucgug

SEQ ID NO: 3063318 - RNA, 12 nt, Mycobacterium bovis subsp bovis AF2122/97
gcaccggcgcaa

SEQ ID NO: 3063319 - RNA, 13 nt, Mycobacterium bovis subsp bovis AF2122/97
gcaccggcggcga

SEQ ID NO: 3063320 - RNA, 17 nt, Mycobacterium bovis subsp bovis AF2122/97
gcaccggcggcgacggu

SEQ ID NO: 3063321 - RNA, 22 nt, Mycobacterium bovis subsp bovis AF2122/97
gcaccggcggucugcagugcag

SEQ ID NO: 3063322 - RNA, 16 nt, Mycobacterium bovis subsp bovis AF2122/97
gcaccggcgucggcgc

SEQ ID NO: 3063323 - RNA, 20 nt, Mycobacterium bovis subsp bovis AF2122/97
gcaccggcgucggcgcggcc

SEQ ID NO: 3063324 - RNA, 17 nt, Mycobacterium bovis subsp bovis AF2122/97
gcaccggcgugguagac

SEQ ID NO: 3063325 - RNA, 17 nt, Mycobacterium bovis subsp bovis AF2122/97
gcaccggcucgacugcc

SEQ ID NO: 3063326 - RNA, 18 nt, Mycobacterium bovis subsp bovis AF2122/97
gcaccggcugcggggcga

SEQ ID NO: 3063327 - RNA, 18 nt, Mycobacterium bovis subsp bovis AF2122/97
gcaccgggaugugcggcu

SEQ ID NO: 3063328 - RNA, 11 nt, Mycobacterium bovis subsp bovis AF2122/97
gcaccggggcu

SEQ ID NO: 3063329 - RNA, 16 nt, Mycobacterium bovis subsp bovis AF2122/97
gcaccggggcugcccg

SEQ ID NO: 3063330 - RNA, 15 nt, Mycobacterium bovis subsp bovis AF2122/97
gcaccggggugugcg

SEQ ID NO: 3063331 - RNA, 19 nt, Mycobacterium bovis subsp bovis AF2122/97
gcaccggggugugcgggcg

SEQ ID NO: 3063332 - RNA, 23 nt, Mycobacterium bovis subsp bovis AF2122/97
gcaccggggugugcgggcggugc

SEQ ID NO: 3063333 - RNA, 15 nt, Mycobacterium bovis subsp bovis AF2122/97
gcaccgggucaacgc

SEQ ID NO: 3063334 - RNA, 16 nt, Mycobacterium bovis subsp bovis AF2122/97
gcaccggguugagccg

SEQ ID NO: 3063335 - RNA, 19 nt, Mycobacterium bovis subsp bovis AF2122/97
gcaccggucuuggugcucu

SEQ ID NO: 3063336 - RNA, 21 nt, Mycobacterium bovis subsp bovis AF2122/97
gcaccggugacgcacagcagc

SEQ ID NO: 3063337 - RNA, 18 nt, Mycobacterium bovis subsp bovis AF2122/97
gcaccggugauggugacc

SEQ ID NO: 3063338 - RNA, 15 nt, Mycobacterium bovis subsp bovis AF2122/97
gcaccggugcccacc

SEQ ID NO: 3063339 - RNA, 17 nt, Mycobacterium bovis subsp bovis AF2122/97
gcaccggugcccaccac

SEQ ID NO: 3063340 - RNA, 19 nt, Mycobacterium bovis subsp bovis AF2122/97
gcaccggugcccaccaccg

SEQ ID NO: 3063341 - RNA, 21 nt, Mycobacterium bovis subsp bovis AF2122/97
gcaccggugcucgucgagcau

SEQ ID NO: 3063342 - RNA, 16 nt, Mycobacterium bovis subsp bovis AF2122/97
gcaccgguuugacguc

SEQ ID NO: 3063343 - RNA, 19 nt, Mycobacterium bovis subsp bovis AF2122/97
gcaccgguuugacguccag

SEQ ID NO: 3063344 - RNA, 23 nt, Mycobacterium bovis subsp bovis AF2122/97
gcaccgguuugacguccagggcc

SEQ ID NO: 3063345 - RNA, 18 nt, Mycobacterium bovis subsp bovis AF2122/97
gcaccgguuuucgccggc

SEQ ID NO: 3063346 - RNA, 20 nt, Mycobacterium bovis subsp bovis AF2122/97
gcaccgguuuucgccggcuc

SEQ ID NO: 3063347 - RNA, 15 nt, Mycobacterium bovis subsp bovis AF2122/97
gcaccguacggcggu

SEQ ID NO: 3063348 - RNA, 21 nt, Mycobacterium bovis subsp bovis AF2122/97
gcaccguagagcaugccgccc

SEQ ID NO: 3063349 - RNA, 17 nt, Mycobacterium bovis subsp bovis AF2122/97
gcaccguagccgcugca

SEQ ID NO: 3063350 - RNA, 12 nt, Mycobacterium bovis subsp bovis AF2122/97
gcaccgucacgu

SEQ ID NO: 3063351 - RNA, 13 nt, Mycobacterium bovis subsp bovis AF2122/97
gcaccgucacguc

SEQ ID NO: 3063352 - RNA, 19 nt, Mycobacterium bovis subsp bovis AF2122/97
gcaccgucagcccgacguu

SEQ ID NO: 3063353 - RNA, 15 nt, Mycobacterium bovis subsp bovis AF2122/97
gcaccguccucgguc

SEQ ID NO: 3063354 - RNA, 21 nt, Mycobacterium bovis subsp bovis AF2122/97
gcaccguccucggucacgauc

SEQ ID NO: 3063355 - RNA, 16 nt, Mycobacterium bovis subsp bovis AF2122/97
gcaccgucgcggguca

SEQ ID NO: 3063356 - RNA, 13 nt, Mycobacterium bovis subsp bovis AF2122/97
gcaccgucggcac

SEQ ID NO: 3063357 - RNA, 17 nt, Mycobacterium bovis subsp bovis AF2122/97
gcaccgucggcaccagc

SEQ ID NO: 3063358 - RNA, 17 nt, Mycobacterium bovis subsp bovis AF2122/97
gcaccgucgggcccagc

SEQ ID NO: 3063359 - RNA, 18 nt, Mycobacterium bovis subsp bovis AF2122/97
gcaccgucgggcccagcc

SEQ ID NO: 3063360 - RNA, 23 nt, Mycobacterium bovis subsp bovis AF2122/97
gcaccgucgggcccagccggacc

SEQ ID NO: 3063361 - RNA, 23 nt, Mycobacterium bovis subsp bovis AF2122/97
gcaccgugacccugauggggccu

SEQ ID NO: 3063362 - RNA, 20 nt, Mycobacterium bovis subsp bovis AF2122/97
gcaccgugaguacucgguca

SEQ ID NO: 3063363 - RNA, 15 nt, Mycobacterium bovis subsp bovis AF2122/97
gcaccgugccgacgc

SEQ ID NO: 3063364 - RNA, 21 nt, Mycobacterium bovis subsp bovis AF2122/97
gcacgacgcgacacgccggcg

SEQ ID NO: 3063365 - RNA, 22 nt, Mycobacterium bovis subsp bovis AF2122/97
gcacgacgcgacacgccggcgg

SEQ ID NO: 3063366 - RNA, 23 nt, Mycobacterium bovis subsp bovis AF2122/97
gcacgacgcgacacgccggcggg

SEQ ID NO: 3063367 - RNA, 16 nt, Mycobacterium bovis subsp bovis AF2122/97
gcacgacgggggagca

SEQ ID NO: 3063368 - RNA, 15 nt, Mycobacterium bovis subsp bovis AF2122/97
gcacgacgguguccg

SEQ ID NO: 3063369 - RNA, 17 nt, Mycobacterium bovis subsp bovis AF2122/97
gcacgacgugcgucggc

SEQ ID NO: 3063370 - RNA, 20 nt, Mycobacterium bovis subsp bovis AF2122/97
gcacgacgugcgucggcccg

SEQ ID NO: 3063371 - RNA, 20 nt, Mycobacterium bovis subsp bovis AF2122/97
gcacgacugugcgccgcagc

SEQ ID NO: 3063372 - RNA, 21 nt, Mycobacterium bovis subsp bovis AF2122/97
gcacgacugugcgccgcagcc

SEQ ID NO: 3063373 - RNA, 14 nt, Mycobacterium bovis subsp bovis AF2122/97
gcacgagugcggcg

SEQ ID NO: 3063374 - RNA, 16 nt, Mycobacterium bovis subsp bovis AF2122/97
gcacgagugcggcgac

SEQ ID NO: 3063375 - RNA, 18 nt, Mycobacterium bovis subsp bovis AF2122/97
gcacgagugcggcgacca

SEQ ID NO: 3063376 - RNA, 17 nt, Mycobacterium bovis subsp bovis AF2122/97
gcacgaguuaccggugg

SEQ ID NO: 3063377 - RNA, 17 nt, Mycobacterium bovis subsp bovis AF2122/97
gcacgauagccaccgac

SEQ ID NO: 3063378 - RNA, 13 nt, Mycobacterium bovis subsp bovis AF2122/97
gcacgauagccga

SEQ ID NO: 3063379 - RNA, 15 nt, Mycobacterium bovis subsp bovis AF2122/97
gcacgauagccgaaa

SEQ ID NO: 3063380 - RNA, 22 nt, Mycobacterium bovis subsp bovis AF2122/97
gcacgaucaucgggguggccac

SEQ ID NO: 3063381 - RNA, 15 nt, Mycobacterium bovis subsp bovis AF2122/97
gcacgauccagcugu

SEQ ID NO: 3063382 - RNA, 13 nt, Mycobacterium bovis subsp bovis AF2122/97
gcacgauccgcac

SEQ ID NO: 3063383 - RNA, 17 nt, Mycobacterium bovis subsp bovis AF2122/97
gcacgauccgcacccgg

SEQ ID NO: 3063384 - RNA, 12 nt, Mycobacterium bovis subsp bovis AF2122/97
gcacgaucgcca

SEQ ID NO: 3063385 - RNA, 17 nt, Mycobacterium bovis subsp bovis AF2122/97
gcacgaucgccaacgac

SEQ ID NO: 3063386 - RNA, 13 nt, Mycobacterium bovis subsp bovis AF2122/97
gcacgaucgcccg

SEQ ID NO: 3063387 - RNA, 14 nt, Mycobacterium bovis subsp bovis AF2122/97
gcacgaucgcccgu

SEQ ID NO: 3063388 - RNA, 14 nt, Mycobacterium bovis subsp bovis AF2122/97
gcacgaucgcggug

SEQ ID NO: 3063389 - RNA, 22 nt, Mycobacterium bovis subsp bovis AF2122/97
gcacgaucgcggugaccucgug

SEQ ID NO: 3063390 - RNA, 16 nt, Mycobacterium bovis subsp bovis AF2122/97
gcacgauggccgucga

SEQ ID NO: 3063391 - RNA, 15 nt, Mycobacterium bovis subsp bovis AF2122/97
gcacgauggugugca

SEQ ID NO: 3063392 - RNA, 17 nt, Mycobacterium bovis subsp bovis AF2122/97
gcacgaugucgaugccg

SEQ ID NO: 3063393 - RNA, 21 nt, Mycobacterium bovis subsp bovis AF2122/97
gcacgauuucgagcgcugcuc

SEQ ID NO: 3063394 - RNA, 17 nt, Mycobacterium bovis subsp bovis AF2122/97
gcacgcaacaccgccaa

SEQ ID NO: 3063395 - RNA, 15 nt, Mycobacterium bovis subsp bovis AF2122/97
gcacgcaaugcgggc

SEQ ID NO: 3063396 - RNA, 20 nt, Mycobacterium bovis subsp bovis AF2122/97
gcacgcaaugucggcagggc

SEQ ID NO: 3063397 - RNA, 14 nt, Mycobacterium bovis subsp bovis AF2122/97
gcacgcacagcccg

SEQ ID NO: 3063398 - RNA, 17 nt, Mycobacterium bovis subsp bovis AF2122/97
gcacgcaccacaaucca

SEQ ID NO: 3063399 - RNA, 13 nt, Mycobacterium bovis subsp bovis AF2122/97
gcacgcacgcggu

SEQ ID NO: 3063400 - RNA, 14 nt, Mycobacterium bovis subsp bovis AF2122/97
gcacgcagagccaa

SEQ ID NO: 3063401 - RNA, 18 nt, Mycobacterium bovis subsp bovis AF2122/97
gcacgcaugagggcaucg

SEQ ID NO: 3063402 - RNA, 21 nt, Mycobacterium bovis subsp bovis AF2122/97
gcacgccaacguugcgccagc

SEQ ID NO: 3063403 - RNA, 18 nt, Mycobacterium bovis subsp bovis AF2122/97
gcacgccacuggacucuu

SEQ ID NO: 3063404 - RNA, 14 nt, Mycobacterium bovis subsp bovis AF2122/97
gcacgccagcccca

SEQ ID NO: 3063405 - RNA, 20 nt, Mycobacterium bovis subsp bovis AF2122/97
gcacgccauaccggcuggcc

SEQ ID NO: 3063406 - RNA, 15 nt, Mycobacterium bovis subsp bovis AF2122/97
gcacgcccacagcug

SEQ ID NO: 3063407 - RNA, 15 nt, Mycobacterium bovis subsp bovis AF2122/97
gcacgcccaggcgac

SEQ ID NO: 3063408 - RNA, 11 nt, Mycobacterium bovis subsp bovis AF2122/97
gcacgcccgca

SEQ ID NO: 3063409 - RNA, 15 nt, Mycobacterium bovis subsp bovis AF2122/97
gcacgcccucgacgc

SEQ ID NO: 3063410 - RNA, 16 nt, Mycobacterium bovis subsp bovis AF2122/97
gcacgcccucgacgcg

SEQ ID NO: 3063411 - RNA, 23 nt, Mycobacterium bovis subsp bovis AF2122/97
gcacgcccucgacgcgcucgggc

SEQ ID NO: 3063412 - RNA, 16 nt, Mycobacterium bovis subsp bovis AF2122/97
gcacgcccucgucgau

SEQ ID NO: 3063413 - RNA, 19 nt, Mycobacterium bovis subsp bovis AF2122/97
gcacgcccucgucgaucgc

SEQ ID NO: 3063414 - RNA, 20 nt, Mycobacterium bovis subsp bovis AF2122/97
gcacgcccucgucgaucgcc

SEQ ID NO: 3063415 - RNA, 15 nt, Mycobacterium bovis subsp bovis AF2122/97
gcacgccgaccagca

SEQ ID NO: 3063416 - RNA, 19 nt, Mycobacterium bovis subsp bovis AF2122/97
gcacgccgaccagcacccg

SEQ ID NO: 3063417 - RNA, 17 nt, Mycobacterium bovis subsp bovis AF2122/97
gcacgccgaccgguggc

SEQ ID NO: 3063418 - RNA, 19 nt, Mycobacterium bovis subsp bovis AF2122/97
gcacgccgaccgguggcac

SEQ ID NO: 3063419 - RNA, 21 nt, Mycobacterium bovis subsp bovis AF2122/97
gcacgccgaccgguggcaccg

SEQ ID NO: 3063420 - RNA, 13 nt, Mycobacterium bovis subsp bovis AF2122/97
gcacgccgccgac

SEQ ID NO: 3063421 - RNA, 14 nt, Mycobacterium bovis subsp bovis AF2122/97
gcacgccgccggcc

SEQ ID NO: 3063422 - RNA, 15 nt, Mycobacterium bovis subsp bovis AF2122/97
gcacgccgcgugccg

SEQ ID NO: 3063423 - RNA, 12 nt, Mycobacterium bovis subsp bovis AF2122/97
gcacgccggcau

SEQ ID NO: 3063424 - RNA, 17 nt, Mycobacterium bovis subsp bovis AF2122/97
gcacgccggcaugccag

SEQ ID NO: 3063425 - RNA, 12 nt, Mycobacterium bovis subsp bovis AF2122/97
gcacgccggcca

SEQ ID NO: 3063426 - RNA, 12 nt, Mycobacterium bovis subsp bovis AF2122/97
gcacgccggcgc

SEQ ID NO: 3063427 - RNA, 15 nt, Mycobacterium bovis subsp bovis AF2122/97
gcacgccggcgcugg

SEQ ID NO: 3063428 - RNA, 13 nt, Mycobacterium bovis subsp bovis AF2122/97
gcacgccggcggc

SEQ ID NO: 3063429 - RNA, 14 nt, Mycobacterium bovis subsp bovis AF2122/97
gcacgccggcggcg

SEQ ID NO: 3063430 - RNA, 16 nt, Mycobacterium bovis subsp bovis AF2122/97
gcacgccggcggcgga

SEQ ID NO: 3063431 - RNA, 17 nt, Mycobacterium bovis subsp bovis AF2122/97
gcacgccuacgaugacg

SEQ ID NO: 3063432 - RNA, 14 nt, Mycobacterium bovis subsp bovis AF2122/97
gcacgcgacggcgc

SEQ ID NO: 3063433 - RNA, 13 nt, Mycobacterium bovis subsp bovis AF2122/97
gcacgcgauggcc

SEQ ID NO: 3063434 - RNA, 21 nt, Mycobacterium bovis subsp bovis AF2122/97
gcacgcgcaguuuggcggcgc

SEQ ID NO: 3063435 - RNA, 15 nt, Mycobacterium bovis subsp bovis AF2122/97
gcacgcgcgcaggcc

SEQ ID NO: 3063436 - RNA, 16 nt, Mycobacterium bovis subsp bovis AF2122/97
gcacgcgcgcaggccg

SEQ ID NO: 3063437 - RNA, 20 nt, Mycobacterium bovis subsp bovis AF2122/97
gcacgcgcgcaggccgccgc

SEQ ID NO: 3063438 - RNA, 22 nt, Mycobacterium bovis subsp bovis AF2122/97
gcacgcggacaugacagccccg

SEQ ID NO: 3063439 - RNA, 13 nt, Mycobacterium bovis subsp bovis AF2122/97
gcacgcgggaagu

SEQ ID NO: 3063440 - RNA, 16 nt, Mycobacterium bovis subsp bovis AF2122/97
gcacgcgggaagugca

SEQ ID NO: 3063441 - RNA, 21 nt, Mycobacterium bovis subsp bovis AF2122/97
gcacgcgggaagugcacccgg

SEQ ID NO: 3063442 - RNA, 20 nt, Mycobacterium bovis subsp bovis AF2122/97
gcacgcgggagguaccccca

SEQ ID NO: 3063443 - RNA, 23 nt, Mycobacterium bovis subsp bovis AF2122/97
gcacgcgggagguacccccagca

SEQ ID NO: 3063444 - RNA, 13 nt, Mycobacterium bovis subsp bovis AF2122/97
gcacgcgugccgc

SEQ ID NO: 3063445 - RNA, 15 nt, Mycobacterium bovis subsp bovis AF2122/97
gcacgcuagccgaca

SEQ ID NO: 3063446 - RNA, 17 nt, Mycobacterium bovis subsp bovis AF2122/97
gcacgcuagccgacagc

SEQ ID NO: 3063447 - RNA, 20 nt, Mycobacterium bovis subsp bovis AF2122/97
gcacgcucaugaccgcucgg

SEQ ID NO: 3063448 - RNA, 21 nt, Mycobacterium bovis subsp bovis AF2122/97
gcacgcucaugaccgcucgga

SEQ ID NO: 3063449 - RNA, 15 nt, Mycobacterium bovis subsp bovis AF2122/97
gcacgcuccagcucg

SEQ ID NO: 3063450 - RNA, 19 nt, Mycobacterium bovis subsp bovis AF2122/97
gcacgcuccagcucggcca

SEQ ID NO: 3063451 - RNA, 21 nt, Mycobacterium bovis subsp bovis AF2122/97
gcacgggugagcaccacgugc

SEQ ID NO: 3063452 - RNA, 21 nt, Mycobacterium bovis subsp bovis AF2122/97
gcacggucaauugugcggccc

SEQ ID NO: 3063453 - RNA, 23 nt, Mycobacterium bovis subsp bovis AF2122/97
gcacggucaauugugcggccccg

SEQ ID NO: 3063454 - RNA, 18 nt, Mycobacterium bovis subsp bovis AF2122/97
gcacgguccacgguggcg

SEQ ID NO: 3063455 - RNA, 22 nt, Mycobacterium bovis subsp bovis AF2122/97
gcacgguccacgguggcgccga

SEQ ID NO: 3063456 - RNA, 15 nt, Mycobacterium bovis subsp bovis AF2122/97
gcacggucgcccgau

SEQ ID NO: 3063457 - RNA, 19 nt, Mycobacterium bovis subsp bovis AF2122/97
gcacggucgcccgaucggc

SEQ ID NO: 3063458 - RNA, 23 nt, Mycobacterium bovis subsp bovis AF2122/97
gcacggucugggucuuggauccg

SEQ ID NO: 3063459 - RNA, 23 nt, Mycobacterium bovis subsp bovis AF2122/97
gcacggugaacaaaugccggugc

SEQ ID NO: 3063460 - RNA, 14 nt, Mycobacterium bovis subsp bovis AF2122/97
gcacggugagccgg

SEQ ID NO: 3063461 - RNA, 22 nt, Mycobacterium bovis subsp bovis AF2122/97
gcacggugagccgguggcccgc

SEQ ID NO: 3063462 - RNA, 18 nt, Mycobacterium bovis subsp bovis AF2122/97
gcacggugaucagcagca

SEQ ID NO: 3063463 - RNA, 16 nt, Mycobacterium bovis subsp bovis AF2122/97
gcacggugcccagggc

SEQ ID NO: 3063464 - RNA, 21 nt, Mycobacterium bovis subsp bovis AF2122/97
gcacggugcugaucgguccgg

SEQ ID NO: 3063465 - RNA, 24 nt, Mycobacterium bovis subsp bovis AF2122/97
gcacggugcugaucgguccggcga

SEQ ID NO: 3063466 - RNA, 12 nt, Mycobacterium bovis subsp bovis AF2122/97
gcacgguggcaa

SEQ ID NO: 3063467 - RNA, 14 nt, Mycobacterium bovis subsp bovis AF2122/97
gcacgguggccgag

SEQ ID NO: 3063468 - RNA, 15 nt, Mycobacterium bovis subsp bovis AF2122/97
gcacgguggccgagc

SEQ ID NO: 3063469 - RNA, 21 nt, Mycobacterium bovis subsp bovis AF2122/97
gcacgguggcuucgacggcgg

SEQ ID NO: 3063470 - RNA, 23 nt, Mycobacterium bovis subsp bovis AF2122/97
gcacgguggcuucgacggcggcc

SEQ ID NO: 3063471 - RNA, 17 nt, Mycobacterium bovis subsp bovis AF2122/97
gcacggugggcgcuggg

SEQ ID NO: 3063472 - RNA, 18 nt, Mycobacterium bovis subsp bovis AF2122/97
gcacggugggcgcugggu

SEQ ID NO: 3063473 - RNA, 13 nt, Mycobacterium bovis subsp bovis AF2122/97
gcacgguguacgc

SEQ ID NO: 3063474 - RNA, 22 nt, Mycobacterium bovis subsp bovis AF2122/97
gcacgguguacgcccgcucgga

SEQ ID NO: 3063475 - RNA, 14 nt, Mycobacterium bovis subsp bovis AF2122/97
gcacgguguauccg

SEQ ID NO: 3063476 - RNA, 21 nt, Mycobacterium bovis subsp bovis AF2122/97
gcacgguguauccgacuggcc

SEQ ID NO: 3063477 - RNA, 16 nt, Mycobacterium bovis subsp bovis AF2122/97
gcacggugucgcgcga

SEQ ID NO: 3063478 - RNA, 18 nt, Mycobacterium bovis subsp bovis AF2122/97
gcacggugucgcgcgacc

SEQ ID NO: 3063479 - RNA, 20 nt, Mycobacterium bovis subsp bovis AF2122/97
gcacggugugcacggcgaau

SEQ ID NO: 3063480 - RNA, 12 nt, Mycobacterium bovis subsp bovis AF2122/97
gcacggugugcg

SEQ ID NO: 3063481 - RNA, 20 nt, Mycobacterium bovis subsp bovis AF2122/97
gcacgguguugcgcacccgc

SEQ ID NO: 3063482 - RNA, 23 nt, Mycobacterium bovis subsp bovis AF2122/97
gcacgguugccgucagggucagc

SEQ ID NO: 3063483 - RNA, 14 nt, Mycobacterium bovis subsp bovis AF2122/97
gcacgguuggcgcu

SEQ ID NO: 3063484 - RNA, 16 nt, Mycobacterium bovis subsp bovis AF2122/97
gcacgguuggcgcuca

SEQ ID NO: 3063485 - RNA, 22 nt, Mycobacterium bovis subsp bovis AF2122/97
gcacgguuguuguagaucugcg

SEQ ID NO: 3063486 - RNA, 14 nt, Mycobacterium bovis subsp bovis AF2122/97
gcacguaacccagu

SEQ ID NO: 3063487 - RNA, 14 nt, Mycobacterium bovis subsp bovis AF2122/97
gcacguaacgccgc

SEQ ID NO: 3063488 - RNA, 15 nt, Mycobacterium bovis subsp bovis AF2122/97
gcacguaacgccgcu

SEQ ID NO: 3063489 - RNA, 22 nt, Mycobacterium bovis subsp bovis AF2122/97
gcacguagaaguaggcggcgac

SEQ ID NO: 3063490 - RNA, 23 nt, Mycobacterium bovis subsp bovis AF2122/97
gcacguagaaguaggcggcgacg

SEQ ID NO: 3063491 - RNA, 14 nt, Mycobacterium bovis subsp bovis AF2122/97
gcacguagacggug

SEQ ID NO: 3063492 - RNA, 16 nt, Mycobacterium bovis subsp bovis AF2122/97
gcacgucacgcgcggc

SEQ ID NO: 3063493 - RNA, 23 nt, Mycobacterium bovis subsp bovis AF2122/97
gcacgucacgcgcggcggcgucc

SEQ ID NO: 3063494 - RNA, 17 nt, Mycobacterium bovis subsp bovis AF2122/97
gcacgucacgcggaaac

SEQ ID NO: 3063495 - RNA, 18 nt, Mycobacterium bovis subsp bovis AF2122/97
gcacgucaucggcuggcc

SEQ ID NO: 3063496 - RNA, 21 nt, Mycobacterium bovis subsp bovis AF2122/97
gcacgucaucggcuggccgcg

SEQ ID NO: 3063497 - RNA, 13 nt, Mycobacterium bovis subsp bovis AF2122/97
gcacgucccggua

SEQ ID NO: 3063498 - RNA, 23 nt, Mycobacterium bovis subsp bovis AF2122/97
gcacguccgaucggcgcgccgau

SEQ ID NO: 3063499 - RNA, 19 nt, Mycobacterium bovis subsp bovis AF2122/97
gcacgucgaaaucggugca

SEQ ID NO: 3063500 - RNA, 20 nt, Mycobacterium bovis subsp bovis AF2122/97
gcacgucgaaaucggugcac

SEQ ID NO: 3063501 - RNA, 16 nt, Mycobacterium bovis subsp bovis AF2122/97
gcacgucgaccucggc

SEQ ID NO: 3063502 - RNA, 19 nt, Mycobacterium bovis subsp bovis AF2122/97
gcacgucgaccucggcaac

SEQ ID NO: 3063503 - RNA, 21 nt, Mycobacterium bovis subsp bovis AF2122/97
gcacgucgagcaggcuggcug

SEQ ID NO: 3063504 - RNA, 13 nt, Mycobacterium bovis subsp bovis AF2122/97
gcacgucgaggcg

SEQ ID NO: 3063505 - RNA, 18 nt, Mycobacterium bovis subsp bovis AF2122/97
gcacgucgaggcggcagu

SEQ ID NO: 3063506 - RNA, 16 nt, Mycobacterium bovis subsp bovis AF2122/97
gcacgucgcauugugc

SEQ ID NO: 3063507 - RNA, 16 nt, Mycobacterium bovis subsp bovis AF2122/97
gcacgucgcggccgug

SEQ ID NO: 3063508 - RNA, 18 nt, Mycobacterium bovis subsp bovis AF2122/97
gcacgucgcggccgugga

SEQ ID NO: 3063509 - RNA, 22 nt, Mycobacterium bovis subsp bovis AF2122/97
gcacgucggcccauaacagcug

SEQ ID NO: 3063510 - RNA, 12 nt, Mycobacterium bovis subsp bovis AF2122/97
gcacgucggcgg

SEQ ID NO: 3063511 - RNA, 21 nt, Mycobacterium bovis subsp bovis AF2122/97
gcacgucggcgggcgugugca

SEQ ID NO: 3063512 - RNA, 17 nt, Mycobacterium bovis subsp bovis AF2122/97
gcacgucggcugccgca

SEQ ID NO: 3063513 - RNA, 19 nt, Mycobacterium bovis subsp bovis AF2122/97
gcacgucggcugccgcaaa

SEQ ID NO: 3063514 - RNA, 14 nt, Mycobacterium bovis subsp bovis AF2122/97
gcacgucgggcccg

SEQ ID NO: 3063515 - RNA, 18 nt, Mycobacterium bovis subsp bovis AF2122/97
gcacgucggggugccggc

SEQ ID NO: 3063516 - RNA, 20 nt, Mycobacterium bovis subsp bovis AF2122/97
gcacgucggggugccggcug

SEQ ID NO: 3063517 - RNA, 18 nt, Mycobacterium bovis subsp bovis AF2122/97
gcacgucguugugcagau

SEQ ID NO: 3063518 - RNA, 17 nt, Mycobacterium bovis subsp bovis AF2122/97
gcacgugcacggcgagg

SEQ ID NO: 3063519 - RNA, 16 nt, Mycobacterium bovis subsp bovis AF2122/97
gcacguggaccggcac

SEQ ID NO: 3063520 - RNA, 17 nt, Mycobacterium bovis subsp bovis AF2122/97
gcacguggaccggcacg

SEQ ID NO: 3063521 - RNA, 12 nt, Mycobacterium bovis subsp bovis AF2122/97
gcacguggcgac

SEQ ID NO: 3063522 - RNA, 15 nt, Mycobacterium bovis subsp bovis AF2122/97
gcacguucaccgcgc

SEQ ID NO: 3063523 - RNA, 16 nt, Mycobacterium bovis subsp bovis AF2122/97
gcacguucaccgcgcg

SEQ ID NO: 3063524 - RNA, 22 nt, Mycobacterium bovis subsp bovis AF2122/97
gcacguucaccgcgcgcucgcc

SEQ ID NO: 3063525 - RNA, 18 nt, Mycobacterium bovis subsp bovis AF2122/97
gcacguucacgcgcggau

SEQ ID NO: 3063526 - RNA, 15 nt, Mycobacterium bovis subsp bovis AF2122/97
gcacguucggcgaug

SEQ ID NO: 3063527 - RNA, 15 nt, Mycobacterium bovis subsp bovis AF2122/97
gcacguucggcgcac

SEQ ID NO: 3063528 - RNA, 16 nt, Mycobacterium bovis subsp bovis AF2122/97
gcacguucggcgcaca

SEQ ID NO: 3063529 - RNA, 23 nt, Mycobacterium bovis subsp bovis AF2122/97
gcacguucggcgcacagcgagca

SEQ ID NO: 3063530 - RNA, 15 nt, Mycobacterium bovis subsp bovis AF2122/97
gcacguucggcgugu

SEQ ID NO: 3063531 - RNA, 17 nt, Mycobacterium bovis subsp bovis AF2122/97
gcacguugacguccaac

SEQ ID NO: 3063532 - RNA, 17 nt, Mycobacterium bovis subsp bovis AF2122/97
gcacguugauccgcgca

SEQ ID NO: 3063533 - RNA, 21 nt, Mycobacterium bovis subsp bovis AF2122/97
gcacguugauccgcgcaacuu

SEQ ID NO: 3063534 - RNA, 13 nt, Mycobacterium bovis subsp bovis AF2122/97
gcacguugccgaa

SEQ ID NO: 3063535 - RNA, 23 nt, Mycobacterium bovis subsp bovis AF2122/97
gcacguuggcggccagcgcaccg

SEQ ID NO: 3063536 - RNA, 18 nt, Mycobacterium bovis subsp bovis AF2122/97
gcacguugugaucgucag

SEQ ID NO: 3063537 - RNA, 14 nt, Mycobacterium bovis subsp bovis AF2122/97
gcagaaggccagcg

SEQ ID NO: 3063538 - RNA, 16 nt, Mycobacterium bovis subsp bovis AF2122/97
gcagaaggccagcgaa

SEQ ID NO: 3063539 - RNA, 20 nt, Mycobacterium bovis subsp bovis AF2122/97
gcagaaggccagcgaaucgc

SEQ ID NO: 3063540 - RNA, 14 nt, Mycobacterium bovis subsp bovis AF2122/97
gcagaaggccgcgg

SEQ ID NO: 3063541 - RNA, 15 nt, Mycobacterium bovis subsp bovis AF2122/97
gcagaaguccucggc

SEQ ID NO: 3063542 - RNA, 20 nt, Mycobacterium bovis subsp bovis AF2122/97
gcagaagucguugcgcgguc

SEQ ID NO: 3063543 - RNA, 22 nt, Mycobacterium bovis subsp bovis AF2122/97
gcagaagucguugcgcggucuc

SEQ ID NO: 3063544 - RNA, 21 nt, Mycobacterium bovis subsp bovis AF2122/97
gcagaauccggucgaugaccu

SEQ ID NO: 3063545 - RNA, 16 nt, Mycobacterium bovis subsp bovis AF2122/97
gcagaauccggucggc

SEQ ID NO: 3063546 - RNA, 22 nt, Mycobacterium bovis subsp bovis AF2122/97
gcagaauccggucggcccacac

SEQ ID NO: 3063547 - RNA, 14 nt, Mycobacterium bovis subsp bovis AF2122/97
gcagaaucgcacgc

SEQ ID NO: 3063548 - RNA, 22 nt, Mycobacterium bovis subsp bovis AF2122/97
gcagaaucgcauugggcgggcu

SEQ ID NO: 3063549 - RNA, 12 nt, Mycobacterium bovis subsp bovis AF2122/97
gcagaaucgccu

SEQ ID NO: 3063550 - RNA, 14 nt, Mycobacterium bovis subsp bovis AF2122/97
gcagaaucgccugc

SEQ ID NO: 3063551 - RNA, 16 nt, Mycobacterium bovis subsp bovis AF2122/97
gcagaaucggugggcg

SEQ ID NO: 3063552 - RNA, 23 nt, Mycobacterium bovis subsp bovis AF2122/97
gcagaaugucguaggcgccguug

SEQ ID NO: 3063553 - RNA, 14 nt, Mycobacterium bovis subsp bovis AF2122/97
gcagaauucggcgc

SEQ ID NO: 3063554 - RNA, 19 nt, Mycobacterium bovis subsp bovis AF2122/97
gcagacacagaaucgcacg

SEQ ID NO: 3063555 - RNA, 20 nt, Mycobacterium bovis subsp bovis AF2122/97
gcagacacagaaucgcccau

SEQ ID NO: 3063556 - RNA, 19 nt, Mycobacterium bovis subsp bovis AF2122/97
gcagacacgaccccgucga

SEQ ID NO: 3063557 - RNA, 18 nt, Mycobacterium bovis subsp bovis AF2122/97
gcagacacgagucgccag

SEQ ID NO: 3063558 - RNA, 13 nt, Mycobacterium bovis subsp bovis AF2122/97
gcagacaggcggc

SEQ ID NO: 3063559 - RNA, 14 nt, Mycobacterium bovis subsp bovis AF2122/97
gcagacaggcggcg

SEQ ID NO: 3063560 - RNA, 16 nt, Mycobacterium bovis subsp bovis AF2122/97
gcagacaggcggcggc

SEQ ID NO: 3063561 - RNA, 17 nt, Mycobacterium bovis subsp bovis AF2122/97
gcagacauggcaaguca

SEQ ID NO: 3063562 - RNA, 20 nt, Mycobacterium bovis subsp bovis AF2122/97
gcagaccaagcccgucgucg

SEQ ID NO: 3063563 - RNA, 15 nt, Mycobacterium bovis subsp bovis AF2122/97
gcagaccaaguccgg

SEQ ID NO: 3063564 - RNA, 20 nt, Mycobacterium bovis subsp bovis AF2122/97
gcagaccaaguccggucgcg

SEQ ID NO: 3063565 - RNA, 18 nt, Mycobacterium bovis subsp bovis AF2122/97
gcagaccacaacgccucg

SEQ ID NO: 3063566 - RNA, 22 nt, Mycobacterium bovis subsp bovis AF2122/97
gcagaccacaacgccucgccau

SEQ ID NO: 3063567 - RNA, 17 nt, Mycobacterium bovis subsp bovis AF2122/97
gcagaccaccagugagg

SEQ ID NO: 3063568 - RNA, 14 nt, Mycobacterium bovis subsp bovis AF2122/97
gcagaccaugguca

SEQ ID NO: 3063569 - RNA, 15 nt, Mycobacterium bovis subsp bovis AF2122/97
gcagacccaguccgg

SEQ ID NO: 3063570 - RNA, 20 nt, Mycobacterium bovis subsp bovis AF2122/97
gcagacccgguaguccgcgc

SEQ ID NO: 3063571 - RNA, 13 nt, Mycobacterium bovis subsp bovis AF2122/97
gcagacccggugg

SEQ ID NO: 3063572 - RNA, 15 nt, Mycobacterium bovis subsp bovis AF2122/97
gcagaccgaucggca

SEQ ID NO: 3063573 - RNA, 17 nt, Mycobacterium bovis subsp bovis AF2122/97
gcagaccgaucggcagg

SEQ ID NO: 3063574 - RNA, 13 nt, Mycobacterium bovis subsp bovis AF2122/97
gcagaccgccacc

SEQ ID NO: 3063575 - RNA, 18 nt, Mycobacterium bovis subsp bovis AF2122/97
gcagaccggugagcaccg

SEQ ID NO: 3063576 - RNA, 20 nt, Mycobacterium bovis subsp bovis AF2122/97
gcagaccggugagcaccgga

SEQ ID NO: 3063577 - RNA, 19 nt, Mycobacterium bovis subsp bovis AF2122/97
gcagaccggugcugucgac

SEQ ID NO: 3063578 - RNA, 21 nt, Mycobacterium bovis subsp bovis AF2122/97
gcagaccgguuucuucggcca

SEQ ID NO: 3063579 - RNA, 14 nt, Mycobacterium bovis subsp bovis AF2122/97
gcagaccguccagc

SEQ ID NO: 3063580 - RNA, 15 nt, Mycobacterium bovis subsp bovis AF2122/97
gcagaccuguccggc

SEQ ID NO: 3063581 - RNA, 17 nt, Mycobacterium bovis subsp bovis AF2122/97
gcagacgaaguagccga

SEQ ID NO: 3063582 - RNA, 20 nt, Mycobacterium bovis subsp bovis AF2122/97
gcagacgaaguagccgacca

SEQ ID NO: 3063583 - RNA, 17 nt, Mycobacterium bovis subsp bovis AF2122/97
gcagacgacaaccgagc

SEQ ID NO: 3063584 - RNA, 20 nt, Mycobacterium bovis subsp bovis AF2122/97
gcagacgcaaaagcccccua

SEQ ID NO: 3063585 - RNA, 19 nt, Mycobacterium bovis subsp bovis AF2122/97
gcagacgcaaaaucgcacg

SEQ ID NO: 3063586 - RNA, 21 nt, Mycobacterium bovis subsp bovis AF2122/97
gcagacgcaaaaucgcacggu

SEQ ID NO: 3063587 - RNA, 19 nt, Mycobacterium bovis subsp bovis AF2122/97
gcagacgcaaaaucgccca

SEQ ID NO: 3063588 - RNA, 20 nt, Mycobacterium bovis subsp bovis AF2122/97
gcagacgcaaaaucgcccaa

SEQ ID NO: 3063589 - RNA, 20 nt, Mycobacterium bovis subsp bovis AF2122/97
gcagacgcaaaaucgcccau

SEQ ID NO: 3063590 - RNA, 13 nt, Mycobacterium bovis subsp bovis AF2122/97
gcagacgcagaag

SEQ ID NO: 3063591 - RNA, 19 nt, Mycobacterium bovis subsp bovis AF2122/97
gcagacgcagaagccccca

SEQ ID NO: 3063592 - RNA, 19 nt, Mycobacterium bovis subsp bovis AF2122/97
gcagacgcagaaucgcacg

SEQ ID NO: 3063593 - RNA, 20 nt, Mycobacterium bovis subsp bovis AF2122/97
gcagacgcagaaucgcacgc

SEQ ID NO: 3063594 - RNA, 20 nt, Mycobacterium bovis subsp bovis AF2122/97
gcagacgcagaaucgcauga

SEQ ID NO: 3063595 - RNA, 21 nt, Mycobacterium bovis subsp bovis AF2122/97
gcagacgcagaaucgcaugau

SEQ ID NO: 3063596 - RNA, 17 nt, Mycobacterium bovis subsp bovis AF2122/97
gcagacgcagagucgca

SEQ ID NO: 3063597 - RNA, 20 nt, Mycobacterium bovis subsp bovis AF2122/97
gcagacgcagagucgcacug

SEQ ID NO: 3063598 - RNA, 21 nt, Mycobacterium bovis subsp bovis AF2122/97
gcagacgcagagucgcacugc

SEQ ID NO: 3063599 - RNA, 20 nt, Mycobacterium bovis subsp bovis AF2122/97
gcagacgcauaagcccccga

SEQ ID NO: 3063600 - RNA, 20 nt, Mycobacterium bovis subsp bovis AF2122/97
gcagacgcauaagcccccgc

SEQ ID NO: 3063601 - RNA, 17 nt, Mycobacterium bovis subsp bovis AF2122/97
gcagacgccgacuccgc

SEQ ID NO: 3063602 - RNA, 14 nt, Mycobacterium bovis subsp bovis AF2122/97
gcagacgccguagc

SEQ ID NO: 3063603 - RNA, 20 nt, Mycobacterium bovis subsp bovis AF2122/97
gcagacgccguagccggccg

SEQ ID NO: 3063604 - RNA, 17 nt, Mycobacterium bovis subsp bovis AF2122/97
gcagacgcggaaucgca

SEQ ID NO: 3063605 - RNA, 20 nt, Mycobacterium bovis subsp bovis AF2122/97
gcagacgcggaaucgcaccg

SEQ ID NO: 3063606 - RNA, 19 nt, Mycobacterium bovis subsp bovis AF2122/97
gcagacgcggaaucgcauc

SEQ ID NO: 3063607 - RNA, 18 nt, Mycobacterium bovis subsp bovis AF2122/97
gcagacgcguuucgucga

SEQ ID NO: 3063608 - RNA, 21 nt, Mycobacterium bovis subsp bovis AF2122/97
gcagacgcguuucgucgaccg

SEQ ID NO: 3063609 - RNA, 24 nt, Mycobacterium bovis subsp bovis AF2122/97
gcagacgcguuucgucgaccgcgc

SEQ ID NO: 3063610 - RNA, 20 nt, Mycobacterium bovis subsp bovis AF2122/97
gcagacgcuaaagcccccgc

SEQ ID NO: 3063611 - RNA, 16 nt, Mycobacterium bovis subsp bovis AF2122/97
gcagacggcugccacg

SEQ ID NO: 3063612 - RNA, 19 nt, Mycobacterium bovis subsp bovis AF2122/97
gcagacgguccgcuacggc

SEQ ID NO: 3063613 - RNA, 19 nt, Mycobacterium bovis subsp bovis AF2122/97
gcagacguaaaagccccca

SEQ ID NO: 3063614 - RNA, 19 nt, Mycobacterium bovis subsp bovis AF2122/97
gcagacguaaaagcccccg

SEQ ID NO: 3063615 - RNA, 20 nt, Mycobacterium bovis subsp bovis AF2122/97
gcagacguaaaagcccccgc

SEQ ID NO: 3063616 - RNA, 15 nt, Mycobacterium bovis subsp bovis AF2122/97
gcagacgucaugcgg

SEQ ID NO: 3063617 - RNA, 15 nt, Mycobacterium bovis subsp bovis AF2122/97
gcagacgugguagcc

SEQ ID NO: 3063618 - RNA, 17 nt, Mycobacterium bovis subsp bovis AF2122/97
gcagacgugguagccgg

SEQ ID NO: 3063619 - RNA, 19 nt, Mycobacterium bovis subsp bovis AF2122/97
gcagacgugguagccggcg

SEQ ID NO: 3063620 - RNA, 20 nt, Mycobacterium bovis subsp bovis AF2122/97
gcagacgugguagccggcga

SEQ ID NO: 3063621 - RNA, 21 nt, Mycobacterium bovis subsp bovis AF2122/97
gcagacgugguagccggcgac

SEQ ID NO: 3063622 - RNA, 14 nt, Mycobacterium bovis subsp bovis AF2122/97
gcagacucgagguc

SEQ ID NO: 3063623 - RNA, 14 nt, Mycobacterium bovis subsp bovis AF2122/97
gcagcacccgcgcc

SEQ ID NO: 3063624 - RNA, 13 nt, Mycobacterium bovis subsp bovis AF2122/97
gcagcacccgggc

SEQ ID NO: 3063625 - RNA, 13 nt, Mycobacterium bovis subsp bovis AF2122/97
gcagcaccgacgu

SEQ ID NO: 3063626 - RNA, 20 nt, Mycobacterium bovis subsp bovis AF2122/97
gcagcaccgacgugauggug

SEQ ID NO: 3063627 - RNA, 17 nt, Mycobacterium bovis subsp bovis AF2122/97
gcagcaccgcacggagg

SEQ ID NO: 3063628 - RNA, 22 nt, Mycobacterium bovis subsp bovis AF2122/97
gcagcaccgcacggaggcggac

SEQ ID NO: 3063629 - RNA, 18 nt, Mycobacterium bovis subsp bovis AF2122/97
gcagcaccgcgaccaucg

SEQ ID NO: 3063630 - RNA, 21 nt, Mycobacterium bovis subsp bovis AF2122/97
gcagcaccgucggcaccagca

SEQ ID NO: 3063631 - RNA, 22 nt, Mycobacterium bovis subsp bovis AF2122/97
gcagcaccgucggcaccagcag

SEQ ID NO: 3063632 - RNA, 14 nt, Mycobacterium bovis subsp bovis AF2122/97
gcagcaccgucggg

SEQ ID NO: 3063633 - RNA, 20 nt, Mycobacterium bovis subsp bovis AF2122/97
gcagcaccgucgggcccagc

SEQ ID NO: 3063634 - RNA, 21 nt, Mycobacterium bovis subsp bovis AF2122/97
gcagcaccgucgggcccagcc

SEQ ID NO: 3063635 - RNA, 23 nt, Mycobacterium bovis subsp bovis AF2122/97
gcagcaccgucgggcccagccgg

SEQ ID NO: 3063636 - RNA, 15 nt, Mycobacterium bovis subsp bovis AF2122/97
gcagcaccugcaccg

SEQ ID NO: 3063637 - RNA, 19 nt, Mycobacterium bovis subsp bovis AF2122/97
gcagcacgacgugcgucgg

SEQ ID NO: 3063638 - RNA, 14 nt, Mycobacterium bovis subsp bovis AF2122/97
gcagcacgauccag

SEQ ID NO: 3063639 - RNA, 17 nt, Mycobacterium bovis subsp bovis AF2122/97
gcagcacgauccagcug

SEQ ID NO: 3063640 - RNA, 14 nt, Mycobacterium bovis subsp bovis AF2122/97
gcagcacgccagcc

SEQ ID NO: 3063641 - RNA, 13 nt, Mycobacterium bovis subsp bovis AF2122/97
gcagcacgcgugg

SEQ ID NO: 3063642 - RNA, 15 nt, Mycobacterium bovis subsp bovis AF2122/97
gcagcacggcgccgc

SEQ ID NO: 3063643 - RNA, 16 nt, Mycobacterium bovis subsp bovis AF2122/97
gcagcacggcgccgcc

SEQ ID NO: 3063644 - RNA, 17 nt, Mycobacterium bovis subsp bovis AF2122/97
gcagcacggcgccgcca

SEQ ID NO: 3063645 - RNA, 20 nt, Mycobacterium bovis subsp bovis AF2122/97
gcagcacggcgccgccacgg

SEQ ID NO: 3063646 - RNA, 17 nt, Mycobacterium bovis subsp bovis AF2122/97
gcagcacggcggccacg

SEQ ID NO: 3063647 - RNA, 19 nt, Mycobacterium bovis subsp bovis AF2122/97
gcagcacggcuucgaccau

SEQ ID NO: 3063648 - RNA, 14 nt, Mycobacterium bovis subsp bovis AF2122/97
gcagcacgucacgc

SEQ ID NO: 3063649 - RNA, 20 nt, Mycobacterium bovis subsp bovis AF2122/97
gcagcacgucacgcaaccgg

SEQ ID NO: 3063650 - RNA, 13 nt, Mycobacterium bovis subsp bovis AF2122/97
gcagcacguccgc

SEQ ID NO: 3063651 - RNA, 13 nt, Mycobacterium bovis subsp bovis AF2122/97
gcagcacgucgaa

SEQ ID NO: 3063652 - RNA, 17 nt, Mycobacterium bovis subsp bovis AF2122/97
gcagcacgucgaacucg

SEQ ID NO: 3063653 - RNA, 16 nt, Mycobacterium bovis subsp bovis AF2122/97
gcagcacuccggcgac

SEQ ID NO: 3063654 - RNA, 14 nt, Mycobacterium bovis subsp bovis AF2122/97
gcagcacucgccca

SEQ ID NO: 3063655 - RNA, 16 nt, Mycobacterium bovis subsp bovis AF2122/97
gcagcacucgcccaag

SEQ ID NO: 3063656 - RNA, 23 nt, Mycobacterium bovis subsp bovis AF2122/97
gcagcacucgcccaagcgcagcc

SEQ ID NO: 3063657 - RNA, 17 nt, Mycobacterium bovis subsp bovis AF2122/97
gcagcacucuucgauga

SEQ ID NO: 3063658 - RNA, 20 nt, Mycobacterium bovis subsp bovis AF2122/97
gcagcacuuccaagccgacc

SEQ ID NO: 3063659 - RNA, 21 nt, Mycobacterium bovis subsp bovis AF2122/97
gcagcacuuccaagccgaccu

SEQ ID NO: 3063660 - RNA, 22 nt, Mycobacterium bovis subsp bovis AF2122/97
gcagcacuuccaagccgaccug

SEQ ID NO: 3063661 - RNA, 22 nt, Mycobacterium bovis subsp bovis AF2122/97
gcagcacuuggacccggccggc

SEQ ID NO: 3063662 - RNA, 20 nt, Mycobacterium bovis subsp bovis AF2122/97
gcagcacuuggccagcuugg

SEQ ID NO: 3063663 - RNA, 16 nt, Mycobacterium bovis subsp bovis AF2122/97
gcagcagaaacggcga

SEQ ID NO: 3063664 - RNA, 17 nt, Mycobacterium bovis subsp bovis AF2122/97
gcagcagaaacggcgac

SEQ ID NO: 3063665 - RNA, 18 nt, Mycobacterium bovis subsp bovis AF2122/97
gcagcagaaacggcgacu

SEQ ID NO: 3063666 - RNA, 17 nt, Mycobacterium bovis subsp bovis AF2122/97
gcagcagacccgguggc

SEQ ID NO: 3063667 - RNA, 18 nt, Mycobacterium bovis subsp bovis AF2122/97
gcagcagacccgguggcg

SEQ ID NO: 3063668 - RNA, 20 nt, Mycobacterium bovis subsp bovis AF2122/97
gcagcagacgacgaucagcc

SEQ ID NO: 3063669 - RNA, 15 nt, Mycobacterium bovis subsp bovis AF2122/97
gcagcagauccuggc

SEQ ID NO: 3063670 - RNA, 17 nt, Mycobacterium bovis subsp bovis AF2122/97
gcagcagauccuggccg

SEQ ID NO: 3063671 - RNA, 21 nt, Mycobacterium bovis subsp bovis AF2122/97
gcagcagaugcgaaaguggug

SEQ ID NO: 3063672 - RNA, 22 nt, Mycobacterium bovis subsp bovis AF2122/97
gcagcagcaaaacccgagccug

SEQ ID NO: 3063673 - RNA, 13 nt, Mycobacterium bovis subsp bovis AF2122/97
gcagcagcaucgg

SEQ ID NO: 3063674 - RNA, 14 nt, Mycobacterium bovis subsp bovis AF2122/97
gcagcagcccgggc

SEQ ID NO: 3063675 - RNA, 17 nt, Mycobacterium bovis subsp bovis AF2122/97
gcagcagccggcgggcc

SEQ ID NO: 3063676 - RNA, 16 nt, Mycobacterium bovis subsp bovis AF2122/97
gcagcagcgccgcgug

SEQ ID NO: 3063677 - RNA, 14 nt, Mycobacterium bovis subsp bovis AF2122/97
gcagcagcgcgcgg

SEQ ID NO: 3063678 - RNA, 15 nt, Mycobacterium bovis subsp bovis AF2122/97
gcagcagcgcgcgga

SEQ ID NO: 3063679 - RNA, 16 nt, Mycobacterium bovis subsp bovis AF2122/97
gcagcagcgcgcggau

SEQ ID NO: 3063680 - RNA, 21 nt, Mycobacterium bovis subsp bovis AF2122/97
gcagcagcgcuucggcggucg

SEQ ID NO: 3063681 - RNA, 15 nt, Mycobacterium bovis subsp bovis AF2122/97
gcagcagcggcggcg

SEQ ID NO: 3063682 - RNA, 14 nt, Mycobacterium bovis subsp bovis AF2122/97
gcagcagcgggcgc

SEQ ID NO: 3063683 - RNA, 17 nt, Mycobacterium bovis subsp bovis AF2122/97
gcagcagcgggcgcgcu

SEQ ID NO: 3063684 - RNA, 17 nt, Mycobacterium bovis subsp bovis AF2122/97
gcagcagcggugcagcc

SEQ ID NO: 3063685 - RNA, 19 nt, Mycobacterium bovis subsp bovis AF2122/97
gcagcagcggugcagcccg

SEQ ID NO: 3063686 - RNA, 18 nt, Mycobacterium bovis subsp bovis AF2122/97
gcagcagcgugaccaccg

SEQ ID NO: 3063687 - RNA, 22 nt, Mycobacterium bovis subsp bovis AF2122/97
gcagcagcgugaccaccgccga

SEQ ID NO: 3063688 - RNA, 23 nt, Mycobacterium bovis subsp bovis AF2122/97
gcagcagcgugaccaccgccgac

SEQ ID NO: 3063689 - RNA, 23 nt, Mycobacterium bovis subsp bovis AF2122/97
gcagcagcuggucgugggccacc

SEQ ID NO: 3063690 - RNA, 14 nt, Mycobacterium bovis subsp bovis AF2122/97
gcagcagcuugacc

SEQ ID NO: 3063691 - RNA, 12 nt, Mycobacterium bovis subsp bovis AF2122/97
gcagcaggacac

SEQ ID NO: 3063692 - RNA, 17 nt, Mycobacterium bovis subsp bovis AF2122/97
gcagcaggcccacccgg

SEQ ID NO: 3063693 - RNA, 17 nt, Mycobacterium bovis subsp bovis AF2122/97
gcagcaggcgaugcgcc

SEQ ID NO: 3063694 - RNA, 22 nt, Mycobacterium bovis subsp bovis AF2122/97
gcagcagggcgcgcaucugcuc

SEQ ID NO: 3063695 - RNA, 17 nt, Mycobacterium bovis subsp bovis AF2122/97
gcagcaggggacgacca

SEQ ID NO: 3063696 - RNA, 20 nt, Mycobacterium bovis subsp bovis AF2122/97
gcagcaggggacgaccaugc

SEQ ID NO: 3063697 - RNA, 12 nt, Mycobacterium bovis subsp bovis AF2122/97
gcagcaggugag

SEQ ID NO: 3063698 - RNA, 21 nt, Mycobacterium bovis subsp bovis AF2122/97
gcagcaggugcaucgccacag

SEQ ID NO: 3063699 - RNA, 13 nt, Mycobacterium bovis subsp bovis AF2122/97
gcagcauauccgc

SEQ ID NO: 3063700 - RNA, 16 nt, Mycobacterium bovis subsp bovis AF2122/97
gcagcaucaacaccgg

SEQ ID NO: 3063701 - RNA, 13 nt, Mycobacterium bovis subsp bovis AF2122/97
gcagcaucacguc

SEQ ID NO: 3063702 - RNA, 16 nt, Mycobacterium bovis subsp bovis AF2122/97
gcagcaucacguccgc

SEQ ID NO: 3063703 - RNA, 15 nt, Mycobacterium bovis subsp bovis AF2122/97
gcagcauccggccgu

SEQ ID NO: 3063704 - RNA, 19 nt, Mycobacterium bovis subsp bovis AF2122/97
gcagcaucggcaccccggc

SEQ ID NO: 3063705 - RNA, 20 nt, Mycobacterium bovis subsp bovis AF2122/97
gcagcaucggcacgucguug

SEQ ID NO: 3063706 - RNA, 13 nt, Mycobacterium bovis subsp bovis AF2122/97
gcagcaucggcga

SEQ ID NO: 3063707 - RNA, 18 nt, Mycobacterium bovis subsp bovis AF2122/97
gcagcaucggcgacagga

SEQ ID NO: 3063708 - RNA, 15 nt, Mycobacterium bovis subsp bovis AF2122/97
gcagcaucgucgcca

SEQ ID NO: 3063709 - RNA, 16 nt, Mycobacterium bovis subsp bovis AF2122/97
gcagcaucgucgccac

SEQ ID NO: 3063710 - RNA, 14 nt, Mycobacterium bovis subsp bovis AF2122/97
gcagccgcgccgcg

SEQ ID NO: 3063711 - RNA, 21 nt, Mycobacterium bovis subsp bovis AF2122/97
gcagccgcgcgguacugcgca

SEQ ID NO: 3063712 - RNA, 22 nt, Mycobacterium bovis subsp bovis AF2122/97
gcagccgcgcggugauggucac

SEQ ID NO: 3063713 - RNA, 17 nt, Mycobacterium bovis subsp bovis AF2122/97
gcagccggaccguguac

SEQ ID NO: 3063714 - RNA, 17 nt, Mycobacterium bovis subsp bovis AF2122/97
gcagccggcccgucgcg

SEQ ID NO: 3063715 - RNA, 19 nt, Mycobacterium bovis subsp bovis AF2122/97
gcagccggcggagaaggcg

SEQ ID NO: 3063716 - RNA, 22 nt, Mycobacterium bovis subsp bovis AF2122/97
gcagccggcggagaaggcgacc

SEQ ID NO: 3063717 - RNA, 13 nt, Mycobacterium bovis subsp bovis AF2122/97
gcagccggcgggc

SEQ ID NO: 3063718 - RNA, 15 nt, Mycobacterium bovis subsp bovis AF2122/97
gcagccgggcaccac

SEQ ID NO: 3063719 - RNA, 17 nt, Mycobacterium bovis subsp bovis AF2122/97
gcagccgggcaccaccc

SEQ ID NO: 3063720 - RNA, 18 nt, Mycobacterium bovis subsp bovis AF2122/97
gcagccgggcaccgaacu

SEQ ID NO: 3063721 - RNA, 17 nt, Mycobacterium bovis subsp bovis AF2122/97
gcagccgggccaaccgg

SEQ ID NO: 3063722 - RNA, 20 nt, Mycobacterium bovis subsp bovis AF2122/97
gcagccgggcggcagcggcu

SEQ ID NO: 3063723 - RNA, 14 nt, Mycobacterium bovis subsp bovis AF2122/97
gcagccgggcgucg

SEQ ID NO: 3063724 - RNA, 18 nt, Mycobacterium bovis subsp bovis AF2122/97
gcagccgggcgucgcugg

SEQ ID NO: 3063725 - RNA, 21 nt, Mycobacterium bovis subsp bovis AF2122/97
gcagccguagcugggcacccc

SEQ ID NO: 3063726 - RNA, 15 nt, Mycobacterium bovis subsp bovis AF2122/97
gcagccugcagcgaa

SEQ ID NO: 3063727 - RNA, 17 nt, Mycobacterium bovis subsp bovis AF2122/97
gcagccugccgaugacg

SEQ ID NO: 3063728 - RNA, 22 nt, Mycobacterium bovis subsp bovis AF2122/97
gcagccugccgaugacgauggc

SEQ ID NO: 3063729 - RNA, 16 nt, Mycobacterium bovis subsp bovis AF2122/97
gcagccugcgccgcgc

SEQ ID NO: 3063730 - RNA, 17 nt, Mycobacterium bovis subsp bovis AF2122/97
gcagccugcgccgcgcg

SEQ ID NO: 3063731 - RNA, 14 nt, Mycobacterium bovis subsp bovis AF2122/97
gcagccugcugcac

SEQ ID NO: 3063732 - RNA, 18 nt, Mycobacterium bovis subsp bovis AF2122/97
gcagccuggucgcgcagc

SEQ ID NO: 3063733 - RNA, 13 nt, Mycobacterium bovis subsp bovis AF2122/97
gcagccuucucgc

SEQ ID NO: 3063734 - RNA, 22 nt, Mycobacterium bovis subsp bovis AF2122/97
gcagcgaaaacccggucggcga

SEQ ID NO: 3063735 - RNA, 14 nt, Mycobacterium bovis subsp bovis AF2122/97
gcagcgaaacaccg

SEQ ID NO: 3063736 - RNA, 21 nt, Mycobacterium bovis subsp bovis AF2122/97
gcagcgaaacaccggccagcg

SEQ ID NO: 3063737 - RNA, 23 nt, Mycobacterium bovis subsp bovis AF2122/97
gcagcgaaacaccggccagcggc

SEQ ID NO: 3063738 - RNA, 20 nt, Mycobacterium bovis subsp bovis AF2122/97
gcagcgaaacgagccggugc

SEQ ID NO: 3063739 - RNA, 21 nt, Mycobacterium bovis subsp bovis AF2122/97
gcagcgaaacgagccggugcg

SEQ ID NO: 3063740 - RNA, 20 nt, Mycobacterium bovis subsp bovis AF2122/97
gcagcgaaagcgucgagcug

SEQ ID NO: 3063741 - RNA, 17 nt, Mycobacterium bovis subsp bovis AF2122/97
gcagcgacacguuggcg

SEQ ID NO: 3063742 - RNA, 12 nt, Mycobacterium bovis subsp bovis AF2122/97
gcagcgaccagc

SEQ ID NO: 3063743 - RNA, 20 nt, Mycobacterium bovis subsp bovis AF2122/97
gcagcgaccgucguccagac

SEQ ID NO: 3063744 - RNA, 17 nt, Mycobacterium bovis subsp bovis AF2122/97
gcagcgacgccggcccg

SEQ ID NO: 3063745 - RNA, 13 nt, Mycobacterium bovis subsp bovis AF2122/97
gcagcgacgcgau

SEQ ID NO: 3063746 - RNA, 15 nt, Mycobacterium bovis subsp bovis AF2122/97
gcagcgacgcugccg

SEQ ID NO: 3063747 - RNA, 18 nt, Mycobacterium bovis subsp bovis AF2122/97
gcagcgacggcagcucgg

SEQ ID NO: 3063748 - RNA, 21 nt, Mycobacterium bovis subsp bovis AF2122/97
gcagcgacggcagcucggggc

SEQ ID NO: 3063749 - RNA, 15 nt, Mycobacterium bovis subsp bovis AF2122/97
gcagcgacggucagg

SEQ ID NO: 3063750 - RNA, 17 nt, Mycobacterium bovis subsp bovis AF2122/97
gcagcgacuccagcgcc

SEQ ID NO: 3063751 - RNA, 15 nt, Mycobacterium bovis subsp bovis AF2122/97
gcagcgagacuucga

SEQ ID NO: 3063752 - RNA, 23 nt, Mycobacterium bovis subsp bovis AF2122/97
gcagcgagacuucgacgcggcga

SEQ ID NO: 3063753 - RNA, 22 nt, Mycobacterium bovis subsp bovis AF2122/97
gcagcgaggagcccggucccuu

SEQ ID NO: 3063754 - RNA, 17 nt, Mycobacterium bovis subsp bovis AF2122/97
gcagcgaggcucgcagg

SEQ ID NO: 3063755 - RNA, 14 nt, Mycobacterium bovis subsp bovis AF2122/97
gcagcgagucgacg

SEQ ID NO: 3063756 - RNA, 19 nt, Mycobacterium bovis subsp bovis AF2122/97
gcagcgagucgacgucgau

SEQ ID NO: 3063757 - RNA, 21 nt, Mycobacterium bovis subsp bovis AF2122/97
gcagcgauaucacaacugccc

SEQ ID NO: 3063758 - RNA, 19 nt, Mycobacterium bovis subsp bovis AF2122/97
gcagcgaucuugguggccu

SEQ ID NO: 3063759 - RNA, 17 nt, Mycobacterium bovis subsp bovis AF2122/97
gcagcgaugacgaccaa

SEQ ID NO: 3063760 - RNA, 19 nt, Mycobacterium bovis subsp bovis AF2122/97
gcagcgcaaacaucuuguc

SEQ ID NO: 3063761 - RNA, 15 nt, Mycobacterium bovis subsp bovis AF2122/97
gcagcgcaacaucga

SEQ ID NO: 3063762 - RNA, 19 nt, Mycobacterium bovis subsp bovis AF2122/97
gcagcgcaacggccagcgc

SEQ ID NO: 3063763 - RNA, 22 nt, Mycobacterium bovis subsp bovis AF2122/97
gcagcgcaaugcaucgcggcgg

SEQ ID NO: 3063764 - RNA, 23 nt, Mycobacterium bovis subsp bovis AF2122/97
gcagcgcaaugcaucgcggcggc

SEQ ID NO: 3063765 - RNA, 14 nt, Mycobacterium bovis subsp bovis AF2122/97
gcagcgcaccaacu

SEQ ID NO: 3063766 - RNA, 14 nt, Mycobacterium bovis subsp bovis AF2122/97
gcagcgcacgcagc

SEQ ID NO: 3063767 - RNA, 22 nt, Mycobacterium bovis subsp bovis AF2122/97
gcagcgcaggauucugcugacc

SEQ ID NO: 3063768 - RNA, 14 nt, Mycobacterium bovis subsp bovis AF2122/97
gcagcgcauccggu

SEQ ID NO: 3063769 - RNA, 19 nt, Mycobacterium bovis subsp bovis AF2122/97
gcagcgccaacgcccccau

SEQ ID NO: 3063770 - RNA, 13 nt, Mycobacterium bovis subsp bovis AF2122/97
gcagcgccacccg

SEQ ID NO: 3063771 - RNA, 20 nt, Mycobacterium bovis subsp bovis AF2122/97
gcagcgccacccgaucgggc

SEQ ID NO: 3063772 - RNA, 19 nt, Mycobacterium bovis subsp bovis AF2122/97
gcagcgccacccgcgucag

SEQ ID NO: 3063773 - RNA, 21 nt, Mycobacterium bovis subsp bovis AF2122/97
gcagcgccacccgcgucaguc

SEQ ID NO: 3063774 - RNA, 15 nt, Mycobacterium bovis subsp bovis AF2122/97
gcagcgccagcagcu

SEQ ID NO: 3063775 - RNA, 18 nt, Mycobacterium bovis subsp bovis AF2122/97
gcagcgccagcgggauga

SEQ ID NO: 3063776 - RNA, 12 nt, Mycobacterium bovis subsp bovis AF2122/97
gcagcgccaggc

SEQ ID NO: 3063777 - RNA, 15 nt, Mycobacterium bovis subsp bovis AF2122/97
gcagcgccaggccgu

SEQ ID NO: 3063778 - RNA, 16 nt, Mycobacterium bovis subsp bovis AF2122/97
gcagcgcccccgcugc

SEQ ID NO: 3063779 - RNA, 20 nt, Mycobacterium bovis subsp bovis AF2122/97
gcagcgcccuuggacgcgau

SEQ ID NO: 3063780 - RNA, 14 nt, Mycobacterium bovis subsp bovis AF2122/97
gcagcgccgacagc

SEQ ID NO: 3063781 - RNA, 15 nt, Mycobacterium bovis subsp bovis AF2122/97
gcagcgccgacagcc

SEQ ID NO: 3063782 - RNA, 12 nt, Mycobacterium bovis subsp bovis AF2122/97
gcagcgccgcca

SEQ ID NO: 3063783 - RNA, 15 nt, Mycobacterium bovis subsp bovis AF2122/97
gcagcgccgccaccc

SEQ ID NO: 3063784 - RNA, 12 nt, Mycobacterium bovis subsp bovis AF2122/97
gcagcgccgcgc

SEQ ID NO: 3063785 - RNA, 13 nt, Mycobacterium bovis subsp bovis AF2122/97
gcagcgccgcgcg

SEQ ID NO: 3063786 - RNA, 14 nt, Mycobacterium bovis subsp bovis AF2122/97
gcagcgccgcgugg

SEQ ID NO: 3063787 - RNA, 17 nt, Mycobacterium bovis subsp bovis AF2122/97
gcagcgccgcguucagg

SEQ ID NO: 3063788 - RNA, 17 nt, Mycobacterium bovis subsp bovis AF2122/97
gcagcgccuaccagcac

SEQ ID NO: 3063789 - RNA, 18 nt, Mycobacterium bovis subsp bovis AF2122/97
gcagcgccuaccagcacc

SEQ ID NO: 3063790 - RNA, 16 nt, Mycobacterium bovis subsp bovis AF2122/97
gcagcgccucgauccg

SEQ ID NO: 3063791 - RNA, 17 nt, Mycobacterium bovis subsp bovis AF2122/97
gcagcgccucgauccgc

SEQ ID NO: 3063792 - RNA, 18 nt, Mycobacterium bovis subsp bovis AF2122/97
gcagcgccugcggcagca

SEQ ID NO: 3063793 - RNA, 15 nt, Mycobacterium bovis subsp bovis AF2122/97
gcagcgcgaacacca

SEQ ID NO: 3063794 - RNA, 19 nt, Mycobacterium bovis subsp bovis AF2122/97
gcagcgcgacaaaguucga

SEQ ID NO: 3063795 - RNA, 13 nt, Mycobacterium bovis subsp bovis AF2122/97
gcagcgcgacccg

SEQ ID NO: 3063796 - RNA, 17 nt, Mycobacterium bovis subsp bovis AF2122/97
gcagcgcgacccguagc

SEQ ID NO: 3063797 - RNA, 17 nt, Mycobacterium bovis subsp bovis AF2122/97
gcagcgugcagcggcgg

SEQ ID NO: 3063798 - RNA, 15 nt, Mycobacterium bovis subsp bovis AF2122/97
gcagcgugcccagua

SEQ ID NO: 3063799 - RNA, 21 nt, Mycobacterium bovis subsp bovis AF2122/97
gcagcguggacaucgggcggc

SEQ ID NO: 3063800 - RNA, 21 nt, Mycobacterium bovis subsp bovis AF2122/97
gcagcgugggaagagccgggc

SEQ ID NO: 3063801 - RNA, 14 nt, Mycobacterium bovis subsp bovis AF2122/97
gcagcgugggcagc

SEQ ID NO: 3063802 - RNA, 19 nt, Mycobacterium bovis subsp bovis AF2122/97
gcagcgugugcucgugggc

SEQ ID NO: 3063803 - RNA, 20 nt, Mycobacterium bovis subsp bovis AF2122/97
gcagcgugugcucgugggcg

SEQ ID NO: 3063804 - RNA, 21 nt, Mycobacterium bovis subsp bovis AF2122/97
gcagcguguugcguucgguga

SEQ ID NO: 3063805 - RNA, 17 nt, Mycobacterium bovis subsp bovis AF2122/97
gcagcguugacggcggg

SEQ ID NO: 3063806 - RNA, 18 nt, Mycobacterium bovis subsp bovis AF2122/97
gcagcguugacggcuucg

SEQ ID NO: 3063807 - RNA, 15 nt, Mycobacterium bovis subsp bovis AF2122/97
gcagcguugacgguc

SEQ ID NO: 3063808 - RNA, 23 nt, Mycobacterium bovis subsp bovis AF2122/97
gcagcguuggccgcugucguacc

SEQ ID NO: 3063809 - RNA, 15 nt, Mycobacterium bovis subsp bovis AF2122/97
gcagcuagcccggca

SEQ ID NO: 3063810 - RNA, 18 nt, Mycobacterium bovis subsp bovis AF2122/97
gcagcuagcccucagcua

SEQ ID NO: 3063811 - RNA, 15 nt, Mycobacterium bovis subsp bovis AF2122/97
gcagcuaguggccga

SEQ ID NO: 3063812 - RNA, 21 nt, Mycobacterium bovis subsp bovis AF2122/97
gcagcuauuucgcgacgcgcg

SEQ ID NO: 3063813 - RNA, 24 nt, Mycobacterium bovis subsp bovis AF2122/97
gcagcuauuucgcgacgcgcgaga

SEQ ID NO: 3063814 - RNA, 15 nt, Mycobacterium bovis subsp bovis AF2122/97
gcagcucaccgacgg

SEQ ID NO: 3063815 - RNA, 16 nt, Mycobacterium bovis subsp bovis AF2122/97
gcagcucaccucauga

SEQ ID NO: 3063816 - RNA, 13 nt, Mycobacterium bovis subsp bovis AF2122/97
gcagcucaucgcg

SEQ ID NO: 3063817 - RNA, 16 nt, Mycobacterium bovis subsp bovis AF2122/97
gcagcucaucgcgcac

SEQ ID NO: 3063818 - RNA, 21 nt, Mycobacterium bovis subsp bovis AF2122/97
gcagcucaucgcgcacgcccu

SEQ ID NO: 3063819 - RNA, 15 nt, Mycobacterium bovis subsp bovis AF2122/97
gcagcuccaccagga

SEQ ID NO: 3063820 - RNA, 17 nt, Mycobacterium bovis subsp bovis AF2122/97
gcagcuccaccgugacg

SEQ ID NO: 3063821 - RNA, 21 nt, Mycobacterium bovis subsp bovis AF2122/97
gcagcuccagcaaaacccgcu

SEQ ID NO: 3063822 - RNA, 13 nt, Mycobacterium bovis subsp bovis AF2122/97
gcagcuccccgac

SEQ ID NO: 3063823 - RNA, 20 nt, Mycobacterium bovis subsp bovis AF2122/97
gcagcuccccgaccgaaccg

SEQ ID NO: 3063824 - RNA, 16 nt, Mycobacterium bovis subsp bovis AF2122/97
gcagcuccgccgccga

SEQ ID NO: 3063825 - RNA, 15 nt, Mycobacterium bovis subsp bovis AF2122/97
gcagcuccucgcgcu

SEQ ID NO: 3063826 - RNA, 15 nt, Mycobacterium bovis subsp bovis AF2122/97
gcagcucgaccagga

SEQ ID NO: 3063827 - RNA, 14 nt, Mycobacterium bovis subsp bovis AF2122/97
gcagcucgauaccc

SEQ ID NO: 3063828 - RNA, 19 nt, Mycobacterium bovis subsp bovis AF2122/97
gcagcucgauacccaggau

SEQ ID NO: 3063829 - RNA, 21 nt, Mycobacterium bovis subsp bovis AF2122/97
gcagcucgcacucguugccga

SEQ ID NO: 3063830 - RNA, 21 nt, Mycobacterium bovis subsp bovis AF2122/97
gcagcucgccggcacgcagcc

SEQ ID NO: 3063831 - RNA, 15 nt, Mycobacterium bovis subsp bovis AF2122/97
gcagcucgcuguaga

SEQ ID NO: 3063832 - RNA, 17 nt, Mycobacterium bovis subsp bovis AF2122/97
gcagcucggccgaggcg

SEQ ID NO: 3063833 - RNA, 16 nt, Mycobacterium bovis subsp bovis AF2122/97
gcagcucgggcaggga

SEQ ID NO: 3063834 - RNA, 23 nt, Mycobacterium bovis subsp bovis AF2122/97
gcagcucggggcgaugagccugc

SEQ ID NO: 3063835 - RNA, 12 nt, Mycobacterium bovis subsp bovis AF2122/97
gcagcucgguca

SEQ ID NO: 3063836 - RNA, 19 nt, Mycobacterium bovis subsp bovis AF2122/97
gcagcucguugaugcggcu

SEQ ID NO: 3063837 - RNA, 21 nt, Mycobacterium bovis subsp bovis AF2122/97
gcagcugaaaauaggccgggc

SEQ ID NO: 3063838 - RNA, 10 nt, Mycobacterium bovis subsp bovis AF2122/97
gcagcugacg

SEQ ID NO: 3063839 - RNA, 19 nt, Mycobacterium bovis subsp bovis AF2122/97
gcagcugacgucaccacga

SEQ ID NO: 3063840 - RNA, 12 nt, Mycobacterium bovis subsp bovis AF2122/97
gcagcugagccg

SEQ ID NO: 3063841 - RNA, 16 nt, Mycobacterium bovis subsp bovis AF2122/97
gcagcugagccguguc

SEQ ID NO: 3063842 - RNA, 17 nt, Mycobacterium bovis subsp bovis AF2122/97
gcagcugccgcaccccc

SEQ ID NO: 3063843 - RNA, 19 nt, Mycobacterium bovis subsp bovis AF2122/97
gcagcugcgauauggucac

SEQ ID NO: 3063844 - RNA, 22 nt, Mycobacterium bovis subsp bovis AF2122/97
gcagcugcgauauggucaccaa

SEQ ID NO: 3063845 - RNA, 14 nt, Mycobacterium bovis subsp bovis AF2122/97
gcagcuggaccacc

SEQ ID NO: 3063846 - RNA, 12 nt, Mycobacterium bovis subsp bovis AF2122/97
gcagcuggcgac

SEQ ID NO: 3063847 - RNA, 14 nt, Mycobacterium bovis subsp bovis AF2122/97
gcagcuggcgcagc

SEQ ID NO: 3063848 - RNA, 19 nt, Mycobacterium bovis subsp bovis AF2122/97
gcagcuggcgcagccugcc

SEQ ID NO: 3063849 - RNA, 20 nt, Mycobacterium bovis subsp bovis AF2122/97
gcagcuggcgcagccugccg

SEQ ID NO: 3063850 - RNA, 14 nt, Mycobacterium bovis subsp bovis AF2122/97
gcagcugguagcgc

SEQ ID NO: 3063851 - RNA, 15 nt, Mycobacterium bovis subsp bovis AF2122/97
gcagcugguagguca

SEQ ID NO: 3063852 - RNA, 17 nt, Mycobacterium bovis subsp bovis AF2122/97
gcagcugguaggucacc

SEQ ID NO: 3063853 - RNA, 17 nt, Mycobacterium bovis subsp bovis AF2122/97
gcagcuggucgugggcc

SEQ ID NO: 3063854 - RNA, 20 nt, Mycobacterium bovis subsp bovis AF2122/97
gcagcuggucgugggccacc

SEQ ID NO: 3063855 - RNA, 14 nt, Mycobacterium bovis subsp bovis AF2122/97
gcagcuguggccca

SEQ ID NO: 3063856 - RNA, 16 nt, Mycobacterium bovis subsp bovis AF2122/97
gcagcuguuggcgugg

SEQ ID NO: 3063857 - RNA, 12 nt, Mycobacterium bovis subsp bovis AF2122/97
gcagcuucaaca

SEQ ID NO: 3063858 - RNA, 13 nt, Mycobacterium bovis subsp bovis AF2122/97
gcagcuucaacac

SEQ ID NO: 3063859 - RNA, 17 nt, Mycobacterium bovis subsp bovis AF2122/97
gcagcuucaacaccggc

SEQ ID NO: 3063860 - RNA, 20 nt, Mycobacterium bovis subsp bovis AF2122/97
gcagcuucaacaccggcauc

SEQ ID NO: 3063861 - RNA, 12 nt, Mycobacterium bovis subsp bovis AF2122/97
gcagcuucucgc

SEQ ID NO: 3063862 - RNA, 18 nt, Mycobacterium bovis subsp bovis AF2122/97
gcagcuugaucccaucca

SEQ ID NO: 3063863 - RNA, 18 nt, Mycobacterium bovis subsp bovis AF2122/97
gcagcuugccaaucaccg

SEQ ID NO: 3063864 - RNA, 17 nt, Mycobacterium bovis subsp bovis AF2122/97
gcagcuugcccgacggc

SEQ ID NO: 3063865 - RNA, 16 nt, Mycobacterium bovis subsp bovis AF2122/97
gcagcuuggacucauc

SEQ ID NO: 3063866 - RNA, 21 nt, Mycobacterium bovis subsp bovis AF2122/97
gcagcuuggcauugaccaccg

SEQ ID NO: 3063867 - RNA, 16 nt, Mycobacterium bovis subsp bovis AF2122/97
gcagcuuggccagcca

SEQ ID NO: 3063868 - RNA, 18 nt, Mycobacterium bovis subsp bovis AF2122/97
gcagcuuggccagccacu

SEQ ID NO: 3063869 - RNA, 15 nt, Mycobacterium bovis subsp bovis AF2122/97
gcagcuugguggcgu

SEQ ID NO: 3063870 - RNA, 15 nt, Mycobacterium bovis subsp bovis AF2122/97
gcagcuuguccggug

SEQ ID NO: 3063871 - RNA, 20 nt, Mycobacterium bovis subsp bovis AF2122/97
gcagcuuuaaucguggcacu

SEQ ID NO: 3063872 - RNA, 22 nt, Mycobacterium bovis subsp bovis AF2122/97
gcagcuuugacgcccucggcga

SEQ ID NO: 3063873 - RNA, 16 nt, Mycobacterium bovis subsp bovis AF2122/97
gcaggaaaaccccggc

SEQ ID NO: 3063874 - RNA, 19 nt, Mycobacterium bovis subsp bovis AF2122/97
gcaggaaaaccccggccac

SEQ ID NO: 3063875 - RNA, 20 nt, Mycobacterium bovis subsp bovis AF2122/97
gcaggaaaaccccggccacc

SEQ ID NO: 3063876 - RNA, 22 nt, Mycobacterium bovis subsp bovis AF2122/97
gcaggaaaaccccggccaccag

SEQ ID NO: 3063877 - RNA, 21 nt, Mycobacterium bovis subsp bovis AF2122/97
gcaggaaaucguccuuggaca

SEQ ID NO: 3063878 - RNA, 23 nt, Mycobacterium bovis subsp bovis AF2122/97
gcaggaaaucguccuuggacagg

SEQ ID NO: 3063879 - RNA, 14 nt, Mycobacterium bovis subsp bovis AF2122/97
gcaggaacacccau

SEQ ID NO: 3063880 - RNA, 14 nt, Mycobacterium bovis subsp bovis AF2122/97
gcaggaacgccgug

SEQ ID NO: 3063881 - RNA, 19 nt, Mycobacterium bovis subsp bovis AF2122/97
gcaggaagccggcgugcuc

SEQ ID NO: 3063882 - RNA, 20 nt, Mycobacterium bovis subsp bovis AF2122/97
gcaggaaggcuucggugacc

SEQ ID NO: 3063883 - RNA, 17 nt, Mycobacterium bovis subsp bovis AF2122/97
gcaggaagucgagcaga

SEQ ID NO: 3063884 - RNA, 14 nt, Mycobacterium bovis subsp bovis AF2122/97
gcaggcgucccagc

SEQ ID NO: 3063885 - RNA, 20 nt, Mycobacterium bovis subsp bovis AF2122/97
gcaggcgucccagccgauca

SEQ ID NO: 3063886 - RNA, 19 nt, Mycobacterium bovis subsp bovis AF2122/97
gcaggcuaaucagccaggc

SEQ ID NO: 3063887 - RNA, 22 nt, Mycobacterium bovis subsp bovis AF2122/97
gcaggcucgggcaaggccaccg

SEQ ID NO: 3063888 - RNA, 18 nt, Mycobacterium bovis subsp bovis AF2122/97
gcaggcugucaauccgcc

SEQ ID NO: 3063889 - RNA, 20 nt, Mycobacterium bovis subsp bovis AF2122/97
gcaggcuuccagccacagcc

SEQ ID NO: 3063890 - RNA, 14 nt, Mycobacterium bovis subsp bovis AF2122/97
gcaggcuuccccga

SEQ ID NO: 3063891 - RNA, 17 nt, Mycobacterium bovis subsp bovis AF2122/97
gcaggcuuucauugaca

SEQ ID NO: 3063892 - RNA, 21 nt, Mycobacterium bovis subsp bovis AF2122/97
gcagggaauagcggcgcccgc

SEQ ID NO: 3063893 - RNA, 21 nt, Mycobacterium bovis subsp bovis AF2122/97
gcagggacccggcgccgucga

SEQ ID NO: 3063894 - RNA, 20 nt, Mycobacterium bovis subsp bovis AF2122/97
gcagggacugugggggcgca

SEQ ID NO: 3063895 - RNA, 22 nt, Mycobacterium bovis subsp bovis AF2122/97
gcagggacugugggggcgcacc

SEQ ID NO: 3063896 - RNA, 14 nt, Mycobacterium bovis subsp bovis AF2122/97
gcagggaucacccc

SEQ ID NO: 3063897 - RNA, 23 nt, Mycobacterium bovis subsp bovis AF2122/97
gcagggauucuggaugccggugg

SEQ ID NO: 3063898 - RNA, 16 nt, Mycobacterium bovis subsp bovis AF2122/97
gcagggcagcccggcg

SEQ ID NO: 3063899 - RNA, 19 nt, Mycobacterium bovis subsp bovis AF2122/97
gcagggcauugcggcccgc

SEQ ID NO: 3063900 - RNA, 20 nt, Mycobacterium bovis subsp bovis AF2122/97
gcagggccaccaccacggcc

SEQ ID NO: 3063901 - RNA, 19 nt, Mycobacterium bovis subsp bovis AF2122/97
gcagggccacuggccgguu

SEQ ID NO: 3063902 - RNA, 14 nt, Mycobacterium bovis subsp bovis AF2122/97
gcagggccagcggc

SEQ ID NO: 3063903 - RNA, 18 nt, Mycobacterium bovis subsp bovis AF2122/97
gcagggccagcggcagcc

SEQ ID NO: 3063904 - RNA, 15 nt, Mycobacterium bovis subsp bovis AF2122/97
gcagggccgccgcga

SEQ ID NO: 3063905 - RNA, 18 nt, Mycobacterium bovis subsp bovis AF2122/97
gcagggccucggucgcca

SEQ ID NO: 3063906 - RNA, 12 nt, Mycobacterium bovis subsp bovis AF2122/97
gcagggccuggc

SEQ ID NO: 3063907 - RNA, 14 nt, Mycobacterium bovis subsp bovis AF2122/97
gcagggccuggcca

SEQ ID NO: 3063908 - RNA, 15 nt, Mycobacterium bovis subsp bovis AF2122/97
gcagggccuggccac

SEQ ID NO: 3063909 - RNA, 14 nt, Mycobacterium bovis subsp bovis AF2122/97
gcagggcggcgaac

SEQ ID NO: 3063910 - RNA, 13 nt, Mycobacterium bovis subsp bovis AF2122/97
gcagggcgucggc

SEQ ID NO: 3063911 - RNA, 15 nt, Mycobacterium bovis subsp bovis AF2122/97
gcagggcgucggcga

SEQ ID NO: 3063912 - RNA, 15 nt, Mycobacterium bovis subsp bovis AF2122/97
gcaggggacgaccau

SEQ ID NO: 3063913 - RNA, 14 nt, Mycobacterium bovis subsp bovis AF2122/97
gcaggggacgggcg

SEQ ID NO: 3063914 - RNA, 15 nt, Mycobacterium bovis subsp bovis AF2122/97
gcaggggacgggcgg

SEQ ID NO: 3063915 - RNA, 14 nt, Mycobacterium bovis subsp bovis AF2122/97
gcaggggcggcgug

SEQ ID NO: 3063916 - RNA, 11 nt, Mycobacterium bovis subsp bovis AF2122/97
gcagggugacc

SEQ ID NO: 3063917 - RNA, 14 nt, Mycobacterium bovis subsp bovis AF2122/97
gcagggugaccagg

SEQ ID NO: 3063918 - RNA, 17 nt, Mycobacterium bovis subsp bovis AF2122/97
gcagggugaccaggauc

SEQ ID NO: 3063919 - RNA, 15 nt, Mycobacterium bovis subsp bovis AF2122/97
gcagggugccggcgc

SEQ ID NO: 3063920 - RNA, 19 nt, Mycobacterium bovis subsp bovis AF2122/97
gcagggugccggcgccgcc

SEQ ID NO: 3063921 - RNA, 20 nt, Mycobacterium bovis subsp bovis AF2122/97
gcagggugccggcgccgccc

SEQ ID NO: 3063922 - RNA, 14 nt, Mycobacterium bovis subsp bovis AF2122/97
gcaggguggccagc

SEQ ID NO: 3063923 - RNA, 15 nt, Mycobacterium bovis subsp bovis AF2122/97
gcaggguggccagca

SEQ ID NO: 3063924 - RNA, 18 nt, Mycobacterium bovis subsp bovis AF2122/97
gcaggguggccagcaggc

SEQ ID NO: 3063925 - RNA, 15 nt, Mycobacterium bovis subsp bovis AF2122/97
gcaggguggggcggu

SEQ ID NO: 3063926 - RNA, 21 nt, Mycobacterium bovis subsp bovis AF2122/97
gcaggguggggcgguggccgg

SEQ ID NO: 3063927 - RNA, 22 nt, Mycobacterium bovis subsp bovis AF2122/97
gcaggguugccccgaagcgggc

SEQ ID NO: 3063928 - RNA, 20 nt, Mycobacterium bovis subsp bovis AF2122/97
gcagguacgccucgacagcg

SEQ ID NO: 3063929 - RNA, 16 nt, Mycobacterium bovis subsp bovis AF2122/97
gcagguacucgcccca

SEQ ID NO: 3063930 - RNA, 22 nt, Mycobacterium bovis subsp bovis AF2122/97
gcagguauaccgagggucgggc

SEQ ID NO: 3063931 - RNA, 21 nt, Mycobacterium bovis subsp bovis AF2122/97
gcagguccaggguggucgucg

SEQ ID NO: 3063932 - RNA, 14 nt, Mycobacterium bovis subsp bovis AF2122/97
gcagguccaucugg

SEQ ID NO: 3063933 - RNA, 12 nt, Mycobacterium bovis subsp bovis AF2122/97
gcaggucgaugc

SEQ ID NO: 3063934 - RNA, 23 nt, Mycobacterium bovis subsp bovis AF2122/97
gcaggucgaugcugccagccaug

SEQ ID NO: 3063935 - RNA, 13 nt, Mycobacterium bovis subsp bovis AF2122/97
gcaggucgcacca

SEQ ID NO: 3063936 - RNA, 13 nt, Mycobacterium bovis subsp bovis AF2122/97
gcaggucgccugc

SEQ ID NO: 3063937 - RNA, 21 nt, Mycobacterium bovis subsp bovis AF2122/97
gcaggucgccugcccccgcgc

SEQ ID NO: 3063938 - RNA, 19 nt, Mycobacterium bovis subsp bovis AF2122/97
gcaggucgucggcgucgcg

SEQ ID NO: 3063939 - RNA, 16 nt, Mycobacterium bovis subsp bovis AF2122/97
gcaggucuucgcuguc

SEQ ID NO: 3063940 - RNA, 19 nt, Mycobacterium bovis subsp bovis AF2122/97
gcaggugaacaacagcgcu

SEQ ID NO: 3063941 - RNA, 15 nt, Mycobacterium bovis subsp bovis AF2122/97
gcaggugacauguug

SEQ ID NO: 3063942 - RNA, 16 nt, Mycobacterium bovis subsp bovis AF2122/97
gcaggugacgaucagg

SEQ ID NO: 3063943 - RNA, 21 nt, Mycobacterium bovis subsp bovis AF2122/97
gcaggugacgaucaggucgcc

SEQ ID NO: 3063944 - RNA, 23 nt, Mycobacterium bovis subsp bovis AF2122/97
gcaggugacgaucaggucgccga

SEQ ID NO: 3063945 - RNA, 19 nt, Mycobacterium bovis subsp bovis AF2122/97
gcaggugagccaguuggcc

SEQ ID NO: 3063946 - RNA, 14 nt, Mycobacterium bovis subsp bovis AF2122/97
gcaggugagugcgg

SEQ ID NO: 3063947 - RNA, 18 nt, Mycobacterium bovis subsp bovis AF2122/97
gcaggugaugagugcgga

SEQ ID NO: 3063948 - RNA, 19 nt, Mycobacterium bovis subsp bovis AF2122/97
gcaggugauguucagcgcc

SEQ ID NO: 3063949 - RNA, 20 nt, Mycobacterium bovis subsp bovis AF2122/97
gcaggugccaaccgcggcga

SEQ ID NO: 3063950 - RNA, 13 nt, Mycobacterium bovis subsp bovis AF2122/97
gcaggugccaccu

SEQ ID NO: 3063951 - RNA, 12 nt, Mycobacterium bovis subsp bovis AF2122/97
gcaggugcccau

SEQ ID NO: 3063952 - RNA, 16 nt, Mycobacterium bovis subsp bovis AF2122/97
gcaggugcccgaggug

SEQ ID NO: 3063953 - RNA, 21 nt, Mycobacterium bovis subsp bovis AF2122/97
gcaggugcccgaggugcuugg

SEQ ID NO: 3063954 - RNA, 14 nt, Mycobacterium bovis subsp bovis AF2122/97
gcaggugcugggcg

SEQ ID NO: 3063955 - RNA, 16 nt, Mycobacterium bovis subsp bovis AF2122/97
gcagguggccgucgcc

SEQ ID NO: 3063956 - RNA, 18 nt, Mycobacterium bovis subsp bovis AF2122/97
gcagguggccgucgccga

SEQ ID NO: 3063957 - RNA, 13 nt, Mycobacterium bovis subsp bovis AF2122/97
gcagguggucgau

SEQ ID NO: 3063958 - RNA, 17 nt, Mycobacterium bovis subsp bovis AF2122/97
gcagguggugacacgac

SEQ ID NO: 3063959 - RNA, 12 nt, Mycobacterium bovis subsp bovis AF2122/97
gcaggugucggu

SEQ ID NO: 3063960 - RNA, 17 nt, Mycobacterium bovis subsp bovis AF2122/97
gcagguguugcacgagc

SEQ ID NO: 3063961 - RNA, 15 nt, Mycobacterium bovis subsp bovis AF2122/97
gcagguguuggugcg

SEQ ID NO: 3063962 - RNA, 14 nt, Mycobacterium bovis subsp bovis AF2122/97
gcagguuccacggc

SEQ ID NO: 3063963 - RNA, 15 nt, Mycobacterium bovis subsp bovis AF2122/97
gcagguuccacggcc

SEQ ID NO: 3063964 - RNA, 17 nt, Mycobacterium bovis subsp bovis AF2122/97
gcagguucuugaccagc

SEQ ID NO: 3063965 - RNA, 17 nt, Mycobacterium bovis subsp bovis AF2122/97
gcagguuggccaccgcc

SEQ ID NO: 3063966 - RNA, 17 nt, Mycobacterium bovis subsp bovis AF2122/97
gcaguaacgucgucgcg

SEQ ID NO: 3063967 - RNA, 18 nt, Mycobacterium bovis subsp bovis AF2122/97
gcaguaacuucaccggcu

SEQ ID NO: 3063968 - RNA, 20 nt, Mycobacterium bovis subsp bovis AF2122/97
gcaguaacuucaccggcucg

SEQ ID NO: 3063969 - RNA, 14 nt, Mycobacterium bovis subsp bovis AF2122/97
gcaguacaccgccc

SEQ ID NO: 3063970 - RNA, 16 nt, Mycobacterium bovis subsp bovis AF2122/97
gcaguacaccgcccgg

SEQ ID NO: 3063971 - RNA, 21 nt, Mycobacterium bovis subsp bovis AF2122/97
gcauaacgccagucccggcgc

SEQ ID NO: 3063972 - RNA, 15 nt, Mycobacterium bovis subsp bovis AF2122/97
gcauaagcccccgac

SEQ ID NO: 3063973 - RNA, 24 nt, Mycobacterium bovis subsp bovis AF2122/97
gcauaagcccccgacacgccgugc

SEQ ID NO: 3063974 - RNA, 13 nt, Mycobacterium bovis subsp bovis AF2122/97
gcauacagcgccc

SEQ ID NO: 3063975 - RNA, 14 nt, Mycobacterium bovis subsp bovis AF2122/97
gcauacagcgcccg

SEQ ID NO: 3063976 - RNA, 15 nt, Mycobacterium bovis subsp bovis AF2122/97
gcauacagcgcccgg

SEQ ID NO: 3063977 - RNA, 16 nt, Mycobacterium bovis subsp bovis AF2122/97
gcauacagcgcccgga

SEQ ID NO: 3063978 - RNA, 17 nt, Mycobacterium bovis subsp bovis AF2122/97
gcauacauccaggcugu

SEQ ID NO: 3063979 - RNA, 19 nt, Mycobacterium bovis subsp bovis AF2122/97
gcauaccgaacagcaccuc

SEQ ID NO: 3063980 - RNA, 15 nt, Mycobacterium bovis subsp bovis AF2122/97
gcauagaucgggucg

SEQ ID NO: 3063981 - RNA, 19 nt, Mycobacterium bovis subsp bovis AF2122/97
gcauagccacgcaagcaaa

SEQ ID NO: 3063982 - RNA, 21 nt, Mycobacterium bovis subsp bovis AF2122/97
gcauagcggcccaucgggcgc

SEQ ID NO: 3063983 - RNA, 18 nt, Mycobacterium bovis subsp bovis AF2122/97
gcauagcucagaccggcg

SEQ ID NO: 3063984 - RNA, 21 nt, Mycobacterium bovis subsp bovis AF2122/97
gcauagcucagaccggcgccg

SEQ ID NO: 3063985 - RNA, 23 nt, Mycobacterium bovis subsp bovis AF2122/97
gcauaggcuuccggcgcgaccgg

SEQ ID NO: 3063986 - RNA, 19 nt, Mycobacterium bovis subsp bovis AF2122/97
gcauagggccaccgccgcc

SEQ ID NO: 3063987 - RNA, 20 nt, Mycobacterium bovis subsp bovis AF2122/97
gcauagggccaccgccgccu

SEQ ID NO: 3063988 - RNA, 20 nt, Mycobacterium bovis subsp bovis AF2122/97
gcauagguaguugcucggcu

SEQ ID NO: 3063989 - RNA, 14 nt, Mycobacterium bovis subsp bovis AF2122/97
gcauagugcggcug

SEQ ID NO: 3063990 - RNA, 18 nt, Mycobacterium bovis subsp bovis AF2122/97
gcauaucaaccccggugc

SEQ ID NO: 3063991 - RNA, 16 nt, Mycobacterium bovis subsp bovis AF2122/97
gcauauccgcaggccc

SEQ ID NO: 3063992 - RNA, 17 nt, Mycobacterium bovis subsp bovis AF2122/97
gcauauccgccggcgac

SEQ ID NO: 3063993 - RNA, 20 nt, Mycobacterium bovis subsp bovis AF2122/97
gcauaucgauucgggcgucg

SEQ ID NO: 3063994 - RNA, 12 nt, Mycobacterium bovis subsp bovis AF2122/97
gcaucaacaccg

SEQ ID NO: 3063995 - RNA, 22 nt, Mycobacterium bovis subsp bovis AF2122/97
gcaucaaccguccccggcgucc

SEQ ID NO: 3063996 - RNA, 15 nt, Mycobacterium bovis subsp bovis AF2122/97
gcaucaacgcgggcg

SEQ ID NO: 3063997 - RNA, 19 nt, Mycobacterium bovis subsp bovis AF2122/97
gcaucacaagggugcccgg

SEQ ID NO: 3063998 - RNA, 19 nt, Mycobacterium bovis subsp bovis AF2122/97
gcaucaccacccgaccgcc

SEQ ID NO: 3063999 - RNA, 22 nt, Mycobacterium bovis subsp bovis AF2122/97
gcaucaccacccgaccgccauc

SEQ ID NO: 3064000 - RNA, 22 nt, Mycobacterium bovis subsp bovis AF2122/97
gcaucacccgggaugaccaccg

SEQ ID NO: 3064001 - RNA, 18 nt, Mycobacterium bovis subsp bovis AF2122/97
gcaucaccgacgcgucgg

SEQ ID NO: 3064002 - RNA, 16 nt, Mycobacterium bovis subsp bovis AF2122/97
gcaucaccgccgcggc

SEQ ID NO: 3064003 - RNA, 17 nt, Mycobacterium bovis subsp bovis AF2122/97
gcaucaccgccgcggcc

SEQ ID NO: 3064004 - RNA, 18 nt, Mycobacterium bovis subsp bovis AF2122/97
gcaucaccgccgcggccg

SEQ ID NO: 3064005 - RNA, 22 nt, Mycobacterium bovis subsp bovis AF2122/97
gcaucaccgccgcggccgccgu

SEQ ID NO: 3064006 - RNA, 14 nt, Mycobacterium bovis subsp bovis AF2122/97
gcaucaccuggcgu

SEQ ID NO: 3064007 - RNA, 23 nt, Mycobacterium bovis subsp bovis AF2122/97
gcaucaccuggcgugucgccgcc

SEQ ID NO: 3064008 - RNA, 19 nt, Mycobacterium bovis subsp bovis AF2122/97
gcaucagauucgcgcuggc

SEQ ID NO: 3064009 - RNA, 20 nt, Mycobacterium bovis subsp bovis AF2122/97
gcaucagauucgcgcuggcc

SEQ ID NO: 3064010 - RNA, 15 nt, Mycobacterium bovis subsp bovis AF2122/97
gcaucagcccggcgc

SEQ ID NO: 3064011 - RNA, 15 nt, Mycobacterium bovis subsp bovis AF2122/97
gcaucagcgccagcg

SEQ ID NO: 3064012 - RNA, 16 nt, Mycobacterium bovis subsp bovis AF2122/97
gcaucagcgccagcga

SEQ ID NO: 3064013 - RNA, 12 nt, Mycobacterium bovis subsp bovis AF2122/97
gcaucagcggcg

SEQ ID NO: 3064014 - RNA, 13 nt, Mycobacterium bovis subsp bovis AF2122/97
gcaucagcggcgc

SEQ ID NO: 3064015 - RNA, 19 nt, Mycobacterium bovis subsp bovis AF2122/97
gcaucagcuuuugcaccgg

SEQ ID NO: 3064016 - RNA, 12 nt, Mycobacterium bovis subsp bovis AF2122/97
gcaucagggucg

SEQ ID NO: 3064017 - RNA, 19 nt, Mycobacterium bovis subsp bovis AF2122/97
gcaucaguuugacgccgau

SEQ ID NO: 3064018 - RNA, 17 nt, Mycobacterium bovis subsp bovis AF2122/97
gcaucauagacagggcc

SEQ ID NO: 3064019 - RNA, 19 nt, Mycobacterium bovis subsp bovis AF2122/97
gcaucauagacagggccgc

SEQ ID NO: 3064020 - RNA, 15 nt, Mycobacterium bovis subsp bovis AF2122/97
gcaucaucagcggcg

SEQ ID NO: 3064021 - RNA, 21 nt, Mycobacterium bovis subsp bovis AF2122/97
gcaucaucagcggcgccgcac

SEQ ID NO: 3064022 - RNA, 13 nt, Mycobacterium bovis subsp bovis AF2122/97
gcaucaucgccca

SEQ ID NO: 3064023 - RNA, 18 nt, Mycobacterium bovis subsp bovis AF2122/97
gcaucaucgcccaccgca

SEQ ID NO: 3064024 - RNA, 14 nt, Mycobacterium bovis subsp bovis AF2122/97
gcauccaaaaucgc

SEQ ID NO: 3064025 - RNA, 17 nt, Mycobacterium bovis subsp bovis AF2122/97
gcauccaaaaucgccug

SEQ ID NO: 3064026 - RNA, 21 nt, Mycobacterium bovis subsp bovis AF2122/97
gcauccagaaguaggcgaccg

SEQ ID NO: 3064027 - RNA, 22 nt, Mycobacterium bovis subsp bovis AF2122/97
gcauccagaaguaggcgaccgc

SEQ ID NO: 3064028 - RNA, 16 nt, Mycobacterium bovis subsp bovis AF2122/97
gcauccagcagcgccu

SEQ ID NO: 3064029 - RNA, 15 nt, Mycobacterium bovis subsp bovis AF2122/97
gcauccagcgcgcgc

SEQ ID NO: 3064030 - RNA, 18 nt, Mycobacterium bovis subsp bovis AF2122/97
gcauccagcuucgcucgg

SEQ ID NO: 3064031 - RNA, 12 nt, Mycobacterium bovis subsp bovis AF2122/97
gcauccaggcug

SEQ ID NO: 3064032 - RNA, 20 nt, Mycobacterium bovis subsp bovis AF2122/97
gcauccaggcugucgcgggc

SEQ ID NO: 3064033 - RNA, 21 nt, Mycobacterium bovis subsp bovis AF2122/97
gcauccaggcugucgcgggcc

SEQ ID NO: 3064034 - RNA, 19 nt, Mycobacterium bovis subsp bovis AF2122/97
gcauccccagcacaaccag

SEQ ID NO: 3064035 - RNA, 18 nt, Mycobacterium bovis subsp bovis AF2122/97
gcauccccgcagcgucca

SEQ ID NO: 3064036 - RNA, 20 nt, Mycobacterium bovis subsp bovis AF2122/97
gcauccccgguacgucgagg

SEQ ID NO: 3064037 - RNA, 22 nt, Mycobacterium bovis subsp bovis AF2122/97
gcaucccggaacgccgccagcg

SEQ ID NO: 3064038 - RNA, 13 nt, Mycobacterium bovis subsp bovis AF2122/97
gcaucccgggcag

SEQ ID NO: 3064039 - RNA, 16 nt, Mycobacterium bovis subsp bovis AF2122/97
gcaucccgggcagucc

SEQ ID NO: 3064040 - RNA, 23 nt, Mycobacterium bovis subsp bovis AF2122/97
gcaucccgggcaguccaggcacu

SEQ ID NO: 3064041 - RNA, 17 nt, Mycobacterium bovis subsp bovis AF2122/97
gcaucccgguccagccc

SEQ ID NO: 3064042 - RNA, 12 nt, Mycobacterium bovis subsp bovis AF2122/97
gcauccgcagca

SEQ ID NO: 3064043 - RNA, 12 nt, Mycobacterium bovis subsp bovis AF2122/97
gcauccgcagcc

SEQ ID NO: 3064044 - RNA, 15 nt, Mycobacterium bovis subsp bovis AF2122/97
gcauccgccccgccc

SEQ ID NO: 3064045 - RNA, 16 nt, Mycobacterium bovis subsp bovis AF2122/97
gcauccgcccgagccg

SEQ ID NO: 3064046 - RNA, 13 nt, Mycobacterium bovis subsp bovis AF2122/97
gcauccgcgacgg

SEQ ID NO: 3064047 - RNA, 16 nt, Mycobacterium bovis subsp bovis AF2122/97
gcauccgcgacggcgc

SEQ ID NO: 3064048 - RNA, 14 nt, Mycobacterium bovis subsp bovis AF2122/97
gcauccgcggggag

SEQ ID NO: 3064049 - RNA, 15 nt, Mycobacterium bovis subsp bovis AF2122/97
gcauccgcgguuggc

SEQ ID NO: 3064050 - RNA, 20 nt, Mycobacterium bovis subsp bovis AF2122/97
gcauccgucguacacgccau

SEQ ID NO: 3064051 - RNA, 16 nt, Mycobacterium bovis subsp bovis AF2122/97
gcauccuccucgucga

SEQ ID NO: 3064052 - RNA, 17 nt, Mycobacterium bovis subsp bovis AF2122/97
gcauccucugaaccagc

SEQ ID NO: 3064053 - RNA, 19 nt, Mycobacterium bovis subsp bovis AF2122/97
gcauccuugccaaucgccg

SEQ ID NO: 3064054 - RNA, 20 nt, Mycobacterium bovis subsp bovis AF2122/97
gcauccuugccaaucgccgu

SEQ ID NO: 3064055 - RNA, 22 nt, Mycobacterium bovis subsp bovis AF2122/97
gcaucgaacgcccugacggugg

SEQ ID NO: 3064056 - RNA, 20 nt, Mycobacterium bovis subsp bovis AF2122/97
gcaucgaacuucgauucugg

SEQ ID NO: 3064057 - RNA, 19 nt, Mycobacterium bovis subsp bovis AF2122/97
gcaucgucgaauccucgcg

SEQ ID NO: 3064058 - RNA, 20 nt, Mycobacterium bovis subsp bovis AF2122/97
gcaucgucgacgaugucggc

SEQ ID NO: 3064059 - RNA, 18 nt, Mycobacterium bovis subsp bovis AF2122/97
gcaucgucgacgcccgau

SEQ ID NO: 3064060 - RNA, 14 nt, Mycobacterium bovis subsp bovis AF2122/97
gcaucgucgagcca

SEQ ID NO: 3064061 - RNA, 19 nt, Mycobacterium bovis subsp bovis AF2122/97
gcaucgucgccaagcccag

SEQ ID NO: 3064062 - RNA, 13 nt, Mycobacterium bovis subsp bovis AF2122/97
gcaucgucgccga

SEQ ID NO: 3064063 - RNA, 14 nt, Mycobacterium bovis subsp bovis AF2122/97
gcaucgucgccgag

SEQ ID NO: 3064064 - RNA, 15 nt, Mycobacterium bovis subsp bovis AF2122/97
gcaucgucgccgagc

SEQ ID NO: 3064065 - RNA, 16 nt, Mycobacterium bovis subsp bovis AF2122/97
gcaucgucgccgagcg

SEQ ID NO: 3064066 - RNA, 18 nt, Mycobacterium bovis subsp bovis AF2122/97
gcaucgucgucgcugccg

SEQ ID NO: 3064067 - RNA, 21 nt, Mycobacterium bovis subsp bovis AF2122/97
gcaucgugugguuaacacccu

SEQ ID NO: 3064068 - RNA, 21 nt, Mycobacterium bovis subsp bovis AF2122/97
gcaucguuuucgccgaucccg

SEQ ID NO: 3064069 - RNA, 23 nt, Mycobacterium bovis subsp bovis AF2122/97
gcaucguuuucgccgaucccggc

SEQ ID NO: 3064070 - RNA, 22 nt, Mycobacterium bovis subsp bovis AF2122/97
gcaucuagguucaguuccaccg

SEQ ID NO: 3064071 - RNA, 17 nt, Mycobacterium bovis subsp bovis AF2122/97
gcaucuccaccgucgcc

SEQ ID NO: 3064072 - RNA, 22 nt, Mycobacterium bovis subsp bovis AF2122/97
gcaucuccaccgucgccgccgg

SEQ ID NO: 3064073 - RNA, 19 nt, Mycobacterium bovis subsp bovis AF2122/97
gcaucuccgucggccaggc

SEQ ID NO: 3064074 - RNA, 20 nt, Mycobacterium bovis subsp bovis AF2122/97
gcaucuccgucggccaggcc

SEQ ID NO: 3064075 - RNA, 22 nt, Mycobacterium bovis subsp bovis AF2122/97
gcaucuccgucggccaggccac

SEQ ID NO: 3064076 - RNA, 23 nt, Mycobacterium bovis subsp bovis AF2122/97
gcaucuccgucggccaggccacg

SEQ ID NO: 3064077 - RNA, 19 nt, Mycobacterium bovis subsp bovis AF2122/97
gcaucuccucgccugcccg

SEQ ID NO: 3064078 - RNA, 19 nt, Mycobacterium bovis subsp bovis AF2122/97
gcaucucgacaucggccag

SEQ ID NO: 3064079 - RNA, 17 nt, Mycobacterium bovis subsp bovis AF2122/97
gcaucucgcaccgcgcc

SEQ ID NO: 3064080 - RNA, 17 nt, Mycobacterium bovis subsp bovis AF2122/97
gcaucucgucgaucucg

SEQ ID NO: 3064081 - RNA, 14 nt, Mycobacterium bovis subsp bovis AF2122/97
gcaucucgucgucg

SEQ ID NO: 3064082 - RNA, 17 nt, Mycobacterium bovis subsp bovis AF2122/97
gcaucugaugacggugu

SEQ ID NO: 3064083 - RNA, 21 nt, Mycobacterium bovis subsp bovis AF2122/97
gcaucugcgggucggcaucgg

SEQ ID NO: 3064084 - RNA, 12 nt, Mycobacterium bovis subsp bovis AF2122/97
gcaucugcucgg

SEQ ID NO: 3064085 - RNA, 18 nt, Mycobacterium bovis subsp bovis AF2122/97
gcaucugcucggcaucga

SEQ ID NO: 3064086 - RNA, 20 nt, Mycobacterium bovis subsp bovis AF2122/97
gcaucuggggguagccgccg

SEQ ID NO: 3064087 - RNA, 21 nt, Mycobacterium bovis subsp bovis AF2122/97
gcaucuggggguagccgccgg

SEQ ID NO: 3064088 - RNA, 22 nt, Mycobacterium bovis subsp bovis AF2122/97
gcaucuggggguagccgccggc

SEQ ID NO: 3064089 - RNA, 24 nt, Mycobacterium bovis subsp bovis AF2122/97
gcaucuggggguagccgccggcgc

SEQ ID NO: 3064090 - RNA, 21 nt, Mycobacterium bovis subsp bovis AF2122/97
gcaucugugagauaccgacgc

SEQ ID NO: 3064091 - RNA, 16 nt, Mycobacterium bovis subsp bovis AF2122/97
gcaucuucgcgcagcc

SEQ ID NO: 3064092 - RNA, 18 nt, Mycobacterium bovis subsp bovis AF2122/97
gcaucuuuggcggccgca

SEQ ID NO: 3064093 - RNA, 23 nt, Mycobacterium bovis subsp bovis AF2122/97
gcaugaagugaaaguucaugcca

SEQ ID NO: 3064094 - RNA, 16 nt, Mycobacterium bovis subsp bovis AF2122/97
gcaugacaccggccac

SEQ ID NO: 3064095 - RNA, 18 nt, Mycobacterium bovis subsp bovis AF2122/97
gcaugacauacagcgggc

SEQ ID NO: 3064096 - RNA, 19 nt, Mycobacterium bovis subsp bovis AF2122/97
gcaugacauacagcgggcg

SEQ ID NO: 3064097 - RNA, 14 nt, Mycobacterium bovis subsp bovis AF2122/97
gcaugaccgcugcc

SEQ ID NO: 3064098 - RNA, 19 nt, Mycobacterium bovis subsp bovis AF2122/97
gcaugaccgcugccgacgc

SEQ ID NO: 3064099 - RNA, 13 nt, Mycobacterium bovis subsp bovis AF2122/97
gcaugacgccggc

SEQ ID NO: 3064100 - RNA, 15 nt, Mycobacterium bovis subsp bovis AF2122/97
gcaugacgccggcgg

SEQ ID NO: 3064101 - RNA, 15 nt, Mycobacterium bovis subsp bovis AF2122/97
gcaugagggcaucga

SEQ ID NO: 3064102 - RNA, 18 nt, Mycobacterium bovis subsp bovis AF2122/97
gcaugagucgaaccaggu

SEQ ID NO: 3064103 - RNA, 17 nt, Mycobacterium bovis subsp bovis AF2122/97
gcaugaucacacugccc

SEQ ID NO: 3064104 - RNA, 20 nt, Mycobacterium bovis subsp bovis AF2122/97
gcaugauccccguugaccca

SEQ ID NO: 3064105 - RNA, 23 nt, Mycobacterium bovis subsp bovis AF2122/97
gcaugauccccguugacccagac

SEQ ID NO: 3064106 - RNA, 15 nt, Mycobacterium bovis subsp bovis AF2122/97
gcaugauccgcucgu

SEQ ID NO: 3064107 - RNA, 15 nt, Mycobacterium bovis subsp bovis AF2122/97
gcaugauccgcuggg

SEQ ID NO: 3064108 - RNA, 14 nt, Mycobacterium bovis subsp bovis AF2122/97
gcaugcaugccggc

SEQ ID NO: 3064109 - RNA, 18 nt, Mycobacterium bovis subsp bovis AF2122/97
gcaugcaugccggcuagc

SEQ ID NO: 3064110 - RNA, 19 nt, Mycobacterium bovis subsp bovis AF2122/97
gcaugccacacacugccgg

SEQ ID NO: 3064111 - RNA, 21 nt, Mycobacterium bovis subsp bovis AF2122/97
gcaugcccagcgcacggacca

SEQ ID NO: 3064112 - RNA, 20 nt, Mycobacterium bovis subsp bovis AF2122/97
gcaugcccgcggugaccacc

SEQ ID NO: 3064113 - RNA, 14 nt, Mycobacterium bovis subsp bovis AF2122/97
gcaugcccucgcug

SEQ ID NO: 3064114 - RNA, 12 nt, Mycobacterium bovis subsp bovis AF2122/97
gcaugcccugga

SEQ ID NO: 3064115 - RNA, 18 nt, Mycobacterium bovis subsp bovis AF2122/97
gcaugcccuggaccagcg

SEQ ID NO: 3064116 - RNA, 13 nt, Mycobacterium bovis subsp bovis AF2122/97
gcaugccgcccgc

SEQ ID NO: 3064117 - RNA, 14 nt, Mycobacterium bovis subsp bovis AF2122/97
gcaugccgcccgcg

SEQ ID NO: 3064118 - RNA, 20 nt, Mycobacterium bovis subsp bovis AF2122/97
gcaugccgcccgcgccgccg

SEQ ID NO: 3064119 - RNA, 21 nt, Mycobacterium bovis subsp bovis AF2122/97
gcaugccgcccgcgccgccgg

SEQ ID NO: 3064120 - RNA, 23 nt, Mycobacterium bovis subsp bovis AF2122/97
gcaugccgcccgcuccugcucgu

SEQ ID NO: 3064121 - RNA, 13 nt, Mycobacterium bovis subsp bovis AF2122/97
gcaugccggcgca

SEQ ID NO: 3064122 - RNA, 18 nt, Mycobacterium bovis subsp bovis AF2122/97
gcaugccggcgcaccaca

SEQ ID NO: 3064123 - RNA, 12 nt, Mycobacterium bovis subsp bovis AF2122/97
gcaugccggcgu

SEQ ID NO: 3064124 - RNA, 14 nt, Mycobacterium bovis subsp bovis AF2122/97
gcaugccgggaagg

SEQ ID NO: 3064125 - RNA, 19 nt, Mycobacterium bovis subsp bovis AF2122/97
gcaugccguugcgaucgcg

SEQ ID NO: 3064126 - RNA, 21 nt, Mycobacterium bovis subsp bovis AF2122/97
gcaugccugcgaaacgcuggc

SEQ ID NO: 3064127 - RNA, 15 nt, Mycobacterium bovis subsp bovis AF2122/97
gcaugcgacgucagg

SEQ ID NO: 3064128 - RNA, 17 nt, Mycobacterium bovis subsp bovis AF2122/97
gcaugcgaggggcggca

SEQ ID NO: 3064129 - RNA, 22 nt, Mycobacterium bovis subsp bovis AF2122/97
gcaugcgcagaaacgccgagcg

SEQ ID NO: 3064130 - RNA, 18 nt, Mycobacterium bovis subsp bovis AF2122/97
gcaugcgcgcgccggugc

SEQ ID NO: 3064131 - RNA, 21 nt, Mycobacterium bovis subsp bovis AF2122/97
gcaugcgcuccggcgcgacgc

SEQ ID NO: 3064132 - RNA, 22 nt, Mycobacterium bovis subsp bovis AF2122/97
gcaugcgugccggcagcggugg

SEQ ID NO: 3064133 - RNA, 20 nt, Mycobacterium bovis subsp bovis AF2122/97
gcaugcuaggcaugccacac

SEQ ID NO: 3064134 - RNA, 23 nt, Mycobacterium bovis subsp bovis AF2122/97
gcaugcucaccgaaacgaugcgg

SEQ ID NO: 3064135 - RNA, 12 nt, Mycobacterium bovis subsp bovis AF2122/97
gcaugcucacga

SEQ ID NO: 3064136 - RNA, 18 nt, Mycobacterium bovis subsp bovis AF2122/97
gcaugcuggcgaucgcga

SEQ ID NO: 3064137 - RNA, 18 nt, Mycobacterium bovis subsp bovis AF2122/97
gcaugcuugaaacccagg

SEQ ID NO: 3064138 - RNA, 19 nt, Mycobacterium bovis subsp bovis AF2122/97
gcaugcuugaaacccaggc

SEQ ID NO: 3064139 - RNA, 21 nt, Mycobacterium bovis subsp bovis AF2122/97
gcaugcuugaaacccaggccg

SEQ ID NO: 3064140 - RNA, 20 nt, Mycobacterium bovis subsp bovis AF2122/97
gcauggacggauaguucacc

SEQ ID NO: 3064141 - RNA, 13 nt, Mycobacterium bovis subsp bovis AF2122/97
gcauggcagcggc

SEQ ID NO: 3064142 - RNA, 14 nt, Mycobacterium bovis subsp bovis AF2122/97
gcauggcagcggcg

SEQ ID NO: 3064143 - RNA, 20 nt, Mycobacterium bovis subsp bovis AF2122/97
gccaaacccaugucggcgcg

SEQ ID NO: 3064144 - RNA, 22 nt, Mycobacterium bovis subsp bovis AF2122/97
gccaaacccggcgggcccgccg

SEQ ID NO: 3064145 - RNA, 12 nt, Mycobacterium bovis subsp bovis AF2122/97
gccaaaccuggg

SEQ ID NO: 3064146 - RNA, 22 nt, Mycobacterium bovis subsp bovis AF2122/97
gccaaaccuggguuugcacggc

SEQ ID NO: 3064147 - RNA, 21 nt, Mycobacterium bovis subsp bovis AF2122/97
gccaaacgccaucauggccgu

SEQ ID NO: 3064148 - RNA, 14 nt, Mycobacterium bovis subsp bovis AF2122/97
gccaaacgccgccc

SEQ ID NO: 3064149 - RNA, 18 nt, Mycobacterium bovis subsp bovis AF2122/97
gccaaacgccgcccgccg

SEQ ID NO: 3064150 - RNA, 15 nt, Mycobacterium bovis subsp bovis AF2122/97
gccaaacuacccgcc

SEQ ID NO: 3064151 - RNA, 18 nt, Mycobacterium bovis subsp bovis AF2122/97
gccaaacuacccgcccac

SEQ ID NO: 3064152 - RNA, 22 nt, Mycobacterium bovis subsp bovis AF2122/97
gccaaacuacccgcccacggca

SEQ ID NO: 3064153 - RNA, 19 nt, Mycobacterium bovis subsp bovis AF2122/97
gccaaagacccggcaccca

SEQ ID NO: 3064154 - RNA, 13 nt, Mycobacterium bovis subsp bovis AF2122/97
gccaaagcccgac

SEQ ID NO: 3064155 - RNA, 15 nt, Mycobacterium bovis subsp bovis AF2122/97
gccaaagcccgacau

SEQ ID NO: 3064156 - RNA, 16 nt, Mycobacterium bovis subsp bovis AF2122/97
gccaaagcgcgggcgg

SEQ ID NO: 3064157 - RNA, 21 nt, Mycobacterium bovis subsp bovis AF2122/97
gccaaauccggugcccgcacc

SEQ ID NO: 3064158 - RNA, 15 nt, Mycobacterium bovis subsp bovis AF2122/97
gccaacaacaucagc

SEQ ID NO: 3064159 - RNA, 18 nt, Mycobacterium bovis subsp bovis AF2122/97
gccaacaacaucagcgac

SEQ ID NO: 3064160 - RNA, 18 nt, Mycobacterium bovis subsp bovis AF2122/97
gccaacaacccaacaaaa

SEQ ID NO: 3064161 - RNA, 15 nt, Mycobacterium bovis subsp bovis AF2122/97
gccaacaccgccagc

SEQ ID NO: 3064162 - RNA, 23 nt, Mycobacterium bovis subsp bovis AF2122/97
gccaacaccgccagcaugacacc

SEQ ID NO: 3064163 - RNA, 16 nt, Mycobacterium bovis subsp bovis AF2122/97
gccaacaccggcaucg

SEQ ID NO: 3064164 - RNA, 22 nt, Mycobacterium bovis subsp bovis AF2122/97
gccaacaccggcgaucaccguu

SEQ ID NO: 3064165 - RNA, 11 nt, Mycobacterium bovis subsp bovis AF2122/97
gccaacaccuc

SEQ ID NO: 3064166 - RNA, 12 nt, Mycobacterium bovis subsp bovis AF2122/97
gccaacaccuca

SEQ ID NO: 3064167 - RNA, 12 nt, Mycobacterium bovis subsp bovis AF2122/97
gccaacagaugc

SEQ ID NO: 3064168 - RNA, 14 nt, Mycobacterium bovis subsp bovis AF2122/97
gccaacagaugcca

SEQ ID NO: 3064169 - RNA, 16 nt, Mycobacterium bovis subsp bovis AF2122/97
gccaacagaugccacc

SEQ ID NO: 3064170 - RNA, 17 nt, Mycobacterium bovis subsp bovis AF2122/97
gccaacagggcgccgac

SEQ ID NO: 3064171 - RNA, 15 nt, Mycobacterium bovis subsp bovis AF2122/97
gccaacagguccacc

SEQ ID NO: 3064172 - RNA, 14 nt, Mycobacterium bovis subsp bovis AF2122/97
gccaacagucgcag

SEQ ID NO: 3064173 - RNA, 21 nt, Mycobacterium bovis subsp bovis AF2122/97
gccaacaucuccgcgucgguc

SEQ ID NO: 3064174 - RNA, 14 nt, Mycobacterium bovis subsp bovis AF2122/97
gccaaccaaccggu

SEQ ID NO: 3064175 - RNA, 17 nt, Mycobacterium bovis subsp bovis AF2122/97
gccaaccaaccggucac

SEQ ID NO: 3064176 - RNA, 16 nt, Mycobacterium bovis subsp bovis AF2122/97
gccaaccacuuuccgg

SEQ ID NO: 3064177 - RNA, 16 nt, Mycobacterium bovis subsp bovis AF2122/97
gccaaccagcccggcc

SEQ ID NO: 3064178 - RNA, 22 nt, Mycobacterium bovis subsp bovis AF2122/97
gccaaccagcccggccgccgag

SEQ ID NO: 3064179 - RNA, 15 nt, Mycobacterium bovis subsp bovis AF2122/97
gccaaccagucgcac

SEQ ID NO: 3064180 - RNA, 19 nt, Mycobacterium bovis subsp bovis AF2122/97
gccaaccagucgcacgacg

SEQ ID NO: 3064181 - RNA, 22 nt, Mycobacterium bovis subsp bovis AF2122/97
gccaacccaauugggacgcgcg

SEQ ID NO: 3064182 - RNA, 23 nt, Mycobacterium bovis subsp bovis AF2122/97
gccaacccgauuuauccggaucg

SEQ ID NO: 3064183 - RNA, 12 nt, Mycobacterium bovis subsp bovis AF2122/97
gccaacccgggc

SEQ ID NO: 3064184 - RNA, 13 nt, Mycobacterium bovis subsp bovis AF2122/97
gccaacccgggcc

SEQ ID NO: 3064185 - RNA, 18 nt, Mycobacterium bovis subsp bovis AF2122/97
gccaacccgggccgccag

SEQ ID NO: 3064186 - RNA, 14 nt, Mycobacterium bovis subsp bovis AF2122/97
gccaacccugcggc

SEQ ID NO: 3064187 - RNA, 15 nt, Mycobacterium bovis subsp bovis AF2122/97
gccaacccugcggcg

SEQ ID NO: 3064188 - RNA, 15 nt, Mycobacterium bovis subsp bovis AF2122/97
gccaaccgcaggccg

SEQ ID NO: 3064189 - RNA, 14 nt, Mycobacterium bovis subsp bovis AF2122/97
gccaaccgcggcga

SEQ ID NO: 3064190 - RNA, 14 nt, Mycobacterium bovis subsp bovis AF2122/97
gccaaccgcgugcg

SEQ ID NO: 3064191 - RNA, 19 nt, Mycobacterium bovis subsp bovis AF2122/97
gccaaccgcgugcgucagc

SEQ ID NO: 3064192 - RNA, 14 nt, Mycobacterium bovis subsp bovis AF2122/97
gccaaccggcgcag

SEQ ID NO: 3064193 - RNA, 16 nt, Mycobacterium bovis subsp bovis AF2122/97
gccaaccgguucgucg

SEQ ID NO: 3064194 - RNA, 17 nt, Mycobacterium bovis subsp bovis AF2122/97
gccaaccgguucgucga

SEQ ID NO: 3064195 - RNA, 21 nt, Mycobacterium bovis subsp bovis AF2122/97
gccaaccgguucgucgaacgg

SEQ ID NO: 3064196 - RNA, 17 nt, Mycobacterium bovis subsp bovis AF2122/97
gccaaccguccggggcc

SEQ ID NO: 3064197 - RNA, 21 nt, Mycobacterium bovis subsp bovis AF2122/97
gccaaccguccggggccgcgg

SEQ ID NO: 3064198 - RNA, 22 nt, Mycobacterium bovis subsp bovis AF2122/97
gccaaccguccggggccgcggc

SEQ ID NO: 3064199 - RNA, 16 nt, Mycobacterium bovis subsp bovis AF2122/97
gccaaccgugcgcacu

SEQ ID NO: 3064200 - RNA, 20 nt, Mycobacterium bovis subsp bovis AF2122/97
gccaaccucugcugagcugc

SEQ ID NO: 3064201 - RNA, 17 nt, Mycobacterium bovis subsp bovis AF2122/97
gccaaccugaagccagc

SEQ ID NO: 3064202 - RNA, 19 nt, Mycobacterium bovis subsp bovis AF2122/97
gccaaccugaagccagcgc

SEQ ID NO: 3064203 - RNA, 21 nt, Mycobacterium bovis subsp bovis AF2122/97
gccaaccugaagccagcgcag

SEQ ID NO: 3064204 - RNA, 23 nt, Mycobacterium bovis subsp bovis AF2122/97
gccaaccugaagccagcgcagca

SEQ ID NO: 3064205 - RNA, 11 nt, Mycobacterium bovis subsp bovis AF2122/97
gccaaccuggg

SEQ ID NO: 3064206 - RNA, 14 nt, Mycobacterium bovis subsp bovis AF2122/97
gccaaccugggcca

SEQ ID NO: 3064207 - RNA, 18 nt, Mycobacterium bovis subsp bovis AF2122/97
gccaacgaaccgcucagc

SEQ ID NO: 3064208 - RNA, 20 nt, Mycobacterium bovis subsp bovis AF2122/97
gccaacgaaccgcucagcgc

SEQ ID NO: 3064209 - RNA, 20 nt, Mycobacterium bovis subsp bovis AF2122/97
gccaacgaacgugccccggc

SEQ ID NO: 3064210 - RNA, 14 nt, Mycobacterium bovis subsp bovis AF2122/97
gccaacgacggccg

SEQ ID NO: 3064211 - RNA, 14 nt, Mycobacterium bovis subsp bovis AF2122/97
gccaacgagcgcgc

SEQ ID NO: 3064212 - RNA, 12 nt, Mycobacterium bovis subsp bovis AF2122/97
gccaacgaugau

SEQ ID NO: 3064213 - RNA, 19 nt, Mycobacterium bovis subsp bovis AF2122/97
gccaacgccaaaacggucg

SEQ ID NO: 3064214 - RNA, 12 nt, Mycobacterium bovis subsp bovis AF2122/97
gccaacgccagc

SEQ ID NO: 3064215 - RNA, 15 nt, Mycobacterium bovis subsp bovis AF2122/97
gccaacgccagcacc

SEQ ID NO: 3064216 - RNA, 18 nt, Mycobacterium bovis subsp bovis AF2122/97
gccaacgccagcaccagc

SEQ ID NO: 3064217 - RNA, 19 nt, Mycobacterium bovis subsp bovis AF2122/97
gccaacgccagcaccagcg

SEQ ID NO: 3064218 - RNA, 13 nt, Mycobacterium bovis subsp bovis AF2122/97
gccaacgcccacg

SEQ ID NO: 3064219 - RNA, 17 nt, Mycobacterium bovis subsp bovis AF2122/97
gccaacgcccguguuga

SEQ ID NO: 3064220 - RNA, 11 nt, Mycobacterium bovis subsp bovis AF2122/97
gccaacgccgg

SEQ ID NO: 3064221 - RNA, 16 nt, Mycobacterium bovis subsp bovis AF2122/97
gccaacgcgcagagcg

SEQ ID NO: 3064222 - RNA, 21 nt, Mycobacterium bovis subsp bovis AF2122/97
gccaacgcgcagagcguuccg

SEQ ID NO: 3064223 - RNA, 22 nt, Mycobacterium bovis subsp bovis AF2122/97
gccaacgcgcagagcguuccgc

SEQ ID NO: 3064224 - RNA, 20 nt, Mycobacterium bovis subsp bovis AF2122/97
gccaacgcgucccgccgcac

SEQ ID NO: 3064225 - RNA, 22 nt, Mycobacterium bovis subsp bovis AF2122/97
gccaacgcgucccgccgcaccg

SEQ ID NO: 3064226 - RNA, 13 nt, Mycobacterium bovis subsp bovis AF2122/97
gccaacggcaccc

SEQ ID NO: 3064227 - RNA, 22 nt, Mycobacterium bovis subsp bovis AF2122/97
gccaacggcacccugcggcacc

SEQ ID NO: 3064228 - RNA, 23 nt, Mycobacterium bovis subsp bovis AF2122/97
gccaacggcacccugcggcaccu

SEQ ID NO: 3064229 - RNA, 21 nt, Mycobacterium bovis subsp bovis AF2122/97
gccaacggcgcugccgggauc

SEQ ID NO: 3064230 - RNA, 21 nt, Mycobacterium bovis subsp bovis AF2122/97
gccacaacguugcaccgagaa

SEQ ID NO: 3064231 - RNA, 13 nt, Mycobacterium bovis subsp bovis AF2122/97
gccacaccaacgu

SEQ ID NO: 3064232 - RNA, 19 nt, Mycobacterium bovis subsp bovis AF2122/97
gccacaccaugauugccag

SEQ ID NO: 3064233 - RNA, 16 nt, Mycobacterium bovis subsp bovis AF2122/97
gccacacccgcgaacg

SEQ ID NO: 3064234 - RNA, 22 nt, Mycobacterium bovis subsp bovis AF2122/97
gccacacccggcgugagcuccg

SEQ ID NO: 3064235 - RNA, 14 nt, Mycobacterium bovis subsp bovis AF2122/97
gccacaccgccgcc

SEQ ID NO: 3064236 - RNA, 19 nt, Mycobacterium bovis subsp bovis AF2122/97
gccacaccgccgccaagcu

SEQ ID NO: 3064237 - RNA, 16 nt, Mycobacterium bovis subsp bovis AF2122/97
gccacaccggggcggc

SEQ ID NO: 3064238 - RNA, 20 nt, Mycobacterium bovis subsp bovis AF2122/97
gccacaccggggcggccgac

SEQ ID NO: 3064239 - RNA, 19 nt, Mycobacterium bovis subsp bovis AF2122/97
gccacaccgucacgccacc

SEQ ID NO: 3064240 - RNA, 20 nt, Mycobacterium bovis subsp bovis AF2122/97
gccacaccgucacgccaccg

SEQ ID NO: 3064241 - RNA, 16 nt, Mycobacterium bovis subsp bovis AF2122/97
gccacaccugcgccac

SEQ ID NO: 3064242 - RNA, 20 nt, Mycobacterium bovis subsp bovis AF2122/97
gccacaccuuggccgccggc

SEQ ID NO: 3064243 - RNA, 21 nt, Mycobacterium bovis subsp bovis AF2122/97
gccacaccuuggccgccggcc

SEQ ID NO: 3064244 - RNA, 17 nt, Mycobacterium bovis subsp bovis AF2122/97
gccacacggggccgcca

SEQ ID NO: 3064245 - RNA, 19 nt, Mycobacterium bovis subsp bovis AF2122/97
gccacacggggccgccagc

SEQ ID NO: 3064246 - RNA, 17 nt, Mycobacterium bovis subsp bovis AF2122/97
gccacacucagcaccca

SEQ ID NO: 3064247 - RNA, 15 nt, Mycobacterium bovis subsp bovis AF2122/97
gccacacucccgcgc

SEQ ID NO: 3064248 - RNA, 16 nt, Mycobacterium bovis subsp bovis AF2122/97
gccacacucccgcgcc

SEQ ID NO: 3064249 - RNA, 17 nt, Mycobacterium bovis subsp bovis AF2122/97
gccacacucgccagggc

SEQ ID NO: 3064250 - RNA, 19 nt, Mycobacterium bovis subsp bovis AF2122/97
gccacacucgccagggcca

SEQ ID NO: 3064251 - RNA, 18 nt, Mycobacterium bovis subsp bovis AF2122/97
gccacagaccgaacagca

SEQ ID NO: 3064252 - RNA, 13 nt, Mycobacterium bovis subsp bovis AF2122/97
gccacagcaacgu

SEQ ID NO: 3064253 - RNA, 14 nt, Mycobacterium bovis subsp bovis AF2122/97
gccacagcacccac

SEQ ID NO: 3064254 - RNA, 21 nt, Mycobacterium bovis subsp bovis AF2122/97
gccacagcagcguugacggcu

SEQ ID NO: 3064255 - RNA, 13 nt, Mycobacterium bovis subsp bovis AF2122/97
gccacagcccggc

SEQ ID NO: 3064256 - RNA, 14 nt, Mycobacterium bovis subsp bovis AF2122/97
gccacagcccggcg

SEQ ID NO: 3064257 - RNA, 15 nt, Mycobacterium bovis subsp bovis AF2122/97
gccacagcccggcga

SEQ ID NO: 3064258 - RNA, 15 nt, Mycobacterium bovis subsp bovis AF2122/97
gccacagcccggcgg

SEQ ID NO: 3064259 - RNA, 17 nt, Mycobacterium bovis subsp bovis AF2122/97
gccacagccgaccucga

SEQ ID NO: 3064260 - RNA, 13 nt, Mycobacterium bovis subsp bovis AF2122/97
gccacagcggcga

SEQ ID NO: 3064261 - RNA, 22 nt, Mycobacterium bovis subsp bovis AF2122/97
gccacagcucgccgugaccagg

SEQ ID NO: 3064262 - RNA, 18 nt, Mycobacterium bovis subsp bovis AF2122/97
gccacaggcguuuccgcu

SEQ ID NO: 3064263 - RNA, 15 nt, Mycobacterium bovis subsp bovis AF2122/97
gccacagggaagcaa

SEQ ID NO: 3064264 - RNA, 22 nt, Mycobacterium bovis subsp bovis AF2122/97
gccacagucgucgagcgcuccc

SEQ ID NO: 3064265 - RNA, 15 nt, Mycobacterium bovis subsp bovis AF2122/97
gccacauacaccggc

SEQ ID NO: 3064266 - RNA, 18 nt, Mycobacterium bovis subsp bovis AF2122/97
gccacauacaggcccgcc

SEQ ID NO: 3064267 - RNA, 21 nt, Mycobacterium bovis subsp bovis AF2122/97
gccacauacaggcccgccagc

SEQ ID NO: 3064268 - RNA, 15 nt, Mycobacterium bovis subsp bovis AF2122/97
gccacauccagcgcu

SEQ ID NO: 3064269 - RNA, 20 nt, Mycobacterium bovis subsp bovis AF2122/97
gccacauccagcgcuucggc

SEQ ID NO: 3064270 - RNA, 16 nt, Mycobacterium bovis subsp bovis AF2122/97
gccacaucgccagcag

SEQ ID NO: 3064271 - RNA, 22 nt, Mycobacterium bovis subsp bovis AF2122/97
gccacaucguucaugaucggca

SEQ ID NO: 3064272 - RNA, 23 nt, Mycobacterium bovis subsp bovis AF2122/97
gccacaucguucaugaucggcag

SEQ ID NO: 3064273 - RNA, 14 nt, Mycobacterium bovis subsp bovis AF2122/97
gccacaugccacag

SEQ ID NO: 3064274 - RNA, 16 nt, Mycobacterium bovis subsp bovis AF2122/97
gccacaugccacagcg

SEQ ID NO: 3064275 - RNA, 21 nt, Mycobacterium bovis subsp bovis AF2122/97
gccacauguugucgacggucg

SEQ ID NO: 3064276 - RNA, 13 nt, Mycobacterium bovis subsp bovis AF2122/97
gccacauuucacc

SEQ ID NO: 3064277 - RNA, 19 nt, Mycobacterium bovis subsp bovis AF2122/97
gccacauuucaccaccgug

SEQ ID NO: 3064278 - RNA, 12 nt, Mycobacterium bovis subsp bovis AF2122/97
gccaccaaaccc

SEQ ID NO: 3064279 - RNA, 12 nt, Mycobacterium bovis subsp bovis AF2122/97
gccaccaaacgc

SEQ ID NO: 3064280 - RNA, 16 nt, Mycobacterium bovis subsp bovis AF2122/97
gccaccaaauccgcaa

SEQ ID NO: 3064281 - RNA, 18 nt, Mycobacterium bovis subsp bovis AF2122/97
gccaccaaauccgcaagg

SEQ ID NO: 3064282 - RNA, 19 nt, Mycobacterium bovis subsp bovis AF2122/97
gccaccaaauccgcaagga

SEQ ID NO: 3064283 - RNA, 13 nt, Mycobacterium bovis subsp bovis AF2122/97
gccaccaacaccg

SEQ ID NO: 3064284 - RNA, 15 nt, Mycobacterium bovis subsp bovis AF2122/97
gccaccaacaccgcg

SEQ ID NO: 3064285 - RNA, 10 nt, Mycobacterium bovis subsp bovis AF2122/97
gccaccaacu

SEQ ID NO: 3064286 - RNA, 16 nt, Mycobacterium bovis subsp bovis AF2122/97
gccaccaacucggcga

SEQ ID NO: 3064287 - RNA, 10 nt, Mycobacterium bovis subsp bovis AF2122/97
gccaccacca

SEQ ID NO: 3064288 - RNA, 15 nt, Mycobacterium bovis subsp bovis AF2122/97
gccaccaccacggcc

SEQ ID NO: 3064289 - RNA, 17 nt, Mycobacterium bovis subsp bovis AF2122/97
gccaccaccacggccag

SEQ ID NO: 3064290 - RNA, 14 nt, Mycobacterium bovis subsp bovis AF2122/97
gccaccaccagggc

SEQ ID NO: 3064291 - RNA, 16 nt, Mycobacterium bovis subsp bovis AF2122/97
gccaccaccagggcaa

SEQ ID NO: 3064292 - RNA, 23 nt, Mycobacterium bovis subsp bovis AF2122/97
gccaccaccagggcaacggccgc

SEQ ID NO: 3064293 - RNA, 17 nt, Mycobacterium bovis subsp bovis AF2122/97
gccaccacccaggccau

SEQ ID NO: 3064294 - RNA, 22 nt, Mycobacterium bovis subsp bovis AF2122/97
gccaccacccaggccauaccgc

SEQ ID NO: 3064295 - RNA, 15 nt, Mycobacterium bovis subsp bovis AF2122/97
gccaccacccggcgc

SEQ ID NO: 3064296 - RNA, 14 nt, Mycobacterium bovis subsp bovis AF2122/97
gccaccaccgccgc

SEQ ID NO: 3064297 - RNA, 15 nt, Mycobacterium bovis subsp bovis AF2122/97
gccaccaccgccgcc

SEQ ID NO: 3064298 - RNA, 16 nt, Mycobacterium bovis subsp bovis AF2122/97
gccaccaccgccgccg

SEQ ID NO: 3064299 - RNA, 22 nt, Mycobacterium bovis subsp bovis AF2122/97
gccaccaccgccgccggcaccg

SEQ ID NO: 3064300 - RNA, 14 nt, Mycobacterium bovis subsp bovis AF2122/97
gccaccaccgcgcc

SEQ ID NO: 3064301 - RNA, 18 nt, Mycobacterium bovis subsp bovis AF2122/97
gccaccaccgcugccggc

SEQ ID NO: 3064302 - RNA, 15 nt, Mycobacterium bovis subsp bovis AF2122/97
gccaccaccggcgcc

SEQ ID NO: 3064303 - RNA, 20 nt, Mycobacterium bovis subsp bovis AF2122/97
gccaccaccggcgccuccgg

SEQ ID NO: 3064304 - RNA, 22 nt, Mycobacterium bovis subsp bovis AF2122/97
gccaccaccgugaagcccuggc

SEQ ID NO: 3064305 - RNA, 23 nt, Mycobacterium bovis subsp bovis AF2122/97
gccaccaccgugaagcccuggcc

SEQ ID NO: 3064306 - RNA, 17 nt, Mycobacterium bovis subsp bovis AF2122/97
gccaccaccuccgcguc

SEQ ID NO: 3064307 - RNA, 19 nt, Mycobacterium bovis subsp bovis AF2122/97
gccaccaccuccgcgucgg

SEQ ID NO: 3064308 - RNA, 20 nt, Mycobacterium bovis subsp bovis AF2122/97
gccaccaccuccgcgucgga

SEQ ID NO: 3064309 - RNA, 13 nt, Mycobacterium bovis subsp bovis AF2122/97
gccaccaccucgg

SEQ ID NO: 3064310 - RNA, 23 nt, Mycobacterium bovis subsp bovis AF2122/97
gccaccaccucggugaccaggcc

SEQ ID NO: 3064311 - RNA, 16 nt, Mycobacterium bovis subsp bovis AF2122/97
gccaccacgccgucga

SEQ ID NO: 3064312 - RNA, 17 nt, Mycobacterium bovis subsp bovis AF2122/97
gccaccacgccgucgac

SEQ ID NO: 3064313 - RNA, 14 nt, Mycobacterium bovis subsp bovis AF2122/97
gccaccacgcgccg

SEQ ID NO: 3064314 - RNA, 18 nt, Mycobacterium bovis subsp bovis AF2122/97
gccaccacgcuccccagc

SEQ ID NO: 3064315 - RNA, 22 nt, Mycobacterium bovis subsp bovis AF2122/97
gccaccacggucaagccggcgc

SEQ ID NO: 3064316 - RNA, 23 nt, Mycobacterium bovis subsp bovis AF2122/97
gccaccacggucaagccggcgcc

SEQ ID NO: 3064317 - RNA, 13 nt, Mycobacterium bovis subsp bovis AF2122/97
gccaccgcacguu

SEQ ID NO: 3064318 - RNA, 15 nt, Mycobacterium bovis subsp bovis AF2122/97
gccaccgcacguucg

SEQ ID NO: 3064319 - RNA, 17 nt, Mycobacterium bovis subsp bovis AF2122/97
gccaccgcacguucggc

SEQ ID NO: 3064320 - RNA, 17 nt, Mycobacterium bovis subsp bovis AF2122/97
gccaccgcagacgccgu

SEQ ID NO: 3064321 - RNA, 13 nt, Mycobacterium bovis subsp bovis AF2122/97
gccaccgcaucgc

SEQ ID NO: 3064322 - RNA, 16 nt, Mycobacterium bovis subsp bovis AF2122/97
gccaccgcaucgccga

SEQ ID NO: 3064323 - RNA, 17 nt, Mycobacterium bovis subsp bovis AF2122/97
gccaccgcaucgccgaa

SEQ ID NO: 3064324 - RNA, 21 nt, Mycobacterium bovis subsp bovis AF2122/97
gccaccgcaucgccgaacggg

SEQ ID NO: 3064325 - RNA, 17 nt, Mycobacterium bovis subsp bovis AF2122/97
gccaccgccagcgucga

SEQ ID NO: 3064326 - RNA, 20 nt, Mycobacterium bovis subsp bovis AF2122/97
gccaccgccagcgucgacac

SEQ ID NO: 3064327 - RNA, 17 nt, Mycobacterium bovis subsp bovis AF2122/97
gccaccgccgaaaaccu

SEQ ID NO: 3064328 - RNA, 13 nt, Mycobacterium bovis subsp bovis AF2122/97
gccaccgccgccg

SEQ ID NO: 3064329 - RNA, 14 nt, Mycobacterium bovis subsp bovis AF2122/97
gccaccgccgccgc

SEQ ID NO: 3064330 - RNA, 15 nt, Mycobacterium bovis subsp bovis AF2122/97
gccaccgccgccgcc

SEQ ID NO: 3064331 - RNA, 19 nt, Mycobacterium bovis subsp bovis AF2122/97
gccaccgccgccgccaccg

SEQ ID NO: 3064332 - RNA, 21 nt, Mycobacterium bovis subsp bovis AF2122/97
gccaccgccgccgccaccggc

SEQ ID NO: 3064333 - RNA, 23 nt, Mycobacterium bovis subsp bovis AF2122/97
gccaccgccgccgccaccggcgc

SEQ ID NO: 3064334 - RNA, 17 nt, Mycobacterium bovis subsp bovis AF2122/97
gccaccgccgccgccga

SEQ ID NO: 3064335 - RNA, 15 nt, Mycobacterium bovis subsp bovis AF2122/97
gccaccgccgccugc

SEQ ID NO: 3064336 - RNA, 21 nt, Mycobacterium bovis subsp bovis AF2122/97
gccaccgccgccugcccggcc

SEQ ID NO: 3064337 - RNA, 14 nt, Mycobacterium bovis subsp bovis AF2122/97
gccaccgccgcugc

SEQ ID NO: 3064338 - RNA, 15 nt, Mycobacterium bovis subsp bovis AF2122/97
gccaccgccgcugcc

SEQ ID NO: 3064339 - RNA, 14 nt, Mycobacterium bovis subsp bovis AF2122/97
gccaccgccggcag

SEQ ID NO: 3064340 - RNA, 16 nt, Mycobacterium bovis subsp bovis AF2122/97
gccaccgccggcagca

SEQ ID NO: 3064341 - RNA, 23 nt, Mycobacterium bovis subsp bovis AF2122/97
gccaccgcgacaccccggaaucc

SEQ ID NO: 3064342 - RNA, 12 nt, Mycobacterium bovis subsp bovis AF2122/97
gccaccgcgacg

SEQ ID NO: 3064343 - RNA, 16 nt, Mycobacterium bovis subsp bovis AF2122/97
gccaccgcgacgagcg

SEQ ID NO: 3064344 - RNA, 15 nt, Mycobacterium bovis subsp bovis AF2122/97
gccaccgcgacggca

SEQ ID NO: 3064345 - RNA, 18 nt, Mycobacterium bovis subsp bovis AF2122/97
gccaccgcgacggcaggc

SEQ ID NO: 3064346 - RNA, 20 nt, Mycobacterium bovis subsp bovis AF2122/97
gccaccgcgacggcaggcuc

SEQ ID NO: 3064347 - RNA, 13 nt, Mycobacterium bovis subsp bovis AF2122/97
gccaccgcggccg

SEQ ID NO: 3064348 - RNA, 15 nt, Mycobacterium bovis subsp bovis AF2122/97
gccaccgcggccgcg

SEQ ID NO: 3064349 - RNA, 12 nt, Mycobacterium bovis subsp bovis AF2122/97
gccaccgcggcg

SEQ ID NO: 3064350 - RNA, 13 nt, Mycobacterium bovis subsp bovis AF2122/97
gccaccgcggcgu

SEQ ID NO: 3064351 - RNA, 16 nt, Mycobacterium bovis subsp bovis AF2122/97
gccaccgcgggcggca

SEQ ID NO: 3064352 - RNA, 17 nt, Mycobacterium bovis subsp bovis AF2122/97
gccaccgcgggcggcau

SEQ ID NO: 3064353 - RNA, 22 nt, Mycobacterium bovis subsp bovis AF2122/97
gccaccgcgggcggcaucgccg

SEQ ID NO: 3064354 - RNA, 16 nt, Mycobacterium bovis subsp bovis AF2122/97
gccaccgcggucaccg

SEQ ID NO: 3064355 - RNA, 19 nt, Mycobacterium bovis subsp bovis AF2122/97
gccaccgcgguggcggcga

SEQ ID NO: 3064356 - RNA, 16 nt, Mycobacterium bovis subsp bovis AF2122/97
gccaccgcugccggca

SEQ ID NO: 3064357 - RNA, 19 nt, Mycobacterium bovis subsp bovis AF2122/97
gccaccgcugccggcacgc

SEQ ID NO: 3064358 - RNA, 16 nt, Mycobacterium bovis subsp bovis AF2122/97
gccaccgcuugacccc

SEQ ID NO: 3064359 - RNA, 18 nt, Mycobacterium bovis subsp bovis AF2122/97
gccaccggaauccuggcc

SEQ ID NO: 3064360 - RNA, 20 nt, Mycobacterium bovis subsp bovis AF2122/97
gccaccggaauccuggccgc

SEQ ID NO: 3064361 - RNA, 19 nt, Mycobacterium bovis subsp bovis AF2122/97
gccaccggaggugcgccgc

SEQ ID NO: 3064362 - RNA, 22 nt, Mycobacterium bovis subsp bovis AF2122/97
gccaccggaggugcgccgcggg

SEQ ID NO: 3064363 - RNA, 23 nt, Mycobacterium bovis subsp bovis AF2122/97
gccaccggcaaucggcggcaccc

SEQ ID NO: 3064364 - RNA, 18 nt, Mycobacterium bovis subsp bovis AF2122/97
gccaccggccggcgcagu

SEQ ID NO: 3064365 - RNA, 13 nt, Mycobacterium bovis subsp bovis AF2122/97
gccaccggcgacc

SEQ ID NO: 3064366 - RNA, 14 nt, Mycobacterium bovis subsp bovis AF2122/97
gccaccggcgaccg

SEQ ID NO: 3064367 - RNA, 19 nt, Mycobacterium bovis subsp bovis AF2122/97
gccaccggcgacgccggcc

SEQ ID NO: 3064368 - RNA, 13 nt, Mycobacterium bovis subsp bovis AF2122/97
gccaccggcgcca

SEQ ID NO: 3064369 - RNA, 20 nt, Mycobacterium bovis subsp bovis AF2122/97
gccaccggcgccaccggcgc

SEQ ID NO: 3064370 - RNA, 21 nt, Mycobacterium bovis subsp bovis AF2122/97
gccaccggcgccaccggcgcc

SEQ ID NO: 3064371 - RNA, 13 nt, Mycobacterium bovis subsp bovis AF2122/97
gccaccggcgccg

SEQ ID NO: 3064372 - RNA, 18 nt, Mycobacterium bovis subsp bovis AF2122/97
gccaccggcgccgccguc

SEQ ID NO: 3064373 - RNA, 20 nt, Mycobacterium bovis subsp bovis AF2122/97
gccaccggcgccgccgucgc

SEQ ID NO: 3064374 - RNA, 18 nt, Mycobacterium bovis subsp bovis AF2122/97
gccaccggcgcgaccgcg

SEQ ID NO: 3064375 - RNA, 22 nt, Mycobacterium bovis subsp bovis AF2122/97
gccaccggcgcgaccgcggcga

SEQ ID NO: 3064376 - RNA, 14 nt, Mycobacterium bovis subsp bovis AF2122/97
gccaccggcggugc

SEQ ID NO: 3064377 - RNA, 15 nt, Mycobacterium bovis subsp bovis AF2122/97
gccaccggcgucgac

SEQ ID NO: 3064378 - RNA, 19 nt, Mycobacterium bovis subsp bovis AF2122/97
gccaccggcgucgacgucg

SEQ ID NO: 3064379 - RNA, 21 nt, Mycobacterium bovis subsp bovis AF2122/97
gccaccggcgucgacgucggc

SEQ ID NO: 3064380 - RNA, 21 nt, Mycobacterium bovis subsp bovis AF2122/97
gccaccggcgucugcccgccc

SEQ ID NO: 3064381 - RNA, 23 nt, Mycobacterium bovis subsp bovis AF2122/97
gccaccggcguuguugaccagca

SEQ ID NO: 3064382 - RNA, 22 nt, Mycobacterium bovis subsp bovis AF2122/97
gccaccggcugcaaccagcggc

SEQ ID NO: 3064383 - RNA, 17 nt, Mycobacterium bovis subsp bovis AF2122/97
gccaccgggacgauucu

SEQ ID NO: 3064384 - RNA, 15 nt, Mycobacterium bovis subsp bovis AF2122/97
gccaccgggcgugcg

SEQ ID NO: 3064385 - RNA, 17 nt, Mycobacterium bovis subsp bovis AF2122/97
gccaccgggcgugcggc

SEQ ID NO: 3064386 - RNA, 19 nt, Mycobacterium bovis subsp bovis AF2122/97
gccaccgggcgugcggcgg

SEQ ID NO: 3064387 - RNA, 21 nt, Mycobacterium bovis subsp bovis AF2122/97
gccaccgggcgugcggcggcc

SEQ ID NO: 3064388 - RNA, 15 nt, Mycobacterium bovis subsp bovis AF2122/97
gccaccggguggaac

SEQ ID NO: 3064389 - RNA, 17 nt, Mycobacterium bovis subsp bovis AF2122/97
gccaccggguucaccga

SEQ ID NO: 3064390 - RNA, 20 nt, Mycobacterium bovis subsp bovis AF2122/97
gccaccggguucaccgaggu

SEQ ID NO: 3064391 - RNA, 21 nt, Mycobacterium bovis subsp bovis AF2122/97
gccaccgguaccgaucagcag

SEQ ID NO: 3064392 - RNA, 15 nt, Mycobacterium bovis subsp bovis AF2122/97
gccaccgguaccgcc

SEQ ID NO: 3064393 - RNA, 18 nt, Mycobacterium bovis subsp bovis AF2122/97
gccaccgguaccgccggc

SEQ ID NO: 3064394 - RNA, 22 nt, Mycobacterium bovis subsp bovis AF2122/97
gccaccgguaccgccggcuccg

SEQ ID NO: 3064395 - RNA, 19 nt, Mycobacterium bovis subsp bovis AF2122/97
gccaccgguaccggcgacg

SEQ ID NO: 3064396 - RNA, 18 nt, Mycobacterium bovis subsp bovis AF2122/97
gccaccggugagcgcagc

SEQ ID NO: 3064397 - RNA, 20 nt, Mycobacterium bovis subsp bovis AF2122/97
gccaccggugagcgcagcuu

SEQ ID NO: 3064398 - RNA, 16 nt, Mycobacterium bovis subsp bovis AF2122/97
gccaccggugccggcg

SEQ ID NO: 3064399 - RNA, 17 nt, Mycobacterium bovis subsp bovis AF2122/97
gccaccggugccggcga

SEQ ID NO: 3064400 - RNA, 18 nt, Mycobacterium bovis subsp bovis AF2122/97
gccaccggugccggcgac

SEQ ID NO: 3064401 - RNA, 22 nt, Mycobacterium bovis subsp bovis AF2122/97
gccaccgguuuggagcucaucg

SEQ ID NO: 3064402 - RNA, 23 nt, Mycobacterium bovis subsp bovis AF2122/97
gccaccgguuuggagcucaucga

SEQ ID NO: 3064403 - RNA, 17 nt, Mycobacterium bovis subsp bovis AF2122/97
gccacgcccgacgccag

SEQ ID NO: 3064404 - RNA, 21 nt, Mycobacterium bovis subsp bovis AF2122/97
gccacgcccgacgccagcugc

SEQ ID NO: 3064405 - RNA, 18 nt, Mycobacterium bovis subsp bovis AF2122/97
gccacgccgaugcggugc

SEQ ID NO: 3064406 - RNA, 15 nt, Mycobacterium bovis subsp bovis AF2122/97
gccacgccgauggga

SEQ ID NO: 3064407 - RNA, 19 nt, Mycobacterium bovis subsp bovis AF2122/97
gccacgccgaugggaaccg

SEQ ID NO: 3064408 - RNA, 13 nt, Mycobacterium bovis subsp bovis AF2122/97
gccacgccgccgg

SEQ ID NO: 3064409 - RNA, 19 nt, Mycobacterium bovis subsp bovis AF2122/97
gccacgcguuccuccagca

SEQ ID NO: 3064410 - RNA, 21 nt, Mycobacterium bovis subsp bovis AF2122/97
gccacgcguuccuccagcagc

SEQ ID NO: 3064411 - RNA, 22 nt, Mycobacterium bovis subsp bovis AF2122/97
gccacgcucggugcugcgccga

SEQ ID NO: 3064412 - RNA, 23 nt, Mycobacterium bovis subsp bovis AF2122/97
gccacgcucggugcugcgccgau

SEQ ID NO: 3064413 - RNA, 22 nt, Mycobacterium bovis subsp bovis AF2122/97
gccacgcuucuuccgcgcgccg

SEQ ID NO: 3064414 - RNA, 14 nt, Mycobacterium bovis subsp bovis AF2122/97
gccacggaucgcgg

SEQ ID NO: 3064415 - RNA, 17 nt, Mycobacterium bovis subsp bovis AF2122/97
gccacggaucgcggcgg

SEQ ID NO: 3064416 - RNA, 18 nt, Mycobacterium bovis subsp bovis AF2122/97
gccacggaucgcggcggc

SEQ ID NO: 3064417 - RNA, 18 nt, Mycobacterium bovis subsp bovis AF2122/97
gccacggcaaaggcgcuc

SEQ ID NO: 3064418 - RNA, 16 nt, Mycobacterium bovis subsp bovis AF2122/97
gccacggcaaucaacg

SEQ ID NO: 3064419 - RNA, 15 nt, Mycobacterium bovis subsp bovis AF2122/97
gccacggcagcgccc

SEQ ID NO: 3064420 - RNA, 18 nt, Mycobacterium bovis subsp bovis AF2122/97
gccacggcagcgcccaga

SEQ ID NO: 3064421 - RNA, 14 nt, Mycobacterium bovis subsp bovis AF2122/97
gccacggcaucggc

SEQ ID NO: 3064422 - RNA, 15 nt, Mycobacterium bovis subsp bovis AF2122/97
gccacggcauucgac

SEQ ID NO: 3064423 - RNA, 13 nt, Mycobacterium bovis subsp bovis AF2122/97
gccacggcgccua

SEQ ID NO: 3064424 - RNA, 12 nt, Mycobacterium bovis subsp bovis AF2122/97
gccacggcggcu

SEQ ID NO: 3064425 - RNA, 14 nt, Mycobacterium bovis subsp bovis AF2122/97
gccacggcgucggc

SEQ ID NO: 3064426 - RNA, 18 nt, Mycobacterium bovis subsp bovis AF2122/97
gccacggcugaccggggu

SEQ ID NO: 3064427 - RNA, 14 nt, Mycobacterium bovis subsp bovis AF2122/97
gccacggcugcgga

SEQ ID NO: 3064428 - RNA, 16 nt, Mycobacterium bovis subsp bovis AF2122/97
gccacggcuucgccgc

SEQ ID NO: 3064429 - RNA, 18 nt, Mycobacterium bovis subsp bovis AF2122/97
gccacggcuucgccgcgg

SEQ ID NO: 3064430 - RNA, 21 nt, Mycobacterium bovis subsp bovis AF2122/97
gccacggcuuugcggcgcgac

SEQ ID NO: 3064431 - RNA, 16 nt, Mycobacterium bovis subsp bovis AF2122/97
gccacgggcggccacc

SEQ ID NO: 3064432 - RNA, 18 nt, Mycobacterium bovis subsp bovis AF2122/97
gccacgggcggccaccgc

SEQ ID NO: 3064433 - RNA, 19 nt, Mycobacterium bovis subsp bovis AF2122/97
gccacgggcggccaccgca

SEQ ID NO: 3064434 - RNA, 20 nt, Mycobacterium bovis subsp bovis AF2122/97
gccacgggcggccaccgcac

SEQ ID NO: 3064435 - RNA, 19 nt, Mycobacterium bovis subsp bovis AF2122/97
gccacggggauuggcgacg

SEQ ID NO: 3064436 - RNA, 13 nt, Mycobacterium bovis subsp bovis AF2122/97
gccacggggcagg

SEQ ID NO: 3064437 - RNA, 18 nt, Mycobacterium bovis subsp bovis AF2122/97
gccacggguagcugccgc

SEQ ID NO: 3064438 - RNA, 22 nt, Mycobacterium bovis subsp bovis AF2122/97
gccacggguagcugccgcggcc

SEQ ID NO: 3064439 - RNA, 23 nt, Mycobacterium bovis subsp bovis AF2122/97
gccacggguagcugccgcggccg

SEQ ID NO: 3064440 - RNA, 12 nt, Mycobacterium bovis subsp bovis AF2122/97
gccacgggugac

SEQ ID NO: 3064441 - RNA, 15 nt, Mycobacterium bovis subsp bovis AF2122/97
gccacgggugacgaa

SEQ ID NO: 3064442 - RNA, 17 nt, Mycobacterium bovis subsp bovis AF2122/97
gccacgggugacgaacc

SEQ ID NO: 3064443 - RNA, 21 nt, Mycobacterium bovis subsp bovis AF2122/97
gccacgggugacucgggcacg

SEQ ID NO: 3064444 - RNA, 14 nt, Mycobacterium bovis subsp bovis AF2122/97
gccacggucagcca

SEQ ID NO: 3064445 - RNA, 18 nt, Mycobacterium bovis subsp bovis AF2122/97
gccacggucauugggugu

SEQ ID NO: 3064446 - RNA, 16 nt, Mycobacterium bovis subsp bovis AF2122/97
gccacgguccggccca

SEQ ID NO: 3064447 - RNA, 22 nt, Mycobacterium bovis subsp bovis AF2122/97
gccacgguccggcccaccagcg

SEQ ID NO: 3064448 - RNA, 20 nt, Mycobacterium bovis subsp bovis AF2122/97
gccacggugacccugguggu

SEQ ID NO: 3064449 - RNA, 20 nt, Mycobacterium bovis subsp bovis AF2122/97
gccacgguggagcgcgccuc

SEQ ID NO: 3064450 - RNA, 22 nt, Mycobacterium bovis subsp bovis AF2122/97
gccacgguggagcgcgccucgc

SEQ ID NO: 3064451 - RNA, 15 nt, Mycobacterium bovis subsp bovis AF2122/97
gccacgguggcgcaa

SEQ ID NO: 3064452 - RNA, 17 nt, Mycobacterium bovis subsp bovis AF2122/97
gccacgguggcgcaagu

SEQ ID NO: 3064453 - RNA, 16 nt, Mycobacterium bovis subsp bovis AF2122/97
gccacggugucgcgau

SEQ ID NO: 3064454 - RNA, 22 nt, Mycobacterium bovis subsp bovis AF2122/97
gccacggugucgcgaugcuucc

SEQ ID NO: 3064455 - RNA, 16 nt, Mycobacterium bovis subsp bovis AF2122/97
gccacgguucgggcag

SEQ ID NO: 3064456 - RNA, 21 nt, Mycobacterium bovis subsp bovis AF2122/97
gccacgguucgggcagcaccc

SEQ ID NO: 3064457 - RNA, 17 nt, Mycobacterium bovis subsp bovis AF2122/97
gccacguacuccaccgc

SEQ ID NO: 3064458 - RNA, 18 nt, Mycobacterium bovis subsp bovis AF2122/97
gccacguacuccaccgcg

SEQ ID NO: 3064459 - RNA, 19 nt, Mycobacterium bovis subsp bovis AF2122/97
gccacguacuccaccgcgc

SEQ ID NO: 3064460 - RNA, 20 nt, Mycobacterium bovis subsp bovis AF2122/97
gccacguacuccaccgcgcc

SEQ ID NO: 3064461 - RNA, 16 nt, Mycobacterium bovis subsp bovis AF2122/97
gccacguacuuggacg

SEQ ID NO: 3064462 - RNA, 15 nt, Mycobacterium bovis subsp bovis AF2122/97
gccacguagcagcag

SEQ ID NO: 3064463 - RNA, 17 nt, Mycobacterium bovis subsp bovis AF2122/97
gccacguagcagcagac

SEQ ID NO: 3064464 - RNA, 14 nt, Mycobacterium bovis subsp bovis AF2122/97
gccacguagcagcg

SEQ ID NO: 3064465 - RNA, 19 nt, Mycobacterium bovis subsp bovis AF2122/97
gccacguagcagcgccggc

SEQ ID NO: 3064466 - RNA, 19 nt, Mycobacterium bovis subsp bovis AF2122/97
gccacguccaucaccggcg

SEQ ID NO: 3064467 - RNA, 21 nt, Mycobacterium bovis subsp bovis AF2122/97
gccacguccaucaccggcggc

SEQ ID NO: 3064468 - RNA, 22 nt, Mycobacterium bovis subsp bovis AF2122/97
gccacguccaucaccggcggcc

SEQ ID NO: 3064469 - RNA, 19 nt, Mycobacterium bovis subsp bovis AF2122/97
gccacguccucagccgugc

SEQ ID NO: 3064470 - RNA, 16 nt, Mycobacterium bovis subsp bovis AF2122/97
gccacgucgagcaccc

SEQ ID NO: 3064471 - RNA, 19 nt, Mycobacterium bovis subsp bovis AF2122/97
gccacgucgaugugcgccc

SEQ ID NO: 3064472 - RNA, 13 nt, Mycobacterium bovis subsp bovis AF2122/97
gccacgucgccgg

SEQ ID NO: 3064473 - RNA, 19 nt, Mycobacterium bovis subsp bovis AF2122/97
gccacgucgccggcuaccg

SEQ ID NO: 3064474 - RNA, 20 nt, Mycobacterium bovis subsp bovis AF2122/97
gccacgucgccggcuaccgc

SEQ ID NO: 3064475 - RNA, 17 nt, Mycobacterium bovis subsp bovis AF2122/97
gccacgucuccuucggc

SEQ ID NO: 3064476 - RNA, 17 nt, Mycobacterium bovis subsp bovis AF2122/97
gccacguggucgagcag

SEQ ID NO: 3064477 - RNA, 22 nt, Mycobacterium bovis subsp bovis AF2122/97
gccacguguggugugucaccgg

SEQ ID NO: 3064478 - RNA, 17 nt, Mycobacterium bovis subsp bovis AF2122/97
gccacguugaucccgaa

SEQ ID NO: 3064479 - RNA, 18 nt, Mycobacterium bovis subsp bovis AF2122/97
gccacuacggccuggcca

SEQ ID NO: 3064480 - RNA, 19 nt, Mycobacterium bovis subsp bovis AF2122/97
gccacuagcauugucgccg

SEQ ID NO: 3064481 - RNA, 23 nt, Mycobacterium bovis subsp bovis AF2122/97
gccacuagcauugucgccggaug

SEQ ID NO: 3064482 - RNA, 22 nt, Mycobacterium bovis subsp bovis AF2122/97
gccacucaagauuuccaucgca

SEQ ID NO: 3064483 - RNA, 19 nt, Mycobacterium bovis subsp bovis AF2122/97
gccacucagcccgacaccg

SEQ ID NO: 3064484 - RNA, 15 nt, Mycobacterium bovis subsp bovis AF2122/97
gccacuccaggagcc

SEQ ID NO: 3064485 - RNA, 20 nt, Mycobacterium bovis subsp bovis AF2122/97
gccacucccagccaacccgu

SEQ ID NO: 3064486 - RNA, 15 nt, Mycobacterium bovis subsp bovis AF2122/97
gccacuccgguggcc

SEQ ID NO: 3064487 - RNA, 23 nt, Mycobacterium bovis subsp bovis AF2122/97
gccacuccgguggccaacaccgc

SEQ ID NO: 3064488 - RNA, 19 nt, Mycobacterium bovis subsp bovis AF2122/97
gccacuccucggugugcuc

SEQ ID NO: 3064489 - RNA, 21 nt, Mycobacterium bovis subsp bovis AF2122/97
gccagcaacugccgcacccgg

SEQ ID NO: 3064490 - RNA, 21 nt, Mycobacterium bovis subsp bovis AF2122/97
gccagcaagacgaugacagac

SEQ ID NO: 3064491 - RNA, 18 nt, Mycobacterium bovis subsp bovis AF2122/97
gccagcaaguacgcgucg

SEQ ID NO: 3064492 - RNA, 17 nt, Mycobacterium bovis subsp bovis AF2122/97
gccagcaaugcccgcac

SEQ ID NO: 3064493 - RNA, 18 nt, Mycobacterium bovis subsp bovis AF2122/97
gccagcaaugcccgcacc

SEQ ID NO: 3064494 - RNA, 16 nt, Mycobacterium bovis subsp bovis AF2122/97
gccagcacaccgucga

SEQ ID NO: 3064495 - RNA, 13 nt, Mycobacterium bovis subsp bovis AF2122/97
gccagcaccaccg

SEQ ID NO: 3064496 - RNA, 14 nt, Mycobacterium bovis subsp bovis AF2122/97
gccagcaccaccgg

SEQ ID NO: 3064497 - RNA, 14 nt, Mycobacterium bovis subsp bovis AF2122/97
gccagcaccacggc

SEQ ID NO: 3064498 - RNA, 17 nt, Mycobacterium bovis subsp bovis AF2122/97
gccagcaccacggccag

SEQ ID NO: 3064499 - RNA, 16 nt, Mycobacterium bovis subsp bovis AF2122/97
gccagcaccacgucga

SEQ ID NO: 3064500 - RNA, 17 nt, Mycobacterium bovis subsp bovis AF2122/97
gccagcaccacgucgac

SEQ ID NO: 3064501 - RNA, 19 nt, Mycobacterium bovis subsp bovis AF2122/97
gccagcaccacgucgacga

SEQ ID NO: 3064502 - RNA, 14 nt, Mycobacterium bovis subsp bovis AF2122/97
gccagcaccagcgu

SEQ ID NO: 3064503 - RNA, 17 nt, Mycobacterium bovis subsp bovis AF2122/97
gccagcacccgcagccg

SEQ ID NO: 3064504 - RNA, 21 nt, Mycobacterium bovis subsp bovis AF2122/97
gccagcacccgcuccagcucg

SEQ ID NO: 3064505 - RNA, 17 nt, Mycobacterium bovis subsp bovis AF2122/97
gccagcacccugaugug

SEQ ID NO: 3064506 - RNA, 12 nt, Mycobacterium bovis subsp bovis AF2122/97
gccagcaccggg

SEQ ID NO: 3064507 - RNA, 17 nt, Mycobacterium bovis subsp bovis AF2122/97
gccagcaccggggacag

SEQ ID NO: 3064508 - RNA, 20 nt, Mycobacterium bovis subsp bovis AF2122/97
gccagcaccuagucgcggcc

SEQ ID NO: 3064509 - RNA, 21 nt, Mycobacterium bovis subsp bovis AF2122/97
gccagcaccuagucgcggccg

SEQ ID NO: 3064510 - RNA, 22 nt, Mycobacterium bovis subsp bovis AF2122/97
gccagcaccuagucgcggccgu

SEQ ID NO: 3064511 - RNA, 18 nt, Mycobacterium bovis subsp bovis AF2122/97
gccagcaccucgaccgcc

SEQ ID NO: 3064512 - RNA, 18 nt, Mycobacterium bovis subsp bovis AF2122/97
gccagcaccucggccagc

SEQ ID NO: 3064513 - RNA, 16 nt, Mycobacterium bovis subsp bovis AF2122/97
gccagcacgcccgcgc

SEQ ID NO: 3064514 - RNA, 21 nt, Mycobacterium bovis subsp bovis AF2122/97
gccagcacgcccucgacgcgc

SEQ ID NO: 3064515 - RNA, 22 nt, Mycobacterium bovis subsp bovis AF2122/97
gccagcacgcccucgacgcgcu

SEQ ID NO: 3064516 - RNA, 16 nt, Mycobacterium bovis subsp bovis AF2122/97
gccagcacgccgccgg

SEQ ID NO: 3064517 - RNA, 14 nt, Mycobacterium bovis subsp bovis AF2122/97
gccagcacggcgac

SEQ ID NO: 3064518 - RNA, 13 nt, Mycobacterium bovis subsp bovis AF2122/97
gccagcacuccac

SEQ ID NO: 3064519 - RNA, 17 nt, Mycobacterium bovis subsp bovis AF2122/97
gccagcagaaacaucga

SEQ ID NO: 3064520 - RNA, 19 nt, Mycobacterium bovis subsp bovis AF2122/97
gccagcagagcggcacgca

SEQ ID NO: 3064521 - RNA, 19 nt, Mycobacterium bovis subsp bovis AF2122/97
gccagcagaucuccggggc

SEQ ID NO: 3064522 - RNA, 19 nt, Mycobacterium bovis subsp bovis AF2122/97
gccagcagauuaccgagcu

SEQ ID NO: 3064523 - RNA, 20 nt, Mycobacterium bovis subsp bovis AF2122/97
gccagcagauuaccgagcug

SEQ ID NO: 3064524 - RNA, 16 nt, Mycobacterium bovis subsp bovis AF2122/97
gccagcagcaaccgcc

SEQ ID NO: 3064525 - RNA, 23 nt, Mycobacterium bovis subsp bovis AF2122/97
gccagcagcaaccgccaucgucg

SEQ ID NO: 3064526 - RNA, 19 nt, Mycobacterium bovis subsp bovis AF2122/97
gccagcagcaacgacccga

SEQ ID NO: 3064527 - RNA, 16 nt, Mycobacterium bovis subsp bovis AF2122/97
gccagcagcaaucagc

SEQ ID NO: 3064528 - RNA, 20 nt, Mycobacterium bovis subsp bovis AF2122/97
gccagcagcaaucagccgcc

SEQ ID NO: 3064529 - RNA, 20 nt, Mycobacterium bovis subsp bovis AF2122/97
gccagcagcaaugcgguacc

SEQ ID NO: 3064530 - RNA, 14 nt, Mycobacterium bovis subsp bovis AF2122/97
gccagcagcagcgc

SEQ ID NO: 3064531 - RNA, 16 nt, Mycobacterium bovis subsp bovis AF2122/97
gccagcagcaggccag

SEQ ID NO: 3064532 - RNA, 19 nt, Mycobacterium bovis subsp bovis AF2122/97
gccagcagcagugccaccg

SEQ ID NO: 3064533 - RNA, 21 nt, Mycobacterium bovis subsp bovis AF2122/97
gccagcagccacccgacaacg

SEQ ID NO: 3064534 - RNA, 23 nt, Mycobacterium bovis subsp bovis AF2122/97
gccagcagccacccgacaacgcu

SEQ ID NO: 3064535 - RNA, 11 nt, Mycobacterium bovis subsp bovis AF2122/97
gccagcagccg

SEQ ID NO: 3064536 - RNA, 15 nt, Mycobacterium bovis subsp bovis AF2122/97
gccagcagccgcgac

SEQ ID NO: 3064537 - RNA, 17 nt, Mycobacterium bovis subsp bovis AF2122/97
gccagcagccgcgacgc

SEQ ID NO: 3064538 - RNA, 15 nt, Mycobacterium bovis subsp bovis AF2122/97
gccagcagccguuca

SEQ ID NO: 3064539 - RNA, 17 nt, Mycobacterium bovis subsp bovis AF2122/97
gccagcagccguucacu

SEQ ID NO: 3064540 - RNA, 14 nt, Mycobacterium bovis subsp bovis AF2122/97
gccagcagcgcggg

SEQ ID NO: 3064541 - RNA, 16 nt, Mycobacterium bovis subsp bovis AF2122/97
gccagcagcggcgagc

SEQ ID NO: 3064542 - RNA, 21 nt, Mycobacterium bovis subsp bovis AF2122/97
gccagcagcuucucguucguc

SEQ ID NO: 3064543 - RNA, 20 nt, Mycobacterium bovis subsp bovis AF2122/97
gccagcagcuuguuuuccac

SEQ ID NO: 3064544 - RNA, 19 nt, Mycobacterium bovis subsp bovis AF2122/97
gccagcaggaacgccgugc

SEQ ID NO: 3064545 - RNA, 22 nt, Mycobacterium bovis subsp bovis AF2122/97
gccagcaggaacgccgugccgu

SEQ ID NO: 3064546 - RNA, 13 nt, Mycobacterium bovis subsp bovis AF2122/97
gccagcaggauga

SEQ ID NO: 3064547 - RNA, 17 nt, Mycobacterium bovis subsp bovis AF2122/97
gccagcaggaugaugac

SEQ ID NO: 3064548 - RNA, 14 nt, Mycobacterium bovis subsp bovis AF2122/97
gccagcagggccac

SEQ ID NO: 3064549 - RNA, 19 nt, Mycobacterium bovis subsp bovis AF2122/97
gccagcagggccaccacca

SEQ ID NO: 3064550 - RNA, 22 nt, Mycobacterium bovis subsp bovis AF2122/97
gccagcagggccaccaccacgg

SEQ ID NO: 3064551 - RNA, 17 nt, Mycobacterium bovis subsp bovis AF2122/97
gccagcaggggacgggc

SEQ ID NO: 3064552 - RNA, 19 nt, Mycobacterium bovis subsp bovis AF2122/97
gccagcagguauuugccgu

SEQ ID NO: 3064553 - RNA, 18 nt, Mycobacterium bovis subsp bovis AF2122/97
gccagcagguuggucacc

SEQ ID NO: 3064554 - RNA, 12 nt, Mycobacterium bovis subsp bovis AF2122/97
gccagcaucagc

SEQ ID NO: 3064555 - RNA, 20 nt, Mycobacterium bovis subsp bovis AF2122/97
gccagcaucagcgccagcga

SEQ ID NO: 3064556 - RNA, 13 nt, Mycobacterium bovis subsp bovis AF2122/97
gccagcaucauca

SEQ ID NO: 3064557 - RNA, 16 nt, Mycobacterium bovis subsp bovis AF2122/97
gccagcaucaucaagc

SEQ ID NO: 3064558 - RNA, 14 nt, Mycobacterium bovis subsp bovis AF2122/97
gccagcaucggcag

SEQ ID NO: 3064559 - RNA, 18 nt, Mycobacterium bovis subsp bovis AF2122/97
gccagcaucggcagcagc

SEQ ID NO: 3064560 - RNA, 20 nt, Mycobacterium bovis subsp bovis AF2122/97
gccagcaucggcagcagcgc

SEQ ID NO: 3064561 - RNA, 12 nt, Mycobacterium bovis subsp bovis AF2122/97
gccagcaugaca

SEQ ID NO: 3064562 - RNA, 16 nt, Mycobacterium bovis subsp bovis AF2122/97
gccagcaugacaccgg

SEQ ID NO: 3064563 - RNA, 21 nt, Mycobacterium bovis subsp bovis AF2122/97
gccagcaugacaccggccacc

SEQ ID NO: 3064564 - RNA, 17 nt, Mycobacterium bovis subsp bovis AF2122/97
gccagcaugucgggccg

SEQ ID NO: 3064565 - RNA, 18 nt, Mycobacterium bovis subsp bovis AF2122/97
gccagcauuagccaggcc

SEQ ID NO: 3064566 - RNA, 16 nt, Mycobacterium bovis subsp bovis AF2122/97
gccagcauugaagaag

SEQ ID NO: 3064567 - RNA, 18 nt, Mycobacterium bovis subsp bovis AF2122/97
gccagcauugaagaagcc

SEQ ID NO: 3064568 - RNA, 22 nt, Mycobacterium bovis subsp bovis AF2122/97
gccagcauugaagaagcccgaa

SEQ ID NO: 3064569 - RNA, 15 nt, Mycobacterium bovis subsp bovis AF2122/97
gccagccacagccga

SEQ ID NO: 3064570 - RNA, 17 nt, Mycobacterium bovis subsp bovis AF2122/97
gccagccacagccgacc

SEQ ID NO: 3064571 - RNA, 22 nt, Mycobacterium bovis subsp bovis AF2122/97
gccagccaccacaucgcgggcg

SEQ ID NO: 3064572 - RNA, 12 nt, Mycobacterium bovis subsp bovis AF2122/97
gccagccaccga

SEQ ID NO: 3064573 - RNA, 16 nt, Mycobacterium bovis subsp bovis AF2122/97
gccagccaccgaucga

SEQ ID NO: 3064574 - RNA, 13 nt, Mycobacterium bovis subsp bovis AF2122/97
gccagccaccggg

SEQ ID NO: 3064575 - RNA, 15 nt, Mycobacterium bovis subsp bovis AF2122/97
gccagccacuccucg

SEQ ID NO: 3064576 - RNA, 13 nt, Mycobacterium bovis subsp bovis AF2122/97
gccagcgcgccac

SEQ ID NO: 3064577 - RNA, 24 nt, Mycobacterium bovis subsp bovis AF2122/97
gccagcgcgcccgcggccgccagc

SEQ ID NO: 3064578 - RNA, 18 nt, Mycobacterium bovis subsp bovis AF2122/97
gccagcgcgcgcgggugc

SEQ ID NO: 3064579 - RNA, 12 nt, Mycobacterium bovis subsp bovis AF2122/97
gccagcgcggcg

SEQ ID NO: 3064580 - RNA, 13 nt, Mycobacterium bovis subsp bovis AF2122/97
gccagcgcggcga

SEQ ID NO: 3064581 - RNA, 18 nt, Mycobacterium bovis subsp bovis AF2122/97
gccagcgcggcgcgcggg

SEQ ID NO: 3064582 - RNA, 14 nt, Mycobacterium bovis subsp bovis AF2122/97
gccagcgcgguguc

SEQ ID NO: 3064583 - RNA, 17 nt, Mycobacterium bovis subsp bovis AF2122/97
gccagcgcggugucggg

SEQ ID NO: 3064584 - RNA, 20 nt, Mycobacterium bovis subsp bovis AF2122/97
gccagcgcggugucggggcc

SEQ ID NO: 3064585 - RNA, 19 nt, Mycobacterium bovis subsp bovis AF2122/97
gccagcgcucaccggcguc

SEQ ID NO: 3064586 - RNA, 16 nt, Mycobacterium bovis subsp bovis AF2122/97
gccagcgcugcugccg

SEQ ID NO: 3064587 - RNA, 19 nt, Mycobacterium bovis subsp bovis AF2122/97
gccagcgcuucgucggccg

SEQ ID NO: 3064588 - RNA, 12 nt, Mycobacterium bovis subsp bovis AF2122/97
gccagcggagca

SEQ ID NO: 3064589 - RNA, 14 nt, Mycobacterium bovis subsp bovis AF2122/97
gccagcggagcagc

SEQ ID NO: 3064590 - RNA, 10 nt, Mycobacterium bovis subsp bovis AF2122/97
gccagcggca

SEQ ID NO: 3064591 - RNA, 20 nt, Mycobacterium bovis subsp bovis AF2122/97
gccagcggcaauggccagca

SEQ ID NO: 3064592 - RNA, 19 nt, Mycobacterium bovis subsp bovis AF2122/97
gccagcggcacacccauca

SEQ ID NO: 3064593 - RNA, 17 nt, Mycobacterium bovis subsp bovis AF2122/97
gccagcggcagcggcgu

SEQ ID NO: 3064594 - RNA, 19 nt, Mycobacterium bovis subsp bovis AF2122/97
gccagcggcaggaagaaac

SEQ ID NO: 3064595 - RNA, 21 nt, Mycobacterium bovis subsp bovis AF2122/97
gccagcggccauccggcggcg

SEQ ID NO: 3064596 - RNA, 17 nt, Mycobacterium bovis subsp bovis AF2122/97
gccagcggcccgucacc

SEQ ID NO: 3064597 - RNA, 22 nt, Mycobacterium bovis subsp bovis AF2122/97
gccagcggcccgucaccgcggg

SEQ ID NO: 3064598 - RNA, 13 nt, Mycobacterium bovis subsp bovis AF2122/97
gccagcggccggg

SEQ ID NO: 3064599 - RNA, 14 nt, Mycobacterium bovis subsp bovis AF2122/97
gccagcggccgggc

SEQ ID NO: 3064600 - RNA, 18 nt, Mycobacterium bovis subsp bovis AF2122/97
gccagcggccgggcggcc

SEQ ID NO: 3064601 - RNA, 23 nt, Mycobacterium bovis subsp bovis AF2122/97
gccagcggccgggcggccaggcg

SEQ ID NO: 3064602 - RNA, 15 nt, Mycobacterium bovis subsp bovis AF2122/97
gccagcggcgcgacc

SEQ ID NO: 3064603 - RNA, 16 nt, Mycobacterium bovis subsp bovis AF2122/97
gccagcggcgcgaccg

SEQ ID NO: 3064604 - RNA, 13 nt, Mycobacterium bovis subsp bovis AF2122/97
gccagcggcugcc

SEQ ID NO: 3064605 - RNA, 19 nt, Mycobacterium bovis subsp bovis AF2122/97
gccagcggcugcccaucgg

SEQ ID NO: 3064606 - RNA, 12 nt, Mycobacterium bovis subsp bovis AF2122/97
gccagcgggaac

SEQ ID NO: 3064607 - RNA, 18 nt, Mycobacterium bovis subsp bovis AF2122/97
gccagcgggaacacaccg

SEQ ID NO: 3064608 - RNA, 18 nt, Mycobacterium bovis subsp bovis AF2122/97
gccagcgggugaggucau

SEQ ID NO: 3064609 - RNA, 20 nt, Mycobacterium bovis subsp bovis AF2122/97
gccagcgguaaugccagcgg

SEQ ID NO: 3064610 - RNA, 21 nt, Mycobacterium bovis subsp bovis AF2122/97
gccagcgguaaugccagcggc

SEQ ID NO: 3064611 - RNA, 22 nt, Mycobacterium bovis subsp bovis AF2122/97
gccagcguaaauagcgcccugc

SEQ ID NO: 3064612 - RNA, 21 nt, Mycobacterium bovis subsp bovis AF2122/97
gccagcgucaacagcguggag

SEQ ID NO: 3064613 - RNA, 17 nt, Mycobacterium bovis subsp bovis AF2122/97
gccagcgucaccucacc

SEQ ID NO: 3064614 - RNA, 15 nt, Mycobacterium bovis subsp bovis AF2122/97
gccagcgucgaccaa

SEQ ID NO: 3064615 - RNA, 13 nt, Mycobacterium bovis subsp bovis AF2122/97
gccagcguggaga

SEQ ID NO: 3064616 - RNA, 12 nt, Mycobacterium bovis subsp bovis AF2122/97
gccagcguggug

SEQ ID NO: 3064617 - RNA, 18 nt, Mycobacterium bovis subsp bovis AF2122/97
gccagcgugucccaacgc

SEQ ID NO: 3064618 - RNA, 14 nt, Mycobacterium bovis subsp bovis AF2122/97
gccagcguguccgc

SEQ ID NO: 3064619 - RNA, 19 nt, Mycobacterium bovis subsp bovis AF2122/97
gccagcguuaggucgccgg

SEQ ID NO: 3064620 - RNA, 20 nt, Mycobacterium bovis subsp bovis AF2122/97
gccagcguuaggucgccggc

SEQ ID NO: 3064621 - RNA, 15 nt, Mycobacterium bovis subsp bovis AF2122/97
gccagcguuggcggc

SEQ ID NO: 3064622 - RNA, 23 nt, Mycobacterium bovis subsp bovis AF2122/97
gccagcuauugcuauuccgcggc

SEQ ID NO: 3064623 - RNA, 13 nt, Mycobacterium bovis subsp bovis AF2122/97
gccagcucaacca

SEQ ID NO: 3064624 - RNA, 17 nt, Mycobacterium bovis subsp bovis AF2122/97
gccagcucaaccacaug

SEQ ID NO: 3064625 - RNA, 23 nt, Mycobacterium bovis subsp bovis AF2122/97
gccagcucccgggcggcggccug

SEQ ID NO: 3064626 - RNA, 18 nt, Mycobacterium bovis subsp bovis AF2122/97
gccagcuccgccugccgc

SEQ ID NO: 3064627 - RNA, 19 nt, Mycobacterium bovis subsp bovis AF2122/97
gccagcuccgccugccgcu

SEQ ID NO: 3064628 - RNA, 14 nt, Mycobacterium bovis subsp bovis AF2122/97
gccagcuccggcgc

SEQ ID NO: 3064629 - RNA, 15 nt, Mycobacterium bovis subsp bovis AF2122/97
gccagcuccggcgcu

SEQ ID NO: 3064630 - RNA, 21 nt, Mycobacterium bovis subsp bovis AF2122/97
gccagcuccggcgcuccacug

SEQ ID NO: 3064631 - RNA, 19 nt, Mycobacterium bovis subsp bovis AF2122/97
gccagcuccgugacaccgg

SEQ ID NO: 3064632 - RNA, 20 nt, Mycobacterium bovis subsp bovis AF2122/97
gccagcuccucagccaccgc

SEQ ID NO: 3064633 - RNA, 21 nt, Mycobacterium bovis subsp bovis AF2122/97
gccagcuccucagccaccgcg

SEQ ID NO: 3064634 - RNA, 13 nt, Mycobacterium bovis subsp bovis AF2122/97
gccagcucgccgg

SEQ ID NO: 3064635 - RNA, 17 nt, Mycobacterium bovis subsp bovis AF2122/97
gccagcucgccggccgg

SEQ ID NO: 3064636 - RNA, 14 nt, Mycobacterium bovis subsp bovis AF2122/97
gccagcucggcacc

SEQ ID NO: 3064637 - RNA, 13 nt, Mycobacterium bovis subsp bovis AF2122/97
gccagcucggcca

SEQ ID NO: 3064638 - RNA, 17 nt, Mycobacterium bovis subsp bovis AF2122/97
gccagcucggcggcagc

SEQ ID NO: 3064639 - RNA, 19 nt, Mycobacterium bovis subsp bovis AF2122/97
gccagcucggcggcagcgg

SEQ ID NO: 3064640 - RNA, 20 nt, Mycobacterium bovis subsp bovis AF2122/97
gccagcucggcggcagcggc

SEQ ID NO: 3064641 - RNA, 23 nt, Mycobacterium bovis subsp bovis AF2122/97
gccagcucggcggcagcggcggu

SEQ ID NO: 3064642 - RNA, 15 nt, Mycobacterium bovis subsp bovis AF2122/97
gccagcugaacacga

SEQ ID NO: 3064643 - RNA, 15 nt, Mycobacterium bovis subsp bovis AF2122/97
gccagcugacacccg

SEQ ID NO: 3064644 - RNA, 19 nt, Mycobacterium bovis subsp bovis AF2122/97
gccagcugacacccgcagc

SEQ ID NO: 3064645 - RNA, 15 nt, Mycobacterium bovis subsp bovis AF2122/97
gccagcugcagcaga

SEQ ID NO: 3064646 - RNA, 20 nt, Mycobacterium bovis subsp bovis AF2122/97
gccagcugcagcagacccgg

SEQ ID NO: 3064647 - RNA, 13 nt, Mycobacterium bovis subsp bovis AF2122/97
gccagcugcgcag

SEQ ID NO: 3064648 - RNA, 14 nt, Mycobacterium bovis subsp bovis AF2122/97
gccagcugcgcagc

SEQ ID NO: 3064649 - RNA, 19 nt, Mycobacterium bovis subsp bovis AF2122/97
gccagcugcggcuccggcg

SEQ ID NO: 3064650 - RNA, 22 nt, Mycobacterium bovis subsp bovis AF2122/97
gccagcugcguggcgaaccagg

SEQ ID NO: 3064651 - RNA, 12 nt, Mycobacterium bovis subsp bovis AF2122/97
gccagcugggca

SEQ ID NO: 3064652 - RNA, 18 nt, Mycobacterium bovis subsp bovis AF2122/97
gccagcuguucgagccgc

SEQ ID NO: 3064653 - RNA, 18 nt, Mycobacterium bovis subsp bovis AF2122/97
gccagcuuagccgcagcu

SEQ ID NO: 3064654 - RNA, 21 nt, Mycobacterium bovis subsp bovis AF2122/97
gccagcuuagccgcagcuugg

SEQ ID NO: 3064655 - RNA, 23 nt, Mycobacterium bovis subsp bovis AF2122/97
gccagcuucccgguagcggcggc

SEQ ID NO: 3064656 - RNA, 22 nt, Mycobacterium bovis subsp bovis AF2122/97
gccagcuucguauggacgagga

SEQ ID NO: 3064657 - RNA, 19 nt, Mycobacterium bovis subsp bovis AF2122/97
gccagcuugcggagccgcc

SEQ ID NO: 3064658 - RNA, 22 nt, Mycobacterium bovis subsp bovis AF2122/97
gccagcuugcggagccgccgcu

SEQ ID NO: 3064659 - RNA, 20 nt, Mycobacterium bovis subsp bovis AF2122/97
gccagcuugucgggcaccgg

SEQ ID NO: 3064660 - RNA, 21 nt, Mycobacterium bovis subsp bovis AF2122/97
gccagcuugucgggcaccggu

SEQ ID NO: 3064661 - RNA, 12 nt, Mycobacterium bovis subsp bovis AF2122/97
gccaggaaccgc

SEQ ID NO: 3064662 - RNA, 16 nt, Mycobacterium bovis subsp bovis AF2122/97
gccaggaacucggccc

SEQ ID NO: 3064663 - RNA, 19 nt, Mycobacterium bovis subsp bovis AF2122/97
gccagggugcccucggccg

SEQ ID NO: 3064664 - RNA, 23 nt, Mycobacterium bovis subsp bovis AF2122/97
gccagggugcccucggccgccug

SEQ ID NO: 3064665 - RNA, 14 nt, Mycobacterium bovis subsp bovis AF2122/97
gccagggugcgccg

SEQ ID NO: 3064666 - RNA, 20 nt, Mycobacterium bovis subsp bovis AF2122/97
gccaggguguugaucucgcc

SEQ ID NO: 3064667 - RNA, 21 nt, Mycobacterium bovis subsp bovis AF2122/97
gccagguaauugccgaccgcc

SEQ ID NO: 3064668 - RNA, 19 nt, Mycobacterium bovis subsp bovis AF2122/97
gccagguacucaguguucc

SEQ ID NO: 3064669 - RNA, 18 nt, Mycobacterium bovis subsp bovis AF2122/97
gccaggucagccgcgcgg

SEQ ID NO: 3064670 - RNA, 20 nt, Mycobacterium bovis subsp bovis AF2122/97
gccaggucagcuccaucccc

SEQ ID NO: 3064671 - RNA, 14 nt, Mycobacterium bovis subsp bovis AF2122/97
gccagguccgccgg

SEQ ID NO: 3064672 - RNA, 15 nt, Mycobacterium bovis subsp bovis AF2122/97
gccaggucgacaccg

SEQ ID NO: 3064673 - RNA, 17 nt, Mycobacterium bovis subsp bovis AF2122/97
gccaggucgacaccgcg

SEQ ID NO: 3064674 - RNA, 18 nt, Mycobacterium bovis subsp bovis AF2122/97
gccaggucgacaccgcgg

SEQ ID NO: 3064675 - RNA, 15 nt, Mycobacterium bovis subsp bovis AF2122/97
gccaggucgagcacc

SEQ ID NO: 3064676 - RNA, 16 nt, Mycobacterium bovis subsp bovis AF2122/97
gccaggucgauaccgg

SEQ ID NO: 3064677 - RNA, 21 nt, Mycobacterium bovis subsp bovis AF2122/97
gccaggucgauaccggcgugc

SEQ ID NO: 3064678 - RNA, 19 nt, Mycobacterium bovis subsp bovis AF2122/97
gccaggucgcgauagccgc

SEQ ID NO: 3064679 - RNA, 20 nt, Mycobacterium bovis subsp bovis AF2122/97
gccaggucgcgauagccgcc

SEQ ID NO: 3064680 - RNA, 15 nt, Mycobacterium bovis subsp bovis AF2122/97
gccaggucggccacc

SEQ ID NO: 3064681 - RNA, 14 nt, Mycobacterium bovis subsp bovis AF2122/97
gccaggucggcgau

SEQ ID NO: 3064682 - RNA, 20 nt, Mycobacterium bovis subsp bovis AF2122/97
gccaggucggcgaugaugac

SEQ ID NO: 3064683 - RNA, 19 nt, Mycobacterium bovis subsp bovis AF2122/97
gccaggucggugggcggcg

SEQ ID NO: 3064684 - RNA, 16 nt, Mycobacterium bovis subsp bovis AF2122/97
gccaggucuccuuggg

SEQ ID NO: 3064685 - RNA, 17 nt, Mycobacterium bovis subsp bovis AF2122/97
gccaggugaugccgccg

SEQ ID NO: 3064686 - RNA, 22 nt, Mycobacterium bovis subsp bovis AF2122/97
gccaggugaugccgccgugguu

SEQ ID NO: 3064687 - RNA, 13 nt, Mycobacterium bovis subsp bovis AF2122/97
gccaggugcagca

SEQ ID NO: 3064688 - RNA, 15 nt, Mycobacterium bovis subsp bovis AF2122/97
gccaggugcagcacc

SEQ ID NO: 3064689 - RNA, 16 nt, Mycobacterium bovis subsp bovis AF2122/97
gccaggugcagcacca

SEQ ID NO: 3064690 - RNA, 15 nt, Mycobacterium bovis subsp bovis AF2122/97
gccaggugcaggcuu

SEQ ID NO: 3064691 - RNA, 19 nt, Mycobacterium bovis subsp bovis AF2122/97
gccaggugcccaagcaguc

SEQ ID NO: 3064692 - RNA, 20 nt, Mycobacterium bovis subsp bovis AF2122/97
gccaggugcccaagcagucc

SEQ ID NO: 3064693 - RNA, 16 nt, Mycobacterium bovis subsp bovis AF2122/97
gccaggugcucgucga

SEQ ID NO: 3064694 - RNA, 13 nt, Mycobacterium bovis subsp bovis AF2122/97
gccagguggccgc

SEQ ID NO: 3064695 - RNA, 14 nt, Mycobacterium bovis subsp bovis AF2122/97
gccagguggcgagc

SEQ ID NO: 3064696 - RNA, 20 nt, Mycobacterium bovis subsp bovis AF2122/97
gccaggugucgucgaucgcg

SEQ ID NO: 3064697 - RNA, 20 nt, Mycobacterium bovis subsp bovis AF2122/97
gccagguguucgccggagac

SEQ ID NO: 3064698 - RNA, 21 nt, Mycobacterium bovis subsp bovis AF2122/97
gccagguguucgccggagacc

SEQ ID NO: 3064699 - RNA, 17 nt, Mycobacterium bovis subsp bovis AF2122/97
gccagguugccgucggc

SEQ ID NO: 3064700 - RNA, 21 nt, Mycobacterium bovis subsp bovis AF2122/97
gccagguuguagacggcaccc

SEQ ID NO: 3064701 - RNA, 22 nt, Mycobacterium bovis subsp bovis AF2122/97
gccagguugugugacagcccgc

SEQ ID NO: 3064702 - RNA, 12 nt, Mycobacterium bovis subsp bovis AF2122/97
gccaguacgucg

SEQ ID NO: 3064703 - RNA, 14 nt, Mycobacterium bovis subsp bovis AF2122/97
gccaguacgucgau

SEQ ID NO: 3064704 - RNA, 19 nt, Mycobacterium bovis subsp bovis AF2122/97
gccaguagcacguugacgu

SEQ ID NO: 3064705 - RNA, 16 nt, Mycobacterium bovis subsp bovis AF2122/97
gccaguaugcggugcc

SEQ ID NO: 3064706 - RNA, 19 nt, Mycobacterium bovis subsp bovis AF2122/97
gccaguaugcggugcccgc

SEQ ID NO: 3064707 - RNA, 21 nt, Mycobacterium bovis subsp bovis AF2122/97
gccaguaugcggugcccgccc

SEQ ID NO: 3064708 - RNA, 13 nt, Mycobacterium bovis subsp bovis AF2122/97
gccaguauggccg

SEQ ID NO: 3064709 - RNA, 14 nt, Mycobacterium bovis subsp bovis AF2122/97
gccaguauggccgc

SEQ ID NO: 3064710 - RNA, 16 nt, Mycobacterium bovis subsp bovis AF2122/97
gccaguauggccgcca

SEQ ID NO: 3064711 - RNA, 21 nt, Mycobacterium bovis subsp bovis AF2122/97
gccaguauggccgccaccgcg

SEQ ID NO: 3064712 - RNA, 23 nt, Mycobacterium bovis subsp bovis AF2122/97
gccaguauggccgccaccgcgac

SEQ ID NO: 3064713 - RNA, 13 nt, Mycobacterium bovis subsp bovis AF2122/97
gccaguccagcgc

SEQ ID NO: 3064714 - RNA, 15 nt, Mycobacterium bovis subsp bovis AF2122/97
gccaguccagcgcgc

SEQ ID NO: 3064715 - RNA, 22 nt, Mycobacterium bovis subsp bovis AF2122/97
gccaguccagcgcgccacccag

SEQ ID NO: 3064716 - RNA, 23 nt, Mycobacterium bovis subsp bovis AF2122/97
gccaguccagcgcgccacccagc

SEQ ID NO: 3064717 - RNA, 13 nt, Mycobacterium bovis subsp bovis AF2122/97
gccagucccacug

SEQ ID NO: 3064718 - RNA, 14 nt, Mycobacterium bovis subsp bovis AF2122/97
gccagucccccgcu

SEQ ID NO: 3064719 - RNA, 14 nt, Mycobacterium bovis subsp bovis AF2122/97
gccagucccggcgc

SEQ ID NO: 3064720 - RNA, 20 nt, Mycobacterium bovis subsp bovis AF2122/97
gccaguccgaaagccgccga

SEQ ID NO: 3064721 - RNA, 17 nt, Mycobacterium bovis subsp bovis AF2122/97
gccaguccgaucgccga

SEQ ID NO: 3064722 - RNA, 13 nt, Mycobacterium bovis subsp bovis AF2122/97
gccaguccgcagc

SEQ ID NO: 3064723 - RNA, 14 nt, Mycobacterium bovis subsp bovis AF2122/97
gccaguccgcagcg

SEQ ID NO: 3064724 - RNA, 18 nt, Mycobacterium bovis subsp bovis AF2122/97
gccaguccgcagcgucca

SEQ ID NO: 3064725 - RNA, 21 nt, Mycobacterium bovis subsp bovis AF2122/97
gccaguccgcagcguccagcg

SEQ ID NO: 3064726 - RNA, 21 nt, Mycobacterium bovis subsp bovis AF2122/97
gccaguccggacggcagccgg

SEQ ID NO: 3064727 - RNA, 15 nt, Mycobacterium bovis subsp bovis AF2122/97
gccaguccggggaac

SEQ ID NO: 3064728 - RNA, 16 nt, Mycobacterium bovis subsp bovis AF2122/97
gccagucgaaucguca

SEQ ID NO: 3064729 - RNA, 14 nt, Mycobacterium bovis subsp bovis AF2122/97
gccagucgaucgcg

SEQ ID NO: 3064730 - RNA, 15 nt, Mycobacterium bovis subsp bovis AF2122/97
gccagucgaucgcgg

SEQ ID NO: 3064731 - RNA, 16 nt, Mycobacterium bovis subsp bovis AF2122/97
gccagucgcaggaucg

SEQ ID NO: 3064732 - RNA, 17 nt, Mycobacterium bovis subsp bovis AF2122/97
gccagucgccgaaaggg

SEQ ID NO: 3064733 - RNA, 18 nt, Mycobacterium bovis subsp bovis AF2122/97
gccagugaaaccaccggc

SEQ ID NO: 3064734 - RNA, 19 nt, Mycobacterium bovis subsp bovis AF2122/97
gccagugaaaccaccggcc

SEQ ID NO: 3064735 - RNA, 21 nt, Mycobacterium bovis subsp bovis AF2122/97
gccagugaaaccaccggccgu

SEQ ID NO: 3064736 - RNA, 17 nt, Mycobacterium bovis subsp bovis AF2122/97
gccagugaacgcgcgug

SEQ ID NO: 3064737 - RNA, 19 nt, Mycobacterium bovis subsp bovis AF2122/97
gccagugaacgcgcgugca

SEQ ID NO: 3064738 - RNA, 21 nt, Mycobacterium bovis subsp bovis AF2122/97
gccagugaacgcgcgugcagc

SEQ ID NO: 3064739 - RNA, 17 nt, Mycobacterium bovis subsp bovis AF2122/97
gccagugacucaccgug

SEQ ID NO: 3064740 - RNA, 16 nt, Mycobacterium bovis subsp bovis AF2122/97
gccagugaggaucaug

SEQ ID NO: 3064741 - RNA, 22 nt, Mycobacterium bovis subsp bovis AF2122/97
gccagugccaccugggcgggcu

SEQ ID NO: 3064742 - RNA, 15 nt, Mycobacterium bovis subsp bovis AF2122/97
gccagugccagcguc

SEQ ID NO: 3064743 - RNA, 15 nt, Mycobacterium bovis subsp bovis AF2122/97
gccagugcccgcacu

SEQ ID NO: 3064744 - RNA, 22 nt, Mycobacterium bovis subsp bovis AF2122/97
gccagugcccgcacugccgccg

SEQ ID NO: 3064745 - RNA, 18 nt, Mycobacterium bovis subsp bovis AF2122/97
gccagugcgcagaacacc

SEQ ID NO: 3064746 - RNA, 13 nt, Mycobacterium bovis subsp bovis AF2122/97
gccagugcgcgcg

SEQ ID NO: 3064747 - RNA, 16 nt, Mycobacterium bovis subsp bovis AF2122/97
gccagugcgcgcguca

SEQ ID NO: 3064748 - RNA, 21 nt, Mycobacterium bovis subsp bovis AF2122/97
gccagugcguggugggcggga

SEQ ID NO: 3064749 - RNA, 19 nt, Mycobacterium bovis subsp bovis AF2122/97
gccaucgccuccagccggc

SEQ ID NO: 3064750 - RNA, 20 nt, Mycobacterium bovis subsp bovis AF2122/97
gccaucgccuccagccggcg

SEQ ID NO: 3064751 - RNA, 21 nt, Mycobacterium bovis subsp bovis AF2122/97
gccaucgccuccagccggcga

SEQ ID NO: 3064752 - RNA, 19 nt, Mycobacterium bovis subsp bovis AF2122/97
gccaucgcgcggaccagag

SEQ ID NO: 3064753 - RNA, 15 nt, Mycobacterium bovis subsp bovis AF2122/97
gccaucggcaccagc

SEQ ID NO: 3064754 - RNA, 24 nt, Mycobacterium bovis subsp bovis AF2122/97
gccaucggcaccagcgcgcgccga

SEQ ID NO: 3064755 - RNA, 13 nt, Mycobacterium bovis subsp bovis AF2122/97
gccaucgggcgcg

SEQ ID NO: 3064756 - RNA, 19 nt, Mycobacterium bovis subsp bovis AF2122/97
gccaucgggucacccccgg

SEQ ID NO: 3064757 - RNA, 18 nt, Mycobacterium bovis subsp bovis AF2122/97
gccaucggugcgcacggc

SEQ ID NO: 3064758 - RNA, 21 nt, Mycobacterium bovis subsp bovis AF2122/97
gccaucggugcgcacggcggc

SEQ ID NO: 3064759 - RNA, 17 nt, Mycobacterium bovis subsp bovis AF2122/97
gccaucgguugacccgg

SEQ ID NO: 3064760 - RNA, 21 nt, Mycobacterium bovis subsp bovis AF2122/97
gccaucgguugacccggcagc

SEQ ID NO: 3064761 - RNA, 22 nt, Mycobacterium bovis subsp bovis AF2122/97
gccaucguccagcaggacggug

SEQ ID NO: 3064762 - RNA, 18 nt, Mycobacterium bovis subsp bovis AF2122/97
gccaucgucgaagaccuc

SEQ ID NO: 3064763 - RNA, 16 nt, Mycobacterium bovis subsp bovis AF2122/97
gccaucgucgcgccgc

SEQ ID NO: 3064764 - RNA, 19 nt, Mycobacterium bovis subsp bovis AF2122/97
gccaucgucgcgccgcgug

SEQ ID NO: 3064765 - RNA, 18 nt, Mycobacterium bovis subsp bovis AF2122/97
gccaucgucggaaugcug

SEQ ID NO: 3064766 - RNA, 19 nt, Mycobacterium bovis subsp bovis AF2122/97
gccaucgugguuuggaccg

SEQ ID NO: 3064767 - RNA, 24 nt, Mycobacterium bovis subsp bovis AF2122/97
gccaucgugguuuggaccgcugau

SEQ ID NO: 3064768 - RNA, 22 nt, Mycobacterium bovis subsp bovis AF2122/97
gccaucuacaucgucgagcgcg

SEQ ID NO: 3064769 - RNA, 17 nt, Mycobacterium bovis subsp bovis AF2122/97
gccaucucgucgauguc

SEQ ID NO: 3064770 - RNA, 17 nt, Mycobacterium bovis subsp bovis AF2122/97
gccaucucuugcaaccu

SEQ ID NO: 3064771 - RNA, 17 nt, Mycobacterium bovis subsp bovis AF2122/97
gccaucugauccggugc

SEQ ID NO: 3064772 - RNA, 18 nt, Mycobacterium bovis subsp bovis AF2122/97
gccaucugauccggugcc

SEQ ID NO: 3064773 - RNA, 13 nt, Mycobacterium bovis subsp bovis AF2122/97
gccaucugccugc

SEQ ID NO: 3064774 - RNA, 16 nt, Mycobacterium bovis subsp bovis AF2122/97
gccaucugccugccug

SEQ ID NO: 3064775 - RNA, 19 nt, Mycobacterium bovis subsp bovis AF2122/97
gccaucugccugccugcgg

SEQ ID NO: 3064776 - RNA, 17 nt, Mycobacterium bovis subsp bovis AF2122/97
gccaucugcuggcuggg

SEQ ID NO: 3064777 - RNA, 22 nt, Mycobacterium bovis subsp bovis AF2122/97
gccaucuugaguuccgcggguu

SEQ ID NO: 3064778 - RNA, 15 nt, Mycobacterium bovis subsp bovis AF2122/97
gccaugaagccgggc

SEQ ID NO: 3064779 - RNA, 17 nt, Mycobacterium bovis subsp bovis AF2122/97
gccaugaagccgggcgc

SEQ ID NO: 3064780 - RNA, 23 nt, Mycobacterium bovis subsp bovis AF2122/97
gccaugagcgcgcccaaccuggg

SEQ ID NO: 3064781 - RNA, 13 nt, Mycobacterium bovis subsp bovis AF2122/97
gccaugaucacac

SEQ ID NO: 3064782 - RNA, 16 nt, Mycobacterium bovis subsp bovis AF2122/97
gccaugaucacaccgc

SEQ ID NO: 3064783 - RNA, 20 nt, Mycobacterium bovis subsp bovis AF2122/97
gccaugccaagcuccaacca

SEQ ID NO: 3064784 - RNA, 19 nt, Mycobacterium bovis subsp bovis AF2122/97
gccaugccacaacgccucg

SEQ ID NO: 3064785 - RNA, 19 nt, Mycobacterium bovis subsp bovis AF2122/97
gccaugcccgcacgcucgg

SEQ ID NO: 3064786 - RNA, 21 nt, Mycobacterium bovis subsp bovis AF2122/97
gccaugcccgcacgcucggcg

SEQ ID NO: 3064787 - RNA, 22 nt, Mycobacterium bovis subsp bovis AF2122/97
gccaugcccgcacgcucggcgg

SEQ ID NO: 3064788 - RNA, 13 nt, Mycobacterium bovis subsp bovis AF2122/97
gccaugccgcucg

SEQ ID NO: 3064789 - RNA, 13 nt, Mycobacterium bovis subsp bovis AF2122/97
gccaugcgcacca

SEQ ID NO: 3064790 - RNA, 19 nt, Mycobacterium bovis subsp bovis AF2122/97
gccaugcgcaccaguccag

SEQ ID NO: 3064791 - RNA, 18 nt, Mycobacterium bovis subsp bovis AF2122/97
gccaugcgccaacccggc

SEQ ID NO: 3064792 - RNA, 22 nt, Mycobacterium bovis subsp bovis AF2122/97
gccaugcgggugucgggcagca

SEQ ID NO: 3064793 - RNA, 15 nt, Mycobacterium bovis subsp bovis AF2122/97
gccaugcugcccuug

SEQ ID NO: 3064794 - RNA, 13 nt, Mycobacterium bovis subsp bovis AF2122/97
gccaugcugcucg

SEQ ID NO: 3064795 - RNA, 16 nt, Mycobacterium bovis subsp bovis AF2122/97
gccaugcuggucagcg

SEQ ID NO: 3064796 - RNA, 18 nt, Mycobacterium bovis subsp bovis AF2122/97
gccaugcuggucagcggc

SEQ ID NO: 3064797 - RNA, 15 nt, Mycobacterium bovis subsp bovis AF2122/97
gccauggaucccacg

SEQ ID NO: 3064798 - RNA, 24 nt, Mycobacterium bovis subsp bovis AF2122/97
gccauggcacugccggcacgccga

SEQ ID NO: 3064799 - RNA, 16 nt, Mycobacterium bovis subsp bovis AF2122/97
gccauggcccgugcgg

SEQ ID NO: 3064800 - RNA, 16 nt, Mycobacterium bovis subsp bovis AF2122/97
gccauggcggcgccgg

SEQ ID NO: 3064801 - RNA, 11 nt, Mycobacterium bovis subsp bovis AF2122/97
gccauggucag

SEQ ID NO: 3064802 - RNA, 18 nt, Mycobacterium bovis subsp bovis AF2122/97
gccauggucgcugcguag

SEQ ID NO: 3064803 - RNA, 15 nt, Mycobacterium bovis subsp bovis AF2122/97
gccaugguguucggc

SEQ ID NO: 3064804 - RNA, 19 nt, Mycobacterium bovis subsp bovis AF2122/97
gccaugguugaugugcagg

SEQ ID NO: 3064805 - RNA, 20 nt, Mycobacterium bovis subsp bovis AF2122/97
gccauguagccguugccgcc

SEQ ID NO: 3064806 - RNA, 16 nt, Mycobacterium bovis subsp bovis AF2122/97
gccauguccaccagcg

SEQ ID NO: 3064807 - RNA, 14 nt, Mycobacterium bovis subsp bovis AF2122/97
gccaugucgauguc

SEQ ID NO: 3064808 - RNA, 15 nt, Mycobacterium bovis subsp bovis AF2122/97
gccaugucgaugucc

SEQ ID NO: 3064809 - RNA, 21 nt, Mycobacterium bovis subsp bovis AF2122/97
gccaugucuccgacauuggcc

SEQ ID NO: 3064810 - RNA, 14 nt, Mycobacterium bovis subsp bovis AF2122/97
gccauguggcgucg

SEQ ID NO: 3064811 - RNA, 15 nt, Mycobacterium bovis subsp bovis AF2122/97
gccauguggcgucgc

SEQ ID NO: 3064812 - RNA, 20 nt, Mycobacterium bovis subsp bovis AF2122/97
gccauguggcgucgcucguc

SEQ ID NO: 3064813 - RNA, 16 nt, Mycobacterium bovis subsp bovis AF2122/97
gccauguucggagcca

SEQ ID NO: 3064814 - RNA, 23 nt, Mycobacterium bovis subsp bovis AF2122/97
gccauguugaaaaggcgcuggcg

SEQ ID NO: 3064815 - RNA, 18 nt, Mycobacterium bovis subsp bovis AF2122/97
gccauuaaaaagcccagc

SEQ ID NO: 3064816 - RNA, 18 nt, Mycobacterium bovis subsp bovis AF2122/97
gccauuagcagcacccgg

SEQ ID NO: 3064817 - RNA, 19 nt, Mycobacterium bovis subsp bovis AF2122/97
gccauuccagaucaacgcg

SEQ ID NO: 3064818 - RNA, 22 nt, Mycobacterium bovis subsp bovis AF2122/97
gccauuccagaucaacgcgucg

SEQ ID NO: 3064819 - RNA, 14 nt, Mycobacterium bovis subsp bovis AF2122/97
gccauuccagccgg

SEQ ID NO: 3064820 - RNA, 15 nt, Mycobacterium bovis subsp bovis AF2122/97
gccauuccagccggu

SEQ ID NO: 3064821 - RNA, 16 nt, Mycobacterium bovis subsp bovis AF2122/97
gccauuccagccggug

SEQ ID NO: 3064822 - RNA, 20 nt, Mycobacterium bovis subsp bovis AF2122/97
gccauuccagccggugccgc

SEQ ID NO: 3064823 - RNA, 16 nt, Mycobacterium bovis subsp bovis AF2122/97
gccauucccgguggcu

SEQ ID NO: 3064824 - RNA, 19 nt, Mycobacterium bovis subsp bovis AF2122/97
gccauucgguguggccgug

SEQ ID NO: 3064825 - RNA, 18 nt, Mycobacterium bovis subsp bovis AF2122/97
gccauucuucgaucagcg

SEQ ID NO: 3064826 - RNA, 19 nt, Mycobacterium bovis subsp bovis AF2122/97
gccauucuucgaucagcgg

SEQ ID NO: 3064827 - RNA, 20 nt, Mycobacterium bovis subsp bovis AF2122/97
gccauucuuggugaucgcga

SEQ ID NO: 3064828 - RNA, 18 nt, Mycobacterium bovis subsp bovis AF2122/97
gccauugcccgggcggga

SEQ ID NO: 3064829 - RNA, 14 nt, Mycobacterium bovis subsp bovis AF2122/97
gccauugccgccgg

SEQ ID NO: 3064830 - RNA, 19 nt, Mycobacterium bovis subsp bovis AF2122/97
gccauugccgccggcgccg

SEQ ID NO: 3064831 - RNA, 20 nt, Mycobacterium bovis subsp bovis AF2122/97
gccauugccgccggcgccgc

SEQ ID NO: 3064832 - RNA, 16 nt, Mycobacterium bovis subsp bovis AF2122/97
gccauugccgccgucg

SEQ ID NO: 3064833 - RNA, 18 nt, Mycobacterium bovis subsp bovis AF2122/97
gccauugccgccgucgcc

SEQ ID NO: 3064834 - RNA, 21 nt, Mycobacterium bovis subsp bovis AF2122/97
gccauugccucccgcgccggc

SEQ ID NO: 3064835 - RNA, 20 nt, Mycobacterium bovis subsp bovis AF2122/97
gccauugccugggcgaccgg

SEQ ID NO: 3064836 - RNA, 15 nt, Mycobacterium bovis subsp bovis AF2122/97
gccauugcgggaacg

SEQ ID NO: 3064837 - RNA, 11 nt, Mycobacterium bovis subsp bovis AF2122/97
gccauuggcag

SEQ ID NO: 3064838 - RNA, 14 nt, Mycobacterium bovis subsp bovis AF2122/97
gccauuggcgccgc

SEQ ID NO: 3064839 - RNA, 17 nt, Mycobacterium bovis subsp bovis AF2122/97
gccauuggcgccgccga

SEQ ID NO: 3064840 - RNA, 18 nt, Mycobacterium bovis subsp bovis AF2122/97
gccauuggcgccgccgau

SEQ ID NO: 3064841 - RNA, 19 nt, Mycobacterium bovis subsp bovis AF2122/97
gccauuguaguacaccuug

SEQ ID NO: 3064842 - RNA, 21 nt, Mycobacterium bovis subsp bovis AF2122/97
gccauuguugggccgccagcg

SEQ ID NO: 3064843 - RNA, 14 nt, Mycobacterium bovis subsp bovis AF2122/97
gccauuucgucguc

SEQ ID NO: 3064844 - RNA, 15 nt, Mycobacterium bovis subsp bovis AF2122/97
gccauuucgucgucg

SEQ ID NO: 3064845 - RNA, 21 nt, Mycobacterium bovis subsp bovis AF2122/97
gcccaaaaagaccgccgcugg

SEQ ID NO: 3064846 - RNA, 24 nt, Mycobacterium bovis subsp bovis AF2122/97
gcccaaaaagaccgccgcuggguc

SEQ ID NO: 3064847 - RNA, 14 nt, Mycobacterium bovis subsp bovis AF2122/97
gcccaaaaccgcga

SEQ ID NO: 3064848 - RNA, 15 nt, Mycobacterium bovis subsp bovis AF2122/97
gcccaaaaccgcgaa

SEQ ID NO: 3064849 - RNA, 16 nt, Mycobacterium bovis subsp bovis AF2122/97
gcccaaaagcgcggca

SEQ ID NO: 3064850 - RNA, 17 nt, Mycobacterium bovis subsp bovis AF2122/97
gcccaaaaggaagaccu

SEQ ID NO: 3064851 - RNA, 18 nt, Mycobacterium bovis subsp bovis AF2122/97
gcccaaagcgccagcagc

SEQ ID NO: 3064852 - RNA, 23 nt, Mycobacterium bovis subsp bovis AF2122/97
gcccaaaggcuguaacacccggc

SEQ ID NO: 3064853 - RNA, 17 nt, Mycobacterium bovis subsp bovis AF2122/97
gcccaaaucccagagca

SEQ ID NO: 3064854 - RNA, 18 nt, Mycobacterium bovis subsp bovis AF2122/97
gcccaacaacgcuucggc

SEQ ID NO: 3064855 - RNA, 22 nt, Mycobacterium bovis subsp bovis AF2122/97
gcccaacacccacugcacggag

SEQ ID NO: 3064856 - RNA, 17 nt, Mycobacterium bovis subsp bovis AF2122/97
gcccaacagcaacccgc

SEQ ID NO: 3064857 - RNA, 18 nt, Mycobacterium bovis subsp bovis AF2122/97
gcccaacagcaacccgcc

SEQ ID NO: 3064858 - RNA, 19 nt, Mycobacterium bovis subsp bovis AF2122/97
gcccaacagcaacccgccg

SEQ ID NO: 3064859 - RNA, 20 nt, Mycobacterium bovis subsp bovis AF2122/97
gcccaacagcaacccgccgu

SEQ ID NO: 3064860 - RNA, 15 nt, Mycobacterium bovis subsp bovis AF2122/97
gcccaacaggcggga

SEQ ID NO: 3064861 - RNA, 23 nt, Mycobacterium bovis subsp bovis AF2122/97
gcccaacaggcgggacaaccggg

SEQ ID NO: 3064862 - RNA, 19 nt, Mycobacterium bovis subsp bovis AF2122/97
gcccaacccacucgcagca

SEQ ID NO: 3064863 - RNA, 21 nt, Mycobacterium bovis subsp bovis AF2122/97
gcccaacccacucgcagcagc

SEQ ID NO: 3064864 - RNA, 23 nt, Mycobacterium bovis subsp bovis AF2122/97
gcccaacccauaucgauaaccgc

SEQ ID NO: 3064865 - RNA, 13 nt, Mycobacterium bovis subsp bovis AF2122/97
gcccaaccuggga

SEQ ID NO: 3064866 - RNA, 16 nt, Mycobacterium bovis subsp bovis AF2122/97
gcccaacgcgagcuug

SEQ ID NO: 3064867 - RNA, 23 nt, Mycobacterium bovis subsp bovis AF2122/97
gcccaacgcgauguccagguggc

SEQ ID NO: 3064868 - RNA, 17 nt, Mycobacterium bovis subsp bovis AF2122/97
gcccaacggaagaccgc

SEQ ID NO: 3064869 - RNA, 22 nt, Mycobacterium bovis subsp bovis AF2122/97
gcccaacggaagaccgcgggac

SEQ ID NO: 3064870 - RNA, 12 nt, Mycobacterium bovis subsp bovis AF2122/97
gcccaacgucgc

SEQ ID NO: 3064871 - RNA, 15 nt, Mycobacterium bovis subsp bovis AF2122/97
gcccaacgucgccag

SEQ ID NO: 3064872 - RNA, 17 nt, Mycobacterium bovis subsp bovis AF2122/97
gcccaacgucgccaggu

SEQ ID NO: 3064873 - RNA, 20 nt, Mycobacterium bovis subsp bovis AF2122/97
gcccaacucccagaacgccg

SEQ ID NO: 3064874 - RNA, 17 nt, Mycobacterium bovis subsp bovis AF2122/97
gcccaacucggccagcu

SEQ ID NO: 3064875 - RNA, 18 nt, Mycobacterium bovis subsp bovis AF2122/97
gcccaacucggccagcuu

SEQ ID NO: 3064876 - RNA, 14 nt, Mycobacterium bovis subsp bovis AF2122/97
gcccaagaucucgc

SEQ ID NO: 3064877 - RNA, 18 nt, Mycobacterium bovis subsp bovis AF2122/97
gcccaagaucucgcgggc

SEQ ID NO: 3064878 - RNA, 22 nt, Mycobacterium bovis subsp bovis AF2122/97
gcccaagcaguccacgagcacg

SEQ ID NO: 3064879 - RNA, 17 nt, Mycobacterium bovis subsp bovis AF2122/97
gcccaagcccucgacgu

SEQ ID NO: 3064880 - RNA, 14 nt, Mycobacterium bovis subsp bovis AF2122/97
gcccaagccgccgg

SEQ ID NO: 3064881 - RNA, 15 nt, Mycobacterium bovis subsp bovis AF2122/97
gcccaagccgccggc

SEQ ID NO: 3064882 - RNA, 19 nt, Mycobacterium bovis subsp bovis AF2122/97
gcccaagccgccggcgcca

SEQ ID NO: 3064883 - RNA, 17 nt, Mycobacterium bovis subsp bovis AF2122/97
gcccaagcucagggugg

SEQ ID NO: 3064884 - RNA, 18 nt, Mycobacterium bovis subsp bovis AF2122/97
gcccaagguggcggccag

SEQ ID NO: 3064885 - RNA, 22 nt, Mycobacterium bovis subsp bovis AF2122/97
gcccaauccgcaacagcucggc

SEQ ID NO: 3064886 - RNA, 12 nt, Mycobacterium bovis subsp bovis AF2122/97
gcccaauucgac

SEQ ID NO: 3064887 - RNA, 17 nt, Mycobacterium bovis subsp bovis AF2122/97
gcccaauugcgccgagc

SEQ ID NO: 3064888 - RNA, 20 nt, Mycobacterium bovis subsp bovis AF2122/97
gcccacaaauauccugcggu

SEQ ID NO: 3064889 - RNA, 18 nt, Mycobacterium bovis subsp bovis AF2122/97
gcccacaaugacucggcc

SEQ ID NO: 3064890 - RNA, 19 nt, Mycobacterium bovis subsp bovis AF2122/97
gcccacaaugacucggccg

SEQ ID NO: 3064891 - RNA, 15 nt, Mycobacterium bovis subsp bovis AF2122/97
gcccacaccagcgca

SEQ ID NO: 3064892 - RNA, 21 nt, Mycobacterium bovis subsp bovis AF2122/97
gcccacaccagcgcagcauug

SEQ ID NO: 3064893 - RNA, 15 nt, Mycobacterium bovis subsp bovis AF2122/97
gcccacacgcucacg

SEQ ID NO: 3064894 - RNA, 19 nt, Mycobacterium bovis subsp bovis AF2122/97
gcccacacgcucacgggcu

SEQ ID NO: 3064895 - RNA, 22 nt, Mycobacterium bovis subsp bovis AF2122/97
gcccacacggucgucgcgagcg

SEQ ID NO: 3064896 - RNA, 20 nt, Mycobacterium bovis subsp bovis AF2122/97
gcccacacuaggccccacca

SEQ ID NO: 3064897 - RNA, 18 nt, Mycobacterium bovis subsp bovis AF2122/97
gcccacagcugacgagcc

SEQ ID NO: 3064898 - RNA, 22 nt, Mycobacterium bovis subsp bovis AF2122/97
gcccacagcugacgagccggug

SEQ ID NO: 3064899 - RNA, 17 nt, Mycobacterium bovis subsp bovis AF2122/97
gcccacagcuugcccga

SEQ ID NO: 3064900 - RNA, 16 nt, Mycobacterium bovis subsp bovis AF2122/97
gcccacaggcggcgcu

SEQ ID NO: 3064901 - RNA, 19 nt, Mycobacterium bovis subsp bovis AF2122/97
gcccacaggggcagcgcgg

SEQ ID NO: 3064902 - RNA, 18 nt, Mycobacterium bovis subsp bovis AF2122/97
gcccacauacagcggagg

SEQ ID NO: 3064903 - RNA, 22 nt, Mycobacterium bovis subsp bovis AF2122/97
gcccacaucgucggcgggcggc

SEQ ID NO: 3064904 - RNA, 17 nt, Mycobacterium bovis subsp bovis AF2122/97
gcccacaugcgcucgcg

SEQ ID NO: 3064905 - RNA, 15 nt, Mycobacterium bovis subsp bovis AF2122/97
gcccacaugcucagg

SEQ ID NO: 3064906 - RNA, 17 nt, Mycobacterium bovis subsp bovis AF2122/97
gcccaccacacagccgc

SEQ ID NO: 3064907 - RNA, 19 nt, Mycobacterium bovis subsp bovis AF2122/97
gcccaccacacagccgcgc

SEQ ID NO: 3064908 - RNA, 14 nt, Mycobacterium bovis subsp bovis AF2122/97
gcccaccaccgaca

SEQ ID NO: 3064909 - RNA, 22 nt, Mycobacterium bovis subsp bovis AF2122/97
gcccaccaccgacagcacccgg

SEQ ID NO: 3064910 - RNA, 21 nt, Mycobacterium bovis subsp bovis AF2122/97
gcccaccacgaacacguucgg

SEQ ID NO: 3064911 - RNA, 22 nt, Mycobacterium bovis subsp bovis AF2122/97
gcccaccacgaacacguucggg

SEQ ID NO: 3064912 - RNA, 19 nt, Mycobacterium bovis subsp bovis AF2122/97
gcccaccacgcgacgcggg

SEQ ID NO: 3064913 - RNA, 21 nt, Mycobacterium bovis subsp bovis AF2122/97
gcccaccacgcgacgcggggc

SEQ ID NO: 3064914 - RNA, 12 nt, Mycobacterium bovis subsp bovis AF2122/97
gcccaccacugu

SEQ ID NO: 3064915 - RNA, 20 nt, Mycobacterium bovis subsp bovis AF2122/97
gcccaccacugugacacccg

SEQ ID NO: 3064916 - RNA, 14 nt, Mycobacterium bovis subsp bovis AF2122/97
gcccaccagcgcag

SEQ ID NO: 3064917 - RNA, 15 nt, Mycobacterium bovis subsp bovis AF2122/97
gcccaccagcgcagc

SEQ ID NO: 3064918 - RNA, 23 nt, Mycobacterium bovis subsp bovis AF2122/97
gcccaccagcgcagccgaucguc

SEQ ID NO: 3064919 - RNA, 13 nt, Mycobacterium bovis subsp bovis AF2122/97
gcccaccagcggc

SEQ ID NO: 3064920 - RNA, 16 nt, Mycobacterium bovis subsp bovis AF2122/97
gcccaccagcggcggc

SEQ ID NO: 3064921 - RNA, 14 nt, Mycobacterium bovis subsp bovis AF2122/97
gcccagccgcagca

SEQ ID NO: 3064922 - RNA, 16 nt, Mycobacterium bovis subsp bovis AF2122/97
gcccagccgcagcacc

SEQ ID NO: 3064923 - RNA, 15 nt, Mycobacterium bovis subsp bovis AF2122/97
gcccagccgccagcc

SEQ ID NO: 3064924 - RNA, 14 nt, Mycobacterium bovis subsp bovis AF2122/97
gcccagccgcgggc

SEQ ID NO: 3064925 - RNA, 15 nt, Mycobacterium bovis subsp bovis AF2122/97
gcccagccgcgggcc

SEQ ID NO: 3064926 - RNA, 16 nt, Mycobacterium bovis subsp bovis AF2122/97
gcccagccgcgggccg

SEQ ID NO: 3064927 - RNA, 16 nt, Mycobacterium bovis subsp bovis AF2122/97
gcccagccggaccgcg

SEQ ID NO: 3064928 - RNA, 24 nt, Mycobacterium bovis subsp bovis AF2122/97
gcccagccggaccgcgacggcgcc

SEQ ID NO: 3064929 - RNA, 14 nt, Mycobacterium bovis subsp bovis AF2122/97
gcccagccgggcac

SEQ ID NO: 3064930 - RNA, 19 nt, Mycobacterium bovis subsp bovis AF2122/97
gcccagcgacaacaccacg

SEQ ID NO: 3064931 - RNA, 22 nt, Mycobacterium bovis subsp bovis AF2122/97
gcccagcgacccggccagcggc

SEQ ID NO: 3064932 - RNA, 21 nt, Mycobacterium bovis subsp bovis AF2122/97
gcccagcgaugcgcucacugc

SEQ ID NO: 3064933 - RNA, 18 nt, Mycobacterium bovis subsp bovis AF2122/97
gcccagcgcccgcgcggc

SEQ ID NO: 3064934 - RNA, 19 nt, Mycobacterium bovis subsp bovis AF2122/97
gcccagcgcccgcgcggcc

SEQ ID NO: 3064935 - RNA, 13 nt, Mycobacterium bovis subsp bovis AF2122/97
gcccagcgccgaa

SEQ ID NO: 3064936 - RNA, 16 nt, Mycobacterium bovis subsp bovis AF2122/97
gcccagcgccgaauuc

SEQ ID NO: 3064937 - RNA, 14 nt, Mycobacterium bovis subsp bovis AF2122/97
gcccagcgccucca

SEQ ID NO: 3064938 - RNA, 17 nt, Mycobacterium bovis subsp bovis AF2122/97
gcccagcgccuccagca

SEQ ID NO: 3064939 - RNA, 20 nt, Mycobacterium bovis subsp bovis AF2122/97
gcccagcgccuccagcacca

SEQ ID NO: 3064940 - RNA, 16 nt, Mycobacterium bovis subsp bovis AF2122/97
gcccagcgcgccagcu

SEQ ID NO: 3064941 - RNA, 13 nt, Mycobacterium bovis subsp bovis AF2122/97
gcccagcgcgcgc

SEQ ID NO: 3064942 - RNA, 15 nt, Mycobacterium bovis subsp bovis AF2122/97
gcccagcgcuagccg

SEQ ID NO: 3064943 - RNA, 14 nt, Mycobacterium bovis subsp bovis AF2122/97
gcccagcggaauca

SEQ ID NO: 3064944 - RNA, 19 nt, Mycobacterium bovis subsp bovis AF2122/97
gcccagcggaaucaccgaa

SEQ ID NO: 3064945 - RNA, 13 nt, Mycobacterium bovis subsp bovis AF2122/97
gcccagcggaucg

SEQ ID NO: 3064946 - RNA, 14 nt, Mycobacterium bovis subsp bovis AF2122/97
gcccagcggccgcg

SEQ ID NO: 3064947 - RNA, 15 nt, Mycobacterium bovis subsp bovis AF2122/97
gcccagcggccgcga

SEQ ID NO: 3064948 - RNA, 16 nt, Mycobacterium bovis subsp bovis AF2122/97
gcccagcggccgcgau

SEQ ID NO: 3064949 - RNA, 18 nt, Mycobacterium bovis subsp bovis AF2122/97
gcccagcgucaucccgau

SEQ ID NO: 3064950 - RNA, 21 nt, Mycobacterium bovis subsp bovis AF2122/97
gcccagcgugauuucaacguc

SEQ ID NO: 3064951 - RNA, 14 nt, Mycobacterium bovis subsp bovis AF2122/97
gcccagcguggcug

SEQ ID NO: 3064952 - RNA, 15 nt, Mycobacterium bovis subsp bovis AF2122/97
gcccagcucgauacc

SEQ ID NO: 3064953 - RNA, 16 nt, Mycobacterium bovis subsp bovis AF2122/97
gcccagcucgucgagc

SEQ ID NO: 3064954 - RNA, 18 nt, Mycobacterium bovis subsp bovis AF2122/97
gcccagcucgucgagcug

SEQ ID NO: 3064955 - RNA, 17 nt, Mycobacterium bovis subsp bovis AF2122/97
gcccaggacagcagccg

SEQ ID NO: 3064956 - RNA, 19 nt, Mycobacterium bovis subsp bovis AF2122/97
gcccaggacagcagccgcc

SEQ ID NO: 3064957 - RNA, 23 nt, Mycobacterium bovis subsp bovis AF2122/97
gcccaggacagcagccgccggcc

SEQ ID NO: 3064958 - RNA, 21 nt, Mycobacterium bovis subsp bovis AF2122/97
gcccaggacggcuaccaccgc

SEQ ID NO: 3064959 - RNA, 18 nt, Mycobacterium bovis subsp bovis AF2122/97
gcccaggcaaaccgauca

SEQ ID NO: 3064960 - RNA, 16 nt, Mycobacterium bovis subsp bovis AF2122/97
gcccaggcauggccug

SEQ ID NO: 3064961 - RNA, 17 nt, Mycobacterium bovis subsp bovis AF2122/97
gcccaggcauggccugg

SEQ ID NO: 3064962 - RNA, 14 nt, Mycobacterium bovis subsp bovis AF2122/97
gcccaggccaccgg

SEQ ID NO: 3064963 - RNA, 19 nt, Mycobacterium bovis subsp bovis AF2122/97
gcccaggccaccggcugca

SEQ ID NO: 3064964 - RNA, 23 nt, Mycobacterium bovis subsp bovis AF2122/97
gcccaggccaccggcugcaacca

SEQ ID NO: 3064965 - RNA, 15 nt, Mycobacterium bovis subsp bovis AF2122/97
gcccaggccgaucag

SEQ ID NO: 3064966 - RNA, 23 nt, Mycobacterium bovis subsp bovis AF2122/97
gcccaggccgaucagcgcggcgc

SEQ ID NO: 3064967 - RNA, 17 nt, Mycobacterium bovis subsp bovis AF2122/97
gcccaggcgaccgcuga

SEQ ID NO: 3064968 - RNA, 22 nt, Mycobacterium bovis subsp bovis AF2122/97
gcccaggcgaucgcccggcccc

SEQ ID NO: 3064969 - RNA, 17 nt, Mycobacterium bovis subsp bovis AF2122/97
gcccaggcguccaucag

SEQ ID NO: 3064970 - RNA, 19 nt, Mycobacterium bovis subsp bovis AF2122/97
gcccaggcgugucgucgcg

SEQ ID NO: 3064971 - RNA, 17 nt, Mycobacterium bovis subsp bovis AF2122/97
gcccagggcgaucugcg

SEQ ID NO: 3064972 - RNA, 18 nt, Mycobacterium bovis subsp bovis AF2122/97
gcccagggcgucggcgac

SEQ ID NO: 3064973 - RNA, 21 nt, Mycobacterium bovis subsp bovis AF2122/97
gcccaggguguccgucgaacc

SEQ ID NO: 3064974 - RNA, 15 nt, Mycobacterium bovis subsp bovis AF2122/97
gcccagguccgcgug

SEQ ID NO: 3064975 - RNA, 17 nt, Mycobacterium bovis subsp bovis AF2122/97
gcccaggugacgcccgc

SEQ ID NO: 3064976 - RNA, 18 nt, Mycobacterium bovis subsp bovis AF2122/97
gcccaggugacgcccgcu

SEQ ID NO: 3064977 - RNA, 16 nt, Mycobacterium bovis subsp bovis AF2122/97
gcccaggugaucgcga

SEQ ID NO: 3064978 - RNA, 18 nt, Mycobacterium bovis subsp bovis AF2122/97
gcccaggugcguccaggc

SEQ ID NO: 3064979 - RNA, 15 nt, Mycobacterium bovis subsp bovis AF2122/97
gcccaggugggccga

SEQ ID NO: 3064980 - RNA, 23 nt, Mycobacterium bovis subsp bovis AF2122/97
gcccaggugggccgagagcagcc

SEQ ID NO: 3064981 - RNA, 16 nt, Mycobacterium bovis subsp bovis AF2122/97
gcccagguguguggcg

SEQ ID NO: 3064982 - RNA, 18 nt, Mycobacterium bovis subsp bovis AF2122/97
gcccagguguguggcggc

SEQ ID NO: 3064983 - RNA, 18 nt, Mycobacterium bovis subsp bovis AF2122/97
gcccagguugauccagug

SEQ ID NO: 3064984 - RNA, 22 nt, Mycobacterium bovis subsp bovis AF2122/97
gcccagguugauccagugcugg

SEQ ID NO: 3064985 - RNA, 14 nt, Mycobacterium bovis subsp bovis AF2122/97
gcccagguugccaa

SEQ ID NO: 3064986 - RNA, 15 nt, Mycobacterium bovis subsp bovis AF2122/97
gcccagguugccaac

SEQ ID NO: 3064987 - RNA, 15 nt, Mycobacterium bovis subsp bovis AF2122/97
gcccagguugccuug

SEQ ID NO: 3064988 - RNA, 19 nt, Mycobacterium bovis subsp bovis AF2122/97
gcccagguugccuuggcgg

SEQ ID NO: 3064989 - RNA, 23 nt, Mycobacterium bovis subsp bovis AF2122/97
gcccagguugccuuggcggccaa

SEQ ID NO: 3064990 - RNA, 20 nt, Mycobacterium bovis subsp bovis AF2122/97
gcccaguaagccacgggcac

SEQ ID NO: 3064991 - RNA, 23 nt, Mycobacterium bovis subsp bovis AF2122/97
gcccaguacggugguaagacgcc

SEQ ID NO: 3064992 - RNA, 20 nt, Mycobacterium bovis subsp bovis AF2122/97
gcccaguacguugguguccc

SEQ ID NO: 3064993 - RNA, 15 nt, Mycobacterium bovis subsp bovis AF2122/97
gcccaguagaucgcg

SEQ ID NO: 3064994 - RNA, 16 nt, Mycobacterium bovis subsp bovis AF2122/97
gcccagugccagaacc

SEQ ID NO: 3064995 - RNA, 22 nt, Mycobacterium bovis subsp bovis AF2122/97
gcccagugcgcaacccagccgc

SEQ ID NO: 3064996 - RNA, 15 nt, Mycobacterium bovis subsp bovis AF2122/97
gcccaguuccgcugc

SEQ ID NO: 3064997 - RNA, 13 nt, Mycobacterium bovis subsp bovis AF2122/97
gcccaguucugca

SEQ ID NO: 3064998 - RNA, 14 nt, Mycobacterium bovis subsp bovis AF2122/97
gcccaguugggccu

SEQ ID NO: 3064999 - RNA, 18 nt, Mycobacterium bovis subsp bovis AF2122/97
gcccaguugggccucagc

SEQ ID NO: 3065000 - RNA, 20 nt, Mycobacterium bovis subsp bovis AF2122/97
gcccauaacagcuggcggca

SEQ ID NO: 3065001 - RNA, 22 nt, Mycobacterium bovis subsp bovis AF2122/97
gcccauaacagcuggcggcagc

SEQ ID NO: 3065002 - RNA, 22 nt, Mycobacterium bovis subsp bovis AF2122/97
gcccauaccgaugguggugcca

SEQ ID NO: 3065003 - RNA, 14 nt, Mycobacterium bovis subsp bovis AF2122/97
gcccauagcaccuc

SEQ ID NO: 3065004 - RNA, 15 nt, Mycobacterium bovis subsp bovis AF2122/97
gcccauagcugccgg

SEQ ID NO: 3065005 - RNA, 13 nt, Mycobacterium bovis subsp bovis AF2122/97
gcccaucacaccc

SEQ ID NO: 3065006 - RNA, 15 nt, Mycobacterium bovis subsp bovis AF2122/97
gcccaucacacccgg

SEQ ID NO: 3065007 - RNA, 16 nt, Mycobacterium bovis subsp bovis AF2122/97
gcccaucccggccgag

SEQ ID NO: 3065008 - RNA, 17 nt, Mycobacterium bovis subsp bovis AF2122/97
gcccccauugccgccgu

SEQ ID NO: 3065009 - RNA, 20 nt, Mycobacterium bovis subsp bovis AF2122/97
gcccccauugccgccgucgc

SEQ ID NO: 3065010 - RNA, 20 nt, Mycobacterium bovis subsp bovis AF2122/97
gcccccauuucggcacgaaa

SEQ ID NO: 3065011 - RNA, 23 nt, Mycobacterium bovis subsp bovis AF2122/97
gccccccagacaauccgccgccg

SEQ ID NO: 3065012 - RNA, 23 nt, Mycobacterium bovis subsp bovis AF2122/97
gccccccagugcagacaggcggc

SEQ ID NO: 3065013 - RNA, 12 nt, Mycobacterium bovis subsp bovis AF2122/97
gccccccgcgcc

SEQ ID NO: 3065014 - RNA, 12 nt, Mycobacterium bovis subsp bovis AF2122/97
gccccccggcga

SEQ ID NO: 3065015 - RNA, 14 nt, Mycobacterium bovis subsp bovis AF2122/97
gccccccggcgacg

SEQ ID NO: 3065016 - RNA, 14 nt, Mycobacterium bovis subsp bovis AF2122/97
gccccccggggccg

SEQ ID NO: 3065017 - RNA, 18 nt, Mycobacterium bovis subsp bovis AF2122/97
gccccccggggccgcaac

SEQ ID NO: 3065018 - RNA, 17 nt, Mycobacterium bovis subsp bovis AF2122/97
gcccccgacacgccgug

SEQ ID NO: 3065019 - RNA, 17 nt, Mycobacterium bovis subsp bovis AF2122/97
gcccccgacguugcugg

SEQ ID NO: 3065020 - RNA, 15 nt, Mycobacterium bovis subsp bovis AF2122/97
gcccccgacuccggc

SEQ ID NO: 3065021 - RNA, 21 nt, Mycobacterium bovis subsp bovis AF2122/97
gcccccgacuccggcaggccc

SEQ ID NO: 3065022 - RNA, 17 nt, Mycobacterium bovis subsp bovis AF2122/97
gcccccgcacgcucggc

SEQ ID NO: 3065023 - RNA, 18 nt, Mycobacterium bovis subsp bovis AF2122/97
gcccccgcacgcucggcg

SEQ ID NO: 3065024 - RNA, 16 nt, Mycobacterium bovis subsp bovis AF2122/97
gcccccgccacgccga

SEQ ID NO: 3065025 - RNA, 17 nt, Mycobacterium bovis subsp bovis AF2122/97
gcccccgccauugccgc

SEQ ID NO: 3065026 - RNA, 20 nt, Mycobacterium bovis subsp bovis AF2122/97
gcccccgccauugccgccgg

SEQ ID NO: 3065027 - RNA, 23 nt, Mycobacterium bovis subsp bovis AF2122/97
gcccccgccauugccgccggcgc

SEQ ID NO: 3065028 - RNA, 23 nt, Mycobacterium bovis subsp bovis AF2122/97
gcccccgccggccgcgccggccc

SEQ ID NO: 3065029 - RNA, 20 nt, Mycobacterium bovis subsp bovis AF2122/97
gcccccgcgggggcggccgg

SEQ ID NO: 3065030 - RNA, 22 nt, Mycobacterium bovis subsp bovis AF2122/97
gcccccgcgggggcggccggcg

SEQ ID NO: 3065031 - RNA, 17 nt, Mycobacterium bovis subsp bovis AF2122/97
gcccccggauccgucgc

SEQ ID NO: 3065032 - RNA, 16 nt, Mycobacterium bovis subsp bovis AF2122/97
gcccccggcagcaucg

SEQ ID NO: 3065033 - RNA, 15 nt, Mycobacterium bovis subsp bovis AF2122/97
gcccccggcgcggcg

SEQ ID NO: 3065034 - RNA, 19 nt, Mycobacterium bovis subsp bovis AF2122/97
gcccccggcuuuuccggca

SEQ ID NO: 3065035 - RNA, 18 nt, Mycobacterium bovis subsp bovis AF2122/97
gcccccggucgagcucga

SEQ ID NO: 3065036 - RNA, 15 nt, Mycobacterium bovis subsp bovis AF2122/97
gcccccggugccgcc

SEQ ID NO: 3065037 - RNA, 16 nt, Mycobacterium bovis subsp bovis AF2122/97
gcccccggugccgccc

SEQ ID NO: 3065038 - RNA, 14 nt, Mycobacterium bovis subsp bovis AF2122/97
gcccccggugccgu

SEQ ID NO: 3065039 - RNA, 20 nt, Mycobacterium bovis subsp bovis AF2122/97
gcccccguagaugguggugg

SEQ ID NO: 3065040 - RNA, 21 nt, Mycobacterium bovis subsp bovis AF2122/97
gcccccguucuggaaccccga

SEQ ID NO: 3065041 - RNA, 20 nt, Mycobacterium bovis subsp bovis AF2122/97
gcccccguuuacggcccggc

SEQ ID NO: 3065042 - RNA, 17 nt, Mycobacterium bovis subsp bovis AF2122/97
gcccccuaaaccggcag

SEQ ID NO: 3065043 - RNA, 16 nt, Mycobacterium bovis subsp bovis AF2122/97
gcccccucggcgugau

SEQ ID NO: 3065044 - RNA, 18 nt, Mycobacterium bovis subsp bovis AF2122/97
gcccccucuagcgccucg

SEQ ID NO: 3065045 - RNA, 23 nt, Mycobacterium bovis subsp bovis AF2122/97
gccccgaaacgauggccgggucg

SEQ ID NO: 3065046 - RNA, 18 nt, Mycobacterium bovis subsp bovis AF2122/97
gccccgaagccggugccg

SEQ ID NO: 3065047 - RNA, 21 nt, Mycobacterium bovis subsp bovis AF2122/97
gccccgaauguugcgaucugc

SEQ ID NO: 3065048 - RNA, 22 nt, Mycobacterium bovis subsp bovis AF2122/97
gccccgaauguugcgaucugcg

SEQ ID NO: 3065049 - RNA, 17 nt, Mycobacterium bovis subsp bovis AF2122/97
gccccgacauacgucgg

SEQ ID NO: 3065050 - RNA, 21 nt, Mycobacterium bovis subsp bovis AF2122/97
gccccgacauacgucggggcc

SEQ ID NO: 3065051 - RNA, 22 nt, Mycobacterium bovis subsp bovis AF2122/97
gccccgacauacgucggggccg

SEQ ID NO: 3065052 - RNA, 14 nt, Mycobacterium bovis subsp bovis AF2122/97
gccccgaccagcag

SEQ ID NO: 3065053 - RNA, 16 nt, Mycobacterium bovis subsp bovis AF2122/97
gccccgaccagcagac

SEQ ID NO: 3065054 - RNA, 22 nt, Mycobacterium bovis subsp bovis AF2122/97
gccccgaccagcagaccaagcc

SEQ ID NO: 3065055 - RNA, 16 nt, Mycobacterium bovis subsp bovis AF2122/97
gccccgacggucaacg

SEQ ID NO: 3065056 - RNA, 18 nt, Mycobacterium bovis subsp bovis AF2122/97
gccccgacggucaacgac

SEQ ID NO: 3065057 - RNA, 16 nt, Mycobacterium bovis subsp bovis AF2122/97
gccccgacugccgcgg

SEQ ID NO: 3065058 - RNA, 17 nt, Mycobacterium bovis subsp bovis AF2122/97
gccccgacugccgcggg

SEQ ID NO: 3065059 - RNA, 21 nt, Mycobacterium bovis subsp bovis AF2122/97
gccccgacugccgcgggcagc

SEQ ID NO: 3065060 - RNA, 18 nt, Mycobacterium bovis subsp bovis AF2122/97
gccccgagcugccgucgc

SEQ ID NO: 3065061 - RNA, 20 nt, Mycobacterium bovis subsp bovis AF2122/97
gccccgauaaaaaccacccc

SEQ ID NO: 3065062 - RNA, 22 nt, Mycobacterium bovis subsp bovis AF2122/97
gccccgauaaaaaccaccccca

SEQ ID NO: 3065063 - RNA, 19 nt, Mycobacterium bovis subsp bovis AF2122/97
gccccgcaggggguggugu

SEQ ID NO: 3065064 - RNA, 16 nt, Mycobacterium bovis subsp bovis AF2122/97
gccccgcaucgcccaa

SEQ ID NO: 3065065 - RNA, 18 nt, Mycobacterium bovis subsp bovis AF2122/97
gccccgcauugccgucgg

SEQ ID NO: 3065066 - RNA, 19 nt, Mycobacterium bovis subsp bovis AF2122/97
gccccgcauugccgucggg

SEQ ID NO: 3065067 - RNA, 18 nt, Mycobacterium bovis subsp bovis AF2122/97
gccccgccaccucgccgg

SEQ ID NO: 3065068 - RNA, 20 nt, Mycobacterium bovis subsp bovis AF2122/97
gccccgccaccucgccggcc

SEQ ID NO: 3065069 - RNA, 14 nt, Mycobacterium bovis subsp bovis AF2122/97
gccccgccagcgcc

SEQ ID NO: 3065070 - RNA, 15 nt, Mycobacterium bovis subsp bovis AF2122/97
gccccgccagcgccg

SEQ ID NO: 3065071 - RNA, 19 nt, Mycobacterium bovis subsp bovis AF2122/97
gccccgccagcgccgccgg

SEQ ID NO: 3065072 - RNA, 16 nt, Mycobacterium bovis subsp bovis AF2122/97
gccccgccagcgccgg

SEQ ID NO: 3065073 - RNA, 17 nt, Mycobacterium bovis subsp bovis AF2122/97
gccccgccagcggcagc

SEQ ID NO: 3065074 - RNA, 12 nt, Mycobacterium bovis subsp bovis AF2122/97
gccccgcccgcg

SEQ ID NO: 3065075 - RNA, 11 nt, Mycobacterium bovis subsp bovis AF2122/97
gccccgcccgg

SEQ ID NO: 3065076 - RNA, 13 nt, Mycobacterium bovis subsp bovis AF2122/97
gccccgccgagca

SEQ ID NO: 3065077 - RNA, 11 nt, Mycobacterium bovis subsp bovis AF2122/97
gccccgccgau

SEQ ID NO: 3065078 - RNA, 13 nt, Mycobacterium bovis subsp bovis AF2122/97
gccccgccgaugc

SEQ ID NO: 3065079 - RNA, 20 nt, Mycobacterium bovis subsp bovis AF2122/97
gccccgccgaugccgccggc

SEQ ID NO: 3065080 - RNA, 14 nt, Mycobacterium bovis subsp bovis AF2122/97
gccccgccgcacgc

SEQ ID NO: 3065081 - RNA, 14 nt, Mycobacterium bovis subsp bovis AF2122/97
gccccgccgccaua

SEQ ID NO: 3065082 - RNA, 14 nt, Mycobacterium bovis subsp bovis AF2122/97
gccccgccgcccuc

SEQ ID NO: 3065083 - RNA, 13 nt, Mycobacterium bovis subsp bovis AF2122/97
gccccgccggccc

SEQ ID NO: 3065084 - RNA, 16 nt, Mycobacterium bovis subsp bovis AF2122/97
gccccgccggcgccgc

SEQ ID NO: 3065085 - RNA, 13 nt, Mycobacterium bovis subsp bovis AF2122/97
gccccgccggugg

SEQ ID NO: 3065086 - RNA, 19 nt, Mycobacterium bovis subsp bovis AF2122/97
gccccgccgucacccccga

SEQ ID NO: 3065087 - RNA, 15 nt, Mycobacterium bovis subsp bovis AF2122/97
gccccgccgucgccg

SEQ ID NO: 3065088 - RNA, 15 nt, Mycobacterium bovis subsp bovis AF2122/97
gccccgccguuaccg

SEQ ID NO: 3065089 - RNA, 23 nt, Mycobacterium bovis subsp bovis AF2122/97
gccccgccguuaccgccguugcc

SEQ ID NO: 3065090 - RNA, 15 nt, Mycobacterium bovis subsp bovis AF2122/97
gccccgccguugaac

SEQ ID NO: 3065091 - RNA, 21 nt, Mycobacterium bovis subsp bovis AF2122/97
gccccgccguugaacggcacc

SEQ ID NO: 3065092 - RNA, 22 nt, Mycobacterium bovis subsp bovis AF2122/97
gccccgccguugaacggcacca

SEQ ID NO: 3065093 - RNA, 13 nt, Mycobacterium bovis subsp bovis AF2122/97
gccccgccguugc

SEQ ID NO: 3065094 - RNA, 22 nt, Mycobacterium bovis subsp bovis AF2122/97
gcccgaauucccuacgccgcca

SEQ ID NO: 3065095 - RNA, 23 nt, Mycobacterium bovis subsp bovis AF2122/97
gcccgaauucccuacgccgccag

SEQ ID NO: 3065096 - RNA, 24 nt, Mycobacterium bovis subsp bovis AF2122/97
gcccgacacccgcauggcagcggc

SEQ ID NO: 3065097 - RNA, 11 nt, Mycobacterium bovis subsp bovis AF2122/97
gcccgacaccg

SEQ ID NO: 3065098 - RNA, 21 nt, Mycobacterium bovis subsp bovis AF2122/97
gcccgacaccgccccgccgcg

SEQ ID NO: 3065099 - RNA, 12 nt, Mycobacterium bovis subsp bovis AF2122/97
gcccgacaccgu

SEQ ID NO: 3065100 - RNA, 13 nt, Mycobacterium bovis subsp bovis AF2122/97
gcccgacaccguc

SEQ ID NO: 3065101 - RNA, 20 nt, Mycobacterium bovis subsp bovis AF2122/97
gcccgacaccguccagcagc

SEQ ID NO: 3065102 - RNA, 24 nt, Mycobacterium bovis subsp bovis AF2122/97
gcccgacaccguccagcagcucgg

SEQ ID NO: 3065103 - RNA, 15 nt, Mycobacterium bovis subsp bovis AF2122/97
gcccgacacggcggc

SEQ ID NO: 3065104 - RNA, 18 nt, Mycobacterium bovis subsp bovis AF2122/97
gcccgacaguggucccgg

SEQ ID NO: 3065105 - RNA, 15 nt, Mycobacterium bovis subsp bovis AF2122/97
gcccgacccaucacc

SEQ ID NO: 3065106 - RNA, 19 nt, Mycobacterium bovis subsp bovis AF2122/97
gcccgacccaucaccagcg

SEQ ID NO: 3065107 - RNA, 22 nt, Mycobacterium bovis subsp bovis AF2122/97
gcccgacccaucaccagcggcu

SEQ ID NO: 3065108 - RNA, 12 nt, Mycobacterium bovis subsp bovis AF2122/97
gcccgacccgcc

SEQ ID NO: 3065109 - RNA, 17 nt, Mycobacterium bovis subsp bovis AF2122/97
gcccgacccgccgacgc

SEQ ID NO: 3065110 - RNA, 13 nt, Mycobacterium bovis subsp bovis AF2122/97
gcccgacccggcc

SEQ ID NO: 3065111 - RNA, 14 nt, Mycobacterium bovis subsp bovis AF2122/97
gcccgacccggccg

SEQ ID NO: 3065112 - RNA, 16 nt, Mycobacterium bovis subsp bovis AF2122/97
gcccgacccggccgau

SEQ ID NO: 3065113 - RNA, 19 nt, Mycobacterium bovis subsp bovis AF2122/97
gcccgaccgggaaccacgg

SEQ ID NO: 3065114 - RNA, 16 nt, Mycobacterium bovis subsp bovis AF2122/97
gcccgaccgguccagc

SEQ ID NO: 3065115 - RNA, 13 nt, Mycobacterium bovis subsp bovis AF2122/97
gcccgacgacgac

SEQ ID NO: 3065116 - RNA, 14 nt, Mycobacterium bovis subsp bovis AF2122/97
gcccgacgacgggg

SEQ ID NO: 3065117 - RNA, 17 nt, Mycobacterium bovis subsp bovis AF2122/97
gcccgacgaggaugucg

SEQ ID NO: 3065118 - RNA, 19 nt, Mycobacterium bovis subsp bovis AF2122/97
gcccgacgaggaugucgau

SEQ ID NO: 3065119 - RNA, 15 nt, Mycobacterium bovis subsp bovis AF2122/97
gcccgacgagucgcc

SEQ ID NO: 3065120 - RNA, 22 nt, Mycobacterium bovis subsp bovis AF2122/97
gcccgacgagucgccgcgggca

SEQ ID NO: 3065121 - RNA, 20 nt, Mycobacterium bovis subsp bovis AF2122/97
gcccgacgaugcgggcgauc

SEQ ID NO: 3065122 - RNA, 20 nt, Mycobacterium bovis subsp bovis AF2122/97
gcccgacgaugugcacggug

SEQ ID NO: 3065123 - RNA, 14 nt, Mycobacterium bovis subsp bovis AF2122/97
gcccgacgccagcu

SEQ ID NO: 3065124 - RNA, 15 nt, Mycobacterium bovis subsp bovis AF2122/97
gcccgacgccagcug

SEQ ID NO: 3065125 - RNA, 16 nt, Mycobacterium bovis subsp bovis AF2122/97
gcccgacgccagcugc

SEQ ID NO: 3065126 - RNA, 15 nt, Mycobacterium bovis subsp bovis AF2122/97
gcccgacgcgaagcu

SEQ ID NO: 3065127 - RNA, 17 nt, Mycobacterium bovis subsp bovis AF2122/97
gcccgacgcguggcauc

SEQ ID NO: 3065128 - RNA, 21 nt, Mycobacterium bovis subsp bovis AF2122/97
gcccgacggaguucgacgucg

SEQ ID NO: 3065129 - RNA, 17 nt, Mycobacterium bovis subsp bovis AF2122/97
gcccgacggcgcccagc

SEQ ID NO: 3065130 - RNA, 19 nt, Mycobacterium bovis subsp bovis AF2122/97
gcccgacggguaucccguc

SEQ ID NO: 3065131 - RNA, 15 nt, Mycobacterium bovis subsp bovis AF2122/97
gcccgacguugccga

SEQ ID NO: 3065132 - RNA, 16 nt, Mycobacterium bovis subsp bovis AF2122/97
gcccgacguugccgaa

SEQ ID NO: 3065133 - RNA, 21 nt, Mycobacterium bovis subsp bovis AF2122/97
gcccgacguugccgaagccgg

SEQ ID NO: 3065134 - RNA, 21 nt, Mycobacterium bovis subsp bovis AF2122/97
gcccgacugaacgucaccguu

SEQ ID NO: 3065135 - RNA, 16 nt, Mycobacterium bovis subsp bovis AF2122/97
gcccgacugccguuca

SEQ ID NO: 3065136 - RNA, 14 nt, Mycobacterium bovis subsp bovis AF2122/97
gcccgacuggucac

SEQ ID NO: 3065137 - RNA, 17 nt, Mycobacterium bovis subsp bovis AF2122/97
gcccgagaccgggcaac

SEQ ID NO: 3065138 - RNA, 15 nt, Mycobacterium bovis subsp bovis AF2122/97
gcccgagauccccaa

SEQ ID NO: 3065139 - RNA, 15 nt, Mycobacterium bovis subsp bovis AF2122/97
gcccgagcaccccag

SEQ ID NO: 3065140 - RNA, 14 nt, Mycobacterium bovis subsp bovis AF2122/97
gcccgagcccagcc

SEQ ID NO: 3065141 - RNA, 23 nt, Mycobacterium bovis subsp bovis AF2122/97
gcccgagcccagccgggcacccu

SEQ ID NO: 3065142 - RNA, 15 nt, Mycobacterium bovis subsp bovis AF2122/97
gcccgagcccagcgc

SEQ ID NO: 3065143 - RNA, 16 nt, Mycobacterium bovis subsp bovis AF2122/97
gcccgagcccagcgcc

SEQ ID NO: 3065144 - RNA, 17 nt, Mycobacterium bovis subsp bovis AF2122/97
gcccgagcccagcgccu

SEQ ID NO: 3065145 - RNA, 21 nt, Mycobacterium bovis subsp bovis AF2122/97
gcccgagcccagcgccuccag

SEQ ID NO: 3065146 - RNA, 16 nt, Mycobacterium bovis subsp bovis AF2122/97
gcccgagccgcguggg

SEQ ID NO: 3065147 - RNA, 15 nt, Mycobacterium bovis subsp bovis AF2122/97
gcccgagccgcugcg

SEQ ID NO: 3065148 - RNA, 13 nt, Mycobacterium bovis subsp bovis AF2122/97
gcccgagccggug

SEQ ID NO: 3065149 - RNA, 15 nt, Mycobacterium bovis subsp bovis AF2122/97
gcccgagcgcgcgcu

SEQ ID NO: 3065150 - RNA, 19 nt, Mycobacterium bovis subsp bovis AF2122/97
gcccgagcgcgcgcuguug

SEQ ID NO: 3065151 - RNA, 20 nt, Mycobacterium bovis subsp bovis AF2122/97
gcccgagcgcuugaccccgc

SEQ ID NO: 3065152 - RNA, 17 nt, Mycobacterium bovis subsp bovis AF2122/97
gcccgagcucaccgcac

SEQ ID NO: 3065153 - RNA, 12 nt, Mycobacterium bovis subsp bovis AF2122/97
gcccgagcucga

SEQ ID NO: 3065154 - RNA, 14 nt, Mycobacterium bovis subsp bovis AF2122/97
gcccgagcucgccg

SEQ ID NO: 3065155 - RNA, 17 nt, Mycobacterium bovis subsp bovis AF2122/97
gcccgaggcgagacgcu

SEQ ID NO: 3065156 - RNA, 21 nt, Mycobacterium bovis subsp bovis AF2122/97
gcccgaggcggguacaccacg

SEQ ID NO: 3065157 - RNA, 17 nt, Mycobacterium bovis subsp bovis AF2122/97
gcccgaggcucgggccg

SEQ ID NO: 3065158 - RNA, 17 nt, Mycobacterium bovis subsp bovis AF2122/97
gcccgaggugccggggc

SEQ ID NO: 3065159 - RNA, 16 nt, Mycobacterium bovis subsp bovis AF2122/97
gcccgagucucgucgg

SEQ ID NO: 3065160 - RNA, 22 nt, Mycobacterium bovis subsp bovis AF2122/97
gcccgagugugaaucgcacgac

SEQ ID NO: 3065161 - RNA, 19 nt, Mycobacterium bovis subsp bovis AF2122/97
gcccgaguuaaacgcagcg

SEQ ID NO: 3065162 - RNA, 20 nt, Mycobacterium bovis subsp bovis AF2122/97
gcccgaguuaaacgcagcgg

SEQ ID NO: 3065163 - RNA, 18 nt, Mycobacterium bovis subsp bovis AF2122/97
gcccgaguugaagaagcc

SEQ ID NO: 3065164 - RNA, 23 nt, Mycobacterium bovis subsp bovis AF2122/97
gcccgaguugaaggugccggcgu

SEQ ID NO: 3065165 - RNA, 19 nt, Mycobacterium bovis subsp bovis AF2122/97
gcccgaguuguggacgccc

SEQ ID NO: 3065166 - RNA, 23 nt, Mycobacterium bovis subsp bovis AF2122/97
gcccgaguuguggacgcccgagu

SEQ ID NO: 3065167 - RNA, 23 nt, Mycobacterium bovis subsp bovis AF2122/97
gcccgaguuguucgugccggcgu

SEQ ID NO: 3065168 - RNA, 19 nt, Mycobacterium bovis subsp bovis AF2122/97
gcccgaguuguugcugccc

SEQ ID NO: 3065169 - RNA, 16 nt, Mycobacterium bovis subsp bovis AF2122/97
gcccgaguuguuggug

SEQ ID NO: 3065170 - RNA, 18 nt, Mycobacterium bovis subsp bovis AF2122/97
gcccgaguuugaccagcc

SEQ ID NO: 3065171 - RNA, 22 nt, Mycobacterium bovis subsp bovis AF2122/97
gcccgaguuugcgauacccacc

SEQ ID NO: 3065172 - RNA, 16 nt, Mycobacterium bovis subsp bovis AF2122/97
gcccgauaaaugccgc

SEQ ID NO: 3065173 - RNA, 22 nt, Mycobacterium bovis subsp bovis AF2122/97
gcccgauaaaugccgcgugggc

SEQ ID NO: 3065174 - RNA, 18 nt, Mycobacterium bovis subsp bovis AF2122/97
gcccgauacgccaccggc

SEQ ID NO: 3065175 - RNA, 14 nt, Mycobacterium bovis subsp bovis AF2122/97
gcccgauagaucgc

SEQ ID NO: 3065176 - RNA, 17 nt, Mycobacterium bovis subsp bovis AF2122/97
gcccgaucaccagcccc

SEQ ID NO: 3065177 - RNA, 14 nt, Mycobacterium bovis subsp bovis AF2122/97
gcccgaucaccauc

SEQ ID NO: 3065178 - RNA, 16 nt, Mycobacterium bovis subsp bovis AF2122/97
gcccgaucaccaucca

SEQ ID NO: 3065179 - RNA, 19 nt, Mycobacterium bovis subsp bovis AF2122/97
gcccgaucaccauccagcc

SEQ ID NO: 3065180 - RNA, 14 nt, Mycobacterium bovis subsp bovis AF2122/97
gcccgcccagcccg

SEQ ID NO: 3065181 - RNA, 17 nt, Mycobacterium bovis subsp bovis AF2122/97
gcccgcccagcccggcg

SEQ ID NO: 3065182 - RNA, 16 nt, Mycobacterium bovis subsp bovis AF2122/97
gcccgccccgcgccuu

SEQ ID NO: 3065183 - RNA, 23 nt, Mycobacterium bovis subsp bovis AF2122/97
gcccgccccgcgccuuggcaccc

SEQ ID NO: 3065184 - RNA, 14 nt, Mycobacterium bovis subsp bovis AF2122/97
gcccgcccgagccg

SEQ ID NO: 3065185 - RNA, 18 nt, Mycobacterium bovis subsp bovis AF2122/97
gcccgcccgagccgcugc

SEQ ID NO: 3065186 - RNA, 14 nt, Mycobacterium bovis subsp bovis AF2122/97
gcccgcccggacgc

SEQ ID NO: 3065187 - RNA, 22 nt, Mycobacterium bovis subsp bovis AF2122/97
gcccgcccgucuuccagccagg

SEQ ID NO: 3065188 - RNA, 15 nt, Mycobacterium bovis subsp bovis AF2122/97
gcccgcccuggcaac

SEQ ID NO: 3065189 - RNA, 19 nt, Mycobacterium bovis subsp bovis AF2122/97
gcccgcccuugcggcguga

SEQ ID NO: 3065190 - RNA, 14 nt, Mycobacterium bovis subsp bovis AF2122/97
gcccgccgaacgug

SEQ ID NO: 3065191 - RNA, 17 nt, Mycobacterium bovis subsp bovis AF2122/97
gcccgccgacgccagau

SEQ ID NO: 3065192 - RNA, 15 nt, Mycobacterium bovis subsp bovis AF2122/97
gcccgccgccaccag

SEQ ID NO: 3065193 - RNA, 17 nt, Mycobacterium bovis subsp bovis AF2122/97
gcccgccgccaccagcu

SEQ ID NO: 3065194 - RNA, 15 nt, Mycobacterium bovis subsp bovis AF2122/97
gcccgccgcggcagc

SEQ ID NO: 3065195 - RNA, 15 nt, Mycobacterium bovis subsp bovis AF2122/97
gcccgccgcgucacc

SEQ ID NO: 3065196 - RNA, 13 nt, Mycobacterium bovis subsp bovis AF2122/97
gcccgccggaccc

SEQ ID NO: 3065197 - RNA, 21 nt, Mycobacterium bovis subsp bovis AF2122/97
gcccgccggauccgccagacc

SEQ ID NO: 3065198 - RNA, 15 nt, Mycobacterium bovis subsp bovis AF2122/97
gcccgccggcaaccg

SEQ ID NO: 3065199 - RNA, 14 nt, Mycobacterium bovis subsp bovis AF2122/97
gcccgccggccccg

SEQ ID NO: 3065200 - RNA, 15 nt, Mycobacterium bovis subsp bovis AF2122/97
gcccgccggccccgc

SEQ ID NO: 3065201 - RNA, 19 nt, Mycobacterium bovis subsp bovis AF2122/97
gcccgccggccccgccggc

SEQ ID NO: 3065202 - RNA, 20 nt, Mycobacterium bovis subsp bovis AF2122/97
gcccgccggccccgccggcc

SEQ ID NO: 3065203 - RNA, 18 nt, Mycobacterium bovis subsp bovis AF2122/97
gcccgccggcgcgagccg

SEQ ID NO: 3065204 - RNA, 14 nt, Mycobacterium bovis subsp bovis AF2122/97
gcccgccggugauc

SEQ ID NO: 3065205 - RNA, 15 nt, Mycobacterium bovis subsp bovis AF2122/97
gcccgccguagacca

SEQ ID NO: 3065206 - RNA, 13 nt, Mycobacterium bovis subsp bovis AF2122/97
gcccgccgucacc

SEQ ID NO: 3065207 - RNA, 14 nt, Mycobacterium bovis subsp bovis AF2122/97
gcccgccgucaccg

SEQ ID NO: 3065208 - RNA, 15 nt, Mycobacterium bovis subsp bovis AF2122/97
gcccgccgucaccgc

SEQ ID NO: 3065209 - RNA, 17 nt, Mycobacterium bovis subsp bovis AF2122/97
gcccgccguccggcgcc

SEQ ID NO: 3065210 - RNA, 18 nt, Mycobacterium bovis subsp bovis AF2122/97
gcccgccgucuuggcccg

SEQ ID NO: 3065211 - RNA, 14 nt, Mycobacterium bovis subsp bovis AF2122/97
gcccgccguuacgg

SEQ ID NO: 3065212 - RNA, 15 nt, Mycobacterium bovis subsp bovis AF2122/97
gcccgccucgaccgc

SEQ ID NO: 3065213 - RNA, 18 nt, Mycobacterium bovis subsp bovis AF2122/97
gcccgccucgcagcgaca

SEQ ID NO: 3065214 - RNA, 20 nt, Mycobacterium bovis subsp bovis AF2122/97
gcccgccucugucuucagcu

SEQ ID NO: 3065215 - RNA, 17 nt, Mycobacterium bovis subsp bovis AF2122/97
gcccgcgaacgaucccg

SEQ ID NO: 3065216 - RNA, 21 nt, Mycobacterium bovis subsp bovis AF2122/97
gcccgcgaacgaucccgccga

SEQ ID NO: 3065217 - RNA, 23 nt, Mycobacterium bovis subsp bovis AF2122/97
gcccgcgaacgaucccgccgauc

SEQ ID NO: 3065218 - RNA, 18 nt, Mycobacterium bovis subsp bovis AF2122/97
gcccgcgaauacgaggac

SEQ ID NO: 3065219 - RNA, 22 nt, Mycobacterium bovis subsp bovis AF2122/97
gcccgcgaauacgaggacgacg

SEQ ID NO: 3065220 - RNA, 14 nt, Mycobacterium bovis subsp bovis AF2122/97
gcccgcgacaucgg

SEQ ID NO: 3065221 - RNA, 15 nt, Mycobacterium bovis subsp bovis AF2122/97
gcccgcgaggacagc

SEQ ID NO: 3065222 - RNA, 12 nt, Mycobacterium bovis subsp bovis AF2122/97
gcccgcgaucgg

SEQ ID NO: 3065223 - RNA, 16 nt, Mycobacterium bovis subsp bovis AF2122/97
gcccgcgaucgggccg

SEQ ID NO: 3065224 - RNA, 20 nt, Mycobacterium bovis subsp bovis AF2122/97
gcccgcgcagcacugcggca

SEQ ID NO: 3065225 - RNA, 14 nt, Mycobacterium bovis subsp bovis AF2122/97
gcccgcgcagcggu

SEQ ID NO: 3065226 - RNA, 13 nt, Mycobacterium bovis subsp bovis AF2122/97
gcccgcgccacca

SEQ ID NO: 3065227 - RNA, 18 nt, Mycobacterium bovis subsp bovis AF2122/97
gcccgcgccaccagcacc

SEQ ID NO: 3065228 - RNA, 19 nt, Mycobacterium bovis subsp bovis AF2122/97
gcccgcgccaccagcaccg

SEQ ID NO: 3065229 - RNA, 13 nt, Mycobacterium bovis subsp bovis AF2122/97
gcccgcgccaccg

SEQ ID NO: 3065230 - RNA, 15 nt, Mycobacterium bovis subsp bovis AF2122/97
gcccgcgccaccggc

SEQ ID NO: 3065231 - RNA, 16 nt, Mycobacterium bovis subsp bovis AF2122/97
gcccgcgccaccggca

SEQ ID NO: 3065232 - RNA, 18 nt, Mycobacterium bovis subsp bovis AF2122/97
gcccgcgcccccggugcc

SEQ ID NO: 3065233 - RNA, 20 nt, Mycobacterium bovis subsp bovis AF2122/97
gcccgcgcccccggugccgu

SEQ ID NO: 3065234 - RNA, 13 nt, Mycobacterium bovis subsp bovis AF2122/97
gcccgcgccgccg

SEQ ID NO: 3065235 - RNA, 14 nt, Mycobacterium bovis subsp bovis AF2122/97
gcccgcgccgccgc

SEQ ID NO: 3065236 - RNA, 15 nt, Mycobacterium bovis subsp bovis AF2122/97
gcccgcgccgccgcc

SEQ ID NO: 3065237 - RNA, 16 nt, Mycobacterium bovis subsp bovis AF2122/97
gcccgcgccgccgcca

SEQ ID NO: 3065238 - RNA, 17 nt, Mycobacterium bovis subsp bovis AF2122/97
gcccgcgccgccgccac

SEQ ID NO: 3065239 - RNA, 18 nt, Mycobacterium bovis subsp bovis AF2122/97
gcccgcgccgccgccacc

SEQ ID NO: 3065240 - RNA, 19 nt, Mycobacterium bovis subsp bovis AF2122/97
gcccgcgccgccgccacca

SEQ ID NO: 3065241 - RNA, 18 nt, Mycobacterium bovis subsp bovis AF2122/97
gcccgcgccgccgcuacc

SEQ ID NO: 3065242 - RNA, 15 nt, Mycobacterium bovis subsp bovis AF2122/97
gcccgcgccgccgga

SEQ ID NO: 3065243 - RNA, 22 nt, Mycobacterium bovis subsp bovis AF2122/97
gcccgcgcggccaaucagcccg

SEQ ID NO: 3065244 - RNA, 13 nt, Mycobacterium bovis subsp bovis AF2122/97
gcccgcgcggcgc

SEQ ID NO: 3065245 - RNA, 21 nt, Mycobacterium bovis subsp bovis AF2122/97
gcccgcgcguacccgaucagc

SEQ ID NO: 3065246 - RNA, 12 nt, Mycobacterium bovis subsp bovis AF2122/97
gcccgcgcucgc

SEQ ID NO: 3065247 - RNA, 13 nt, Mycobacterium bovis subsp bovis AF2122/97
gcccgcgcucgca

SEQ ID NO: 3065248 - RNA, 15 nt, Mycobacterium bovis subsp bovis AF2122/97
gcccgcgcucgcacc

SEQ ID NO: 3065249 - RNA, 13 nt, Mycobacterium bovis subsp bovis AF2122/97
gcccgcgcugccg

SEQ ID NO: 3065250 - RNA, 16 nt, Mycobacterium bovis subsp bovis AF2122/97
gcccgcgcugccgacu

SEQ ID NO: 3065251 - RNA, 15 nt, Mycobacterium bovis subsp bovis AF2122/97
gcccgcgcuugaucc

SEQ ID NO: 3065252 - RNA, 14 nt, Mycobacterium bovis subsp bovis AF2122/97
gcccgcggccgcca

SEQ ID NO: 3065253 - RNA, 19 nt, Mycobacterium bovis subsp bovis AF2122/97
gcccgcggccgccagcgga

SEQ ID NO: 3065254 - RNA, 13 nt, Mycobacterium bovis subsp bovis AF2122/97
gcccgcgggauca

SEQ ID NO: 3065255 - RNA, 20 nt, Mycobacterium bovis subsp bovis AF2122/97
gcccgcgggcaagccggaca

SEQ ID NO: 3065256 - RNA, 21 nt, Mycobacterium bovis subsp bovis AF2122/97
gcccgcgggcaguggcagccc

SEQ ID NO: 3065257 - RNA, 17 nt, Mycobacterium bovis subsp bovis AF2122/97
gcccgcgggcgguaauc

SEQ ID NO: 3065258 - RNA, 13 nt, Mycobacterium bovis subsp bovis AF2122/97
gcccgcggucgcg

SEQ ID NO: 3065259 - RNA, 16 nt, Mycobacterium bovis subsp bovis AF2122/97
gcccgcggugaccacc

SEQ ID NO: 3065260 - RNA, 18 nt, Mycobacterium bovis subsp bovis AF2122/97
gcccgcggugacgagcac

SEQ ID NO: 3065261 - RNA, 17 nt, Mycobacterium bovis subsp bovis AF2122/97
gcccgcggugacgcaac

SEQ ID NO: 3065262 - RNA, 22 nt, Mycobacterium bovis subsp bovis AF2122/97
gcccgcgguuugcacgucacgc

SEQ ID NO: 3065263 - RNA, 23 nt, Mycobacterium bovis subsp bovis AF2122/97
gcccgcgucuacgucguccagca

SEQ ID NO: 3065264 - RNA, 13 nt, Mycobacterium bovis subsp bovis AF2122/97
gcccgcguucagg

SEQ ID NO: 3065265 - RNA, 18 nt, Mycobacterium bovis subsp bovis AF2122/97
gcccgcguucagggcacg

SEQ ID NO: 3065266 - RNA, 21 nt, Mycobacterium bovis subsp bovis AF2122/97
gcccgcguucagggcacgcug

SEQ ID NO: 3065267 - RNA, 23 nt, Mycobacterium bovis subsp bovis AF2122/97
gcccggccccgcggccagcaccg

SEQ ID NO: 3065268 - RNA, 15 nt, Mycobacterium bovis subsp bovis AF2122/97
gcccggcccgccacc

SEQ ID NO: 3065269 - RNA, 16 nt, Mycobacterium bovis subsp bovis AF2122/97
gcccggcccgccaccc

SEQ ID NO: 3065270 - RNA, 16 nt, Mycobacterium bovis subsp bovis AF2122/97
gcccggcccgcucagc

SEQ ID NO: 3065271 - RNA, 15 nt, Mycobacterium bovis subsp bovis AF2122/97
gcccggcccggcucg

SEQ ID NO: 3065272 - RNA, 16 nt, Mycobacterium bovis subsp bovis AF2122/97
gcccggccgccagcgc

SEQ ID NO: 3065273 - RNA, 18 nt, Mycobacterium bovis subsp bovis AF2122/97
gcccggccgccagcgcgc

SEQ ID NO: 3065274 - RNA, 19 nt, Mycobacterium bovis subsp bovis AF2122/97
gcccggccgccagcgcgcc

SEQ ID NO: 3065275 - RNA, 13 nt, Mycobacterium bovis subsp bovis AF2122/97
gcccggccgccga

SEQ ID NO: 3065276 - RNA, 14 nt, Mycobacterium bovis subsp bovis AF2122/97
gcccggccgccgag

SEQ ID NO: 3065277 - RNA, 15 nt, Mycobacterium bovis subsp bovis AF2122/97
gcccggccgccgagg

SEQ ID NO: 3065278 - RNA, 12 nt, Mycobacterium bovis subsp bovis AF2122/97
gcccggccgcgc

SEQ ID NO: 3065279 - RNA, 14 nt, Mycobacterium bovis subsp bovis AF2122/97
gcccggccgcgccc

SEQ ID NO: 3065280 - RNA, 15 nt, Mycobacterium bovis subsp bovis AF2122/97
gcccggccgcgcccc

SEQ ID NO: 3065281 - RNA, 14 nt, Mycobacterium bovis subsp bovis AF2122/97
gcccggccggacgg

SEQ ID NO: 3065282 - RNA, 14 nt, Mycobacterium bovis subsp bovis AF2122/97
gcccggccggucga

SEQ ID NO: 3065283 - RNA, 13 nt, Mycobacterium bovis subsp bovis AF2122/97
gcccggccucggc

SEQ ID NO: 3065284 - RNA, 18 nt, Mycobacterium bovis subsp bovis AF2122/97
gcccggccugcuggucac

SEQ ID NO: 3065285 - RNA, 16 nt, Mycobacterium bovis subsp bovis AF2122/97
gcccggccuugccgcc

SEQ ID NO: 3065286 - RNA, 18 nt, Mycobacterium bovis subsp bovis AF2122/97
gcccggccuugccgccgg

SEQ ID NO: 3065287 - RNA, 19 nt, Mycobacterium bovis subsp bovis AF2122/97
gcccggccuugccgccggc

SEQ ID NO: 3065288 - RNA, 21 nt, Mycobacterium bovis subsp bovis AF2122/97
gcccggccuugccgccggccc

SEQ ID NO: 3065289 - RNA, 20 nt, Mycobacterium bovis subsp bovis AF2122/97
gcccggccuugccgccggcg

SEQ ID NO: 3065290 - RNA, 23 nt, Mycobacterium bovis subsp bovis AF2122/97
gcccggcgaaagcuugggcgauc

SEQ ID NO: 3065291 - RNA, 22 nt, Mycobacterium bovis subsp bovis AF2122/97
gcccggcgaacaggcgaccggg

SEQ ID NO: 3065292 - RNA, 20 nt, Mycobacterium bovis subsp bovis AF2122/97
gcccggcgaauacgaccguc

SEQ ID NO: 3065293 - RNA, 15 nt, Mycobacterium bovis subsp bovis AF2122/97
gcccggcgacgaccc

SEQ ID NO: 3065294 - RNA, 17 nt, Mycobacterium bovis subsp bovis AF2122/97
gcccggcgacgacccgg

SEQ ID NO: 3065295 - RNA, 23 nt, Mycobacterium bovis subsp bovis AF2122/97
gcccggcgagcagacgcauaagc

SEQ ID NO: 3065296 - RNA, 15 nt, Mycobacterium bovis subsp bovis AF2122/97
gcccggcgagcaggg

SEQ ID NO: 3065297 - RNA, 12 nt, Mycobacterium bovis subsp bovis AF2122/97
gcccggcgagcu

SEQ ID NO: 3065298 - RNA, 20 nt, Mycobacterium bovis subsp bovis AF2122/97
gcccggcgagcuaacacccg

SEQ ID NO: 3065299 - RNA, 23 nt, Mycobacterium bovis subsp bovis AF2122/97
gcccggcgagcuaacacccgagc

SEQ ID NO: 3065300 - RNA, 21 nt, Mycobacterium bovis subsp bovis AF2122/97
gcccggcgauaaacccgaggc

SEQ ID NO: 3065301 - RNA, 14 nt, Mycobacterium bovis subsp bovis AF2122/97
gcccggcgaugagc

SEQ ID NO: 3065302 - RNA, 16 nt, Mycobacterium bovis subsp bovis AF2122/97
gcccggcgcaagcgcc

SEQ ID NO: 3065303 - RNA, 18 nt, Mycobacterium bovis subsp bovis AF2122/97
gcccggcgcaagcgccgc

SEQ ID NO: 3065304 - RNA, 13 nt, Mycobacterium bovis subsp bovis AF2122/97
gcccggcgcacca

SEQ ID NO: 3065305 - RNA, 17 nt, Mycobacterium bovis subsp bovis AF2122/97
gcccggcgcaccaucgc

SEQ ID NO: 3065306 - RNA, 13 nt, Mycobacterium bovis subsp bovis AF2122/97
gcccggcgcccgg

SEQ ID NO: 3065307 - RNA, 12 nt, Mycobacterium bovis subsp bovis AF2122/97
gcccggcgcgaa

SEQ ID NO: 3065308 - RNA, 16 nt, Mycobacterium bovis subsp bovis AF2122/97
gcccggcgcgaagucg

SEQ ID NO: 3065309 - RNA, 13 nt, Mycobacterium bovis subsp bovis AF2122/97
gcccggcgcgccg

SEQ ID NO: 3065310 - RNA, 16 nt, Mycobacterium bovis subsp bovis AF2122/97
gcccggcgcggccgca

SEQ ID NO: 3065311 - RNA, 18 nt, Mycobacterium bovis subsp bovis AF2122/97
gcccggcgcuagcgccgc

SEQ ID NO: 3065312 - RNA, 22 nt, Mycobacterium bovis subsp bovis AF2122/97
gcccggcgcuagcgccgcgcuu

SEQ ID NO: 3065313 - RNA, 22 nt, Mycobacterium bovis subsp bovis AF2122/97
gcccggcggaucccgaggcgcc

SEQ ID NO: 3065314 - RNA, 13 nt, Mycobacterium bovis subsp bovis AF2122/97
gcccggcggcagc

SEQ ID NO: 3065315 - RNA, 11 nt, Mycobacterium bovis subsp bovis AF2122/97
gcccggcggcc

SEQ ID NO: 3065316 - RNA, 13 nt, Mycobacterium bovis subsp bovis AF2122/97
gcccggcggccaa

SEQ ID NO: 3065317 - RNA, 14 nt, Mycobacterium bovis subsp bovis AF2122/97
gcccggcggccaac

SEQ ID NO: 3065318 - RNA, 21 nt, Mycobacterium bovis subsp bovis AF2122/97
gcccggcggccaacgacgacc

SEQ ID NO: 3065319 - RNA, 14 nt, Mycobacterium bovis subsp bovis AF2122/97
gcccggcggcccga

SEQ ID NO: 3065320 - RNA, 15 nt, Mycobacterium bovis subsp bovis AF2122/97
gcccggcggccgcuu

SEQ ID NO: 3065321 - RNA, 13 nt, Mycobacterium bovis subsp bovis AF2122/97
gcccggcggcggu

SEQ ID NO: 3065322 - RNA, 12 nt, Mycobacterium bovis subsp bovis AF2122/97
gcccggcgguaa

SEQ ID NO: 3065323 - RNA, 18 nt, Mycobacterium bovis subsp bovis AF2122/97
gcccggcgugucgccgcc

SEQ ID NO: 3065324 - RNA, 21 nt, Mycobacterium bovis subsp bovis AF2122/97
gcccggcgugucgccgccacc

SEQ ID NO: 3065325 - RNA, 21 nt, Mycobacterium bovis subsp bovis AF2122/97
gcccggcguuguugaccagca

SEQ ID NO: 3065326 - RNA, 22 nt, Mycobacterium bovis subsp bovis AF2122/97
gcccggcguuguugaccagcac

SEQ ID NO: 3065327 - RNA, 23 nt, Mycobacterium bovis subsp bovis AF2122/97
gcccggcguuguugaccagcacg

SEQ ID NO: 3065328 - RNA, 17 nt, Mycobacterium bovis subsp bovis AF2122/97
gcccggcuacgacggcg

SEQ ID NO: 3065329 - RNA, 21 nt, Mycobacterium bovis subsp bovis AF2122/97
gcccggcuacgacggcgccau

SEQ ID NO: 3065330 - RNA, 23 nt, Mycobacterium bovis subsp bovis AF2122/97
gcccggcuaggagaucagcaccg

SEQ ID NO: 3065331 - RNA, 16 nt, Mycobacterium bovis subsp bovis AF2122/97
gcccggcucacagcac

SEQ ID NO: 3065332 - RNA, 19 nt, Mycobacterium bovis subsp bovis AF2122/97
gcccggcucacagcacagc

SEQ ID NO: 3065333 - RNA, 17 nt, Mycobacterium bovis subsp bovis AF2122/97
gcccggcuccuccccgg

SEQ ID NO: 3065334 - RNA, 20 nt, Mycobacterium bovis subsp bovis AF2122/97
gcccggcuccuccccggccc

SEQ ID NO: 3065335 - RNA, 12 nt, Mycobacterium bovis subsp bovis AF2122/97
gcccggcucggu

SEQ ID NO: 3065336 - RNA, 17 nt, Mycobacterium bovis subsp bovis AF2122/97
gcccggcucggugcgcc

SEQ ID NO: 3065337 - RNA, 17 nt, Mycobacterium bovis subsp bovis AF2122/97
gcccggcuggcuagcag

SEQ ID NO: 3065338 - RNA, 23 nt, Mycobacterium bovis subsp bovis AF2122/97
gcccggcuuuugucacaggcgac

SEQ ID NO: 3065339 - RNA, 16 nt, Mycobacterium bovis subsp bovis AF2122/97
gcccgggacaaguucg

SEQ ID NO: 3065340 - RNA, 20 nt, Mycobacterium bovis subsp bovis AF2122/97
gcccgggaccauagccugcg

SEQ ID NO: 3065341 - RNA, 22 nt, Mycobacterium bovis subsp bovis AF2122/97
gcccgggauaguuuucggccgc

SEQ ID NO: 3065342 - RNA, 23 nt, Mycobacterium bovis subsp bovis AF2122/97
gcccgggauaguuuucggccgcc

SEQ ID NO: 3065343 - RNA, 21 nt, Mycobacterium bovis subsp bovis AF2122/97
gcccgggaucggggcaccgug

SEQ ID NO: 3065344 - RNA, 13 nt, Mycobacterium bovis subsp bovis AF2122/97
gcccgggcaccgg

SEQ ID NO: 3065345 - RNA, 15 nt, Mycobacterium bovis subsp bovis AF2122/97
gcccgggcagcacca

SEQ ID NO: 3065346 - RNA, 18 nt, Mycobacterium bovis subsp bovis AF2122/97
gcccgggcagcaccagcg

SEQ ID NO: 3065347 - RNA, 20 nt, Mycobacterium bovis subsp bovis AF2122/97
gcccgggcagcaccagcgcc

SEQ ID NO: 3065348 - RNA, 23 nt, Mycobacterium bovis subsp bovis AF2122/97
gcccgggcauccuucaccagcug

SEQ ID NO: 3065349 - RNA, 13 nt, Mycobacterium bovis subsp bovis AF2122/97
gcccgggccaccg

SEQ ID NO: 3065350 - RNA, 14 nt, Mycobacterium bovis subsp bovis AF2122/97
gcccgggccaccgg

SEQ ID NO: 3065351 - RNA, 22 nt, Mycobacterium bovis subsp bovis AF2122/97
gcccgggcccgcgggaucagcg

SEQ ID NO: 3065352 - RNA, 20 nt, Mycobacterium bovis subsp bovis AF2122/97
gcccgggccgaagcgcgcgc

SEQ ID NO: 3065353 - RNA, 13 nt, Mycobacterium bovis subsp bovis AF2122/97
gcccgggccgcgu

SEQ ID NO: 3065354 - RNA, 23 nt, Mycobacterium bovis subsp bovis AF2122/97
gcccgucggugguguuccagguc

SEQ ID NO: 3065355 - RNA, 22 nt, Mycobacterium bovis subsp bovis AF2122/97
gcccgucguagguggccggcuu

SEQ ID NO: 3065356 - RNA, 14 nt, Mycobacterium bovis subsp bovis AF2122/97
gcccgucgucggca

SEQ ID NO: 3065357 - RNA, 16 nt, Mycobacterium bovis subsp bovis AF2122/97
gcccgucgucggcaac

SEQ ID NO: 3065358 - RNA, 15 nt, Mycobacterium bovis subsp bovis AF2122/97
gcccgucgucgucga

SEQ ID NO: 3065359 - RNA, 13 nt, Mycobacterium bovis subsp bovis AF2122/97
gcccgucuuccag

SEQ ID NO: 3065360 - RNA, 15 nt, Mycobacterium bovis subsp bovis AF2122/97
gcccgucuuccagcc

SEQ ID NO: 3065361 - RNA, 15 nt, Mycobacterium bovis subsp bovis AF2122/97
gcccgugacugguga

SEQ ID NO: 3065362 - RNA, 15 nt, Mycobacterium bovis subsp bovis AF2122/97
gcccgugccacagcu

SEQ ID NO: 3065363 - RNA, 22 nt, Mycobacterium bovis subsp bovis AF2122/97
gcccgugccacagcucgccgug

SEQ ID NO: 3065364 - RNA, 16 nt, Mycobacterium bovis subsp bovis AF2122/97
gcccgugccgcccgcg

SEQ ID NO: 3065365 - RNA, 15 nt, Mycobacterium bovis subsp bovis AF2122/97
gcccgugccuggccg

SEQ ID NO: 3065366 - RNA, 14 nt, Mycobacterium bovis subsp bovis AF2122/97
gcccgugcgaugca

SEQ ID NO: 3065367 - RNA, 15 nt, Mycobacterium bovis subsp bovis AF2122/97
gcccgugcggcucgc

SEQ ID NO: 3065368 - RNA, 20 nt, Mycobacterium bovis subsp bovis AF2122/97
gcccgugggugcgucugggc

SEQ ID NO: 3065369 - RNA, 16 nt, Mycobacterium bovis subsp bovis AF2122/97
gcccguggucgaucau

SEQ ID NO: 3065370 - RNA, 21 nt, Mycobacterium bovis subsp bovis AF2122/97
gcccguggucgaucaugacga

SEQ ID NO: 3065371 - RNA, 21 nt, Mycobacterium bovis subsp bovis AF2122/97
gcccguggugauggucgugau

SEQ ID NO: 3065372 - RNA, 20 nt, Mycobacterium bovis subsp bovis AF2122/97
gcccgugugcagccagccgg

SEQ ID NO: 3065373 - RNA, 16 nt, Mycobacterium bovis subsp bovis AF2122/97
gcccguguugaagaag

SEQ ID NO: 3065374 - RNA, 18 nt, Mycobacterium bovis subsp bovis AF2122/97
gcccguguugaagaagcc

SEQ ID NO: 3065375 - RNA, 23 nt, Mycobacterium bovis subsp bovis AF2122/97
gcccguguugaagaagcccgagu

SEQ ID NO: 3065376 - RNA, 18 nt, Mycobacterium bovis subsp bovis AF2122/97
gcccguucaugcggcggc

SEQ ID NO: 3065377 - RNA, 20 nt, Mycobacterium bovis subsp bovis AF2122/97
gcccguucaugcggcggcgc

SEQ ID NO: 3065378 - RNA, 21 nt, Mycobacterium bovis subsp bovis AF2122/97
gcccguucaugcggcggcgcu

SEQ ID NO: 3065379 - RNA, 22 nt, Mycobacterium bovis subsp bovis AF2122/97
gcccguucaugcggcggcgcuc

SEQ ID NO: 3065380 - RNA, 23 nt, Mycobacterium bovis subsp bovis AF2122/97
gcccguucgaaguucucggugcg

SEQ ID NO: 3065381 - RNA, 16 nt, Mycobacterium bovis subsp bovis AF2122/97
gcccguucugcccagg

SEQ ID NO: 3065382 - RNA, 18 nt, Mycobacterium bovis subsp bovis AF2122/97
gcccguucugcccaggca

SEQ ID NO: 3065383 - RNA, 20 nt, Mycobacterium bovis subsp bovis AF2122/97
gcccguugcaggacgcccac

SEQ ID NO: 3065384 - RNA, 21 nt, Mycobacterium bovis subsp bovis AF2122/97
gcccguugcaggacgcccaca

SEQ ID NO: 3065385 - RNA, 15 nt, Mycobacterium bovis subsp bovis AF2122/97
gcccguugcagguga

SEQ ID NO: 3065386 - RNA, 16 nt, Mycobacterium bovis subsp bovis AF2122/97
gcccguugguagccgg

SEQ ID NO: 3065387 - RNA, 17 nt, Mycobacterium bovis subsp bovis AF2122/97
gcccguuuccucagcug

SEQ ID NO: 3065388 - RNA, 21 nt, Mycobacterium bovis subsp bovis AF2122/97
gcccguuuccucagcugcucg

SEQ ID NO: 3065389 - RNA, 19 nt, Mycobacterium bovis subsp bovis AF2122/97
gcccguuugccgguucggc

SEQ ID NO: 3065390 - RNA, 20 nt, Mycobacterium bovis subsp bovis AF2122/97
gcccguuugccgguucggcg

SEQ ID NO: 3065391 - RNA, 18 nt, Mycobacterium bovis subsp bovis AF2122/97
gcccuacgcagcgcggcu

SEQ ID NO: 3065392 - RNA, 14 nt, Mycobacterium bovis subsp bovis AF2122/97
gcccuagccggcgc

SEQ ID NO: 3065393 - RNA, 16 nt, Mycobacterium bovis subsp bovis AF2122/97
gcccuagccggcgcgc

SEQ ID NO: 3065394 - RNA, 17 nt, Mycobacterium bovis subsp bovis AF2122/97
gcccuagccggcgcgcc

SEQ ID NO: 3065395 - RNA, 21 nt, Mycobacterium bovis subsp bovis AF2122/97
gcccuauacgcaacaggccaa

SEQ ID NO: 3065396 - RNA, 21 nt, Mycobacterium bovis subsp bovis AF2122/97
gcccuaucguuaucgacacca

SEQ ID NO: 3065397 - RNA, 16 nt, Mycobacterium bovis subsp bovis AF2122/97
gcccucaacgaucgcg

SEQ ID NO: 3065398 - RNA, 18 nt, Mycobacterium bovis subsp bovis AF2122/97
gcccucaacgaucgcgcc

SEQ ID NO: 3065399 - RNA, 21 nt, Mycobacterium bovis subsp bovis AF2122/97
gcccucaacgaucgcgccguc

SEQ ID NO: 3065400 - RNA, 15 nt, Mycobacterium bovis subsp bovis AF2122/97
gcccucaacggcggc

SEQ ID NO: 3065401 - RNA, 16 nt, Mycobacterium bovis subsp bovis AF2122/97
gcccucaacggcggca

SEQ ID NO: 3065402 - RNA, 17 nt, Mycobacterium bovis subsp bovis AF2122/97
gcccucaacggcggcaa

SEQ ID NO: 3065403 - RNA, 18 nt, Mycobacterium bovis subsp bovis AF2122/97
gcccucaacggcggcaac

SEQ ID NO: 3065404 - RNA, 18 nt, Mycobacterium bovis subsp bovis AF2122/97
gcccucacaacgauugcg

SEQ ID NO: 3065405 - RNA, 23 nt, Mycobacterium bovis subsp bovis AF2122/97
gcccucaccgccugugccgccgg

SEQ ID NO: 3065406 - RNA, 12 nt, Mycobacterium bovis subsp bovis AF2122/97
gcccucagccgc

SEQ ID NO: 3065407 - RNA, 16 nt, Mycobacterium bovis subsp bovis AF2122/97
gcccucagccgcggcc

SEQ ID NO: 3065408 - RNA, 17 nt, Mycobacterium bovis subsp bovis AF2122/97
gcccucagccgcggcca

SEQ ID NO: 3065409 - RNA, 18 nt, Mycobacterium bovis subsp bovis AF2122/97
gcccucagccgcggccac

SEQ ID NO: 3065410 - RNA, 20 nt, Mycobacterium bovis subsp bovis AF2122/97
gcccucagcuagcgcgggcu

SEQ ID NO: 3065411 - RNA, 16 nt, Mycobacterium bovis subsp bovis AF2122/97
gcccucaguucacgcu

SEQ ID NO: 3065412 - RNA, 20 nt, Mycobacterium bovis subsp bovis AF2122/97
gcccucaguucacgcucgac

SEQ ID NO: 3065413 - RNA, 21 nt, Mycobacterium bovis subsp bovis AF2122/97
gcccucauagauacagucgac

SEQ ID NO: 3065414 - RNA, 19 nt, Mycobacterium bovis subsp bovis AF2122/97
gcccucaugucgggcaacu

SEQ ID NO: 3065415 - RNA, 22 nt, Mycobacterium bovis subsp bovis AF2122/97
gcccuccacugcgagcgccggc

SEQ ID NO: 3065416 - RNA, 23 nt, Mycobacterium bovis subsp bovis AF2122/97
gcccuccagggcccugcuggccc

SEQ ID NO: 3065417 - RNA, 17 nt, Mycobacterium bovis subsp bovis AF2122/97
gcccucccgggcccgcu

SEQ ID NO: 3065418 - RNA, 20 nt, Mycobacterium bovis subsp bovis AF2122/97
gcccucccgggcccgcuggg

SEQ ID NO: 3065419 - RNA, 21 nt, Mycobacterium bovis subsp bovis AF2122/97
gcccucccgggcccgcugggc

SEQ ID NO: 3065420 - RNA, 15 nt, Mycobacterium bovis subsp bovis AF2122/97
gcccuccggcgcagc

SEQ ID NO: 3065421 - RNA, 21 nt, Mycobacterium bovis subsp bovis AF2122/97
gcccuccgggcccaucgcccg

SEQ ID NO: 3065422 - RNA, 20 nt, Mycobacterium bovis subsp bovis AF2122/97
gcccuccggguauggcggcg

SEQ ID NO: 3065423 - RNA, 14 nt, Mycobacterium bovis subsp bovis AF2122/97
gcccuccucgaccg

SEQ ID NO: 3065424 - RNA, 15 nt, Mycobacterium bovis subsp bovis AF2122/97
gcccuccucgaccgc

SEQ ID NO: 3065425 - RNA, 19 nt, Mycobacterium bovis subsp bovis AF2122/97
gcccuccucgaccgcggcc

SEQ ID NO: 3065426 - RNA, 14 nt, Mycobacterium bovis subsp bovis AF2122/97
gcccuccucgauga

SEQ ID NO: 3065427 - RNA, 19 nt, Mycobacterium bovis subsp bovis AF2122/97
gcccucgaauucggccggc

SEQ ID NO: 3065428 - RNA, 20 nt, Mycobacterium bovis subsp bovis AF2122/97
gcccucgacgccgcgcagcc

SEQ ID NO: 3065429 - RNA, 21 nt, Mycobacterium bovis subsp bovis AF2122/97
gcccucgacgccgcgcagccg

SEQ ID NO: 3065430 - RNA, 23 nt, Mycobacterium bovis subsp bovis AF2122/97
gcccucgacgccgcgcagccggc

SEQ ID NO: 3065431 - RNA, 17 nt, Mycobacterium bovis subsp bovis AF2122/97
gcccucgacgcgcucgg

SEQ ID NO: 3065432 - RNA, 18 nt, Mycobacterium bovis subsp bovis AF2122/97
gcccucgacgcgcucggg

SEQ ID NO: 3065433 - RNA, 12 nt, Mycobacterium bovis subsp bovis AF2122/97
gcccucgacggc

SEQ ID NO: 3065434 - RNA, 15 nt, Mycobacterium bovis subsp bovis AF2122/97
gcccucgaucgccac

SEQ ID NO: 3065435 - RNA, 20 nt, Mycobacterium bovis subsp bovis AF2122/97
gcccucgaugccgcguagcu

SEQ ID NO: 3065436 - RNA, 15 nt, Mycobacterium bovis subsp bovis AF2122/97
gcccucgauggccag

SEQ ID NO: 3065437 - RNA, 21 nt, Mycobacterium bovis subsp bovis AF2122/97
gcccucgccauggcguucugc

SEQ ID NO: 3065438 - RNA, 13 nt, Mycobacterium bovis subsp bovis AF2122/97
gcccucgcuguug

SEQ ID NO: 3065439 - RNA, 12 nt, Mycobacterium bovis subsp bovis AF2122/97
gcccucggccgc

SEQ ID NO: 3065440 - RNA, 18 nt, Mycobacterium bovis subsp bovis AF2122/97
gcccuucaguucgacggu

SEQ ID NO: 3065441 - RNA, 22 nt, Mycobacterium bovis subsp bovis AF2122/97
gcccuuccggccgacacgccga

SEQ ID NO: 3065442 - RNA, 16 nt, Mycobacterium bovis subsp bovis AF2122/97
gcccuuccuggccgaa

SEQ ID NO: 3065443 - RNA, 17 nt, Mycobacterium bovis subsp bovis AF2122/97
gcccuucuucgaccgcg

SEQ ID NO: 3065444 - RNA, 18 nt, Mycobacterium bovis subsp bovis AF2122/97
gcccuucuucgaccgcga

SEQ ID NO: 3065445 - RNA, 21 nt, Mycobacterium bovis subsp bovis AF2122/97
gcccuucuucgaccgcgaacu

SEQ ID NO: 3065446 - RNA, 13 nt, Mycobacterium bovis subsp bovis AF2122/97
gcccuugaugucc

SEQ ID NO: 3065447 - RNA, 14 nt, Mycobacterium bovis subsp bovis AF2122/97
gcccuugccgcaga

SEQ ID NO: 3065448 - RNA, 20 nt, Mycobacterium bovis subsp bovis AF2122/97
gcccuugccgccagccccag

SEQ ID NO: 3065449 - RNA, 22 nt, Mycobacterium bovis subsp bovis AF2122/97
gcccuugccgccagccccagcg

SEQ ID NO: 3065450 - RNA, 20 nt, Mycobacterium bovis subsp bovis AF2122/97
gcccuugccgcccgcuccgc

SEQ ID NO: 3065451 - RNA, 14 nt, Mycobacterium bovis subsp bovis AF2122/97
gcccuugccgccga

SEQ ID NO: 3065452 - RNA, 16 nt, Mycobacterium bovis subsp bovis AF2122/97
gcccuugccgccgagg

SEQ ID NO: 3065453 - RNA, 14 nt, Mycobacterium bovis subsp bovis AF2122/97
gcccuugccgccgg

SEQ ID NO: 3065454 - RNA, 19 nt, Mycobacterium bovis subsp bovis AF2122/97
gcccuugccgccggccccg

SEQ ID NO: 3065455 - RNA, 23 nt, Mycobacterium bovis subsp bovis AF2122/97
gcccuugccgccggccccgccgu

SEQ ID NO: 3065456 - RNA, 14 nt, Mycobacterium bovis subsp bovis AF2122/97
gcccuugccgccuu

SEQ ID NO: 3065457 - RNA, 19 nt, Mycobacterium bovis subsp bovis AF2122/97
gcccuugccgccuuggccc

SEQ ID NO: 3065458 - RNA, 16 nt, Mycobacterium bovis subsp bovis AF2122/97
gcccuugccggcgaga

SEQ ID NO: 3065459 - RNA, 22 nt, Mycobacterium bovis subsp bovis AF2122/97
gcccuugccggcgagagcguca

SEQ ID NO: 3065460 - RNA, 12 nt, Mycobacterium bovis subsp bovis AF2122/97
gcccuugccuug

SEQ ID NO: 3065461 - RNA, 15 nt, Mycobacterium bovis subsp bovis AF2122/97
gcccuugcggaagaa

SEQ ID NO: 3065462 - RNA, 18 nt, Mycobacterium bovis subsp bovis AF2122/97
gcccuuguagcacaccga

SEQ ID NO: 3065463 - RNA, 20 nt, Mycobacterium bovis subsp bovis AF2122/97
gcccuuguagcacaccgaca

SEQ ID NO: 3065464 - RNA, 22 nt, Mycobacterium bovis subsp bovis AF2122/97
gcccuuugcuguccccgccgag

SEQ ID NO: 3065465 - RNA, 17 nt, Mycobacterium bovis subsp bovis AF2122/97
gccgaaaaagaccgaca

SEQ ID NO: 3065466 - RNA, 15 nt, Mycobacterium bovis subsp bovis AF2122/97
gccgaaaaucgcagc

SEQ ID NO: 3065467 - RNA, 15 nt, Mycobacterium bovis subsp bovis AF2122/97
gccgaaaaugccgcc

SEQ ID NO: 3065468 - RNA, 16 nt, Mycobacterium bovis subsp bovis AF2122/97
gccgaaaaugccgccc

SEQ ID NO: 3065469 - RNA, 18 nt, Mycobacterium bovis subsp bovis AF2122/97
gccgaaacauugcccgug

SEQ ID NO: 3065470 - RNA, 12 nt, Mycobacterium bovis subsp bovis AF2122/97
gccgaaacccga

SEQ ID NO: 3065471 - RNA, 20 nt, Mycobacterium bovis subsp bovis AF2122/97
gccgaaacccgaguucgggc

SEQ ID NO: 3065472 - RNA, 13 nt, Mycobacterium bovis subsp bovis AF2122/97
gccgaaaccggga

SEQ ID NO: 3065473 - RNA, 16 nt, Mycobacterium bovis subsp bovis AF2122/97
gccgaaaccgggacaa

SEQ ID NO: 3065474 - RNA, 15 nt, Mycobacterium bovis subsp bovis AF2122/97
gccgaaacgccgacc

SEQ ID NO: 3065475 - RNA, 22 nt, Mycobacterium bovis subsp bovis AF2122/97
gccgaaacucaccagcaccccg

SEQ ID NO: 3065476 - RNA, 15 nt, Mycobacterium bovis subsp bovis AF2122/97
gccgaaagccaggcg

SEQ ID NO: 3065477 - RNA, 14 nt, Mycobacterium bovis subsp bovis AF2122/97
gccgaaagccuugc

SEQ ID NO: 3065478 - RNA, 20 nt, Mycobacterium bovis subsp bovis AF2122/97
gccgaaagccuugccgucga

SEQ ID NO: 3065479 - RNA, 21 nt, Mycobacterium bovis subsp bovis AF2122/97
gccgaaagccuugccgucgag

SEQ ID NO: 3065480 - RNA, 18 nt, Mycobacterium bovis subsp bovis AF2122/97
gccgaaagggucgacgua

SEQ ID NO: 3065481 - RNA, 23 nt, Mycobacterium bovis subsp bovis AF2122/97
gccgaaaucacugaggcugcggg

SEQ ID NO: 3065482 - RNA, 22 nt, Mycobacterium bovis subsp bovis AF2122/97
gccgaaaucaguugcgcuccaa

SEQ ID NO: 3065483 - RNA, 13 nt, Mycobacterium bovis subsp bovis AF2122/97
gccgaaauccaga

SEQ ID NO: 3065484 - RNA, 19 nt, Mycobacterium bovis subsp bovis AF2122/97
gccgaaauccuugacgcgc

SEQ ID NO: 3065485 - RNA, 13 nt, Mycobacterium bovis subsp bovis AF2122/97
gccgaaaucggcc

SEQ ID NO: 3065486 - RNA, 16 nt, Mycobacterium bovis subsp bovis AF2122/97
gccgaaaucggccagc

SEQ ID NO: 3065487 - RNA, 15 nt, Mycobacterium bovis subsp bovis AF2122/97
gccgaacacaccgag

SEQ ID NO: 3065488 - RNA, 12 nt, Mycobacterium bovis subsp bovis AF2122/97
gccgaacaccgc

SEQ ID NO: 3065489 - RNA, 17 nt, Mycobacterium bovis subsp bovis AF2122/97
gccgaacaccgccgcgu

SEQ ID NO: 3065490 - RNA, 14 nt, Mycobacterium bovis subsp bovis AF2122/97
gccgaacaccggua

SEQ ID NO: 3065491 - RNA, 22 nt, Mycobacterium bovis subsp bovis AF2122/97
gccgaacaccucggcacggacc

SEQ ID NO: 3065492 - RNA, 15 nt, Mycobacterium bovis subsp bovis AF2122/97
gccgaacagcaggcc

SEQ ID NO: 3065493 - RNA, 15 nt, Mycobacterium bovis subsp bovis AF2122/97
gccgaacagccgagc

SEQ ID NO: 3065494 - RNA, 21 nt, Mycobacterium bovis subsp bovis AF2122/97
gccgaacagcgaaccgccggc

SEQ ID NO: 3065495 - RNA, 13 nt, Mycobacterium bovis subsp bovis AF2122/97
gccgaacagcgac

SEQ ID NO: 3065496 - RNA, 20 nt, Mycobacterium bovis subsp bovis AF2122/97
gccgaacagcugcccgccag

SEQ ID NO: 3065497 - RNA, 22 nt, Mycobacterium bovis subsp bovis AF2122/97
gccgaacagcugcccgccagcg

SEQ ID NO: 3065498 - RNA, 23 nt, Mycobacterium bovis subsp bovis AF2122/97
gccgaacagcugcccgccagcgc

SEQ ID NO: 3065499 - RNA, 21 nt, Mycobacterium bovis subsp bovis AF2122/97
gccgaacagggaggucgccgc

SEQ ID NO: 3065500 - RNA, 22 nt, Mycobacterium bovis subsp bovis AF2122/97
gccgaacagugcggucccgacc

SEQ ID NO: 3065501 - RNA, 19 nt, Mycobacterium bovis subsp bovis AF2122/97
gccgaacaguucggcgagc

SEQ ID NO: 3065502 - RNA, 20 nt, Mycobacterium bovis subsp bovis AF2122/97
gccgaacaguucggcgagca

SEQ ID NO: 3065503 - RNA, 15 nt, Mycobacterium bovis subsp bovis AF2122/97
gccgaaccacgcgcc

SEQ ID NO: 3065504 - RNA, 21 nt, Mycobacterium bovis subsp bovis AF2122/97
gccgaaccacgcgcccgcacc

SEQ ID NO: 3065505 - RNA, 24 nt, Mycobacterium bovis subsp bovis AF2122/97
gccgaaccacgcgcccgcaccacc

SEQ ID NO: 3065506 - RNA, 17 nt, Mycobacterium bovis subsp bovis AF2122/97
gccgaacccggcggacg

SEQ ID NO: 3065507 - RNA, 18 nt, Mycobacterium bovis subsp bovis AF2122/97
gccgaacccgguguugag

SEQ ID NO: 3065508 - RNA, 15 nt, Mycobacterium bovis subsp bovis AF2122/97
gccgaaccgcugcgg

SEQ ID NO: 3065509 - RNA, 16 nt, Mycobacterium bovis subsp bovis AF2122/97
gccgaaccggcaccag

SEQ ID NO: 3065510 - RNA, 18 nt, Mycobacterium bovis subsp bovis AF2122/97
gccgaaccggcaccagcg

SEQ ID NO: 3065511 - RNA, 20 nt, Mycobacterium bovis subsp bovis AF2122/97
gccgaaccggcaccagcggc

SEQ ID NO: 3065512 - RNA, 13 nt, Mycobacterium bovis subsp bovis AF2122/97
gccgaaccggcgc

SEQ ID NO: 3065513 - RNA, 20 nt, Mycobacterium bovis subsp bovis AF2122/97
gccgaaccguucggcgacag

SEQ ID NO: 3065514 - RNA, 15 nt, Mycobacterium bovis subsp bovis AF2122/97
gccgaacgacagcag

SEQ ID NO: 3065515 - RNA, 20 nt, Mycobacterium bovis subsp bovis AF2122/97
gccgaacgacggguccgggc

SEQ ID NO: 3065516 - RNA, 13 nt, Mycobacterium bovis subsp bovis AF2122/97
gccgaacgccacc

SEQ ID NO: 3065517 - RNA, 17 nt, Mycobacterium bovis subsp bovis AF2122/97
gccgaacgggucggcga

SEQ ID NO: 3065518 - RNA, 18 nt, Mycobacterium bovis subsp bovis AF2122/97
gccgaacgggucggcgac

SEQ ID NO: 3065519 - RNA, 19 nt, Mycobacterium bovis subsp bovis AF2122/97
gccgaacgggucggcgacc

SEQ ID NO: 3065520 - RNA, 15 nt, Mycobacterium bovis subsp bovis AF2122/97
gccgaacgguugcuc

SEQ ID NO: 3065521 - RNA, 14 nt, Mycobacterium bovis subsp bovis AF2122/97
gccgaacgucgcgg

SEQ ID NO: 3065522 - RNA, 19 nt, Mycobacterium bovis subsp bovis AF2122/97
gccgaacgugaacucacgg

SEQ ID NO: 3065523 - RNA, 20 nt, Mycobacterium bovis subsp bovis AF2122/97
gccgaacgugaacugagggc

SEQ ID NO: 3065524 - RNA, 23 nt, Mycobacterium bovis subsp bovis AF2122/97
gccgaacgugcaaccacggcggc

SEQ ID NO: 3065525 - RNA, 20 nt, Mycobacterium bovis subsp bovis AF2122/97
gccgaacgugcaaccauggc

SEQ ID NO: 3065526 - RNA, 21 nt, Mycobacterium bovis subsp bovis AF2122/97
gccgacauggcggugcgcagc

SEQ ID NO: 3065527 - RNA, 20 nt, Mycobacterium bovis subsp bovis AF2122/97
gccgacauugcugcucguga

SEQ ID NO: 3065528 - RNA, 22 nt, Mycobacterium bovis subsp bovis AF2122/97
gccgacauugcugcucgugagc

SEQ ID NO: 3065529 - RNA, 16 nt, Mycobacterium bovis subsp bovis AF2122/97
gccgaccaccgccggg

SEQ ID NO: 3065530 - RNA, 22 nt, Mycobacterium bovis subsp bovis AF2122/97
gccgaccagagcuucgccgcgc

SEQ ID NO: 3065531 - RNA, 23 nt, Mycobacterium bovis subsp bovis AF2122/97
gccgaccagagcuucgccgcgca

SEQ ID NO: 3065532 - RNA, 16 nt, Mycobacterium bovis subsp bovis AF2122/97
gccgaccagcacaccg

SEQ ID NO: 3065533 - RNA, 14 nt, Mycobacterium bovis subsp bovis AF2122/97
gccgaccagcaccc

SEQ ID NO: 3065534 - RNA, 17 nt, Mycobacterium bovis subsp bovis AF2122/97
gccgaccagcacccgcu

SEQ ID NO: 3065535 - RNA, 21 nt, Mycobacterium bovis subsp bovis AF2122/97
gccgaccagcacccgcucggc

SEQ ID NO: 3065536 - RNA, 12 nt, Mycobacterium bovis subsp bovis AF2122/97
gccgaccagcgc

SEQ ID NO: 3065537 - RNA, 15 nt, Mycobacterium bovis subsp bovis AF2122/97
gccgaccagcgcgcu

SEQ ID NO: 3065538 - RNA, 19 nt, Mycobacterium bovis subsp bovis AF2122/97
gccgaccagcgcgcugcgc

SEQ ID NO: 3065539 - RNA, 22 nt, Mycobacterium bovis subsp bovis AF2122/97
gccgaccagcgcgcugcgcgac

SEQ ID NO: 3065540 - RNA, 23 nt, Mycobacterium bovis subsp bovis AF2122/97
gccgaccagcgcgcugcgcgacu

SEQ ID NO: 3065541 - RNA, 17 nt, Mycobacterium bovis subsp bovis AF2122/97
gccgaccaggaccaccg

SEQ ID NO: 3065542 - RNA, 19 nt, Mycobacterium bovis subsp bovis AF2122/97
gccgaccaggaccaccgca

SEQ ID NO: 3065543 - RNA, 16 nt, Mycobacterium bovis subsp bovis AF2122/97
gccgaccagucgacgu

SEQ ID NO: 3065544 - RNA, 15 nt, Mycobacterium bovis subsp bovis AF2122/97
gccgaccaucucacc

SEQ ID NO: 3065545 - RNA, 16 nt, Mycobacterium bovis subsp bovis AF2122/97
gccgaccaucucaccg

SEQ ID NO: 3065546 - RNA, 23 nt, Mycobacterium bovis subsp bovis AF2122/97
gccgacccgacgcuggucggcgg

SEQ ID NO: 3065547 - RNA, 20 nt, Mycobacterium bovis subsp bovis AF2122/97
gccgacccgccacaucgugg

SEQ ID NO: 3065548 - RNA, 22 nt, Mycobacterium bovis subsp bovis AF2122/97
gccgacccgccacaucguggcg

SEQ ID NO: 3065549 - RNA, 15 nt, Mycobacterium bovis subsp bovis AF2122/97
gccgacccgccgcgc

SEQ ID NO: 3065550 - RNA, 16 nt, Mycobacterium bovis subsp bovis AF2122/97
gccgacccgccgcgcc

SEQ ID NO: 3065551 - RNA, 20 nt, Mycobacterium bovis subsp bovis AF2122/97
gccgacccgccgcgcccggc

SEQ ID NO: 3065552 - RNA, 16 nt, Mycobacterium bovis subsp bovis AF2122/97
gccgacccgccgcgga

SEQ ID NO: 3065553 - RNA, 17 nt, Mycobacterium bovis subsp bovis AF2122/97
gccgacccgcgcgccgg

SEQ ID NO: 3065554 - RNA, 14 nt, Mycobacterium bovis subsp bovis AF2122/97
gccgacccgggggc

SEQ ID NO: 3065555 - RNA, 20 nt, Mycobacterium bovis subsp bovis AF2122/97
gccgacccuagauaugcacc

SEQ ID NO: 3065556 - RNA, 19 nt, Mycobacterium bovis subsp bovis AF2122/97
gccgaccgaaucagcacgg

SEQ ID NO: 3065557 - RNA, 17 nt, Mycobacterium bovis subsp bovis AF2122/97
gccgaccgacaccacca

SEQ ID NO: 3065558 - RNA, 18 nt, Mycobacterium bovis subsp bovis AF2122/97
gccgaccgacaccaccag

SEQ ID NO: 3065559 - RNA, 23 nt, Mycobacterium bovis subsp bovis AF2122/97
gccgaccgacaccaccaggucca

SEQ ID NO: 3065560 - RNA, 19 nt, Mycobacterium bovis subsp bovis AF2122/97
gccgaccgauacaccgacg

SEQ ID NO: 3065561 - RNA, 16 nt, Mycobacterium bovis subsp bovis AF2122/97
gccgaccgauggcuca

SEQ ID NO: 3065562 - RNA, 22 nt, Mycobacterium bovis subsp bovis AF2122/97
gccgaccgauggcucaccagcu

SEQ ID NO: 3065563 - RNA, 12 nt, Mycobacterium bovis subsp bovis AF2122/97
gccgaccgcgcc

SEQ ID NO: 3065564 - RNA, 15 nt, Mycobacterium bovis subsp bovis AF2122/97
gccgaccggcacccg

SEQ ID NO: 3065565 - RNA, 17 nt, Mycobacterium bovis subsp bovis AF2122/97
gccgaccggcacccgcg

SEQ ID NO: 3065566 - RNA, 19 nt, Mycobacterium bovis subsp bovis AF2122/97
gccgaccggcacccgcggc

SEQ ID NO: 3065567 - RNA, 18 nt, Mycobacterium bovis subsp bovis AF2122/97
gccgaccggcagcgaugc

SEQ ID NO: 3065568 - RNA, 23 nt, Mycobacterium bovis subsp bovis AF2122/97
gccgaccggcccgcauccgcacc

SEQ ID NO: 3065569 - RNA, 18 nt, Mycobacterium bovis subsp bovis AF2122/97
gccgaccgggcucuggcc

SEQ ID NO: 3065570 - RNA, 21 nt, Mycobacterium bovis subsp bovis AF2122/97
gccgaccgggcucuggccagu

SEQ ID NO: 3065571 - RNA, 12 nt, Mycobacterium bovis subsp bovis AF2122/97
gccgaccgggua

SEQ ID NO: 3065572 - RNA, 16 nt, Mycobacterium bovis subsp bovis AF2122/97
gccgaccggguugaug

SEQ ID NO: 3065573 - RNA, 18 nt, Mycobacterium bovis subsp bovis AF2122/97
gccgaccgguggcaccgg

SEQ ID NO: 3065574 - RNA, 20 nt, Mycobacterium bovis subsp bovis AF2122/97
gccgaccgguggcaccggcg

SEQ ID NO: 3065575 - RNA, 22 nt, Mycobacterium bovis subsp bovis AF2122/97
gccgaccgguggcaccggcggc

SEQ ID NO: 3065576 - RNA, 23 nt, Mycobacterium bovis subsp bovis AF2122/97
gccgaccgguuggguagcaccga

SEQ ID NO: 3065577 - RNA, 19 nt, Mycobacterium bovis subsp bovis AF2122/97
gccgaccguuucuccgccg

SEQ ID NO: 3065578 - RNA, 22 nt, Mycobacterium bovis subsp bovis AF2122/97
gccgaccguuucuccgccgccc

SEQ ID NO: 3065579 - RNA, 14 nt, Mycobacterium bovis subsp bovis AF2122/97
gccgaccuagucac

SEQ ID NO: 3065580 - RNA, 15 nt, Mycobacterium bovis subsp bovis AF2122/97
gccgaccuagucacc

SEQ ID NO: 3065581 - RNA, 22 nt, Mycobacterium bovis subsp bovis AF2122/97
gccgaccuagucaccuugaccg

SEQ ID NO: 3065582 - RNA, 14 nt, Mycobacterium bovis subsp bovis AF2122/97
gccgaccucacggc

SEQ ID NO: 3065583 - RNA, 17 nt, Mycobacterium bovis subsp bovis AF2122/97
gccgaccucaucggcac

SEQ ID NO: 3065584 - RNA, 21 nt, Mycobacterium bovis subsp bovis AF2122/97
gccgaccucaucggcaccguc

SEQ ID NO: 3065585 - RNA, 13 nt, Mycobacterium bovis subsp bovis AF2122/97
gccgaccucgagu

SEQ ID NO: 3065586 - RNA, 15 nt, Mycobacterium bovis subsp bovis AF2122/97
gccgaccucggcaac

SEQ ID NO: 3065587 - RNA, 16 nt, Mycobacterium bovis subsp bovis AF2122/97
gccgaccucguucguc

SEQ ID NO: 3065588 - RNA, 20 nt, Mycobacterium bovis subsp bovis AF2122/97
gccgaccucguucgucacca

SEQ ID NO: 3065589 - RNA, 17 nt, Mycobacterium bovis subsp bovis AF2122/97
gccgaccugcgcgacgg

SEQ ID NO: 3065590 - RNA, 22 nt, Mycobacterium bovis subsp bovis AF2122/97
gccgaccugcgcgacggcgcug

SEQ ID NO: 3065591 - RNA, 23 nt, Mycobacterium bovis subsp bovis AF2122/97
gccgaccugcuggaucucggugg

SEQ ID NO: 3065592 - RNA, 23 nt, Mycobacterium bovis subsp bovis AF2122/97
gccgaccuguaugccgcggugga

SEQ ID NO: 3065593 - RNA, 19 nt, Mycobacterium bovis subsp bovis AF2122/97
gccgaccuguccgauaacg

SEQ ID NO: 3065594 - RNA, 23 nt, Mycobacterium bovis subsp bovis AF2122/97
gccgaccuuccguuggcggcucg

SEQ ID NO: 3065595 - RNA, 13 nt, Mycobacterium bovis subsp bovis AF2122/97
gccgaccuucggc

SEQ ID NO: 3065596 - RNA, 19 nt, Mycobacterium bovis subsp bovis AF2122/97
gccgaccuucucggcguac

SEQ ID NO: 3065597 - RNA, 19 nt, Mycobacterium bovis subsp bovis AF2122/97
gccgaccuuggcgucgauc

SEQ ID NO: 3065598 - RNA, 18 nt, Mycobacterium bovis subsp bovis AF2122/97
gccgaccuuuugcggcaa

SEQ ID NO: 3065599 - RNA, 19 nt, Mycobacterium bovis subsp bovis AF2122/97
gccgaccuuuugcggcaag

SEQ ID NO: 3065600 - RNA, 20 nt, Mycobacterium bovis subsp bovis AF2122/97
gccgaccuuuugcggcaagc

SEQ ID NO: 3065601 - RNA, 19 nt, Mycobacterium bovis subsp bovis AF2122/97
gccgacgaaagguugccga

SEQ ID NO: 3065602 - RNA, 18 nt, Mycobacterium bovis subsp bovis AF2122/97
gccgacgaaaucgucggg

SEQ ID NO: 3065603 - RNA, 16 nt, Mycobacterium bovis subsp bovis AF2122/97
gccgacgaacagcggu

SEQ ID NO: 3065604 - RNA, 21 nt, Mycobacterium bovis subsp bovis AF2122/97
gccgacgaacgaaccgccgcc

SEQ ID NO: 3065605 - RNA, 19 nt, Mycobacterium bovis subsp bovis AF2122/97
gccgacgaaggauugcgga

SEQ ID NO: 3065606 - RNA, 22 nt, Mycobacterium bovis subsp bovis AF2122/97
gccgacgaaggauugcggaaac

SEQ ID NO: 3065607 - RNA, 19 nt, Mycobacterium bovis subsp bovis AF2122/97
gccgacgacaacagccagc

SEQ ID NO: 3065608 - RNA, 16 nt, Mycobacterium bovis subsp bovis AF2122/97
gccgacgaccagcaga

SEQ ID NO: 3065609 - RNA, 17 nt, Mycobacterium bovis subsp bovis AF2122/97
gccgacgaccagcagau

SEQ ID NO: 3065610 - RNA, 16 nt, Mycobacterium bovis subsp bovis AF2122/97
gccgacgaggggcgcg

SEQ ID NO: 3065611 - RNA, 18 nt, Mycobacterium bovis subsp bovis AF2122/97
gccgacgaggggcgcggg

SEQ ID NO: 3065612 - RNA, 16 nt, Mycobacterium bovis subsp bovis AF2122/97
gccgagaacaccggcc

SEQ ID NO: 3065613 - RNA, 14 nt, Mycobacterium bovis subsp bovis AF2122/97
gccgagaaccagcg

SEQ ID NO: 3065614 - RNA, 15 nt, Mycobacterium bovis subsp bovis AF2122/97
gccgagaaccagcga

SEQ ID NO: 3065615 - RNA, 18 nt, Mycobacterium bovis subsp bovis AF2122/97
gccgagaacgauguccgc

SEQ ID NO: 3065616 - RNA, 18 nt, Mycobacterium bovis subsp bovis AF2122/97
gccgagaagugggcggua

SEQ ID NO: 3065617 - RNA, 20 nt, Mycobacterium bovis subsp bovis AF2122/97
gccgagaagugggcgguacc

SEQ ID NO: 3065618 - RNA, 23 nt, Mycobacterium bovis subsp bovis AF2122/97
gccgagaauuccccagccgcauc

SEQ ID NO: 3065619 - RNA, 13 nt, Mycobacterium bovis subsp bovis AF2122/97
gccgagaccacgc

SEQ ID NO: 3065620 - RNA, 19 nt, Mycobacterium bovis subsp bovis AF2122/97
gccgagaccacgcgcgucg

SEQ ID NO: 3065621 - RNA, 15 nt, Mycobacterium bovis subsp bovis AF2122/97
gccgagaccgccgcu

SEQ ID NO: 3065622 - RNA, 17 nt, Mycobacterium bovis subsp bovis AF2122/97
gccgagaccgccgcugc

SEQ ID NO: 3065623 - RNA, 20 nt, Mycobacterium bovis subsp bovis AF2122/97
gccgagaccgccgcugccgc

SEQ ID NO: 3065624 - RNA, 22 nt, Mycobacterium bovis subsp bovis AF2122/97
gccgagaccgcguggucggcga

SEQ ID NO: 3065625 - RNA, 19 nt, Mycobacterium bovis subsp bovis AF2122/97
gccgagagcaccgcucggu

SEQ ID NO: 3065626 - RNA, 13 nt, Mycobacterium bovis subsp bovis AF2122/97
gccgagagcagcc

SEQ ID NO: 3065627 - RNA, 14 nt, Mycobacterium bovis subsp bovis AF2122/97
gccgagagcagcca

SEQ ID NO: 3065628 - RNA, 16 nt, Mycobacterium bovis subsp bovis AF2122/97
gccgagagcagccagc

SEQ ID NO: 3065629 - RNA, 19 nt, Mycobacterium bovis subsp bovis AF2122/97
gccgagagcagccagccac

SEQ ID NO: 3065630 - RNA, 22 nt, Mycobacterium bovis subsp bovis AF2122/97
gccgagagcagccagccaccga

SEQ ID NO: 3065631 - RNA, 22 nt, Mycobacterium bovis subsp bovis AF2122/97
gccgagauagcaacgaagccgg

SEQ ID NO: 3065632 - RNA, 14 nt, Mycobacterium bovis subsp bovis AF2122/97
gccgagaucacgcc

SEQ ID NO: 3065633 - RNA, 18 nt, Mycobacterium bovis subsp bovis AF2122/97
gccgagaucacgccgggc

SEQ ID NO: 3065634 - RNA, 21 nt, Mycobacterium bovis subsp bovis AF2122/97
gccgagauccacgccagagcg

SEQ ID NO: 3065635 - RNA, 15 nt, Mycobacterium bovis subsp bovis AF2122/97
gccgagaucccagcg

SEQ ID NO: 3065636 - RNA, 21 nt, Mycobacterium bovis subsp bovis AF2122/97
gccgagaucccagcgggacaa

SEQ ID NO: 3065637 - RNA, 21 nt, Mycobacterium bovis subsp bovis AF2122/97
gccgagaucgacaucguuggc

SEQ ID NO: 3065638 - RNA, 16 nt, Mycobacterium bovis subsp bovis AF2122/97
gccgagaugccggcga

SEQ ID NO: 3065639 - RNA, 18 nt, Mycobacterium bovis subsp bovis AF2122/97
gccgagaugccggcgagc

SEQ ID NO: 3065640 - RNA, 22 nt, Mycobacterium bovis subsp bovis AF2122/97
gccgagaugcuggucggcgaug

SEQ ID NO: 3065641 - RNA, 22 nt, Mycobacterium bovis subsp bovis AF2122/97
gccgagcaaacauccacccgcg

SEQ ID NO: 3065642 - RNA, 23 nt, Mycobacterium bovis subsp bovis AF2122/97
gccgagcaaacauccacccgcgg

SEQ ID NO: 3065643 - RNA, 17 nt, Mycobacterium bovis subsp bovis AF2122/97
gccgagcaacaccgucg

SEQ ID NO: 3065644 - RNA, 19 nt, Mycobacterium bovis subsp bovis AF2122/97
gccgagcacgacgacgucg

SEQ ID NO: 3065645 - RNA, 22 nt, Mycobacterium bovis subsp bovis AF2122/97
gccgagcacgccgagcccgccg

SEQ ID NO: 3065646 - RNA, 21 nt, Mycobacterium bovis subsp bovis AF2122/97
gccgagcacgggcagauacgc

SEQ ID NO: 3065647 - RNA, 14 nt, Mycobacterium bovis subsp bovis AF2122/97
gccgagcacucggc

SEQ ID NO: 3065648 - RNA, 18 nt, Mycobacterium bovis subsp bovis AF2122/97
gccgagcacucggccacg

SEQ ID NO: 3065649 - RNA, 20 nt, Mycobacterium bovis subsp bovis AF2122/97
gccgagcacucggccacgac

SEQ ID NO: 3065650 - RNA, 17 nt, Mycobacterium bovis subsp bovis AF2122/97
gccgagcagggccggca

SEQ ID NO: 3065651 - RNA, 18 nt, Mycobacterium bovis subsp bovis AF2122/97
gccgagcagggccggcac

SEQ ID NO: 3065652 - RNA, 13 nt, Mycobacterium bovis subsp bovis AF2122/97
gccgagcaggucg

SEQ ID NO: 3065653 - RNA, 17 nt, Mycobacterium bovis subsp bovis AF2122/97
gccgagccagcacccgc

SEQ ID NO: 3065654 - RNA, 14 nt, Mycobacterium bovis subsp bovis AF2122/97
gccgagccagcucc

SEQ ID NO: 3065655 - RNA, 18 nt, Mycobacterium bovis subsp bovis AF2122/97
gccgagccagcuccggcg

SEQ ID NO: 3065656 - RNA, 14 nt, Mycobacterium bovis subsp bovis AF2122/97
gccgagcccgccgg

SEQ ID NO: 3065657 - RNA, 13 nt, Mycobacterium bovis subsp bovis AF2122/97
gccgagcccgggc

SEQ ID NO: 3065658 - RNA, 13 nt, Mycobacterium bovis subsp bovis AF2122/97
gccgagccgacau

SEQ ID NO: 3065659 - RNA, 21 nt, Mycobacterium bovis subsp bovis AF2122/97
gccgagccgauauaccagggc

SEQ ID NO: 3065660 - RNA, 15 nt, Mycobacterium bovis subsp bovis AF2122/97
gccgagccgcccgcc

SEQ ID NO: 3065661 - RNA, 15 nt, Mycobacterium bovis subsp bovis AF2122/97
gccgagccgcgguca

SEQ ID NO: 3065662 - RNA, 17 nt, Mycobacterium bovis subsp bovis AF2122/97
gccgagccgcggucacc

SEQ ID NO: 3065663 - RNA, 17 nt, Mycobacterium bovis subsp bovis AF2122/97
gccgagcgaccguccca

SEQ ID NO: 3065664 - RNA, 18 nt, Mycobacterium bovis subsp bovis AF2122/97
gccgagcgagaaucacgg

SEQ ID NO: 3065665 - RNA, 20 nt, Mycobacterium bovis subsp bovis AF2122/97
gccgagcgcaacucccagca

SEQ ID NO: 3065666 - RNA, 22 nt, Mycobacterium bovis subsp bovis AF2122/97
gccgagcgcaacucccagcacg

SEQ ID NO: 3065667 - RNA, 16 nt, Mycobacterium bovis subsp bovis AF2122/97
gccgagcgcaaggucg

SEQ ID NO: 3065668 - RNA, 17 nt, Mycobacterium bovis subsp bovis AF2122/97
gccgagcgcaccacggc

SEQ ID NO: 3065669 - RNA, 18 nt, Mycobacterium bovis subsp bovis AF2122/97
gccgagcgcaccacggcg

SEQ ID NO: 3065670 - RNA, 18 nt, Mycobacterium bovis subsp bovis AF2122/97
gccgagcgcaccgcugac

SEQ ID NO: 3065671 - RNA, 12 nt, Mycobacterium bovis subsp bovis AF2122/97
gccgagcgcacu

SEQ ID NO: 3065672 - RNA, 13 nt, Mycobacterium bovis subsp bovis AF2122/97
gccgagcgcccgc

SEQ ID NO: 3065673 - RNA, 11 nt, Mycobacterium bovis subsp bovis AF2122/97
gccgagcgcga

SEQ ID NO: 3065674 - RNA, 11 nt, Mycobacterium bovis subsp bovis AF2122/97
gccgagcgcgc

SEQ ID NO: 3065675 - RNA, 15 nt, Mycobacterium bovis subsp bovis AF2122/97
gccgagcgcgccgaa

SEQ ID NO: 3065676 - RNA, 16 nt, Mycobacterium bovis subsp bovis AF2122/97
gccgagcgcgccgaag

SEQ ID NO: 3065677 - RNA, 14 nt, Mycobacterium bovis subsp bovis AF2122/97
gccgagcggaccac

SEQ ID NO: 3065678 - RNA, 20 nt, Mycobacterium bovis subsp bovis AF2122/97
gccgagcggaccaccgcucg

SEQ ID NO: 3065679 - RNA, 21 nt, Mycobacterium bovis subsp bovis AF2122/97
gccgagcggaccaccgcucgc

SEQ ID NO: 3065680 - RNA, 14 nt, Mycobacterium bovis subsp bovis AF2122/97
gccgagcggcggca

SEQ ID NO: 3065681 - RNA, 17 nt, Mycobacterium bovis subsp bovis AF2122/97
gccgagcggugccggcg

SEQ ID NO: 3065682 - RNA, 18 nt, Mycobacterium bovis subsp bovis AF2122/97
gccgagcgugaaccuggc

SEQ ID NO: 3065683 - RNA, 23 nt, Mycobacterium bovis subsp bovis AF2122/97
gccgagcgugaagucacggcggc

SEQ ID NO: 3065684 - RNA, 23 nt, Mycobacterium bovis subsp bovis AF2122/97
gccgagcguggccaauccggcgg

SEQ ID NO: 3065685 - RNA, 13 nt, Mycobacterium bovis subsp bovis AF2122/97
gccgagcguggcg

SEQ ID NO: 3065686 - RNA, 13 nt, Mycobacterium bovis subsp bovis AF2122/97
gccgagcuagauc

SEQ ID NO: 3065687 - RNA, 21 nt, Mycobacterium bovis subsp bovis AF2122/97
gccgagcuagaucacggagcu

SEQ ID NO: 3065688 - RNA, 16 nt, Mycobacterium bovis subsp bovis AF2122/97
gccgagcuccuccacc

SEQ ID NO: 3065689 - RNA, 16 nt, Mycobacterium bovis subsp bovis AF2122/97
gccgagcucguugacc

SEQ ID NO: 3065690 - RNA, 17 nt, Mycobacterium bovis subsp bovis AF2122/97
gccgagcucguugcugg

SEQ ID NO: 3065691 - RNA, 23 nt, Mycobacterium bovis subsp bovis AF2122/97
gccgagcucguugcuggcggcca

SEQ ID NO: 3065692 - RNA, 15 nt, Mycobacterium bovis subsp bovis AF2122/97
gccgagcuggcgacc

SEQ ID NO: 3065693 - RNA, 19 nt, Mycobacterium bovis subsp bovis AF2122/97
gccgagcuggcgaccuggu

SEQ ID NO: 3065694 - RNA, 16 nt, Mycobacterium bovis subsp bovis AF2122/97
gccgagcuggcgcgcg

SEQ ID NO: 3065695 - RNA, 18 nt, Mycobacterium bovis subsp bovis AF2122/97
gccgagcuggcgcgcggg

SEQ ID NO: 3065696 - RNA, 19 nt, Mycobacterium bovis subsp bovis AF2122/97
gccgagcugguuggcgccg

SEQ ID NO: 3065697 - RNA, 19 nt, Mycobacterium bovis subsp bovis AF2122/97
gccgagcugugcgcagaca

SEQ ID NO: 3065698 - RNA, 16 nt, Mycobacterium bovis subsp bovis AF2122/97
gccgaucaccaccggc

SEQ ID NO: 3065699 - RNA, 21 nt, Mycobacterium bovis subsp bovis AF2122/97
gccgaucaccgcaucggugcc

SEQ ID NO: 3065700 - RNA, 15 nt, Mycobacterium bovis subsp bovis AF2122/97
gccgaucaccgccgg

SEQ ID NO: 3065701 - RNA, 23 nt, Mycobacterium bovis subsp bovis AF2122/97
gccgaucaccgccggggcuggug

SEQ ID NO: 3065702 - RNA, 23 nt, Mycobacterium bovis subsp bovis AF2122/97
gccgaucaccgcuguguucagcg

SEQ ID NO: 3065703 - RNA, 13 nt, Mycobacterium bovis subsp bovis AF2122/97
gccgaucacgcug

SEQ ID NO: 3065704 - RNA, 13 nt, Mycobacterium bovis subsp bovis AF2122/97
gccgaucacggca

SEQ ID NO: 3065705 - RNA, 14 nt, Mycobacterium bovis subsp bovis AF2122/97
gccgaucacggcac

SEQ ID NO: 3065706 - RNA, 23 nt, Mycobacterium bovis subsp bovis AF2122/97
gccgaucacgggcuaccggcagc

SEQ ID NO: 3065707 - RNA, 21 nt, Mycobacterium bovis subsp bovis AF2122/97
gccgaucacggugggcgccga

SEQ ID NO: 3065708 - RNA, 19 nt, Mycobacterium bovis subsp bovis AF2122/97
gccgaucagcccggccuug

SEQ ID NO: 3065709 - RNA, 14 nt, Mycobacterium bovis subsp bovis AF2122/97
gccgaucagcgaac

SEQ ID NO: 3065710 - RNA, 21 nt, Mycobacterium bovis subsp bovis AF2122/97
gccgaucagcgaaccaccggc

SEQ ID NO: 3065711 - RNA, 16 nt, Mycobacterium bovis subsp bovis AF2122/97
gccgaucagcguggcg

SEQ ID NO: 3065712 - RNA, 22 nt, Mycobacterium bovis subsp bovis AF2122/97
gccgaucagcguggcgcccgug

SEQ ID NO: 3065713 - RNA, 23 nt, Mycobacterium bovis subsp bovis AF2122/97
gccgaucagcugcgcaucgccac

SEQ ID NO: 3065714 - RNA, 15 nt, Mycobacterium bovis subsp bovis AF2122/97
gccgaucaguccggc

SEQ ID NO: 3065715 - RNA, 16 nt, Mycobacterium bovis subsp bovis AF2122/97
gccgaucaucaccggc

SEQ ID NO: 3065716 - RNA, 19 nt, Mycobacterium bovis subsp bovis AF2122/97
gccgaucaucaccggcaua

SEQ ID NO: 3065717 - RNA, 15 nt, Mycobacterium bovis subsp bovis AF2122/97
gccgauccagcaggc

SEQ ID NO: 3065718 - RNA, 21 nt, Mycobacterium bovis subsp bovis AF2122/97
gccgauccagcaggccgucga

SEQ ID NO: 3065719 - RNA, 16 nt, Mycobacterium bovis subsp bovis AF2122/97
gccgaucccaccggcu

SEQ ID NO: 3065720 - RNA, 14 nt, Mycobacterium bovis subsp bovis AF2122/97
gccgaucccggcga

SEQ ID NO: 3065721 - RNA, 16 nt, Mycobacterium bovis subsp bovis AF2122/97
gccgaucccggcgagc

SEQ ID NO: 3065722 - RNA, 17 nt, Mycobacterium bovis subsp bovis AF2122/97
gccgaucccggcgagca

SEQ ID NO: 3065723 - RNA, 19 nt, Mycobacterium bovis subsp bovis AF2122/97
gccgaucccggcgagcacc

SEQ ID NO: 3065724 - RNA, 22 nt, Mycobacterium bovis subsp bovis AF2122/97
gccgaucccggcgagcacccgc

SEQ ID NO: 3065725 - RNA, 15 nt, Mycobacterium bovis subsp bovis AF2122/97
gccgaucccggcggu

SEQ ID NO: 3065726 - RNA, 15 nt, Mycobacterium bovis subsp bovis AF2122/97
gccgaucccguggug

SEQ ID NO: 3065727 - RNA, 14 nt, Mycobacterium bovis subsp bovis AF2122/97
gccgauccgguggc

SEQ ID NO: 3065728 - RNA, 14 nt, Mycobacterium bovis subsp bovis AF2122/97
gccgaucgacaccc

SEQ ID NO: 3065729 - RNA, 15 nt, Mycobacterium bovis subsp bovis AF2122/97
gccgaucgacacccg

SEQ ID NO: 3065730 - RNA, 16 nt, Mycobacterium bovis subsp bovis AF2122/97
gccgaucgacacccgc

SEQ ID NO: 3065731 - RNA, 19 nt, Mycobacterium bovis subsp bovis AF2122/97
gccgaucgacacccgcucg

SEQ ID NO: 3065732 - RNA, 22 nt, Mycobacterium bovis subsp bovis AF2122/97
gccgaucgaugccacgucccag

SEQ ID NO: 3065733 - RNA, 13 nt, Mycobacterium bovis subsp bovis AF2122/97
gccgaucgcccgc

SEQ ID NO: 3065734 - RNA, 18 nt, Mycobacterium bovis subsp bovis AF2122/97
gccgaucgcggcggccuc

SEQ ID NO: 3065735 - RNA, 15 nt, Mycobacterium bovis subsp bovis AF2122/97
gccgaucgcuccggc

SEQ ID NO: 3065736 - RNA, 12 nt, Mycobacterium bovis subsp bovis AF2122/97
gccgaucggcac

SEQ ID NO: 3065737 - RNA, 14 nt, Mycobacterium bovis subsp bovis AF2122/97
gccgaucggcaccg

SEQ ID NO: 3065738 - RNA, 16 nt, Mycobacterium bovis subsp bovis AF2122/97
gccgaucggcaccgug

SEQ ID NO: 3065739 - RNA, 23 nt, Mycobacterium bovis subsp bovis AF2122/97
gccgaucggcaccgugucgacgg

SEQ ID NO: 3065740 - RNA, 14 nt, Mycobacterium bovis subsp bovis AF2122/97
gccgaucggccaac

SEQ ID NO: 3065741 - RNA, 16 nt, Mycobacterium bovis subsp bovis AF2122/97
gccgaucggccacagu

SEQ ID NO: 3065742 - RNA, 17 nt, Mycobacterium bovis subsp bovis AF2122/97
gccgaucgggcucacuc

SEQ ID NO: 3065743 - RNA, 12 nt, Mycobacterium bovis subsp bovis AF2122/97
gccgaucggugc

SEQ ID NO: 3065744 - RNA, 18 nt, Mycobacterium bovis subsp bovis AF2122/97
gccgaucgucucggccac

SEQ ID NO: 3065745 - RNA, 20 nt, Mycobacterium bovis subsp bovis AF2122/97
gccgaucucgcccagcgagc

SEQ ID NO: 3065746 - RNA, 17 nt, Mycobacterium bovis subsp bovis AF2122/97
gccgaucucuccggcgg

SEQ ID NO: 3065747 - RNA, 20 nt, Mycobacterium bovis subsp bovis AF2122/97
gccgaucucuccggcggcga

SEQ ID NO: 3065748 - RNA, 14 nt, Mycobacterium bovis subsp bovis AF2122/97
gccgaucugcucgc

SEQ ID NO: 3065749 - RNA, 18 nt, Mycobacterium bovis subsp bovis AF2122/97
gccgaucugcucgccgag

SEQ ID NO: 3065750 - RNA, 19 nt, Mycobacterium bovis subsp bovis AF2122/97
gccgaucugcucgccgagc

SEQ ID NO: 3065751 - RNA, 15 nt, Mycobacterium bovis subsp bovis AF2122/97
gccgaucugcugcag

SEQ ID NO: 3065752 - RNA, 16 nt, Mycobacterium bovis subsp bovis AF2122/97
gccgaucugcugcagc

SEQ ID NO: 3065753 - RNA, 16 nt, Mycobacterium bovis subsp bovis AF2122/97
gccgaucuucgcgcgc

SEQ ID NO: 3065754 - RNA, 12 nt, Mycobacterium bovis subsp bovis AF2122/97
gccgaugaccga

SEQ ID NO: 3065755 - RNA, 13 nt, Mycobacterium bovis subsp bovis AF2122/97
gccgaugaccgaa

SEQ ID NO: 3065756 - RNA, 21 nt, Mycobacterium bovis subsp bovis AF2122/97
gccgaugaccgaagagcgcgc

SEQ ID NO: 3065757 - RNA, 16 nt, Mycobacterium bovis subsp bovis AF2122/97
gccgaugaccgcaacc

SEQ ID NO: 3065758 - RNA, 18 nt, Mycobacterium bovis subsp bovis AF2122/97
gccgaugaccgcaaccgg

SEQ ID NO: 3065759 - RNA, 23 nt, Mycobacterium bovis subsp bovis AF2122/97
gccgaugaccgccugcuggccgc

SEQ ID NO: 3065760 - RNA, 13 nt, Mycobacterium bovis subsp bovis AF2122/97
gccgaugaccugc

SEQ ID NO: 3065761 - RNA, 16 nt, Mycobacterium bovis subsp bovis AF2122/97
gccgaugaccugcccg

SEQ ID NO: 3065762 - RNA, 22 nt, Mycobacterium bovis subsp bovis AF2122/97
gccgaugaccugcccgucccgc

SEQ ID NO: 3065763 - RNA, 17 nt, Mycobacterium bovis subsp bovis AF2122/97
gccgaugacgaugcccu

SEQ ID NO: 3065764 - RNA, 19 nt, Mycobacterium bovis subsp bovis AF2122/97
gccgaugacgaugccgccg

SEQ ID NO: 3065765 - RNA, 23 nt, Mycobacterium bovis subsp bovis AF2122/97
gccgaugacgaugccgccgaaga

SEQ ID NO: 3065766 - RNA, 14 nt, Mycobacterium bovis subsp bovis AF2122/97
gccgaugacgaugg

SEQ ID NO: 3065767 - RNA, 20 nt, Mycobacterium bovis subsp bovis AF2122/97
gccgaugacgauggccgccg

SEQ ID NO: 3065768 - RNA, 13 nt, Mycobacterium bovis subsp bovis AF2122/97
gccgaugagccca

SEQ ID NO: 3065769 - RNA, 14 nt, Mycobacterium bovis subsp bovis AF2122/97
gccgaugagcccag

SEQ ID NO: 3065770 - RNA, 18 nt, Mycobacterium bovis subsp bovis AF2122/97
gccgaugagcccagccgc

SEQ ID NO: 3065771 - RNA, 13 nt, Mycobacterium bovis subsp bovis AF2122/97
gccgaugaucgaa

SEQ ID NO: 3065772 - RNA, 20 nt, Mycobacterium bovis subsp bovis AF2122/97
gccgaugaugcggcgcagcg

SEQ ID NO: 3065773 - RNA, 22 nt, Mycobacterium bovis subsp bovis AF2122/97
gccgaugaugcggcgcagcgac

SEQ ID NO: 3065774 - RNA, 19 nt, Mycobacterium bovis subsp bovis AF2122/97
gccgaugaugugcggugac

SEQ ID NO: 3065775 - RNA, 12 nt, Mycobacterium bovis subsp bovis AF2122/97
gccgaugccacc

SEQ ID NO: 3065776 - RNA, 16 nt, Mycobacterium bovis subsp bovis AF2122/97
gccgaugcccaucacg

SEQ ID NO: 3065777 - RNA, 14 nt, Mycobacterium bovis subsp bovis AF2122/97
gccgaugccgccgg

SEQ ID NO: 3065778 - RNA, 13 nt, Mycobacterium bovis subsp bovis AF2122/97
gccgaugccggcc

SEQ ID NO: 3065779 - RNA, 14 nt, Mycobacterium bovis subsp bovis AF2122/97
gccgaugccggcga

SEQ ID NO: 3065780 - RNA, 15 nt, Mycobacterium bovis subsp bovis AF2122/97
gccgaugccggcgag

SEQ ID NO: 3065781 - RNA, 18 nt, Mycobacterium bovis subsp bovis AF2122/97
gccgaugccggcgagggc

SEQ ID NO: 3065782 - RNA, 15 nt, Mycobacterium bovis subsp bovis AF2122/97
gccgaugcgacgcag

SEQ ID NO: 3065783 - RNA, 16 nt, Mycobacterium bovis subsp bovis AF2122/97
gccgaugcgacgcaga

SEQ ID NO: 3065784 - RNA, 16 nt, Mycobacterium bovis subsp bovis AF2122/97
gccgaugcgcagugca

SEQ ID NO: 3065785 - RNA, 15 nt, Mycobacterium bovis subsp bovis AF2122/97
gccgccaagcucggc

SEQ ID NO: 3065786 - RNA, 19 nt, Mycobacterium bovis subsp bovis AF2122/97
gccgccaagcucggccacc

SEQ ID NO: 3065787 - RNA, 20 nt, Mycobacterium bovis subsp bovis AF2122/97
gccgccaagcucggccacca

SEQ ID NO: 3065788 - RNA, 16 nt, Mycobacterium bovis subsp bovis AF2122/97
gccgccacaccgccgc

SEQ ID NO: 3065789 - RNA, 15 nt, Mycobacterium bovis subsp bovis AF2122/97
gccgccacagcaccc

SEQ ID NO: 3065790 - RNA, 19 nt, Mycobacterium bovis subsp bovis AF2122/97
gccgccacagcacccacgc

SEQ ID NO: 3065791 - RNA, 19 nt, Mycobacterium bovis subsp bovis AF2122/97
gccgccaccacccaacagc

SEQ ID NO: 3065792 - RNA, 22 nt, Mycobacterium bovis subsp bovis AF2122/97
gccgccaccaccgcugccggcg

SEQ ID NO: 3065793 - RNA, 15 nt, Mycobacterium bovis subsp bovis AF2122/97
gccgccaccaccggc

SEQ ID NO: 3065794 - RNA, 16 nt, Mycobacterium bovis subsp bovis AF2122/97
gccgccaccaccggcg

SEQ ID NO: 3065795 - RNA, 18 nt, Mycobacterium bovis subsp bovis AF2122/97
gccgccaccaccggcgcc

SEQ ID NO: 3065796 - RNA, 19 nt, Mycobacterium bovis subsp bovis AF2122/97
gccgccaccaccggcgccu

SEQ ID NO: 3065797 - RNA, 12 nt, Mycobacterium bovis subsp bovis AF2122/97
gccgccaccagc

SEQ ID NO: 3065798 - RNA, 13 nt, Mycobacterium bovis subsp bovis AF2122/97
gccgccaccagcg

SEQ ID NO: 3065799 - RNA, 15 nt, Mycobacterium bovis subsp bovis AF2122/97
gccgccaccagcgca

SEQ ID NO: 3065800 - RNA, 16 nt, Mycobacterium bovis subsp bovis AF2122/97
gccgccaccagcgcac

SEQ ID NO: 3065801 - RNA, 23 nt, Mycobacterium bovis subsp bovis AF2122/97
gccgccaccagcgcacgcucggc

SEQ ID NO: 3065802 - RNA, 19 nt, Mycobacterium bovis subsp bovis AF2122/97
gccgccaccagcgcgagcc

SEQ ID NO: 3065803 - RNA, 21 nt, Mycobacterium bovis subsp bovis AF2122/97
gccgccaccagcgcgagcccg

SEQ ID NO: 3065804 - RNA, 13 nt, Mycobacterium bovis subsp bovis AF2122/97
gccgccaccaggg

SEQ ID NO: 3065805 - RNA, 14 nt, Mycobacterium bovis subsp bovis AF2122/97
gccgccaccagggc

SEQ ID NO: 3065806 - RNA, 23 nt, Mycobacterium bovis subsp bovis AF2122/97
gccgccaccagggcacguucggc

SEQ ID NO: 3065807 - RNA, 18 nt, Mycobacterium bovis subsp bovis AF2122/97
gccgccaccagggcggcc

SEQ ID NO: 3065808 - RNA, 13 nt, Mycobacterium bovis subsp bovis AF2122/97
gccgccacccggc

SEQ ID NO: 3065809 - RNA, 21 nt, Mycobacterium bovis subsp bovis AF2122/97
gccgccacccggcgggcggug

SEQ ID NO: 3065810 - RNA, 16 nt, Mycobacterium bovis subsp bovis AF2122/97
gccgccaccgaagccg

SEQ ID NO: 3065811 - RNA, 18 nt, Mycobacterium bovis subsp bovis AF2122/97
gccgccaccgaagccgcc

SEQ ID NO: 3065812 - RNA, 20 nt, Mycobacterium bovis subsp bovis AF2122/97
gccgccaccgaagccgccgg

SEQ ID NO: 3065813 - RNA, 12 nt, Mycobacterium bovis subsp bovis AF2122/97
gccgccaccgca

SEQ ID NO: 3065814 - RNA, 13 nt, Mycobacterium bovis subsp bovis AF2122/97
gccgccaccgcca

SEQ ID NO: 3065815 - RNA, 23 nt, Mycobacterium bovis subsp bovis AF2122/97
gccgccaccgccaccgcggccug

SEQ ID NO: 3065816 - RNA, 12 nt, Mycobacterium bovis subsp bovis AF2122/97
gccgccaccgcg

SEQ ID NO: 3065817 - RNA, 23 nt, Mycobacterium bovis subsp bovis AF2122/97
gccgccaccgcgacgagcggccg

SEQ ID NO: 3065818 - RNA, 17 nt, Mycobacterium bovis subsp bovis AF2122/97
gccgccaccgcugucga

SEQ ID NO: 3065819 - RNA, 18 nt, Mycobacterium bovis subsp bovis AF2122/97
gccgccaccggcgccgcc

SEQ ID NO: 3065820 - RNA, 19 nt, Mycobacterium bovis subsp bovis AF2122/97
gccgccaccggcgccgccg

SEQ ID NO: 3065821 - RNA, 13 nt, Mycobacterium bovis subsp bovis AF2122/97
gccgccaccguca

SEQ ID NO: 3065822 - RNA, 20 nt, Mycobacterium bovis subsp bovis AF2122/97
gccgccaccgucaccgccgu

SEQ ID NO: 3065823 - RNA, 22 nt, Mycobacterium bovis subsp bovis AF2122/97
gccgccaccgucaccgccguca

SEQ ID NO: 3065824 - RNA, 21 nt, Mycobacterium bovis subsp bovis AF2122/97
gccgccaccuuggcugggccc

SEQ ID NO: 3065825 - RNA, 16 nt, Mycobacterium bovis subsp bovis AF2122/97
gccgccacggaucgcg

SEQ ID NO: 3065826 - RNA, 19 nt, Mycobacterium bovis subsp bovis AF2122/97
gccgccacggaucgcggcg

SEQ ID NO: 3065827 - RNA, 22 nt, Mycobacterium bovis subsp bovis AF2122/97
gccgccacggaucgcggcggcg

SEQ ID NO: 3065828 - RNA, 15 nt, Mycobacterium bovis subsp bovis AF2122/97
gccgccacgggcggc

SEQ ID NO: 3065829 - RNA, 16 nt, Mycobacterium bovis subsp bovis AF2122/97
gccgccacgggcggcc

SEQ ID NO: 3065830 - RNA, 18 nt, Mycobacterium bovis subsp bovis AF2122/97
gccgccacgggcggccac

SEQ ID NO: 3065831 - RNA, 20 nt, Mycobacterium bovis subsp bovis AF2122/97
gccgccacgguacauccaga

SEQ ID NO: 3065832 - RNA, 13 nt, Mycobacterium bovis subsp bovis AF2122/97
gccgccacgugug

SEQ ID NO: 3065833 - RNA, 18 nt, Mycobacterium bovis subsp bovis AF2122/97
gccgccagauuggcgcug

SEQ ID NO: 3065834 - RNA, 15 nt, Mycobacterium bovis subsp bovis AF2122/97
gccgccagcaccacc

SEQ ID NO: 3065835 - RNA, 16 nt, Mycobacterium bovis subsp bovis AF2122/97
gccgccagcaccaccg

SEQ ID NO: 3065836 - RNA, 12 nt, Mycobacterium bovis subsp bovis AF2122/97
gccgccagcauu

SEQ ID NO: 3065837 - RNA, 12 nt, Mycobacterium bovis subsp bovis AF2122/97
gccgccagcccc

SEQ ID NO: 3065838 - RNA, 18 nt, Mycobacterium bovis subsp bovis AF2122/97
gccgccagccccacccgc

SEQ ID NO: 3065839 - RNA, 15 nt, Mycobacterium bovis subsp bovis AF2122/97
gccgccagccccagc

SEQ ID NO: 3065840 - RNA, 20 nt, Mycobacterium bovis subsp bovis AF2122/97
gccgccagcccgucaucgcg

SEQ ID NO: 3065841 - RNA, 13 nt, Mycobacterium bovis subsp bovis AF2122/97
gccgccagccggc

SEQ ID NO: 3065842 - RNA, 14 nt, Mycobacterium bovis subsp bovis AF2122/97
gccgccagccggcg

SEQ ID NO: 3065843 - RNA, 13 nt, Mycobacterium bovis subsp bovis AF2122/97
gccgccagccugg

SEQ ID NO: 3065844 - RNA, 17 nt, Mycobacterium bovis subsp bovis AF2122/97
gccgccagcgcacgaua

SEQ ID NO: 3065845 - RNA, 15 nt, Mycobacterium bovis subsp bovis AF2122/97
gccgccagcgccgcc

SEQ ID NO: 3065846 - RNA, 19 nt, Mycobacterium bovis subsp bovis AF2122/97
gccgccagcgccgccggcg

SEQ ID NO: 3065847 - RNA, 13 nt, Mycobacterium bovis subsp bovis AF2122/97
gccgccagcgcgc

SEQ ID NO: 3065848 - RNA, 15 nt, Mycobacterium bovis subsp bovis AF2122/97
gccgccagcgcgccg

SEQ ID NO: 3065849 - RNA, 21 nt, Mycobacterium bovis subsp bovis AF2122/97
gccgccagcgcggccauuagc

SEQ ID NO: 3065850 - RNA, 12 nt, Mycobacterium bovis subsp bovis AF2122/97
gccgccagcggc

SEQ ID NO: 3065851 - RNA, 17 nt, Mycobacterium bovis subsp bovis AF2122/97
gccgccagcugcgcagc

SEQ ID NO: 3065852 - RNA, 23 nt, Mycobacterium bovis subsp bovis AF2122/97
gccgccaggaaucccucggccgc

SEQ ID NO: 3065853 - RNA, 11 nt, Mycobacterium bovis subsp bovis AF2122/97
gccgccaggcg

SEQ ID NO: 3065854 - RNA, 17 nt, Mycobacterium bovis subsp bovis AF2122/97
gccgccaggcgcuuggc

SEQ ID NO: 3065855 - RNA, 13 nt, Mycobacterium bovis subsp bovis AF2122/97
gccgccaggcggc

SEQ ID NO: 3065856 - RNA, 16 nt, Mycobacterium bovis subsp bovis AF2122/97
gccgccaggcggccgg

SEQ ID NO: 3065857 - RNA, 21 nt, Mycobacterium bovis subsp bovis AF2122/97
gccgccagggcccuagccggc

SEQ ID NO: 3065858 - RNA, 18 nt, Mycobacterium bovis subsp bovis AF2122/97
gccgccagguguucgccg

SEQ ID NO: 3065859 - RNA, 22 nt, Mycobacterium bovis subsp bovis AF2122/97
gccgccaguccgaucgccgagg

SEQ ID NO: 3065860 - RNA, 13 nt, Mycobacterium bovis subsp bovis AF2122/97
gccgccaguccgg

SEQ ID NO: 3065861 - RNA, 22 nt, Mycobacterium bovis subsp bovis AF2122/97
gccgccaguccggacggcagcc

SEQ ID NO: 3065862 - RNA, 23 nt, Mycobacterium bovis subsp bovis AF2122/97
gccgccaguccggacggcagccg

SEQ ID NO: 3065863 - RNA, 15 nt, Mycobacterium bovis subsp bovis AF2122/97
gccgccaguucggcg

SEQ ID NO: 3065864 - RNA, 23 nt, Mycobacterium bovis subsp bovis AF2122/97
gccgccauaccucggcgaccucc

SEQ ID NO: 3065865 - RNA, 17 nt, Mycobacterium bovis subsp bovis AF2122/97
gccgccaucagcccuuc

SEQ ID NO: 3065866 - RNA, 14 nt, Mycobacterium bovis subsp bovis AF2122/97
gccgccaucagccg

SEQ ID NO: 3065867 - RNA, 18 nt, Mycobacterium bovis subsp bovis AF2122/97
gccgccauccccuggcca

SEQ ID NO: 3065868 - RNA, 23 nt, Mycobacterium bovis subsp bovis AF2122/97
gccgccauccccuggccagcaga

SEQ ID NO: 3065869 - RNA, 15 nt, Mycobacterium bovis subsp bovis AF2122/97
gccgccaucgccgau

SEQ ID NO: 3065870 - RNA, 14 nt, Mycobacterium bovis subsp bovis AF2122/97
gccgccaucgccgc

SEQ ID NO: 3065871 - RNA, 20 nt, Mycobacterium bovis subsp bovis AF2122/97
gccgccaugaaaucacccau

SEQ ID NO: 3065872 - RNA, 24 nt, Mycobacterium bovis subsp bovis AF2122/97
gccgccgaacacaccgagcgcgcc

SEQ ID NO: 3065873 - RNA, 17 nt, Mycobacterium bovis subsp bovis AF2122/97
gccgccgaagccgacga

SEQ ID NO: 3065874 - RNA, 16 nt, Mycobacterium bovis subsp bovis AF2122/97
gccgccgaagccgcgc

SEQ ID NO: 3065875 - RNA, 12 nt, Mycobacterium bovis subsp bovis AF2122/97
gccgccgaaucc

SEQ ID NO: 3065876 - RNA, 19 nt, Mycobacterium bovis subsp bovis AF2122/97
gccgccgaauuggcggaac

SEQ ID NO: 3065877 - RNA, 15 nt, Mycobacterium bovis subsp bovis AF2122/97
gccgccgacaacccc

SEQ ID NO: 3065878 - RNA, 22 nt, Mycobacterium bovis subsp bovis AF2122/97
gccgccgacaaccccgccagga

SEQ ID NO: 3065879 - RNA, 20 nt, Mycobacterium bovis subsp bovis AF2122/97
gccgccgacaaucaccaacg

SEQ ID NO: 3065880 - RNA, 13 nt, Mycobacterium bovis subsp bovis AF2122/97
gccgccgacacca

SEQ ID NO: 3065881 - RNA, 14 nt, Mycobacterium bovis subsp bovis AF2122/97
gccgccgacaccac

SEQ ID NO: 3065882 - RNA, 16 nt, Mycobacterium bovis subsp bovis AF2122/97
gccgccgacaccaccg

SEQ ID NO: 3065883 - RNA, 14 nt, Mycobacterium bovis subsp bovis AF2122/97
gccgccgacaggga

SEQ ID NO: 3065884 - RNA, 17 nt, Mycobacterium bovis subsp bovis AF2122/97
gccgccgacagggaccc

SEQ ID NO: 3065885 - RNA, 15 nt, Mycobacterium bovis subsp bovis AF2122/97
gccgccgacgccgcc

SEQ ID NO: 3065886 - RNA, 16 nt, Mycobacterium bovis subsp bovis AF2122/97
gccgccgacgccgccg

SEQ ID NO: 3065887 - RNA, 17 nt, Mycobacterium bovis subsp bovis AF2122/97
gccgccgacgccgccgg

SEQ ID NO: 3065888 - RNA, 21 nt, Mycobacterium bovis subsp bovis AF2122/97
gccgccgacgccgccggcacc

SEQ ID NO: 3065889 - RNA, 19 nt, Mycobacterium bovis subsp bovis AF2122/97
gccgccgacgccgccggcg

SEQ ID NO: 3065890 - RNA, 18 nt, Mycobacterium bovis subsp bovis AF2122/97
gccgccgacguuggggau

SEQ ID NO: 3065891 - RNA, 20 nt, Mycobacterium bovis subsp bovis AF2122/97
gccgccgacuuccgcgucgc

SEQ ID NO: 3065892 - RNA, 21 nt, Mycobacterium bovis subsp bovis AF2122/97
gccgccgacuuccgcgucgcc

SEQ ID NO: 3065893 - RNA, 19 nt, Mycobacterium bovis subsp bovis AF2122/97
gccgccgacuugauuucga

SEQ ID NO: 3065894 - RNA, 21 nt, Mycobacterium bovis subsp bovis AF2122/97
gccgccgacuugauuucgauc

SEQ ID NO: 3065895 - RNA, 18 nt, Mycobacterium bovis subsp bovis AF2122/97
gccgccgagacgaccucc

SEQ ID NO: 3065896 - RNA, 23 nt, Mycobacterium bovis subsp bovis AF2122/97
gccgccgagaugaugcugccggc

SEQ ID NO: 3065897 - RNA, 15 nt, Mycobacterium bovis subsp bovis AF2122/97
gccgccgagcggacc

SEQ ID NO: 3065898 - RNA, 18 nt, Mycobacterium bovis subsp bovis AF2122/97
gccgccgagcggaccacc

SEQ ID NO: 3065899 - RNA, 21 nt, Mycobacterium bovis subsp bovis AF2122/97
gccgccgagcggaccaccgcu

SEQ ID NO: 3065900 - RNA, 13 nt, Mycobacterium bovis subsp bovis AF2122/97
gccgccgagcucg

SEQ ID NO: 3065901 - RNA, 21 nt, Mycobacterium bovis subsp bovis AF2122/97
gccgccgagcucggucaccac

SEQ ID NO: 3065902 - RNA, 16 nt, Mycobacterium bovis subsp bovis AF2122/97
gccgccgagcuggcgc

SEQ ID NO: 3065903 - RNA, 17 nt, Mycobacterium bovis subsp bovis AF2122/97
gccgccgagcuggcgcg

SEQ ID NO: 3065904 - RNA, 21 nt, Mycobacterium bovis subsp bovis AF2122/97
gccgccgagcuggcgcgcggg

SEQ ID NO: 3065905 - RNA, 17 nt, Mycobacterium bovis subsp bovis AF2122/97
gccgccgagggcgccgg

SEQ ID NO: 3065906 - RNA, 18 nt, Mycobacterium bovis subsp bovis AF2122/97
gccgccgagggcgccggg

SEQ ID NO: 3065907 - RNA, 19 nt, Mycobacterium bovis subsp bovis AF2122/97
gccgccgagggcgccgggg

SEQ ID NO: 3065908 - RNA, 18 nt, Mycobacterium bovis subsp bovis AF2122/97
gccgccgauaccgccggc

SEQ ID NO: 3065909 - RNA, 19 nt, Mycobacterium bovis subsp bovis AF2122/97
gccgccgauaccgccggcc

SEQ ID NO: 3065910 - RNA, 21 nt, Mycobacterium bovis subsp bovis AF2122/97
gccgccgauaccgccggcccc

SEQ ID NO: 3065911 - RNA, 14 nt, Mycobacterium bovis subsp bovis AF2122/97
gccgccgaucacca

SEQ ID NO: 3065912 - RNA, 15 nt, Mycobacterium bovis subsp bovis AF2122/97
gccgccgaucaccag

SEQ ID NO: 3065913 - RNA, 15 nt, Mycobacterium bovis subsp bovis AF2122/97
gccgccgaucccguc

SEQ ID NO: 3065914 - RNA, 17 nt, Mycobacterium bovis subsp bovis AF2122/97
gccgccgaucgacaccc

SEQ ID NO: 3065915 - RNA, 23 nt, Mycobacterium bovis subsp bovis AF2122/97
gccgccgaucgacacccgcucgg

SEQ ID NO: 3065916 - RNA, 15 nt, Mycobacterium bovis subsp bovis AF2122/97
gccgccgaugccacc

SEQ ID NO: 3065917 - RNA, 16 nt, Mycobacterium bovis subsp bovis AF2122/97
gccgccgaugccaccg

SEQ ID NO: 3065918 - RNA, 17 nt, Mycobacterium bovis subsp bovis AF2122/97
gccgccgaugccaccgc

SEQ ID NO: 3065919 - RNA, 18 nt, Mycobacterium bovis subsp bovis AF2122/97
gccgccgaugccaccgcu

SEQ ID NO: 3065920 - RNA, 17 nt, Mycobacterium bovis subsp bovis AF2122/97
gccgccgaugucgacga

SEQ ID NO: 3065921 - RNA, 12 nt, Mycobacterium bovis subsp bovis AF2122/97
gccgccgcagcu

SEQ ID NO: 3065922 - RNA, 18 nt, Mycobacterium bovis subsp bovis AF2122/97
gccgccgcagcuccccga

SEQ ID NO: 3065923 - RNA, 14 nt, Mycobacterium bovis subsp bovis AF2122/97
gccgccgccaccac

SEQ ID NO: 3065924 - RNA, 16 nt, Mycobacterium bovis subsp bovis AF2122/97
gccgccgccaccaccc

SEQ ID NO: 3065925 - RNA, 15 nt, Mycobacterium bovis subsp bovis AF2122/97
gccgccgccaccggc

SEQ ID NO: 3065926 - RNA, 13 nt, Mycobacterium bovis subsp bovis AF2122/97
gccgccgccccgg

SEQ ID NO: 3065927 - RNA, 16 nt, Mycobacterium bovis subsp bovis AF2122/97
gccgccgccccggcgc

SEQ ID NO: 3065928 - RNA, 12 nt, Mycobacterium bovis subsp bovis AF2122/97
gccgccgcccgg

SEQ ID NO: 3065929 - RNA, 10 nt, Mycobacterium bovis subsp bovis AF2122/97
gccgccgccg

SEQ ID NO: 3065930 - RNA, 16 nt, Mycobacterium bovis subsp bovis AF2122/97
gccgccgccgacgccg

SEQ ID NO: 3065931 - RNA, 13 nt, Mycobacterium bovis subsp bovis AF2122/97
gccgccgccgcca

SEQ ID NO: 3065932 - RNA, 14 nt, Mycobacterium bovis subsp bovis AF2122/97
gccgccgccgccau

SEQ ID NO: 3065933 - RNA, 15 nt, Mycobacterium bovis subsp bovis AF2122/97
gccgccgccgccauc

SEQ ID NO: 3065934 - RNA, 16 nt, Mycobacterium bovis subsp bovis AF2122/97
gccgccgccgccaucg

SEQ ID NO: 3065935 - RNA, 16 nt, Mycobacterium bovis subsp bovis AF2122/97
gccgccgccgccggcg

SEQ ID NO: 3065936 - RNA, 15 nt, Mycobacterium bovis subsp bovis AF2122/97
gccgccgccggcgcc

SEQ ID NO: 3065937 - RNA, 14 nt, Mycobacterium bovis subsp bovis AF2122/97
gccgccgccggcgg

SEQ ID NO: 3065938 - RNA, 12 nt, Mycobacterium bovis subsp bovis AF2122/97
gccgccgccggg

SEQ ID NO: 3065939 - RNA, 17 nt, Mycobacterium bovis subsp bovis AF2122/97
gccgccgccgucggcga

SEQ ID NO: 3065940 - RNA, 22 nt, Mycobacterium bovis subsp bovis AF2122/97
gccgccgccugcuccucggcca

SEQ ID NO: 3065941 - RNA, 14 nt, Mycobacterium bovis subsp bovis AF2122/97
gccgccgccugugc

SEQ ID NO: 3065942 - RNA, 19 nt, Mycobacterium bovis subsp bovis AF2122/97
gccgccgccugugcgcggu

SEQ ID NO: 3065943 - RNA, 21 nt, Mycobacterium bovis subsp bovis AF2122/97
gccgccgccugugcgcgguga

SEQ ID NO: 3065944 - RNA, 13 nt, Mycobacterium bovis subsp bovis AF2122/97
gccgccgcgacca

SEQ ID NO: 3065945 - RNA, 17 nt, Mycobacterium bovis subsp bovis AF2122/97
gccgccgcgacggcacg

SEQ ID NO: 3065946 - RNA, 17 nt, Mycobacterium bovis subsp bovis AF2122/97
gccgccgcgagcgccgg

SEQ ID NO: 3065947 - RNA, 21 nt, Mycobacterium bovis subsp bovis AF2122/97
gccgccgcgagcgccggccgc

SEQ ID NO: 3065948 - RNA, 13 nt, Mycobacterium bovis subsp bovis AF2122/97
gccgccgcgagga

SEQ ID NO: 3065949 - RNA, 14 nt, Mycobacterium bovis subsp bovis AF2122/97
gccgccgcgauggc

SEQ ID NO: 3065950 - RNA, 14 nt, Mycobacterium bovis subsp bovis AF2122/97
gccgccgcgccccg

SEQ ID NO: 3065951 - RNA, 12 nt, Mycobacterium bovis subsp bovis AF2122/97
gccgccgcgccg

SEQ ID NO: 3065952 - RNA, 13 nt, Mycobacterium bovis subsp bovis AF2122/97
gccgccgcgccgg

SEQ ID NO: 3065953 - RNA, 14 nt, Mycobacterium bovis subsp bovis AF2122/97
gccgccgcggcagg

SEQ ID NO: 3065954 - RNA, 19 nt, Mycobacterium bovis subsp bovis AF2122/97
gccgccgcggcagggcggu

SEQ ID NO: 3065955 - RNA, 12 nt, Mycobacterium bovis subsp bovis AF2122/97
gccgccgcggcc

SEQ ID NO: 3065956 - RNA, 13 nt, Mycobacterium bovis subsp bovis AF2122/97
gccgccgcggcca

SEQ ID NO: 3065957 - RNA, 15 nt, Mycobacterium bovis subsp bovis AF2122/97
gccgccgcggccacc

SEQ ID NO: 3065958 - RNA, 16 nt, Mycobacterium bovis subsp bovis AF2122/97
gccgccgcggccacca

SEQ ID NO: 3065959 - RNA, 21 nt, Mycobacterium bovis subsp bovis AF2122/97
gccgccgggaaauaucucggu

SEQ ID NO: 3065960 - RNA, 23 nt, Mycobacterium bovis subsp bovis AF2122/97
gccgccgggaaauaucucgguga

SEQ ID NO: 3065961 - RNA, 18 nt, Mycobacterium bovis subsp bovis AF2122/97
gccgccgggauaacccag

SEQ ID NO: 3065962 - RNA, 20 nt, Mycobacterium bovis subsp bovis AF2122/97
gccgccgggauaacccagca

SEQ ID NO: 3065963 - RNA, 13 nt, Mycobacterium bovis subsp bovis AF2122/97
gccgccgggcauc

SEQ ID NO: 3065964 - RNA, 14 nt, Mycobacterium bovis subsp bovis AF2122/97
gccgccgggcaucg

SEQ ID NO: 3065965 - RNA, 17 nt, Mycobacterium bovis subsp bovis AF2122/97
gccgccgggugcgccgu

SEQ ID NO: 3065966 - RNA, 18 nt, Mycobacterium bovis subsp bovis AF2122/97
gccgccggguuuauccag

SEQ ID NO: 3065967 - RNA, 13 nt, Mycobacterium bovis subsp bovis AF2122/97
gccgccggucauc

SEQ ID NO: 3065968 - RNA, 14 nt, Mycobacterium bovis subsp bovis AF2122/97
gccgccggucaucc

SEQ ID NO: 3065969 - RNA, 19 nt, Mycobacterium bovis subsp bovis AF2122/97
gccgccggucaucccaagc

SEQ ID NO: 3065970 - RNA, 20 nt, Mycobacterium bovis subsp bovis AF2122/97
gccgccggucaucccaagcg

SEQ ID NO: 3065971 - RNA, 15 nt, Mycobacterium bovis subsp bovis AF2122/97
gccgccgguccccuc

SEQ ID NO: 3065972 - RNA, 19 nt, Mycobacterium bovis subsp bovis AF2122/97
gccgccggugaggaucagc

SEQ ID NO: 3065973 - RNA, 15 nt, Mycobacterium bovis subsp bovis AF2122/97
gccgccggugccacc

SEQ ID NO: 3065974 - RNA, 16 nt, Mycobacterium bovis subsp bovis AF2122/97
gccgccggugccaccg

SEQ ID NO: 3065975 - RNA, 20 nt, Mycobacterium bovis subsp bovis AF2122/97
gccgccggugccaccgacgc

SEQ ID NO: 3065976 - RNA, 14 nt, Mycobacterium bovis subsp bovis AF2122/97
gccgccggugccgc

SEQ ID NO: 3065977 - RNA, 15 nt, Mycobacterium bovis subsp bovis AF2122/97
gccgccggugccgcc

SEQ ID NO: 3065978 - RNA, 16 nt, Mycobacterium bovis subsp bovis AF2122/97
gccgccggugccgcca

SEQ ID NO: 3065979 - RNA, 16 nt, Mycobacterium bovis subsp bovis AF2122/97
gccgccggugccgccc

SEQ ID NO: 3065980 - RNA, 19 nt, Mycobacterium bovis subsp bovis AF2122/97
gccgccggugccgcccgag

SEQ ID NO: 3065981 - RNA, 17 nt, Mycobacterium bovis subsp bovis AF2122/97
gccgccggugccgccgc

SEQ ID NO: 3065982 - RNA, 20 nt, Mycobacterium bovis subsp bovis AF2122/97
gccgccgguggugccggcgc

SEQ ID NO: 3065983 - RNA, 21 nt, Mycobacterium bovis subsp bovis AF2122/97
gccgccgguggugccggcgcc

SEQ ID NO: 3065984 - RNA, 19 nt, Mycobacterium bovis subsp bovis AF2122/97
gccgccgguguaacccucg

SEQ ID NO: 3065985 - RNA, 20 nt, Mycobacterium bovis subsp bovis AF2122/97
gccgccgguguuagccccga

SEQ ID NO: 3065986 - RNA, 14 nt, Mycobacterium bovis subsp bovis AF2122/97
gccgccgguguugc

SEQ ID NO: 3065987 - RNA, 22 nt, Mycobacterium bovis subsp bovis AF2122/97
gccgccgguuccgccggcccca

SEQ ID NO: 3065988 - RNA, 17 nt, Mycobacterium bovis subsp bovis AF2122/97
gccgccguaacggucgc

SEQ ID NO: 3065989 - RNA, 21 nt, Mycobacterium bovis subsp bovis AF2122/97
gccgccgucaccgcccuugcc

SEQ ID NO: 3065990 - RNA, 17 nt, Mycobacterium bovis subsp bovis AF2122/97
gccgccgucaccgccgu

SEQ ID NO: 3065991 - RNA, 23 nt, Mycobacterium bovis subsp bovis AF2122/97
gccgccgucaccgccguugccga

SEQ ID NO: 3065992 - RNA, 18 nt, Mycobacterium bovis subsp bovis AF2122/97
gccgccguccagcgccgc

SEQ ID NO: 3065993 - RNA, 12 nt, Mycobacterium bovis subsp bovis AF2122/97
gccgccgucccc

SEQ ID NO: 3065994 - RNA, 15 nt, Mycobacterium bovis subsp bovis AF2122/97
gccgccguccccgcc

SEQ ID NO: 3065995 - RNA, 17 nt, Mycobacterium bovis subsp bovis AF2122/97
gccgccguccccgccga

SEQ ID NO: 3065996 - RNA, 20 nt, Mycobacterium bovis subsp bovis AF2122/97
gccgccguccccgccgacgc

SEQ ID NO: 3065997 - RNA, 20 nt, Mycobacterium bovis subsp bovis AF2122/97
gccgccguccccgccgucgc

SEQ ID NO: 3065998 - RNA, 22 nt, Mycobacterium bovis subsp bovis AF2122/97
gccgccguccccgccgucgcca

SEQ ID NO: 3065999 - RNA, 12 nt, Mycobacterium bovis subsp bovis AF2122/97
gccgccgucgac

SEQ ID NO: 3066000 - RNA, 13 nt, Mycobacterium bovis subsp bovis AF2122/97
gccgccgucgccg

SEQ ID NO: 3066001 - RNA, 14 nt, Mycobacterium bovis subsp bovis AF2122/97
gccgccgucgccga

SEQ ID NO: 3066002 - RNA, 15 nt, Mycobacterium bovis subsp bovis AF2122/97
gccgccgucgccgau

SEQ ID NO: 3066003 - RNA, 15 nt, Mycobacterium bovis subsp bovis AF2122/97
gccgccgucgccgcc

SEQ ID NO: 3066004 - RNA, 16 nt, Mycobacterium bovis subsp bovis AF2122/97
gccgccgucgccgccg

SEQ ID NO: 3066005 - RNA, 17 nt, Mycobacterium bovis subsp bovis AF2122/97
gccgccgucgccggugc

SEQ ID NO: 3066006 - RNA, 13 nt, Mycobacterium bovis subsp bovis AF2122/97
gccgccgucggcg

SEQ ID NO: 3066007 - RNA, 18 nt, Mycobacterium bovis subsp bovis AF2122/97
gccgccgucggcgagcag

SEQ ID NO: 3066008 - RNA, 21 nt, Mycobacterium bovis subsp bovis AF2122/97
gccgccguggcgucggcguca

SEQ ID NO: 3066009 - RNA, 17 nt, Mycobacterium bovis subsp bovis AF2122/97
gccgccguuaccgccgc

SEQ ID NO: 3066010 - RNA, 22 nt, Mycobacterium bovis subsp bovis AF2122/97
gccgccguuaccgccgcugccg

SEQ ID NO: 3066011 - RNA, 18 nt, Mycobacterium bovis subsp bovis AF2122/97
gccgccguuaccgccggc

SEQ ID NO: 3066012 - RNA, 22 nt, Mycobacterium bovis subsp bovis AF2122/97
gccgccguuaccgccggcgccg

SEQ ID NO: 3066013 - RNA, 17 nt, Mycobacterium bovis subsp bovis AF2122/97
gccgccguucccaccac

SEQ ID NO: 3066014 - RNA, 20 nt, Mycobacterium bovis subsp bovis AF2122/97
gccgccguucccgccggcgc

SEQ ID NO: 3066015 - RNA, 21 nt, Mycobacterium bovis subsp bovis AF2122/97
gccgccguucccgccggcgcc

SEQ ID NO: 3066016 - RNA, 23 nt, Mycobacterium bovis subsp bovis AF2122/97
gccgccguucgggaugcaaggaa

SEQ ID NO: 3066017 - RNA, 22 nt, Mycobacterium bovis subsp bovis AF2122/97
gccgccguugccauugccuccc

SEQ ID NO: 3066018 - RNA, 20 nt, Mycobacterium bovis subsp bovis AF2122/97
gccgccguugccgccaucac

SEQ ID NO: 3066019 - RNA, 17 nt, Mycobacterium bovis subsp bovis AF2122/97
gccgccguugccgccga

SEQ ID NO: 3066020 - RNA, 17 nt, Mycobacterium bovis subsp bovis AF2122/97
gccgccguugccgccgg

SEQ ID NO: 3066021 - RNA, 18 nt, Mycobacterium bovis subsp bovis AF2122/97
gccgccguugccgccggc

SEQ ID NO: 3066022 - RNA, 20 nt, Mycobacterium bovis subsp bovis AF2122/97
gccgccguugccgccgucgu

SEQ ID NO: 3066023 - RNA, 23 nt, Mycobacterium bovis subsp bovis AF2122/97
gccgccguugccgccguugccga

SEQ ID NO: 3066024 - RNA, 14 nt, Mycobacterium bovis subsp bovis AF2122/97
gccgccguugccgg

SEQ ID NO: 3066025 - RNA, 16 nt, Mycobacterium bovis subsp bovis AF2122/97
gccgccguugccggcu

SEQ ID NO: 3066026 - RNA, 17 nt, Mycobacterium bovis subsp bovis AF2122/97
gccgccguugccggcuu

SEQ ID NO: 3066027 - RNA, 22 nt, Mycobacterium bovis subsp bovis AF2122/97
gccgccguugccggcuuggccu

SEQ ID NO: 3066028 - RNA, 16 nt, Mycobacterium bovis subsp bovis AF2122/97
gccgccguugccgucg

SEQ ID NO: 3066029 - RNA, 17 nt, Mycobacterium bovis subsp bovis AF2122/97
gccgccguugccgucgu

SEQ ID NO: 3066030 - RNA, 20 nt, Mycobacterium bovis subsp bovis AF2122/97
gccgccguugccguuggugc

SEQ ID NO: 3066031 - RNA, 20 nt, Mycobacterium bovis subsp bovis AF2122/97
gccgccguuggcucgagccg

SEQ ID NO: 3066032 - RNA, 22 nt, Mycobacterium bovis subsp bovis AF2122/97
gccgccguuggcucgagccgcc

SEQ ID NO: 3066033 - RNA, 16 nt, Mycobacterium bovis subsp bovis AF2122/97
gccgccguuuccugcg

SEQ ID NO: 3066034 - RNA, 22 nt, Mycobacterium bovis subsp bovis AF2122/97
gccgccuacccguucuucgcga

SEQ ID NO: 3066035 - RNA, 18 nt, Mycobacterium bovis subsp bovis AF2122/97
gccgccucaaugaccacc

SEQ ID NO: 3066036 - RNA, 17 nt, Mycobacterium bovis subsp bovis AF2122/97
gccgccuccgccgaggc

SEQ ID NO: 3066037 - RNA, 14 nt, Mycobacterium bovis subsp bovis AF2122/97
gccgccuccgcggc

SEQ ID NO: 3066038 - RNA, 16 nt, Mycobacterium bovis subsp bovis AF2122/97
gccgccuccgcggcau

SEQ ID NO: 3066039 - RNA, 19 nt, Mycobacterium bovis subsp bovis AF2122/97
gccgccucgaucgacucga

SEQ ID NO: 3066040 - RNA, 22 nt, Mycobacterium bovis subsp bovis AF2122/97
gccgccucgcggaugagcucgg

SEQ ID NO: 3066041 - RNA, 14 nt, Mycobacterium bovis subsp bovis AF2122/97
gccgccucgggcac

SEQ ID NO: 3066042 - RNA, 16 nt, Mycobacterium bovis subsp bovis AF2122/97
gccgccucgggcaccu

SEQ ID NO: 3066043 - RNA, 13 nt, Mycobacterium bovis subsp bovis AF2122/97
gccgccugcccgg

SEQ ID NO: 3066044 - RNA, 17 nt, Mycobacterium bovis subsp bovis AF2122/97
gccgccugcccggcccg

SEQ ID NO: 3066045 - RNA, 12 nt, Mycobacterium bovis subsp bovis AF2122/97
gccgcgauggcc

SEQ ID NO: 3066046 - RNA, 15 nt, Mycobacterium bovis subsp bovis AF2122/97
gccgcgauggccccu

SEQ ID NO: 3066047 - RNA, 16 nt, Mycobacterium bovis subsp bovis AF2122/97
gccgcgauggccccug

SEQ ID NO: 3066048 - RNA, 21 nt, Mycobacterium bovis subsp bovis AF2122/97
gccgcgauggcgguccaccgg

SEQ ID NO: 3066049 - RNA, 15 nt, Mycobacterium bovis subsp bovis AF2122/97
gccgcgauggcguag

SEQ ID NO: 3066050 - RNA, 23 nt, Mycobacterium bovis subsp bovis AF2122/97
gccgcgaugugguggacgccaug

SEQ ID NO: 3066051 - RNA, 19 nt, Mycobacterium bovis subsp bovis AF2122/97
gccgcgcaccaacaccagc

SEQ ID NO: 3066052 - RNA, 23 nt, Mycobacterium bovis subsp bovis AF2122/97
gccgcgcacccguccgccgcaga

SEQ ID NO: 3066053 - RNA, 12 nt, Mycobacterium bovis subsp bovis AF2122/97
gccgcgcaccga

SEQ ID NO: 3066054 - RNA, 17 nt, Mycobacterium bovis subsp bovis AF2122/97
gccgcgcaccgaccgca

SEQ ID NO: 3066055 - RNA, 20 nt, Mycobacterium bovis subsp bovis AF2122/97
gccgcgcaccgaccgcaccg

SEQ ID NO: 3066056 - RNA, 13 nt, Mycobacterium bovis subsp bovis AF2122/97
gccgcgcaccgcg

SEQ ID NO: 3066057 - RNA, 16 nt, Mycobacterium bovis subsp bovis AF2122/97
gccgcgcagccgcucg

SEQ ID NO: 3066058 - RNA, 17 nt, Mycobacterium bovis subsp bovis AF2122/97
gccgcgcagccgcucga

SEQ ID NO: 3066059 - RNA, 20 nt, Mycobacterium bovis subsp bovis AF2122/97
gccgcgcagccgcucgacgg

SEQ ID NO: 3066060 - RNA, 14 nt, Mycobacterium bovis subsp bovis AF2122/97
gccgcgcagcgcgg

SEQ ID NO: 3066061 - RNA, 13 nt, Mycobacterium bovis subsp bovis AF2122/97
gccgcgcagcgug

SEQ ID NO: 3066062 - RNA, 14 nt, Mycobacterium bovis subsp bovis AF2122/97
gccgcgcagcgugc

SEQ ID NO: 3066063 - RNA, 12 nt, Mycobacterium bovis subsp bovis AF2122/97
gccgcgcagcug

SEQ ID NO: 3066064 - RNA, 13 nt, Mycobacterium bovis subsp bovis AF2122/97
gccgcgcagcugc

SEQ ID NO: 3066065 - RNA, 16 nt, Mycobacterium bovis subsp bovis AF2122/97
gccgcgcagcugccgc

SEQ ID NO: 3066066 - RNA, 20 nt, Mycobacterium bovis subsp bovis AF2122/97
gccgcgcaggcuuccagcca

SEQ ID NO: 3066067 - RNA, 21 nt, Mycobacterium bovis subsp bovis AF2122/97
gccgcgcaggcuuccagccac

SEQ ID NO: 3066068 - RNA, 20 nt, Mycobacterium bovis subsp bovis AF2122/97
gccgcgcaggggcggcguga

SEQ ID NO: 3066069 - RNA, 14 nt, Mycobacterium bovis subsp bovis AF2122/97
gccgcgcauccgca

SEQ ID NO: 3066070 - RNA, 13 nt, Mycobacterium bovis subsp bovis AF2122/97
gccgcgcaucgcg

SEQ ID NO: 3066071 - RNA, 17 nt, Mycobacterium bovis subsp bovis AF2122/97
gccgcgcaucgcggccg

SEQ ID NO: 3066072 - RNA, 18 nt, Mycobacterium bovis subsp bovis AF2122/97
gccgcgcaucgcggccga

SEQ ID NO: 3066073 - RNA, 22 nt, Mycobacterium bovis subsp bovis AF2122/97
gccgcgcaucugucgcgcggca

SEQ ID NO: 3066074 - RNA, 22 nt, Mycobacterium bovis subsp bovis AF2122/97
gccgcgcccaaugcgggcuggg

SEQ ID NO: 3066075 - RNA, 13 nt, Mycobacterium bovis subsp bovis AF2122/97
gccgcgcccacca

SEQ ID NO: 3066076 - RNA, 16 nt, Mycobacterium bovis subsp bovis AF2122/97
gccgcgcccaccauga

SEQ ID NO: 3066077 - RNA, 14 nt, Mycobacterium bovis subsp bovis AF2122/97
gccgcgcccggcgc

SEQ ID NO: 3066078 - RNA, 16 nt, Mycobacterium bovis subsp bovis AF2122/97
gccgcgcccggcgcaa

SEQ ID NO: 3066079 - RNA, 20 nt, Mycobacterium bovis subsp bovis AF2122/97
gccgcgcccggcgcaagcgc

SEQ ID NO: 3066080 - RNA, 18 nt, Mycobacterium bovis subsp bovis AF2122/97
gccgcgcccggcgcuagc

SEQ ID NO: 3066081 - RNA, 20 nt, Mycobacterium bovis subsp bovis AF2122/97
gccgcgccgaaucgcgggcu

SEQ ID NO: 3066082 - RNA, 13 nt, Mycobacterium bovis subsp bovis AF2122/97
gccgcgccgaccu

SEQ ID NO: 3066083 - RNA, 21 nt, Mycobacterium bovis subsp bovis AF2122/97
gccgcgccgaccucaucggca

SEQ ID NO: 3066084 - RNA, 20 nt, Mycobacterium bovis subsp bovis AF2122/97
gccgcgccgauuccaccgcc

SEQ ID NO: 3066085 - RNA, 16 nt, Mycobacterium bovis subsp bovis AF2122/97
gccgcgccgcagagca

SEQ ID NO: 3066086 - RNA, 12 nt, Mycobacterium bovis subsp bovis AF2122/97
gccgcgccgccu

SEQ ID NO: 3066087 - RNA, 17 nt, Mycobacterium bovis subsp bovis AF2122/97
gccgcgccgcgccgccu

SEQ ID NO: 3066088 - RNA, 13 nt, Mycobacterium bovis subsp bovis AF2122/97
gccgcgccgcggc

SEQ ID NO: 3066089 - RNA, 15 nt, Mycobacterium bovis subsp bovis AF2122/97
gccgcgccgcggccc

SEQ ID NO: 3066090 - RNA, 12 nt, Mycobacterium bovis subsp bovis AF2122/97
gccgcgccggca

SEQ ID NO: 3066091 - RNA, 13 nt, Mycobacterium bovis subsp bovis AF2122/97
gccgcgccggcac

SEQ ID NO: 3066092 - RNA, 12 nt, Mycobacterium bovis subsp bovis AF2122/97
gccgcgccggcg

SEQ ID NO: 3066093 - RNA, 15 nt, Mycobacterium bovis subsp bovis AF2122/97
gccgcgccggcggcc

SEQ ID NO: 3066094 - RNA, 18 nt, Mycobacterium bovis subsp bovis AF2122/97
gccgcgccggcgggcgag

SEQ ID NO: 3066095 - RNA, 14 nt, Mycobacterium bovis subsp bovis AF2122/97
gccgcgccggucgu

SEQ ID NO: 3066096 - RNA, 24 nt, Mycobacterium bovis subsp bovis AF2122/97
gccgcgccguaguucuccgccaac

SEQ ID NO: 3066097 - RNA, 15 nt, Mycobacterium bovis subsp bovis AF2122/97
gccgcgccgucccga

SEQ ID NO: 3066098 - RNA, 15 nt, Mycobacterium bovis subsp bovis AF2122/97
gccgcgccucggucu

SEQ ID NO: 3066099 - RNA, 15 nt, Mycobacterium bovis subsp bovis AF2122/97
gccgcgcgacaaccc

SEQ ID NO: 3066100 - RNA, 18 nt, Mycobacterium bovis subsp bovis AF2122/97
gccgcgcgacaacccggc

SEQ ID NO: 3066101 - RNA, 23 nt, Mycobacterium bovis subsp bovis AF2122/97
gccgcgcgacaacccggcgucga

SEQ ID NO: 3066102 - RNA, 21 nt, Mycobacterium bovis subsp bovis AF2122/97
gccgcgcgcacuugcguggcg

SEQ ID NO: 3066103 - RNA, 13 nt, Mycobacterium bovis subsp bovis AF2122/97
gccgcgcgccauc

SEQ ID NO: 3066104 - RNA, 14 nt, Mycobacterium bovis subsp bovis AF2122/97
gccgcgcgccaucg

SEQ ID NO: 3066105 - RNA, 13 nt, Mycobacterium bovis subsp bovis AF2122/97
gccgcgcgccggc

SEQ ID NO: 3066106 - RNA, 13 nt, Mycobacterium bovis subsp bovis AF2122/97
gccgcgcgcgccg

SEQ ID NO: 3066107 - RNA, 15 nt, Mycobacterium bovis subsp bovis AF2122/97
gccgcgcgcggcgua

SEQ ID NO: 3066108 - RNA, 16 nt, Mycobacterium bovis subsp bovis AF2122/97
gccgcgcgcggcguag

SEQ ID NO: 3066109 - RNA, 22 nt, Mycobacterium bovis subsp bovis AF2122/97
gccgcgcgcugccgcugcgcgu

SEQ ID NO: 3066110 - RNA, 21 nt, Mycobacterium bovis subsp bovis AF2122/97
gccgcgcggaacaccgaggcg

SEQ ID NO: 3066111 - RNA, 17 nt, Mycobacterium bovis subsp bovis AF2122/97
gccgcgcggacccagca

SEQ ID NO: 3066112 - RNA, 19 nt, Mycobacterium bovis subsp bovis AF2122/97
gccgcgcggacccagcacc

SEQ ID NO: 3066113 - RNA, 15 nt, Mycobacterium bovis subsp bovis AF2122/97
gccgcgcggauacgc

SEQ ID NO: 3066114 - RNA, 12 nt, Mycobacterium bovis subsp bovis AF2122/97
gccgcgcggcga

SEQ ID NO: 3066115 - RNA, 13 nt, Mycobacterium bovis subsp bovis AF2122/97
gccgcgcggcgac

SEQ ID NO: 3066116 - RNA, 14 nt, Mycobacterium bovis subsp bovis AF2122/97
gccgcgcggcgaca

SEQ ID NO: 3066117 - RNA, 23 nt, Mycobacterium bovis subsp bovis AF2122/97
gccgcgcggcgacagcuuggccg

SEQ ID NO: 3066118 - RNA, 18 nt, Mycobacterium bovis subsp bovis AF2122/97
gccgcgcggcggcgccgg

SEQ ID NO: 3066119 - RNA, 19 nt, Mycobacterium bovis subsp bovis AF2122/97
gccgcgcggcuuguaccgc

SEQ ID NO: 3066120 - RNA, 15 nt, Mycobacterium bovis subsp bovis AF2122/97
gccgcgcgggccgcc

SEQ ID NO: 3066121 - RNA, 17 nt, Mycobacterium bovis subsp bovis AF2122/97
gccgcgcgggccgccgc

SEQ ID NO: 3066122 - RNA, 18 nt, Mycobacterium bovis subsp bovis AF2122/97
gccgcgcgggccgccgca

SEQ ID NO: 3066123 - RNA, 23 nt, Mycobacterium bovis subsp bovis AF2122/97
gccgcgcggggugcgcgcgacca

SEQ ID NO: 3066124 - RNA, 21 nt, Mycobacterium bovis subsp bovis AF2122/97
gccgcgcggugauggucaccg

SEQ ID NO: 3066125 - RNA, 17 nt, Mycobacterium bovis subsp bovis AF2122/97
gccgcgcguccgggcag

SEQ ID NO: 3066126 - RNA, 21 nt, Mycobacterium bovis subsp bovis AF2122/97
gccgcgcguccgggcagccgc

SEQ ID NO: 3066127 - RNA, 14 nt, Mycobacterium bovis subsp bovis AF2122/97
gccgcgcguucggc

SEQ ID NO: 3066128 - RNA, 18 nt, Mycobacterium bovis subsp bovis AF2122/97
gccgcgcguucggcgcug

SEQ ID NO: 3066129 - RNA, 18 nt, Mycobacterium bovis subsp bovis AF2122/97
gccgcgcuacgucaagcc

SEQ ID NO: 3066130 - RNA, 23 nt, Mycobacterium bovis subsp bovis AF2122/97
gccgcgcuacgucaagccgugcu

SEQ ID NO: 3066131 - RNA, 16 nt, Mycobacterium bovis subsp bovis AF2122/97
gccgcgcuagcucggc

SEQ ID NO: 3066132 - RNA, 13 nt, Mycobacterium bovis subsp bovis AF2122/97
gccgcggucggcg

SEQ ID NO: 3066133 - RNA, 14 nt, Mycobacterium bovis subsp bovis AF2122/97
gccgcggucggcga

SEQ ID NO: 3066134 - RNA, 15 nt, Mycobacterium bovis subsp bovis AF2122/97
gccgcggucggcgac

SEQ ID NO: 3066135 - RNA, 16 nt, Mycobacterium bovis subsp bovis AF2122/97
gccgcggucggcgacg

SEQ ID NO: 3066136 - RNA, 15 nt, Mycobacterium bovis subsp bovis AF2122/97
gccgcggucggcgug

SEQ ID NO: 3066137 - RNA, 17 nt, Mycobacterium bovis subsp bovis AF2122/97
gccgcggucggcgugca

SEQ ID NO: 3066138 - RNA, 19 nt, Mycobacterium bovis subsp bovis AF2122/97
gccgcggucggcgugcagg

SEQ ID NO: 3066139 - RNA, 20 nt, Mycobacterium bovis subsp bovis AF2122/97
gccgcggucggcgugcaggg

SEQ ID NO: 3066140 - RNA, 18 nt, Mycobacterium bovis subsp bovis AF2122/97
gccgcggucgugaucagc

SEQ ID NO: 3066141 - RNA, 21 nt, Mycobacterium bovis subsp bovis AF2122/97
gccgcggucgugaucagcagg

SEQ ID NO: 3066142 - RNA, 24 nt, Mycobacterium bovis subsp bovis AF2122/97
gccgcggucgugaucagcaggacg

SEQ ID NO: 3066143 - RNA, 15 nt, Mycobacterium bovis subsp bovis AF2122/97
gccgcggucguuggc

SEQ ID NO: 3066144 - RNA, 16 nt, Mycobacterium bovis subsp bovis AF2122/97
gccgcggucguuggcg

SEQ ID NO: 3066145 - RNA, 22 nt, Mycobacterium bovis subsp bovis AF2122/97
gccgcgguggaugcgaugcgcg

SEQ ID NO: 3066146 - RNA, 21 nt, Mycobacterium bovis subsp bovis AF2122/97
gccgcgguguagaagcgggcg

SEQ ID NO: 3066147 - RNA, 17 nt, Mycobacterium bovis subsp bovis AF2122/97
gccgcgguuaucgccga

SEQ ID NO: 3066148 - RNA, 18 nt, Mycobacterium bovis subsp bovis AF2122/97
gccgcgguugugcugggu

SEQ ID NO: 3066149 - RNA, 14 nt, Mycobacterium bovis subsp bovis AF2122/97
gccgcgguuuggcg

SEQ ID NO: 3066150 - RNA, 17 nt, Mycobacterium bovis subsp bovis AF2122/97
gccgcgguuuggcgacg

SEQ ID NO: 3066151 - RNA, 22 nt, Mycobacterium bovis subsp bovis AF2122/97
gccgcgguuuggcgacgucgac

SEQ ID NO: 3066152 - RNA, 17 nt, Mycobacterium bovis subsp bovis AF2122/97
gccgcgguuuucgccgg

SEQ ID NO: 3066153 - RNA, 18 nt, Mycobacterium bovis subsp bovis AF2122/97
gccgcgguuuucgccgga

SEQ ID NO: 3066154 - RNA, 24 nt, Mycobacterium bovis subsp bovis AF2122/97
gccgcguaccaauucccgcgcggc

SEQ ID NO: 3066155 - RNA, 14 nt, Mycobacterium bovis subsp bovis AF2122/97
gccgcguacgaccc

SEQ ID NO: 3066156 - RNA, 18 nt, Mycobacterium bovis subsp bovis AF2122/97
gccgcguagguggccagc

SEQ ID NO: 3066157 - RNA, 20 nt, Mycobacterium bovis subsp bovis AF2122/97
gccgcguagugcuccguccg

SEQ ID NO: 3066158 - RNA, 13 nt, Mycobacterium bovis subsp bovis AF2122/97
gccgcgucaaccg

SEQ ID NO: 3066159 - RNA, 16 nt, Mycobacterium bovis subsp bovis AF2122/97
gccgcgucaaccgauc

SEQ ID NO: 3066160 - RNA, 18 nt, Mycobacterium bovis subsp bovis AF2122/97
gccgcgucaaccgaucgg

SEQ ID NO: 3066161 - RNA, 14 nt, Mycobacterium bovis subsp bovis AF2122/97
gccgcguccagacc

SEQ ID NO: 3066162 - RNA, 16 nt, Mycobacterium bovis subsp bovis AF2122/97
gccgcguccagaccgu

SEQ ID NO: 3066163 - RNA, 15 nt, Mycobacterium bovis subsp bovis AF2122/97
gccgcgucgagcacc

SEQ ID NO: 3066164 - RNA, 12 nt, Mycobacterium bovis subsp bovis AF2122/97
gccgcgucgcga

SEQ ID NO: 3066165 - RNA, 16 nt, Mycobacterium bovis subsp bovis AF2122/97
gccgcgucgcugagca

SEQ ID NO: 3066166 - RNA, 16 nt, Mycobacterium bovis subsp bovis AF2122/97
gccgcgucucggugca

SEQ ID NO: 3066167 - RNA, 21 nt, Mycobacterium bovis subsp bovis AF2122/97
gccgcgucucggugcagcagc

SEQ ID NO: 3066168 - RNA, 22 nt, Mycobacterium bovis subsp bovis AF2122/97
gccgcgucucggugcagcagcg

SEQ ID NO: 3066169 - RNA, 21 nt, Mycobacterium bovis subsp bovis AF2122/97
gccgcgucuuggugcgcguca

SEQ ID NO: 3066170 - RNA, 21 nt, Mycobacterium bovis subsp bovis AF2122/97
gccgcgugacguaccacggcg

SEQ ID NO: 3066171 - RNA, 22 nt, Mycobacterium bovis subsp bovis AF2122/97
gccgcgugacguaccacggcga

SEQ ID NO: 3066172 - RNA, 13 nt, Mycobacterium bovis subsp bovis AF2122/97
gccgcgugcagcc

SEQ ID NO: 3066173 - RNA, 16 nt, Mycobacterium bovis subsp bovis AF2122/97
gccgcgugcagcccca

SEQ ID NO: 3066174 - RNA, 17 nt, Mycobacterium bovis subsp bovis AF2122/97
gccgcgugcagccccaa

SEQ ID NO: 3066175 - RNA, 12 nt, Mycobacterium bovis subsp bovis AF2122/97
gccgcgugccgc

SEQ ID NO: 3066176 - RNA, 15 nt, Mycobacterium bovis subsp bovis AF2122/97
gccgcgugccgcaac

SEQ ID NO: 3066177 - RNA, 14 nt, Mycobacterium bovis subsp bovis AF2122/97
gccgcgugccgccc

SEQ ID NO: 3066178 - RNA, 16 nt, Mycobacterium bovis subsp bovis AF2122/97
gccgcgugccgcccgc

SEQ ID NO: 3066179 - RNA, 15 nt, Mycobacterium bovis subsp bovis AF2122/97
gccgcgugcucgccg

SEQ ID NO: 3066180 - RNA, 16 nt, Mycobacterium bovis subsp bovis AF2122/97
gccgcgugcucgccgu

SEQ ID NO: 3066181 - RNA, 14 nt, Mycobacterium bovis subsp bovis AF2122/97
gccgcgugcugcgg

SEQ ID NO: 3066182 - RNA, 14 nt, Mycobacterium bovis subsp bovis AF2122/97
gccgcguggcuggc

SEQ ID NO: 3066183 - RNA, 16 nt, Mycobacterium bovis subsp bovis AF2122/97
gccgcguggcuggcgg

SEQ ID NO: 3066184 - RNA, 17 nt, Mycobacterium bovis subsp bovis AF2122/97
gccgcguggcuggcggc

SEQ ID NO: 3066185 - RNA, 19 nt, Mycobacterium bovis subsp bovis AF2122/97
gccgcguggcuggcggcga

SEQ ID NO: 3066186 - RNA, 16 nt, Mycobacterium bovis subsp bovis AF2122/97
gccgcgugggcaugcg

SEQ ID NO: 3066187 - RNA, 20 nt, Mycobacterium bovis subsp bovis AF2122/97
gccgcgugguuccggcgugc

SEQ ID NO: 3066188 - RNA, 21 nt, Mycobacterium bovis subsp bovis AF2122/97
gccgcgugguuccggcgugca

SEQ ID NO: 3066189 - RNA, 15 nt, Mycobacterium bovis subsp bovis AF2122/97
gccgcguucacgcaa

SEQ ID NO: 3066190 - RNA, 23 nt, Mycobacterium bovis subsp bovis AF2122/97
gccgcguucgcgcaaaugccugc

SEQ ID NO: 3066191 - RNA, 16 nt, Mycobacterium bovis subsp bovis AF2122/97
gccgcguugccggucg

SEQ ID NO: 3066192 - RNA, 21 nt, Mycobacterium bovis subsp bovis AF2122/97
gccgcguugccggucgcaugg

SEQ ID NO: 3066193 - RNA, 13 nt, Mycobacterium bovis subsp bovis AF2122/97
gccgcguuggggu

SEQ ID NO: 3066194 - RNA, 22 nt, Mycobacterium bovis subsp bovis AF2122/97
gccgcguuucggucguuggugc

SEQ ID NO: 3066195 - RNA, 22 nt, Mycobacterium bovis subsp bovis AF2122/97
gccgcguuugggguuguuggcg

SEQ ID NO: 3066196 - RNA, 21 nt, Mycobacterium bovis subsp bovis AF2122/97
gccgcuaauggauccagcccg

SEQ ID NO: 3066197 - RNA, 19 nt, Mycobacterium bovis subsp bovis AF2122/97
gccgcuaccccagccggca

SEQ ID NO: 3066198 - RNA, 22 nt, Mycobacterium bovis subsp bovis AF2122/97
gccgcuaccccagccggcagca

SEQ ID NO: 3066199 - RNA, 23 nt, Mycobacterium bovis subsp bovis AF2122/97
gccgcuaccccagccggcagcag

SEQ ID NO: 3066200 - RNA, 19 nt, Mycobacterium bovis subsp bovis AF2122/97
gccgcuacccccgauggcg

SEQ ID NO: 3066201 - RNA, 13 nt, Mycobacterium bovis subsp bovis AF2122/97
gccgcuaccgaac

SEQ ID NO: 3066202 - RNA, 18 nt, Mycobacterium bovis subsp bovis AF2122/97
gccgcuaccgcccgcgcc

SEQ ID NO: 3066203 - RNA, 20 nt, Mycobacterium bovis subsp bovis AF2122/97
gccgcuaccgcccgcgccac

SEQ ID NO: 3066204 - RNA, 14 nt, Mycobacterium bovis subsp bovis AF2122/97
gccgcuaccgccgg

SEQ ID NO: 3066205 - RNA, 14 nt, Mycobacterium bovis subsp bovis AF2122/97
gccgcuacgccggc

SEQ ID NO: 3066206 - RNA, 17 nt, Mycobacterium bovis subsp bovis AF2122/97
gccgcuagcggauucag

SEQ ID NO: 3066207 - RNA, 15 nt, Mycobacterium bovis subsp bovis AF2122/97
gccgcuaggacggcg

SEQ ID NO: 3066208 - RNA, 17 nt, Mycobacterium bovis subsp bovis AF2122/97
gccgcuaggacggcgcg

SEQ ID NO: 3066209 - RNA, 20 nt, Mycobacterium bovis subsp bovis AF2122/97
gccgcuaggacggcgcgagc

SEQ ID NO: 3066210 - RNA, 22 nt, Mycobacterium bovis subsp bovis AF2122/97
gccgcuaggacggcgcgagccg

SEQ ID NO: 3066211 - RNA, 22 nt, Mycobacterium bovis subsp bovis AF2122/97
gccgcuaggugacgccgccagc

SEQ ID NO: 3066212 - RNA, 22 nt, Mycobacterium bovis subsp bovis AF2122/97
gccgcuaucgaggaggcggucg

SEQ ID NO: 3066213 - RNA, 18 nt, Mycobacterium bovis subsp bovis AF2122/97
gccgcuauggcccgggcc

SEQ ID NO: 3066214 - RNA, 13 nt, Mycobacterium bovis subsp bovis AF2122/97
gccgcucaccccg

SEQ ID NO: 3066215 - RNA, 13 nt, Mycobacterium bovis subsp bovis AF2122/97
gccgcucacccgg

SEQ ID NO: 3066216 - RNA, 14 nt, Mycobacterium bovis subsp bovis AF2122/97
gccgcucauccagc

SEQ ID NO: 3066217 - RNA, 19 nt, Mycobacterium bovis subsp bovis AF2122/97
gccgcucauccagcgcgug

SEQ ID NO: 3066218 - RNA, 16 nt, Mycobacterium bovis subsp bovis AF2122/97
gccgcuuucgccggcg

SEQ ID NO: 3066219 - RNA, 18 nt, Mycobacterium bovis subsp bovis AF2122/97
gccgcuuucuuggcgggc

SEQ ID NO: 3066220 - RNA, 19 nt, Mycobacterium bovis subsp bovis AF2122/97
gccgcuuucuuggcgggcg

SEQ ID NO: 3066221 - RNA, 17 nt, Mycobacterium bovis subsp bovis AF2122/97
gccgcuuugcgcgguca

SEQ ID NO: 3066222 - RNA, 23 nt, Mycobacterium bovis subsp bovis AF2122/97
gccgcuuuucgauggugucgcgc

SEQ ID NO: 3066223 - RNA, 14 nt, Mycobacterium bovis subsp bovis AF2122/97
gccggaaagcccgu

SEQ ID NO: 3066224 - RNA, 13 nt, Mycobacterium bovis subsp bovis AF2122/97
gccggaacgcccg

SEQ ID NO: 3066225 - RNA, 15 nt, Mycobacterium bovis subsp bovis AF2122/97
gccggaacgcccggc

SEQ ID NO: 3066226 - RNA, 14 nt, Mycobacterium bovis subsp bovis AF2122/97
gccggaacugcgca

SEQ ID NO: 3066227 - RNA, 13 nt, Mycobacterium bovis subsp bovis AF2122/97
gccggaagcgccg

SEQ ID NO: 3066228 - RNA, 14 nt, Mycobacterium bovis subsp bovis AF2122/97
gccggaagcgccgg

SEQ ID NO: 3066229 - RNA, 15 nt, Mycobacterium bovis subsp bovis AF2122/97
gccggaagcgccggc

SEQ ID NO: 3066230 - RNA, 15 nt, Mycobacterium bovis subsp bovis AF2122/97
gccggaauacaccag

SEQ ID NO: 3066231 - RNA, 16 nt, Mycobacterium bovis subsp bovis AF2122/97
gccggaauacccgcug

SEQ ID NO: 3066232 - RNA, 18 nt, Mycobacterium bovis subsp bovis AF2122/97
gccggaauacccgcuggc

SEQ ID NO: 3066233 - RNA, 15 nt, Mycobacterium bovis subsp bovis AF2122/97
gccggacaaccuggg

SEQ ID NO: 3066234 - RNA, 16 nt, Mycobacterium bovis subsp bovis AF2122/97
gccggacaaccugggg

SEQ ID NO: 3066235 - RNA, 19 nt, Mycobacterium bovis subsp bovis AF2122/97
gccggacaaccuggggcca

SEQ ID NO: 3066236 - RNA, 15 nt, Mycobacterium bovis subsp bovis AF2122/97
gccggacagccacgc

SEQ ID NO: 3066237 - RNA, 17 nt, Mycobacterium bovis subsp bovis AF2122/97
gccggacagccacgcac

SEQ ID NO: 3066238 - RNA, 16 nt, Mycobacterium bovis subsp bovis AF2122/97
gccggacagcucgcgc

SEQ ID NO: 3066239 - RNA, 18 nt, Mycobacterium bovis subsp bovis AF2122/97
gccggaccagcuccugca

SEQ ID NO: 3066240 - RNA, 16 nt, Mycobacterium bovis subsp bovis AF2122/97
gccggacccaccguca

SEQ ID NO: 3066241 - RNA, 21 nt, Mycobacterium bovis subsp bovis AF2122/97
gccggacccaccgucaccccc

SEQ ID NO: 3066242 - RNA, 23 nt, Mycobacterium bovis subsp bovis AF2122/97
gccggacccaccgucacccccga

SEQ ID NO: 3066243 - RNA, 19 nt, Mycobacterium bovis subsp bovis AF2122/97
gccggacccauuggaccga

SEQ ID NO: 3066244 - RNA, 13 nt, Mycobacterium bovis subsp bovis AF2122/97
gccggacccgccc

SEQ ID NO: 3066245 - RNA, 23 nt, Mycobacterium bovis subsp bovis AF2122/97
gccggacccgcccuugccgccga

SEQ ID NO: 3066246 - RNA, 12 nt, Mycobacterium bovis subsp bovis AF2122/97
gccggacccggu

SEQ ID NO: 3066247 - RNA, 17 nt, Mycobacterium bovis subsp bovis AF2122/97
gccggacccggucgccg

SEQ ID NO: 3066248 - RNA, 15 nt, Mycobacterium bovis subsp bovis AF2122/97
gccggaccgccgcaa

SEQ ID NO: 3066249 - RNA, 18 nt, Mycobacterium bovis subsp bovis AF2122/97
gccggaccgcgacggcgc

SEQ ID NO: 3066250 - RNA, 20 nt, Mycobacterium bovis subsp bovis AF2122/97
gccggaccgcgacggcgccg

SEQ ID NO: 3066251 - RNA, 19 nt, Mycobacterium bovis subsp bovis AF2122/97
gccggaccgguguggcgca

SEQ ID NO: 3066252 - RNA, 19 nt, Mycobacterium bovis subsp bovis AF2122/97
gccggaccguguacuggua

SEQ ID NO: 3066253 - RNA, 18 nt, Mycobacterium bovis subsp bovis AF2122/97
gccggaccuuguuggcca

SEQ ID NO: 3066254 - RNA, 23 nt, Mycobacterium bovis subsp bovis AF2122/97
gccggacgacaacaggccgucga

SEQ ID NO: 3066255 - RNA, 19 nt, Mycobacterium bovis subsp bovis AF2122/97
gccggacgccaugcccgca

SEQ ID NO: 3066256 - RNA, 22 nt, Mycobacterium bovis subsp bovis AF2122/97
gccggacgccaugcccgcacgc

SEQ ID NO: 3066257 - RNA, 16 nt, Mycobacterium bovis subsp bovis AF2122/97
gccggacgggugcggg

SEQ ID NO: 3066258 - RNA, 20 nt, Mycobacterium bovis subsp bovis AF2122/97
gccggacguucuggaucgug

SEQ ID NO: 3066259 - RNA, 13 nt, Mycobacterium bovis subsp bovis AF2122/97
gccggacuaccgc

SEQ ID NO: 3066260 - RNA, 18 nt, Mycobacterium bovis subsp bovis AF2122/97
gccggacuaccgccggcg

SEQ ID NO: 3066261 - RNA, 20 nt, Mycobacterium bovis subsp bovis AF2122/97
gccggacuaccgccggcggc

SEQ ID NO: 3066262 - RNA, 21 nt, Mycobacterium bovis subsp bovis AF2122/97
gccggacuaccgccggcggcg

SEQ ID NO: 3066263 - RNA, 20 nt, Mycobacterium bovis subsp bovis AF2122/97
gccggagaaguucgugagcg

SEQ ID NO: 3066264 - RNA, 14 nt, Mycobacterium bovis subsp bovis AF2122/97
gccggagacacccg

SEQ ID NO: 3066265 - RNA, 16 nt, Mycobacterium bovis subsp bovis AF2122/97
gccggagacacccgcc

SEQ ID NO: 3066266 - RNA, 17 nt, Mycobacterium bovis subsp bovis AF2122/97
gccggagacacccgcca

SEQ ID NO: 3066267 - RNA, 20 nt, Mycobacterium bovis subsp bovis AF2122/97
gccggagacgucgccgcagu

SEQ ID NO: 3066268 - RNA, 14 nt, Mycobacterium bovis subsp bovis AF2122/97
gccggagaguagga

SEQ ID NO: 3066269 - RNA, 14 nt, Mycobacterium bovis subsp bovis AF2122/97
gccggagagucggg

SEQ ID NO: 3066270 - RNA, 17 nt, Mycobacterium bovis subsp bovis AF2122/97
gccggagaucgucgcgu

SEQ ID NO: 3066271 - RNA, 17 nt, Mycobacterium bovis subsp bovis AF2122/97
gccggagaucuugcgca

SEQ ID NO: 3066272 - RNA, 16 nt, Mycobacterium bovis subsp bovis AF2122/97
gccggagccgccggcc

SEQ ID NO: 3066273 - RNA, 18 nt, Mycobacterium bovis subsp bovis AF2122/97
gccggagccgccggcccc

SEQ ID NO: 3066274 - RNA, 20 nt, Mycobacterium bovis subsp bovis AF2122/97
gccggagccgccggccccgc

SEQ ID NO: 3066275 - RNA, 12 nt, Mycobacterium bovis subsp bovis AF2122/97
gccggagccggu

SEQ ID NO: 3066276 - RNA, 13 nt, Mycobacterium bovis subsp bovis AF2122/97
gccggagcgcacc

SEQ ID NO: 3066277 - RNA, 17 nt, Mycobacterium bovis subsp bovis AF2122/97
gccggaggaucgcuggu

SEQ ID NO: 3066278 - RNA, 18 nt, Mycobacterium bovis subsp bovis AF2122/97
gccggaggcaagcaaccg

SEQ ID NO: 3066279 - RNA, 20 nt, Mycobacterium bovis subsp bovis AF2122/97
gccggaggcaagcaaccggu

SEQ ID NO: 3066280 - RNA, 23 nt, Mycobacterium bovis subsp bovis AF2122/97
gccggaggcaagcaaccggugcg

SEQ ID NO: 3066281 - RNA, 23 nt, Mycobacterium bovis subsp bovis AF2122/97
gccggaggcuugcaacaccccga

SEQ ID NO: 3066282 - RNA, 19 nt, Mycobacterium bovis subsp bovis AF2122/97
gccggaguccgucggggac

SEQ ID NO: 3066283 - RNA, 17 nt, Mycobacterium bovis subsp bovis AF2122/97
gccggagucgacccugc

SEQ ID NO: 3066284 - RNA, 15 nt, Mycobacterium bovis subsp bovis AF2122/97
gccggagucgaucag

SEQ ID NO: 3066285 - RNA, 23 nt, Mycobacterium bovis subsp bovis AF2122/97
gccggagucgaucagcuugggca

SEQ ID NO: 3066286 - RNA, 13 nt, Mycobacterium bovis subsp bovis AF2122/97
gccggaguuccgc

SEQ ID NO: 3066287 - RNA, 21 nt, Mycobacterium bovis subsp bovis AF2122/97
gccggaguucuguaccggcug

SEQ ID NO: 3066288 - RNA, 15 nt, Mycobacterium bovis subsp bovis AF2122/97
gccggaguugucgac

SEQ ID NO: 3066289 - RNA, 21 nt, Mycobacterium bovis subsp bovis AF2122/97
gccggaguugucgacggccac

SEQ ID NO: 3066290 - RNA, 23 nt, Mycobacterium bovis subsp bovis AF2122/97
gccggaguugucgacggccaccc

SEQ ID NO: 3066291 - RNA, 18 nt, Mycobacterium bovis subsp bovis AF2122/97
gccggauacgggcugacg

SEQ ID NO: 3066292 - RNA, 16 nt, Mycobacterium bovis subsp bovis AF2122/97
gccggauagcaccggc

SEQ ID NO: 3066293 - RNA, 17 nt, Mycobacterium bovis subsp bovis AF2122/97
gccggauagcaccggca

SEQ ID NO: 3066294 - RNA, 19 nt, Mycobacterium bovis subsp bovis AF2122/97
gccggauagcaccggcacc

SEQ ID NO: 3066295 - RNA, 20 nt, Mycobacterium bovis subsp bovis AF2122/97
gccggauagcaccggcaccc

SEQ ID NO: 3066296 - RNA, 17 nt, Mycobacterium bovis subsp bovis AF2122/97
gccggauagcgcagcuc

SEQ ID NO: 3066297 - RNA, 14 nt, Mycobacterium bovis subsp bovis AF2122/97
gccggauaggucgg

SEQ ID NO: 3066298 - RNA, 19 nt, Mycobacterium bovis subsp bovis AF2122/97
gccggauaggucgggcaug

SEQ ID NO: 3066299 - RNA, 19 nt, Mycobacterium bovis subsp bovis AF2122/97
gccggaucaggaucgacag

SEQ ID NO: 3066300 - RNA, 13 nt, Mycobacterium bovis subsp bovis AF2122/97
gccggaucccagu

SEQ ID NO: 3066301 - RNA, 15 nt, Mycobacterium bovis subsp bovis AF2122/97
gccggauccgauccg

SEQ ID NO: 3066302 - RNA, 17 nt, Mycobacterium bovis subsp bovis AF2122/97
gccggaucgacguucgg

SEQ ID NO: 3066303 - RNA, 14 nt, Mycobacterium bovis subsp bovis AF2122/97
gccggaucguucgc

SEQ ID NO: 3066304 - RNA, 16 nt, Mycobacterium bovis subsp bovis AF2122/97
gccggaugacaccgac

SEQ ID NO: 3066305 - RNA, 13 nt, Mycobacterium bovis subsp bovis AF2122/97
gccggcagcgucc

SEQ ID NO: 3066306 - RNA, 17 nt, Mycobacterium bovis subsp bovis AF2122/97
gccggcagcguccgaac

SEQ ID NO: 3066307 - RNA, 20 nt, Mycobacterium bovis subsp bovis AF2122/97
gccggcaggaaacucagguc

SEQ ID NO: 3066308 - RNA, 13 nt, Mycobacterium bovis subsp bovis AF2122/97
gccggcagugagu

SEQ ID NO: 3066309 - RNA, 14 nt, Mycobacterium bovis subsp bovis AF2122/97
gccggcagugaguc

SEQ ID NO: 3066310 - RNA, 19 nt, Mycobacterium bovis subsp bovis AF2122/97
gccggcagugagucgguga

SEQ ID NO: 3066311 - RNA, 16 nt, Mycobacterium bovis subsp bovis AF2122/97
gccggcauaaaccgcg

SEQ ID NO: 3066312 - RNA, 18 nt, Mycobacterium bovis subsp bovis AF2122/97
gccggcauaaaccgcguc

SEQ ID NO: 3066313 - RNA, 21 nt, Mycobacterium bovis subsp bovis AF2122/97
gccggcauaaaccgcguccgc

SEQ ID NO: 3066314 - RNA, 23 nt, Mycobacterium bovis subsp bovis AF2122/97
gccggcauaaaccgcguccgcgc

SEQ ID NO: 3066315 - RNA, 19 nt, Mycobacterium bovis subsp bovis AF2122/97
gccggcauagaucgggucg

SEQ ID NO: 3066316 - RNA, 20 nt, Mycobacterium bovis subsp bovis AF2122/97
gccggcauagaucgggucgu

SEQ ID NO: 3066317 - RNA, 16 nt, Mycobacterium bovis subsp bovis AF2122/97
gccggcauagcggccc

SEQ ID NO: 3066318 - RNA, 21 nt, Mycobacterium bovis subsp bovis AF2122/97
gccggcauccgguucgccgcc

SEQ ID NO: 3066319 - RNA, 15 nt, Mycobacterium bovis subsp bovis AF2122/97
gccggcaucgcgcaa

SEQ ID NO: 3066320 - RNA, 18 nt, Mycobacterium bovis subsp bovis AF2122/97
gccggcaucgcgcaaccg

SEQ ID NO: 3066321 - RNA, 19 nt, Mycobacterium bovis subsp bovis AF2122/97
gccggcaucgcgcaaccgg

SEQ ID NO: 3066322 - RNA, 16 nt, Mycobacterium bovis subsp bovis AF2122/97
gccggcaucgcgcgcg

SEQ ID NO: 3066323 - RNA, 18 nt, Mycobacterium bovis subsp bovis AF2122/97
gccggcaucgcgcgcggc

SEQ ID NO: 3066324 - RNA, 17 nt, Mycobacterium bovis subsp bovis AF2122/97
gccggcaucgucgacgc

SEQ ID NO: 3066325 - RNA, 21 nt, Mycobacterium bovis subsp bovis AF2122/97
gccggcaucgucgacgcccga

SEQ ID NO: 3066326 - RNA, 18 nt, Mycobacterium bovis subsp bovis AF2122/97
gccggcaucgucggguca

SEQ ID NO: 3066327 - RNA, 16 nt, Mycobacterium bovis subsp bovis AF2122/97
gccggcaucuccaccg

SEQ ID NO: 3066328 - RNA, 14 nt, Mycobacterium bovis subsp bovis AF2122/97
gccggcaugccagc

SEQ ID NO: 3066329 - RNA, 15 nt, Mycobacterium bovis subsp bovis AF2122/97
gccggcauggcggca

SEQ ID NO: 3066330 - RNA, 21 nt, Mycobacterium bovis subsp bovis AF2122/97
gccggcauugacccauccggc

SEQ ID NO: 3066331 - RNA, 12 nt, Mycobacterium bovis subsp bovis AF2122/97
gccggccaacug

SEQ ID NO: 3066332 - RNA, 14 nt, Mycobacterium bovis subsp bovis AF2122/97
gccggccaacuggg

SEQ ID NO: 3066333 - RNA, 13 nt, Mycobacterium bovis subsp bovis AF2122/97
gccggccaacuuc

SEQ ID NO: 3066334 - RNA, 17 nt, Mycobacterium bovis subsp bovis AF2122/97
gccggccaccaccgcgc

SEQ ID NO: 3066335 - RNA, 21 nt, Mycobacterium bovis subsp bovis AF2122/97
gccggccaccaccgcgccguc

SEQ ID NO: 3066336 - RNA, 12 nt, Mycobacterium bovis subsp bovis AF2122/97
gccggccaccag

SEQ ID NO: 3066337 - RNA, 17 nt, Mycobacterium bovis subsp bovis AF2122/97
gccggccaccagccggu

SEQ ID NO: 3066338 - RNA, 22 nt, Mycobacterium bovis subsp bovis AF2122/97
gccggccaccaguccgauggga

SEQ ID NO: 3066339 - RNA, 15 nt, Mycobacterium bovis subsp bovis AF2122/97
gccggccacccgcgc

SEQ ID NO: 3066340 - RNA, 14 nt, Mycobacterium bovis subsp bovis AF2122/97
gccggccaccguca

SEQ ID NO: 3066341 - RNA, 12 nt, Mycobacterium bovis subsp bovis AF2122/97
gccggccaccuc

SEQ ID NO: 3066342 - RNA, 14 nt, Mycobacterium bovis subsp bovis AF2122/97
gccggccaccucgg

SEQ ID NO: 3066343 - RNA, 17 nt, Mycobacterium bovis subsp bovis AF2122/97
gccggccaccucggugc

SEQ ID NO: 3066344 - RNA, 21 nt, Mycobacterium bovis subsp bovis AF2122/97
gccggccaccucggugcggaa

SEQ ID NO: 3066345 - RNA, 16 nt, Mycobacterium bovis subsp bovis AF2122/97
gccggccacgaccucu

SEQ ID NO: 3066346 - RNA, 17 nt, Mycobacterium bovis subsp bovis AF2122/97
gccggccacgaccucuu

SEQ ID NO: 3066347 - RNA, 17 nt, Mycobacterium bovis subsp bovis AF2122/97
gccggccacgucgaugu

SEQ ID NO: 3066348 - RNA, 15 nt, Mycobacterium bovis subsp bovis AF2122/97
gccggccagcgucgc

SEQ ID NO: 3066349 - RNA, 15 nt, Mycobacterium bovis subsp bovis AF2122/97
gccggccaguucggc

SEQ ID NO: 3066350 - RNA, 15 nt, Mycobacterium bovis subsp bovis AF2122/97
gccggccaucgcccg

SEQ ID NO: 3066351 - RNA, 16 nt, Mycobacterium bovis subsp bovis AF2122/97
gccggccaucgcccgg

SEQ ID NO: 3066352 - RNA, 21 nt, Mycobacterium bovis subsp bovis AF2122/97
gccggccaugccuucggugcc

SEQ ID NO: 3066353 - RNA, 17 nt, Mycobacterium bovis subsp bovis AF2122/97
gccggcccaccaggccc

SEQ ID NO: 3066354 - RNA, 18 nt, Mycobacterium bovis subsp bovis AF2122/97
gccggcccaccaggccca

SEQ ID NO: 3066355 - RNA, 22 nt, Mycobacterium bovis subsp bovis AF2122/97
gccggcccaccaggcccaucuc

SEQ ID NO: 3066356 - RNA, 15 nt, Mycobacterium bovis subsp bovis AF2122/97
gccggcccagagauu

SEQ ID NO: 3066357 - RNA, 13 nt, Mycobacterium bovis subsp bovis AF2122/97
gccggccccaccg

SEQ ID NO: 3066358 - RNA, 17 nt, Mycobacterium bovis subsp bovis AF2122/97
gccggccccaccggugc

SEQ ID NO: 3066359 - RNA, 22 nt, Mycobacterium bovis subsp bovis AF2122/97
gccggccccaccggugccgccg

SEQ ID NO: 3066360 - RNA, 13 nt, Mycobacterium bovis subsp bovis AF2122/97
gccggccccgcca

SEQ ID NO: 3066361 - RNA, 20 nt, Mycobacterium bovis subsp bovis AF2122/97
gccggccccgccagcgccgc

SEQ ID NO: 3066362 - RNA, 23 nt, Mycobacterium bovis subsp bovis AF2122/97
gccggccccgccagcgccgccgg

SEQ ID NO: 3066363 - RNA, 15 nt, Mycobacterium bovis subsp bovis AF2122/97
gccggccccgcccgc

SEQ ID NO: 3066364 - RNA, 13 nt, Mycobacterium bovis subsp bovis AF2122/97
gccggccccgccg

SEQ ID NO: 3066365 - RNA, 14 nt, Mycobacterium bovis subsp bovis AF2122/97
gccggccccgccga

SEQ ID NO: 3066366 - RNA, 20 nt, Mycobacterium bovis subsp bovis AF2122/97
gccggccccgccgaugccgc

SEQ ID NO: 3066367 - RNA, 22 nt, Mycobacterium bovis subsp bovis AF2122/97
gccggccccgccgaugccgccg

SEQ ID NO: 3066368 - RNA, 14 nt, Mycobacterium bovis subsp bovis AF2122/97
gccggccccgccgc

SEQ ID NO: 3066369 - RNA, 14 nt, Mycobacterium bovis subsp bovis AF2122/97
gccggccccgccgg

SEQ ID NO: 3066370 - RNA, 16 nt, Mycobacterium bovis subsp bovis AF2122/97
gccggccccgccggcg

SEQ ID NO: 3066371 - RNA, 22 nt, Mycobacterium bovis subsp bovis AF2122/97
gccggccccgccggcgccgccc

SEQ ID NO: 3066372 - RNA, 14 nt, Mycobacterium bovis subsp bovis AF2122/97
gccggccccgccgu

SEQ ID NO: 3066373 - RNA, 18 nt, Mycobacterium bovis subsp bovis AF2122/97
gccggccccgccgucacc

SEQ ID NO: 3066374 - RNA, 19 nt, Mycobacterium bovis subsp bovis AF2122/97
gccggccccgccgucaccc

SEQ ID NO: 3066375 - RNA, 22 nt, Mycobacterium bovis subsp bovis AF2122/97
gccggccccgccgucacccccg

SEQ ID NO: 3066376 - RNA, 23 nt, Mycobacterium bovis subsp bovis AF2122/97
gccggccccgccgucgccgccgg

SEQ ID NO: 3066377 - RNA, 16 nt, Mycobacterium bovis subsp bovis AF2122/97
gccggccccgccguuu

SEQ ID NO: 3066378 - RNA, 14 nt, Mycobacterium bovis subsp bovis AF2122/97
gccggccccggggg

SEQ ID NO: 3066379 - RNA, 20 nt, Mycobacterium bovis subsp bovis AF2122/97
gccggccccgggggaagcgc

SEQ ID NO: 3066380 - RNA, 18 nt, Mycobacterium bovis subsp bovis AF2122/97
gccggcccgacggguauc

SEQ ID NO: 3066381 - RNA, 20 nt, Mycobacterium bovis subsp bovis AF2122/97
gccggcccggguaucgccag

SEQ ID NO: 3066382 - RNA, 22 nt, Mycobacterium bovis subsp bovis AF2122/97
gccggcccggguaucgccagug

SEQ ID NO: 3066383 - RNA, 14 nt, Mycobacterium bovis subsp bovis AF2122/97
gccggcccugcggc

SEQ ID NO: 3066384 - RNA, 14 nt, Mycobacterium bovis subsp bovis AF2122/97
gccggcccugcucg

SEQ ID NO: 3066385 - RNA, 20 nt, Mycobacterium bovis subsp bovis AF2122/97
gccggcccugcucgccgucu

SEQ ID NO: 3066386 - RNA, 22 nt, Mycobacterium bovis subsp bovis AF2122/97
gccggcccugcucgccgucucg

SEQ ID NO: 3066387 - RNA, 16 nt, Mycobacterium bovis subsp bovis AF2122/97
gccggcccugcucggc

SEQ ID NO: 3066388 - RNA, 23 nt, Mycobacterium bovis subsp bovis AF2122/97
gccggccgagcgcacuggggagg

SEQ ID NO: 3066389 - RNA, 18 nt, Mycobacterium bovis subsp bovis AF2122/97
gccggccgcacaugagcu

SEQ ID NO: 3066390 - RNA, 13 nt, Mycobacterium bovis subsp bovis AF2122/97
gccggccgcacgc

SEQ ID NO: 3066391 - RNA, 12 nt, Mycobacterium bovis subsp bovis AF2122/97
gccggccgccgc

SEQ ID NO: 3066392 - RNA, 13 nt, Mycobacterium bovis subsp bovis AF2122/97
gccggcgccgaac

SEQ ID NO: 3066393 - RNA, 23 nt, Mycobacterium bovis subsp bovis AF2122/97
gccggcgccgaacaccucggcac

SEQ ID NO: 3066394 - RNA, 12 nt, Mycobacterium bovis subsp bovis AF2122/97
gccggcgccgca

SEQ ID NO: 3066395 - RNA, 24 nt, Mycobacterium bovis subsp bovis AF2122/97
gccggcgccgccacugccggcagc

SEQ ID NO: 3066396 - RNA, 15 nt, Mycobacterium bovis subsp bovis AF2122/97
gccggcgccgccagc

SEQ ID NO: 3066397 - RNA, 16 nt, Mycobacterium bovis subsp bovis AF2122/97
gccggcgccgccagca

SEQ ID NO: 3066398 - RNA, 17 nt, Mycobacterium bovis subsp bovis AF2122/97
gccggcgccgccagcac

SEQ ID NO: 3066399 - RNA, 18 nt, Mycobacterium bovis subsp bovis AF2122/97
gccggcgccgccagcacc

SEQ ID NO: 3066400 - RNA, 13 nt, Mycobacterium bovis subsp bovis AF2122/97
gccggcgccgccc

SEQ ID NO: 3066401 - RNA, 16 nt, Mycobacterium bovis subsp bovis AF2122/97
gccggcgccgcccgcg

SEQ ID NO: 3066402 - RNA, 17 nt, Mycobacterium bovis subsp bovis AF2122/97
gccggcgccgcccgcgc

SEQ ID NO: 3066403 - RNA, 23 nt, Mycobacterium bovis subsp bovis AF2122/97
gccggcgccgcccgcgccgccgc

SEQ ID NO: 3066404 - RNA, 14 nt, Mycobacterium bovis subsp bovis AF2122/97
gccggcgccgcccu

SEQ ID NO: 3066405 - RNA, 23 nt, Mycobacterium bovis subsp bovis AF2122/97
gccggcgccgcccuugccgccgg

SEQ ID NO: 3066406 - RNA, 14 nt, Mycobacterium bovis subsp bovis AF2122/97
gccggcgccgccga

SEQ ID NO: 3066407 - RNA, 14 nt, Mycobacterium bovis subsp bovis AF2122/97
gccggcgccgccgg

SEQ ID NO: 3066408 - RNA, 15 nt, Mycobacterium bovis subsp bovis AF2122/97
gccggcgccgccggc

SEQ ID NO: 3066409 - RNA, 16 nt, Mycobacterium bovis subsp bovis AF2122/97
gccggcgccgccggcg

SEQ ID NO: 3066410 - RNA, 16 nt, Mycobacterium bovis subsp bovis AF2122/97
gccggcgccgccggug

SEQ ID NO: 3066411 - RNA, 18 nt, Mycobacterium bovis subsp bovis AF2122/97
gccggcgccgccggugcc

SEQ ID NO: 3066412 - RNA, 16 nt, Mycobacterium bovis subsp bovis AF2122/97
gccggcgccgccgucg

SEQ ID NO: 3066413 - RNA, 11 nt, Mycobacterium bovis subsp bovis AF2122/97
gccggcgccgg

SEQ ID NO: 3066414 - RNA, 14 nt, Mycobacterium bovis subsp bovis AF2122/97
gccggcgccggagc

SEQ ID NO: 3066415 - RNA, 19 nt, Mycobacterium bovis subsp bovis AF2122/97
gccggcgccggcgcugcug

SEQ ID NO: 3066416 - RNA, 15 nt, Mycobacterium bovis subsp bovis AF2122/97
gccggcgccggugcc

SEQ ID NO: 3066417 - RNA, 20 nt, Mycobacterium bovis subsp bovis AF2122/97
gccggcgccuuggucgccgc

SEQ ID NO: 3066418 - RNA, 14 nt, Mycobacterium bovis subsp bovis AF2122/97
gccggcgcgagccg

SEQ ID NO: 3066419 - RNA, 21 nt, Mycobacterium bovis subsp bovis AF2122/97
gccggcgcgcaagugcuggcc

SEQ ID NO: 3066420 - RNA, 16 nt, Mycobacterium bovis subsp bovis AF2122/97
gccggcgcgcaccccg

SEQ ID NO: 3066421 - RNA, 17 nt, Mycobacterium bovis subsp bovis AF2122/97
gccggcgcgcaccccgg

SEQ ID NO: 3066422 - RNA, 18 nt, Mycobacterium bovis subsp bovis AF2122/97
gccggcgcgcaccccggc

SEQ ID NO: 3066423 - RNA, 14 nt, Mycobacterium bovis subsp bovis AF2122/97
gccggcgcgcagcc

SEQ ID NO: 3066424 - RNA, 16 nt, Mycobacterium bovis subsp bovis AF2122/97
gccggcgcgcagccgg

SEQ ID NO: 3066425 - RNA, 18 nt, Mycobacterium bovis subsp bovis AF2122/97
gccggcgcgcagccgggc

SEQ ID NO: 3066426 - RNA, 19 nt, Mycobacterium bovis subsp bovis AF2122/97
gccggcgcgcagccgggcc

SEQ ID NO: 3066427 - RNA, 15 nt, Mycobacterium bovis subsp bovis AF2122/97
gccggcgcgccccac

SEQ ID NO: 3066428 - RNA, 19 nt, Mycobacterium bovis subsp bovis AF2122/97
gccggcgcgccccaccgcg

SEQ ID NO: 3066429 - RNA, 14 nt, Mycobacterium bovis subsp bovis AF2122/97
gccggcgcgccgau

SEQ ID NO: 3066430 - RNA, 12 nt, Mycobacterium bovis subsp bovis AF2122/97
gccggcgcggcg

SEQ ID NO: 3066431 - RNA, 14 nt, Mycobacterium bovis subsp bovis AF2122/97
gccggcgcggcggc

SEQ ID NO: 3066432 - RNA, 15 nt, Mycobacterium bovis subsp bovis AF2122/97
gccggcgcggcggcg

SEQ ID NO: 3066433 - RNA, 16 nt, Mycobacterium bovis subsp bovis AF2122/97
gccggcgcggcggcgu

SEQ ID NO: 3066434 - RNA, 21 nt, Mycobacterium bovis subsp bovis AF2122/97
gccggcgcguaguaaugcucg

SEQ ID NO: 3066435 - RNA, 15 nt, Mycobacterium bovis subsp bovis AF2122/97
gccggcgcucgcggc

SEQ ID NO: 3066436 - RNA, 20 nt, Mycobacterium bovis subsp bovis AF2122/97
gccggcgcucgcggcggcgc

SEQ ID NO: 3066437 - RNA, 17 nt, Mycobacterium bovis subsp bovis AF2122/97
gccggcgcugccaaacu

SEQ ID NO: 3066438 - RNA, 14 nt, Mycobacterium bovis subsp bovis AF2122/97
gccggcgcugcccg

SEQ ID NO: 3066439 - RNA, 19 nt, Mycobacterium bovis subsp bovis AF2122/97
gccggcgcugcccgggcug

SEQ ID NO: 3066440 - RNA, 23 nt, Mycobacterium bovis subsp bovis AF2122/97
gccggcgcugcugccauugccga

SEQ ID NO: 3066441 - RNA, 12 nt, Mycobacterium bovis subsp bovis AF2122/97
gccggcgcuggc

SEQ ID NO: 3066442 - RNA, 20 nt, Mycobacterium bovis subsp bovis AF2122/97
gccggcggaaauggcgucgc

SEQ ID NO: 3066443 - RNA, 22 nt, Mycobacterium bovis subsp bovis AF2122/97
gccggcggaaauggcgucgccg

SEQ ID NO: 3066444 - RNA, 16 nt, Mycobacterium bovis subsp bovis AF2122/97
gccggcggacgcccgg

SEQ ID NO: 3066445 - RNA, 22 nt, Mycobacterium bovis subsp bovis AF2122/97
gccggcggacgcccggcgcacc

SEQ ID NO: 3066446 - RNA, 15 nt, Mycobacterium bovis subsp bovis AF2122/97
gccggcggcccgcuc

SEQ ID NO: 3066447 - RNA, 14 nt, Mycobacterium bovis subsp bovis AF2122/97
gccggcggccgccc

SEQ ID NO: 3066448 - RNA, 23 nt, Mycobacterium bovis subsp bovis AF2122/97
gccggcggccgcccagaugucuu

SEQ ID NO: 3066449 - RNA, 15 nt, Mycobacterium bovis subsp bovis AF2122/97
gccggcggccgcggu

SEQ ID NO: 3066450 - RNA, 13 nt, Mycobacterium bovis subsp bovis AF2122/97
gccggcggcgccc

SEQ ID NO: 3066451 - RNA, 15 nt, Mycobacterium bovis subsp bovis AF2122/97
gccggcggcgcccau

SEQ ID NO: 3066452 - RNA, 18 nt, Mycobacterium bovis subsp bovis AF2122/97
gccggcggcgcccaucgc

SEQ ID NO: 3066453 - RNA, 20 nt, Mycobacterium bovis subsp bovis AF2122/97
gccggcggcgcccaucgcga

SEQ ID NO: 3066454 - RNA, 21 nt, Mycobacterium bovis subsp bovis AF2122/97
gccggcggcgcccaucgcgac

SEQ ID NO: 3066455 - RNA, 15 nt, Mycobacterium bovis subsp bovis AF2122/97
gccggcggcggccgc

SEQ ID NO: 3066456 - RNA, 17 nt, Mycobacterium bovis subsp bovis AF2122/97
gccggcggcggccgcag

SEQ ID NO: 3066457 - RNA, 18 nt, Mycobacterium bovis subsp bovis AF2122/97
gccggcggcggccgcagc

SEQ ID NO: 3066458 - RNA, 21 nt, Mycobacterium bovis subsp bovis AF2122/97
gccggcggcggccgcagcggc

SEQ ID NO: 3066459 - RNA, 15 nt, Mycobacterium bovis subsp bovis AF2122/97
gccggcggcggcgcu

SEQ ID NO: 3066460 - RNA, 19 nt, Mycobacterium bovis subsp bovis AF2122/97
gccggcggcggcgcucggc

SEQ ID NO: 3066461 - RNA, 21 nt, Mycobacterium bovis subsp bovis AF2122/97
gccggcggcggcgcucggcca

SEQ ID NO: 3066462 - RNA, 12 nt, Mycobacterium bovis subsp bovis AF2122/97
gccggcggcggg

SEQ ID NO: 3066463 - RNA, 14 nt, Mycobacterium bovis subsp bovis AF2122/97
gccggcggcgguac

SEQ ID NO: 3066464 - RNA, 15 nt, Mycobacterium bovis subsp bovis AF2122/97
gccggcggcgguacc

SEQ ID NO: 3066465 - RNA, 14 nt, Mycobacterium bovis subsp bovis AF2122/97
gccggcggcggugc

SEQ ID NO: 3066466 - RNA, 17 nt, Mycobacterium bovis subsp bovis AF2122/97
gccggcggcggugcgcc

SEQ ID NO: 3066467 - RNA, 22 nt, Mycobacterium bovis subsp bovis AF2122/97
gccggcggcggugguaccggcg

SEQ ID NO: 3066468 - RNA, 12 nt, Mycobacterium bovis subsp bovis AF2122/97
gccggcggcugu

SEQ ID NO: 3066469 - RNA, 21 nt, Mycobacterium bovis subsp bovis AF2122/97
gccggcggcuguggucgcugc

SEQ ID NO: 3066470 - RNA, 16 nt, Mycobacterium bovis subsp bovis AF2122/97
gccggcgggccugccc

SEQ ID NO: 3066471 - RNA, 18 nt, Mycobacterium bovis subsp bovis AF2122/97
gccggcgggccugcccgg

SEQ ID NO: 3066472 - RNA, 21 nt, Mycobacterium bovis subsp bovis AF2122/97
gccggcgggcgcgggcgccgg

SEQ ID NO: 3066473 - RNA, 19 nt, Mycobacterium bovis subsp bovis AF2122/97
gccggcggguggcccccgc

SEQ ID NO: 3066474 - RNA, 21 nt, Mycobacterium bovis subsp bovis AF2122/97
gccggcgguagucggccagcu

SEQ ID NO: 3066475 - RNA, 17 nt, Mycobacterium bovis subsp bovis AF2122/97
gccggcggucagcagcg

SEQ ID NO: 3066476 - RNA, 18 nt, Mycobacterium bovis subsp bovis AF2122/97
gccggcggucagcagcgc

SEQ ID NO: 3066477 - RNA, 12 nt, Mycobacterium bovis subsp bovis AF2122/97
gccggcggucgg

SEQ ID NO: 3066478 - RNA, 22 nt, Mycobacterium bovis subsp bovis AF2122/97
gccggcggucgggcccggcgag

SEQ ID NO: 3066479 - RNA, 16 nt, Mycobacterium bovis subsp bovis AF2122/97
gccgggaugccgccgc

SEQ ID NO: 3066480 - RNA, 19 nt, Mycobacterium bovis subsp bovis AF2122/97
gccgggaugccgccgcuga

SEQ ID NO: 3066481 - RNA, 20 nt, Mycobacterium bovis subsp bovis AF2122/97
gccgggaugguuucgacucg

SEQ ID NO: 3066482 - RNA, 16 nt, Mycobacterium bovis subsp bovis AF2122/97
gccgggauugccgucg

SEQ ID NO: 3066483 - RNA, 17 nt, Mycobacterium bovis subsp bovis AF2122/97
gccgggauugccgucgg

SEQ ID NO: 3066484 - RNA, 17 nt, Mycobacterium bovis subsp bovis AF2122/97
gccgggcaaccagcagc

SEQ ID NO: 3066485 - RNA, 19 nt, Mycobacterium bovis subsp bovis AF2122/97
gccgggcaaccagcagcag

SEQ ID NO: 3066486 - RNA, 22 nt, Mycobacterium bovis subsp bovis AF2122/97
gccgggcaacgcgaaccggcca

SEQ ID NO: 3066487 - RNA, 13 nt, Mycobacterium bovis subsp bovis AF2122/97
gccgggcaaggcc

SEQ ID NO: 3066488 - RNA, 17 nt, Mycobacterium bovis subsp bovis AF2122/97
gccgggcaaggccaccg

SEQ ID NO: 3066489 - RNA, 21 nt, Mycobacterium bovis subsp bovis AF2122/97
gccgggcaaggccaccgucgc

SEQ ID NO: 3066490 - RNA, 23 nt, Mycobacterium bovis subsp bovis AF2122/97
gccgggcaauacguagucgccga

SEQ ID NO: 3066491 - RNA, 13 nt, Mycobacterium bovis subsp bovis AF2122/97
gccgggcaccacc

SEQ ID NO: 3066492 - RNA, 19 nt, Mycobacterium bovis subsp bovis AF2122/97
gccgggcaccaccacaccg

SEQ ID NO: 3066493 - RNA, 20 nt, Mycobacterium bovis subsp bovis AF2122/97
gccgggcacgcgaggcgcuc

SEQ ID NO: 3066494 - RNA, 15 nt, Mycobacterium bovis subsp bovis AF2122/97
gccgggcagucaggc

SEQ ID NO: 3066495 - RNA, 17 nt, Mycobacterium bovis subsp bovis AF2122/97
gccgggcagucaggccu

SEQ ID NO: 3066496 - RNA, 15 nt, Mycobacterium bovis subsp bovis AF2122/97
gccgggcaguguggu

SEQ ID NO: 3066497 - RNA, 20 nt, Mycobacterium bovis subsp bovis AF2122/97
gccgggcaguguggucauug

SEQ ID NO: 3066498 - RNA, 19 nt, Mycobacterium bovis subsp bovis AF2122/97
gccgggcaguuuggcggca

SEQ ID NO: 3066499 - RNA, 12 nt, Mycobacterium bovis subsp bovis AF2122/97
gccgggcaucgg

SEQ ID NO: 3066500 - RNA, 18 nt, Mycobacterium bovis subsp bovis AF2122/97
gccgggccaaccggucgu

SEQ ID NO: 3066501 - RNA, 12 nt, Mycobacterium bovis subsp bovis AF2122/97
gccgggccaggc

SEQ ID NO: 3066502 - RNA, 11 nt, Mycobacterium bovis subsp bovis AF2122/97
gccgggcccag

SEQ ID NO: 3066503 - RNA, 12 nt, Mycobacterium bovis subsp bovis AF2122/97
gccgggcccagc

SEQ ID NO: 3066504 - RNA, 13 nt, Mycobacterium bovis subsp bovis AF2122/97
gccgggcccagca

SEQ ID NO: 3066505 - RNA, 15 nt, Mycobacterium bovis subsp bovis AF2122/97
gccgggccccacauc

SEQ ID NO: 3066506 - RNA, 14 nt, Mycobacterium bovis subsp bovis AF2122/97
gccgggcccgacgu

SEQ ID NO: 3066507 - RNA, 17 nt, Mycobacterium bovis subsp bovis AF2122/97
gccgggccgagugccca

SEQ ID NO: 3066508 - RNA, 12 nt, Mycobacterium bovis subsp bovis AF2122/97
gccgggccgccg

SEQ ID NO: 3066509 - RNA, 15 nt, Mycobacterium bovis subsp bovis AF2122/97
gccgggccgccgagc

SEQ ID NO: 3066510 - RNA, 15 nt, Mycobacterium bovis subsp bovis AF2122/97
gccgggccgcgcggg

SEQ ID NO: 3066511 - RNA, 16 nt, Mycobacterium bovis subsp bovis AF2122/97
gccgggccguguccgc

SEQ ID NO: 3066512 - RNA, 19 nt, Mycobacterium bovis subsp bovis AF2122/97
gccgggccguguccgccgg

SEQ ID NO: 3066513 - RNA, 16 nt, Mycobacterium bovis subsp bovis AF2122/97
gccgggccugcaccac

SEQ ID NO: 3066514 - RNA, 23 nt, Mycobacterium bovis subsp bovis AF2122/97
gccgggccugcaccacggcggcc

SEQ ID NO: 3066515 - RNA, 18 nt, Mycobacterium bovis subsp bovis AF2122/97
gccgggcgaguacaggcg

SEQ ID NO: 3066516 - RNA, 22 nt, Mycobacterium bovis subsp bovis AF2122/97
gccgggcgaguacaggcgcagc

SEQ ID NO: 3066517 - RNA, 17 nt, Mycobacterium bovis subsp bovis AF2122/97
gccgggcgaugcugggc

SEQ ID NO: 3066518 - RNA, 13 nt, Mycobacterium bovis subsp bovis AF2122/97
gccgggcgcaagc

SEQ ID NO: 3066519 - RNA, 19 nt, Mycobacterium bovis subsp bovis AF2122/97
gccgggcgcaagcagcccg

SEQ ID NO: 3066520 - RNA, 20 nt, Mycobacterium bovis subsp bovis AF2122/97
gccgggcgcaagcagcccgg

SEQ ID NO: 3066521 - RNA, 14 nt, Mycobacterium bovis subsp bovis AF2122/97
gccgggcgccgugc

SEQ ID NO: 3066522 - RNA, 21 nt, Mycobacterium bovis subsp bovis AF2122/97
gccgggcgccgugccccgggc

SEQ ID NO: 3066523 - RNA, 19 nt, Mycobacterium bovis subsp bovis AF2122/97
gccgggcgcgccggccaug

SEQ ID NO: 3066524 - RNA, 15 nt, Mycobacterium bovis subsp bovis AF2122/97
gccgggcgcuggacg

SEQ ID NO: 3066525 - RNA, 14 nt, Mycobacterium bovis subsp bovis AF2122/97
gccgggcggcagcg

SEQ ID NO: 3066526 - RNA, 16 nt, Mycobacterium bovis subsp bovis AF2122/97
gccgggcggcagcggc

SEQ ID NO: 3066527 - RNA, 12 nt, Mycobacterium bovis subsp bovis AF2122/97
gccgggcggcca

SEQ ID NO: 3066528 - RNA, 22 nt, Mycobacterium bovis subsp bovis AF2122/97
gccgggcggccucguugaccgg

SEQ ID NO: 3066529 - RNA, 13 nt, Mycobacterium bovis subsp bovis AF2122/97
gccgggcguccgc

SEQ ID NO: 3066530 - RNA, 18 nt, Mycobacterium bovis subsp bovis AF2122/97
gccgggcguccgccggcg

SEQ ID NO: 3066531 - RNA, 19 nt, Mycobacterium bovis subsp bovis AF2122/97
gccgggcguccgccggcga

SEQ ID NO: 3066532 - RNA, 17 nt, Mycobacterium bovis subsp bovis AF2122/97
gccgggcgucgcuggug

SEQ ID NO: 3066533 - RNA, 23 nt, Mycobacterium bovis subsp bovis AF2122/97
gccgggcuccucugguugggagc

SEQ ID NO: 3066534 - RNA, 14 nt, Mycobacterium bovis subsp bovis AF2122/97
gccgggcucgucga

SEQ ID NO: 3066535 - RNA, 18 nt, Mycobacterium bovis subsp bovis AF2122/97
gccgggcugaggcggcga

SEQ ID NO: 3066536 - RNA, 19 nt, Mycobacterium bovis subsp bovis AF2122/97
gccgggcugaggcggcgac

SEQ ID NO: 3066537 - RNA, 19 nt, Mycobacterium bovis subsp bovis AF2122/97
gccgggcuguucggccaug

SEQ ID NO: 3066538 - RNA, 21 nt, Mycobacterium bovis subsp bovis AF2122/97
gccgggcuuaggccgcggcac

SEQ ID NO: 3066539 - RNA, 18 nt, Mycobacterium bovis subsp bovis AF2122/97
gccgggcuucagcacgcg

SEQ ID NO: 3066540 - RNA, 15 nt, Mycobacterium bovis subsp bovis AF2122/97
gccgggcuuggccgc

SEQ ID NO: 3066541 - RNA, 17 nt, Mycobacterium bovis subsp bovis AF2122/97
gccgggcuuggccgcgc

SEQ ID NO: 3066542 - RNA, 18 nt, Mycobacterium bovis subsp bovis AF2122/97
gccgggcuuggccgcgcc

SEQ ID NO: 3066543 - RNA, 22 nt, Mycobacterium bovis subsp bovis AF2122/97
gccggggaacuuaccgaggcca

SEQ ID NO: 3066544 - RNA, 17 nt, Mycobacterium bovis subsp bovis AF2122/97
gccggggacgccgcggc

SEQ ID NO: 3066545 - RNA, 20 nt, Mycobacterium bovis subsp bovis AF2122/97
gccggggacgccgcggcgcc

SEQ ID NO: 3066546 - RNA, 21 nt, Mycobacterium bovis subsp bovis AF2122/97
gccggggaguggaaacccgcc

SEQ ID NO: 3066547 - RNA, 18 nt, Mycobacterium bovis subsp bovis AF2122/97
gccggggcagcucaccuu

SEQ ID NO: 3066548 - RNA, 13 nt, Mycobacterium bovis subsp bovis AF2122/97
gccggggccaccc

SEQ ID NO: 3066549 - RNA, 15 nt, Mycobacterium bovis subsp bovis AF2122/97
gccggggccccaugc

SEQ ID NO: 3066550 - RNA, 19 nt, Mycobacterium bovis subsp bovis AF2122/97
gccggggccccaugccgac

SEQ ID NO: 3066551 - RNA, 21 nt, Mycobacterium bovis subsp bovis AF2122/97
gccggggccccaugccgaccg

SEQ ID NO: 3066552 - RNA, 15 nt, Mycobacterium bovis subsp bovis AF2122/97
gccggggccgccgau

SEQ ID NO: 3066553 - RNA, 16 nt, Mycobacterium bovis subsp bovis AF2122/97
gccggggccgccgaug

SEQ ID NO: 3066554 - RNA, 15 nt, Mycobacterium bovis subsp bovis AF2122/97
gccggggccgcuggc

SEQ ID NO: 3066555 - RNA, 18 nt, Mycobacterium bovis subsp bovis AF2122/97
gccggggccgcuggcggu

SEQ ID NO: 3066556 - RNA, 19 nt, Mycobacterium bovis subsp bovis AF2122/97
gccggggcgaacggcaccg

SEQ ID NO: 3066557 - RNA, 17 nt, Mycobacterium bovis subsp bovis AF2122/97
gccggggcgaugucggc

SEQ ID NO: 3066558 - RNA, 14 nt, Mycobacterium bovis subsp bovis AF2122/97
gccggggcgcaggu

SEQ ID NO: 3066559 - RNA, 17 nt, Mycobacterium bovis subsp bovis AF2122/97
gccggggcgcagguugg

SEQ ID NO: 3066560 - RNA, 16 nt, Mycobacterium bovis subsp bovis AF2122/97
gccggggcggaaccug

SEQ ID NO: 3066561 - RNA, 18 nt, Mycobacterium bovis subsp bovis AF2122/97
gccggggcggaaccuguc

SEQ ID NO: 3066562 - RNA, 14 nt, Mycobacterium bovis subsp bovis AF2122/97
gccggggcugccga

SEQ ID NO: 3066563 - RNA, 17 nt, Mycobacterium bovis subsp bovis AF2122/97
gccggggcugccgaaca

SEQ ID NO: 3066564 - RNA, 20 nt, Mycobacterium bovis subsp bovis AF2122/97
gccgggggcaccguuaccgc

SEQ ID NO: 3066565 - RNA, 18 nt, Mycobacterium bovis subsp bovis AF2122/97
gccgggguagacgccccg

SEQ ID NO: 3066566 - RNA, 17 nt, Mycobacterium bovis subsp bovis AF2122/97
gccggucaggccgccgc

SEQ ID NO: 3066567 - RNA, 21 nt, Mycobacterium bovis subsp bovis AF2122/97
gccggucaggccgccgcggcg

SEQ ID NO: 3066568 - RNA, 13 nt, Mycobacterium bovis subsp bovis AF2122/97
gccggucauacca

SEQ ID NO: 3066569 - RNA, 22 nt, Mycobacterium bovis subsp bovis AF2122/97
gccggucaucccaagcguccgc

SEQ ID NO: 3066570 - RNA, 22 nt, Mycobacterium bovis subsp bovis AF2122/97
gccggucauccgggcgaccacc

SEQ ID NO: 3066571 - RNA, 22 nt, Mycobacterium bovis subsp bovis AF2122/97
gccggucaugauccgaacuucg

SEQ ID NO: 3066572 - RNA, 17 nt, Mycobacterium bovis subsp bovis AF2122/97
gccgguccagacccagc

SEQ ID NO: 3066573 - RNA, 20 nt, Mycobacterium bovis subsp bovis AF2122/97
gccgguccagacccagcucg

SEQ ID NO: 3066574 - RNA, 21 nt, Mycobacterium bovis subsp bovis AF2122/97
gccgguccagacccagcucgu

SEQ ID NO: 3066575 - RNA, 14 nt, Mycobacterium bovis subsp bovis AF2122/97
gccgguccagcagc

SEQ ID NO: 3066576 - RNA, 19 nt, Mycobacterium bovis subsp bovis AF2122/97
gccgguccagcagcucggc

SEQ ID NO: 3066577 - RNA, 23 nt, Mycobacterium bovis subsp bovis AF2122/97
gccgguccccccguugccgccgu

SEQ ID NO: 3066578 - RNA, 18 nt, Mycobacterium bovis subsp bovis AF2122/97
gccggucccccgcccaca

SEQ ID NO: 3066579 - RNA, 17 nt, Mycobacterium bovis subsp bovis AF2122/97
gccgguccccgccggcg

SEQ ID NO: 3066580 - RNA, 18 nt, Mycobacterium bovis subsp bovis AF2122/97
gccgguccccgccggcgg

SEQ ID NO: 3066581 - RNA, 17 nt, Mycobacterium bovis subsp bovis AF2122/97
gccgguccccucggugc

SEQ ID NO: 3066582 - RNA, 14 nt, Mycobacterium bovis subsp bovis AF2122/97
gccgguccggggca

SEQ ID NO: 3066583 - RNA, 16 nt, Mycobacterium bovis subsp bovis AF2122/97
gccgguccggggcaac

SEQ ID NO: 3066584 - RNA, 16 nt, Mycobacterium bovis subsp bovis AF2122/97
gccgguccucgucggc

SEQ ID NO: 3066585 - RNA, 17 nt, Mycobacterium bovis subsp bovis AF2122/97
gccgguccucgucggcg

SEQ ID NO: 3066586 - RNA, 18 nt, Mycobacterium bovis subsp bovis AF2122/97
gccgguccucgucggcga

SEQ ID NO: 3066587 - RNA, 20 nt, Mycobacterium bovis subsp bovis AF2122/97
gccggucgaugucggcgaac

SEQ ID NO: 3066588 - RNA, 22 nt, Mycobacterium bovis subsp bovis AF2122/97
gccggucgaugucggcgaacca

SEQ ID NO: 3066589 - RNA, 20 nt, Mycobacterium bovis subsp bovis AF2122/97
gccggucgcauggucgacga

SEQ ID NO: 3066590 - RNA, 13 nt, Mycobacterium bovis subsp bovis AF2122/97
gccggucgccgac

SEQ ID NO: 3066591 - RNA, 16 nt, Mycobacterium bovis subsp bovis AF2122/97
gccggucgccgacggc

SEQ ID NO: 3066592 - RNA, 13 nt, Mycobacterium bovis subsp bovis AF2122/97
gccggucgccggc

SEQ ID NO: 3066593 - RNA, 18 nt, Mycobacterium bovis subsp bovis AF2122/97
gccggucgccggcugggg

SEQ ID NO: 3066594 - RNA, 13 nt, Mycobacterium bovis subsp bovis AF2122/97
gccggucggaucg

SEQ ID NO: 3066595 - RNA, 14 nt, Mycobacterium bovis subsp bovis AF2122/97
gccggucggcacca

SEQ ID NO: 3066596 - RNA, 12 nt, Mycobacterium bovis subsp bovis AF2122/97
gccggucggcgu

SEQ ID NO: 3066597 - RNA, 14 nt, Mycobacterium bovis subsp bovis AF2122/97
gccggucggcgucg

SEQ ID NO: 3066598 - RNA, 17 nt, Mycobacterium bovis subsp bovis AF2122/97
gccggucuccgaacggg

SEQ ID NO: 3066599 - RNA, 22 nt, Mycobacterium bovis subsp bovis AF2122/97
gccggucuugcaucgccaaugc

SEQ ID NO: 3066600 - RNA, 14 nt, Mycobacterium bovis subsp bovis AF2122/97
gccggucuuggaca

SEQ ID NO: 3066601 - RNA, 21 nt, Mycobacterium bovis subsp bovis AF2122/97
gccggugacaaguggugcccu

SEQ ID NO: 3066602 - RNA, 23 nt, Mycobacterium bovis subsp bovis AF2122/97
gccggugacgacgucgccgccgc

SEQ ID NO: 3066603 - RNA, 23 nt, Mycobacterium bovis subsp bovis AF2122/97
gccggugacgaugaccgcgcggc

SEQ ID NO: 3066604 - RNA, 21 nt, Mycobacterium bovis subsp bovis AF2122/97
gccggugacgggguugaccgc

SEQ ID NO: 3066605 - RNA, 18 nt, Mycobacterium bovis subsp bovis AF2122/97
gccggugacgguguuggu

SEQ ID NO: 3066606 - RNA, 23 nt, Mycobacterium bovis subsp bovis AF2122/97
gccggugacgguguuggugaccg

SEQ ID NO: 3066607 - RNA, 18 nt, Mycobacterium bovis subsp bovis AF2122/97
gccggugacguggugggc

SEQ ID NO: 3066608 - RNA, 14 nt, Mycobacterium bovis subsp bovis AF2122/97
gccggugacucaga

SEQ ID NO: 3066609 - RNA, 16 nt, Mycobacterium bovis subsp bovis AF2122/97
gccggugagcgagcgc

SEQ ID NO: 3066610 - RNA, 17 nt, Mycobacterium bovis subsp bovis AF2122/97
gccggugauccggucgu

SEQ ID NO: 3066611 - RNA, 15 nt, Mycobacterium bovis subsp bovis AF2122/97
gccggugaucggcgg

SEQ ID NO: 3066612 - RNA, 16 nt, Mycobacterium bovis subsp bovis AF2122/97
gccggugaucggcggc

SEQ ID NO: 3066613 - RNA, 17 nt, Mycobacterium bovis subsp bovis AF2122/97
gccggugaucggcggca

SEQ ID NO: 3066614 - RNA, 22 nt, Mycobacterium bovis subsp bovis AF2122/97
gccggugauggccgaccagccg

SEQ ID NO: 3066615 - RNA, 23 nt, Mycobacterium bovis subsp bovis AF2122/97
gccggugauggccgaccagccga

SEQ ID NO: 3066616 - RNA, 14 nt, Mycobacterium bovis subsp bovis AF2122/97
gccggugcagcacg

SEQ ID NO: 3066617 - RNA, 23 nt, Mycobacterium bovis subsp bovis AF2122/97
gccggugccacccuugccgccgg

SEQ ID NO: 3066618 - RNA, 13 nt, Mycobacterium bovis subsp bovis AF2122/97
gccggugccaccg

SEQ ID NO: 3066619 - RNA, 22 nt, Mycobacterium bovis subsp bovis AF2122/97
gccggugccaccggcuggugcc

SEQ ID NO: 3066620 - RNA, 17 nt, Mycobacterium bovis subsp bovis AF2122/97
gccggugccacugccgu

SEQ ID NO: 3066621 - RNA, 19 nt, Mycobacterium bovis subsp bovis AF2122/97
gccggugccacugccguug

SEQ ID NO: 3066622 - RNA, 18 nt, Mycobacterium bovis subsp bovis AF2122/97
gccggugcccgggcguca

SEQ ID NO: 3066623 - RNA, 12 nt, Mycobacterium bovis subsp bovis AF2122/97
gccggugccgau

SEQ ID NO: 3066624 - RNA, 13 nt, Mycobacterium bovis subsp bovis AF2122/97
gccggugccgcca

SEQ ID NO: 3066625 - RNA, 18 nt, Mycobacterium bovis subsp bovis AF2122/97
gccggugccgccgcggcc

SEQ ID NO: 3066626 - RNA, 19 nt, Mycobacterium bovis subsp bovis AF2122/97
gccggugccgccgcggcca

SEQ ID NO: 3066627 - RNA, 14 nt, Mycobacterium bovis subsp bovis AF2122/97
gccggugccgccgg

SEQ ID NO: 3066628 - RNA, 15 nt, Mycobacterium bovis subsp bovis AF2122/97
gccggugccgccggu

SEQ ID NO: 3066629 - RNA, 16 nt, Mycobacterium bovis subsp bovis AF2122/97
gccggugccgccguuc

SEQ ID NO: 3066630 - RNA, 18 nt, Mycobacterium bovis subsp bovis AF2122/97
gccggugccgccuccgcc

SEQ ID NO: 3066631 - RNA, 17 nt, Mycobacterium bovis subsp bovis AF2122/97
gccggugccgccugcgc

SEQ ID NO: 3066632 - RNA, 20 nt, Mycobacterium bovis subsp bovis AF2122/97
gccggugccgccugcgccgc

SEQ ID NO: 3066633 - RNA, 16 nt, Mycobacterium bovis subsp bovis AF2122/97
gccggugccgcgguag

SEQ ID NO: 3066634 - RNA, 17 nt, Mycobacterium bovis subsp bovis AF2122/97
gccggugccggccaucg

SEQ ID NO: 3066635 - RNA, 13 nt, Mycobacterium bovis subsp bovis AF2122/97
gccggugccggcg

SEQ ID NO: 3066636 - RNA, 14 nt, Mycobacterium bovis subsp bovis AF2122/97
gccggugccggcgc

SEQ ID NO: 3066637 - RNA, 16 nt, Mycobacterium bovis subsp bovis AF2122/97
gccggugccggcgcac

SEQ ID NO: 3066638 - RNA, 21 nt, Mycobacterium bovis subsp bovis AF2122/97
gccggugccggcguugccgcc

SEQ ID NO: 3066639 - RNA, 18 nt, Mycobacterium bovis subsp bovis AF2122/97
gccggugccgggcaccac

SEQ ID NO: 3066640 - RNA, 13 nt, Mycobacterium bovis subsp bovis AF2122/97
gccggugcgcacc

SEQ ID NO: 3066641 - RNA, 14 nt, Mycobacterium bovis subsp bovis AF2122/97
gccggugcgcacca

SEQ ID NO: 3066642 - RNA, 17 nt, Mycobacterium bovis subsp bovis AF2122/97
gccggugcgcaccagca

SEQ ID NO: 3066643 - RNA, 22 nt, Mycobacterium bovis subsp bovis AF2122/97
gccggugcgcaccagcacaccc

SEQ ID NO: 3066644 - RNA, 11 nt, Mycobacterium bovis subsp bovis AF2122/97
gccggugcgcc

SEQ ID NO: 3066645 - RNA, 13 nt, Mycobacterium bovis subsp bovis AF2122/97
gccggugcgcccu

SEQ ID NO: 3066646 - RNA, 14 nt, Mycobacterium bovis subsp bovis AF2122/97
gccggugcgcugga

SEQ ID NO: 3066647 - RNA, 16 nt, Mycobacterium bovis subsp bovis AF2122/97
gccggugcggccaaug

SEQ ID NO: 3066648 - RNA, 13 nt, Mycobacterium bovis subsp bovis AF2122/97
gccggugcggcgg

SEQ ID NO: 3066649 - RNA, 18 nt, Mycobacterium bovis subsp bovis AF2122/97
gccggugcggcgggcucg

SEQ ID NO: 3066650 - RNA, 15 nt, Mycobacterium bovis subsp bovis AF2122/97
gccggugcgguggug

SEQ ID NO: 3066651 - RNA, 16 nt, Mycobacterium bovis subsp bovis AF2122/97
gccggugcgguggugc

SEQ ID NO: 3066652 - RNA, 12 nt, Mycobacterium bovis subsp bovis AF2122/97
gccggugcguca

SEQ ID NO: 3066653 - RNA, 22 nt, Mycobacterium bovis subsp bovis AF2122/97
gccguaguaguggccgccaccc

SEQ ID NO: 3066654 - RNA, 23 nt, Mycobacterium bovis subsp bovis AF2122/97
gccguaguaguggccgccacccg

SEQ ID NO: 3066655 - RNA, 16 nt, Mycobacterium bovis subsp bovis AF2122/97
gccguagugcgcaucg

SEQ ID NO: 3066656 - RNA, 20 nt, Mycobacterium bovis subsp bovis AF2122/97
gccguagugcgcaucgccgg

SEQ ID NO: 3066657 - RNA, 17 nt, Mycobacterium bovis subsp bovis AF2122/97
gccguagugucggcguc

SEQ ID NO: 3066658 - RNA, 22 nt, Mycobacterium bovis subsp bovis AF2122/97
gccguaguugguccaggugacc

SEQ ID NO: 3066659 - RNA, 22 nt, Mycobacterium bovis subsp bovis AF2122/97
gccguauaggcccgggcggcca

SEQ ID NO: 3066660 - RNA, 16 nt, Mycobacterium bovis subsp bovis AF2122/97
gccguauccaggcgug

SEQ ID NO: 3066661 - RNA, 17 nt, Mycobacterium bovis subsp bovis AF2122/97
gccguauccaggcgugc

SEQ ID NO: 3066662 - RNA, 13 nt, Mycobacterium bovis subsp bovis AF2122/97
gccguaucggugu

SEQ ID NO: 3066663 - RNA, 17 nt, Mycobacterium bovis subsp bovis AF2122/97
gccguaucgucgagcac

SEQ ID NO: 3066664 - RNA, 19 nt, Mycobacterium bovis subsp bovis AF2122/97
gccguaugccgccaaccgc

SEQ ID NO: 3066665 - RNA, 20 nt, Mycobacterium bovis subsp bovis AF2122/97
gccguaugccgccaaccgcg

SEQ ID NO: 3066666 - RNA, 22 nt, Mycobacterium bovis subsp bovis AF2122/97
gccgucaaccagggugccggcg

SEQ ID NO: 3066667 - RNA, 23 nt, Mycobacterium bovis subsp bovis AF2122/97
gccgucaaccagggugccggcgg

SEQ ID NO: 3066668 - RNA, 16 nt, Mycobacterium bovis subsp bovis AF2122/97
gccgucaacgauggug

SEQ ID NO: 3066669 - RNA, 20 nt, Mycobacterium bovis subsp bovis AF2122/97
gccgucaacgaugguggcga

SEQ ID NO: 3066670 - RNA, 18 nt, Mycobacterium bovis subsp bovis AF2122/97
gccgucaacgccucugcu

SEQ ID NO: 3066671 - RNA, 18 nt, Mycobacterium bovis subsp bovis AF2122/97
gccgucaagauugaacga

SEQ ID NO: 3066672 - RNA, 23 nt, Mycobacterium bovis subsp bovis AF2122/97
gccgucaagauugaacgaguagc

SEQ ID NO: 3066673 - RNA, 14 nt, Mycobacterium bovis subsp bovis AF2122/97
gccgucaauggaac

SEQ ID NO: 3066674 - RNA, 13 nt, Mycobacterium bovis subsp bovis AF2122/97
gccgucacccccg

SEQ ID NO: 3066675 - RNA, 23 nt, Mycobacterium bovis subsp bovis AF2122/97
gccgucaccgacgcacaggcgac

SEQ ID NO: 3066676 - RNA, 15 nt, Mycobacterium bovis subsp bovis AF2122/97
gccgucaccgaucga

SEQ ID NO: 3066677 - RNA, 21 nt, Mycobacterium bovis subsp bovis AF2122/97
gccgucaccgaucgaacagug

SEQ ID NO: 3066678 - RNA, 11 nt, Mycobacterium bovis subsp bovis AF2122/97
gccgucaccgc

SEQ ID NO: 3066679 - RNA, 13 nt, Mycobacterium bovis subsp bovis AF2122/97
gccgucaccgccc

SEQ ID NO: 3066680 - RNA, 20 nt, Mycobacterium bovis subsp bovis AF2122/97
gccgucaccgcccuugccgc

SEQ ID NO: 3066681 - RNA, 13 nt, Mycobacterium bovis subsp bovis AF2122/97
gccgucaccgccg

SEQ ID NO: 3066682 - RNA, 14 nt, Mycobacterium bovis subsp bovis AF2122/97
gccgucaccgccgu

SEQ ID NO: 3066683 - RNA, 21 nt, Mycobacterium bovis subsp bovis AF2122/97
gccgucaccgccguugccgcc

SEQ ID NO: 3066684 - RNA, 16 nt, Mycobacterium bovis subsp bovis AF2122/97
gccgucaccggucggc

SEQ ID NO: 3066685 - RNA, 19 nt, Mycobacterium bovis subsp bovis AF2122/97
gccgucaccgucauugcca

SEQ ID NO: 3066686 - RNA, 21 nt, Mycobacterium bovis subsp bovis AF2122/97
gccgucaccgucauugccacc

SEQ ID NO: 3066687 - RNA, 14 nt, Mycobacterium bovis subsp bovis AF2122/97
gccgucacgccgga

SEQ ID NO: 3066688 - RNA, 17 nt, Mycobacterium bovis subsp bovis AF2122/97
gccgucacggcaguacc

SEQ ID NO: 3066689 - RNA, 15 nt, Mycobacterium bovis subsp bovis AF2122/97
gccgucagaacaccg

SEQ ID NO: 3066690 - RNA, 17 nt, Mycobacterium bovis subsp bovis AF2122/97
gccgucagaacaccggc

SEQ ID NO: 3066691 - RNA, 23 nt, Mycobacterium bovis subsp bovis AF2122/97
gccgucagaacaccggccaggcc

SEQ ID NO: 3066692 - RNA, 20 nt, Mycobacterium bovis subsp bovis AF2122/97
gccgucagcacaaacccagu

SEQ ID NO: 3066693 - RNA, 14 nt, Mycobacterium bovis subsp bovis AF2122/97
gccgucagccaggu

SEQ ID NO: 3066694 - RNA, 17 nt, Mycobacterium bovis subsp bovis AF2122/97
gccgucagccaggugcc

SEQ ID NO: 3066695 - RNA, 21 nt, Mycobacterium bovis subsp bovis AF2122/97
gccgucagccaggugcccaag

SEQ ID NO: 3066696 - RNA, 14 nt, Mycobacterium bovis subsp bovis AF2122/97
gccgucagccguuc

SEQ ID NO: 3066697 - RNA, 17 nt, Mycobacterium bovis subsp bovis AF2122/97
gccgucagccguucggc

SEQ ID NO: 3066698 - RNA, 15 nt, Mycobacterium bovis subsp bovis AF2122/97
gccgucagcggcggc

SEQ ID NO: 3066699 - RNA, 18 nt, Mycobacterium bovis subsp bovis AF2122/97
gccgucagcggcggccac

SEQ ID NO: 3066700 - RNA, 14 nt, Mycobacterium bovis subsp bovis AF2122/97
gccgucagcucacc

SEQ ID NO: 3066701 - RNA, 22 nt, Mycobacterium bovis subsp bovis AF2122/97
gccgucagcucaccacccagau

SEQ ID NO: 3066702 - RNA, 19 nt, Mycobacterium bovis subsp bovis AF2122/97
gccgucagcugaccgaaga

SEQ ID NO: 3066703 - RNA, 20 nt, Mycobacterium bovis subsp bovis AF2122/97
gccgucagggucagcuggga

SEQ ID NO: 3066704 - RNA, 21 nt, Mycobacterium bovis subsp bovis AF2122/97
gccgucagggucagcugggac

SEQ ID NO: 3066705 - RNA, 14 nt, Mycobacterium bovis subsp bovis AF2122/97
gccgucaucgcagc

SEQ ID NO: 3066706 - RNA, 14 nt, Mycobacterium bovis subsp bovis AF2122/97
gccgucaucuccga

SEQ ID NO: 3066707 - RNA, 20 nt, Mycobacterium bovis subsp bovis AF2122/97
gccgucaucuccgacucgau

SEQ ID NO: 3066708 - RNA, 17 nt, Mycobacterium bovis subsp bovis AF2122/97
gccgucaucuggaagua

SEQ ID NO: 3066709 - RNA, 20 nt, Mycobacterium bovis subsp bovis AF2122/97
gccgucaugcccaucuccaa

SEQ ID NO: 3066710 - RNA, 14 nt, Mycobacterium bovis subsp bovis AF2122/97
gccgucauggcccg

SEQ ID NO: 3066711 - RNA, 23 nt, Mycobacterium bovis subsp bovis AF2122/97
gccguccaagaugucguguucgc

SEQ ID NO: 3066712 - RNA, 15 nt, Mycobacterium bovis subsp bovis AF2122/97
gccguccaagccagc

SEQ ID NO: 3066713 - RNA, 16 nt, Mycobacterium bovis subsp bovis AF2122/97
gccguccaagccagcg

SEQ ID NO: 3066714 - RNA, 18 nt, Mycobacterium bovis subsp bovis AF2122/97
gccguccaauuccgcaga

SEQ ID NO: 3066715 - RNA, 20 nt, Mycobacterium bovis subsp bovis AF2122/97
gccguccaccgauacccccg

SEQ ID NO: 3066716 - RNA, 22 nt, Mycobacterium bovis subsp bovis AF2122/97
gccguccaccgauacccccggc

SEQ ID NO: 3066717 - RNA, 13 nt, Mycobacterium bovis subsp bovis AF2122/97
gccguccagcgcc

SEQ ID NO: 3066718 - RNA, 17 nt, Mycobacterium bovis subsp bovis AF2122/97
gccguccagcgccgcgg

SEQ ID NO: 3066719 - RNA, 19 nt, Mycobacterium bovis subsp bovis AF2122/97
gccguccagguucaugcaa

SEQ ID NO: 3066720 - RNA, 14 nt, Mycobacterium bovis subsp bovis AF2122/97
gccguccagucggu

SEQ ID NO: 3066721 - RNA, 14 nt, Mycobacterium bovis subsp bovis AF2122/97
gccgucccaccagc

SEQ ID NO: 3066722 - RNA, 16 nt, Mycobacterium bovis subsp bovis AF2122/97
gccgucccaccagccg

SEQ ID NO: 3066723 - RNA, 17 nt, Mycobacterium bovis subsp bovis AF2122/97
gccguccccgccgacgc

SEQ ID NO: 3066724 - RNA, 21 nt, Mycobacterium bovis subsp bovis AF2122/97
gccgucccgaaacgccggguu

SEQ ID NO: 3066725 - RNA, 23 nt, Mycobacterium bovis subsp bovis AF2122/97
gccgucccgaaacgccggguucg

SEQ ID NO: 3066726 - RNA, 20 nt, Mycobacterium bovis subsp bovis AF2122/97
gccgucccgauacggccggc

SEQ ID NO: 3066727 - RNA, 15 nt, Mycobacterium bovis subsp bovis AF2122/97
gccgucccgcgagca

SEQ ID NO: 3066728 - RNA, 16 nt, Mycobacterium bovis subsp bovis AF2122/97
gccgucccgcgagcag

SEQ ID NO: 3066729 - RNA, 18 nt, Mycobacterium bovis subsp bovis AF2122/97
gccgucccgcgagcagcc

SEQ ID NO: 3066730 - RNA, 21 nt, Mycobacterium bovis subsp bovis AF2122/97
gccgucccgcgagcagcccgg

SEQ ID NO: 3066731 - RNA, 15 nt, Mycobacterium bovis subsp bovis AF2122/97
gccgucccggcucga

SEQ ID NO: 3066732 - RNA, 14 nt, Mycobacterium bovis subsp bovis AF2122/97
gccguccgaccagg

SEQ ID NO: 3066733 - RNA, 17 nt, Mycobacterium bovis subsp bovis AF2122/97
gccguccgaccagggau

SEQ ID NO: 3066734 - RNA, 12 nt, Mycobacterium bovis subsp bovis AF2122/97
gccguccggcgc

SEQ ID NO: 3066735 - RNA, 15 nt, Mycobacterium bovis subsp bovis AF2122/97
gccguccggcgccca

SEQ ID NO: 3066736 - RNA, 14 nt, Mycobacterium bovis subsp bovis AF2122/97
gccguccggcgcug

SEQ ID NO: 3066737 - RNA, 18 nt, Mycobacterium bovis subsp bovis AF2122/97
gccguccggcgcuggcgu

SEQ ID NO: 3066738 - RNA, 14 nt, Mycobacterium bovis subsp bovis AF2122/97
gccguccggcuugg

SEQ ID NO: 3066739 - RNA, 15 nt, Mycobacterium bovis subsp bovis AF2122/97
gccgucggcgccggc

SEQ ID NO: 3066740 - RNA, 19 nt, Mycobacterium bovis subsp bovis AF2122/97
gccgucggcgccggcaucg

SEQ ID NO: 3066741 - RNA, 14 nt, Mycobacterium bovis subsp bovis AF2122/97
gccgucggcgccuc

SEQ ID NO: 3066742 - RNA, 22 nt, Mycobacterium bovis subsp bovis AF2122/97
gccgucggcgugacgucgucga

SEQ ID NO: 3066743 - RNA, 19 nt, Mycobacterium bovis subsp bovis AF2122/97
gccgucggcgugcagcagc

SEQ ID NO: 3066744 - RNA, 16 nt, Mycobacterium bovis subsp bovis AF2122/97
gccgucgggcagcagc

SEQ ID NO: 3066745 - RNA, 21 nt, Mycobacterium bovis subsp bovis AF2122/97
gccgucggggaguucgcgcag

SEQ ID NO: 3066746 - RNA, 23 nt, Mycobacterium bovis subsp bovis AF2122/97
gccgucggggguaauugccagcc

SEQ ID NO: 3066747 - RNA, 19 nt, Mycobacterium bovis subsp bovis AF2122/97
gccgucggguaggccgccg

SEQ ID NO: 3066748 - RNA, 20 nt, Mycobacterium bovis subsp bovis AF2122/97
gccgucgggugcagcacggc

SEQ ID NO: 3066749 - RNA, 20 nt, Mycobacterium bovis subsp bovis AF2122/97
gccgucggugaugacguagu

SEQ ID NO: 3066750 - RNA, 20 nt, Mycobacterium bovis subsp bovis AF2122/97
gccgucggugauggagccgg

SEQ ID NO: 3066751 - RNA, 21 nt, Mycobacterium bovis subsp bovis AF2122/97
gccgucggugauggagccggu

SEQ ID NO: 3066752 - RNA, 12 nt, Mycobacterium bovis subsp bovis AF2122/97
gccgucggugcc

SEQ ID NO: 3066753 - RNA, 14 nt, Mycobacterium bovis subsp bovis AF2122/97
gccgucggugccgc

SEQ ID NO: 3066754 - RNA, 15 nt, Mycobacterium bovis subsp bovis AF2122/97
gccgucggugccgcc

SEQ ID NO: 3066755 - RNA, 17 nt, Mycobacterium bovis subsp bovis AF2122/97
gccgucggugccgccgc

SEQ ID NO: 3066756 - RNA, 18 nt, Mycobacterium bovis subsp bovis AF2122/97
gccgucggugccgccgcc

SEQ ID NO: 3066757 - RNA, 19 nt, Mycobacterium bovis subsp bovis AF2122/97
gccgucggugccgccgccg

SEQ ID NO: 3066758 - RNA, 22 nt, Mycobacterium bovis subsp bovis AF2122/97
gccgucggugccgccgccggcg

SEQ ID NO: 3066759 - RNA, 17 nt, Mycobacterium bovis subsp bovis AF2122/97
gccgucggugccgcgga

SEQ ID NO: 3066760 - RNA, 22 nt, Mycobacterium bovis subsp bovis AF2122/97
gccgucggugccggggcugccg

SEQ ID NO: 3066761 - RNA, 19 nt, Mycobacterium bovis subsp bovis AF2122/97
gccgucggugggugccagc

SEQ ID NO: 3066762 - RNA, 23 nt, Mycobacterium bovis subsp bovis AF2122/97
gccgucggugguuuucccgucgc

SEQ ID NO: 3066763 - RNA, 17 nt, Mycobacterium bovis subsp bovis AF2122/97
gccgucguacaccucga

SEQ ID NO: 3066764 - RNA, 20 nt, Mycobacterium bovis subsp bovis AF2122/97
gccgucguacucgaccgcga

SEQ ID NO: 3066765 - RNA, 23 nt, Mycobacterium bovis subsp bovis AF2122/97
gccgucguacucgaccgcgagca

SEQ ID NO: 3066766 - RNA, 12 nt, Mycobacterium bovis subsp bovis AF2122/97
gccgucgucagc

SEQ ID NO: 3066767 - RNA, 15 nt, Mycobacterium bovis subsp bovis AF2122/97
gccgucgucgaccac

SEQ ID NO: 3066768 - RNA, 17 nt, Mycobacterium bovis subsp bovis AF2122/97
gccgucgucgaccacga

SEQ ID NO: 3066769 - RNA, 13 nt, Mycobacterium bovis subsp bovis AF2122/97
gccgucgucgauc

SEQ ID NO: 3066770 - RNA, 13 nt, Mycobacterium bovis subsp bovis AF2122/97
gccgucgucgccg

SEQ ID NO: 3066771 - RNA, 21 nt, Mycobacterium bovis subsp bovis AF2122/97
gccgucgucgccgucggugcc

SEQ ID NO: 3066772 - RNA, 15 nt, Mycobacterium bovis subsp bovis AF2122/97
gccgucgucgcgcag

SEQ ID NO: 3066773 - RNA, 19 nt, Mycobacterium bovis subsp bovis AF2122/97
gccgucgucgcgcaguacu

SEQ ID NO: 3066774 - RNA, 12 nt, Mycobacterium bovis subsp bovis AF2122/97
gccgucgucggc

SEQ ID NO: 3066775 - RNA, 16 nt, Mycobacterium bovis subsp bovis AF2122/97
gccgucgucggccaga

SEQ ID NO: 3066776 - RNA, 14 nt, Mycobacterium bovis subsp bovis AF2122/97
gccgucgucggcgu

SEQ ID NO: 3066777 - RNA, 16 nt, Mycobacterium bovis subsp bovis AF2122/97
gccgucgucggcguac

SEQ ID NO: 3066778 - RNA, 16 nt, Mycobacterium bovis subsp bovis AF2122/97
gccgucgucgucgaga

SEQ ID NO: 3066779 - RNA, 15 nt, Mycobacterium bovis subsp bovis AF2122/97
gccgucgucgucgcu

SEQ ID NO: 3066780 - RNA, 21 nt, Mycobacterium bovis subsp bovis AF2122/97
gccgucgucgucgcuguaggc

SEQ ID NO: 3066781 - RNA, 13 nt, Mycobacterium bovis subsp bovis AF2122/97
gccgucgugaucg

SEQ ID NO: 3066782 - RNA, 17 nt, Mycobacterium bovis subsp bovis AF2122/97
gccgucgugaucggcga

SEQ ID NO: 3066783 - RNA, 18 nt, Mycobacterium bovis subsp bovis AF2122/97
gccgucgugaucggcgaa

SEQ ID NO: 3066784 - RNA, 14 nt, Mycobacterium bovis subsp bovis AF2122/97
gccgucgugccacc

SEQ ID NO: 3066785 - RNA, 21 nt, Mycobacterium bovis subsp bovis AF2122/97
gccgucgugccaccguugggc

SEQ ID NO: 3066786 - RNA, 17 nt, Mycobacterium bovis subsp bovis AF2122/97
gccgucguugcccgacc

SEQ ID NO: 3066787 - RNA, 20 nt, Mycobacterium bovis subsp bovis AF2122/97
gccgucguugcccgacccgc

SEQ ID NO: 3066788 - RNA, 23 nt, Mycobacterium bovis subsp bovis AF2122/97
gccgucguugcccgacccgccga

SEQ ID NO: 3066789 - RNA, 14 nt, Mycobacterium bovis subsp bovis AF2122/97
gccgucguugccgg

SEQ ID NO: 3066790 - RNA, 17 nt, Mycobacterium bovis subsp bovis AF2122/97
gccgucguugccggcga

SEQ ID NO: 3066791 - RNA, 17 nt, Mycobacterium bovis subsp bovis AF2122/97
gccgucuagcacacgcu

SEQ ID NO: 3066792 - RNA, 14 nt, Mycobacterium bovis subsp bovis AF2122/97
gccgucucgaucgc

SEQ ID NO: 3066793 - RNA, 16 nt, Mycobacterium bovis subsp bovis AF2122/97
gccgucucgaucgcgg

SEQ ID NO: 3066794 - RNA, 14 nt, Mycobacterium bovis subsp bovis AF2122/97
gccgucucgcggug

SEQ ID NO: 3066795 - RNA, 19 nt, Mycobacterium bovis subsp bovis AF2122/97
gccgucucugacgaauggg

SEQ ID NO: 3066796 - RNA, 21 nt, Mycobacterium bovis subsp bovis AF2122/97
gccgucucugccacgcguucc

SEQ ID NO: 3066797 - RNA, 18 nt, Mycobacterium bovis subsp bovis AF2122/97
gccgucuucgccgccacc

SEQ ID NO: 3066798 - RNA, 21 nt, Mycobacterium bovis subsp bovis AF2122/97
gccgucuucgccgccaccggc

SEQ ID NO: 3066799 - RNA, 15 nt, Mycobacterium bovis subsp bovis AF2122/97
gccgucuuggcccgg

SEQ ID NO: 3066800 - RNA, 22 nt, Mycobacterium bovis subsp bovis AF2122/97
gccgucuuugucacgcaccgcg

SEQ ID NO: 3066801 - RNA, 15 nt, Mycobacterium bovis subsp bovis AF2122/97
gccgugaacggcgcg

SEQ ID NO: 3066802 - RNA, 16 nt, Mycobacterium bovis subsp bovis AF2122/97
gccgugaauucgccga

SEQ ID NO: 3066803 - RNA, 14 nt, Mycobacterium bovis subsp bovis AF2122/97
gccgugaccaggug

SEQ ID NO: 3066804 - RNA, 22 nt, Mycobacterium bovis subsp bovis AF2122/97
gccgugacccauucucggccgg

SEQ ID NO: 3066805 - RNA, 16 nt, Mycobacterium bovis subsp bovis AF2122/97
gccgugacccucagca

SEQ ID NO: 3066806 - RNA, 19 nt, Mycobacterium bovis subsp bovis AF2122/97
gccgugacccucagcaccg

SEQ ID NO: 3066807 - RNA, 22 nt, Mycobacterium bovis subsp bovis AF2122/97
gccgugaccgagccgcgaugcg

SEQ ID NO: 3066808 - RNA, 19 nt, Mycobacterium bovis subsp bovis AF2122/97
gccgugacgauucgagcaa

SEQ ID NO: 3066809 - RNA, 23 nt, Mycobacterium bovis subsp bovis AF2122/97
gccgugacgauucgagcaacugc

SEQ ID NO: 3066810 - RNA, 15 nt, Mycobacterium bovis subsp bovis AF2122/97
gccgugaucgcuggc

SEQ ID NO: 3066811 - RNA, 16 nt, Mycobacterium bovis subsp bovis AF2122/97
gccgugaucgcuggcg

SEQ ID NO: 3066812 - RNA, 15 nt, Mycobacterium bovis subsp bovis AF2122/97
gccgugaucggcgcc

SEQ ID NO: 3066813 - RNA, 18 nt, Mycobacterium bovis subsp bovis AF2122/97
gccgugaucggcgcccgg

SEQ ID NO: 3066814 - RNA, 21 nt, Mycobacterium bovis subsp bovis AF2122/97
gccgugaugccacggcgucgc

SEQ ID NO: 3066815 - RNA, 21 nt, Mycobacterium bovis subsp bovis AF2122/97
gccgugcaauagcucgggcgc

SEQ ID NO: 3066816 - RNA, 13 nt, Mycobacterium bovis subsp bovis AF2122/97
gccgugcaccagc

SEQ ID NO: 3066817 - RNA, 15 nt, Mycobacterium bovis subsp bovis AF2122/97
gccgugcaccagcga

SEQ ID NO: 3066818 - RNA, 14 nt, Mycobacterium bovis subsp bovis AF2122/97
gccgugcagcucgg

SEQ ID NO: 3066819 - RNA, 17 nt, Mycobacterium bovis subsp bovis AF2122/97
gccgugcagcucgguca

SEQ ID NO: 3066820 - RNA, 20 nt, Mycobacterium bovis subsp bovis AF2122/97
gccgugccagcaggggacgg

SEQ ID NO: 3066821 - RNA, 18 nt, Mycobacterium bovis subsp bovis AF2122/97
gccgugcccaggccaccg

SEQ ID NO: 3066822 - RNA, 20 nt, Mycobacterium bovis subsp bovis AF2122/97
gccgugcccaggccaccggc

SEQ ID NO: 3066823 - RNA, 19 nt, Mycobacterium bovis subsp bovis AF2122/97
gccgugccccgggcccagg

SEQ ID NO: 3066824 - RNA, 16 nt, Mycobacterium bovis subsp bovis AF2122/97
gccgugcccggugcgg

SEQ ID NO: 3066825 - RNA, 15 nt, Mycobacterium bovis subsp bovis AF2122/97
gccguucgggaugca

SEQ ID NO: 3066826 - RNA, 14 nt, Mycobacterium bovis subsp bovis AF2122/97
gccguucgucgcgg

SEQ ID NO: 3066827 - RNA, 16 nt, Mycobacterium bovis subsp bovis AF2122/97
gccguucucgcccacc

SEQ ID NO: 3066828 - RNA, 16 nt, Mycobacterium bovis subsp bovis AF2122/97
gccguucucgucgagg

SEQ ID NO: 3066829 - RNA, 20 nt, Mycobacterium bovis subsp bovis AF2122/97
gccguucugaucugcgcaac

SEQ ID NO: 3066830 - RNA, 19 nt, Mycobacterium bovis subsp bovis AF2122/97
gccguucugucccggcgcg

SEQ ID NO: 3066831 - RNA, 19 nt, Mycobacterium bovis subsp bovis AF2122/97
gccguugaacggcaccagc

SEQ ID NO: 3066832 - RNA, 14 nt, Mycobacterium bovis subsp bovis AF2122/97
gccguugacgccgu

SEQ ID NO: 3066833 - RNA, 14 nt, Mycobacterium bovis subsp bovis AF2122/97
gccguugacggugu

SEQ ID NO: 3066834 - RNA, 15 nt, Mycobacterium bovis subsp bovis AF2122/97
gccguugaguccggc

SEQ ID NO: 3066835 - RNA, 23 nt, Mycobacterium bovis subsp bovis AF2122/97
gccguugauaaaaaccuggcccg

SEQ ID NO: 3066836 - RNA, 22 nt, Mycobacterium bovis subsp bovis AF2122/97
gccguugaucaagaaggccagc

SEQ ID NO: 3066837 - RNA, 17 nt, Mycobacterium bovis subsp bovis AF2122/97
gccguugauucggccgc

SEQ ID NO: 3066838 - RNA, 18 nt, Mycobacterium bovis subsp bovis AF2122/97
gccguugauucggccgcc

SEQ ID NO: 3066839 - RNA, 23 nt, Mycobacterium bovis subsp bovis AF2122/97
gccguugauucggccgccgacgu

SEQ ID NO: 3066840 - RNA, 20 nt, Mycobacterium bovis subsp bovis AF2122/97
gccguugcacggccgggacg

SEQ ID NO: 3066841 - RNA, 12 nt, Mycobacterium bovis subsp bovis AF2122/97
gccguugccaac

SEQ ID NO: 3066842 - RNA, 17 nt, Mycobacterium bovis subsp bovis AF2122/97
gccguugccaagcagcu

SEQ ID NO: 3066843 - RNA, 16 nt, Mycobacterium bovis subsp bovis AF2122/97
gccguugccaccggug

SEQ ID NO: 3066844 - RNA, 18 nt, Mycobacterium bovis subsp bovis AF2122/97
gccguugccaccggugcc

SEQ ID NO: 3066845 - RNA, 23 nt, Mycobacterium bovis subsp bovis AF2122/97
gccguugccaccguugccgccgu

SEQ ID NO: 3066846 - RNA, 21 nt, Mycobacterium bovis subsp bovis AF2122/97
gccguugcccccguugccgcc

SEQ ID NO: 3066847 - RNA, 16 nt, Mycobacterium bovis subsp bovis AF2122/97
gccguugccgaucacc

SEQ ID NO: 3066848 - RNA, 22 nt, Mycobacterium bovis subsp bovis AF2122/97
gccguugccgaucagcccggcc

SEQ ID NO: 3066849 - RNA, 19 nt, Mycobacterium bovis subsp bovis AF2122/97
gccguugccgaucgcuccg

SEQ ID NO: 3066850 - RNA, 12 nt, Mycobacterium bovis subsp bovis AF2122/97
gccguugccgcc

SEQ ID NO: 3066851 - RNA, 15 nt, Mycobacterium bovis subsp bovis AF2122/97
gccguugccgccauc

SEQ ID NO: 3066852 - RNA, 15 nt, Mycobacterium bovis subsp bovis AF2122/97
gccguugccgccauu

SEQ ID NO: 3066853 - RNA, 19 nt, Mycobacterium bovis subsp bovis AF2122/97
gccguugccgccauuggca

SEQ ID NO: 3066854 - RNA, 17 nt, Mycobacterium bovis subsp bovis AF2122/97
gccguugccgccgaagc

SEQ ID NO: 3066855 - RNA, 20 nt, Mycobacterium bovis subsp bovis AF2122/97
gccguugccgccgaagccga

SEQ ID NO: 3066856 - RNA, 17 nt, Mycobacterium bovis subsp bovis AF2122/97
gccguugccgccgacgc

SEQ ID NO: 3066857 - RNA, 18 nt, Mycobacterium bovis subsp bovis AF2122/97
gccguugccgccgacgcc

SEQ ID NO: 3066858 - RNA, 14 nt, Mycobacterium bovis subsp bovis AF2122/97
gccguugccgccgc

SEQ ID NO: 3066859 - RNA, 15 nt, Mycobacterium bovis subsp bovis AF2122/97
gccguugccgccggc

SEQ ID NO: 3066860 - RNA, 16 nt, Mycobacterium bovis subsp bovis AF2122/97
gccguugccgccggcg

SEQ ID NO: 3066861 - RNA, 17 nt, Mycobacterium bovis subsp bovis AF2122/97
gccguugccgccggcgc

SEQ ID NO: 3066862 - RNA, 18 nt, Mycobacterium bovis subsp bovis AF2122/97
gccguugccgccggcgcc

SEQ ID NO: 3066863 - RNA, 23 nt, Mycobacterium bovis subsp bovis AF2122/97
gccguugccgccggcgccgccga

SEQ ID NO: 3066864 - RNA, 15 nt, Mycobacterium bovis subsp bovis AF2122/97
gccguugccgccggu

SEQ ID NO: 3066865 - RNA, 17 nt, Mycobacterium bovis subsp bovis AF2122/97
gccguugccgccggugc

SEQ ID NO: 3066866 - RNA, 14 nt, Mycobacterium bovis subsp bovis AF2122/97
gccguugccgccgu

SEQ ID NO: 3066867 - RNA, 14 nt, Mycobacterium bovis subsp bovis AF2122/97
gccguugccggcca

SEQ ID NO: 3066868 - RNA, 15 nt, Mycobacterium bovis subsp bovis AF2122/97
gccguugccggcgac

SEQ ID NO: 3066869 - RNA, 20 nt, Mycobacterium bovis subsp bovis AF2122/97
gccguugccguacagcccgg

SEQ ID NO: 3066870 - RNA, 22 nt, Mycobacterium bovis subsp bovis AF2122/97
gccguugccguacagcccggcc

SEQ ID NO: 3066871 - RNA, 20 nt, Mycobacterium bovis subsp bovis AF2122/97
gccguugcgaucgcgugcgg

SEQ ID NO: 3066872 - RNA, 22 nt, Mycobacterium bovis subsp bovis AF2122/97
gccguugcgccucuuccuggcg

SEQ ID NO: 3066873 - RNA, 16 nt, Mycobacterium bovis subsp bovis AF2122/97
gccguugcgucugcuc

SEQ ID NO: 3066874 - RNA, 19 nt, Mycobacterium bovis subsp bovis AF2122/97
gccguugcuauucgccagc

SEQ ID NO: 3066875 - RNA, 20 nt, Mycobacterium bovis subsp bovis AF2122/97
gccguugcuauucgccagcg

SEQ ID NO: 3066876 - RNA, 21 nt, Mycobacterium bovis subsp bovis AF2122/97
gccguugcuauucgccagcgc

SEQ ID NO: 3066877 - RNA, 16 nt, Mycobacterium bovis subsp bovis AF2122/97
gccguuggagccgcca

SEQ ID NO: 3066878 - RNA, 23 nt, Mycobacterium bovis subsp bovis AF2122/97
gccguuggcaaugaccccggcgu

SEQ ID NO: 3066879 - RNA, 20 nt, Mycobacterium bovis subsp bovis AF2122/97
gccguuggccggaucgaaga

SEQ ID NO: 3066880 - RNA, 13 nt, Mycobacterium bovis subsp bovis AF2122/97
gccguuggcggcg

SEQ ID NO: 3066881 - RNA, 23 nt, Mycobacterium bovis subsp bovis AF2122/97
gccguuggcggcgguggccagcg

SEQ ID NO: 3066882 - RNA, 22 nt, Mycobacterium bovis subsp bovis AF2122/97
gccguugggaaccgacuugguu

SEQ ID NO: 3066883 - RNA, 22 nt, Mycobacterium bovis subsp bovis AF2122/97
gccguugggcaccguguagcug

SEQ ID NO: 3066884 - RNA, 17 nt, Mycobacterium bovis subsp bovis AF2122/97
gccguugggccaccggc

SEQ ID NO: 3066885 - RNA, 20 nt, Mycobacterium bovis subsp bovis AF2122/97
gccguugggccgcgcccugu

SEQ ID NO: 3066886 - RNA, 14 nt, Mycobacterium bovis subsp bovis AF2122/97
gccguuggugccgc

SEQ ID NO: 3066887 - RNA, 22 nt, Mycobacterium bovis subsp bovis AF2122/97
gccguuguagacggcggcaucg

SEQ ID NO: 3066888 - RNA, 15 nt, Mycobacterium bovis subsp bovis AF2122/97
gccguuuccgccgcc

SEQ ID NO: 3066889 - RNA, 15 nt, Mycobacterium bovis subsp bovis AF2122/97
gccguuucggcgccg

SEQ ID NO: 3066890 - RNA, 17 nt, Mycobacterium bovis subsp bovis AF2122/97
gccuaacucgccugcac

SEQ ID NO: 3066891 - RNA, 22 nt, Mycobacterium bovis subsp bovis AF2122/97
gccuaacucgccugcacccggc

SEQ ID NO: 3066892 - RNA, 14 nt, Mycobacterium bovis subsp bovis AF2122/97
gccuaccagcaccg

SEQ ID NO: 3066893 - RNA, 16 nt, Mycobacterium bovis subsp bovis AF2122/97
gccuaccaggcgcggc

SEQ ID NO: 3066894 - RNA, 23 nt, Mycobacterium bovis subsp bovis AF2122/97
gccuacccuucgguaggcaggcc

SEQ ID NO: 3066895 - RNA, 19 nt, Mycobacterium bovis subsp bovis AF2122/97
gccuaccgugcuggcacca

SEQ ID NO: 3066896 - RNA, 23 nt, Mycobacterium bovis subsp bovis AF2122/97
gccuacugauagacccugggguc

SEQ ID NO: 3066897 - RNA, 20 nt, Mycobacterium bovis subsp bovis AF2122/97
gccuagccgcagccccgaca

SEQ ID NO: 3066898 - RNA, 16 nt, Mycobacterium bovis subsp bovis AF2122/97
gccuagccgcggcacc

SEQ ID NO: 3066899 - RNA, 19 nt, Mycobacterium bovis subsp bovis AF2122/97
gccuagccgcggcaccgcc

SEQ ID NO: 3066900 - RNA, 15 nt, Mycobacterium bovis subsp bovis AF2122/97
gccuagccgcuccgc

SEQ ID NO: 3066901 - RNA, 22 nt, Mycobacterium bovis subsp bovis AF2122/97
gccuagcgccacuugaugccgc

SEQ ID NO: 3066902 - RNA, 12 nt, Mycobacterium bovis subsp bovis AF2122/97
gccuagcgcggc

SEQ ID NO: 3066903 - RNA, 13 nt, Mycobacterium bovis subsp bovis AF2122/97
gccuagcgcggcg

SEQ ID NO: 3066904 - RNA, 17 nt, Mycobacterium bovis subsp bovis AF2122/97
gccuaggccgaggccgc

SEQ ID NO: 3066905 - RNA, 19 nt, Mycobacterium bovis subsp bovis AF2122/97
gccuagguagucggccucc

SEQ ID NO: 3066906 - RNA, 23 nt, Mycobacterium bovis subsp bovis AF2122/97
gccuaggucgacgccgaccaccc

SEQ ID NO: 3066907 - RNA, 18 nt, Mycobacterium bovis subsp bovis AF2122/97
gccuagguucgcccagcc

SEQ ID NO: 3066908 - RNA, 21 nt, Mycobacterium bovis subsp bovis AF2122/97
gccuaguccggcacugcggcc

SEQ ID NO: 3066909 - RNA, 23 nt, Mycobacterium bovis subsp bovis AF2122/97
gccuaguugcaacggguacaccc

SEQ ID NO: 3066910 - RNA, 21 nt, Mycobacterium bovis subsp bovis AF2122/97
gccuaucccgaaucucaccca

SEQ ID NO: 3066911 - RNA, 18 nt, Mycobacterium bovis subsp bovis AF2122/97
gccucgacagcggcaauc

SEQ ID NO: 3066912 - RNA, 21 nt, Mycobacterium bovis subsp bovis AF2122/97
gccucgaccaccugcugcacg

SEQ ID NO: 3066913 - RNA, 14 nt, Mycobacterium bovis subsp bovis AF2122/97
gccucgaccgccag

SEQ ID NO: 3066914 - RNA, 16 nt, Mycobacterium bovis subsp bovis AF2122/97
gccucgaccgccagcc

SEQ ID NO: 3066915 - RNA, 21 nt, Mycobacterium bovis subsp bovis AF2122/97
gccucgaccgccagcccggug

SEQ ID NO: 3066916 - RNA, 22 nt, Mycobacterium bovis subsp bovis AF2122/97
gccucgaccgccagcccgguga

SEQ ID NO: 3066917 - RNA, 22 nt, Mycobacterium bovis subsp bovis AF2122/97
gccucgaccgccagccgcgagc

SEQ ID NO: 3066918 - RNA, 12 nt, Mycobacterium bovis subsp bovis AF2122/97
gccucgaccgcg

SEQ ID NO: 3066919 - RNA, 15 nt, Mycobacterium bovis subsp bovis AF2122/97
gccucgagacggucg

SEQ ID NO: 3066920 - RNA, 16 nt, Mycobacterium bovis subsp bovis AF2122/97
gccucgaggaccacca

SEQ ID NO: 3066921 - RNA, 21 nt, Mycobacterium bovis subsp bovis AF2122/97
gccucgagguauucgcgcagc

SEQ ID NO: 3066922 - RNA, 22 nt, Mycobacterium bovis subsp bovis AF2122/97
gccucgagguauucgcgcagca

SEQ ID NO: 3066923 - RNA, 15 nt, Mycobacterium bovis subsp bovis AF2122/97
gccucgaucagcgcc

SEQ ID NO: 3066924 - RNA, 18 nt, Mycobacterium bovis subsp bovis AF2122/97
gccucgaucagcgccgga

SEQ ID NO: 3066925 - RNA, 22 nt, Mycobacterium bovis subsp bovis AF2122/97
gccucgauccgcaucaugucga

SEQ ID NO: 3066926 - RNA, 23 nt, Mycobacterium bovis subsp bovis AF2122/97
gccucgauccgcaucaugucgaa

SEQ ID NO: 3066927 - RNA, 22 nt, Mycobacterium bovis subsp bovis AF2122/97
gccucgaucgacucgaaccguu

SEQ ID NO: 3066928 - RNA, 18 nt, Mycobacterium bovis subsp bovis AF2122/97
gccucgauggcgguggcg

SEQ ID NO: 3066929 - RNA, 20 nt, Mycobacterium bovis subsp bovis AF2122/97
gccucgauguccgauaccgc

SEQ ID NO: 3066930 - RNA, 22 nt, Mycobacterium bovis subsp bovis AF2122/97
gccucgauuguggccagcgcuu

SEQ ID NO: 3066931 - RNA, 16 nt, Mycobacterium bovis subsp bovis AF2122/97
gccucgcagcgacacg

SEQ ID NO: 3066932 - RNA, 21 nt, Mycobacterium bovis subsp bovis AF2122/97
gccucgccauccaugauggcc

SEQ ID NO: 3066933 - RNA, 15 nt, Mycobacterium bovis subsp bovis AF2122/97
gccucgccggccacc

SEQ ID NO: 3066934 - RNA, 16 nt, Mycobacterium bovis subsp bovis AF2122/97
gccucgccggccaccc

SEQ ID NO: 3066935 - RNA, 18 nt, Mycobacterium bovis subsp bovis AF2122/97
gccucgccggcgcgcagc

SEQ ID NO: 3066936 - RNA, 22 nt, Mycobacterium bovis subsp bovis AF2122/97
gccucgcgacgaguugcgaacc

SEQ ID NO: 3066937 - RNA, 22 nt, Mycobacterium bovis subsp bovis AF2122/97
gccucgcggaugagcucggcca

SEQ ID NO: 3066938 - RNA, 21 nt, Mycobacterium bovis subsp bovis AF2122/97
gccucgcgggaagucccgagu

SEQ ID NO: 3066939 - RNA, 17 nt, Mycobacterium bovis subsp bovis AF2122/97
gccucgcgggcagggcc

SEQ ID NO: 3066940 - RNA, 18 nt, Mycobacterium bovis subsp bovis AF2122/97
gccucgcgggcagggccu

SEQ ID NO: 3066941 - RNA, 21 nt, Mycobacterium bovis subsp bovis AF2122/97
gccucgcuaacuccccagaca

SEQ ID NO: 3066942 - RNA, 13 nt, Mycobacterium bovis subsp bovis AF2122/97
gccucgcucucca

SEQ ID NO: 3066943 - RNA, 20 nt, Mycobacterium bovis subsp bovis AF2122/97
gccucggacaaagccgucgc

SEQ ID NO: 3066944 - RNA, 21 nt, Mycobacterium bovis subsp bovis AF2122/97
gccucggacaaagccgucgcg

SEQ ID NO: 3066945 - RNA, 21 nt, Mycobacterium bovis subsp bovis AF2122/97
gccucggaccagacccacgau

SEQ ID NO: 3066946 - RNA, 21 nt, Mycobacterium bovis subsp bovis AF2122/97
gccucggagaucgagaucacc

SEQ ID NO: 3066947 - RNA, 12 nt, Mycobacterium bovis subsp bovis AF2122/97
gccucggcgacc

SEQ ID NO: 3066948 - RNA, 18 nt, Mycobacterium bovis subsp bovis AF2122/97
gccucggcgaccaucuga

SEQ ID NO: 3066949 - RNA, 15 nt, Mycobacterium bovis subsp bovis AF2122/97
gccucggcgauaccg

SEQ ID NO: 3066950 - RNA, 12 nt, Mycobacterium bovis subsp bovis AF2122/97
gccucggcgaug

SEQ ID NO: 3066951 - RNA, 15 nt, Mycobacterium bovis subsp bovis AF2122/97
gccucggcgaugggc

SEQ ID NO: 3066952 - RNA, 15 nt, Mycobacterium bovis subsp bovis AF2122/97
gccucggcgccgccc

SEQ ID NO: 3066953 - RNA, 18 nt, Mycobacterium bovis subsp bovis AF2122/97
gccucggcgccgcccagc

SEQ ID NO: 3066954 - RNA, 15 nt, Mycobacterium bovis subsp bovis AF2122/97
gccucggcgcugcgc

SEQ ID NO: 3066955 - RNA, 23 nt, Mycobacterium bovis subsp bovis AF2122/97
gccucggcgcugcgcaccgccgc

SEQ ID NO: 3066956 - RNA, 15 nt, Mycobacterium bovis subsp bovis AF2122/97
gccucggcggccagc

SEQ ID NO: 3066957 - RNA, 20 nt, Mycobacterium bovis subsp bovis AF2122/97
gccucggcggccagcucggc

SEQ ID NO: 3066958 - RNA, 14 nt, Mycobacterium bovis subsp bovis AF2122/97
gccucggcggccuc

SEQ ID NO: 3066959 - RNA, 16 nt, Mycobacterium bovis subsp bovis AF2122/97
gccucggcggccucgc

SEQ ID NO: 3066960 - RNA, 18 nt, Mycobacterium bovis subsp bovis AF2122/97
gccucggcggccucgcug

SEQ ID NO: 3066961 - RNA, 13 nt, Mycobacterium bovis subsp bovis AF2122/97
gccucggcggcgc

SEQ ID NO: 3066962 - RNA, 17 nt, Mycobacterium bovis subsp bovis AF2122/97
gccucggcggcgccgaa

SEQ ID NO: 3066963 - RNA, 13 nt, Mycobacterium bovis subsp bovis AF2122/97
gccucggcggcgu

SEQ ID NO: 3066964 - RNA, 14 nt, Mycobacterium bovis subsp bovis AF2122/97
gccucggcggucgc

SEQ ID NO: 3066965 - RNA, 15 nt, Mycobacterium bovis subsp bovis AF2122/97
gccucggcguaggcg

SEQ ID NO: 3066966 - RNA, 23 nt, Mycobacterium bovis subsp bovis AF2122/97
gccucggcguaggcgauggcggc

SEQ ID NO: 3066967 - RNA, 15 nt, Mycobacterium bovis subsp bovis AF2122/97
gccucgggaggcagc

SEQ ID NO: 3066968 - RNA, 22 nt, Mycobacterium bovis subsp bovis AF2122/97
gccucgggaggcagcgcgaggc

SEQ ID NO: 3066969 - RNA, 14 nt, Mycobacterium bovis subsp bovis AF2122/97
gccucgggcaccug

SEQ ID NO: 3066970 - RNA, 14 nt, Mycobacterium bovis subsp bovis AF2122/97
gccucgggccggcg

SEQ ID NO: 3066971 - RNA, 15 nt, Mycobacterium bovis subsp bovis AF2122/97
gccucgggccggcgu

SEQ ID NO: 3066972 - RNA, 18 nt, Mycobacterium bovis subsp bovis AF2122/97
gccucgggcucaaacgga

SEQ ID NO: 3066973 - RNA, 19 nt, Mycobacterium bovis subsp bovis AF2122/97
gccucgguggucuuggccc

SEQ ID NO: 3066974 - RNA, 21 nt, Mycobacterium bovis subsp bovis AF2122/97
gccucgguggucuuggcccgg

SEQ ID NO: 3066975 - RNA, 14 nt, Mycobacterium bovis subsp bovis AF2122/97
gccucguacggacc

SEQ ID NO: 3066976 - RNA, 20 nt, Mycobacterium bovis subsp bovis AF2122/97
gccucguacggaccgucgcc

SEQ ID NO: 3066977 - RNA, 17 nt, Mycobacterium bovis subsp bovis AF2122/97
gccucguagucccacug

SEQ ID NO: 3066978 - RNA, 15 nt, Mycobacterium bovis subsp bovis AF2122/97
gccucgucccacaac

SEQ ID NO: 3066979 - RNA, 17 nt, Mycobacterium bovis subsp bovis AF2122/97
gccucgucgauguucgc

SEQ ID NO: 3066980 - RNA, 13 nt, Mycobacterium bovis subsp bovis AF2122/97
gccucgucgccgc

SEQ ID NO: 3066981 - RNA, 16 nt, Mycobacterium bovis subsp bovis AF2122/97
gccucgucgccgcggu

SEQ ID NO: 3066982 - RNA, 15 nt, Mycobacterium bovis subsp bovis AF2122/97
gccucgugcgugggc

SEQ ID NO: 3066983 - RNA, 23 nt, Mycobacterium bovis subsp bovis AF2122/97
gccucguuagaguaggccaccac

SEQ ID NO: 3066984 - RNA, 18 nt, Mycobacterium bovis subsp bovis AF2122/97
gccucguugaccagaacc

SEQ ID NO: 3066985 - RNA, 22 nt, Mycobacterium bovis subsp bovis AF2122/97
gccucguugaccgggucgccga

SEQ ID NO: 3066986 - RNA, 21 nt, Mycobacterium bovis subsp bovis AF2122/97
gccucuagcuugacaacccug

SEQ ID NO: 3066987 - RNA, 18 nt, Mycobacterium bovis subsp bovis AF2122/97
gccucucgaccucagaca

SEQ ID NO: 3066988 - RNA, 21 nt, Mycobacterium bovis subsp bovis AF2122/97
gccucucgggggccgagccga

SEQ ID NO: 3066989 - RNA, 15 nt, Mycobacterium bovis subsp bovis AF2122/97
gccucucgguccaca

SEQ ID NO: 3066990 - RNA, 21 nt, Mycobacterium bovis subsp bovis AF2122/97
gccucucuccgcgcucgucua

SEQ ID NO: 3066991 - RNA, 15 nt, Mycobacterium bovis subsp bovis AF2122/97
gccucucuucccaac

SEQ ID NO: 3066992 - RNA, 14 nt, Mycobacterium bovis subsp bovis AF2122/97
gccucugaccagcc

SEQ ID NO: 3066993 - RNA, 11 nt, Mycobacterium bovis subsp bovis AF2122/97
gccucugcauc

SEQ ID NO: 3066994 - RNA, 12 nt, Mycobacterium bovis subsp bovis AF2122/97
gccucugucuuc

SEQ ID NO: 3066995 - RNA, 16 nt, Mycobacterium bovis subsp bovis AF2122/97
gccugaaacgauugcu

SEQ ID NO: 3066996 - RNA, 21 nt, Mycobacterium bovis subsp bovis AF2122/97
gccugaaacgauugcugcggc

SEQ ID NO: 3066997 - RNA, 13 nt, Mycobacterium bovis subsp bovis AF2122/97
gccugcgcacgac

SEQ ID NO: 3066998 - RNA, 13 nt, Mycobacterium bovis subsp bovis AF2122/97
gccugcgcagacu

SEQ ID NO: 3066999 - RNA, 15 nt, Mycobacterium bovis subsp bovis AF2122/97
gccugcgccacccgc

SEQ ID NO: 3067000 - RNA, 19 nt, Mycobacterium bovis subsp bovis AF2122/97
gccugcgccacccgcggug

SEQ ID NO: 3067001 - RNA, 16 nt, Mycobacterium bovis subsp bovis AF2122/97
gccugcgccgacccgc

SEQ ID NO: 3067002 - RNA, 17 nt, Mycobacterium bovis subsp bovis AF2122/97
gccugcgccgacccgcg

SEQ ID NO: 3067003 - RNA, 13 nt, Mycobacterium bovis subsp bovis AF2122/97
gccugcgccgagu

SEQ ID NO: 3067004 - RNA, 19 nt, Mycobacterium bovis subsp bovis AF2122/97
gccugcgccgccagcgccg

SEQ ID NO: 3067005 - RNA, 16 nt, Mycobacterium bovis subsp bovis AF2122/97
gccugcgccgcccgcg

SEQ ID NO: 3067006 - RNA, 13 nt, Mycobacterium bovis subsp bovis AF2122/97
gccugcgccgcgc

SEQ ID NO: 3067007 - RNA, 12 nt, Mycobacterium bovis subsp bovis AF2122/97
gccugcgccggc

SEQ ID NO: 3067008 - RNA, 17 nt, Mycobacterium bovis subsp bovis AF2122/97
gccugcgccuuggucgc

SEQ ID NO: 3067009 - RNA, 21 nt, Mycobacterium bovis subsp bovis AF2122/97
gccugcgccuuggucgccggc

SEQ ID NO: 3067010 - RNA, 22 nt, Mycobacterium bovis subsp bovis AF2122/97
gccugcgccuuggucgccggcg

SEQ ID NO: 3067011 - RNA, 14 nt, Mycobacterium bovis subsp bovis AF2122/97
gccugcgcgauccg

SEQ ID NO: 3067012 - RNA, 15 nt, Mycobacterium bovis subsp bovis AF2122/97
gccugcgcgauccgc

SEQ ID NO: 3067013 - RNA, 20 nt, Mycobacterium bovis subsp bovis AF2122/97
gccugcgcgauccgcgcgca

SEQ ID NO: 3067014 - RNA, 15 nt, Mycobacterium bovis subsp bovis AF2122/97
gccugcgcgaugcga

SEQ ID NO: 3067015 - RNA, 21 nt, Mycobacterium bovis subsp bovis AF2122/97
gccugcgcgaugcgauucugc

SEQ ID NO: 3067016 - RNA, 16 nt, Mycobacterium bovis subsp bovis AF2122/97
gccugcggcaacggcu

SEQ ID NO: 3067017 - RNA, 21 nt, Mycobacterium bovis subsp bovis AF2122/97
gccugcggcaacggcucgucg

SEQ ID NO: 3067018 - RNA, 13 nt, Mycobacterium bovis subsp bovis AF2122/97
gccugcggcaccg

SEQ ID NO: 3067019 - RNA, 13 nt, Mycobacterium bovis subsp bovis AF2122/97
gccugcggcagca

SEQ ID NO: 3067020 - RNA, 14 nt, Mycobacterium bovis subsp bovis AF2122/97
gccugcggcggcgu

SEQ ID NO: 3067021 - RNA, 12 nt, Mycobacterium bovis subsp bovis AF2122/97
gccugcggcggu

SEQ ID NO: 3067022 - RNA, 14 nt, Mycobacterium bovis subsp bovis AF2122/97
gccugcggcgguca

SEQ ID NO: 3067023 - RNA, 18 nt, Mycobacterium bovis subsp bovis AF2122/97
gccugcgggaacgcggcg

SEQ ID NO: 3067024 - RNA, 21 nt, Mycobacterium bovis subsp bovis AF2122/97
gccugcgggaacgcggcggcg

SEQ ID NO: 3067025 - RNA, 15 nt, Mycobacterium bovis subsp bovis AF2122/97
gccugcggucagggc

SEQ ID NO: 3067026 - RNA, 18 nt, Mycobacterium bovis subsp bovis AF2122/97
gccugcggucagggcuua

SEQ ID NO: 3067027 - RNA, 15 nt, Mycobacterium bovis subsp bovis AF2122/97
gccugcgucucgaug

SEQ ID NO: 3067028 - RNA, 17 nt, Mycobacterium bovis subsp bovis AF2122/97
gccugcgucucgaugag

SEQ ID NO: 3067029 - RNA, 15 nt, Mycobacterium bovis subsp bovis AF2122/97
gccugcucaaccagc

SEQ ID NO: 3067030 - RNA, 17 nt, Mycobacterium bovis subsp bovis AF2122/97
gccugcuccaccgucga

SEQ ID NO: 3067031 - RNA, 15 nt, Mycobacterium bovis subsp bovis AF2122/97
gccugcuccucggcc

SEQ ID NO: 3067032 - RNA, 17 nt, Mycobacterium bovis subsp bovis AF2122/97
gccugcuccucggccag

SEQ ID NO: 3067033 - RNA, 18 nt, Mycobacterium bovis subsp bovis AF2122/97
gccugcuccucggccagc

SEQ ID NO: 3067034 - RNA, 19 nt, Mycobacterium bovis subsp bovis AF2122/97
gccugcuccucggccagcg

SEQ ID NO: 3067035 - RNA, 21 nt, Mycobacterium bovis subsp bovis AF2122/97
gccugcuccucggccagcgug

SEQ ID NO: 3067036 - RNA, 13 nt, Mycobacterium bovis subsp bovis AF2122/97
gccugcuccugcg

SEQ ID NO: 3067037 - RNA, 20 nt, Mycobacterium bovis subsp bovis AF2122/97
gccugcuccugcguccagau

SEQ ID NO: 3067038 - RNA, 19 nt, Mycobacterium bovis subsp bovis AF2122/97
gccugcucggcgaccgucg

SEQ ID NO: 3067039 - RNA, 22 nt, Mycobacterium bovis subsp bovis AF2122/97
gccugcugcacaucgcauccac

SEQ ID NO: 3067040 - RNA, 20 nt, Mycobacterium bovis subsp bovis AF2122/97
gccugcugcugcagcgaugc

SEQ ID NO: 3067041 - RNA, 16 nt, Mycobacterium bovis subsp bovis AF2122/97
gccugcuggccgcggc

SEQ ID NO: 3067042 - RNA, 17 nt, Mycobacterium bovis subsp bovis AF2122/97
gccugcuggccgcggcc

SEQ ID NO: 3067043 - RNA, 19 nt, Mycobacterium bovis subsp bovis AF2122/97
gccugcugguaccgggcuc

SEQ ID NO: 3067044 - RNA, 14 nt, Mycobacterium bovis subsp bovis AF2122/97
gccugcuuggccac

SEQ ID NO: 3067045 - RNA, 22 nt, Mycobacterium bovis subsp bovis AF2122/97
gccugcuuggccacuugcucgg

SEQ ID NO: 3067046 - RNA, 16 nt, Mycobacterium bovis subsp bovis AF2122/97
gccugcuugucaaccc

SEQ ID NO: 3067047 - RNA, 17 nt, Mycobacterium bovis subsp bovis AF2122/97
gccuggaagacggugcg

SEQ ID NO: 3067048 - RNA, 21 nt, Mycobacterium bovis subsp bovis AF2122/97
gccuggaagaucacgcgucgu

SEQ ID NO: 3067049 - RNA, 22 nt, Mycobacterium bovis subsp bovis AF2122/97
gccuggaagaucacgcgucgug

SEQ ID NO: 3067050 - RNA, 23 nt, Mycobacterium bovis subsp bovis AF2122/97
gccuggaaggaaccgaucggucg

SEQ ID NO: 3067051 - RNA, 16 nt, Mycobacterium bovis subsp bovis AF2122/97
gccuggaaucgcggag

SEQ ID NO: 3067052 - RNA, 22 nt, Mycobacterium bovis subsp bovis AF2122/97
gccuggaaucgcggagccagga

SEQ ID NO: 3067053 - RNA, 17 nt, Mycobacterium bovis subsp bovis AF2122/97
gccuggacgccgccgga

SEQ ID NO: 3067054 - RNA, 22 nt, Mycobacterium bovis subsp bovis AF2122/97
gccuggaucagcgcguugagcu

SEQ ID NO: 3067055 - RNA, 14 nt, Mycobacterium bovis subsp bovis AF2122/97
gccuggauggguug

SEQ ID NO: 3067056 - RNA, 14 nt, Mycobacterium bovis subsp bovis AF2122/97
gccuggcagggugg

SEQ ID NO: 3067057 - RNA, 16 nt, Mycobacterium bovis subsp bovis AF2122/97
gccuggcagggugggg

SEQ ID NO: 3067058 - RNA, 23 nt, Mycobacterium bovis subsp bovis AF2122/97
gccuggcaggguggggcgguggc

SEQ ID NO: 3067059 - RNA, 15 nt, Mycobacterium bovis subsp bovis AF2122/97
gccuggccacacuca

SEQ ID NO: 3067060 - RNA, 14 nt, Mycobacterium bovis subsp bovis AF2122/97
gccuggccaccugg

SEQ ID NO: 3067061 - RNA, 15 nt, Mycobacterium bovis subsp bovis AF2122/97
gccuggccaccuggu

SEQ ID NO: 3067062 - RNA, 16 nt, Mycobacterium bovis subsp bovis AF2122/97
gccuggcccacgccgc

SEQ ID NO: 3067063 - RNA, 18 nt, Mycobacterium bovis subsp bovis AF2122/97
gccuggccccggcugucg

SEQ ID NO: 3067064 - RNA, 14 nt, Mycobacterium bovis subsp bovis AF2122/97
gccuggcccgucgg

SEQ ID NO: 3067065 - RNA, 17 nt, Mycobacterium bovis subsp bovis AF2122/97
gccuggcccgucggcgu

SEQ ID NO: 3067066 - RNA, 22 nt, Mycobacterium bovis subsp bovis AF2122/97
gccuggccgccagauuggcgcu

SEQ ID NO: 3067067 - RNA, 15 nt, Mycobacterium bovis subsp bovis AF2122/97
gccuggccgggaccg

SEQ ID NO: 3067068 - RNA, 18 nt, Mycobacterium bovis subsp bovis AF2122/97
gccuggccgggaccgccc

SEQ ID NO: 3067069 - RNA, 19 nt, Mycobacterium bovis subsp bovis AF2122/97
gccuggccggugcgcaggu

SEQ ID NO: 3067070 - RNA, 15 nt, Mycobacterium bovis subsp bovis AF2122/97
gccuggccugcccag

SEQ ID NO: 3067071 - RNA, 15 nt, Mycobacterium bovis subsp bovis AF2122/97
gccuggcgagccagc

SEQ ID NO: 3067072 - RNA, 15 nt, Mycobacterium bovis subsp bovis AF2122/97
gccuggcggcgccgc

SEQ ID NO: 3067073 - RNA, 16 nt, Mycobacterium bovis subsp bovis AF2122/97
gccuggcggcgccgca

SEQ ID NO: 3067074 - RNA, 18 nt, Mycobacterium bovis subsp bovis AF2122/97
gccuggcggcgccgcaga

SEQ ID NO: 3067075 - RNA, 20 nt, Mycobacterium bovis subsp bovis AF2122/97
gccuggcuacgcgcgcccga

SEQ ID NO: 3067076 - RNA, 15 nt, Mycobacterium bovis subsp bovis AF2122/97
gccuggcuggccagc

SEQ ID NO: 3067077 - RNA, 16 nt, Mycobacterium bovis subsp bovis AF2122/97
gccugggaaacugggu

SEQ ID NO: 3067078 - RNA, 14 nt, Mycobacterium bovis subsp bovis AF2122/97
gccugggacggcgg

SEQ ID NO: 3067079 - RNA, 19 nt, Mycobacterium bovis subsp bovis AF2122/97
gccugggcacggccgucga

SEQ ID NO: 3067080 - RNA, 21 nt, Mycobacterium bovis subsp bovis AF2122/97
gccugggccagccgcucaccc

SEQ ID NO: 3067081 - RNA, 13 nt, Mycobacterium bovis subsp bovis AF2122/97
gccugggcgacga

SEQ ID NO: 3067082 - RNA, 16 nt, Mycobacterium bovis subsp bovis AF2122/97
gccugggcggccagca

SEQ ID NO: 3067083 - RNA, 22 nt, Mycobacterium bovis subsp bovis AF2122/97
gccugggcggccagcacgucgu

SEQ ID NO: 3067084 - RNA, 15 nt, Mycobacterium bovis subsp bovis AF2122/97
gccuugcgcacaggc

SEQ ID NO: 3067085 - RNA, 17 nt, Mycobacterium bovis subsp bovis AF2122/97
gccuugcgcacaggcgc

SEQ ID NO: 3067086 - RNA, 19 nt, Mycobacterium bovis subsp bovis AF2122/97
gccuugcgcacaggcgcga

SEQ ID NO: 3067087 - RNA, 22 nt, Mycobacterium bovis subsp bovis AF2122/97
gccuugcgcacaggcgcgaucg

SEQ ID NO: 3067088 - RNA, 23 nt, Mycobacterium bovis subsp bovis AF2122/97
gccuugcgcacaggcgcgaucgc

SEQ ID NO: 3067089 - RNA, 17 nt, Mycobacterium bovis subsp bovis AF2122/97
gccuugcgggccuggug

SEQ ID NO: 3067090 - RNA, 17 nt, Mycobacterium bovis subsp bovis AF2122/97
gccuugcgggcucucgg

SEQ ID NO: 3067091 - RNA, 18 nt, Mycobacterium bovis subsp bovis AF2122/97
gccuugcgggcucucggc

SEQ ID NO: 3067092 - RNA, 17 nt, Mycobacterium bovis subsp bovis AF2122/97
gccuugcgucaucggcu

SEQ ID NO: 3067093 - RNA, 20 nt, Mycobacterium bovis subsp bovis AF2122/97
gccuuggcacccuccgccgg

SEQ ID NO: 3067094 - RNA, 14 nt, Mycobacterium bovis subsp bovis AF2122/97
gccuuggcagccca

SEQ ID NO: 3067095 - RNA, 16 nt, Mycobacterium bovis subsp bovis AF2122/97
gccuuggcagcccagu

SEQ ID NO: 3067096 - RNA, 20 nt, Mycobacterium bovis subsp bovis AF2122/97
gccuuggcagcccaguacgg

SEQ ID NO: 3067097 - RNA, 17 nt, Mycobacterium bovis subsp bovis AF2122/97
gccuuggcaguccagcc

SEQ ID NO: 3067098 - RNA, 19 nt, Mycobacterium bovis subsp bovis AF2122/97
gccuuggcaguccagccgg

SEQ ID NO: 3067099 - RNA, 21 nt, Mycobacterium bovis subsp bovis AF2122/97
gccuuggccaccaucgccgcc

SEQ ID NO: 3067100 - RNA, 14 nt, Mycobacterium bovis subsp bovis AF2122/97
gccuuggcccccgg

SEQ ID NO: 3067101 - RNA, 13 nt, Mycobacterium bovis subsp bovis AF2122/97
gccuuggccggcu

SEQ ID NO: 3067102 - RNA, 14 nt, Mycobacterium bovis subsp bovis AF2122/97
gccuuggcgcggca

SEQ ID NO: 3067103 - RNA, 17 nt, Mycobacterium bovis subsp bovis AF2122/97
gccuuggcgcggcaccc

SEQ ID NO: 3067104 - RNA, 13 nt, Mycobacterium bovis subsp bovis AF2122/97
gccuuggcggcca

SEQ ID NO: 3067105 - RNA, 15 nt, Mycobacterium bovis subsp bovis AF2122/97
gccuuggcggcggca

SEQ ID NO: 3067106 - RNA, 16 nt, Mycobacterium bovis subsp bovis AF2122/97
gccuugggaccgcgcc

SEQ ID NO: 3067107 - RNA, 13 nt, Mycobacterium bovis subsp bovis AF2122/97
gccuugggcggca

SEQ ID NO: 3067108 - RNA, 22 nt, Mycobacterium bovis subsp bovis AF2122/97
gccuugggcguacucggcgcgc

SEQ ID NO: 3067109 - RNA, 23 nt, Mycobacterium bovis subsp bovis AF2122/97
gccuugggcguacucggcgcgca

SEQ ID NO: 3067110 - RNA, 22 nt, Mycobacterium bovis subsp bovis AF2122/97
gccuuggguaggcaauggcgug

SEQ ID NO: 3067111 - RNA, 18 nt, Mycobacterium bovis subsp bovis AF2122/97
gccuuggucaccuucuug

SEQ ID NO: 3067112 - RNA, 14 nt, Mycobacterium bovis subsp bovis AF2122/97
gccuuggucgccgc

SEQ ID NO: 3067113 - RNA, 15 nt, Mycobacterium bovis subsp bovis AF2122/97
gccuuggucgccgcc

SEQ ID NO: 3067114 - RNA, 21 nt, Mycobacterium bovis subsp bovis AF2122/97
gccuuggucgccgcuuucuug

SEQ ID NO: 3067115 - RNA, 12 nt, Mycobacterium bovis subsp bovis AF2122/97
gccuugucuagu

SEQ ID NO: 3067116 - RNA, 13 nt, Mycobacterium bovis subsp bovis AF2122/97
gccuugugcucga

SEQ ID NO: 3067117 - RNA, 17 nt, Mycobacterium bovis subsp bovis AF2122/97
gccuugugcucgaugcg

SEQ ID NO: 3067118 - RNA, 20 nt, Mycobacterium bovis subsp bovis AF2122/97
gccuuguggcacacccgcac

SEQ ID NO: 3067119 - RNA, 15 nt, Mycobacterium bovis subsp bovis AF2122/97
gccuuguugccgccg

SEQ ID NO: 3067120 - RNA, 16 nt, Mycobacterium bovis subsp bovis AF2122/97
gccuuguugccgccgg

SEQ ID NO: 3067121 - RNA, 17 nt, Mycobacterium bovis subsp bovis AF2122/97
gccuuguugccgccggc

SEQ ID NO: 3067122 - RNA, 19 nt, Mycobacterium bovis subsp bovis AF2122/97
gccuuguuggcgaagucgu

SEQ ID NO: 3067123 - RNA, 22 nt, Mycobacterium bovis subsp bovis AF2122/97
gccuuguuguccuucagccagu

SEQ ID NO: 3067124 - RNA, 16 nt, Mycobacterium bovis subsp bovis AF2122/97
gccuuuauuaauacug

SEQ ID NO: 3067125 - RNA, 23 nt, Mycobacterium bovis subsp bovis AF2122/97
gccuuuccagcaccccgaucugg

SEQ ID NO: 3067126 - RNA, 20 nt, Mycobacterium bovis subsp bovis AF2122/97
gccuuucgugcaccgcgacc

SEQ ID NO: 3067127 - RNA, 14 nt, Mycobacterium bovis subsp bovis AF2122/97
gccuuugagcgcgg

SEQ ID NO: 3067128 - RNA, 17 nt, Mycobacterium bovis subsp bovis AF2122/97
gccuuugagggcgacga

SEQ ID NO: 3067129 - RNA, 17 nt, Mycobacterium bovis subsp bovis AF2122/97
gccuuugcccgccgcgu

SEQ ID NO: 3067130 - RNA, 16 nt, Mycobacterium bovis subsp bovis AF2122/97
gccuuugccgccggca

SEQ ID NO: 3067131 - RNA, 14 nt, Mycobacterium bovis subsp bovis AF2122/97
gccuuugcggcggg

SEQ ID NO: 3067132 - RNA, 21 nt, Mycobacterium bovis subsp bovis AF2122/97
gccuuugguaguaggccuggc

SEQ ID NO: 3067133 - RNA, 16 nt, Mycobacterium bovis subsp bovis AF2122/97
gccuuuggucgcggcu

SEQ ID NO: 3067134 - RNA, 16 nt, Mycobacterium bovis subsp bovis AF2122/97
gccuuugucgccuucu

SEQ ID NO: 3067135 - RNA, 18 nt, Mycobacterium bovis subsp bovis AF2122/97
gccuuugucgccuucuug

SEQ ID NO: 3067136 - RNA, 22 nt, Mycobacterium bovis subsp bovis AF2122/97
gcgaaaaagguaccgcgugcgc

SEQ ID NO: 3067137 - RNA, 14 nt, Mycobacterium bovis subsp bovis AF2122/97
gcgaaaaucccgcu

SEQ ID NO: 3067138 - RNA, 19 nt, Mycobacterium bovis subsp bovis AF2122/97
gcgaaaaucgcgcgcgaaa

SEQ ID NO: 3067139 - RNA, 21 nt, Mycobacterium bovis subsp bovis AF2122/97
gcgaaaauucggucucgaccg

SEQ ID NO: 3067140 - RNA, 17 nt, Mycobacterium bovis subsp bovis AF2122/97
gcgaaaauucgucgcgu

SEQ ID NO: 3067141 - RNA, 18 nt, Mycobacterium bovis subsp bovis AF2122/97
gcgaaaauugcuccacca

SEQ ID NO: 3067142 - RNA, 19 nt, Mycobacterium bovis subsp bovis AF2122/97
gcgaaaauugcuccaccac

SEQ ID NO: 3067143 - RNA, 19 nt, Mycobacterium bovis subsp bovis AF2122/97
gcgaaacaccagacacugg

SEQ ID NO: 3067144 - RNA, 16 nt, Mycobacterium bovis subsp bovis AF2122/97
gcgaaacaccggccag

SEQ ID NO: 3067145 - RNA, 20 nt, Mycobacterium bovis subsp bovis AF2122/97
gcgaaacagcacgcccgaag

SEQ ID NO: 3067146 - RNA, 19 nt, Mycobacterium bovis subsp bovis AF2122/97
gcgaaacaucucggcgcag

SEQ ID NO: 3067147 - RNA, 23 nt, Mycobacterium bovis subsp bovis AF2122/97
gcgaaacaucucggcgcagccgg

SEQ ID NO: 3067148 - RNA, 12 nt, Mycobacterium bovis subsp bovis AF2122/97
gcgaaacgccac

SEQ ID NO: 3067149 - RNA, 19 nt, Mycobacterium bovis subsp bovis AF2122/97
gcgaaacgcccgggcggcg

SEQ ID NO: 3067150 - RNA, 20 nt, Mycobacterium bovis subsp bovis AF2122/97
gcgaaacgcccgggcggcgu

SEQ ID NO: 3067151 - RNA, 23 nt, Mycobacterium bovis subsp bovis AF2122/97
gcgaaacgccgcaauggaccgaa

SEQ ID NO: 3067152 - RNA, 19 nt, Mycobacterium bovis subsp bovis AF2122/97
gcgaaagcuugggcgaucg

SEQ ID NO: 3067153 - RNA, 19 nt, Mycobacterium bovis subsp bovis AF2122/97
gcgaaaguccugcagugcg

SEQ ID NO: 3067154 - RNA, 22 nt, Mycobacterium bovis subsp bovis AF2122/97
gcgaaagugauccagucgaugu

SEQ ID NO: 3067155 - RNA, 15 nt, Mycobacterium bovis subsp bovis AF2122/97
gcgaaauaacggagc

SEQ ID NO: 3067156 - RNA, 20 nt, Mycobacterium bovis subsp bovis AF2122/97
gcgaaauaacggagcggccu

SEQ ID NO: 3067157 - RNA, 16 nt, Mycobacterium bovis subsp bovis AF2122/97
gcgaaauagcgagcgu

SEQ ID NO: 3067158 - RNA, 23 nt, Mycobacterium bovis subsp bovis AF2122/97
gcgaaaucaguucccgaaccccg

SEQ ID NO: 3067159 - RNA, 16 nt, Mycobacterium bovis subsp bovis AF2122/97
gcgaaaucgacagcag

SEQ ID NO: 3067160 - RNA, 18 nt, Mycobacterium bovis subsp bovis AF2122/97
gcgaaaucgacagcagcg

SEQ ID NO: 3067161 - RNA, 21 nt, Mycobacterium bovis subsp bovis AF2122/97
gcgaaaucgacagcagcgcga

SEQ ID NO: 3067162 - RNA, 18 nt, Mycobacterium bovis subsp bovis AF2122/97
gcgaaaugccugcgcgau

SEQ ID NO: 3067163 - RNA, 20 nt, Mycobacterium bovis subsp bovis AF2122/97
gcgaaauuacuucggccaca

SEQ ID NO: 3067164 - RNA, 15 nt, Mycobacterium bovis subsp bovis AF2122/97
gcgaaauuccgggcc

SEQ ID NO: 3067165 - RNA, 13 nt, Mycobacterium bovis subsp bovis AF2122/97
gcgaacaaccacg

SEQ ID NO: 3067166 - RNA, 21 nt, Mycobacterium bovis subsp bovis AF2122/97
gcgaacaaccugccgguguac

SEQ ID NO: 3067167 - RNA, 18 nt, Mycobacterium bovis subsp bovis AF2122/97
gcgaacaaguggccagcg

SEQ ID NO: 3067168 - RNA, 23 nt, Mycobacterium bovis subsp bovis AF2122/97
gcgaacaaguggccagcgccaac

SEQ ID NO: 3067169 - RNA, 14 nt, Mycobacterium bovis subsp bovis AF2122/97
gcgaacaccagaug

SEQ ID NO: 3067170 - RNA, 19 nt, Mycobacterium bovis subsp bovis AF2122/97
gcgaagcgucuggucagcc

SEQ ID NO: 3067171 - RNA, 16 nt, Mycobacterium bovis subsp bovis AF2122/97
gcgaagcuagagccag

SEQ ID NO: 3067172 - RNA, 21 nt, Mycobacterium bovis subsp bovis AF2122/97
gcgaagcuguagaccuggccg

SEQ ID NO: 3067173 - RNA, 19 nt, Mycobacterium bovis subsp bovis AF2122/97
gcgaagcugugcccggcgc

SEQ ID NO: 3067174 - RNA, 19 nt, Mycobacterium bovis subsp bovis AF2122/97
gcgaaggauuugauaggcg

SEQ ID NO: 3067175 - RNA, 15 nt, Mycobacterium bovis subsp bovis AF2122/97
gcgaaggcgccgaac

SEQ ID NO: 3067176 - RNA, 13 nt, Mycobacterium bovis subsp bovis AF2122/97
gcgaagggcaccg

SEQ ID NO: 3067177 - RNA, 20 nt, Mycobacterium bovis subsp bovis AF2122/97
gcgaaggggugcccggcggc

SEQ ID NO: 3067178 - RNA, 17 nt, Mycobacterium bovis subsp bovis AF2122/97
gcgaagguccgugccga

SEQ ID NO: 3067179 - RNA, 16 nt, Mycobacterium bovis subsp bovis AF2122/97
gcgaagguguccucca

SEQ ID NO: 3067180 - RNA, 21 nt, Mycobacterium bovis subsp bovis AF2122/97
gcgaagucacgcacccggcgc

SEQ ID NO: 3067181 - RNA, 17 nt, Mycobacterium bovis subsp bovis AF2122/97
gcgaagucgagugccgc

SEQ ID NO: 3067182 - RNA, 18 nt, Mycobacterium bovis subsp bovis AF2122/97
gcgaagucgagugccgcg

SEQ ID NO: 3067183 - RNA, 13 nt, Mycobacterium bovis subsp bovis AF2122/97
gcgaagucgcaug

SEQ ID NO: 3067184 - RNA, 15 nt, Mycobacterium bovis subsp bovis AF2122/97
gcgaagucgcauggc

SEQ ID NO: 3067185 - RNA, 15 nt, Mycobacterium bovis subsp bovis AF2122/97
gcgaagucuugaccg

SEQ ID NO: 3067186 - RNA, 19 nt, Mycobacterium bovis subsp bovis AF2122/97
gcgaagucuugaccgcacc

SEQ ID NO: 3067187 - RNA, 18 nt, Mycobacterium bovis subsp bovis AF2122/97
gcgaaguggaucuggcgc

SEQ ID NO: 3067188 - RNA, 23 nt, Mycobacterium bovis subsp bovis AF2122/97
gcgaagugucgcugcaaccgccg

SEQ ID NO: 3067189 - RNA, 15 nt, Mycobacterium bovis subsp bovis AF2122/97
gcgaaguugcgcgac

SEQ ID NO: 3067190 - RNA, 22 nt, Mycobacterium bovis subsp bovis AF2122/97
gcgaauaccagaccggccgacg

SEQ ID NO: 3067191 - RNA, 14 nt, Mycobacterium bovis subsp bovis AF2122/97
gcgaauagccacca

SEQ ID NO: 3067192 - RNA, 17 nt, Mycobacterium bovis subsp bovis AF2122/97
gcgaauauagcggcguu

SEQ ID NO: 3067193 - RNA, 19 nt, Mycobacterium bovis subsp bovis AF2122/97
gcgaaucaacaggaccggg

SEQ ID NO: 3067194 - RNA, 12 nt, Mycobacterium bovis subsp bovis AF2122/97
gcgaaucacccg

SEQ ID NO: 3067195 - RNA, 21 nt, Mycobacterium bovis subsp bovis AF2122/97
gcgaaucacccgcgagaucgg

SEQ ID NO: 3067196 - RNA, 22 nt, Mycobacterium bovis subsp bovis AF2122/97
gcgaauccagccgcgcgccggc

SEQ ID NO: 3067197 - RNA, 23 nt, Mycobacterium bovis subsp bovis AF2122/97
gcgaauccagccgcgcgccggcc

SEQ ID NO: 3067198 - RNA, 15 nt, Mycobacterium bovis subsp bovis AF2122/97
gcgaauccgccgccu

SEQ ID NO: 3067199 - RNA, 23 nt, Mycobacterium bovis subsp bovis AF2122/97
gcgaauccggcgggugccgagcu

SEQ ID NO: 3067200 - RNA, 17 nt, Mycobacterium bovis subsp bovis AF2122/97
gcgaauccuggcgggug

SEQ ID NO: 3067201 - RNA, 17 nt, Mycobacterium bovis subsp bovis AF2122/97
gcgaaucgcgacgcgac

SEQ ID NO: 3067202 - RNA, 22 nt, Mycobacterium bovis subsp bovis AF2122/97
gcgaaucggcccgugccacagc

SEQ ID NO: 3067203 - RNA, 15 nt, Mycobacterium bovis subsp bovis AF2122/97
gcgaaucgguggucg

SEQ ID NO: 3067204 - RNA, 22 nt, Mycobacterium bovis subsp bovis AF2122/97
gcgaaucuuugguagucugcac

SEQ ID NO: 3067205 - RNA, 16 nt, Mycobacterium bovis subsp bovis AF2122/97
gcgaaugaagcccucg

SEQ ID NO: 3067206 - RNA, 16 nt, Mycobacterium bovis subsp bovis AF2122/97
gcgaaugacggccagu

SEQ ID NO: 3067207 - RNA, 20 nt, Mycobacterium bovis subsp bovis AF2122/97
gcgaaugcauuggcggugcg

SEQ ID NO: 3067208 - RNA, 17 nt, Mycobacterium bovis subsp bovis AF2122/97
gcgaaugcgggccuccu

SEQ ID NO: 3067209 - RNA, 23 nt, Mycobacterium bovis subsp bovis AF2122/97
gcgaaugcugugccgagaugccg

SEQ ID NO: 3067210 - RNA, 14 nt, Mycobacterium bovis subsp bovis AF2122/97
gcgaaugucgccgc

SEQ ID NO: 3067211 - RNA, 16 nt, Mycobacterium bovis subsp bovis AF2122/97
gcgaaugucgccgccu

SEQ ID NO: 3067212 - RNA, 22 nt, Mycobacterium bovis subsp bovis AF2122/97
gcgaaugugaucacccgcaucg

SEQ ID NO: 3067213 - RNA, 16 nt, Mycobacterium bovis subsp bovis AF2122/97
gcgaauuccucuguac

SEQ ID NO: 3067214 - RNA, 19 nt, Mycobacterium bovis subsp bovis AF2122/97
gcgacaaaucggucgacga

SEQ ID NO: 3067215 - RNA, 23 nt, Mycobacterium bovis subsp bovis AF2122/97
gcgacaacaccacggugccgacg

SEQ ID NO: 3067216 - RNA, 22 nt, Mycobacterium bovis subsp bovis AF2122/97
gcgacaacccggcgucgacgau

SEQ ID NO: 3067217 - RNA, 17 nt, Mycobacterium bovis subsp bovis AF2122/97
gcgacaagaccggcggg

SEQ ID NO: 3067218 - RNA, 20 nt, Mycobacterium bovis subsp bovis AF2122/97
gcgacaagaccggcgggcag

SEQ ID NO: 3067219 - RNA, 21 nt, Mycobacterium bovis subsp bovis AF2122/97
gcgacaagccgagcccgucga

SEQ ID NO: 3067220 - RNA, 16 nt, Mycobacterium bovis subsp bovis AF2122/97
gcgacaaggucgucga

SEQ ID NO: 3067221 - RNA, 18 nt, Mycobacterium bovis subsp bovis AF2122/97
gcgacaaggucgucgacu

SEQ ID NO: 3067222 - RNA, 17 nt, Mycobacterium bovis subsp bovis AF2122/97
gcgacacacgccgccgg

SEQ ID NO: 3067223 - RNA, 21 nt, Mycobacterium bovis subsp bovis AF2122/97
gcgacacacgccgccgguguc

SEQ ID NO: 3067224 - RNA, 16 nt, Mycobacterium bovis subsp bovis AF2122/97
gcgacaccacgaaucc

SEQ ID NO: 3067225 - RNA, 19 nt, Mycobacterium bovis subsp bovis AF2122/97
gcgacaccgcaggugccgu

SEQ ID NO: 3067226 - RNA, 22 nt, Mycobacterium bovis subsp bovis AF2122/97
gcgacaccuccgucagcgccgc

SEQ ID NO: 3067227 - RNA, 12 nt, Mycobacterium bovis subsp bovis AF2122/97
gcgacacgccag

SEQ ID NO: 3067228 - RNA, 16 nt, Mycobacterium bovis subsp bovis AF2122/97
gcgacacgccagccgu

SEQ ID NO: 3067229 - RNA, 14 nt, Mycobacterium bovis subsp bovis AF2122/97
gcgacacgccaggu

SEQ ID NO: 3067230 - RNA, 22 nt, Mycobacterium bovis subsp bovis AF2122/97
gcgacacgccgauucgccgucg

SEQ ID NO: 3067231 - RNA, 16 nt, Mycobacterium bovis subsp bovis AF2122/97
gcgacacgccggcggg

SEQ ID NO: 3067232 - RNA, 19 nt, Mycobacterium bovis subsp bovis AF2122/97
gcgacacgccggcgggcug

SEQ ID NO: 3067233 - RNA, 19 nt, Mycobacterium bovis subsp bovis AF2122/97
gcgacagacagcaccgccg

SEQ ID NO: 3067234 - RNA, 21 nt, Mycobacterium bovis subsp bovis AF2122/97
gcgacagacagcaccgccggu

SEQ ID NO: 3067235 - RNA, 17 nt, Mycobacterium bovis subsp bovis AF2122/97
gcgacagaugccgggcu

SEQ ID NO: 3067236 - RNA, 13 nt, Mycobacterium bovis subsp bovis AF2122/97
gcgacagccaccu

SEQ ID NO: 3067237 - RNA, 15 nt, Mycobacterium bovis subsp bovis AF2122/97
gcgacagccaccucg

SEQ ID NO: 3067238 - RNA, 14 nt, Mycobacterium bovis subsp bovis AF2122/97
gcgacagccguggc

SEQ ID NO: 3067239 - RNA, 14 nt, Mycobacterium bovis subsp bovis AF2122/97
gcgacagcgcggcg

SEQ ID NO: 3067240 - RNA, 15 nt, Mycobacterium bovis subsp bovis AF2122/97
gcgacagcgcggcgc

SEQ ID NO: 3067241 - RNA, 18 nt, Mycobacterium bovis subsp bovis AF2122/97
gcgacagcgcggcgcgac

SEQ ID NO: 3067242 - RNA, 11 nt, Mycobacterium bovis subsp bovis AF2122/97
gcgacagcgcu

SEQ ID NO: 3067243 - RNA, 18 nt, Mycobacterium bovis subsp bovis AF2122/97
gcgacaggacgucggcga

SEQ ID NO: 3067244 - RNA, 22 nt, Mycobacterium bovis subsp bovis AF2122/97
gcgacaggagacgguacgccag

SEQ ID NO: 3067245 - RNA, 12 nt, Mycobacterium bovis subsp bovis AF2122/97
gcgacaggccga

SEQ ID NO: 3067246 - RNA, 18 nt, Mycobacterium bovis subsp bovis AF2122/97
gcgacaggccgagcagau

SEQ ID NO: 3067247 - RNA, 16 nt, Mycobacterium bovis subsp bovis AF2122/97
gcgacauacccgauca

SEQ ID NO: 3067248 - RNA, 14 nt, Mycobacterium bovis subsp bovis AF2122/97
gcgacaucaccgaa

SEQ ID NO: 3067249 - RNA, 13 nt, Mycobacterium bovis subsp bovis AF2122/97
gcgacauccgcgg

SEQ ID NO: 3067250 - RNA, 14 nt, Mycobacterium bovis subsp bovis AF2122/97
gcgacauccgcggc

SEQ ID NO: 3067251 - RNA, 19 nt, Mycobacterium bovis subsp bovis AF2122/97
gcgacaucgagaucgccgu

SEQ ID NO: 3067252 - RNA, 13 nt, Mycobacterium bovis subsp bovis AF2122/97
gcgacaucgguca

SEQ ID NO: 3067253 - RNA, 23 nt, Mycobacterium bovis subsp bovis AF2122/97
gcgacaucgguggcggccuccga

SEQ ID NO: 3067254 - RNA, 19 nt, Mycobacterium bovis subsp bovis AF2122/97
gcgacaugaucugccaccg

SEQ ID NO: 3067255 - RNA, 22 nt, Mycobacterium bovis subsp bovis AF2122/97
gcgacaugucgaacgcccccca

SEQ ID NO: 3067256 - RNA, 15 nt, Mycobacterium bovis subsp bovis AF2122/97
gcgaccgcgcacggc

SEQ ID NO: 3067257 - RNA, 22 nt, Mycobacterium bovis subsp bovis AF2122/97
gcgaccgcgcucaccggggccg

SEQ ID NO: 3067258 - RNA, 13 nt, Mycobacterium bovis subsp bovis AF2122/97
gcgaccgcggccc

SEQ ID NO: 3067259 - RNA, 13 nt, Mycobacterium bovis subsp bovis AF2122/97
gcgaccgcggcga

SEQ ID NO: 3067260 - RNA, 17 nt, Mycobacterium bovis subsp bovis AF2122/97
gcgaccgcggucgcugc

SEQ ID NO: 3067261 - RNA, 18 nt, Mycobacterium bovis subsp bovis AF2122/97
gcgaccgcggucgcugcg

SEQ ID NO: 3067262 - RNA, 20 nt, Mycobacterium bovis subsp bovis AF2122/97
gcgaccgcggucgcugcgau

SEQ ID NO: 3067263 - RNA, 17 nt, Mycobacterium bovis subsp bovis AF2122/97
gcgaccgcgucguccca

SEQ ID NO: 3067264 - RNA, 17 nt, Mycobacterium bovis subsp bovis AF2122/97
gcgaccgcugagguauu

SEQ ID NO: 3067265 - RNA, 15 nt, Mycobacterium bovis subsp bovis AF2122/97
gcgaccggcgagccc

SEQ ID NO: 3067266 - RNA, 18 nt, Mycobacterium bovis subsp bovis AF2122/97
gcgaccggcgagcccgca

SEQ ID NO: 3067267 - RNA, 22 nt, Mycobacterium bovis subsp bovis AF2122/97
gcgaccggcgagcccgcaucgc

SEQ ID NO: 3067268 - RNA, 20 nt, Mycobacterium bovis subsp bovis AF2122/97
gcgaccggcguaaccggcag

SEQ ID NO: 3067269 - RNA, 11 nt, Mycobacterium bovis subsp bovis AF2122/97
gcgaccggcuc

SEQ ID NO: 3067270 - RNA, 20 nt, Mycobacterium bovis subsp bovis AF2122/97
gcgaccggcuccggacaccc

SEQ ID NO: 3067271 - RNA, 18 nt, Mycobacterium bovis subsp bovis AF2122/97
gcgaccgggaucggcucc

SEQ ID NO: 3067272 - RNA, 23 nt, Mycobacterium bovis subsp bovis AF2122/97
gcgaccgggaucggcuccgccgc

SEQ ID NO: 3067273 - RNA, 16 nt, Mycobacterium bovis subsp bovis AF2122/97
gcgaccggggaucggg

SEQ ID NO: 3067274 - RNA, 20 nt, Mycobacterium bovis subsp bovis AF2122/97
gcgaccggggaucggggcac

SEQ ID NO: 3067275 - RNA, 16 nt, Mycobacterium bovis subsp bovis AF2122/97
gcgaccggucugaucg

SEQ ID NO: 3067276 - RNA, 20 nt, Mycobacterium bovis subsp bovis AF2122/97
gcgaccggucugaucggcuu

SEQ ID NO: 3067277 - RNA, 19 nt, Mycobacterium bovis subsp bovis AF2122/97
gcgaccggugccugcaacg

SEQ ID NO: 3067278 - RNA, 22 nt, Mycobacterium bovis subsp bovis AF2122/97
gcgaccgucagggucaccugcg

SEQ ID NO: 3067279 - RNA, 16 nt, Mycobacterium bovis subsp bovis AF2122/97
gcgaccgucccagcgc

SEQ ID NO: 3067280 - RNA, 15 nt, Mycobacterium bovis subsp bovis AF2122/97
gcgaccgucccggcc

SEQ ID NO: 3067281 - RNA, 22 nt, Mycobacterium bovis subsp bovis AF2122/97
gcgaccgucgauuucgacgacc

SEQ ID NO: 3067282 - RNA, 16 nt, Mycobacterium bovis subsp bovis AF2122/97
gcgaccgucgucaccg

SEQ ID NO: 3067283 - RNA, 22 nt, Mycobacterium bovis subsp bovis AF2122/97
gcgaccgucgucaccgcgacgg

SEQ ID NO: 3067284 - RNA, 12 nt, Mycobacterium bovis subsp bovis AF2122/97
gcgaccgucugg

SEQ ID NO: 3067285 - RNA, 21 nt, Mycobacterium bovis subsp bovis AF2122/97
gcgaccuagcagcgcugcgau

SEQ ID NO: 3067286 - RNA, 13 nt, Mycobacterium bovis subsp bovis AF2122/97
gcgaccucacgaa

SEQ ID NO: 3067287 - RNA, 16 nt, Mycobacterium bovis subsp bovis AF2122/97
gcgaccuccggaaucg

SEQ ID NO: 3067288 - RNA, 17 nt, Mycobacterium bovis subsp bovis AF2122/97
gcgaccuccggaaucgc

SEQ ID NO: 3067289 - RNA, 19 nt, Mycobacterium bovis subsp bovis AF2122/97
gcgaccuccggaaucgccc

SEQ ID NO: 3067290 - RNA, 20 nt, Mycobacterium bovis subsp bovis AF2122/97
gcgaccuccggaaucgcccg

SEQ ID NO: 3067291 - RNA, 14 nt, Mycobacterium bovis subsp bovis AF2122/97
gcgaccucgccgcg

SEQ ID NO: 3067292 - RNA, 16 nt, Mycobacterium bovis subsp bovis AF2122/97
gcgaccucgccgcggc

SEQ ID NO: 3067293 - RNA, 18 nt, Mycobacterium bovis subsp bovis AF2122/97
gcgaccucgccgcggcgg

SEQ ID NO: 3067294 - RNA, 20 nt, Mycobacterium bovis subsp bovis AF2122/97
gcgaccucgccgcggcggaa

SEQ ID NO: 3067295 - RNA, 13 nt, Mycobacterium bovis subsp bovis AF2122/97
gcgaccucgccgg

SEQ ID NO: 3067296 - RNA, 12 nt, Mycobacterium bovis subsp bovis AF2122/97
gcgaccucgcgg

SEQ ID NO: 3067297 - RNA, 15 nt, Mycobacterium bovis subsp bovis AF2122/97
gcgaccucgcggcgc

SEQ ID NO: 3067298 - RNA, 17 nt, Mycobacterium bovis subsp bovis AF2122/97
gcgaccucgcggcgcug

SEQ ID NO: 3067299 - RNA, 18 nt, Mycobacterium bovis subsp bovis AF2122/97
gcgaccucgcuggccgca

SEQ ID NO: 3067300 - RNA, 19 nt, Mycobacterium bovis subsp bovis AF2122/97
gcgaccucgcuggccgcac

SEQ ID NO: 3067301 - RNA, 17 nt, Mycobacterium bovis subsp bovis AF2122/97
gcgaccucggcggcggc

SEQ ID NO: 3067302 - RNA, 20 nt, Mycobacterium bovis subsp bovis AF2122/97
gcgaccucggcggcggcacg

SEQ ID NO: 3067303 - RNA, 16 nt, Mycobacterium bovis subsp bovis AF2122/97
gcgaccugccggaccg

SEQ ID NO: 3067304 - RNA, 13 nt, Mycobacterium bovis subsp bovis AF2122/97
gcgaccugcgcga

SEQ ID NO: 3067305 - RNA, 17 nt, Mycobacterium bovis subsp bovis AF2122/97
gcgaccugcgcgagguu

SEQ ID NO: 3067306 - RNA, 13 nt, Mycobacterium bovis subsp bovis AF2122/97
gcgaccugcucgc

SEQ ID NO: 3067307 - RNA, 22 nt, Mycobacterium bovis subsp bovis AF2122/97
gcgaccuggcucaucgaugcga

SEQ ID NO: 3067308 - RNA, 19 nt, Mycobacterium bovis subsp bovis AF2122/97
gcgaccuggucgcuggugc

SEQ ID NO: 3067309 - RNA, 16 nt, Mycobacterium bovis subsp bovis AF2122/97
gcgaccuugacccgca

SEQ ID NO: 3067310 - RNA, 19 nt, Mycobacterium bovis subsp bovis AF2122/97
gcgaccuugacccgcaagu

SEQ ID NO: 3067311 - RNA, 18 nt, Mycobacterium bovis subsp bovis AF2122/97
gcgaccuugcccgcuagc

SEQ ID NO: 3067312 - RNA, 22 nt, Mycobacterium bovis subsp bovis AF2122/97
gcgacgaaccggaucaucgccg

SEQ ID NO: 3067313 - RNA, 23 nt, Mycobacterium bovis subsp bovis AF2122/97
gcgacgaaccggaucaucgccgc

SEQ ID NO: 3067314 - RNA, 14 nt, Mycobacterium bovis subsp bovis AF2122/97
gcgacgaaccucgg

SEQ ID NO: 3067315 - RNA, 22 nt, Mycobacterium bovis subsp bovis AF2122/97
gcgacgacacgccugggcgacg

SEQ ID NO: 3067316 - RNA, 19 nt, Mycobacterium bovis subsp bovis AF2122/97
gcgacgacccgggucggca

SEQ ID NO: 3067317 - RNA, 20 nt, Mycobacterium bovis subsp bovis AF2122/97
gcgacgacccgggucggcac

SEQ ID NO: 3067318 - RNA, 13 nt, Mycobacterium bovis subsp bovis AF2122/97
gcgacgaccgucg

SEQ ID NO: 3067319 - RNA, 14 nt, Mycobacterium bovis subsp bovis AF2122/97
gcgacgaccgucgg

SEQ ID NO: 3067320 - RNA, 19 nt, Mycobacterium bovis subsp bovis AF2122/97
gcgacgaccgucggcucca

SEQ ID NO: 3067321 - RNA, 20 nt, Mycobacterium bovis subsp bovis AF2122/97
gcgacgaccgucggcuccag

SEQ ID NO: 3067322 - RNA, 14 nt, Mycobacterium bovis subsp bovis AF2122/97
gcgacgacgagguc

SEQ ID NO: 3067323 - RNA, 13 nt, Mycobacterium bovis subsp bovis AF2122/97
gcgacgacggcgc

SEQ ID NO: 3067324 - RNA, 14 nt, Mycobacterium bovis subsp bovis AF2122/97
gcgacgacggcgcc

SEQ ID NO: 3067325 - RNA, 19 nt, Mycobacterium bovis subsp bovis AF2122/97
gcgacgacggcgccgucgu

SEQ ID NO: 3067326 - RNA, 18 nt, Mycobacterium bovis subsp bovis AF2122/97
gcgacgagaucagccucg

SEQ ID NO: 3067327 - RNA, 23 nt, Mycobacterium bovis subsp bovis AF2122/97
gcgacgagaucagccucgcgggc

SEQ ID NO: 3067328 - RNA, 12 nt, Mycobacterium bovis subsp bovis AF2122/97
gcgacgagaucu

SEQ ID NO: 3067329 - RNA, 15 nt, Mycobacterium bovis subsp bovis AF2122/97
gcgacgagaucugcg

SEQ ID NO: 3067330 - RNA, 18 nt, Mycobacterium bovis subsp bovis AF2122/97
gcgacgagcaacgccacc

SEQ ID NO: 3067331 - RNA, 19 nt, Mycobacterium bovis subsp bovis AF2122/97
gcgacgagcaacgccaccc

SEQ ID NO: 3067332 - RNA, 14 nt, Mycobacterium bovis subsp bovis AF2122/97
gcgacgagcccacc

SEQ ID NO: 3067333 - RNA, 15 nt, Mycobacterium bovis subsp bovis AF2122/97
gcgacgagcccaccg

SEQ ID NO: 3067334 - RNA, 19 nt, Mycobacterium bovis subsp bovis AF2122/97
gcgacgagcccaccgucgc

SEQ ID NO: 3067335 - RNA, 14 nt, Mycobacterium bovis subsp bovis AF2122/97
gcgacgagcgcagc

SEQ ID NO: 3067336 - RNA, 18 nt, Mycobacterium bovis subsp bovis AF2122/97
gcgacgagcggccguggc

SEQ ID NO: 3067337 - RNA, 19 nt, Mycobacterium bovis subsp bovis AF2122/97
gcgacgaguugcgaaccau

SEQ ID NO: 3067338 - RNA, 21 nt, Mycobacterium bovis subsp bovis AF2122/97
gcgacgaguugcgaaccauga

SEQ ID NO: 3067339 - RNA, 22 nt, Mycobacterium bovis subsp bovis AF2122/97
gcgacgauaucgggagcggcug

SEQ ID NO: 3067340 - RNA, 23 nt, Mycobacterium bovis subsp bovis AF2122/97
gcgacgauaucgggagcggcugc

SEQ ID NO: 3067341 - RNA, 15 nt, Mycobacterium bovis subsp bovis AF2122/97
gcgacgauccgcacg

SEQ ID NO: 3067342 - RNA, 21 nt, Mycobacterium bovis subsp bovis AF2122/97
gcgacguugguugcguccgcc

SEQ ID NO: 3067343 - RNA, 20 nt, Mycobacterium bovis subsp bovis AF2122/97
gcgacguuguuuuugcacug

SEQ ID NO: 3067344 - RNA, 15 nt, Mycobacterium bovis subsp bovis AF2122/97
gcgacuaagggcacu

SEQ ID NO: 3067345 - RNA, 19 nt, Mycobacterium bovis subsp bovis AF2122/97
gcgacuaagggcacuccac

SEQ ID NO: 3067346 - RNA, 16 nt, Mycobacterium bovis subsp bovis AF2122/97
gcgacuaccaucgccg

SEQ ID NO: 3067347 - RNA, 15 nt, Mycobacterium bovis subsp bovis AF2122/97
gcgacuacggccucg

SEQ ID NO: 3067348 - RNA, 17 nt, Mycobacterium bovis subsp bovis AF2122/97
gcgacuagacgccgccg

SEQ ID NO: 3067349 - RNA, 14 nt, Mycobacterium bovis subsp bovis AF2122/97
gcgacuccacccca

SEQ ID NO: 3067350 - RNA, 16 nt, Mycobacterium bovis subsp bovis AF2122/97
gcgacuccaccccacc

SEQ ID NO: 3067351 - RNA, 20 nt, Mycobacterium bovis subsp bovis AF2122/97
gcgacucgaggaccugcucg

SEQ ID NO: 3067352 - RNA, 21 nt, Mycobacterium bovis subsp bovis AF2122/97
gcgacucgaggaccugcucgg

SEQ ID NO: 3067353 - RNA, 13 nt, Mycobacterium bovis subsp bovis AF2122/97
gcgacucgccggc

SEQ ID NO: 3067354 - RNA, 21 nt, Mycobacterium bovis subsp bovis AF2122/97
gcgacucgccggcgaauccgc

SEQ ID NO: 3067355 - RNA, 15 nt, Mycobacterium bovis subsp bovis AF2122/97
gcgacucggccagga

SEQ ID NO: 3067356 - RNA, 12 nt, Mycobacterium bovis subsp bovis AF2122/97
gcgacucggugc

SEQ ID NO: 3067357 - RNA, 17 nt, Mycobacterium bovis subsp bovis AF2122/97
gcgacucggugcgguga

SEQ ID NO: 3067358 - RNA, 19 nt, Mycobacterium bovis subsp bovis AF2122/97
gcgacucgugucugccucg

SEQ ID NO: 3067359 - RNA, 23 nt, Mycobacterium bovis subsp bovis AF2122/97
gcgacucgugucugccucggggc

SEQ ID NO: 3067360 - RNA, 20 nt, Mycobacterium bovis subsp bovis AF2122/97
gcgacucugcgucugcucac

SEQ ID NO: 3067361 - RNA, 20 nt, Mycobacterium bovis subsp bovis AF2122/97
gcgacugagaucgcuucccg

SEQ ID NO: 3067362 - RNA, 16 nt, Mycobacterium bovis subsp bovis AF2122/97
gcgacugcagcggcgc

SEQ ID NO: 3067363 - RNA, 19 nt, Mycobacterium bovis subsp bovis AF2122/97
gcgacugcgcaccuggguc

SEQ ID NO: 3067364 - RNA, 15 nt, Mycobacterium bovis subsp bovis AF2122/97
gcgacugcgucggcg

SEQ ID NO: 3067365 - RNA, 16 nt, Mycobacterium bovis subsp bovis AF2122/97
gcgacugcgucggcgg

SEQ ID NO: 3067366 - RNA, 13 nt, Mycobacterium bovis subsp bovis AF2122/97
gcgacuggugccu

SEQ ID NO: 3067367 - RNA, 19 nt, Mycobacterium bovis subsp bovis AF2122/97
gcgacuggugccugccgca

SEQ ID NO: 3067368 - RNA, 20 nt, Mycobacterium bovis subsp bovis AF2122/97
gcgacuggugccugccgcac

SEQ ID NO: 3067369 - RNA, 21 nt, Mycobacterium bovis subsp bovis AF2122/97
gcgacuggugccugccgcacg

SEQ ID NO: 3067370 - RNA, 14 nt, Mycobacterium bovis subsp bovis AF2122/97
gcgacugucugguc

SEQ ID NO: 3067371 - RNA, 20 nt, Mycobacterium bovis subsp bovis AF2122/97
gcgacugugaaucucacgac

SEQ ID NO: 3067372 - RNA, 16 nt, Mycobacterium bovis subsp bovis AF2122/97
gcgacuucaucuucga

SEQ ID NO: 3067373 - RNA, 17 nt, Mycobacterium bovis subsp bovis AF2122/97
gcgacuuggugacaccg

SEQ ID NO: 3067374 - RNA, 18 nt, Mycobacterium bovis subsp bovis AF2122/97
gcgacuuggugacaccga

SEQ ID NO: 3067375 - RNA, 15 nt, Mycobacterium bovis subsp bovis AF2122/97
gcgacuuucugcgcg

SEQ ID NO: 3067376 - RNA, 16 nt, Mycobacterium bovis subsp bovis AF2122/97
gcgacuuucugcgcgu

SEQ ID NO: 3067377 - RNA, 18 nt, Mycobacterium bovis subsp bovis AF2122/97
gcgacuuucugcgcgugg

SEQ ID NO: 3067378 - RNA, 17 nt, Mycobacterium bovis subsp bovis AF2122/97
gcgagaaacacgacagc

SEQ ID NO: 3067379 - RNA, 14 nt, Mycobacterium bovis subsp bovis AF2122/97
gcgagaacacccgu

SEQ ID NO: 3067380 - RNA, 19 nt, Mycobacterium bovis subsp bovis AF2122/97
gcgagaagcagggauucug

SEQ ID NO: 3067381 - RNA, 16 nt, Mycobacterium bovis subsp bovis AF2122/97
gcgagaaggugcugcg

SEQ ID NO: 3067382 - RNA, 23 nt, Mycobacterium bovis subsp bovis AF2122/97
gcgagaagucaaggugucaacgc

SEQ ID NO: 3067383 - RNA, 19 nt, Mycobacterium bovis subsp bovis AF2122/97
gcgagaagucgcagcgagg

SEQ ID NO: 3067384 - RNA, 19 nt, Mycobacterium bovis subsp bovis AF2122/97
gcgagaaucacggucaucu

SEQ ID NO: 3067385 - RNA, 22 nt, Mycobacterium bovis subsp bovis AF2122/97
gcgagaaucacggucaucucgg

SEQ ID NO: 3067386 - RNA, 15 nt, Mycobacterium bovis subsp bovis AF2122/97
gcgagaccgcgagca

SEQ ID NO: 3067387 - RNA, 13 nt, Mycobacterium bovis subsp bovis AF2122/97
gcgagacgcucca

SEQ ID NO: 3067388 - RNA, 20 nt, Mycobacterium bovis subsp bovis AF2122/97
gcgagacuucgacgcggcga

SEQ ID NO: 3067389 - RNA, 14 nt, Mycobacterium bovis subsp bovis AF2122/97
gcgagacuugguga

SEQ ID NO: 3067390 - RNA, 22 nt, Mycobacterium bovis subsp bovis AF2122/97
gcgagaggugcugcaccuggcg

SEQ ID NO: 3067391 - RNA, 16 nt, Mycobacterium bovis subsp bovis AF2122/97
gcgagauagcaccagu

SEQ ID NO: 3067392 - RNA, 14 nt, Mycobacterium bovis subsp bovis AF2122/97
gcgagaucagccgg

SEQ ID NO: 3067393 - RNA, 16 nt, Mycobacterium bovis subsp bovis AF2122/97
gcgagauccuucgcgu

SEQ ID NO: 3067394 - RNA, 16 nt, Mycobacterium bovis subsp bovis AF2122/97
gcgagaucgcggcgac

SEQ ID NO: 3067395 - RNA, 22 nt, Mycobacterium bovis subsp bovis AF2122/97
gcgagaucggauggugugucgg

SEQ ID NO: 3067396 - RNA, 23 nt, Mycobacterium bovis subsp bovis AF2122/97
gcgagaucggauggugugucggg

SEQ ID NO: 3067397 - RNA, 17 nt, Mycobacterium bovis subsp bovis AF2122/97
gcgagaucgggccggcc

SEQ ID NO: 3067398 - RNA, 19 nt, Mycobacterium bovis subsp bovis AF2122/97
gcgagaucgggccggccgc

SEQ ID NO: 3067399 - RNA, 21 nt, Mycobacterium bovis subsp bovis AF2122/97
gcgagaucgggccggccgccg

SEQ ID NO: 3067400 - RNA, 15 nt, Mycobacterium bovis subsp bovis AF2122/97
gcgagcaacaccagg

SEQ ID NO: 3067401 - RNA, 21 nt, Mycobacterium bovis subsp bovis AF2122/97
gcgagcaacucguccagcagu

SEQ ID NO: 3067402 - RNA, 13 nt, Mycobacterium bovis subsp bovis AF2122/97
gcgagcaccaccc

SEQ ID NO: 3067403 - RNA, 15 nt, Mycobacterium bovis subsp bovis AF2122/97
gcgagcaccacccca

SEQ ID NO: 3067404 - RNA, 17 nt, Mycobacterium bovis subsp bovis AF2122/97
gcgagcaccaccccagc

SEQ ID NO: 3067405 - RNA, 17 nt, Mycobacterium bovis subsp bovis AF2122/97
gcgagcacccgcugguc

SEQ ID NO: 3067406 - RNA, 21 nt, Mycobacterium bovis subsp bovis AF2122/97
gcgagcacccgcuggucgagc

SEQ ID NO: 3067407 - RNA, 23 nt, Mycobacterium bovis subsp bovis AF2122/97
gcgagcacccguugaucgcggac

SEQ ID NO: 3067408 - RNA, 23 nt, Mycobacterium bovis subsp bovis AF2122/97
gcgagcacgcgggcacugguggc

SEQ ID NO: 3067409 - RNA, 17 nt, Mycobacterium bovis subsp bovis AF2122/97
gcgagcacgucggggug

SEQ ID NO: 3067410 - RNA, 20 nt, Mycobacterium bovis subsp bovis AF2122/97
gcgagcagacacagaaucgc

SEQ ID NO: 3067411 - RNA, 20 nt, Mycobacterium bovis subsp bovis AF2122/97
gcgagcagacacuaaagccc

SEQ ID NO: 3067412 - RNA, 22 nt, Mycobacterium bovis subsp bovis AF2122/97
gcgagcagacgcaaaagccacc

SEQ ID NO: 3067413 - RNA, 20 nt, Mycobacterium bovis subsp bovis AF2122/97
gcgagcagacgcagaaucgc

SEQ ID NO: 3067414 - RNA, 21 nt, Mycobacterium bovis subsp bovis AF2122/97
gcgagcagacgcagaaucgca

SEQ ID NO: 3067415 - RNA, 21 nt, Mycobacterium bovis subsp bovis AF2122/97
gcgagcagacgcagaaucgcc

SEQ ID NO: 3067416 - RNA, 20 nt, Mycobacterium bovis subsp bovis AF2122/97
gcgagcagacgcagagucgc

SEQ ID NO: 3067417 - RNA, 22 nt, Mycobacterium bovis subsp bovis AF2122/97
gcgagcagacgcagagucgcac

SEQ ID NO: 3067418 - RNA, 23 nt, Mycobacterium bovis subsp bovis AF2122/97
gcgagcagacgcagagucgcacu

SEQ ID NO: 3067419 - RNA, 20 nt, Mycobacterium bovis subsp bovis AF2122/97
gcgagcagacgcauaagccc

SEQ ID NO: 3067420 - RNA, 15 nt, Mycobacterium bovis subsp bovis AF2122/97
gcgagcagacgccgc

SEQ ID NO: 3067421 - RNA, 16 nt, Mycobacterium bovis subsp bovis AF2122/97
gcgagcagacgccgcg

SEQ ID NO: 3067422 - RNA, 20 nt, Mycobacterium bovis subsp bovis AF2122/97
gcgagcagacgcggaaucgc

SEQ ID NO: 3067423 - RNA, 20 nt, Mycobacterium bovis subsp bovis AF2122/97
gcgagcagacgcuaaagccc

SEQ ID NO: 3067424 - RNA, 19 nt, Mycobacterium bovis subsp bovis AF2122/97
gcgagcagacgugggcgcu

SEQ ID NO: 3067425 - RNA, 13 nt, Mycobacterium bovis subsp bovis AF2122/97
gcgagcagcccgg

SEQ ID NO: 3067426 - RNA, 15 nt, Mycobacterium bovis subsp bovis AF2122/97
gcgagcaggccguug

SEQ ID NO: 3067427 - RNA, 16 nt, Mycobacterium bovis subsp bovis AF2122/97
gcgagcagggcgucga

SEQ ID NO: 3067428 - RNA, 14 nt, Mycobacterium bovis subsp bovis AF2122/97
gcgaggggcggcaa

SEQ ID NO: 3067429 - RNA, 23 nt, Mycobacterium bovis subsp bovis AF2122/97
gcgagggugaagacaccggcguc

SEQ ID NO: 3067430 - RNA, 21 nt, Mycobacterium bovis subsp bovis AF2122/97
gcgagggugagcauggcuagg

SEQ ID NO: 3067431 - RNA, 18 nt, Mycobacterium bovis subsp bovis AF2122/97
gcgagguaagcgagucga

SEQ ID NO: 3067432 - RNA, 21 nt, Mycobacterium bovis subsp bovis AF2122/97
gcgagguaagcgagucgacga

SEQ ID NO: 3067433 - RNA, 19 nt, Mycobacterium bovis subsp bovis AF2122/97
gcgagguacccaucgucga

SEQ ID NO: 3067434 - RNA, 20 nt, Mycobacterium bovis subsp bovis AF2122/97
gcgagguauaaacgcggcgc

SEQ ID NO: 3067435 - RNA, 21 nt, Mycobacterium bovis subsp bovis AF2122/97
gcgagguauaaacgcggcgcg

SEQ ID NO: 3067436 - RNA, 23 nt, Mycobacterium bovis subsp bovis AF2122/97
gcgagguauaaacgcggcgcgcu

SEQ ID NO: 3067437 - RNA, 15 nt, Mycobacterium bovis subsp bovis AF2122/97
gcgagguccagcaug

SEQ ID NO: 3067438 - RNA, 19 nt, Mycobacterium bovis subsp bovis AF2122/97
gcgaggucccggccgagcg

SEQ ID NO: 3067439 - RNA, 18 nt, Mycobacterium bovis subsp bovis AF2122/97
gcgaggucggcggcgcag

SEQ ID NO: 3067440 - RNA, 21 nt, Mycobacterium bovis subsp bovis AF2122/97
gcgaggucggugaggucgaug

SEQ ID NO: 3067441 - RNA, 22 nt, Mycobacterium bovis subsp bovis AF2122/97
gcgaggucggugaggucgaugc

SEQ ID NO: 3067442 - RNA, 18 nt, Mycobacterium bovis subsp bovis AF2122/97
gcgaggugaaucgcgucg

SEQ ID NO: 3067443 - RNA, 19 nt, Mycobacterium bovis subsp bovis AF2122/97
gcgaggugauuggucacac

SEQ ID NO: 3067444 - RNA, 14 nt, Mycobacterium bovis subsp bovis AF2122/97
gcgagguucagccu

SEQ ID NO: 3067445 - RNA, 19 nt, Mycobacterium bovis subsp bovis AF2122/97
gcgagguucagccugagca

SEQ ID NO: 3067446 - RNA, 16 nt, Mycobacterium bovis subsp bovis AF2122/97
gcgagguugaccacca

SEQ ID NO: 3067447 - RNA, 21 nt, Mycobacterium bovis subsp bovis AF2122/97
gcgagguugaccaccagcgug

SEQ ID NO: 3067448 - RNA, 20 nt, Mycobacterium bovis subsp bovis AF2122/97
gcgagguuggcguugguggu

SEQ ID NO: 3067449 - RNA, 18 nt, Mycobacterium bovis subsp bovis AF2122/97
gcgaguaagcgaacagcg

SEQ ID NO: 3067450 - RNA, 15 nt, Mycobacterium bovis subsp bovis AF2122/97
gcgaguacaggcgca

SEQ ID NO: 3067451 - RNA, 19 nt, Mycobacterium bovis subsp bovis AF2122/97
gcgaguagcugacccgcgg

SEQ ID NO: 3067452 - RNA, 23 nt, Mycobacterium bovis subsp bovis AF2122/97
gcgaguaggacacguggugggcg

SEQ ID NO: 3067453 - RNA, 16 nt, Mycobacterium bovis subsp bovis AF2122/97
gcgagucagaaaaagc

SEQ ID NO: 3067454 - RNA, 19 nt, Mycobacterium bovis subsp bovis AF2122/97
gcgaguccacaaguaccgc

SEQ ID NO: 3067455 - RNA, 20 nt, Mycobacterium bovis subsp bovis AF2122/97
gcgaguccaggcugaucccg

SEQ ID NO: 3067456 - RNA, 17 nt, Mycobacterium bovis subsp bovis AF2122/97
gcgagucccggcgguug

SEQ ID NO: 3067457 - RNA, 21 nt, Mycobacterium bovis subsp bovis AF2122/97
gcgaguccucgagugccgccg

SEQ ID NO: 3067458 - RNA, 22 nt, Mycobacterium bovis subsp bovis AF2122/97
gcgaguccucgagugccgccgu

SEQ ID NO: 3067459 - RNA, 19 nt, Mycobacterium bovis subsp bovis AF2122/97
gcgagucgaacccgcgagc

SEQ ID NO: 3067460 - RNA, 14 nt, Mycobacterium bovis subsp bovis AF2122/97
gcgagucgaucucg

SEQ ID NO: 3067461 - RNA, 16 nt, Mycobacterium bovis subsp bovis AF2122/97
gcgagucggcggggcg

SEQ ID NO: 3067462 - RNA, 13 nt, Mycobacterium bovis subsp bovis AF2122/97
gcgagucgggggc

SEQ ID NO: 3067463 - RNA, 17 nt, Mycobacterium bovis subsp bovis AF2122/97
gcgagucgggggccgcg

SEQ ID NO: 3067464 - RNA, 13 nt, Mycobacterium bovis subsp bovis AF2122/97
gcgagugcggcac

SEQ ID NO: 3067465 - RNA, 19 nt, Mycobacterium bovis subsp bovis AF2122/97
gcgagugcggcacgaucgc

SEQ ID NO: 3067466 - RNA, 15 nt, Mycobacterium bovis subsp bovis AF2122/97
gcgagugucagcaga

SEQ ID NO: 3067467 - RNA, 18 nt, Mycobacterium bovis subsp bovis AF2122/97
gcgagugucuuagccagc

SEQ ID NO: 3067468 - RNA, 21 nt, Mycobacterium bovis subsp bovis AF2122/97
gcgagugucuuagccagcagc

SEQ ID NO: 3067469 - RNA, 22 nt, Mycobacterium bovis subsp bovis AF2122/97
gcgagugucuuagccagcagca

SEQ ID NO: 3067470 - RNA, 17 nt, Mycobacterium bovis subsp bovis AF2122/97
gcgaguuaggccgccag

SEQ ID NO: 3067471 - RNA, 18 nt, Mycobacterium bovis subsp bovis AF2122/97
gcgaguuaggccgccagc

SEQ ID NO: 3067472 - RNA, 19 nt, Mycobacterium bovis subsp bovis AF2122/97
gcgaguuaggccgccagcc

SEQ ID NO: 3067473 - RNA, 14 nt, Mycobacterium bovis subsp bovis AF2122/97
gcgaguucgcgcac

SEQ ID NO: 3067474 - RNA, 14 nt, Mycobacterium bovis subsp bovis AF2122/97
gcgaguuggccgug

SEQ ID NO: 3067475 - RNA, 18 nt, Mycobacterium bovis subsp bovis AF2122/97
gcgaguuucugcucgacc

SEQ ID NO: 3067476 - RNA, 19 nt, Mycobacterium bovis subsp bovis AF2122/97
gcgaguuucugcucgaccg

SEQ ID NO: 3067477 - RNA, 20 nt, Mycobacterium bovis subsp bovis AF2122/97
gcgaguuucugcucgaccgu

SEQ ID NO: 3067478 - RNA, 13 nt, Mycobacterium bovis subsp bovis AF2122/97
gcgauaacccgca

SEQ ID NO: 3067479 - RNA, 16 nt, Mycobacterium bovis subsp bovis AF2122/97
gcgauaacccgcaucg

SEQ ID NO: 3067480 - RNA, 23 nt, Mycobacterium bovis subsp bovis AF2122/97
gcgauaacccgcaucggaaucgc

SEQ ID NO: 3067481 - RNA, 16 nt, Mycobacterium bovis subsp bovis AF2122/97
gcgauacacggcggcg

SEQ ID NO: 3067482 - RNA, 13 nt, Mycobacterium bovis subsp bovis AF2122/97
gcgauacccaccg

SEQ ID NO: 3067483 - RNA, 16 nt, Mycobacterium bovis subsp bovis AF2122/97
gcgauaccgaggaucu

SEQ ID NO: 3067484 - RNA, 19 nt, Mycobacterium bovis subsp bovis AF2122/97
gcgauagaugcgugcggca

SEQ ID NO: 3067485 - RNA, 14 nt, Mycobacterium bovis subsp bovis AF2122/97
gcgauagccgccgc

SEQ ID NO: 3067486 - RNA, 14 nt, Mycobacterium bovis subsp bovis AF2122/97
gcgauaggcccggu

SEQ ID NO: 3067487 - RNA, 21 nt, Mycobacterium bovis subsp bovis AF2122/97
gcgauaggugcucgcgaucug

SEQ ID NO: 3067488 - RNA, 19 nt, Mycobacterium bovis subsp bovis AF2122/97
gcgauauaggacgccgcgc

SEQ ID NO: 3067489 - RNA, 21 nt, Mycobacterium bovis subsp bovis AF2122/97
gcgauauccacaauccgcucg

SEQ ID NO: 3067490 - RNA, 13 nt, Mycobacterium bovis subsp bovis AF2122/97
gcgauaucgcaca

SEQ ID NO: 3067491 - RNA, 17 nt, Mycobacterium bovis subsp bovis AF2122/97
gcgauaucgcacaugga

SEQ ID NO: 3067492 - RNA, 13 nt, Mycobacterium bovis subsp bovis AF2122/97
gcgauaucggcgg

SEQ ID NO: 3067493 - RNA, 16 nt, Mycobacterium bovis subsp bovis AF2122/97
gcgaucaaagccagca

SEQ ID NO: 3067494 - RNA, 16 nt, Mycobacterium bovis subsp bovis AF2122/97
gcgaucaacgcgcacg

SEQ ID NO: 3067495 - RNA, 13 nt, Mycobacterium bovis subsp bovis AF2122/97
gcgaucaacgcgu

SEQ ID NO: 3067496 - RNA, 17 nt, Mycobacterium bovis subsp bovis AF2122/97
gcgaucaacucgggcag

SEQ ID NO: 3067497 - RNA, 19 nt, Mycobacterium bovis subsp bovis AF2122/97
gcgaucaauugcccggcac

SEQ ID NO: 3067498 - RNA, 20 nt, Mycobacterium bovis subsp bovis AF2122/97
gcgaucaauugcccggcacg

SEQ ID NO: 3067499 - RNA, 21 nt, Mycobacterium bovis subsp bovis AF2122/97
gcgaucaauugcccggcacgg

SEQ ID NO: 3067500 - RNA, 15 nt, Mycobacterium bovis subsp bovis AF2122/97
gcgaucaccaccgga

SEQ ID NO: 3067501 - RNA, 19 nt, Mycobacterium bovis subsp bovis AF2122/97
gcgaucacccacaugguga

SEQ ID NO: 3067502 - RNA, 19 nt, Mycobacterium bovis subsp bovis AF2122/97
gcgaucaccgagauggcga

SEQ ID NO: 3067503 - RNA, 18 nt, Mycobacterium bovis subsp bovis AF2122/97
gcgaucaccguuuggucc

SEQ ID NO: 3067504 - RNA, 16 nt, Mycobacterium bovis subsp bovis AF2122/97
gcgaucagcagccgcc

SEQ ID NO: 3067505 - RNA, 18 nt, Mycobacterium bovis subsp bovis AF2122/97
gcgaucagcagccgccga

SEQ ID NO: 3067506 - RNA, 21 nt, Mycobacterium bovis subsp bovis AF2122/97
gcgaucagcagccgccgauga

SEQ ID NO: 3067507 - RNA, 14 nt, Mycobacterium bovis subsp bovis AF2122/97
gcgaucaggcgcuc

SEQ ID NO: 3067508 - RNA, 16 nt, Mycobacterium bovis subsp bovis AF2122/97
gcgaucaggcgcucga

SEQ ID NO: 3067509 - RNA, 16 nt, Mycobacterium bovis subsp bovis AF2122/97
gcgaucaggcugccgc

SEQ ID NO: 3067510 - RNA, 22 nt, Mycobacterium bovis subsp bovis AF2122/97
gcgaucaggcugccgcugcgcc

SEQ ID NO: 3067511 - RNA, 19 nt, Mycobacterium bovis subsp bovis AF2122/97
gcgaucagguaccggcgga

SEQ ID NO: 3067512 - RNA, 18 nt, Mycobacterium bovis subsp bovis AF2122/97
gcgaucaguucgugacgu

SEQ ID NO: 3067513 - RNA, 19 nt, Mycobacterium bovis subsp bovis AF2122/97
gcgaucaucaggugcgccu

SEQ ID NO: 3067514 - RNA, 20 nt, Mycobacterium bovis subsp bovis AF2122/97
gcgaugacaucaccgaccaa

SEQ ID NO: 3067515 - RNA, 22 nt, Mycobacterium bovis subsp bovis AF2122/97
gcgaugacaucaccgaccaacg

SEQ ID NO: 3067516 - RNA, 18 nt, Mycobacterium bovis subsp bovis AF2122/97
gcgaugaccacgccgacg

SEQ ID NO: 3067517 - RNA, 15 nt, Mycobacterium bovis subsp bovis AF2122/97
gcgaugaccgggcga

SEQ ID NO: 3067518 - RNA, 13 nt, Mycobacterium bovis subsp bovis AF2122/97
gcgaugacgaccg

SEQ ID NO: 3067519 - RNA, 19 nt, Mycobacterium bovis subsp bovis AF2122/97
gcgaugacgaccgaucggc

SEQ ID NO: 3067520 - RNA, 22 nt, Mycobacterium bovis subsp bovis AF2122/97
gcgaugacgaccgaucggcgcg

SEQ ID NO: 3067521 - RNA, 23 nt, Mycobacterium bovis subsp bovis AF2122/97
gcgaugacgaccgaucggcgcgu

SEQ ID NO: 3067522 - RNA, 16 nt, Mycobacterium bovis subsp bovis AF2122/97
gcgaugacgaucgcgu

SEQ ID NO: 3067523 - RNA, 22 nt, Mycobacterium bovis subsp bovis AF2122/97
gcgaugacgaucgcguccgcgc

SEQ ID NO: 3067524 - RNA, 21 nt, Mycobacterium bovis subsp bovis AF2122/97
gcgaugacggugccgaccgcg

SEQ ID NO: 3067525 - RNA, 21 nt, Mycobacterium bovis subsp bovis AF2122/97
gcgaugagccugcaggccgcc

SEQ ID NO: 3067526 - RNA, 22 nt, Mycobacterium bovis subsp bovis AF2122/97
gcgaugagccugcaggccgccg

SEQ ID NO: 3067527 - RNA, 17 nt, Mycobacterium bovis subsp bovis AF2122/97
gcgaugagcgugccgca

SEQ ID NO: 3067528 - RNA, 23 nt, Mycobacterium bovis subsp bovis AF2122/97
gcgaugaggaacguuucgcuguc

SEQ ID NO: 3067529 - RNA, 15 nt, Mycobacterium bovis subsp bovis AF2122/97
gcgaugaucaccagu

SEQ ID NO: 3067530 - RNA, 17 nt, Mycobacterium bovis subsp bovis AF2122/97
gcgaugaucaccagucg

SEQ ID NO: 3067531 - RNA, 21 nt, Mycobacterium bovis subsp bovis AF2122/97
gcgaugaucaccagucgcuga

SEQ ID NO: 3067532 - RNA, 22 nt, Mycobacterium bovis subsp bovis AF2122/97
gcgaugaucaugaacgcaagca

SEQ ID NO: 3067533 - RNA, 15 nt, Mycobacterium bovis subsp bovis AF2122/97
gcgaugaucgcaucg

SEQ ID NO: 3067534 - RNA, 16 nt, Mycobacterium bovis subsp bovis AF2122/97
gcgaugaucgcaucga

SEQ ID NO: 3067535 - RNA, 19 nt, Mycobacterium bovis subsp bovis AF2122/97
gcgaugaucgcaucgacgu

SEQ ID NO: 3067536 - RNA, 19 nt, Mycobacterium bovis subsp bovis AF2122/97
gcgaugaugacggcggccc

SEQ ID NO: 3067537 - RNA, 17 nt, Mycobacterium bovis subsp bovis AF2122/97
gcgaugaugcucgacaa

SEQ ID NO: 3067538 - RNA, 19 nt, Mycobacterium bovis subsp bovis AF2122/97
gcgaugauggcgcgaucgg

SEQ ID NO: 3067539 - RNA, 19 nt, Mycobacterium bovis subsp bovis AF2122/97
gcgaugaugucggccgcgg

SEQ ID NO: 3067540 - RNA, 22 nt, Mycobacterium bovis subsp bovis AF2122/97
gcgaugauguugagcuggaccu

SEQ ID NO: 3067541 - RNA, 20 nt, Mycobacterium bovis subsp bovis AF2122/97
gcgaugauuucgucgaucgg

SEQ ID NO: 3067542 - RNA, 21 nt, Mycobacterium bovis subsp bovis AF2122/97
gcgaugauuucgucgaucggc

SEQ ID NO: 3067543 - RNA, 22 nt, Mycobacterium bovis subsp bovis AF2122/97
gcgaugauuucgucgaucggcu

SEQ ID NO: 3067544 - RNA, 13 nt, Mycobacterium bovis subsp bovis AF2122/97
gcgaugcagccgg

SEQ ID NO: 3067545 - RNA, 15 nt, Mycobacterium bovis subsp bovis AF2122/97
gcgaugcagcgcgcc

SEQ ID NO: 3067546 - RNA, 15 nt, Mycobacterium bovis subsp bovis AF2122/97
gcgaugccacccaac

SEQ ID NO: 3067547 - RNA, 19 nt, Mycobacterium bovis subsp bovis AF2122/97
gcgaugccacccaacagcg

SEQ ID NO: 3067548 - RNA, 18 nt, Mycobacterium bovis subsp bovis AF2122/97
gcgaugcccacgcacagc

SEQ ID NO: 3067549 - RNA, 14 nt, Mycobacterium bovis subsp bovis AF2122/97
gcgaugcccgucga

SEQ ID NO: 3067550 - RNA, 20 nt, Mycobacterium bovis subsp bovis AF2122/97
gcgaugccguccaagauguc

SEQ ID NO: 3067551 - RNA, 19 nt, Mycobacterium bovis subsp bovis AF2122/97
gcgaugccgugcugggccg

SEQ ID NO: 3067552 - RNA, 21 nt, Mycobacterium bovis subsp bovis AF2122/97
gcgaugccgugcugggccgac

SEQ ID NO: 3067553 - RNA, 23 nt, Mycobacterium bovis subsp bovis AF2122/97
gcgaugccgugcugggccgacgg

SEQ ID NO: 3067554 - RNA, 11 nt, Mycobacterium bovis subsp bovis AF2122/97
gcgaugcgacc

SEQ ID NO: 3067555 - RNA, 15 nt, Mycobacterium bovis subsp bovis AF2122/97
gcgaugcgcaccagc

SEQ ID NO: 3067556 - RNA, 16 nt, Mycobacterium bovis subsp bovis AF2122/97
gcgaugcgcaccagcg

SEQ ID NO: 3067557 - RNA, 15 nt, Mycobacterium bovis subsp bovis AF2122/97
gcgaugcgcgccccg

SEQ ID NO: 3067558 - RNA, 15 nt, Mycobacterium bovis subsp bovis AF2122/97
gcgaugcgcgccgau

SEQ ID NO: 3067559 - RNA, 19 nt, Mycobacterium bovis subsp bovis AF2122/97
gcgaugcgcgggugguuca

SEQ ID NO: 3067560 - RNA, 16 nt, Mycobacterium bovis subsp bovis AF2122/97
gcgaugcggcccucga

SEQ ID NO: 3067561 - RNA, 14 nt, Mycobacterium bovis subsp bovis AF2122/97
gcgaugcggcgucg

SEQ ID NO: 3067562 - RNA, 20 nt, Mycobacterium bovis subsp bovis AF2122/97
gcgaugcgggccgccaggcg

SEQ ID NO: 3067563 - RNA, 13 nt, Mycobacterium bovis subsp bovis AF2122/97
gcgaugcggucgg

SEQ ID NO: 3067564 - RNA, 17 nt, Mycobacterium bovis subsp bovis AF2122/97
gcgaugcggucggccac

SEQ ID NO: 3067565 - RNA, 21 nt, Mycobacterium bovis subsp bovis AF2122/97
gcgaugcgguguagggcggcg

SEQ ID NO: 3067566 - RNA, 23 nt, Mycobacterium bovis subsp bovis AF2122/97
gcgaugcgguguagggcggcguu

SEQ ID NO: 3067567 - RNA, 13 nt, Mycobacterium bovis subsp bovis AF2122/97
gcgaugcguccgc

SEQ ID NO: 3067568 - RNA, 22 nt, Mycobacterium bovis subsp bovis AF2122/97
gcgaugcucaaugugccgccgg

SEQ ID NO: 3067569 - RNA, 18 nt, Mycobacterium bovis subsp bovis AF2122/97
gcgaugcugaucaccguc

SEQ ID NO: 3067570 - RNA, 15 nt, Mycobacterium bovis subsp bovis AF2122/97
gcgauggcaccggcg

SEQ ID NO: 3067571 - RNA, 17 nt, Mycobacterium bovis subsp bovis AF2122/97
gcgauggcaccggcgug

SEQ ID NO: 3067572 - RNA, 12 nt, Mycobacterium bovis subsp bovis AF2122/97
gcgauggccagc

SEQ ID NO: 3067573 - RNA, 22 nt, Mycobacterium bovis subsp bovis AF2122/97
gcgauggccccugucauguccu

SEQ ID NO: 3067574 - RNA, 17 nt, Mycobacterium bovis subsp bovis AF2122/97
gcgauggcccggguguu

SEQ ID NO: 3067575 - RNA, 14 nt, Mycobacterium bovis subsp bovis AF2122/97
gcgauggccgacgc

SEQ ID NO: 3067576 - RNA, 18 nt, Mycobacterium bovis subsp bovis AF2122/97
gcgauggccgacgcugcu

SEQ ID NO: 3067577 - RNA, 19 nt, Mycobacterium bovis subsp bovis AF2122/97
gcgauggccguccgaccga

SEQ ID NO: 3067578 - RNA, 14 nt, Mycobacterium bovis subsp bovis AF2122/97
gcgauggccguugc

SEQ ID NO: 3067579 - RNA, 13 nt, Mycobacterium bovis subsp bovis AF2122/97
gcgauggcggcgc

SEQ ID NO: 3067580 - RNA, 18 nt, Mycobacterium bovis subsp bovis AF2122/97
gcgauggcggcgcguucg

SEQ ID NO: 3067581 - RNA, 13 nt, Mycobacterium bovis subsp bovis AF2122/97
gcgauggcggucc

SEQ ID NO: 3067582 - RNA, 16 nt, Mycobacterium bovis subsp bovis AF2122/97
gcgauggcgguccacc

SEQ ID NO: 3067583 - RNA, 22 nt, Mycobacterium bovis subsp bovis AF2122/97
gcgauggcguagcccaugccga

SEQ ID NO: 3067584 - RNA, 18 nt, Mycobacterium bovis subsp bovis AF2122/97
gcgaugggagcccggcgg

SEQ ID NO: 3067585 - RNA, 19 nt, Mycobacterium bovis subsp bovis AF2122/97
gcgaugggcccagcggccg

SEQ ID NO: 3067586 - RNA, 20 nt, Mycobacterium bovis subsp bovis AF2122/97
gcgauggguguugcuggccg

SEQ ID NO: 3067587 - RNA, 21 nt, Mycobacterium bovis subsp bovis AF2122/97
gcgauggguguugcuggccgc

SEQ ID NO: 3067588 - RNA, 17 nt, Mycobacterium bovis subsp bovis AF2122/97
gcgaugguagucgcgac

SEQ ID NO: 3067589 - RNA, 19 nt, Mycobacterium bovis subsp bovis AF2122/97
gcgaugguagucgcgaccg

SEQ ID NO: 3067590 - RNA, 16 nt, Mycobacterium bovis subsp bovis AF2122/97
gcgaugguaucgccgc

SEQ ID NO: 3067591 - RNA, 18 nt, Mycobacterium bovis subsp bovis AF2122/97
gcgauggugcgcccgccg

SEQ ID NO: 3067592 - RNA, 19 nt, Mycobacterium bovis subsp bovis AF2122/97
gcgauggugcgcccgccgg

SEQ ID NO: 3067593 - RNA, 22 nt, Mycobacterium bovis subsp bovis AF2122/97
gcgauggugcgcccgccggcgc

SEQ ID NO: 3067594 - RNA, 15 nt, Mycobacterium bovis subsp bovis AF2122/97
gcgauggugcgccgg

SEQ ID NO: 3067595 - RNA, 23 nt, Mycobacterium bovis subsp bovis AF2122/97
gcgaugguggccgccaccuccca

SEQ ID NO: 3067596 - RNA, 23 nt, Mycobacterium bovis subsp bovis AF2122/97
gcgauggugguuccgcccggugc

SEQ ID NO: 3067597 - RNA, 19 nt, Mycobacterium bovis subsp bovis AF2122/97
gcgauguccuuguuggcca

SEQ ID NO: 3067598 - RNA, 17 nt, Mycobacterium bovis subsp bovis AF2122/97
gcgaugucgccggcgac

SEQ ID NO: 3067599 - RNA, 14 nt, Mycobacterium bovis subsp bovis AF2122/97
gcgaugucgcgcau

SEQ ID NO: 3067600 - RNA, 23 nt, Mycobacterium bovis subsp bovis AF2122/97
gcgaugucgcgcauugccgacgc

SEQ ID NO: 3067601 - RNA, 16 nt, Mycobacterium bovis subsp bovis AF2122/97
gcgaugucguucgcgu

SEQ ID NO: 3067602 - RNA, 20 nt, Mycobacterium bovis subsp bovis AF2122/97
gcgaugugaaccgggcacca

SEQ ID NO: 3067603 - RNA, 23 nt, Mycobacterium bovis subsp bovis AF2122/97
gcgaugugcgccaccucgacgca

SEQ ID NO: 3067604 - RNA, 16 nt, Mycobacterium bovis subsp bovis AF2122/97
gcgauguggguuaccu

SEQ ID NO: 3067605 - RNA, 15 nt, Mycobacterium bovis subsp bovis AF2122/97
gcgauguuggccagc

SEQ ID NO: 3067606 - RNA, 21 nt, Mycobacterium bovis subsp bovis AF2122/97
gcgauuaccggcacgccggcg

SEQ ID NO: 3067607 - RNA, 21 nt, Mycobacterium bovis subsp bovis AF2122/97
gcgauucacacucgggcggcu

SEQ ID NO: 3067608 - RNA, 20 nt, Mycobacterium bovis subsp bovis AF2122/97
gcgauucccaaccgguggcc

SEQ ID NO: 3067609 - RNA, 20 nt, Mycobacterium bovis subsp bovis AF2122/97
gcgauuccgcgucugcucgc

SEQ ID NO: 3067610 - RNA, 14 nt, Mycobacterium bovis subsp bovis AF2122/97
gcgauuccggcggc

SEQ ID NO: 3067611 - RNA, 22 nt, Mycobacterium bovis subsp bovis AF2122/97
gcgauuccggcggccacgccgg

SEQ ID NO: 3067612 - RNA, 21 nt, Mycobacterium bovis subsp bovis AF2122/97
gcgauucugcguccugcucgc

SEQ ID NO: 3067613 - RNA, 19 nt, Mycobacterium bovis subsp bovis AF2122/97
gcgauucugcgucugcucg

SEQ ID NO: 3067614 - RNA, 20 nt, Mycobacterium bovis subsp bovis AF2122/97
gcgauucugcgucugcucgc

SEQ ID NO: 3067615 - RNA, 21 nt, Mycobacterium bovis subsp bovis AF2122/97
gcgauucugcgucugcucgcc

SEQ ID NO: 3067616 - RNA, 23 nt, Mycobacterium bovis subsp bovis AF2122/97
gcgauucugcgucugcucgccag

SEQ ID NO: 3067617 - RNA, 18 nt, Mycobacterium bovis subsp bovis AF2122/97
gcgauucugugucugcuc

SEQ ID NO: 3067618 - RNA, 14 nt, Mycobacterium bovis subsp bovis AF2122/97
gcgauugauccggu

SEQ ID NO: 3067619 - RNA, 19 nt, Mycobacterium bovis subsp bovis AF2122/97
gcgauugauccgguggcac

SEQ ID NO: 3067620 - RNA, 13 nt, Mycobacterium bovis subsp bovis AF2122/97
gcgauugccgcgg

SEQ ID NO: 3067621 - RNA, 22 nt, Mycobacterium bovis subsp bovis AF2122/97
gcgauugccgcgguugugcugg

SEQ ID NO: 3067622 - RNA, 14 nt, Mycobacterium bovis subsp bovis AF2122/97
gcgauugccgucgu

SEQ ID NO: 3067623 - RNA, 16 nt, Mycobacterium bovis subsp bovis AF2122/97
gcgauugcgcacaccc

SEQ ID NO: 3067624 - RNA, 13 nt, Mycobacterium bovis subsp bovis AF2122/97
gcgauuggcuggg

SEQ ID NO: 3067625 - RNA, 16 nt, Mycobacterium bovis subsp bovis AF2122/97
gcgauuggcugggucg

SEQ ID NO: 3067626 - RNA, 19 nt, Mycobacterium bovis subsp bovis AF2122/97
gcgauugucggggccgcag

SEQ ID NO: 3067627 - RNA, 20 nt, Mycobacterium bovis subsp bovis AF2122/97
gcgauugucggggccgcagg

SEQ ID NO: 3067628 - RNA, 13 nt, Mycobacterium bovis subsp bovis AF2122/97
gcgauuucggcgc

SEQ ID NO: 3067629 - RNA, 16 nt, Mycobacterium bovis subsp bovis AF2122/97
gcgauuucggcgccgg

SEQ ID NO: 3067630 - RNA, 23 nt, Mycobacterium bovis subsp bovis AF2122/97
gcgauuucggcgccuggcggcgc

SEQ ID NO: 3067631 - RNA, 15 nt, Mycobacterium bovis subsp bovis AF2122/97
gcgauuucgucgucg

SEQ ID NO: 3067632 - RNA, 17 nt, Mycobacterium bovis subsp bovis AF2122/97
gcgauuuugcgucgcgc

SEQ ID NO: 3067633 - RNA, 20 nt, Mycobacterium bovis subsp bovis AF2122/97
gcgauuuugcgucugcucgc

SEQ ID NO: 3067634 - RNA, 18 nt, Mycobacterium bovis subsp bovis AF2122/97
gcgauuuugugucugcuc

SEQ ID NO: 3067635 - RNA, 19 nt, Mycobacterium bovis subsp bovis AF2122/97
gcgauuuugugucugcucg

SEQ ID NO: 3067636 - RNA, 22 nt, Mycobacterium bovis subsp bovis AF2122/97
gcgauuuugugucugcucgccg

SEQ ID NO: 3067637 - RNA, 17 nt, Mycobacterium bovis subsp bovis AF2122/97
gcgcaaagcccuccucg

SEQ ID NO: 3067638 - RNA, 18 nt, Mycobacterium bovis subsp bovis AF2122/97
gcgcaaauaggacugcgc

SEQ ID NO: 3067639 - RNA, 22 nt, Mycobacterium bovis subsp bovis AF2122/97
gcgcaaauaggacugcgccacc

SEQ ID NO: 3067640 - RNA, 18 nt, Mycobacterium bovis subsp bovis AF2122/97
gcgcaaaugccugcuggu

SEQ ID NO: 3067641 - RNA, 20 nt, Mycobacterium bovis subsp bovis AF2122/97
gcgcaacaaccgguuggcga

SEQ ID NO: 3067642 - RNA, 15 nt, Mycobacterium bovis subsp bovis AF2122/97
gcgcaacacauccag

SEQ ID NO: 3067643 - RNA, 21 nt, Mycobacterium bovis subsp bovis AF2122/97
gcgcaacaccaucagcgacaa

SEQ ID NO: 3067644 - RNA, 21 nt, Mycobacterium bovis subsp bovis AF2122/97
gcgcaacaccgugcaccagcu

SEQ ID NO: 3067645 - RNA, 22 nt, Mycobacterium bovis subsp bovis AF2122/97
gcgcaacaccgugcaccagcuc

SEQ ID NO: 3067646 - RNA, 20 nt, Mycobacterium bovis subsp bovis AF2122/97
gcgcaacaccucgucggcuu

SEQ ID NO: 3067647 - RNA, 21 nt, Mycobacterium bovis subsp bovis AF2122/97
gcgcaaccagcaaugccgacu

SEQ ID NO: 3067648 - RNA, 14 nt, Mycobacterium bovis subsp bovis AF2122/97
gcgcaaccagccca

SEQ ID NO: 3067649 - RNA, 12 nt, Mycobacterium bovis subsp bovis AF2122/97
gcgcaacccagc

SEQ ID NO: 3067650 - RNA, 17 nt, Mycobacterium bovis subsp bovis AF2122/97
gcgcaacccagccgcgc

SEQ ID NO: 3067651 - RNA, 14 nt, Mycobacterium bovis subsp bovis AF2122/97
gcgcaacccccgaa

SEQ ID NO: 3067652 - RNA, 14 nt, Mycobacterium bovis subsp bovis AF2122/97
gcgcaaccgcggcc

SEQ ID NO: 3067653 - RNA, 19 nt, Mycobacterium bovis subsp bovis AF2122/97
gcgcaaccgcggccccgac

SEQ ID NO: 3067654 - RNA, 13 nt, Mycobacterium bovis subsp bovis AF2122/97
gcgcaaccgcuca

SEQ ID NO: 3067655 - RNA, 22 nt, Mycobacterium bovis subsp bovis AF2122/97
gcgcaaccgguggaugaacacc

SEQ ID NO: 3067656 - RNA, 22 nt, Mycobacterium bovis subsp bovis AF2122/97
gcgcaaccuaaauugccgggcc

SEQ ID NO: 3067657 - RNA, 17 nt, Mycobacterium bovis subsp bovis AF2122/97
gcgcaacgccgccagcc

SEQ ID NO: 3067658 - RNA, 21 nt, Mycobacterium bovis subsp bovis AF2122/97
gcgcaacgcuggaggcgaucu

SEQ ID NO: 3067659 - RNA, 22 nt, Mycobacterium bovis subsp bovis AF2122/97
gcgcaacgggucgguccacuuc

SEQ ID NO: 3067660 - RNA, 18 nt, Mycobacterium bovis subsp bovis AF2122/97
gcgcaacguagccagcag

SEQ ID NO: 3067661 - RNA, 22 nt, Mycobacterium bovis subsp bovis AF2122/97
gcgcaacguagccagcagcggc

SEQ ID NO: 3067662 - RNA, 19 nt, Mycobacterium bovis subsp bovis AF2122/97
gcgcaacuaucgcaccucc

SEQ ID NO: 3067663 - RNA, 16 nt, Mycobacterium bovis subsp bovis AF2122/97
gcgcaacucccagcac

SEQ ID NO: 3067664 - RNA, 18 nt, Mycobacterium bovis subsp bovis AF2122/97
gcgcaacucccagcacgg

SEQ ID NO: 3067665 - RNA, 22 nt, Mycobacterium bovis subsp bovis AF2122/97
gcgcaacucgccacggucgccg

SEQ ID NO: 3067666 - RNA, 23 nt, Mycobacterium bovis subsp bovis AF2122/97
gcgcaacuucgacuugagaaacc

SEQ ID NO: 3067667 - RNA, 19 nt, Mycobacterium bovis subsp bovis AF2122/97
gcgcaacuucuucagcagc

SEQ ID NO: 3067668 - RNA, 20 nt, Mycobacterium bovis subsp bovis AF2122/97
gcgcaacuucuucagcagcg

SEQ ID NO: 3067669 - RNA, 18 nt, Mycobacterium bovis subsp bovis AF2122/97
gcgcaagaaugccgccga

SEQ ID NO: 3067670 - RNA, 12 nt, Mycobacterium bovis subsp bovis AF2122/97
gcgcaagcgccg

SEQ ID NO: 3067671 - RNA, 16 nt, Mycobacterium bovis subsp bovis AF2122/97
gcgcaaggcgccgcag

SEQ ID NO: 3067672 - RNA, 13 nt, Mycobacterium bovis subsp bovis AF2122/97
gcgcaaggucgac

SEQ ID NO: 3067673 - RNA, 19 nt, Mycobacterium bovis subsp bovis AF2122/97
gcgcaagguggcaugcgac

SEQ ID NO: 3067674 - RNA, 18 nt, Mycobacterium bovis subsp bovis AF2122/97
gcgcaagguugccaacgc

SEQ ID NO: 3067675 - RNA, 13 nt, Mycobacterium bovis subsp bovis AF2122/97
gcgcaaucaacgu

SEQ ID NO: 3067676 - RNA, 17 nt, Mycobacterium bovis subsp bovis AF2122/97
gcgcaaucgaccacgac

SEQ ID NO: 3067677 - RNA, 20 nt, Mycobacterium bovis subsp bovis AF2122/97
gcgcaaugcaucgcggcggc

SEQ ID NO: 3067678 - RNA, 22 nt, Mycobacterium bovis subsp bovis AF2122/97
gcgcaaugcaucgcggcggcgc

SEQ ID NO: 3067679 - RNA, 23 nt, Mycobacterium bovis subsp bovis AF2122/97
gcgcaaugcaucgcggcggcgcu

SEQ ID NO: 3067680 - RNA, 13 nt, Mycobacterium bovis subsp bovis AF2122/97
gcgcaaugccgac

SEQ ID NO: 3067681 - RNA, 15 nt, Mycobacterium bovis subsp bovis AF2122/97
gcgcaaugccgacgc

SEQ ID NO: 3067682 - RNA, 16 nt, Mycobacterium bovis subsp bovis AF2122/97
gcgcaaugccgacgcc

SEQ ID NO: 3067683 - RNA, 24 nt, Mycobacterium bovis subsp bovis AF2122/97
gcgcaaugccgacgccaacgccag

SEQ ID NO: 3067684 - RNA, 17 nt, Mycobacterium bovis subsp bovis AF2122/97
gcgcaaugcgcgacggu

SEQ ID NO: 3067685 - RNA, 17 nt, Mycobacterium bovis subsp bovis AF2122/97
gcgcaaugcggcccggg

SEQ ID NO: 3067686 - RNA, 15 nt, Mycobacterium bovis subsp bovis AF2122/97
gcgcagaacaccacc

SEQ ID NO: 3067687 - RNA, 17 nt, Mycobacterium bovis subsp bovis AF2122/97
gcgcagaacaccaccgc

SEQ ID NO: 3067688 - RNA, 18 nt, Mycobacterium bovis subsp bovis AF2122/97
gcgcagaacaccaccgcc

SEQ ID NO: 3067689 - RNA, 15 nt, Mycobacterium bovis subsp bovis AF2122/97
gcgcagaacgaucgc

SEQ ID NO: 3067690 - RNA, 22 nt, Mycobacterium bovis subsp bovis AF2122/97
gcgcagaacgaucgcgcuggcg

SEQ ID NO: 3067691 - RNA, 14 nt, Mycobacterium bovis subsp bovis AF2122/97
gcgcagaaucgccu

SEQ ID NO: 3067692 - RNA, 14 nt, Mycobacterium bovis subsp bovis AF2122/97
gcgcagacucgcca

SEQ ID NO: 3067693 - RNA, 17 nt, Mycobacterium bovis subsp bovis AF2122/97
gcgcagagucaacgucg

SEQ ID NO: 3067694 - RNA, 15 nt, Mycobacterium bovis subsp bovis AF2122/97
gcgcagauacgcgug

SEQ ID NO: 3067695 - RNA, 16 nt, Mycobacterium bovis subsp bovis AF2122/97
gcgcagaucguccacc

SEQ ID NO: 3067696 - RNA, 21 nt, Mycobacterium bovis subsp bovis AF2122/97
gcgcagaucguccaccgccga

SEQ ID NO: 3067697 - RNA, 22 nt, Mycobacterium bovis subsp bovis AF2122/97
gcgcagaucguccaccgccgac

SEQ ID NO: 3067698 - RNA, 20 nt, Mycobacterium bovis subsp bovis AF2122/97
gcgcagaucgugcacaaucg

SEQ ID NO: 3067699 - RNA, 21 nt, Mycobacterium bovis subsp bovis AF2122/97
gcgcagaugagcgcggcgaca

SEQ ID NO: 3067700 - RNA, 22 nt, Mycobacterium bovis subsp bovis AF2122/97
gcgcagauggcauugcgcccac

SEQ ID NO: 3067701 - RNA, 24 nt, Mycobacterium bovis subsp bovis AF2122/97
gcgcagauggcauugcgcccaccg

SEQ ID NO: 3067702 - RNA, 19 nt, Mycobacterium bovis subsp bovis AF2122/97
gcgcagauuugcuccagcg

SEQ ID NO: 3067703 - RNA, 21 nt, Mycobacterium bovis subsp bovis AF2122/97
gcgcagauuugcuccagcgac

SEQ ID NO: 3067704 - RNA, 14 nt, Mycobacterium bovis subsp bovis AF2122/97
gcgcagcaacucga

SEQ ID NO: 3067705 - RNA, 17 nt, Mycobacterium bovis subsp bovis AF2122/97
gcgcagcaacucgacgu

SEQ ID NO: 3067706 - RNA, 19 nt, Mycobacterium bovis subsp bovis AF2122/97
gcgcagcaacucgacguca

SEQ ID NO: 3067707 - RNA, 16 nt, Mycobacterium bovis subsp bovis AF2122/97
gcgcagcaacugggcg

SEQ ID NO: 3067708 - RNA, 18 nt, Mycobacterium bovis subsp bovis AF2122/97
gcgcagcaacugggcggc

SEQ ID NO: 3067709 - RNA, 19 nt, Mycobacterium bovis subsp bovis AF2122/97
gcgcagcaacugggcggcc

SEQ ID NO: 3067710 - RNA, 21 nt, Mycobacterium bovis subsp bovis AF2122/97
gcgcagcaacugggcggccug

SEQ ID NO: 3067711 - RNA, 13 nt, Mycobacterium bovis subsp bovis AF2122/97
gcgcagcaccagg

SEQ ID NO: 3067712 - RNA, 17 nt, Mycobacterium bovis subsp bovis AF2122/97
gcgcagcaccagggugg

SEQ ID NO: 3067713 - RNA, 18 nt, Mycobacterium bovis subsp bovis AF2122/97
gcgcagcaccaggguggc

SEQ ID NO: 3067714 - RNA, 17 nt, Mycobacterium bovis subsp bovis AF2122/97
gcgcagcaccggcucga

SEQ ID NO: 3067715 - RNA, 22 nt, Mycobacterium bovis subsp bovis AF2122/97
gcgcagcaccgucggcaccagc

SEQ ID NO: 3067716 - RNA, 23 nt, Mycobacterium bovis subsp bovis AF2122/97
gcgcagcaccgucggcaccagca

SEQ ID NO: 3067717 - RNA, 20 nt, Mycobacterium bovis subsp bovis AF2122/97
gcgcagcacugcggcagcga

SEQ ID NO: 3067718 - RNA, 11 nt, Mycobacterium bovis subsp bovis AF2122/97
gcgcagcagcg

SEQ ID NO: 3067719 - RNA, 12 nt, Mycobacterium bovis subsp bovis AF2122/97
gcgcagcagcgg

SEQ ID NO: 3067720 - RNA, 13 nt, Mycobacterium bovis subsp bovis AF2122/97
gcgcagcagcggc

SEQ ID NO: 3067721 - RNA, 13 nt, Mycobacterium bovis subsp bovis AF2122/97
gcgcagcagcgug

SEQ ID NO: 3067722 - RNA, 19 nt, Mycobacterium bovis subsp bovis AF2122/97
gcgcagcaguuggucgcgg

SEQ ID NO: 3067723 - RNA, 15 nt, Mycobacterium bovis subsp bovis AF2122/97
gcgcagcaucggcga

SEQ ID NO: 3067724 - RNA, 19 nt, Mycobacterium bovis subsp bovis AF2122/97
gcgcagcaucgucgccacg

SEQ ID NO: 3067725 - RNA, 19 nt, Mycobacterium bovis subsp bovis AF2122/97
gcgcagcaucuccgccggu

SEQ ID NO: 3067726 - RNA, 22 nt, Mycobacterium bovis subsp bovis AF2122/97
gcgcagcaucucgucgaucucg

SEQ ID NO: 3067727 - RNA, 20 nt, Mycobacterium bovis subsp bovis AF2122/97
gcgcagcauggugcggcggc

SEQ ID NO: 3067728 - RNA, 20 nt, Mycobacterium bovis subsp bovis AF2122/97
gcgcagccgcagccgguuaa

SEQ ID NO: 3067729 - RNA, 13 nt, Mycobacterium bovis subsp bovis AF2122/97
gcgcagccgccgc

SEQ ID NO: 3067730 - RNA, 14 nt, Mycobacterium bovis subsp bovis AF2122/97
gcgcagccgccgcg

SEQ ID NO: 3067731 - RNA, 15 nt, Mycobacterium bovis subsp bovis AF2122/97
gcgcagccgccgcgc

SEQ ID NO: 3067732 - RNA, 17 nt, Mycobacterium bovis subsp bovis AF2122/97
gcgcagccgccgcgccc

SEQ ID NO: 3067733 - RNA, 16 nt, Mycobacterium bovis subsp bovis AF2122/97
gcgcagccgcucgacg

SEQ ID NO: 3067734 - RNA, 17 nt, Mycobacterium bovis subsp bovis AF2122/97
gcgcagccgcucgacgg

SEQ ID NO: 3067735 - RNA, 19 nt, Mycobacterium bovis subsp bovis AF2122/97
gcgcagccgcucgacggcc

SEQ ID NO: 3067736 - RNA, 17 nt, Mycobacterium bovis subsp bovis AF2122/97
gcgcagccggcccgucg

SEQ ID NO: 3067737 - RNA, 21 nt, Mycobacterium bovis subsp bovis AF2122/97
gcgcagccgggucuacagcgu

SEQ ID NO: 3067738 - RNA, 14 nt, Mycobacterium bovis subsp bovis AF2122/97
gcgcagccugcagc

SEQ ID NO: 3067739 - RNA, 15 nt, Mycobacterium bovis subsp bovis AF2122/97
gcgcagccugcagcg

SEQ ID NO: 3067740 - RNA, 21 nt, Mycobacterium bovis subsp bovis AF2122/97
gcgcagcgaaucuccaaguag

SEQ ID NO: 3067741 - RNA, 20 nt, Mycobacterium bovis subsp bovis AF2122/97
gcgcagcgauucgccuagcg

SEQ ID NO: 3067742 - RNA, 17 nt, Mycobacterium bovis subsp bovis AF2122/97
gcgcagcgcaacaucga

SEQ ID NO: 3067743 - RNA, 20 nt, Mycobacterium bovis subsp bovis AF2122/97
gcgcagcgccaucgaggucg

SEQ ID NO: 3067744 - RNA, 13 nt, Mycobacterium bovis subsp bovis AF2122/97
gcgcagcgccgcc

SEQ ID NO: 3067745 - RNA, 15 nt, Mycobacterium bovis subsp bovis AF2122/97
gcgcagcgccgccac

SEQ ID NO: 3067746 - RNA, 13 nt, Mycobacterium bovis subsp bovis AF2122/97
gcgcagcgccucc

SEQ ID NO: 3067747 - RNA, 16 nt, Mycobacterium bovis subsp bovis AF2122/97
gcgcagcgcgaucgcg

SEQ ID NO: 3067748 - RNA, 22 nt, Mycobacterium bovis subsp bovis AF2122/97
gcgcagcgcgaugucgccggcg

SEQ ID NO: 3067749 - RNA, 12 nt, Mycobacterium bovis subsp bovis AF2122/97
gcgcagcgcggc

SEQ ID NO: 3067750 - RNA, 17 nt, Mycobacterium bovis subsp bovis AF2122/97
gcgcagcgcggcggcau

SEQ ID NO: 3067751 - RNA, 13 nt, Mycobacterium bovis subsp bovis AF2122/97
gcgcagcggacgg

SEQ ID NO: 3067752 - RNA, 14 nt, Mycobacterium bovis subsp bovis AF2122/97
gcgcagcggacgga

SEQ ID NO: 3067753 - RNA, 14 nt, Mycobacterium bovis subsp bovis AF2122/97
gcgcagcgugcgau

SEQ ID NO: 3067754 - RNA, 16 nt, Mycobacterium bovis subsp bovis AF2122/97
gcgcagcgugcgaugc

SEQ ID NO: 3067755 - RNA, 19 nt, Mycobacterium bovis subsp bovis AF2122/97
gcgcagcguguugagggcu

SEQ ID NO: 3067756 - RNA, 19 nt, Mycobacterium bovis subsp bovis AF2122/97
gcgcagcuaacccgccacg

SEQ ID NO: 3067757 - RNA, 18 nt, Mycobacterium bovis subsp bovis AF2122/97
gcgcagcuacuaccugcc

SEQ ID NO: 3067758 - RNA, 22 nt, Mycobacterium bovis subsp bovis AF2122/97
gcgcagcuagcccucagcuagc

SEQ ID NO: 3067759 - RNA, 15 nt, Mycobacterium bovis subsp bovis AF2122/97
gcgcagcugacguca

SEQ ID NO: 3067760 - RNA, 18 nt, Mycobacterium bovis subsp bovis AF2122/97
gcgcagcugccgcacccc

SEQ ID NO: 3067761 - RNA, 19 nt, Mycobacterium bovis subsp bovis AF2122/97
gcgcagcugcgggucgugc

SEQ ID NO: 3067762 - RNA, 14 nt, Mycobacterium bovis subsp bovis AF2122/97
gcgcagcugggugc

SEQ ID NO: 3067763 - RNA, 21 nt, Mycobacterium bovis subsp bovis AF2122/97
gcgcaggaagcccacgaucgc

SEQ ID NO: 3067764 - RNA, 23 nt, Mycobacterium bovis subsp bovis AF2122/97
gcgcaggaagcccacgaucgcgu

SEQ ID NO: 3067765 - RNA, 16 nt, Mycobacterium bovis subsp bovis AF2122/97
gcgcaggaagccggcg

SEQ ID NO: 3067766 - RNA, 21 nt, Mycobacterium bovis subsp bovis AF2122/97
gcgcaggauguucaaucccuc

SEQ ID NO: 3067767 - RNA, 13 nt, Mycobacterium bovis subsp bovis AF2122/97
gcgcaggccgccg

SEQ ID NO: 3067768 - RNA, 14 nt, Mycobacterium bovis subsp bovis AF2122/97
gcgcaggccgccgc

SEQ ID NO: 3067769 - RNA, 18 nt, Mycobacterium bovis subsp bovis AF2122/97
gcgcaggcuuccagccac

SEQ ID NO: 3067770 - RNA, 20 nt, Mycobacterium bovis subsp bovis AF2122/97
gcgcaggcuuccagccacag

SEQ ID NO: 3067771 - RNA, 15 nt, Mycobacterium bovis subsp bovis AF2122/97
gcgcagggaucgcag

SEQ ID NO: 3067772 - RNA, 14 nt, Mycobacterium bovis subsp bovis AF2122/97
gcgcagggccugga

SEQ ID NO: 3067773 - RNA, 19 nt, Mycobacterium bovis subsp bovis AF2122/97
gcgccaccagcaccgccgc

SEQ ID NO: 3067774 - RNA, 20 nt, Mycobacterium bovis subsp bovis AF2122/97
gcgccaccagucacgcccac

SEQ ID NO: 3067775 - RNA, 21 nt, Mycobacterium bovis subsp bovis AF2122/97
gcgccaccagucacgcccacc

SEQ ID NO: 3067776 - RNA, 16 nt, Mycobacterium bovis subsp bovis AF2122/97
gcgccacccgcgccgc

SEQ ID NO: 3067777 - RNA, 22 nt, Mycobacterium bovis subsp bovis AF2122/97
gcgccacccgcggugccugcag

SEQ ID NO: 3067778 - RNA, 23 nt, Mycobacterium bovis subsp bovis AF2122/97
gcgccacccgcggugccugcagc

SEQ ID NO: 3067779 - RNA, 20 nt, Mycobacterium bovis subsp bovis AF2122/97
gcgccacccgcgucaguccu

SEQ ID NO: 3067780 - RNA, 13 nt, Mycobacterium bovis subsp bovis AF2122/97
gcgccaccgagcc

SEQ ID NO: 3067781 - RNA, 15 nt, Mycobacterium bovis subsp bovis AF2122/97
gcgccaccgauaccg

SEQ ID NO: 3067782 - RNA, 17 nt, Mycobacterium bovis subsp bovis AF2122/97
gcgccaccgauaccguc

SEQ ID NO: 3067783 - RNA, 22 nt, Mycobacterium bovis subsp bovis AF2122/97
gcgccaccgauaccgucagcgc

SEQ ID NO: 3067784 - RNA, 22 nt, Mycobacterium bovis subsp bovis AF2122/97
gcgccaccgccgcugccggugu

SEQ ID NO: 3067785 - RNA, 17 nt, Mycobacterium bovis subsp bovis AF2122/97
gcgccaccggcaccgcc

SEQ ID NO: 3067786 - RNA, 12 nt, Mycobacterium bovis subsp bovis AF2122/97
gcgccaccggcg

SEQ ID NO: 3067787 - RNA, 18 nt, Mycobacterium bovis subsp bovis AF2122/97
gcgccaccggcgccgccc

SEQ ID NO: 3067788 - RNA, 21 nt, Mycobacterium bovis subsp bovis AF2122/97
gcgccaccggcgccgcccgcg

SEQ ID NO: 3067789 - RNA, 17 nt, Mycobacterium bovis subsp bovis AF2122/97
gcgccaccggcgccgga

SEQ ID NO: 3067790 - RNA, 20 nt, Mycobacterium bovis subsp bovis AF2122/97
gcgccaccgucaccgccguu

SEQ ID NO: 3067791 - RNA, 19 nt, Mycobacterium bovis subsp bovis AF2122/97
gcgccaccgucgccguaca

SEQ ID NO: 3067792 - RNA, 15 nt, Mycobacterium bovis subsp bovis AF2122/97
gcgccaccguggugg

SEQ ID NO: 3067793 - RNA, 18 nt, Mycobacterium bovis subsp bovis AF2122/97
gcgccaccgugguggacg

SEQ ID NO: 3067794 - RNA, 19 nt, Mycobacterium bovis subsp bovis AF2122/97
gcgccaccguuaccgccgu

SEQ ID NO: 3067795 - RNA, 21 nt, Mycobacterium bovis subsp bovis AF2122/97
gcgccaccucccacgccgccg

SEQ ID NO: 3067796 - RNA, 16 nt, Mycobacterium bovis subsp bovis AF2122/97
gcgccaccuccgacgg

SEQ ID NO: 3067797 - RNA, 18 nt, Mycobacterium bovis subsp bovis AF2122/97
gcgccaccuccgacgggc

SEQ ID NO: 3067798 - RNA, 14 nt, Mycobacterium bovis subsp bovis AF2122/97
gcgccaccucgacg

SEQ ID NO: 3067799 - RNA, 14 nt, Mycobacterium bovis subsp bovis AF2122/97
gcgccacgcacccg

SEQ ID NO: 3067800 - RNA, 17 nt, Mycobacterium bovis subsp bovis AF2122/97
gcgccacgcacccggca

SEQ ID NO: 3067801 - RNA, 20 nt, Mycobacterium bovis subsp bovis AF2122/97
gcgccacgcacccggcaauc

SEQ ID NO: 3067802 - RNA, 14 nt, Mycobacterium bovis subsp bovis AF2122/97
gcgccacgccaccg

SEQ ID NO: 3067803 - RNA, 16 nt, Mycobacterium bovis subsp bovis AF2122/97
gcgccacgccaccgcg

SEQ ID NO: 3067804 - RNA, 23 nt, Mycobacterium bovis subsp bovis AF2122/97
gcgccacgccaccgcggucaccg

SEQ ID NO: 3067805 - RNA, 14 nt, Mycobacterium bovis subsp bovis AF2122/97
gcgccacgccgagg

SEQ ID NO: 3067806 - RNA, 13 nt, Mycobacterium bovis subsp bovis AF2122/97
gcgccacggcagc

SEQ ID NO: 3067807 - RNA, 16 nt, Mycobacterium bovis subsp bovis AF2122/97
gcgccacggcagcgcc

SEQ ID NO: 3067808 - RNA, 20 nt, Mycobacterium bovis subsp bovis AF2122/97
gcgccacggcagcgcccaga

SEQ ID NO: 3067809 - RNA, 15 nt, Mycobacterium bovis subsp bovis AF2122/97
gcgccacgucgacgg

SEQ ID NO: 3067810 - RNA, 21 nt, Mycobacterium bovis subsp bovis AF2122/97
gcgccacgucgacggucuggc

SEQ ID NO: 3067811 - RNA, 20 nt, Mycobacterium bovis subsp bovis AF2122/97
gcgccacguggucgagcagg

SEQ ID NO: 3067812 - RNA, 17 nt, Mycobacterium bovis subsp bovis AF2122/97
gcgccacugcuuccgga

SEQ ID NO: 3067813 - RNA, 20 nt, Mycobacterium bovis subsp bovis AF2122/97
gcgccacuggaagccaagcu

SEQ ID NO: 3067814 - RNA, 18 nt, Mycobacterium bovis subsp bovis AF2122/97
gcgccagacacaaccgcu

SEQ ID NO: 3067815 - RNA, 13 nt, Mycobacterium bovis subsp bovis AF2122/97
gcgccagaucacc

SEQ ID NO: 3067816 - RNA, 14 nt, Mycobacterium bovis subsp bovis AF2122/97
gcgccagaucaccg

SEQ ID NO: 3067817 - RNA, 14 nt, Mycobacterium bovis subsp bovis AF2122/97
gcgccagaucgacg

SEQ ID NO: 3067818 - RNA, 15 nt, Mycobacterium bovis subsp bovis AF2122/97
gcgccagaucgacgc

SEQ ID NO: 3067819 - RNA, 14 nt, Mycobacterium bovis subsp bovis AF2122/97
gcgccagccgaccg

SEQ ID NO: 3067820 - RNA, 18 nt, Mycobacterium bovis subsp bovis AF2122/97
gcgccagcgagcauaccg

SEQ ID NO: 3067821 - RNA, 22 nt, Mycobacterium bovis subsp bovis AF2122/97
gcgccagcgagcauaccgccgc

SEQ ID NO: 3067822 - RNA, 14 nt, Mycobacterium bovis subsp bovis AF2122/97
gcgccagcgagcgc

SEQ ID NO: 3067823 - RNA, 18 nt, Mycobacterium bovis subsp bovis AF2122/97
gcgccagcgauaucggcg

SEQ ID NO: 3067824 - RNA, 14 nt, Mycobacterium bovis subsp bovis AF2122/97
gcgccagcgccgcc

SEQ ID NO: 3067825 - RNA, 15 nt, Mycobacterium bovis subsp bovis AF2122/97
gcgccagcgccgcca

SEQ ID NO: 3067826 - RNA, 13 nt, Mycobacterium bovis subsp bovis AF2122/97
gcgccagcgggcu

SEQ ID NO: 3067827 - RNA, 13 nt, Mycobacterium bovis subsp bovis AF2122/97
gcgccagcggugg

SEQ ID NO: 3067828 - RNA, 14 nt, Mycobacterium bovis subsp bovis AF2122/97
gcgccagcggugga

SEQ ID NO: 3067829 - RNA, 20 nt, Mycobacterium bovis subsp bovis AF2122/97
gcgccagcguuaggucgccg

SEQ ID NO: 3067830 - RNA, 21 nt, Mycobacterium bovis subsp bovis AF2122/97
gcgccagcguuaggucgccgg

SEQ ID NO: 3067831 - RNA, 18 nt, Mycobacterium bovis subsp bovis AF2122/97
gcgccagcuccgugucgg

SEQ ID NO: 3067832 - RNA, 16 nt, Mycobacterium bovis subsp bovis AF2122/97
gcgccagcucggcggc

SEQ ID NO: 3067833 - RNA, 19 nt, Mycobacterium bovis subsp bovis AF2122/97
gcgccagcucggcggcagc

SEQ ID NO: 3067834 - RNA, 22 nt, Mycobacterium bovis subsp bovis AF2122/97
gcgccagcucggcggcagcggc

SEQ ID NO: 3067835 - RNA, 12 nt, Mycobacterium bovis subsp bovis AF2122/97
gcgccaggaacc

SEQ ID NO: 3067836 - RNA, 17 nt, Mycobacterium bovis subsp bovis AF2122/97
gcgccaggagcgcggcc

SEQ ID NO: 3067837 - RNA, 22 nt, Mycobacterium bovis subsp bovis AF2122/97
gcgccaggagcgcggcccgccu

SEQ ID NO: 3067838 - RNA, 18 nt, Mycobacterium bovis subsp bovis AF2122/97
gcgccaggaguggccacg

SEQ ID NO: 3067839 - RNA, 20 nt, Mycobacterium bovis subsp bovis AF2122/97
gcgccaggaguggccacguu

SEQ ID NO: 3067840 - RNA, 24 nt, Mycobacterium bovis subsp bovis AF2122/97
gcgccaggaguggccacguugcgc

SEQ ID NO: 3067841 - RNA, 15 nt, Mycobacterium bovis subsp bovis AF2122/97
gcgccaggcaccacg

SEQ ID NO: 3067842 - RNA, 12 nt, Mycobacterium bovis subsp bovis AF2122/97
gcgccaggccgc

SEQ ID NO: 3067843 - RNA, 12 nt, Mycobacterium bovis subsp bovis AF2122/97
gcgccaggccgu

SEQ ID NO: 3067844 - RNA, 17 nt, Mycobacterium bovis subsp bovis AF2122/97
gcgccaggcgcgaucgc

SEQ ID NO: 3067845 - RNA, 18 nt, Mycobacterium bovis subsp bovis AF2122/97
gcgccaggcgcgaucgcg

SEQ ID NO: 3067846 - RNA, 15 nt, Mycobacterium bovis subsp bovis AF2122/97
gcgccaggcggcaau

SEQ ID NO: 3067847 - RNA, 15 nt, Mycobacterium bovis subsp bovis AF2122/97
gcgccaggggugugc

SEQ ID NO: 3067848 - RNA, 18 nt, Mycobacterium bovis subsp bovis AF2122/97
gcgccagggucgguugcu

SEQ ID NO: 3067849 - RNA, 13 nt, Mycobacterium bovis subsp bovis AF2122/97
gcgccaggucggu

SEQ ID NO: 3067850 - RNA, 15 nt, Mycobacterium bovis subsp bovis AF2122/97
gcgccaggucgguga

SEQ ID NO: 3067851 - RNA, 21 nt, Mycobacterium bovis subsp bovis AF2122/97
gcgccaguaacgcccacaaug

SEQ ID NO: 3067852 - RNA, 22 nt, Mycobacterium bovis subsp bovis AF2122/97
gcgccaguagcacguugacguc

SEQ ID NO: 3067853 - RNA, 15 nt, Mycobacterium bovis subsp bovis AF2122/97
gcgccaguggccacc

SEQ ID NO: 3067854 - RNA, 19 nt, Mycobacterium bovis subsp bovis AF2122/97
gcgccaguggccaccauca

SEQ ID NO: 3067855 - RNA, 21 nt, Mycobacterium bovis subsp bovis AF2122/97
gcgccaguguggugcggcgcg

SEQ ID NO: 3067856 - RNA, 22 nt, Mycobacterium bovis subsp bovis AF2122/97
gcgccaguguggugcggcgcga

SEQ ID NO: 3067857 - RNA, 19 nt, Mycobacterium bovis subsp bovis AF2122/97
gcgccaguucgcggcugcg

SEQ ID NO: 3067858 - RNA, 20 nt, Mycobacterium bovis subsp bovis AF2122/97
gcgccaguucgcggcugcgu

SEQ ID NO: 3067859 - RNA, 20 nt, Mycobacterium bovis subsp bovis AF2122/97
gcgcccggcgcuagcgccgc

SEQ ID NO: 3067860 - RNA, 13 nt, Mycobacterium bovis subsp bovis AF2122/97
gcgcccggcgugg

SEQ ID NO: 3067861 - RNA, 19 nt, Mycobacterium bovis subsp bovis AF2122/97
gcgcccgggcggaacgccg

SEQ ID NO: 3067862 - RNA, 17 nt, Mycobacterium bovis subsp bovis AF2122/97
gcgcccgggguguucgu

SEQ ID NO: 3067863 - RNA, 14 nt, Mycobacterium bovis subsp bovis AF2122/97
gcgcccgucgcugg

SEQ ID NO: 3067864 - RNA, 15 nt, Mycobacterium bovis subsp bovis AF2122/97
gcgcccgugccgccc

SEQ ID NO: 3067865 - RNA, 17 nt, Mycobacterium bovis subsp bovis AF2122/97
gcgcccgugccgcccgc

SEQ ID NO: 3067866 - RNA, 14 nt, Mycobacterium bovis subsp bovis AF2122/97
gcgcccucagccgc

SEQ ID NO: 3067867 - RNA, 17 nt, Mycobacterium bovis subsp bovis AF2122/97
gcgcccucagccgcggc

SEQ ID NO: 3067868 - RNA, 24 nt, Mycobacterium bovis subsp bovis AF2122/97
gcgcccucagccgcggccacauga

SEQ ID NO: 3067869 - RNA, 14 nt, Mycobacterium bovis subsp bovis AF2122/97
gcgcccuccuuggc

SEQ ID NO: 3067870 - RNA, 16 nt, Mycobacterium bovis subsp bovis AF2122/97
gcgcccugagccaccc

SEQ ID NO: 3067871 - RNA, 18 nt, Mycobacterium bovis subsp bovis AF2122/97
gcgcccugagccaccccg

SEQ ID NO: 3067872 - RNA, 13 nt, Mycobacterium bovis subsp bovis AF2122/97
gcgcccugcgcca

SEQ ID NO: 3067873 - RNA, 15 nt, Mycobacterium bovis subsp bovis AF2122/97
gcgcccuggccgccc

SEQ ID NO: 3067874 - RNA, 19 nt, Mycobacterium bovis subsp bovis AF2122/97
gcgcccuguccuuggcgaa

SEQ ID NO: 3067875 - RNA, 18 nt, Mycobacterium bovis subsp bovis AF2122/97
gcgcccuuaagccggcgc

SEQ ID NO: 3067876 - RNA, 19 nt, Mycobacterium bovis subsp bovis AF2122/97
gcgccgaaaaggucgggga

SEQ ID NO: 3067877 - RNA, 16 nt, Mycobacterium bovis subsp bovis AF2122/97
gcgccgaacaccacac

SEQ ID NO: 3067878 - RNA, 23 nt, Mycobacterium bovis subsp bovis AF2122/97
gcgccgaacaccacaccgagcac

SEQ ID NO: 3067879 - RNA, 14 nt, Mycobacterium bovis subsp bovis AF2122/97
gcgccgaacccggu

SEQ ID NO: 3067880 - RNA, 14 nt, Mycobacterium bovis subsp bovis AF2122/97
gcgccgaacgccag

SEQ ID NO: 3067881 - RNA, 18 nt, Mycobacterium bovis subsp bovis AF2122/97
gcgccgaacgccagcagc

SEQ ID NO: 3067882 - RNA, 16 nt, Mycobacterium bovis subsp bovis AF2122/97
gcgccgaacgcuccag

SEQ ID NO: 3067883 - RNA, 19 nt, Mycobacterium bovis subsp bovis AF2122/97
gcgccgaacgcuccaggcc

SEQ ID NO: 3067884 - RNA, 20 nt, Mycobacterium bovis subsp bovis AF2122/97
gcgccgaacgcuccaggccu

SEQ ID NO: 3067885 - RNA, 14 nt, Mycobacterium bovis subsp bovis AF2122/97
gcgccgaacucaac

SEQ ID NO: 3067886 - RNA, 20 nt, Mycobacterium bovis subsp bovis AF2122/97
gcgccgaacucaacgacacc

SEQ ID NO: 3067887 - RNA, 21 nt, Mycobacterium bovis subsp bovis AF2122/97
gcgccgaagccuugcagcgcc

SEQ ID NO: 3067888 - RNA, 23 nt, Mycobacterium bovis subsp bovis AF2122/97
gcgccgaaguagccgaccggcag

SEQ ID NO: 3067889 - RNA, 17 nt, Mycobacterium bovis subsp bovis AF2122/97
gcgccgaaucgcgggcu

SEQ ID NO: 3067890 - RNA, 19 nt, Mycobacterium bovis subsp bovis AF2122/97
gcgccgaaugccaccucga

SEQ ID NO: 3067891 - RNA, 21 nt, Mycobacterium bovis subsp bovis AF2122/97
gcgccgaaugccaccucgacg

SEQ ID NO: 3067892 - RNA, 22 nt, Mycobacterium bovis subsp bovis AF2122/97
gcgccgaaugccaccucgacgc

SEQ ID NO: 3067893 - RNA, 15 nt, Mycobacterium bovis subsp bovis AF2122/97
gcgccgaauggcggu

SEQ ID NO: 3067894 - RNA, 19 nt, Mycobacterium bovis subsp bovis AF2122/97
gcgccgaauggcggugggc

SEQ ID NO: 3067895 - RNA, 22 nt, Mycobacterium bovis subsp bovis AF2122/97
gcgccgaauucauccgggcucg

SEQ ID NO: 3067896 - RNA, 23 nt, Mycobacterium bovis subsp bovis AF2122/97
gcgccgaauuggcccgggucucc

SEQ ID NO: 3067897 - RNA, 12 nt, Mycobacterium bovis subsp bovis AF2122/97
gcgccgacaccg

SEQ ID NO: 3067898 - RNA, 15 nt, Mycobacterium bovis subsp bovis AF2122/97
gcgccgacagccgau

SEQ ID NO: 3067899 - RNA, 18 nt, Mycobacterium bovis subsp bovis AF2122/97
gcgccgacagccgauccg

SEQ ID NO: 3067900 - RNA, 13 nt, Mycobacterium bovis subsp bovis AF2122/97
gcgccgacccgcg

SEQ ID NO: 3067901 - RNA, 14 nt, Mycobacterium bovis subsp bovis AF2122/97
gcgccgacccgcgc

SEQ ID NO: 3067902 - RNA, 17 nt, Mycobacterium bovis subsp bovis AF2122/97
gcgccgacccgcgcgcc

SEQ ID NO: 3067903 - RNA, 18 nt, Mycobacterium bovis subsp bovis AF2122/97
gcgccgacccgcgcgccg

SEQ ID NO: 3067904 - RNA, 20 nt, Mycobacterium bovis subsp bovis AF2122/97
gcgccgacccgcgcgccggc

SEQ ID NO: 3067905 - RNA, 21 nt, Mycobacterium bovis subsp bovis AF2122/97
gcgccgacccgcgcgccggcg

SEQ ID NO: 3067906 - RNA, 23 nt, Mycobacterium bovis subsp bovis AF2122/97
gcgccgacccgcgcgccggcgac

SEQ ID NO: 3067907 - RNA, 19 nt, Mycobacterium bovis subsp bovis AF2122/97
gcgccgacccguaccagcc

SEQ ID NO: 3067908 - RNA, 13 nt, Mycobacterium bovis subsp bovis AF2122/97
gcgccgaccgacg

SEQ ID NO: 3067909 - RNA, 13 nt, Mycobacterium bovis subsp bovis AF2122/97
gcgccgaccugga

SEQ ID NO: 3067910 - RNA, 21 nt, Mycobacterium bovis subsp bovis AF2122/97
gcgccgacgaaaucgucgggu

SEQ ID NO: 3067911 - RNA, 18 nt, Mycobacterium bovis subsp bovis AF2122/97
gcgccgacgacuccggca

SEQ ID NO: 3067912 - RNA, 19 nt, Mycobacterium bovis subsp bovis AF2122/97
gcgccgacgacuccggcaa

SEQ ID NO: 3067913 - RNA, 14 nt, Mycobacterium bovis subsp bovis AF2122/97
gcgccgacggccag

SEQ ID NO: 3067914 - RNA, 20 nt, Mycobacterium bovis subsp bovis AF2122/97
gcgccgacggugcaagcccu

SEQ ID NO: 3067915 - RNA, 16 nt, Mycobacterium bovis subsp bovis AF2122/97
gcgccgagagcaccgc

SEQ ID NO: 3067916 - RNA, 15 nt, Mycobacterium bovis subsp bovis AF2122/97
gcgccgagauccacg

SEQ ID NO: 3067917 - RNA, 16 nt, Mycobacterium bovis subsp bovis AF2122/97
gcgccgagauccacgc

SEQ ID NO: 3067918 - RNA, 18 nt, Mycobacterium bovis subsp bovis AF2122/97
gcgccgagauccacgcca

SEQ ID NO: 3067919 - RNA, 23 nt, Mycobacterium bovis subsp bovis AF2122/97
gcgccgagauccacgccagagcg

SEQ ID NO: 3067920 - RNA, 14 nt, Mycobacterium bovis subsp bovis AF2122/97
gcgccgagaucgac

SEQ ID NO: 3067921 - RNA, 21 nt, Mycobacterium bovis subsp bovis AF2122/97
gcgccgagaucgacaucguug

SEQ ID NO: 3067922 - RNA, 14 nt, Mycobacterium bovis subsp bovis AF2122/97
gcgccgagccagca

SEQ ID NO: 3067923 - RNA, 15 nt, Mycobacterium bovis subsp bovis AF2122/97
gcgccgagccagcac

SEQ ID NO: 3067924 - RNA, 16 nt, Mycobacterium bovis subsp bovis AF2122/97
gcgccgagcccgggcc

SEQ ID NO: 3067925 - RNA, 17 nt, Mycobacterium bovis subsp bovis AF2122/97
gcgccgagcccgggccg

SEQ ID NO: 3067926 - RNA, 23 nt, Mycobacterium bovis subsp bovis AF2122/97
gcgccgagcccgggccguacggc

SEQ ID NO: 3067927 - RNA, 12 nt, Mycobacterium bovis subsp bovis AF2122/97
gcgccgagcucg

SEQ ID NO: 3067928 - RNA, 15 nt, Mycobacterium bovis subsp bovis AF2122/97
gcgccgagcucggcg

SEQ ID NO: 3067929 - RNA, 17 nt, Mycobacterium bovis subsp bovis AF2122/97
gcgccgagcucggcgcc

SEQ ID NO: 3067930 - RNA, 13 nt, Mycobacterium bovis subsp bovis AF2122/97
gcgccgaggucga

SEQ ID NO: 3067931 - RNA, 20 nt, Mycobacterium bovis subsp bovis AF2122/97
gcgccgaguugcccgggucg

SEQ ID NO: 3067932 - RNA, 16 nt, Mycobacterium bovis subsp bovis AF2122/97
gcgccgauaccagcca

SEQ ID NO: 3067933 - RNA, 15 nt, Mycobacterium bovis subsp bovis AF2122/97
gcgccgauacccagc

SEQ ID NO: 3067934 - RNA, 16 nt, Mycobacterium bovis subsp bovis AF2122/97
gcgccgauacccagcg

SEQ ID NO: 3067935 - RNA, 23 nt, Mycobacterium bovis subsp bovis AF2122/97
gcgccgauacccagcgggucgcg

SEQ ID NO: 3067936 - RNA, 17 nt, Mycobacterium bovis subsp bovis AF2122/97
gcgccgauaccggcggc

SEQ ID NO: 3067937 - RNA, 19 nt, Mycobacterium bovis subsp bovis AF2122/97
gcgccgauaccggcggcga

SEQ ID NO: 3067938 - RNA, 21 nt, Mycobacterium bovis subsp bovis AF2122/97
gcgccgauaccggcggcgagc

SEQ ID NO: 3067939 - RNA, 17 nt, Mycobacterium bovis subsp bovis AF2122/97
gcgccgaucaccaccgg

SEQ ID NO: 3067940 - RNA, 18 nt, Mycobacterium bovis subsp bovis AF2122/97
gcgccgaucaccaccggc

SEQ ID NO: 3067941 - RNA, 18 nt, Mycobacterium bovis subsp bovis AF2122/97
gcgccgaucacggcaccg

SEQ ID NO: 3067942 - RNA, 18 nt, Mycobacterium bovis subsp bovis AF2122/97
gcgccgaucacggugggc

SEQ ID NO: 3067943 - RNA, 22 nt, Mycobacterium bovis subsp bovis AF2122/97
gcgccgaucacggugggcgccg

SEQ ID NO: 3067944 - RNA, 13 nt, Mycobacterium bovis subsp bovis AF2122/97
gcgccgaucggca

SEQ ID NO: 3067945 - RNA, 23 nt, Mycobacterium bovis subsp bovis AF2122/97
gcgccgccguuaccgccggcgcc

SEQ ID NO: 3067946 - RNA, 17 nt, Mycobacterium bovis subsp bovis AF2122/97
gcgccgccguucccgcc

SEQ ID NO: 3067947 - RNA, 19 nt, Mycobacterium bovis subsp bovis AF2122/97
gcgccgccguucccgccgg

SEQ ID NO: 3067948 - RNA, 12 nt, Mycobacterium bovis subsp bovis AF2122/97
gcgccgccguug

SEQ ID NO: 3067949 - RNA, 22 nt, Mycobacterium bovis subsp bovis AF2122/97
gcgccgccuggacgccgccgga

SEQ ID NO: 3067950 - RNA, 20 nt, Mycobacterium bovis subsp bovis AF2122/97
gcgccgcgacaaaucggucg

SEQ ID NO: 3067951 - RNA, 15 nt, Mycobacterium bovis subsp bovis AF2122/97
gcgccgcgaggcacc

SEQ ID NO: 3067952 - RNA, 16 nt, Mycobacterium bovis subsp bovis AF2122/97
gcgccgcgaggcaccg

SEQ ID NO: 3067953 - RNA, 16 nt, Mycobacterium bovis subsp bovis AF2122/97
gcgccgcgcagcgagg

SEQ ID NO: 3067954 - RNA, 17 nt, Mycobacterium bovis subsp bovis AF2122/97
gcgccgcgcagcgagga

SEQ ID NO: 3067955 - RNA, 14 nt, Mycobacterium bovis subsp bovis AF2122/97
gcgccgcgcaucgc

SEQ ID NO: 3067956 - RNA, 13 nt, Mycobacterium bovis subsp bovis AF2122/97
gcgccgcgcccac

SEQ ID NO: 3067957 - RNA, 14 nt, Mycobacterium bovis subsp bovis AF2122/97
gcgccgcgcccacc

SEQ ID NO: 3067958 - RNA, 16 nt, Mycobacterium bovis subsp bovis AF2122/97
gcgccgcgcccaccau

SEQ ID NO: 3067959 - RNA, 17 nt, Mycobacterium bovis subsp bovis AF2122/97
gcgccgcgcccaccaug

SEQ ID NO: 3067960 - RNA, 17 nt, Mycobacterium bovis subsp bovis AF2122/97
gcgccgcgccgcgccgc

SEQ ID NO: 3067961 - RNA, 13 nt, Mycobacterium bovis subsp bovis AF2122/97
gcgccgcgcgcgc

SEQ ID NO: 3067962 - RNA, 13 nt, Mycobacterium bovis subsp bovis AF2122/97
gcgccgcgcggcu

SEQ ID NO: 3067963 - RNA, 15 nt, Mycobacterium bovis subsp bovis AF2122/97
gcgccgcgcggcuug

SEQ ID NO: 3067964 - RNA, 21 nt, Mycobacterium bovis subsp bovis AF2122/97
gcgccgcgcuugcgaucggca

SEQ ID NO: 3067965 - RNA, 15 nt, Mycobacterium bovis subsp bovis AF2122/97
gcgccgcggcccgcu

SEQ ID NO: 3067966 - RNA, 16 nt, Mycobacterium bovis subsp bovis AF2122/97
gcgccgcggcccgcuc

SEQ ID NO: 3067967 - RNA, 12 nt, Mycobacterium bovis subsp bovis AF2122/97
gcgccgcggcga

SEQ ID NO: 3067968 - RNA, 13 nt, Mycobacterium bovis subsp bovis AF2122/97
gcgccgcggcgac

SEQ ID NO: 3067969 - RNA, 12 nt, Mycobacterium bovis subsp bovis AF2122/97
gcgccgcggcgg

SEQ ID NO: 3067970 - RNA, 18 nt, Mycobacterium bovis subsp bovis AF2122/97
gcgccgcggcggauggcg

SEQ ID NO: 3067971 - RNA, 20 nt, Mycobacterium bovis subsp bovis AF2122/97
gcgccgcggcuacaucggcg

SEQ ID NO: 3067972 - RNA, 14 nt, Mycobacterium bovis subsp bovis AF2122/97
gcgccgcggcuggg

SEQ ID NO: 3067973 - RNA, 21 nt, Mycobacterium bovis subsp bovis AF2122/97
gcgccgcguggcuggcggcga

SEQ ID NO: 3067974 - RNA, 17 nt, Mycobacterium bovis subsp bovis AF2122/97
gcgccgcuaaccggacc

SEQ ID NO: 3067975 - RNA, 16 nt, Mycobacterium bovis subsp bovis AF2122/97
gcgccgcuaggugacg

SEQ ID NO: 3067976 - RNA, 18 nt, Mycobacterium bovis subsp bovis AF2122/97
gcgccgcugacuccugcg

SEQ ID NO: 3067977 - RNA, 19 nt, Mycobacterium bovis subsp bovis AF2122/97
gcgccgcugggugaccagg

SEQ ID NO: 3067978 - RNA, 21 nt, Mycobacterium bovis subsp bovis AF2122/97
gcgccgcugggugaccaggaa

SEQ ID NO: 3067979 - RNA, 22 nt, Mycobacterium bovis subsp bovis AF2122/97
gcgccggaaccccucgauuccc

SEQ ID NO: 3067980 - RNA, 17 nt, Mycobacterium bovis subsp bovis AF2122/97
gcgccggaacgagcggc

SEQ ID NO: 3067981 - RNA, 20 nt, Mycobacterium bovis subsp bovis AF2122/97
gcgccggaacgagcggccgc

SEQ ID NO: 3067982 - RNA, 13 nt, Mycobacterium bovis subsp bovis AF2122/97
gcgccggacagcg

SEQ ID NO: 3067983 - RNA, 14 nt, Mycobacterium bovis subsp bovis AF2122/97
gcgccggacagcgc

SEQ ID NO: 3067984 - RNA, 14 nt, Mycobacterium bovis subsp bovis AF2122/97
gcgccggaccagcu

SEQ ID NO: 3067985 - RNA, 15 nt, Mycobacterium bovis subsp bovis AF2122/97
gcgccggaccagcuc

SEQ ID NO: 3067986 - RNA, 17 nt, Mycobacterium bovis subsp bovis AF2122/97
gcgccggaccgucuuug

SEQ ID NO: 3067987 - RNA, 23 nt, Mycobacterium bovis subsp bovis AF2122/97
gcgccggaccgucuuuggugccg

SEQ ID NO: 3067988 - RNA, 16 nt, Mycobacterium bovis subsp bovis AF2122/97
gcgccggagaucgucg

SEQ ID NO: 3067989 - RNA, 16 nt, Mycobacterium bovis subsp bovis AF2122/97
gcgccggagccgccca

SEQ ID NO: 3067990 - RNA, 19 nt, Mycobacterium bovis subsp bovis AF2122/97
gcgccggagccgcccaagc

SEQ ID NO: 3067991 - RNA, 23 nt, Mycobacterium bovis subsp bovis AF2122/97
gcgccggagccgcccaagccgcc

SEQ ID NO: 3067992 - RNA, 14 nt, Mycobacterium bovis subsp bovis AF2122/97
gcgccggaggcggc

SEQ ID NO: 3067993 - RNA, 20 nt, Mycobacterium bovis subsp bovis AF2122/97
gcgccggaguugaagaagcc

SEQ ID NO: 3067994 - RNA, 17 nt, Mycobacterium bovis subsp bovis AF2122/97
gcgccggaguuucccuu

SEQ ID NO: 3067995 - RNA, 17 nt, Mycobacterium bovis subsp bovis AF2122/97
gcgccggauccacaccg

SEQ ID NO: 3067996 - RNA, 18 nt, Mycobacterium bovis subsp bovis AF2122/97
gcgccggauccacaccga

SEQ ID NO: 3067997 - RNA, 16 nt, Mycobacterium bovis subsp bovis AF2122/97
gcgccggaugacaccg

SEQ ID NO: 3067998 - RNA, 22 nt, Mycobacterium bovis subsp bovis AF2122/97
gcgccggaugacaccgaccggg

SEQ ID NO: 3067999 - RNA, 12 nt, Mycobacterium bovis subsp bovis AF2122/97
gcgccggaugua

SEQ ID NO: 3068000 - RNA, 15 nt, Mycobacterium bovis subsp bovis AF2122/97
gcgccggcacgggcg

SEQ ID NO: 3068001 - RNA, 17 nt, Mycobacterium bovis subsp bovis AF2122/97
gcgccggcaucgacgua

SEQ ID NO: 3068002 - RNA, 13 nt, Mycobacterium bovis subsp bovis AF2122/97
gcgccggcaucgc

SEQ ID NO: 3068003 - RNA, 20 nt, Mycobacterium bovis subsp bovis AF2122/97
gcgccggcaucggucagcgc

SEQ ID NO: 3068004 - RNA, 20 nt, Mycobacterium bovis subsp bovis AF2122/97
gcgccggcaucuccaccguc

SEQ ID NO: 3068005 - RNA, 14 nt, Mycobacterium bovis subsp bovis AF2122/97
gcgccggccagcca

SEQ ID NO: 3068006 - RNA, 16 nt, Mycobacterium bovis subsp bovis AF2122/97
gcgccggccagccagc

SEQ ID NO: 3068007 - RNA, 17 nt, Mycobacterium bovis subsp bovis AF2122/97
gcgccggccagccagcg

SEQ ID NO: 3068008 - RNA, 18 nt, Mycobacterium bovis subsp bovis AF2122/97
gcgccggccagccagcga

SEQ ID NO: 3068009 - RNA, 14 nt, Mycobacterium bovis subsp bovis AF2122/97
gcgccggccaggcu

SEQ ID NO: 3068010 - RNA, 15 nt, Mycobacterium bovis subsp bovis AF2122/97
gcgccggccaugccu

SEQ ID NO: 3068011 - RNA, 13 nt, Mycobacterium bovis subsp bovis AF2122/97
gcgccggccccgg

SEQ ID NO: 3068012 - RNA, 13 nt, Mycobacterium bovis subsp bovis AF2122/97
gcgccggccgauc

SEQ ID NO: 3068013 - RNA, 15 nt, Mycobacterium bovis subsp bovis AF2122/97
gcgccggccgaucgg

SEQ ID NO: 3068014 - RNA, 17 nt, Mycobacterium bovis subsp bovis AF2122/97
gcgccggccgaucggcc

SEQ ID NO: 3068015 - RNA, 14 nt, Mycobacterium bovis subsp bovis AF2122/97
gcgccggccgcggc

SEQ ID NO: 3068016 - RNA, 14 nt, Mycobacterium bovis subsp bovis AF2122/97
gcgccggccgcugc

SEQ ID NO: 3068017 - RNA, 12 nt, Mycobacterium bovis subsp bovis AF2122/97
gcgccggccggc

SEQ ID NO: 3068018 - RNA, 13 nt, Mycobacterium bovis subsp bovis AF2122/97
gcgccggccggca

SEQ ID NO: 3068019 - RNA, 13 nt, Mycobacterium bovis subsp bovis AF2122/97
gcgccggccggcg

SEQ ID NO: 3068020 - RNA, 14 nt, Mycobacterium bovis subsp bovis AF2122/97
gcgccggccggcgc

SEQ ID NO: 3068021 - RNA, 12 nt, Mycobacterium bovis subsp bovis AF2122/97
gcgccggcgccc

SEQ ID NO: 3068022 - RNA, 20 nt, Mycobacterium bovis subsp bovis AF2122/97
gcgccggcgcgucggcaccg

SEQ ID NO: 3068023 - RNA, 22 nt, Mycobacterium bovis subsp bovis AF2122/97
gcgccggcgcgucggcaccgau

SEQ ID NO: 3068024 - RNA, 13 nt, Mycobacterium bovis subsp bovis AF2122/97
gcgccggcgcugc

SEQ ID NO: 3068025 - RNA, 14 nt, Mycobacterium bovis subsp bovis AF2122/97
gcgccggcgcugcu

SEQ ID NO: 3068026 - RNA, 15 nt, Mycobacterium bovis subsp bovis AF2122/97
gcgccggcgcugcug

SEQ ID NO: 3068027 - RNA, 24 nt, Mycobacterium bovis subsp bovis AF2122/97
gcgccggcggaccccucgaccgau

SEQ ID NO: 3068028 - RNA, 12 nt, Mycobacterium bovis subsp bovis AF2122/97
gcgccggcggca

SEQ ID NO: 3068029 - RNA, 15 nt, Mycobacterium bovis subsp bovis AF2122/97
gcgccggcggccgcg

SEQ ID NO: 3068030 - RNA, 13 nt, Mycobacterium bovis subsp bovis AF2122/97
gcgccggcgggcg

SEQ ID NO: 3068031 - RNA, 14 nt, Mycobacterium bovis subsp bovis AF2122/97
gcgccggcgggcgc

SEQ ID NO: 3068032 - RNA, 16 nt, Mycobacterium bovis subsp bovis AF2122/97
gcgccggcgggcgcgg

SEQ ID NO: 3068033 - RNA, 13 nt, Mycobacterium bovis subsp bovis AF2122/97
gcgccgugaccca

SEQ ID NO: 3068034 - RNA, 14 nt, Mycobacterium bovis subsp bovis AF2122/97
gcgccgugacccau

SEQ ID NO: 3068035 - RNA, 22 nt, Mycobacterium bovis subsp bovis AF2122/97
gcgccgugaucagcucgcgcac

SEQ ID NO: 3068036 - RNA, 21 nt, Mycobacterium bovis subsp bovis AF2122/97
gcgccguggacgaucaacccg

SEQ ID NO: 3068037 - RNA, 21 nt, Mycobacterium bovis subsp bovis AF2122/97
gcgccguggaucaucccgacc

SEQ ID NO: 3068038 - RNA, 15 nt, Mycobacterium bovis subsp bovis AF2122/97
gcgccguggcgcggu

SEQ ID NO: 3068039 - RNA, 14 nt, Mycobacterium bovis subsp bovis AF2122/97
gcgccguggcgucg

SEQ ID NO: 3068040 - RNA, 15 nt, Mycobacterium bovis subsp bovis AF2122/97
gcgccguggcgucgg

SEQ ID NO: 3068041 - RNA, 18 nt, Mycobacterium bovis subsp bovis AF2122/97
gcgccguggcgucggugg

SEQ ID NO: 3068042 - RNA, 12 nt, Mycobacterium bovis subsp bovis AF2122/97
gcgccgugucac

SEQ ID NO: 3068043 - RNA, 20 nt, Mycobacterium bovis subsp bovis AF2122/97
gcgccgugucaccgggugca

SEQ ID NO: 3068044 - RNA, 16 nt, Mycobacterium bovis subsp bovis AF2122/97
gcgccguuagcgucgc

SEQ ID NO: 3068045 - RNA, 19 nt, Mycobacterium bovis subsp bovis AF2122/97
gcgccguuagcgucgccuu

SEQ ID NO: 3068046 - RNA, 21 nt, Mycobacterium bovis subsp bovis AF2122/97
gcgccguucacccuggugguc

SEQ ID NO: 3068047 - RNA, 20 nt, Mycobacterium bovis subsp bovis AF2122/97
gcgccguucgccuggucacc

SEQ ID NO: 3068048 - RNA, 21 nt, Mycobacterium bovis subsp bovis AF2122/97
gcgccguucgccuggucaccg

SEQ ID NO: 3068049 - RNA, 16 nt, Mycobacterium bovis subsp bovis AF2122/97
gcgccguugccaccgu

SEQ ID NO: 3068050 - RNA, 16 nt, Mycobacterium bovis subsp bovis AF2122/97
gcgccguugcccccgu

SEQ ID NO: 3068051 - RNA, 13 nt, Mycobacterium bovis subsp bovis AF2122/97
gcgccguugccgc

SEQ ID NO: 3068052 - RNA, 15 nt, Mycobacterium bovis subsp bovis AF2122/97
gcgccguugccgccg

SEQ ID NO: 3068053 - RNA, 16 nt, Mycobacterium bovis subsp bovis AF2122/97
gcgccguugccgccgu

SEQ ID NO: 3068054 - RNA, 19 nt, Mycobacterium bovis subsp bovis AF2122/97
gcgccguugccgccgucgc

SEQ ID NO: 3068055 - RNA, 18 nt, Mycobacterium bovis subsp bovis AF2122/97
gcgccguugccggccacc

SEQ ID NO: 3068056 - RNA, 16 nt, Mycobacterium bovis subsp bovis AF2122/97
gcgccguugucggcgg

SEQ ID NO: 3068057 - RNA, 18 nt, Mycobacterium bovis subsp bovis AF2122/97
gcgccguugucggcggug

SEQ ID NO: 3068058 - RNA, 20 nt, Mycobacterium bovis subsp bovis AF2122/97
gcgccuaaagacucgaccaa

SEQ ID NO: 3068059 - RNA, 19 nt, Mycobacterium bovis subsp bovis AF2122/97
gcgccuaaccccggcucga

SEQ ID NO: 3068060 - RNA, 21 nt, Mycobacterium bovis subsp bovis AF2122/97
gcgccuaaccccggcucgacg

SEQ ID NO: 3068061 - RNA, 15 nt, Mycobacterium bovis subsp bovis AF2122/97
gcgccuacaccggcg

SEQ ID NO: 3068062 - RNA, 15 nt, Mycobacterium bovis subsp bovis AF2122/97
gcgccuaccagcacc

SEQ ID NO: 3068063 - RNA, 13 nt, Mycobacterium bovis subsp bovis AF2122/97
gcgccuacccuuc

SEQ ID NO: 3068064 - RNA, 17 nt, Mycobacterium bovis subsp bovis AF2122/97
gcgccucaagcucgccg

SEQ ID NO: 3068065 - RNA, 17 nt, Mycobacterium bovis subsp bovis AF2122/97
gcgccucauccuccagu

SEQ ID NO: 3068066 - RNA, 19 nt, Mycobacterium bovis subsp bovis AF2122/97
gcgccucaucggacagcgc

SEQ ID NO: 3068067 - RNA, 20 nt, Mycobacterium bovis subsp bovis AF2122/97
gcgccucaucggacagcgcc

SEQ ID NO: 3068068 - RNA, 14 nt, Mycobacterium bovis subsp bovis AF2122/97
gcgccuccacucuu

SEQ ID NO: 3068069 - RNA, 19 nt, Mycobacterium bovis subsp bovis AF2122/97
gcgccuccagcaccacggc

SEQ ID NO: 3068070 - RNA, 20 nt, Mycobacterium bovis subsp bovis AF2122/97
gcgccuccagcaccacggcg

SEQ ID NO: 3068071 - RNA, 21 nt, Mycobacterium bovis subsp bovis AF2122/97
gcgccuccagcaccacggcgc

SEQ ID NO: 3068072 - RNA, 15 nt, Mycobacterium bovis subsp bovis AF2122/97
gcgccucgccggcca

SEQ ID NO: 3068073 - RNA, 17 nt, Mycobacterium bovis subsp bovis AF2122/97
gcgccucgccggccacc

SEQ ID NO: 3068074 - RNA, 19 nt, Mycobacterium bovis subsp bovis AF2122/97
gcgccucgccggccacccg

SEQ ID NO: 3068075 - RNA, 14 nt, Mycobacterium bovis subsp bovis AF2122/97
gcgccucggcaucg

SEQ ID NO: 3068076 - RNA, 15 nt, Mycobacterium bovis subsp bovis AF2122/97
gcgccucggcaucgc

SEQ ID NO: 3068077 - RNA, 17 nt, Mycobacterium bovis subsp bovis AF2122/97
gcgccucgggaggcagc

SEQ ID NO: 3068078 - RNA, 21 nt, Mycobacterium bovis subsp bovis AF2122/97
gcgccucgggaggcagcgcga

SEQ ID NO: 3068079 - RNA, 12 nt, Mycobacterium bovis subsp bovis AF2122/97
gcgccucggugg

SEQ ID NO: 3068080 - RNA, 15 nt, Mycobacterium bovis subsp bovis AF2122/97
gcgccucgugcgugg

SEQ ID NO: 3068081 - RNA, 23 nt, Mycobacterium bovis subsp bovis AF2122/97
gcgccucgugcgugggcgcggcg

SEQ ID NO: 3068082 - RNA, 19 nt, Mycobacterium bovis subsp bovis AF2122/97
gcgccugaauaggucgguc

SEQ ID NO: 3068083 - RNA, 14 nt, Mycobacterium bovis subsp bovis AF2122/97
gcgccugacucauc

SEQ ID NO: 3068084 - RNA, 15 nt, Mycobacterium bovis subsp bovis AF2122/97
gcgccugagcggccu

SEQ ID NO: 3068085 - RNA, 17 nt, Mycobacterium bovis subsp bovis AF2122/97
gcgccugagcggccucg

SEQ ID NO: 3068086 - RNA, 17 nt, Mycobacterium bovis subsp bovis AF2122/97
gcgccugaugcggccgg

SEQ ID NO: 3068087 - RNA, 18 nt, Mycobacterium bovis subsp bovis AF2122/97
gcgccugaugcggccggc

SEQ ID NO: 3068088 - RNA, 20 nt, Mycobacterium bovis subsp bovis AF2122/97
gcgccugaugcggccggcgc

SEQ ID NO: 3068089 - RNA, 13 nt, Mycobacterium bovis subsp bovis AF2122/97
gcgccugcccggg

SEQ ID NO: 3068090 - RNA, 14 nt, Mycobacterium bovis subsp bovis AF2122/97
gcgccugcgccacc

SEQ ID NO: 3068091 - RNA, 13 nt, Mycobacterium bovis subsp bovis AF2122/97
gcgccugcguucc

SEQ ID NO: 3068092 - RNA, 17 nt, Mycobacterium bovis subsp bovis AF2122/97
gcgccuggagcgaucuc

SEQ ID NO: 3068093 - RNA, 16 nt, Mycobacterium bovis subsp bovis AF2122/97
gcgccuggcggcgccg

SEQ ID NO: 3068094 - RNA, 21 nt, Mycobacterium bovis subsp bovis AF2122/97
gcgccugguccucacggguca

SEQ ID NO: 3068095 - RNA, 18 nt, Mycobacterium bovis subsp bovis AF2122/97
gcgccuucaccuggugug

SEQ ID NO: 3068096 - RNA, 16 nt, Mycobacterium bovis subsp bovis AF2122/97
gcgccuucacgcuggc

SEQ ID NO: 3068097 - RNA, 14 nt, Mycobacterium bovis subsp bovis AF2122/97
gcgccuucgccagc

SEQ ID NO: 3068098 - RNA, 17 nt, Mycobacterium bovis subsp bovis AF2122/97
gcgccuugaagcggugg

SEQ ID NO: 3068099 - RNA, 13 nt, Mycobacterium bovis subsp bovis AF2122/97
gcgccuugaccac

SEQ ID NO: 3068100 - RNA, 12 nt, Mycobacterium bovis subsp bovis AF2122/97
gcgccuugacgc

SEQ ID NO: 3068101 - RNA, 21 nt, Mycobacterium bovis subsp bovis AF2122/97
gcgccuugauggucuccacca

SEQ ID NO: 3068102 - RNA, 14 nt, Mycobacterium bovis subsp bovis AF2122/97
gcgccuugcgggcc

SEQ ID NO: 3068103 - RNA, 18 nt, Mycobacterium bovis subsp bovis AF2122/97
gcgccuugcgggccuggu

SEQ ID NO: 3068104 - RNA, 21 nt, Mycobacterium bovis subsp bovis AF2122/97
gcgccuugcgggccuggugga

SEQ ID NO: 3068105 - RNA, 17 nt, Mycobacterium bovis subsp bovis AF2122/97
gcgccuuggcacccucc

SEQ ID NO: 3068106 - RNA, 15 nt, Mycobacterium bovis subsp bovis AF2122/97
gcgccuuggucgccg

SEQ ID NO: 3068107 - RNA, 18 nt, Mycobacterium bovis subsp bovis AF2122/97
gcgccuuggucgccgccu

SEQ ID NO: 3068108 - RNA, 17 nt, Mycobacterium bovis subsp bovis AF2122/97
gcgccuuggucgccgcu

SEQ ID NO: 3068109 - RNA, 16 nt, Mycobacterium bovis subsp bovis AF2122/97
gcgccuuggucgccgg

SEQ ID NO: 3068110 - RNA, 18 nt, Mycobacterium bovis subsp bovis AF2122/97
gcgccuuggucgccggcg

SEQ ID NO: 3068111 - RNA, 18 nt, Mycobacterium bovis subsp bovis AF2122/97
gcgccuuguggcacaccc

SEQ ID NO: 3068112 - RNA, 22 nt, Mycobacterium bovis subsp bovis AF2122/97
gcgccuuguggcacacccgcac

SEQ ID NO: 3068113 - RNA, 15 nt, Mycobacterium bovis subsp bovis AF2122/97
gcgccuuguuggcga

SEQ ID NO: 3068114 - RNA, 16 nt, Mycobacterium bovis subsp bovis AF2122/97
gcgccuuucgucgaag

SEQ ID NO: 3068115 - RNA, 23 nt, Mycobacterium bovis subsp bovis AF2122/97
gcgccuuugagcccgcgaucacc

SEQ ID NO: 3068116 - RNA, 16 nt, Mycobacterium bovis subsp bovis AF2122/97
gcgccuuuggcgguga

SEQ ID NO: 3068117 - RNA, 20 nt, Mycobacterium bovis subsp bovis AF2122/97
gcgcgaaaccaguccaucga

SEQ ID NO: 3068118 - RNA, 18 nt, Mycobacterium bovis subsp bovis AF2122/97
gcgcgaaacgccgcaaug

SEQ ID NO: 3068119 - RNA, 22 nt, Mycobacterium bovis subsp bovis AF2122/97
gcgcgaacacccgaagccggcg

SEQ ID NO: 3068120 - RNA, 19 nt, Mycobacterium bovis subsp bovis AF2122/97
gcgcgcaacccugccgcga

SEQ ID NO: 3068121 - RNA, 22 nt, Mycobacterium bovis subsp bovis AF2122/97
gcgcgcaacccugccgcgauga

SEQ ID NO: 3068122 - RNA, 13 nt, Mycobacterium bovis subsp bovis AF2122/97
gcgcgcaaccgcu

SEQ ID NO: 3068123 - RNA, 15 nt, Mycobacterium bovis subsp bovis AF2122/97
gcgcgcaaccgcuca

SEQ ID NO: 3068124 - RNA, 18 nt, Mycobacterium bovis subsp bovis AF2122/97
gcgcgcaaccgcucaucg

SEQ ID NO: 3068125 - RNA, 16 nt, Mycobacterium bovis subsp bovis AF2122/97
gcgcgcaacgcuggag

SEQ ID NO: 3068126 - RNA, 15 nt, Mycobacterium bovis subsp bovis AF2122/97
gcgcgcaacguacgc

SEQ ID NO: 3068127 - RNA, 19 nt, Mycobacterium bovis subsp bovis AF2122/97
gcgcgcaacguacgcacgc

SEQ ID NO: 3068128 - RNA, 21 nt, Mycobacterium bovis subsp bovis AF2122/97
gcgcgcaacguagccagcagc

SEQ ID NO: 3068129 - RNA, 22 nt, Mycobacterium bovis subsp bovis AF2122/97
gcgcgcaacguagccagcagcg

SEQ ID NO: 3068130 - RNA, 22 nt, Mycobacterium bovis subsp bovis AF2122/97
gcgcgcaagugcuggccgaaga

SEQ ID NO: 3068131 - RNA, 18 nt, Mycobacterium bovis subsp bovis AF2122/97
gcgcgcaauccugcggga

SEQ ID NO: 3068132 - RNA, 21 nt, Mycobacterium bovis subsp bovis AF2122/97
gcgcgcaaucgugguucggcg

SEQ ID NO: 3068133 - RNA, 14 nt, Mycobacterium bovis subsp bovis AF2122/97
gcgcgcaccaccgc

SEQ ID NO: 3068134 - RNA, 12 nt, Mycobacterium bovis subsp bovis AF2122/97
gcgcgcaccccg

SEQ ID NO: 3068135 - RNA, 22 nt, Mycobacterium bovis subsp bovis AF2122/97
gcgcgcaccggguugagccgcc

SEQ ID NO: 3068136 - RNA, 23 nt, Mycobacterium bovis subsp bovis AF2122/97
gcgcgcaccggguugagccgccg

SEQ ID NO: 3068137 - RNA, 16 nt, Mycobacterium bovis subsp bovis AF2122/97
gcgcgcacgccaccgg

SEQ ID NO: 3068138 - RNA, 16 nt, Mycobacterium bovis subsp bovis AF2122/97
gcgcgcacggcgucgg

SEQ ID NO: 3068139 - RNA, 17 nt, Mycobacterium bovis subsp bovis AF2122/97
gcgcgcacggcgucggc

SEQ ID NO: 3068140 - RNA, 18 nt, Mycobacterium bovis subsp bovis AF2122/97
gcgcgcagaucguccacc

SEQ ID NO: 3068141 - RNA, 13 nt, Mycobacterium bovis subsp bovis AF2122/97
gcgcgcagccggg

SEQ ID NO: 3068142 - RNA, 18 nt, Mycobacterium bovis subsp bovis AF2122/97
gcgcgcagccgggcaccg

SEQ ID NO: 3068143 - RNA, 16 nt, Mycobacterium bovis subsp bovis AF2122/97
gcgcgcagccgggcca

SEQ ID NO: 3068144 - RNA, 15 nt, Mycobacterium bovis subsp bovis AF2122/97
gcgcgcagcgauucg

SEQ ID NO: 3068145 - RNA, 16 nt, Mycobacterium bovis subsp bovis AF2122/97
gcgcgcaggccgccgc

SEQ ID NO: 3068146 - RNA, 18 nt, Mycobacterium bovis subsp bovis AF2122/97
gcgcgcaggccgccgcca

SEQ ID NO: 3068147 - RNA, 15 nt, Mycobacterium bovis subsp bovis AF2122/97
gcgcgcagggcgucg

SEQ ID NO: 3068148 - RNA, 20 nt, Mycobacterium bovis subsp bovis AF2122/97
gcgcgcauaccuacccgaga

SEQ ID NO: 3068149 - RNA, 17 nt, Mycobacterium bovis subsp bovis AF2122/97
gcgcgcauagggcuggu

SEQ ID NO: 3068150 - RNA, 15 nt, Mycobacterium bovis subsp bovis AF2122/97
gcgcgcaucugcucg

SEQ ID NO: 3068151 - RNA, 20 nt, Mycobacterium bovis subsp bovis AF2122/97
gcgcgcauuuuucgccagcu

SEQ ID NO: 3068152 - RNA, 13 nt, Mycobacterium bovis subsp bovis AF2122/97
gcgcgccaacacc

SEQ ID NO: 3068153 - RNA, 16 nt, Mycobacterium bovis subsp bovis AF2122/97
gcgcgccaaucgccca

SEQ ID NO: 3068154 - RNA, 13 nt, Mycobacterium bovis subsp bovis AF2122/97
gcgcgccacgagc

SEQ ID NO: 3068155 - RNA, 13 nt, Mycobacterium bovis subsp bovis AF2122/97
gcgcgccagcucg

SEQ ID NO: 3068156 - RNA, 14 nt, Mycobacterium bovis subsp bovis AF2122/97
gcgcgccagcucgg

SEQ ID NO: 3068157 - RNA, 17 nt, Mycobacterium bovis subsp bovis AF2122/97
gcgcgccagcucggcgg

SEQ ID NO: 3068158 - RNA, 20 nt, Mycobacterium bovis subsp bovis AF2122/97
gcgcgccagcucggcggcag

SEQ ID NO: 3068159 - RNA, 23 nt, Mycobacterium bovis subsp bovis AF2122/97
gcgcgccagcuugucgggcaccg

SEQ ID NO: 3068160 - RNA, 15 nt, Mycobacterium bovis subsp bovis AF2122/97
gcgcgccaggcucga

SEQ ID NO: 3068161 - RNA, 18 nt, Mycobacterium bovis subsp bovis AF2122/97
gcgcgccaggcucgaugu

SEQ ID NO: 3068162 - RNA, 15 nt, Mycobacterium bovis subsp bovis AF2122/97
gcgcgccauuggcgc

SEQ ID NO: 3068163 - RNA, 21 nt, Mycobacterium bovis subsp bovis AF2122/97
gcgcgccauuggcgccgccga

SEQ ID NO: 3068164 - RNA, 19 nt, Mycobacterium bovis subsp bovis AF2122/97
gcgcgccauuggcgguggu

SEQ ID NO: 3068165 - RNA, 20 nt, Mycobacterium bovis subsp bovis AF2122/97
gcgcgcccacagcccgggcg

SEQ ID NO: 3068166 - RNA, 22 nt, Mycobacterium bovis subsp bovis AF2122/97
gcgcgcccacagcccgggcgga

SEQ ID NO: 3068167 - RNA, 19 nt, Mycobacterium bovis subsp bovis AF2122/97
gcgcgcccaccgggcggcg

SEQ ID NO: 3068168 - RNA, 20 nt, Mycobacterium bovis subsp bovis AF2122/97
gcgcgcccaccgggcggcgg

SEQ ID NO: 3068169 - RNA, 13 nt, Mycobacterium bovis subsp bovis AF2122/97
gcgcgccccaccg

SEQ ID NO: 3068170 - RNA, 17 nt, Mycobacterium bovis subsp bovis AF2122/97
gcgcgccccaccgcgcc

SEQ ID NO: 3068171 - RNA, 21 nt, Mycobacterium bovis subsp bovis AF2122/97
gcgcgccccaccgcgccgagc

SEQ ID NO: 3068172 - RNA, 15 nt, Mycobacterium bovis subsp bovis AF2122/97
gcgcgccccgccgca

SEQ ID NO: 3068173 - RNA, 16 nt, Mycobacterium bovis subsp bovis AF2122/97
gcgcgccccgccgcac

SEQ ID NO: 3068174 - RNA, 12 nt, Mycobacterium bovis subsp bovis AF2122/97
gcgcgcccgaau

SEQ ID NO: 3068175 - RNA, 12 nt, Mycobacterium bovis subsp bovis AF2122/97
gcgcgcccgcgg

SEQ ID NO: 3068176 - RNA, 20 nt, Mycobacterium bovis subsp bovis AF2122/97
gcgcgcccggaucucggcgu

SEQ ID NO: 3068177 - RNA, 14 nt, Mycobacterium bovis subsp bovis AF2122/97
gcgcgcccgggcgg

SEQ ID NO: 3068178 - RNA, 14 nt, Mycobacterium bovis subsp bovis AF2122/97
gcgcgccgaccacc

SEQ ID NO: 3068179 - RNA, 15 nt, Mycobacterium bovis subsp bovis AF2122/97
gcgcgccgaccaccg

SEQ ID NO: 3068180 - RNA, 16 nt, Mycobacterium bovis subsp bovis AF2122/97
gcgcgccgaccaccgc

SEQ ID NO: 3068181 - RNA, 14 nt, Mycobacterium bovis subsp bovis AF2122/97
gcgcgccgagcccg

SEQ ID NO: 3068182 - RNA, 16 nt, Mycobacterium bovis subsp bovis AF2122/97
gcgcgccgaucggcac

SEQ ID NO: 3068183 - RNA, 14 nt, Mycobacterium bovis subsp bovis AF2122/97
gcgcgccgcgcucg

SEQ ID NO: 3068184 - RNA, 13 nt, Mycobacterium bovis subsp bovis AF2122/97
gcgcgccggcgac

SEQ ID NO: 3068185 - RNA, 12 nt, Mycobacterium bovis subsp bovis AF2122/97
gcgcgccggcgg

SEQ ID NO: 3068186 - RNA, 13 nt, Mycobacterium bovis subsp bovis AF2122/97
gcgcgccggcggu

SEQ ID NO: 3068187 - RNA, 15 nt, Mycobacterium bovis subsp bovis AF2122/97
gcgcgccggcgguag

SEQ ID NO: 3068188 - RNA, 14 nt, Mycobacterium bovis subsp bovis AF2122/97
gcgcgccggcgucg

SEQ ID NO: 3068189 - RNA, 15 nt, Mycobacterium bovis subsp bovis AF2122/97
gcgcgccggcgucgg

SEQ ID NO: 3068190 - RNA, 11 nt, Mycobacterium bovis subsp bovis AF2122/97
gcgcgccggcu

SEQ ID NO: 3068191 - RNA, 14 nt, Mycobacterium bovis subsp bovis AF2122/97
gcgcgccggcugcc

SEQ ID NO: 3068192 - RNA, 15 nt, Mycobacterium bovis subsp bovis AF2122/97
gcgcgccggcugcca

SEQ ID NO: 3068193 - RNA, 18 nt, Mycobacterium bovis subsp bovis AF2122/97
gcgcgccggucgccgacg

SEQ ID NO: 3068194 - RNA, 13 nt, Mycobacterium bovis subsp bovis AF2122/97
gcgcgccggugcu

SEQ ID NO: 3068195 - RNA, 21 nt, Mycobacterium bovis subsp bovis AF2122/97
gcgcgccguagaccagcaggc

SEQ ID NO: 3068196 - RNA, 22 nt, Mycobacterium bovis subsp bovis AF2122/97
gcgcgccguagaccagcaggcc

SEQ ID NO: 3068197 - RNA, 14 nt, Mycobacterium bovis subsp bovis AF2122/97
gcgcgccgucgggu

SEQ ID NO: 3068198 - RNA, 12 nt, Mycobacterium bovis subsp bovis AF2122/97
gcgcgccguuca

SEQ ID NO: 3068199 - RNA, 15 nt, Mycobacterium bovis subsp bovis AF2122/97
gcgcgccguucaccc

SEQ ID NO: 3068200 - RNA, 21 nt, Mycobacterium bovis subsp bovis AF2122/97
gcgcgccguugccgcccacgc

SEQ ID NO: 3068201 - RNA, 20 nt, Mycobacterium bovis subsp bovis AF2122/97
gcgcgccuaugggccugcga

SEQ ID NO: 3068202 - RNA, 16 nt, Mycobacterium bovis subsp bovis AF2122/97
gcgcgccucgcccagc

SEQ ID NO: 3068203 - RNA, 17 nt, Mycobacterium bovis subsp bovis AF2122/97
gcgcgccucgcccagca

SEQ ID NO: 3068204 - RNA, 12 nt, Mycobacterium bovis subsp bovis AF2122/97
gcgcgccugcgc

SEQ ID NO: 3068205 - RNA, 13 nt, Mycobacterium bovis subsp bovis AF2122/97
gcgcgccugcgcc

SEQ ID NO: 3068206 - RNA, 16 nt, Mycobacterium bovis subsp bovis AF2122/97
gcgcgccugugccacc

SEQ ID NO: 3068207 - RNA, 12 nt, Mycobacterium bovis subsp bovis AF2122/97
gcgcggccagca

SEQ ID NO: 3068208 - RNA, 14 nt, Mycobacterium bovis subsp bovis AF2122/97
gcgcggccagcagc

SEQ ID NO: 3068209 - RNA, 18 nt, Mycobacterium bovis subsp bovis AF2122/97
gcgcggccagcagcagau

SEQ ID NO: 3068210 - RNA, 13 nt, Mycobacterium bovis subsp bovis AF2122/97
gcgcggccagccc

SEQ ID NO: 3068211 - RNA, 17 nt, Mycobacterium bovis subsp bovis AF2122/97
gcgcggcccagguccgc

SEQ ID NO: 3068212 - RNA, 15 nt, Mycobacterium bovis subsp bovis AF2122/97
gcgcggcccgccgag

SEQ ID NO: 3068213 - RNA, 16 nt, Mycobacterium bovis subsp bovis AF2122/97
gcgcggcccgccgagu

SEQ ID NO: 3068214 - RNA, 21 nt, Mycobacterium bovis subsp bovis AF2122/97
gcgcggcccgccucggcggcg

SEQ ID NO: 3068215 - RNA, 21 nt, Mycobacterium bovis subsp bovis AF2122/97
gcgcggccgcaagccgcgagu

SEQ ID NO: 3068216 - RNA, 13 nt, Mycobacterium bovis subsp bovis AF2122/97
gcgcggccgcagc

SEQ ID NO: 3068217 - RNA, 14 nt, Mycobacterium bovis subsp bovis AF2122/97
gcgcggccgcagcc

SEQ ID NO: 3068218 - RNA, 14 nt, Mycobacterium bovis subsp bovis AF2122/97
gcgcggccgcgcug

SEQ ID NO: 3068219 - RNA, 14 nt, Mycobacterium bovis subsp bovis AF2122/97
gcgcggccggcacg

SEQ ID NO: 3068220 - RNA, 22 nt, Mycobacterium bovis subsp bovis AF2122/97
gcgcggccggcacgaccgcucc

SEQ ID NO: 3068221 - RNA, 15 nt, Mycobacterium bovis subsp bovis AF2122/97
gcgcggccggccgcu

SEQ ID NO: 3068222 - RNA, 13 nt, Mycobacterium bovis subsp bovis AF2122/97
gcgcggccgggcg

SEQ ID NO: 3068223 - RNA, 14 nt, Mycobacterium bovis subsp bovis AF2122/97
gcgcggccgggcgc

SEQ ID NO: 3068224 - RNA, 22 nt, Mycobacterium bovis subsp bovis AF2122/97
gcgcggccguagugcacgucgg

SEQ ID NO: 3068225 - RNA, 23 nt, Mycobacterium bovis subsp bovis AF2122/97
gcgcggccguagugcacgucggc

SEQ ID NO: 3068226 - RNA, 18 nt, Mycobacterium bovis subsp bovis AF2122/97
gcgcggccgugaacggcg

SEQ ID NO: 3068227 - RNA, 18 nt, Mycobacterium bovis subsp bovis AF2122/97
gcgcggccugcaccagcg

SEQ ID NO: 3068228 - RNA, 18 nt, Mycobacterium bovis subsp bovis AF2122/97
gcgcggcgaagccgggug

SEQ ID NO: 3068229 - RNA, 20 nt, Mycobacterium bovis subsp bovis AF2122/97
gcgcggcgaagccgggugcu

SEQ ID NO: 3068230 - RNA, 15 nt, Mycobacterium bovis subsp bovis AF2122/97
gcgcggcgacaucca

SEQ ID NO: 3068231 - RNA, 14 nt, Mycobacterium bovis subsp bovis AF2122/97
gcgcggcgaccugu

SEQ ID NO: 3068232 - RNA, 16 nt, Mycobacterium bovis subsp bovis AF2122/97
gcgcggcgacgacggc

SEQ ID NO: 3068233 - RNA, 21 nt, Mycobacterium bovis subsp bovis AF2122/97
gcgcggcgacgacggccugcg

SEQ ID NO: 3068234 - RNA, 12 nt, Mycobacterium bovis subsp bovis AF2122/97
gcgcggcgagca

SEQ ID NO: 3068235 - RNA, 14 nt, Mycobacterium bovis subsp bovis AF2122/97
gcgcggcgagcacg

SEQ ID NO: 3068236 - RNA, 11 nt, Mycobacterium bovis subsp bovis AF2122/97
gcgcggcgauc

SEQ ID NO: 3068237 - RNA, 13 nt, Mycobacterium bovis subsp bovis AF2122/97
gcgcggcgaucga

SEQ ID NO: 3068238 - RNA, 18 nt, Mycobacterium bovis subsp bovis AF2122/97
gcgcggcgaucgcuccgc

SEQ ID NO: 3068239 - RNA, 13 nt, Mycobacterium bovis subsp bovis AF2122/97
gcgcggcgcacaa

SEQ ID NO: 3068240 - RNA, 13 nt, Mycobacterium bovis subsp bovis AF2122/97
gcgcggcgcagca

SEQ ID NO: 3068241 - RNA, 16 nt, Mycobacterium bovis subsp bovis AF2122/97
gcgcggcgccgcaaug

SEQ ID NO: 3068242 - RNA, 15 nt, Mycobacterium bovis subsp bovis AF2122/97
gcgcggcgcgaucgu

SEQ ID NO: 3068243 - RNA, 17 nt, Mycobacterium bovis subsp bovis AF2122/97
gcgcggcgcgaucgucg

SEQ ID NO: 3068244 - RNA, 17 nt, Mycobacterium bovis subsp bovis AF2122/97
gcgcggcggccgcggcu

SEQ ID NO: 3068245 - RNA, 13 nt, Mycobacterium bovis subsp bovis AF2122/97
gcgcggcggcgcc

SEQ ID NO: 3068246 - RNA, 12 nt, Mycobacterium bovis subsp bovis AF2122/97
gcgcggcggcgg

SEQ ID NO: 3068247 - RNA, 21 nt, Mycobacterium bovis subsp bovis AF2122/97
gcgcggcggggguucgcucug

SEQ ID NO: 3068248 - RNA, 13 nt, Mycobacterium bovis subsp bovis AF2122/97
gcgcggcggucga

SEQ ID NO: 3068249 - RNA, 12 nt, Mycobacterium bovis subsp bovis AF2122/97
gcgcggcgucgc

SEQ ID NO: 3068250 - RNA, 16 nt, Mycobacterium bovis subsp bovis AF2122/97
gcgcggcgugcgcggu

SEQ ID NO: 3068251 - RNA, 23 nt, Mycobacterium bovis subsp bovis AF2122/97
gcgcggcguguacgucgaucagg

SEQ ID NO: 3068252 - RNA, 22 nt, Mycobacterium bovis subsp bovis AF2122/97
gcgcggcugugcccgaucagcc

SEQ ID NO: 3068253 - RNA, 23 nt, Mycobacterium bovis subsp bovis AF2122/97
gcgcggcuugggcuugcgccgga

SEQ ID NO: 3068254 - RNA, 19 nt, Mycobacterium bovis subsp bovis AF2122/97
gcgcggcuuguaccgcaau

SEQ ID NO: 3068255 - RNA, 19 nt, Mycobacterium bovis subsp bovis AF2122/97
gcgcgggauguaccccggc

SEQ ID NO: 3068256 - RNA, 14 nt, Mycobacterium bovis subsp bovis AF2122/97
gcgcgggccaccac

SEQ ID NO: 3068257 - RNA, 15 nt, Mycobacterium bovis subsp bovis AF2122/97
gcgcgggccaccacg

SEQ ID NO: 3068258 - RNA, 18 nt, Mycobacterium bovis subsp bovis AF2122/97
gcgcgggccaccacgcgc

SEQ ID NO: 3068259 - RNA, 15 nt, Mycobacterium bovis subsp bovis AF2122/97
gcgcgggccggcgac

SEQ ID NO: 3068260 - RNA, 16 nt, Mycobacterium bovis subsp bovis AF2122/97
gcgcgggccggcgacu

SEQ ID NO: 3068261 - RNA, 13 nt, Mycobacterium bovis subsp bovis AF2122/97
gcgcgggccuggc

SEQ ID NO: 3068262 - RNA, 16 nt, Mycobacterium bovis subsp bovis AF2122/97
gcgcgggccuggccca

SEQ ID NO: 3068263 - RNA, 14 nt, Mycobacterium bovis subsp bovis AF2122/97
gcgcgggcgacguc

SEQ ID NO: 3068264 - RNA, 14 nt, Mycobacterium bovis subsp bovis AF2122/97
gcgcgggcgccggg

SEQ ID NO: 3068265 - RNA, 15 nt, Mycobacterium bovis subsp bovis AF2122/97
gcgcgggcucggugg

SEQ ID NO: 3068266 - RNA, 19 nt, Mycobacterium bovis subsp bovis AF2122/97
gcgcgggcucgguggcgga

SEQ ID NO: 3068267 - RNA, 22 nt, Mycobacterium bovis subsp bovis AF2122/97
gcgcggggaucacaccccaggc

SEQ ID NO: 3068268 - RNA, 14 nt, Mycobacterium bovis subsp bovis AF2122/97
gcgcggggccgccg

SEQ ID NO: 3068269 - RNA, 15 nt, Mycobacterium bovis subsp bovis AF2122/97
gcgcggggccgccgc

SEQ ID NO: 3068270 - RNA, 19 nt, Mycobacterium bovis subsp bovis AF2122/97
gcgcggggccgccgcggcc

SEQ ID NO: 3068271 - RNA, 14 nt, Mycobacterium bovis subsp bovis AF2122/97
gcgcggggccucgc

SEQ ID NO: 3068272 - RNA, 13 nt, Mycobacterium bovis subsp bovis AF2122/97
gcgcggggcggcc

SEQ ID NO: 3068273 - RNA, 14 nt, Mycobacterium bovis subsp bovis AF2122/97
gcgcggggcggccu

SEQ ID NO: 3068274 - RNA, 15 nt, Mycobacterium bovis subsp bovis AF2122/97
gcgcggggcggccug

SEQ ID NO: 3068275 - RNA, 17 nt, Mycobacterium bovis subsp bovis AF2122/97
gcgcggggcggccugcc

SEQ ID NO: 3068276 - RNA, 15 nt, Mycobacterium bovis subsp bovis AF2122/97
gcgcgggggugggcg

SEQ ID NO: 3068277 - RNA, 15 nt, Mycobacterium bovis subsp bovis AF2122/97
gcgcggggugcgcgc

SEQ ID NO: 3068278 - RNA, 19 nt, Mycobacterium bovis subsp bovis AF2122/97
gcgcggggugcgcgcgacc

SEQ ID NO: 3068279 - RNA, 16 nt, Mycobacterium bovis subsp bovis AF2122/97
gcgcggguccagccac

SEQ ID NO: 3068280 - RNA, 17 nt, Mycobacterium bovis subsp bovis AF2122/97
gcgcggguccagccacc

SEQ ID NO: 3068281 - RNA, 16 nt, Mycobacterium bovis subsp bovis AF2122/97
gcgcgggucggcgacc

SEQ ID NO: 3068282 - RNA, 19 nt, Mycobacterium bovis subsp bovis AF2122/97
gcgcgggugaccaggcggc

SEQ ID NO: 3068283 - RNA, 20 nt, Mycobacterium bovis subsp bovis AF2122/97
gcgcgggugaccaggcggcg

SEQ ID NO: 3068284 - RNA, 19 nt, Mycobacterium bovis subsp bovis AF2122/97
gcgcgggugcaaccggauu

SEQ ID NO: 3068285 - RNA, 18 nt, Mycobacterium bovis subsp bovis AF2122/97
gcgcggguggcagcggcg

SEQ ID NO: 3068286 - RNA, 20 nt, Mycobacterium bovis subsp bovis AF2122/97
gcgcggguggcagcggcgau

SEQ ID NO: 3068287 - RNA, 15 nt, Mycobacterium bovis subsp bovis AF2122/97
gcgcggguggcucgg

SEQ ID NO: 3068288 - RNA, 18 nt, Mycobacterium bovis subsp bovis AF2122/97
gcgcggguuacccgcagc

SEQ ID NO: 3068289 - RNA, 21 nt, Mycobacterium bovis subsp bovis AF2122/97
gcgcggguuacccgcagcgug

SEQ ID NO: 3068290 - RNA, 19 nt, Mycobacterium bovis subsp bovis AF2122/97
gcgcggguugucggcgacc

SEQ ID NO: 3068291 - RNA, 22 nt, Mycobacterium bovis subsp bovis AF2122/97
gcgcggguuugcgguaguccgc

SEQ ID NO: 3068292 - RNA, 16 nt, Mycobacterium bovis subsp bovis AF2122/97
gcgcgguaccgcucgg

SEQ ID NO: 3068293 - RNA, 17 nt, Mycobacterium bovis subsp bovis AF2122/97
gcgcgguaccgcucggg

SEQ ID NO: 3068294 - RNA, 16 nt, Mycobacterium bovis subsp bovis AF2122/97
gcgcguggucgccccg

SEQ ID NO: 3068295 - RNA, 22 nt, Mycobacterium bovis subsp bovis AF2122/97
gcgcguggucgccccgaugacc

SEQ ID NO: 3068296 - RNA, 18 nt, Mycobacterium bovis subsp bovis AF2122/97
gcgcgugugcgucgcacg

SEQ ID NO: 3068297 - RNA, 19 nt, Mycobacterium bovis subsp bovis AF2122/97
gcgcgugugcgucgcacga

SEQ ID NO: 3068298 - RNA, 16 nt, Mycobacterium bovis subsp bovis AF2122/97
gcgcguuccaucaggg

SEQ ID NO: 3068299 - RNA, 18 nt, Mycobacterium bovis subsp bovis AF2122/97
gcgcguucccacgguucu

SEQ ID NO: 3068300 - RNA, 15 nt, Mycobacterium bovis subsp bovis AF2122/97
gcgcguucgaccucg

SEQ ID NO: 3068301 - RNA, 18 nt, Mycobacterium bovis subsp bovis AF2122/97
gcgcguucgaccucgacu

SEQ ID NO: 3068302 - RNA, 15 nt, Mycobacterium bovis subsp bovis AF2122/97
gcgcguucggcaccu

SEQ ID NO: 3068303 - RNA, 18 nt, Mycobacterium bovis subsp bovis AF2122/97
gcgcguucggcgagcagc

SEQ ID NO: 3068304 - RNA, 14 nt, Mycobacterium bovis subsp bovis AF2122/97
gcgcguucggcgcu

SEQ ID NO: 3068305 - RNA, 20 nt, Mycobacterium bovis subsp bovis AF2122/97
gcgcguucggcgcugaucgc

SEQ ID NO: 3068306 - RNA, 17 nt, Mycobacterium bovis subsp bovis AF2122/97
gcgcguugaagucgccg

SEQ ID NO: 3068307 - RNA, 14 nt, Mycobacterium bovis subsp bovis AF2122/97
gcgcguugaccgaa

SEQ ID NO: 3068308 - RNA, 13 nt, Mycobacterium bovis subsp bovis AF2122/97
gcgcguugcuggu

SEQ ID NO: 3068309 - RNA, 19 nt, Mycobacterium bovis subsp bovis AF2122/97
gcgcguugcuggucgccgu

SEQ ID NO: 3068310 - RNA, 21 nt, Mycobacterium bovis subsp bovis AF2122/97
gcgcguuuagucuccggcguc

SEQ ID NO: 3068311 - RNA, 20 nt, Mycobacterium bovis subsp bovis AF2122/97
gcgcguuugguuuucccggc

SEQ ID NO: 3068312 - RNA, 18 nt, Mycobacterium bovis subsp bovis AF2122/97
gcgcuacagcaucaaccg

SEQ ID NO: 3068313 - RNA, 14 nt, Mycobacterium bovis subsp bovis AF2122/97
gcgcuacccagcgc

SEQ ID NO: 3068314 - RNA, 17 nt, Mycobacterium bovis subsp bovis AF2122/97
gcgcuagccgggcgcgc

SEQ ID NO: 3068315 - RNA, 20 nt, Mycobacterium bovis subsp bovis AF2122/97
gcgcuagccgggcgcgccgg

SEQ ID NO: 3068316 - RNA, 17 nt, Mycobacterium bovis subsp bovis AF2122/97
gcgcuagcgccgcgcuu

SEQ ID NO: 3068317 - RNA, 17 nt, Mycobacterium bovis subsp bovis AF2122/97
gcgcuauaggccgcaug

SEQ ID NO: 3068318 - RNA, 16 nt, Mycobacterium bovis subsp bovis AF2122/97
gcgcucaacggcgaaa

SEQ ID NO: 3068319 - RNA, 21 nt, Mycobacterium bovis subsp bovis AF2122/97
gcgcucaaugaucgcggcggc

SEQ ID NO: 3068320 - RNA, 16 nt, Mycobacterium bovis subsp bovis AF2122/97
gcgcucacccgccgcg

SEQ ID NO: 3068321 - RNA, 16 nt, Mycobacterium bovis subsp bovis AF2122/97
gcgcucaccggcgucg

SEQ ID NO: 3068322 - RNA, 19 nt, Mycobacterium bovis subsp bovis AF2122/97
gcgcucaccggggccgucg

SEQ ID NO: 3068323 - RNA, 20 nt, Mycobacterium bovis subsp bovis AF2122/97
gcgcucaccggggccgucgg

SEQ ID NO: 3068324 - RNA, 21 nt, Mycobacterium bovis subsp bovis AF2122/97
gcgcucaccggggccgucggc

SEQ ID NO: 3068325 - RNA, 21 nt, Mycobacterium bovis subsp bovis AF2122/97
gcgcucacugcagcgccucga

SEQ ID NO: 3068326 - RNA, 13 nt, Mycobacterium bovis subsp bovis AF2122/97
gcgcucagccggg

SEQ ID NO: 3068327 - RNA, 14 nt, Mycobacterium bovis subsp bovis AF2122/97
gcgcucagcgcggc

SEQ ID NO: 3068328 - RNA, 15 nt, Mycobacterium bovis subsp bovis AF2122/97
gcgcucagcgcggcc

SEQ ID NO: 3068329 - RNA, 22 nt, Mycobacterium bovis subsp bovis AF2122/97
gcgcucaggucaucggcggcgg

SEQ ID NO: 3068330 - RNA, 17 nt, Mycobacterium bovis subsp bovis AF2122/97
gcgcucauaggccggcg

SEQ ID NO: 3068331 - RNA, 15 nt, Mycobacterium bovis subsp bovis AF2122/97
gcgcucaucacccag

SEQ ID NO: 3068332 - RNA, 19 nt, Mycobacterium bovis subsp bovis AF2122/97
gcgcucaucacccagcgcc

SEQ ID NO: 3068333 - RNA, 15 nt, Mycobacterium bovis subsp bovis AF2122/97
gcgcucaucgaccgc

SEQ ID NO: 3068334 - RNA, 22 nt, Mycobacterium bovis subsp bovis AF2122/97
gcgcucaucgaccgcggccggg

SEQ ID NO: 3068335 - RNA, 17 nt, Mycobacterium bovis subsp bovis AF2122/97
gcgcucaucgaccgggg

SEQ ID NO: 3068336 - RNA, 15 nt, Mycobacterium bovis subsp bovis AF2122/97
gcgcucaucugcgcg

SEQ ID NO: 3068337 - RNA, 18 nt, Mycobacterium bovis subsp bovis AF2122/97
gcgcucaucugcgcgcgg

SEQ ID NO: 3068338 - RNA, 19 nt, Mycobacterium bovis subsp bovis AF2122/97
gcgcucaucugcgcgcgga

SEQ ID NO: 3068339 - RNA, 20 nt, Mycobacterium bovis subsp bovis AF2122/97
gcgcucauguucucgaccgc

SEQ ID NO: 3068340 - RNA, 20 nt, Mycobacterium bovis subsp bovis AF2122/97
gcgcucauugcaucugccaa

SEQ ID NO: 3068341 - RNA, 18 nt, Mycobacterium bovis subsp bovis AF2122/97
gcgcuccaacaacuccag

SEQ ID NO: 3068342 - RNA, 23 nt, Mycobacterium bovis subsp bovis AF2122/97
gcgcuccaacaacuccagcaggu

SEQ ID NO: 3068343 - RNA, 19 nt, Mycobacterium bovis subsp bovis AF2122/97
gcgcuccacugaccagguc

SEQ ID NO: 3068344 - RNA, 15 nt, Mycobacterium bovis subsp bovis AF2122/97
gcgcuccagccgcgc

SEQ ID NO: 3068345 - RNA, 21 nt, Mycobacterium bovis subsp bovis AF2122/97
gcgcuccagcugagcggccgg

SEQ ID NO: 3068346 - RNA, 16 nt, Mycobacterium bovis subsp bovis AF2122/97
gcgcucccggagcaca

SEQ ID NO: 3068347 - RNA, 14 nt, Mycobacterium bovis subsp bovis AF2122/97
gcgcucccggcguc

SEQ ID NO: 3068348 - RNA, 12 nt, Mycobacterium bovis subsp bovis AF2122/97
gcgcuccggcgc

SEQ ID NO: 3068349 - RNA, 22 nt, Mycobacterium bovis subsp bovis AF2122/97
gcgcuccuucagggcgucgaac

SEQ ID NO: 3068350 - RNA, 19 nt, Mycobacterium bovis subsp bovis AF2122/97
gcgcucgaaagagccgcuu

SEQ ID NO: 3068351 - RNA, 21 nt, Mycobacterium bovis subsp bovis AF2122/97
gcgcucgaacuccccggucgc

SEQ ID NO: 3068352 - RNA, 22 nt, Mycobacterium bovis subsp bovis AF2122/97
gcgcucgaaggccgcacucaca

SEQ ID NO: 3068353 - RNA, 22 nt, Mycobacterium bovis subsp bovis AF2122/97
gcgcucgacaaagccacgcaga

SEQ ID NO: 3068354 - RNA, 21 nt, Mycobacterium bovis subsp bovis AF2122/97
gcgcucgacgagcacgccgac

SEQ ID NO: 3068355 - RNA, 13 nt, Mycobacterium bovis subsp bovis AF2122/97
gcgcucgaucacg

SEQ ID NO: 3068356 - RNA, 14 nt, Mycobacterium bovis subsp bovis AF2122/97
gcgcucgauggcgg

SEQ ID NO: 3068357 - RNA, 18 nt, Mycobacterium bovis subsp bovis AF2122/97
gcgcucgauggcggccac

SEQ ID NO: 3068358 - RNA, 14 nt, Mycobacterium bovis subsp bovis AF2122/97
gcgcucgcaccacc

SEQ ID NO: 3068359 - RNA, 15 nt, Mycobacterium bovis subsp bovis AF2122/97
gcgcucgcaccacca

SEQ ID NO: 3068360 - RNA, 16 nt, Mycobacterium bovis subsp bovis AF2122/97
gcgcucgcaccaccac

SEQ ID NO: 3068361 - RNA, 18 nt, Mycobacterium bovis subsp bovis AF2122/97
gcgcucgcacccgcucgg

SEQ ID NO: 3068362 - RNA, 19 nt, Mycobacterium bovis subsp bovis AF2122/97
gcgcucgcacccgcucggc

SEQ ID NO: 3068363 - RNA, 22 nt, Mycobacterium bovis subsp bovis AF2122/97
gcgcucgcaguggagggcccgg

SEQ ID NO: 3068364 - RNA, 15 nt, Mycobacterium bovis subsp bovis AF2122/97
gcgcucgcccgcggc

SEQ ID NO: 3068365 - RNA, 21 nt, Mycobacterium bovis subsp bovis AF2122/97
gcgcucgccgauaucugccac

SEQ ID NO: 3068366 - RNA, 22 nt, Mycobacterium bovis subsp bovis AF2122/97
gcgcucgcggcuucaguccggc

SEQ ID NO: 3068367 - RNA, 14 nt, Mycobacterium bovis subsp bovis AF2122/97
gcgcucgcgguagc

SEQ ID NO: 3068368 - RNA, 18 nt, Mycobacterium bovis subsp bovis AF2122/97
gcgcucgcgguagcgccg

SEQ ID NO: 3068369 - RNA, 23 nt, Mycobacterium bovis subsp bovis AF2122/97
gcgcucgcucacgccguccggug

SEQ ID NO: 3068370 - RNA, 15 nt, Mycobacterium bovis subsp bovis AF2122/97
gcgcucggcagccgg

SEQ ID NO: 3068371 - RNA, 15 nt, Mycobacterium bovis subsp bovis AF2122/97
gcgcucggccagcau

SEQ ID NO: 3068372 - RNA, 16 nt, Mycobacterium bovis subsp bovis AF2122/97
gcgcucggccagcauc

SEQ ID NO: 3068373 - RNA, 20 nt, Mycobacterium bovis subsp bovis AF2122/97
gcgcucggccauagcgccgc

SEQ ID NO: 3068374 - RNA, 16 nt, Mycobacterium bovis subsp bovis AF2122/97
gcgcucggcgagcaac

SEQ ID NO: 3068375 - RNA, 13 nt, Mycobacterium bovis subsp bovis AF2122/97
gcgcucgggcaac

SEQ ID NO: 3068376 - RNA, 15 nt, Mycobacterium bovis subsp bovis AF2122/97
gcgcucgggcugccg

SEQ ID NO: 3068377 - RNA, 14 nt, Mycobacterium bovis subsp bovis AF2122/97
gcgcucggucucca

SEQ ID NO: 3068378 - RNA, 18 nt, Mycobacterium bovis subsp bovis AF2122/97
gcgcucggucuccaccac

SEQ ID NO: 3068379 - RNA, 19 nt, Mycobacterium bovis subsp bovis AF2122/97
gcgcucggugccgcccagg

SEQ ID NO: 3068380 - RNA, 17 nt, Mycobacterium bovis subsp bovis AF2122/97
gcgcuggucgcgguggc

SEQ ID NO: 3068381 - RNA, 23 nt, Mycobacterium bovis subsp bovis AF2122/97
gcgcuggugauucgcagccgauc

SEQ ID NO: 3068382 - RNA, 17 nt, Mycobacterium bovis subsp bovis AF2122/97
gcgcuggugcgccacgc

SEQ ID NO: 3068383 - RNA, 20 nt, Mycobacterium bovis subsp bovis AF2122/97
gcgcuggugcgccacgccac

SEQ ID NO: 3068384 - RNA, 16 nt, Mycobacterium bovis subsp bovis AF2122/97
gcgcuggugcgcccau

SEQ ID NO: 3068385 - RNA, 13 nt, Mycobacterium bovis subsp bovis AF2122/97
gcgcugguggcgg

SEQ ID NO: 3068386 - RNA, 16 nt, Mycobacterium bovis subsp bovis AF2122/97
gcgcugguuggccugc

SEQ ID NO: 3068387 - RNA, 17 nt, Mycobacterium bovis subsp bovis AF2122/97
gcgcugguuggccugcc

SEQ ID NO: 3068388 - RNA, 21 nt, Mycobacterium bovis subsp bovis AF2122/97
gcgcuguagggcacugaaccg

SEQ ID NO: 3068389 - RNA, 14 nt, Mycobacterium bovis subsp bovis AF2122/97
gcgcuguccacgau

SEQ ID NO: 3068390 - RNA, 13 nt, Mycobacterium bovis subsp bovis AF2122/97
gcgcugucgcccu

SEQ ID NO: 3068391 - RNA, 18 nt, Mycobacterium bovis subsp bovis AF2122/97
gcgcugucguaccgcgga

SEQ ID NO: 3068392 - RNA, 22 nt, Mycobacterium bovis subsp bovis AF2122/97
gcgcugucguaccgcggaucgg

SEQ ID NO: 3068393 - RNA, 16 nt, Mycobacterium bovis subsp bovis AF2122/97
gcgcuguggcgggaga

SEQ ID NO: 3068394 - RNA, 22 nt, Mycobacterium bovis subsp bovis AF2122/97
gcgcuguggcgggagaucgucg

SEQ ID NO: 3068395 - RNA, 15 nt, Mycobacterium bovis subsp bovis AF2122/97
gcgcuguucggcacg

SEQ ID NO: 3068396 - RNA, 17 nt, Mycobacterium bovis subsp bovis AF2122/97
gcgcuguugcuggcgcc

SEQ ID NO: 3068397 - RNA, 18 nt, Mycobacterium bovis subsp bovis AF2122/97
gcgcuguugcuggcgccc

SEQ ID NO: 3068398 - RNA, 23 nt, Mycobacterium bovis subsp bovis AF2122/97
gcgcuguugcuggcgcccccgcc

SEQ ID NO: 3068399 - RNA, 17 nt, Mycobacterium bovis subsp bovis AF2122/97
gcgcuucacagccacca

SEQ ID NO: 3068400 - RNA, 20 nt, Mycobacterium bovis subsp bovis AF2122/97
gcgcuucacagccaccagcc

SEQ ID NO: 3068401 - RNA, 22 nt, Mycobacterium bovis subsp bovis AF2122/97
gcgcuucacagccaccagccgg

SEQ ID NO: 3068402 - RNA, 16 nt, Mycobacterium bovis subsp bovis AF2122/97
gcgcuuccaucgccac

SEQ ID NO: 3068403 - RNA, 14 nt, Mycobacterium bovis subsp bovis AF2122/97
gcgcuucgaccgag

SEQ ID NO: 3068404 - RNA, 14 nt, Mycobacterium bovis subsp bovis AF2122/97
gcgcuucgccacac

SEQ ID NO: 3068405 - RNA, 16 nt, Mycobacterium bovis subsp bovis AF2122/97
gcgcuucggcggucgc

SEQ ID NO: 3068406 - RNA, 22 nt, Mycobacterium bovis subsp bovis AF2122/97
gcgcuucugcuacccgagccgg

SEQ ID NO: 3068407 - RNA, 22 nt, Mycobacterium bovis subsp bovis AF2122/97
gcgcuugaagguucgaucgcgg

SEQ ID NO: 3068408 - RNA, 16 nt, Mycobacterium bovis subsp bovis AF2122/97
gcgcuugaccccgccg

SEQ ID NO: 3068409 - RNA, 14 nt, Mycobacterium bovis subsp bovis AF2122/97
gcgcuugacccgcg

SEQ ID NO: 3068410 - RNA, 19 nt, Mycobacterium bovis subsp bovis AF2122/97
gcgcuugacccgcggaccg

SEQ ID NO: 3068411 - RNA, 14 nt, Mycobacterium bovis subsp bovis AF2122/97
gcgcuugaugccgg

SEQ ID NO: 3068412 - RNA, 21 nt, Mycobacterium bovis subsp bovis AF2122/97
gcgcuugcgaccccggcugcg

SEQ ID NO: 3068413 - RNA, 15 nt, Mycobacterium bovis subsp bovis AF2122/97
gcgcuugcgaucgcc

SEQ ID NO: 3068414 - RNA, 16 nt, Mycobacterium bovis subsp bovis AF2122/97
gcgcuugcgaucgccg

SEQ ID NO: 3068415 - RNA, 23 nt, Mycobacterium bovis subsp bovis AF2122/97
gcgcuugcgaucgccgcuaacgc

SEQ ID NO: 3068416 - RNA, 14 nt, Mycobacterium bovis subsp bovis AF2122/97
gcgcuugcgaucgg

SEQ ID NO: 3068417 - RNA, 14 nt, Mycobacterium bovis subsp bovis AF2122/97
gcgcuugcggccgc

SEQ ID NO: 3068418 - RNA, 15 nt, Mycobacterium bovis subsp bovis AF2122/97
gcgcuugcggccgcg

SEQ ID NO: 3068419 - RNA, 19 nt, Mycobacterium bovis subsp bovis AF2122/97
gcgcuuggucgaccgccga

SEQ ID NO: 3068420 - RNA, 14 nt, Mycobacterium bovis subsp bovis AF2122/97
gcgcuuucgagugc

SEQ ID NO: 3068421 - RNA, 19 nt, Mycobacterium bovis subsp bovis AF2122/97
gcgcuuuggcguucgguga

SEQ ID NO: 3068422 - RNA, 15 nt, Mycobacterium bovis subsp bovis AF2122/97
gcgcuuuggucgucg

SEQ ID NO: 3068423 - RNA, 20 nt, Mycobacterium bovis subsp bovis AF2122/97
gcggaaaacccagaucggcg

SEQ ID NO: 3068424 - RNA, 15 nt, Mycobacterium bovis subsp bovis AF2122/97
gcggaaaaucggcug

SEQ ID NO: 3068425 - RNA, 18 nt, Mycobacterium bovis subsp bovis AF2122/97
gcggaaaccaucgccagc

SEQ ID NO: 3068426 - RNA, 19 nt, Mycobacterium bovis subsp bovis AF2122/97
gcggaaacccggccgccga

SEQ ID NO: 3068427 - RNA, 24 nt, Mycobacterium bovis subsp bovis AF2122/97
gcggaaaccgcugggggcggucgc

SEQ ID NO: 3068428 - RNA, 16 nt, Mycobacterium bovis subsp bovis AF2122/97
gcggaaauggcgucgc

SEQ ID NO: 3068429 - RNA, 18 nt, Mycobacterium bovis subsp bovis AF2122/97
gcggaaauggcgucgccg

SEQ ID NO: 3068430 - RNA, 14 nt, Mycobacterium bovis subsp bovis AF2122/97
gcggaacaccagca

SEQ ID NO: 3068431 - RNA, 16 nt, Mycobacterium bovis subsp bovis AF2122/97
gcggaacaccagcagg

SEQ ID NO: 3068432 - RNA, 19 nt, Mycobacterium bovis subsp bovis AF2122/97
gcggaacaccagcaggcgg

SEQ ID NO: 3068433 - RNA, 20 nt, Mycobacterium bovis subsp bovis AF2122/97
gcggaacaccagcaggcggc

SEQ ID NO: 3068434 - RNA, 14 nt, Mycobacterium bovis subsp bovis AF2122/97
gcggaacaccgccc

SEQ ID NO: 3068435 - RNA, 17 nt, Mycobacterium bovis subsp bovis AF2122/97
gcggaacaccgcccggc

SEQ ID NO: 3068436 - RNA, 19 nt, Mycobacterium bovis subsp bovis AF2122/97
gcggaacacgaugcgcggu

SEQ ID NO: 3068437 - RNA, 21 nt, Mycobacterium bovis subsp bovis AF2122/97
gcggaacacgaugcgcggugc

SEQ ID NO: 3068438 - RNA, 20 nt, Mycobacterium bovis subsp bovis AF2122/97
gcggaacagcuucgcgcagc

SEQ ID NO: 3068439 - RNA, 13 nt, Mycobacterium bovis subsp bovis AF2122/97
gcggaacccagca

SEQ ID NO: 3068440 - RNA, 14 nt, Mycobacterium bovis subsp bovis AF2122/97
gcggaacccagcac

SEQ ID NO: 3068441 - RNA, 15 nt, Mycobacterium bovis subsp bovis AF2122/97
gcggaacccagcacu

SEQ ID NO: 3068442 - RNA, 19 nt, Mycobacterium bovis subsp bovis AF2122/97
gcggaaccgagggccguca

SEQ ID NO: 3068443 - RNA, 16 nt, Mycobacterium bovis subsp bovis AF2122/97
gcggaaccugcucggc

SEQ ID NO: 3068444 - RNA, 19 nt, Mycobacterium bovis subsp bovis AF2122/97
gcggaaccugcucggccgu

SEQ ID NO: 3068445 - RNA, 13 nt, Mycobacterium bovis subsp bovis AF2122/97
gcggaacgccggc

SEQ ID NO: 3068446 - RNA, 18 nt, Mycobacterium bovis subsp bovis AF2122/97
gcggaacgcgucgccgac

SEQ ID NO: 3068447 - RNA, 13 nt, Mycobacterium bovis subsp bovis AF2122/97
gcggaacgggcag

SEQ ID NO: 3068448 - RNA, 18 nt, Mycobacterium bovis subsp bovis AF2122/97
gcggaacugggcccccaa

SEQ ID NO: 3068449 - RNA, 14 nt, Mycobacterium bovis subsp bovis AF2122/97
gcggaagaccggau

SEQ ID NO: 3068450 - RNA, 18 nt, Mycobacterium bovis subsp bovis AF2122/97
gcggaagcaucggcugcg

SEQ ID NO: 3068451 - RNA, 14 nt, Mycobacterium bovis subsp bovis AF2122/97
gcggaagcggcggc

SEQ ID NO: 3068452 - RNA, 15 nt, Mycobacterium bovis subsp bovis AF2122/97
gcggaagcggcggcc

SEQ ID NO: 3068453 - RNA, 13 nt, Mycobacterium bovis subsp bovis AF2122/97
gcggaagcgggcg

SEQ ID NO: 3068454 - RNA, 21 nt, Mycobacterium bovis subsp bovis AF2122/97
gcggaagcgguugacccacag

SEQ ID NO: 3068455 - RNA, 22 nt, Mycobacterium bovis subsp bovis AF2122/97
gcggaagcgguugacccacagc

SEQ ID NO: 3068456 - RNA, 14 nt, Mycobacterium bovis subsp bovis AF2122/97
gcggaaggcgucga

SEQ ID NO: 3068457 - RNA, 13 nt, Mycobacterium bovis subsp bovis AF2122/97
gcggaagggggca

SEQ ID NO: 3068458 - RNA, 22 nt, Mycobacterium bovis subsp bovis AF2122/97
gcggaauccgaacgcgauccgg

SEQ ID NO: 3068459 - RNA, 13 nt, Mycobacterium bovis subsp bovis AF2122/97
gcggaaucgcgac

SEQ ID NO: 3068460 - RNA, 14 nt, Mycobacterium bovis subsp bovis AF2122/97
gcggaaucgcgaca

SEQ ID NO: 3068461 - RNA, 12 nt, Mycobacterium bovis subsp bovis AF2122/97
gcggaauggcgc

SEQ ID NO: 3068462 - RNA, 15 nt, Mycobacterium bovis subsp bovis AF2122/97
gcggaauggcgccgg

SEQ ID NO: 3068463 - RNA, 16 nt, Mycobacterium bovis subsp bovis AF2122/97
gcggaauggcgccggc

SEQ ID NO: 3068464 - RNA, 22 nt, Mycobacterium bovis subsp bovis AF2122/97
gcggaauggcgccggccggcgc

SEQ ID NO: 3068465 - RNA, 16 nt, Mycobacterium bovis subsp bovis AF2122/97
gcggacaagucggcac

SEQ ID NO: 3068466 - RNA, 18 nt, Mycobacterium bovis subsp bovis AF2122/97
gcggacaccgcggcgauc

SEQ ID NO: 3068467 - RNA, 14 nt, Mycobacterium bovis subsp bovis AF2122/97
gcggaggcggccag

SEQ ID NO: 3068468 - RNA, 16 nt, Mycobacterium bovis subsp bovis AF2122/97
gcggaggcggccagcc

SEQ ID NO: 3068469 - RNA, 13 nt, Mycobacterium bovis subsp bovis AF2122/97
gcggaggcugggc

SEQ ID NO: 3068470 - RNA, 17 nt, Mycobacterium bovis subsp bovis AF2122/97
gcggaggcugggcugag

SEQ ID NO: 3068471 - RNA, 23 nt, Mycobacterium bovis subsp bovis AF2122/97
gcggaguaaacaaacccaacacc

SEQ ID NO: 3068472 - RNA, 18 nt, Mycobacterium bovis subsp bovis AF2122/97
gcggaguacuccagccgc

SEQ ID NO: 3068473 - RNA, 14 nt, Mycobacterium bovis subsp bovis AF2122/97
gcggaguccgucga

SEQ ID NO: 3068474 - RNA, 20 nt, Mycobacterium bovis subsp bovis AF2122/97
gcggaguccgucgacaccgc

SEQ ID NO: 3068475 - RNA, 17 nt, Mycobacterium bovis subsp bovis AF2122/97
gcggagucgcgcagggc

SEQ ID NO: 3068476 - RNA, 21 nt, Mycobacterium bovis subsp bovis AF2122/97
gcggagucgcgcagggcgaca

SEQ ID NO: 3068477 - RNA, 17 nt, Mycobacterium bovis subsp bovis AF2122/97
gcggagugcccagggcc

SEQ ID NO: 3068478 - RNA, 20 nt, Mycobacterium bovis subsp bovis AF2122/97
gcggagugcccagggccgag

SEQ ID NO: 3068479 - RNA, 14 nt, Mycobacterium bovis subsp bovis AF2122/97
gcggaguucgcuga

SEQ ID NO: 3068480 - RNA, 17 nt, Mycobacterium bovis subsp bovis AF2122/97
gcggaguucgcugacgg

SEQ ID NO: 3068481 - RNA, 22 nt, Mycobacterium bovis subsp bovis AF2122/97
gcggaguucgcugacggccaug

SEQ ID NO: 3068482 - RNA, 19 nt, Mycobacterium bovis subsp bovis AF2122/97
gcggauacaugguccggcc

SEQ ID NO: 3068483 - RNA, 17 nt, Mycobacterium bovis subsp bovis AF2122/97
gcggauacuguucugcu

SEQ ID NO: 3068484 - RNA, 15 nt, Mycobacterium bovis subsp bovis AF2122/97
gcggauagcggcaaa

SEQ ID NO: 3068485 - RNA, 20 nt, Mycobacterium bovis subsp bovis AF2122/97
gcggauagcggcaaagccgg

SEQ ID NO: 3068486 - RNA, 18 nt, Mycobacterium bovis subsp bovis AF2122/97
gcggauaggccgcgcggc

SEQ ID NO: 3068487 - RNA, 19 nt, Mycobacterium bovis subsp bovis AF2122/97
gcggauaggccgcgcggcg

SEQ ID NO: 3068488 - RNA, 23 nt, Mycobacterium bovis subsp bovis AF2122/97
gcggauaggccgcgcggcggcgc

SEQ ID NO: 3068489 - RNA, 19 nt, Mycobacterium bovis subsp bovis AF2122/97
gcggauagugguugcggcc

SEQ ID NO: 3068490 - RNA, 15 nt, Mycobacterium bovis subsp bovis AF2122/97
gcggauaucuugcgc

SEQ ID NO: 3068491 - RNA, 23 nt, Mycobacterium bovis subsp bovis AF2122/97
gcggauauuccuuuaacgcaggc

SEQ ID NO: 3068492 - RNA, 14 nt, Mycobacterium bovis subsp bovis AF2122/97
gcggaucaacaggc

SEQ ID NO: 3068493 - RNA, 21 nt, Mycobacterium bovis subsp bovis AF2122/97
gcggaucaacaggccggcucg

SEQ ID NO: 3068494 - RNA, 22 nt, Mycobacterium bovis subsp bovis AF2122/97
gcggaucaacaggccggcucgc

SEQ ID NO: 3068495 - RNA, 21 nt, Mycobacterium bovis subsp bovis AF2122/97
gcggaucaccaucgccgccgc

SEQ ID NO: 3068496 - RNA, 17 nt, Mycobacterium bovis subsp bovis AF2122/97
gcggaucagcccgcgca

SEQ ID NO: 3068497 - RNA, 19 nt, Mycobacterium bovis subsp bovis AF2122/97
gcggaucagcccgcgcagc

SEQ ID NO: 3068498 - RNA, 19 nt, Mycobacterium bovis subsp bovis AF2122/97
gcggaucauccuucgccgg

SEQ ID NO: 3068499 - RNA, 18 nt, Mycobacterium bovis subsp bovis AF2122/97
gcggaucauuccgacgaa

SEQ ID NO: 3068500 - RNA, 19 nt, Mycobacterium bovis subsp bovis AF2122/97
gcggaucauuccgacgaac

SEQ ID NO: 3068501 - RNA, 21 nt, Mycobacterium bovis subsp bovis AF2122/97
gcggauccaccacgcuggccu

SEQ ID NO: 3068502 - RNA, 21 nt, Mycobacterium bovis subsp bovis AF2122/97
gcggauccagaaacugcucgg

SEQ ID NO: 3068503 - RNA, 17 nt, Mycobacterium bovis subsp bovis AF2122/97
gcggaucccgaggcgcc

SEQ ID NO: 3068504 - RNA, 16 nt, Mycobacterium bovis subsp bovis AF2122/97
gcggaucccgccggug

SEQ ID NO: 3068505 - RNA, 17 nt, Mycobacterium bovis subsp bovis AF2122/97
gcggaucgaccgccagc

SEQ ID NO: 3068506 - RNA, 18 nt, Mycobacterium bovis subsp bovis AF2122/97
gcggaucgacuucgacga

SEQ ID NO: 3068507 - RNA, 19 nt, Mycobacterium bovis subsp bovis AF2122/97
gcggaucgacuucgacgac

SEQ ID NO: 3068508 - RNA, 22 nt, Mycobacterium bovis subsp bovis AF2122/97
gcggaucgacuucgacgacacg

SEQ ID NO: 3068509 - RNA, 12 nt, Mycobacterium bovis subsp bovis AF2122/97
gcggaucgccgg

SEQ ID NO: 3068510 - RNA, 15 nt, Mycobacterium bovis subsp bovis AF2122/97
gcggaucgcgcugau

SEQ ID NO: 3068511 - RNA, 19 nt, Mycobacterium bovis subsp bovis AF2122/97
gcggaucgcgcugaucagc

SEQ ID NO: 3068512 - RNA, 12 nt, Mycobacterium bovis subsp bovis AF2122/97
gcggaucggcgg

SEQ ID NO: 3068513 - RNA, 13 nt, Mycobacterium bovis subsp bovis AF2122/97
gcggaucggcgga

SEQ ID NO: 3068514 - RNA, 20 nt, Mycobacterium bovis subsp bovis AF2122/97
gcggaucggcggaccgcagc

SEQ ID NO: 3068515 - RNA, 21 nt, Mycobacterium bovis subsp bovis AF2122/97
gcggaucggcggaccgcagcg

SEQ ID NO: 3068516 - RNA, 15 nt, Mycobacterium bovis subsp bovis AF2122/97
gcggaucggcggccg

SEQ ID NO: 3068517 - RNA, 23 nt, Mycobacterium bovis subsp bovis AF2122/97
gcggaucggcggccgcgaccagc

SEQ ID NO: 3068518 - RNA, 16 nt, Mycobacterium bovis subsp bovis AF2122/97
gcggaucggcggccgg

SEQ ID NO: 3068519 - RNA, 18 nt, Mycobacterium bovis subsp bovis AF2122/97
gcggaucggcggccggca

SEQ ID NO: 3068520 - RNA, 16 nt, Mycobacterium bovis subsp bovis AF2122/97
gcggaucgucguuguc

SEQ ID NO: 3068521 - RNA, 17 nt, Mycobacterium bovis subsp bovis AF2122/97
gcggaucguggcgcccg

SEQ ID NO: 3068522 - RNA, 21 nt, Mycobacterium bovis subsp bovis AF2122/97
gcggaucucaccacccgucgg

SEQ ID NO: 3068523 - RNA, 22 nt, Mycobacterium bovis subsp bovis AF2122/97
gcggaucucaccacccgucggc

SEQ ID NO: 3068524 - RNA, 18 nt, Mycobacterium bovis subsp bovis AF2122/97
gcggaucucaucgggcca

SEQ ID NO: 3068525 - RNA, 22 nt, Mycobacterium bovis subsp bovis AF2122/97
gcggaucucaucgggccacagc

SEQ ID NO: 3068526 - RNA, 17 nt, Mycobacterium bovis subsp bovis AF2122/97
gcggaucugcagcacgc

SEQ ID NO: 3068527 - RNA, 12 nt, Mycobacterium bovis subsp bovis AF2122/97
gcggaucugggc

SEQ ID NO: 3068528 - RNA, 16 nt, Mycobacterium bovis subsp bovis AF2122/97
gcggaucugggcggcc

SEQ ID NO: 3068529 - RNA, 17 nt, Mycobacterium bovis subsp bovis AF2122/97
gcggaucugggcggccu

SEQ ID NO: 3068530 - RNA, 16 nt, Mycobacterium bovis subsp bovis AF2122/97
gcggaucugguccagu

SEQ ID NO: 3068531 - RNA, 21 nt, Mycobacterium bovis subsp bovis AF2122/97
gcggaucuguuccucggugac

SEQ ID NO: 3068532 - RNA, 23 nt, Mycobacterium bovis subsp bovis AF2122/97
gcggaucuucucgguaccaccgg

SEQ ID NO: 3068533 - RNA, 16 nt, Mycobacterium bovis subsp bovis AF2122/97
gcggaucuugguguug

SEQ ID NO: 3068534 - RNA, 17 nt, Mycobacterium bovis subsp bovis AF2122/97
gcggaugagcucggcca

SEQ ID NO: 3068535 - RNA, 14 nt, Mycobacterium bovis subsp bovis AF2122/97
gcggaugcgcggcg

SEQ ID NO: 3068536 - RNA, 19 nt, Mycobacterium bovis subsp bovis AF2122/97
gcggaugcuguugacccgu

SEQ ID NO: 3068537 - RNA, 14 nt, Mycobacterium bovis subsp bovis AF2122/97
gcggauggcgucga

SEQ ID NO: 3068538 - RNA, 22 nt, Mycobacterium bovis subsp bovis AF2122/97
gcggauguacacuuugcccgcc

SEQ ID NO: 3068539 - RNA, 16 nt, Mycobacterium bovis subsp bovis AF2122/97
gcggauguccccgacg

SEQ ID NO: 3068540 - RNA, 22 nt, Mycobacterium bovis subsp bovis AF2122/97
gcggaugucgucgaccaggcca

SEQ ID NO: 3068541 - RNA, 20 nt, Mycobacterium bovis subsp bovis AF2122/97
gcggauuaagucggcggccu

SEQ ID NO: 3068542 - RNA, 21 nt, Mycobacterium bovis subsp bovis AF2122/97
gcggauuccggcaucgguucg

SEQ ID NO: 3068543 - RNA, 15 nt, Mycobacterium bovis subsp bovis AF2122/97
gcggauuccggcucg

SEQ ID NO: 3068544 - RNA, 23 nt, Mycobacterium bovis subsp bovis AF2122/97
gcggauucgcgcuguccacgaug

SEQ ID NO: 3068545 - RNA, 15 nt, Mycobacterium bovis subsp bovis AF2122/97
gcggauucggcgcug

SEQ ID NO: 3068546 - RNA, 20 nt, Mycobacterium bovis subsp bovis AF2122/97
gcggauugccgcgcgcaagc

SEQ ID NO: 3068547 - RNA, 15 nt, Mycobacterium bovis subsp bovis AF2122/97
gcggauuggccuugu

SEQ ID NO: 3068548 - RNA, 14 nt, Mycobacterium bovis subsp bovis AF2122/97
gcggauuucgccgu

SEQ ID NO: 3068549 - RNA, 17 nt, Mycobacterium bovis subsp bovis AF2122/97
gcggauuucucgcccug

SEQ ID NO: 3068550 - RNA, 17 nt, Mycobacterium bovis subsp bovis AF2122/97
gcggauuugccccguug

SEQ ID NO: 3068551 - RNA, 19 nt, Mycobacterium bovis subsp bovis AF2122/97
gcggcaaacacugcggccu

SEQ ID NO: 3068552 - RNA, 20 nt, Mycobacterium bovis subsp bovis AF2122/97
gcggcaaacacugcggccug

SEQ ID NO: 3068553 - RNA, 15 nt, Mycobacterium bovis subsp bovis AF2122/97
gcggcagccuggccu

SEQ ID NO: 3068554 - RNA, 13 nt, Mycobacterium bovis subsp bovis AF2122/97
gcggcagcgcggc

SEQ ID NO: 3068555 - RNA, 17 nt, Mycobacterium bovis subsp bovis AF2122/97
gcggcagcgcggccaau

SEQ ID NO: 3068556 - RNA, 14 nt, Mycobacterium bovis subsp bovis AF2122/97
gcggcagcggcgau

SEQ ID NO: 3068557 - RNA, 15 nt, Mycobacterium bovis subsp bovis AF2122/97
gcggcagcggcgauc

SEQ ID NO: 3068558 - RNA, 17 nt, Mycobacterium bovis subsp bovis AF2122/97
gcggcagcggcgccgcc

SEQ ID NO: 3068559 - RNA, 16 nt, Mycobacterium bovis subsp bovis AF2122/97
gcggcagcggcguagc

SEQ ID NO: 3068560 - RNA, 16 nt, Mycobacterium bovis subsp bovis AF2122/97
gcggcagcggcgucgu

SEQ ID NO: 3068561 - RNA, 16 nt, Mycobacterium bovis subsp bovis AF2122/97
gcggcagcggugcugg

SEQ ID NO: 3068562 - RNA, 14 nt, Mycobacterium bovis subsp bovis AF2122/97
gcggcagcgguggc

SEQ ID NO: 3068563 - RNA, 14 nt, Mycobacterium bovis subsp bovis AF2122/97
gcggcagcuggcgc

SEQ ID NO: 3068564 - RNA, 17 nt, Mycobacterium bovis subsp bovis AF2122/97
gcggcagcuggcgcagc

SEQ ID NO: 3068565 - RNA, 22 nt, Mycobacterium bovis subsp bovis AF2122/97
gcggcagcuggcgcagccugcc

SEQ ID NO: 3068566 - RNA, 21 nt, Mycobacterium bovis subsp bovis AF2122/97
gcggcaggaaucgggucagca

SEQ ID NO: 3068567 - RNA, 15 nt, Mycobacterium bovis subsp bovis AF2122/97
gcggcaggccggcca

SEQ ID NO: 3068568 - RNA, 17 nt, Mycobacterium bovis subsp bovis AF2122/97
gcggcaggccggccacc

SEQ ID NO: 3068569 - RNA, 19 nt, Mycobacterium bovis subsp bovis AF2122/97
gcggcaggccggccaccga

SEQ ID NO: 3068570 - RNA, 17 nt, Mycobacterium bovis subsp bovis AF2122/97
gcggcaggccuggcgag

SEQ ID NO: 3068571 - RNA, 19 nt, Mycobacterium bovis subsp bovis AF2122/97
gcggcaggccuggcgagcc

SEQ ID NO: 3068572 - RNA, 15 nt, Mycobacterium bovis subsp bovis AF2122/97
gcggcagggcggugc

SEQ ID NO: 3068573 - RNA, 16 nt, Mycobacterium bovis subsp bovis AF2122/97
gcggcaggguguuuau

SEQ ID NO: 3068574 - RNA, 17 nt, Mycobacterium bovis subsp bovis AF2122/97
gcggcaggguguuuaug

SEQ ID NO: 3068575 - RNA, 18 nt, Mycobacterium bovis subsp bovis AF2122/97
gcggcaggguguuuaugg

SEQ ID NO: 3068576 - RNA, 22 nt, Mycobacterium bovis subsp bovis AF2122/97
gcggcaggucgaugcugccagc

SEQ ID NO: 3068577 - RNA, 17 nt, Mycobacterium bovis subsp bovis AF2122/97
gcggcaggugcggcggc

SEQ ID NO: 3068578 - RNA, 15 nt, Mycobacterium bovis subsp bovis AF2122/97
gcggcagguucggcg

SEQ ID NO: 3068579 - RNA, 23 nt, Mycobacterium bovis subsp bovis AF2122/97
gcggcagguugcguugcaggaaa

SEQ ID NO: 3068580 - RNA, 22 nt, Mycobacterium bovis subsp bovis AF2122/97
gcggcagucauuauucgcgcaa

SEQ ID NO: 3068581 - RNA, 23 nt, Mycobacterium bovis subsp bovis AF2122/97
gcggcagucgcgguaccaucacc

SEQ ID NO: 3068582 - RNA, 18 nt, Mycobacterium bovis subsp bovis AF2122/97
gcggcaguuguggcgcug

SEQ ID NO: 3068583 - RNA, 21 nt, Mycobacterium bovis subsp bovis AF2122/97
gcggcauaaacaucgguggcg

SEQ ID NO: 3068584 - RNA, 16 nt, Mycobacterium bovis subsp bovis AF2122/97
gcggcauacauccagg

SEQ ID NO: 3068585 - RNA, 15 nt, Mycobacterium bovis subsp bovis AF2122/97
gcggcauagccgaac

SEQ ID NO: 3068586 - RNA, 19 nt, Mycobacterium bovis subsp bovis AF2122/97
gcggcauagccgaacagcg

SEQ ID NO: 3068587 - RNA, 16 nt, Mycobacterium bovis subsp bovis AF2122/97
gcggcauagcggguca

SEQ ID NO: 3068588 - RNA, 19 nt, Mycobacterium bovis subsp bovis AF2122/97
gcggcauagcucagaccgg

SEQ ID NO: 3068589 - RNA, 22 nt, Mycobacterium bovis subsp bovis AF2122/97
gcggcauagcucagaccggcgc

SEQ ID NO: 3068590 - RNA, 23 nt, Mycobacterium bovis subsp bovis AF2122/97
gcggcauagcucagaccggcgcc

SEQ ID NO: 3068591 - RNA, 16 nt, Mycobacterium bovis subsp bovis AF2122/97
gcggcaucccgccaca

SEQ ID NO: 3068592 - RNA, 18 nt, Mycobacterium bovis subsp bovis AF2122/97
gcggcaucccgccacacc

SEQ ID NO: 3068593 - RNA, 22 nt, Mycobacterium bovis subsp bovis AF2122/97
gcggcaucgaauuccagccagc

SEQ ID NO: 3068594 - RNA, 15 nt, Mycobacterium bovis subsp bovis AF2122/97
gcggcaucgacgcgg

SEQ ID NO: 3068595 - RNA, 16 nt, Mycobacterium bovis subsp bovis AF2122/97
gcggcaucgacgcggc

SEQ ID NO: 3068596 - RNA, 14 nt, Mycobacterium bovis subsp bovis AF2122/97
gcggcaucgccgag

SEQ ID NO: 3068597 - RNA, 14 nt, Mycobacterium bovis subsp bovis AF2122/97
gcggcaucgcgggc

SEQ ID NO: 3068598 - RNA, 17 nt, Mycobacterium bovis subsp bovis AF2122/97
gcggcaucgcgggcggc

SEQ ID NO: 3068599 - RNA, 13 nt, Mycobacterium bovis subsp bovis AF2122/97
gcggcaucggcgg

SEQ ID NO: 3068600 - RNA, 22 nt, Mycobacterium bovis subsp bovis AF2122/97
gcggcaucgggguuggugaacg

SEQ ID NO: 3068601 - RNA, 18 nt, Mycobacterium bovis subsp bovis AF2122/97
gcggcaucggucaccgcg

SEQ ID NO: 3068602 - RNA, 13 nt, Mycobacterium bovis subsp bovis AF2122/97
gcggcaucggugg

SEQ ID NO: 3068603 - RNA, 20 nt, Mycobacterium bovis subsp bovis AF2122/97
gcggcaucucgcaccgcgcc

SEQ ID NO: 3068604 - RNA, 22 nt, Mycobacterium bovis subsp bovis AF2122/97
gcggcaugaagcaguuggccga

SEQ ID NO: 3068605 - RNA, 20 nt, Mycobacterium bovis subsp bovis AF2122/97
gcggcaugauuuuucgcagu

SEQ ID NO: 3068606 - RNA, 22 nt, Mycobacterium bovis subsp bovis AF2122/97
gcggcaugcaaugcuggcggcg

SEQ ID NO: 3068607 - RNA, 23 nt, Mycobacterium bovis subsp bovis AF2122/97
gcggcaugcaaugcuggcggcgc

SEQ ID NO: 3068608 - RNA, 20 nt, Mycobacterium bovis subsp bovis AF2122/97
gcggcaugcagaucucacgg

SEQ ID NO: 3068609 - RNA, 15 nt, Mycobacterium bovis subsp bovis AF2122/97
gcggcaugcucaccg

SEQ ID NO: 3068610 - RNA, 15 nt, Mycobacterium bovis subsp bovis AF2122/97
gcggcauggcaggcg

SEQ ID NO: 3068611 - RNA, 17 nt, Mycobacterium bovis subsp bovis AF2122/97
gcggcaugggcccugca

SEQ ID NO: 3068612 - RNA, 22 nt, Mycobacterium bovis subsp bovis AF2122/97
gcggcauguauuucgugccggc

SEQ ID NO: 3068613 - RNA, 20 nt, Mycobacterium bovis subsp bovis AF2122/97
gcggcauuaccaacgcggug

SEQ ID NO: 3068614 - RNA, 15 nt, Mycobacterium bovis subsp bovis AF2122/97
gcggcauucucgagc

SEQ ID NO: 3068615 - RNA, 17 nt, Mycobacterium bovis subsp bovis AF2122/97
gcggcauucucgagcac

SEQ ID NO: 3068616 - RNA, 23 nt, Mycobacterium bovis subsp bovis AF2122/97
gcggcauucucgagcacccgcaa

SEQ ID NO: 3068617 - RNA, 14 nt, Mycobacterium bovis subsp bovis AF2122/97
gcggcauugccagc

SEQ ID NO: 3068618 - RNA, 15 nt, Mycobacterium bovis subsp bovis AF2122/97
gcggcauugccagcc

SEQ ID NO: 3068619 - RNA, 22 nt, Mycobacterium bovis subsp bovis AF2122/97
gcggcauugguaccggcuucgu

SEQ ID NO: 3068620 - RNA, 17 nt, Mycobacterium bovis subsp bovis AF2122/97
gcggccaacagcacccg

SEQ ID NO: 3068621 - RNA, 17 nt, Mycobacterium bovis subsp bovis AF2122/97
gcggccaacgacgaccc

SEQ ID NO: 3068622 - RNA, 21 nt, Mycobacterium bovis subsp bovis AF2122/97
gcggccaacggcuccgggcgc

SEQ ID NO: 3068623 - RNA, 24 nt, Mycobacterium bovis subsp bovis AF2122/97
gcggccaacggcuccgggcgcucg

SEQ ID NO: 3068624 - RNA, 13 nt, Mycobacterium bovis subsp bovis AF2122/97
gcggccaaggucg

SEQ ID NO: 3068625 - RNA, 14 nt, Mycobacterium bovis subsp bovis AF2122/97
gcggccaagucacc

SEQ ID NO: 3068626 - RNA, 18 nt, Mycobacterium bovis subsp bovis AF2122/97
gcggccaaucagcccgcc

SEQ ID NO: 3068627 - RNA, 20 nt, Mycobacterium bovis subsp bovis AF2122/97
gcggccaaucagcccgccgg

SEQ ID NO: 3068628 - RNA, 21 nt, Mycobacterium bovis subsp bovis AF2122/97
gcggccaaucagcccgccgga

SEQ ID NO: 3068629 - RNA, 19 nt, Mycobacterium bovis subsp bovis AF2122/97
gcggccaaugacgucggac

SEQ ID NO: 3068630 - RNA, 17 nt, Mycobacterium bovis subsp bovis AF2122/97
gcggccaauggccgcgg

SEQ ID NO: 3068631 - RNA, 18 nt, Mycobacterium bovis subsp bovis AF2122/97
gcggccaauggccgcggc

SEQ ID NO: 3068632 - RNA, 18 nt, Mycobacterium bovis subsp bovis AF2122/97
gcggccaauggugggcga

SEQ ID NO: 3068633 - RNA, 24 nt, Mycobacterium bovis subsp bovis AF2122/97
gcggccaauggugggcgagcugcu

SEQ ID NO: 3068634 - RNA, 18 nt, Mycobacterium bovis subsp bovis AF2122/97
gcggccaauugcgccgcc

SEQ ID NO: 3068635 - RNA, 15 nt, Mycobacterium bovis subsp bovis AF2122/97
gcggccacaaccucg

SEQ ID NO: 3068636 - RNA, 23 nt, Mycobacterium bovis subsp bovis AF2122/97
gcggccacaccuuggccgccggc

SEQ ID NO: 3068637 - RNA, 24 nt, Mycobacterium bovis subsp bovis AF2122/97
gcggccacauaccaccacguggcc

SEQ ID NO: 3068638 - RNA, 13 nt, Mycobacterium bovis subsp bovis AF2122/97
gcggccaccaccg

SEQ ID NO: 3068639 - RNA, 16 nt, Mycobacterium bovis subsp bovis AF2122/97
gcggcccuucaccagc

SEQ ID NO: 3068640 - RNA, 18 nt, Mycobacterium bovis subsp bovis AF2122/97
gcggcccuucaccagcca

SEQ ID NO: 3068641 - RNA, 19 nt, Mycobacterium bovis subsp bovis AF2122/97
gcggccgaaacuucgcccg

SEQ ID NO: 3068642 - RNA, 19 nt, Mycobacterium bovis subsp bovis AF2122/97
gcggccgaaagagccagcg

SEQ ID NO: 3068643 - RNA, 19 nt, Mycobacterium bovis subsp bovis AF2122/97
gcggccgaccgcgacccgg

SEQ ID NO: 3068644 - RNA, 15 nt, Mycobacterium bovis subsp bovis AF2122/97
gcggccgagacggcg

SEQ ID NO: 3068645 - RNA, 16 nt, Mycobacterium bovis subsp bovis AF2122/97
gcggccgagcgcaccg

SEQ ID NO: 3068646 - RNA, 18 nt, Mycobacterium bovis subsp bovis AF2122/97
gcggccgcagccagcaag

SEQ ID NO: 3068647 - RNA, 13 nt, Mycobacterium bovis subsp bovis AF2122/97
gcggccgcagcgg

SEQ ID NO: 3068648 - RNA, 21 nt, Mycobacterium bovis subsp bovis AF2122/97
gcggccgcagcggccagccca

SEQ ID NO: 3068649 - RNA, 22 nt, Mycobacterium bovis subsp bovis AF2122/97
gcggccgcagcggccagcccag

SEQ ID NO: 3068650 - RNA, 12 nt, Mycobacterium bovis subsp bovis AF2122/97
gcggccgccauc

SEQ ID NO: 3068651 - RNA, 15 nt, Mycobacterium bovis subsp bovis AF2122/97
gcggccgccaucagc

SEQ ID NO: 3068652 - RNA, 20 nt, Mycobacterium bovis subsp bovis AF2122/97
gcggccgccaucagccgcug

SEQ ID NO: 3068653 - RNA, 11 nt, Mycobacterium bovis subsp bovis AF2122/97
gcggccgccga

SEQ ID NO: 3068654 - RNA, 13 nt, Mycobacterium bovis subsp bovis AF2122/97
gcggccgccgagu

SEQ ID NO: 3068655 - RNA, 12 nt, Mycobacterium bovis subsp bovis AF2122/97
gcggccgccgca

SEQ ID NO: 3068656 - RNA, 12 nt, Mycobacterium bovis subsp bovis AF2122/97
gcggccgccgcg

SEQ ID NO: 3068657 - RNA, 13 nt, Mycobacterium bovis subsp bovis AF2122/97
gcggccgccgcgg

SEQ ID NO: 3068658 - RNA, 11 nt, Mycobacterium bovis subsp bovis AF2122/97
gcggccgccgg

SEQ ID NO: 3068659 - RNA, 20 nt, Mycobacterium bovis subsp bovis AF2122/97
gcggccgccguccccgccgu

SEQ ID NO: 3068660 - RNA, 23 nt, Mycobacterium bovis subsp bovis AF2122/97
gcggccgccguccccgccgucgc

SEQ ID NO: 3068661 - RNA, 14 nt, Mycobacterium bovis subsp bovis AF2122/97
gcggccgccuaccc

SEQ ID NO: 3068662 - RNA, 23 nt, Mycobacterium bovis subsp bovis AF2122/97
gcggccgccuacccguucuucgc

SEQ ID NO: 3068663 - RNA, 16 nt, Mycobacterium bovis subsp bovis AF2122/97
gcggccgcgaccagcg

SEQ ID NO: 3068664 - RNA, 20 nt, Mycobacterium bovis subsp bovis AF2122/97
gcggccgcgaccagcgccgc

SEQ ID NO: 3068665 - RNA, 23 nt, Mycobacterium bovis subsp bovis AF2122/97
gcggccgcgaccagcgccgcacc

SEQ ID NO: 3068666 - RNA, 24 nt, Mycobacterium bovis subsp bovis AF2122/97
gcggccgcgaccagcgccgcaccc

SEQ ID NO: 3068667 - RNA, 22 nt, Mycobacterium bovis subsp bovis AF2122/97
gcggccgcgcgcaucgcgccuu

SEQ ID NO: 3068668 - RNA, 16 nt, Mycobacterium bovis subsp bovis AF2122/97
gcggccgcgcgcucga

SEQ ID NO: 3068669 - RNA, 17 nt, Mycobacterium bovis subsp bovis AF2122/97
gcggccgcgcgcucgag

SEQ ID NO: 3068670 - RNA, 15 nt, Mycobacterium bovis subsp bovis AF2122/97
gcggccgcgcugcag

SEQ ID NO: 3068671 - RNA, 20 nt, Mycobacterium bovis subsp bovis AF2122/97
gcggccgcgcugcagcacgg

SEQ ID NO: 3068672 - RNA, 15 nt, Mycobacterium bovis subsp bovis AF2122/97
gcggccgcggaugcu

SEQ ID NO: 3068673 - RNA, 14 nt, Mycobacterium bovis subsp bovis AF2122/97
gcggccgcggcagc

SEQ ID NO: 3068674 - RNA, 14 nt, Mycobacterium bovis subsp bovis AF2122/97
gcggccgcggcgau

SEQ ID NO: 3068675 - RNA, 18 nt, Mycobacterium bovis subsp bovis AF2122/97
gcggccgcggugacggcg

SEQ ID NO: 3068676 - RNA, 20 nt, Mycobacterium bovis subsp bovis AF2122/97
gcggccgcgugccgcccgcc

SEQ ID NO: 3068677 - RNA, 13 nt, Mycobacterium bovis subsp bovis AF2122/97
gcggccgcgugcu

SEQ ID NO: 3068678 - RNA, 23 nt, Mycobacterium bovis subsp bovis AF2122/97
gcggccgcucacauacagcaggc

SEQ ID NO: 3068679 - RNA, 17 nt, Mycobacterium bovis subsp bovis AF2122/97
gcggccgcuccaccucg

SEQ ID NO: 3068680 - RNA, 12 nt, Mycobacterium bovis subsp bovis AF2122/97
gcggccgcuggg

SEQ ID NO: 3068681 - RNA, 13 nt, Mycobacterium bovis subsp bovis AF2122/97
gcggccgcugggc

SEQ ID NO: 3068682 - RNA, 19 nt, Mycobacterium bovis subsp bovis AF2122/97
gcggccgcuugagcgaguu

SEQ ID NO: 3068683 - RNA, 16 nt, Mycobacterium bovis subsp bovis AF2122/97
gcggccggcacgaccg

SEQ ID NO: 3068684 - RNA, 13 nt, Mycobacterium bovis subsp bovis AF2122/97
gcggccggcacgg

SEQ ID NO: 3068685 - RNA, 16 nt, Mycobacterium bovis subsp bovis AF2122/97
gcggccggcacgggcg

SEQ ID NO: 3068686 - RNA, 15 nt, Mycobacterium bovis subsp bovis AF2122/97
gcggccggcaugcug

SEQ ID NO: 3068687 - RNA, 14 nt, Mycobacterium bovis subsp bovis AF2122/97
gcggccggccgccc

SEQ ID NO: 3068688 - RNA, 20 nt, Mycobacterium bovis subsp bovis AF2122/97
gcggccggccgcccgcucga

SEQ ID NO: 3068689 - RNA, 12 nt, Mycobacterium bovis subsp bovis AF2122/97
gcggccggcgcc

SEQ ID NO: 3068690 - RNA, 12 nt, Mycobacterium bovis subsp bovis AF2122/97
gcggccggcgcu

SEQ ID NO: 3068691 - RNA, 18 nt, Mycobacterium bovis subsp bovis AF2122/97
gcggccggcgcucgcggc

SEQ ID NO: 3068692 - RNA, 14 nt, Mycobacterium bovis subsp bovis AF2122/97
gcggccggcgucgg

SEQ ID NO: 3068693 - RNA, 15 nt, Mycobacterium bovis subsp bovis AF2122/97
gcggccggcgucggc

SEQ ID NO: 3068694 - RNA, 17 nt, Mycobacterium bovis subsp bovis AF2122/97
gcggccggcgugccagc

SEQ ID NO: 3068695 - RNA, 22 nt, Mycobacterium bovis subsp bovis AF2122/97
gcggccggcgugccagcacacg

SEQ ID NO: 3068696 - RNA, 14 nt, Mycobacterium bovis subsp bovis AF2122/97
gcggccgggccgcu

SEQ ID NO: 3068697 - RNA, 14 nt, Mycobacterium bovis subsp bovis AF2122/97
gcggccgggcgccc

SEQ ID NO: 3068698 - RNA, 17 nt, Mycobacterium bovis subsp bovis AF2122/97
gcggccgggcggccagg

SEQ ID NO: 3068699 - RNA, 20 nt, Mycobacterium bovis subsp bovis AF2122/97
gcggccgggcggccaggcgc

SEQ ID NO: 3068700 - RNA, 17 nt, Mycobacterium bovis subsp bovis AF2122/97
gcggccgggcguccucg

SEQ ID NO: 3068701 - RNA, 15 nt, Mycobacterium bovis subsp bovis AF2122/97
gcggccgggguggug

SEQ ID NO: 3068702 - RNA, 14 nt, Mycobacterium bovis subsp bovis AF2122/97
gcggccggguucgc

SEQ ID NO: 3068703 - RNA, 23 nt, Mycobacterium bovis subsp bovis AF2122/97
gcggccguagugcacgucggcgg

SEQ ID NO: 3068704 - RNA, 16 nt, Mycobacterium bovis subsp bovis AF2122/97
gcggccgucgcgggac

SEQ ID NO: 3068705 - RNA, 13 nt, Mycobacterium bovis subsp bovis AF2122/97
gcggccgucggga

SEQ ID NO: 3068706 - RNA, 18 nt, Mycobacterium bovis subsp bovis AF2122/97
gcggccgucgucggccag

SEQ ID NO: 3068707 - RNA, 17 nt, Mycobacterium bovis subsp bovis AF2122/97
gcggccguggcguggcu

SEQ ID NO: 3068708 - RNA, 16 nt, Mycobacterium bovis subsp bovis AF2122/97
gcggccgugucgggcg

SEQ ID NO: 3068709 - RNA, 22 nt, Mycobacterium bovis subsp bovis AF2122/97
gcggccuaacgaguaggcggcu

SEQ ID NO: 3068710 - RNA, 23 nt, Mycobacterium bovis subsp bovis AF2122/97
gcggccuaacgaguaggcggcuc

SEQ ID NO: 3068711 - RNA, 19 nt, Mycobacterium bovis subsp bovis AF2122/97
gcggccuagcgccacuuga

SEQ ID NO: 3068712 - RNA, 14 nt, Mycobacterium bovis subsp bovis AF2122/97
gcggccuaggacgc

SEQ ID NO: 3068713 - RNA, 21 nt, Mycobacterium bovis subsp bovis AF2122/97
gcggccuaggacgccgcccuc

SEQ ID NO: 3068714 - RNA, 14 nt, Mycobacterium bovis subsp bovis AF2122/97
gcggccuccaccac

SEQ ID NO: 3068715 - RNA, 20 nt, Mycobacterium bovis subsp bovis AF2122/97
gcggccuccaccacgucggg

SEQ ID NO: 3068716 - RNA, 18 nt, Mycobacterium bovis subsp bovis AF2122/97
gcggccuccagcacccgg

SEQ ID NO: 3068717 - RNA, 19 nt, Mycobacterium bovis subsp bovis AF2122/97
gcggccuccagcacccggu

SEQ ID NO: 3068718 - RNA, 13 nt, Mycobacterium bovis subsp bovis AF2122/97
gcggccucccgca

SEQ ID NO: 3068719 - RNA, 23 nt, Mycobacterium bovis subsp bovis AF2122/97
gcggccucccgcaaugcgagcgc

SEQ ID NO: 3068720 - RNA, 15 nt, Mycobacterium bovis subsp bovis AF2122/97
gcggccucccgggcc

SEQ ID NO: 3068721 - RNA, 20 nt, Mycobacterium bovis subsp bovis AF2122/97
gcggccucccgggccgccgc

SEQ ID NO: 3068722 - RNA, 21 nt, Mycobacterium bovis subsp bovis AF2122/97
gcggccucccgggccgccgcg

SEQ ID NO: 3068723 - RNA, 16 nt, Mycobacterium bovis subsp bovis AF2122/97
gcggccucgaccucuu

SEQ ID NO: 3068724 - RNA, 15 nt, Mycobacterium bovis subsp bovis AF2122/97
gcggccucgccggcg

SEQ ID NO: 3068725 - RNA, 16 nt, Mycobacterium bovis subsp bovis AF2122/97
gcggccucgccggcgc

SEQ ID NO: 3068726 - RNA, 19 nt, Mycobacterium bovis subsp bovis AF2122/97
gcggcgaggcggucgccga

SEQ ID NO: 3068727 - RNA, 12 nt, Mycobacterium bovis subsp bovis AF2122/97
gcggcgaguugg

SEQ ID NO: 3068728 - RNA, 20 nt, Mycobacterium bovis subsp bovis AF2122/97
gcggcgaguuggccguggcg

SEQ ID NO: 3068729 - RNA, 19 nt, Mycobacterium bovis subsp bovis AF2122/97
gcggcgauacccaucgauc

SEQ ID NO: 3068730 - RNA, 20 nt, Mycobacterium bovis subsp bovis AF2122/97
gcggcgauacccaucgaucg

SEQ ID NO: 3068731 - RNA, 17 nt, Mycobacterium bovis subsp bovis AF2122/97
gcggcgauaccgguugc

SEQ ID NO: 3068732 - RNA, 11 nt, Mycobacterium bovis subsp bovis AF2122/97
gcggcgaucaa

SEQ ID NO: 3068733 - RNA, 23 nt, Mycobacterium bovis subsp bovis AF2122/97
gcggcgaucaacucgggcagcgc

SEQ ID NO: 3068734 - RNA, 16 nt, Mycobacterium bovis subsp bovis AF2122/97
gcggcgaucaggcgga

SEQ ID NO: 3068735 - RNA, 19 nt, Mycobacterium bovis subsp bovis AF2122/97
gcggcgaucaggcggacgg

SEQ ID NO: 3068736 - RNA, 23 nt, Mycobacterium bovis subsp bovis AF2122/97
gcggcgaugaccgggcgauucgc

SEQ ID NO: 3068737 - RNA, 20 nt, Mycobacterium bovis subsp bovis AF2122/97
gcggcgaugauggcgcgauc

SEQ ID NO: 3068738 - RNA, 12 nt, Mycobacterium bovis subsp bovis AF2122/97
gcggcgaugggc

SEQ ID NO: 3068739 - RNA, 22 nt, Mycobacterium bovis subsp bovis AF2122/97
gcggcgaugguagucgcgaccg

SEQ ID NO: 3068740 - RNA, 21 nt, Mycobacterium bovis subsp bovis AF2122/97
gcggcgauucccgcgaagcgg

SEQ ID NO: 3068741 - RNA, 15 nt, Mycobacterium bovis subsp bovis AF2122/97
gcggcgcaagcccac

SEQ ID NO: 3068742 - RNA, 16 nt, Mycobacterium bovis subsp bovis AF2122/97
gcggcgcacaacccgu

SEQ ID NO: 3068743 - RNA, 19 nt, Mycobacterium bovis subsp bovis AF2122/97
gcggcgcacaacccgucga

SEQ ID NO: 3068744 - RNA, 14 nt, Mycobacterium bovis subsp bovis AF2122/97
gcggcgcagcaccg

SEQ ID NO: 3068745 - RNA, 18 nt, Mycobacterium bovis subsp bovis AF2122/97
gcggcgcagcaccgucgg

SEQ ID NO: 3068746 - RNA, 20 nt, Mycobacterium bovis subsp bovis AF2122/97
gcggcgcagcaccgucggca

SEQ ID NO: 3068747 - RNA, 21 nt, Mycobacterium bovis subsp bovis AF2122/97
gcggcgcagcacggcggccac

SEQ ID NO: 3068748 - RNA, 11 nt, Mycobacterium bovis subsp bovis AF2122/97
gcggcgcagcg

SEQ ID NO: 3068749 - RNA, 21 nt, Mycobacterium bovis subsp bovis AF2122/97
gcggcgcaggucgcgcaguug

SEQ ID NO: 3068750 - RNA, 14 nt, Mycobacterium bovis subsp bovis AF2122/97
gcggcgcaguuucc

SEQ ID NO: 3068751 - RNA, 21 nt, Mycobacterium bovis subsp bovis AF2122/97
gcggcgcaugcaagucaaacg

SEQ ID NO: 3068752 - RNA, 18 nt, Mycobacterium bovis subsp bovis AF2122/97
gcggcgcauuccggcgcc

SEQ ID NO: 3068753 - RNA, 23 nt, Mycobacterium bovis subsp bovis AF2122/97
gcggcgccaguauggccgccacc

SEQ ID NO: 3068754 - RNA, 18 nt, Mycobacterium bovis subsp bovis AF2122/97
gcggcgccauagccgcga

SEQ ID NO: 3068755 - RNA, 23 nt, Mycobacterium bovis subsp bovis AF2122/97
gcggcgccauagccgcgacccgc

SEQ ID NO: 3068756 - RNA, 14 nt, Mycobacterium bovis subsp bovis AF2122/97
gcggcgcccaggaa

SEQ ID NO: 3068757 - RNA, 13 nt, Mycobacterium bovis subsp bovis AF2122/97
gcggcgcccaucg

SEQ ID NO: 3068758 - RNA, 23 nt, Mycobacterium bovis subsp bovis AF2122/97
gcggcgcccaucgcgacggcccg

SEQ ID NO: 3068759 - RNA, 15 nt, Mycobacterium bovis subsp bovis AF2122/97
gcggcgcccgccacc

SEQ ID NO: 3068760 - RNA, 11 nt, Mycobacterium bovis subsp bovis AF2122/97
gcggcgcccgg

SEQ ID NO: 3068761 - RNA, 13 nt, Mycobacterium bovis subsp bovis AF2122/97
gcggcgcccggcg

SEQ ID NO: 3068762 - RNA, 21 nt, Mycobacterium bovis subsp bovis AF2122/97
gcggcgcccggcggaucccga

SEQ ID NO: 3068763 - RNA, 17 nt, Mycobacterium bovis subsp bovis AF2122/97
gcggcgcccggucgagc

SEQ ID NO: 3068764 - RNA, 13 nt, Mycobacterium bovis subsp bovis AF2122/97
gcggcgccgcaga

SEQ ID NO: 3068765 - RNA, 18 nt, Mycobacterium bovis subsp bovis AF2122/97
gcggcgccgcagaucacc

SEQ ID NO: 3068766 - RNA, 12 nt, Mycobacterium bovis subsp bovis AF2122/97
gcggcgccgcca

SEQ ID NO: 3068767 - RNA, 13 nt, Mycobacterium bovis subsp bovis AF2122/97
gcggcgccgccac

SEQ ID NO: 3068768 - RNA, 15 nt, Mycobacterium bovis subsp bovis AF2122/97
gcggcgccgccacgg

SEQ ID NO: 3068769 - RNA, 18 nt, Mycobacterium bovis subsp bovis AF2122/97
gcggcgccgccacgguac

SEQ ID NO: 3068770 - RNA, 13 nt, Mycobacterium bovis subsp bovis AF2122/97
gcggcgccgccca

SEQ ID NO: 3068771 - RNA, 15 nt, Mycobacterium bovis subsp bovis AF2122/97
gcggcgccgcccaac

SEQ ID NO: 3068772 - RNA, 13 nt, Mycobacterium bovis subsp bovis AF2122/97
gcggcgccgcccu

SEQ ID NO: 3068773 - RNA, 12 nt, Mycobacterium bovis subsp bovis AF2122/97
gcggcgccgccu

SEQ ID NO: 3068774 - RNA, 15 nt, Mycobacterium bovis subsp bovis AF2122/97
gcggcgccgccugga

SEQ ID NO: 3068775 - RNA, 20 nt, Mycobacterium bovis subsp bovis AF2122/97
gcggcgccggaggcggcgcu

SEQ ID NO: 3068776 - RNA, 13 nt, Mycobacterium bovis subsp bovis AF2122/97
gcggcgccggccu

SEQ ID NO: 3068777 - RNA, 16 nt, Mycobacterium bovis subsp bovis AF2122/97
gcggcgccggccucgc

SEQ ID NO: 3068778 - RNA, 12 nt, Mycobacterium bovis subsp bovis AF2122/97
gcggcgccgggg

SEQ ID NO: 3068779 - RNA, 21 nt, Mycobacterium bovis subsp bovis AF2122/97
gcggcgccggggggcugcugc

SEQ ID NO: 3068780 - RNA, 22 nt, Mycobacterium bovis subsp bovis AF2122/97
gcggcgccggggggcugcugcu

SEQ ID NO: 3068781 - RNA, 16 nt, Mycobacterium bovis subsp bovis AF2122/97
gcggcgccggugguac

SEQ ID NO: 3068782 - RNA, 12 nt, Mycobacterium bovis subsp bovis AF2122/97
gcggcgccgucg

SEQ ID NO: 3068783 - RNA, 13 nt, Mycobacterium bovis subsp bovis AF2122/97
gcggcgccgucga

SEQ ID NO: 3068784 - RNA, 13 nt, Mycobacterium bovis subsp bovis AF2122/97
gcggcgccgucgu

SEQ ID NO: 3068785 - RNA, 21 nt, Mycobacterium bovis subsp bovis AF2122/97
gcggcgccgugaucagcucgc

SEQ ID NO: 3068786 - RNA, 12 nt, Mycobacterium bovis subsp bovis AF2122/97
gcggcgccguug

SEQ ID NO: 3068787 - RNA, 14 nt, Mycobacterium bovis subsp bovis AF2122/97
gcggcgccguugcc

SEQ ID NO: 3068788 - RNA, 17 nt, Mycobacterium bovis subsp bovis AF2122/97
gcggcgccguugccacc

SEQ ID NO: 3068789 - RNA, 13 nt, Mycobacterium bovis subsp bovis AF2122/97
gcggcgccuccgc

SEQ ID NO: 3068790 - RNA, 22 nt, Mycobacterium bovis subsp bovis AF2122/97
gcggcgccuguucgggagcuga

SEQ ID NO: 3068791 - RNA, 15 nt, Mycobacterium bovis subsp bovis AF2122/97
gcggcgcgaagucuu

SEQ ID NO: 3068792 - RNA, 18 nt, Mycobacterium bovis subsp bovis AF2122/97
gcggcgcgaagucuugac

SEQ ID NO: 3068793 - RNA, 22 nt, Mycobacterium bovis subsp bovis AF2122/97
gcggcgcgaagucuugaccgca

SEQ ID NO: 3068794 - RNA, 17 nt, Mycobacterium bovis subsp bovis AF2122/97
gcggcgcgaccgucugg

SEQ ID NO: 3068795 - RNA, 13 nt, Mycobacterium bovis subsp bovis AF2122/97
gcggcgcgagcag

SEQ ID NO: 3068796 - RNA, 17 nt, Mycobacterium bovis subsp bovis AF2122/97
gcggcgcgcagcuugga

SEQ ID NO: 3068797 - RNA, 16 nt, Mycobacterium bovis subsp bovis AF2122/97
gcggcgcgccgaucga

SEQ ID NO: 3068798 - RNA, 16 nt, Mycobacterium bovis subsp bovis AF2122/97
gcggcgcgcggggccu

SEQ ID NO: 3068799 - RNA, 16 nt, Mycobacterium bovis subsp bovis AF2122/97
gcggcgcgcugcacgg

SEQ ID NO: 3068800 - RNA, 17 nt, Mycobacterium bovis subsp bovis AF2122/97
gcggcgcggcaaaccug

SEQ ID NO: 3068801 - RNA, 16 nt, Mycobacterium bovis subsp bovis AF2122/97
gcggcgcggccgcagc

SEQ ID NO: 3068802 - RNA, 21 nt, Mycobacterium bovis subsp bovis AF2122/97
gcggcgcggccgcagccagca

SEQ ID NO: 3068803 - RNA, 24 nt, Mycobacterium bovis subsp bovis AF2122/97
gcggcgcgggggugggcgugacgg

SEQ ID NO: 3068804 - RNA, 12 nt, Mycobacterium bovis subsp bovis AF2122/97
gcggcgcgggug

SEQ ID NO: 3068805 - RNA, 14 nt, Mycobacterium bovis subsp bovis AF2122/97
gcggcgcgggugcg

SEQ ID NO: 3068806 - RNA, 18 nt, Mycobacterium bovis subsp bovis AF2122/97
gcggcgcgggugcggauc

SEQ ID NO: 3068807 - RNA, 13 nt, Mycobacterium bovis subsp bovis AF2122/97
gcggcgcggucga

SEQ ID NO: 3068808 - RNA, 20 nt, Mycobacterium bovis subsp bovis AF2122/97
gcggcgcggucgaagcuggc

SEQ ID NO: 3068809 - RNA, 23 nt, Mycobacterium bovis subsp bovis AF2122/97
gcggcgcggucgaagcuggcacg

SEQ ID NO: 3068810 - RNA, 13 nt, Mycobacterium bovis subsp bovis AF2122/97
gcggcgcgguuuc

SEQ ID NO: 3068811 - RNA, 13 nt, Mycobacterium bovis subsp bovis AF2122/97
gcggcgcucggcg

SEQ ID NO: 3068812 - RNA, 21 nt, Mycobacterium bovis subsp bovis AF2122/97
gcggcgcucggcgccacggug

SEQ ID NO: 3068813 - RNA, 17 nt, Mycobacterium bovis subsp bovis AF2122/97
gcggcguauugcggccu

SEQ ID NO: 3068814 - RNA, 13 nt, Mycobacterium bovis subsp bovis AF2122/97
gcggcguccagca

SEQ ID NO: 3068815 - RNA, 15 nt, Mycobacterium bovis subsp bovis AF2122/97
gcggcguccagcagc

SEQ ID NO: 3068816 - RNA, 16 nt, Mycobacterium bovis subsp bovis AF2122/97
gcggcguccagcagcg

SEQ ID NO: 3068817 - RNA, 12 nt, Mycobacterium bovis subsp bovis AF2122/97
gcggcguccauc

SEQ ID NO: 3068818 - RNA, 21 nt, Mycobacterium bovis subsp bovis AF2122/97
gcggcguccaucgcgcgccga

SEQ ID NO: 3068819 - RNA, 13 nt, Mycobacterium bovis subsp bovis AF2122/97
gcggcgucgacgg

SEQ ID NO: 3068820 - RNA, 14 nt, Mycobacterium bovis subsp bovis AF2122/97
gcggcgucgacggc

SEQ ID NO: 3068821 - RNA, 16 nt, Mycobacterium bovis subsp bovis AF2122/97
gcggcgucgacggcuc

SEQ ID NO: 3068822 - RNA, 12 nt, Mycobacterium bovis subsp bovis AF2122/97
gcggcgucggga

SEQ ID NO: 3068823 - RNA, 13 nt, Mycobacterium bovis subsp bovis AF2122/97
gcggcgucgucga

SEQ ID NO: 3068824 - RNA, 14 nt, Mycobacterium bovis subsp bovis AF2122/97
gcggcgucgucgau

SEQ ID NO: 3068825 - RNA, 21 nt, Mycobacterium bovis subsp bovis AF2122/97
gcggcgucgugagaggccaag

SEQ ID NO: 3068826 - RNA, 23 nt, Mycobacterium bovis subsp bovis AF2122/97
gcggcgucguggaucuucgcgcu

SEQ ID NO: 3068827 - RNA, 13 nt, Mycobacterium bovis subsp bovis AF2122/97
gcggcgucguucg

SEQ ID NO: 3068828 - RNA, 15 nt, Mycobacterium bovis subsp bovis AF2122/97
gcggcgugccgggug

SEQ ID NO: 3068829 - RNA, 14 nt, Mycobacterium bovis subsp bovis AF2122/97
gcggcgugcgcggu

SEQ ID NO: 3068830 - RNA, 12 nt, Mycobacterium bovis subsp bovis AF2122/97
gcggcguggcgc

SEQ ID NO: 3068831 - RNA, 16 nt, Mycobacterium bovis subsp bovis AF2122/97
gcggcguggcgccggc

SEQ ID NO: 3068832 - RNA, 18 nt, Mycobacterium bovis subsp bovis AF2122/97
gcggcguggcgccggcca

SEQ ID NO: 3068833 - RNA, 22 nt, Mycobacterium bovis subsp bovis AF2122/97
gcggcgugucguugccagggcg

SEQ ID NO: 3068834 - RNA, 21 nt, Mycobacterium bovis subsp bovis AF2122/97
gcggcguuaccaccgucaccg

SEQ ID NO: 3068835 - RNA, 19 nt, Mycobacterium bovis subsp bovis AF2122/97
gcggcguuccaacucgguu

SEQ ID NO: 3068836 - RNA, 14 nt, Mycobacterium bovis subsp bovis AF2122/97
gcggcguucgaugc

SEQ ID NO: 3068837 - RNA, 19 nt, Mycobacterium bovis subsp bovis AF2122/97
gcggcguucgaugccacau

SEQ ID NO: 3068838 - RNA, 12 nt, Mycobacterium bovis subsp bovis AF2122/97
gcggcguucggc

SEQ ID NO: 3068839 - RNA, 17 nt, Mycobacterium bovis subsp bovis AF2122/97
gcggcguugagcuggcg

SEQ ID NO: 3068840 - RNA, 16 nt, Mycobacterium bovis subsp bovis AF2122/97
gcggcguugugaccgc

SEQ ID NO: 3068841 - RNA, 19 nt, Mycobacterium bovis subsp bovis AF2122/97
gcggcguugugaccgccga

SEQ ID NO: 3068842 - RNA, 21 nt, Mycobacterium bovis subsp bovis AF2122/97
gcggcguuguggcguguggcu

SEQ ID NO: 3068843 - RNA, 16 nt, Mycobacterium bovis subsp bovis AF2122/97
gcggcuacaucggcgg

SEQ ID NO: 3068844 - RNA, 18 nt, Mycobacterium bovis subsp bovis AF2122/97
gcggcuacaucggcggcg

SEQ ID NO: 3068845 - RNA, 21 nt, Mycobacterium bovis subsp bovis AF2122/97
gcggcuacccauggcccguug

SEQ ID NO: 3068846 - RNA, 16 nt, Mycobacterium bovis subsp bovis AF2122/97
gcggcuacggcugccc

SEQ ID NO: 3068847 - RNA, 17 nt, Mycobacterium bovis subsp bovis AF2122/97
gcggcuaggcaccagcg

SEQ ID NO: 3068848 - RNA, 21 nt, Mycobacterium bovis subsp bovis AF2122/97
gcggcuaggccagcacggcga

SEQ ID NO: 3068849 - RNA, 22 nt, Mycobacterium bovis subsp bovis AF2122/97
gcggcuaggccagcacggcgac

SEQ ID NO: 3068850 - RNA, 19 nt, Mycobacterium bovis subsp bovis AF2122/97
gcggcuauggcgccgcggc

SEQ ID NO: 3068851 - RNA, 22 nt, Mycobacterium bovis subsp bovis AF2122/97
gcggcucaaccucuggcggcgg

SEQ ID NO: 3068852 - RNA, 13 nt, Mycobacterium bovis subsp bovis AF2122/97
gcggcucaccgcg

SEQ ID NO: 3068853 - RNA, 16 nt, Mycobacterium bovis subsp bovis AF2122/97
gcggcuccaccgggcc

SEQ ID NO: 3068854 - RNA, 18 nt, Mycobacterium bovis subsp bovis AF2122/97
gcggcuccaccgggcccg

SEQ ID NO: 3068855 - RNA, 19 nt, Mycobacterium bovis subsp bovis AF2122/97
gcggcuccaccgggcccgc

SEQ ID NO: 3068856 - RNA, 23 nt, Mycobacterium bovis subsp bovis AF2122/97
gcggcuccaccgggcccgccggc

SEQ ID NO: 3068857 - RNA, 18 nt, Mycobacterium bovis subsp bovis AF2122/97
gcggcuccgagggcugcg

SEQ ID NO: 3068858 - RNA, 18 nt, Mycobacterium bovis subsp bovis AF2122/97
gcggcuccguuguccagc

SEQ ID NO: 3068859 - RNA, 12 nt, Mycobacterium bovis subsp bovis AF2122/97
gcggcucgccgg

SEQ ID NO: 3068860 - RNA, 13 nt, Mycobacterium bovis subsp bovis AF2122/97
gcggcucgccggc

SEQ ID NO: 3068861 - RNA, 13 nt, Mycobacterium bovis subsp bovis AF2122/97
gcggcucgcguag

SEQ ID NO: 3068862 - RNA, 16 nt, Mycobacterium bovis subsp bovis AF2122/97
gcggcucgcguaggug

SEQ ID NO: 3068863 - RNA, 19 nt, Mycobacterium bovis subsp bovis AF2122/97
gcggcucgcguagguggca

SEQ ID NO: 3068864 - RNA, 17 nt, Mycobacterium bovis subsp bovis AF2122/97
gcggcucgggugcgccc

SEQ ID NO: 3068865 - RNA, 20 nt, Mycobacterium bovis subsp bovis AF2122/97
gcggcucgggugcgcccggc

SEQ ID NO: 3068866 - RNA, 18 nt, Mycobacterium bovis subsp bovis AF2122/97
gcggcucguuggcaaaga

SEQ ID NO: 3068867 - RNA, 21 nt, Mycobacterium bovis subsp bovis AF2122/97
gcggcucuagaucgccgagcg

SEQ ID NO: 3068868 - RNA, 20 nt, Mycobacterium bovis subsp bovis AF2122/97
gcggcucuauccggcgcagg

SEQ ID NO: 3068869 - RNA, 12 nt, Mycobacterium bovis subsp bovis AF2122/97
gcggcugagccg

SEQ ID NO: 3068870 - RNA, 22 nt, Mycobacterium bovis subsp bovis AF2122/97
gcggcugagccgcaucuggccg

SEQ ID NO: 3068871 - RNA, 22 nt, Mycobacterium bovis subsp bovis AF2122/97
gcggcugcaacgauugaacucu

SEQ ID NO: 3068872 - RNA, 17 nt, Mycobacterium bovis subsp bovis AF2122/97
gcggcugcacgcugcgg

SEQ ID NO: 3068873 - RNA, 12 nt, Mycobacterium bovis subsp bovis AF2122/97
gcggcugccagc

SEQ ID NO: 3068874 - RNA, 23 nt, Mycobacterium bovis subsp bovis AF2122/97
gcggcugcccgagaucgcgugcg

SEQ ID NO: 3068875 - RNA, 13 nt, Mycobacterium bovis subsp bovis AF2122/97
gcggcugccgguu

SEQ ID NO: 3068876 - RNA, 16 nt, Mycobacterium bovis subsp bovis AF2122/97
gcggcugcugcgcggu

SEQ ID NO: 3068877 - RNA, 15 nt, Mycobacterium bovis subsp bovis AF2122/97
gcggcuggcccgcau

SEQ ID NO: 3068878 - RNA, 23 nt, Mycobacterium bovis subsp bovis AF2122/97
gcggcuggcccgcaugccggcgc

SEQ ID NO: 3068879 - RNA, 16 nt, Mycobacterium bovis subsp bovis AF2122/97
gcggcuggggccccgc

SEQ ID NO: 3068880 - RNA, 22 nt, Mycobacterium bovis subsp bovis AF2122/97
gcggcuggggccccgcgccggc

SEQ ID NO: 3068881 - RNA, 17 nt, Mycobacterium bovis subsp bovis AF2122/97
gcggcugguguccagcc

SEQ ID NO: 3068882 - RNA, 22 nt, Mycobacterium bovis subsp bovis AF2122/97
gcggcugguguccagccaggcg

SEQ ID NO: 3068883 - RNA, 17 nt, Mycobacterium bovis subsp bovis AF2122/97
gcggcuggugucgggcg

SEQ ID NO: 3068884 - RNA, 18 nt, Mycobacterium bovis subsp bovis AF2122/97
gcggcugucacgccugcc

SEQ ID NO: 3068885 - RNA, 21 nt, Mycobacterium bovis subsp bovis AF2122/97
gcggcugucacgccugccacc

SEQ ID NO: 3068886 - RNA, 22 nt, Mycobacterium bovis subsp bovis AF2122/97
gcggcugucacgccugccaccg

SEQ ID NO: 3068887 - RNA, 17 nt, Mycobacterium bovis subsp bovis AF2122/97
gcggcugucggccgggu

SEQ ID NO: 3068888 - RNA, 23 nt, Mycobacterium bovis subsp bovis AF2122/97
gcggcugucgugauacagcucgg

SEQ ID NO: 3068889 - RNA, 15 nt, Mycobacterium bovis subsp bovis AF2122/97
gcggcugugcccgau

SEQ ID NO: 3068890 - RNA, 20 nt, Mycobacterium bovis subsp bovis AF2122/97
gcggcugugcccgaucagcc

SEQ ID NO: 3068891 - RNA, 19 nt, Mycobacterium bovis subsp bovis AF2122/97
gcggcuguggucgcugcug

SEQ ID NO: 3068892 - RNA, 16 nt, Mycobacterium bovis subsp bovis AF2122/97
gcggcuguugcggcgg

SEQ ID NO: 3068893 - RNA, 19 nt, Mycobacterium bovis subsp bovis AF2122/97
gcggcuguugcggcggcgc

SEQ ID NO: 3068894 - RNA, 21 nt, Mycobacterium bovis subsp bovis AF2122/97
gcggcuuagaacgugcuggug

SEQ ID NO: 3068895 - RNA, 18 nt, Mycobacterium bovis subsp bovis AF2122/97
gcggcuucaguccggccc

SEQ ID NO: 3068896 - RNA, 14 nt, Mycobacterium bovis subsp bovis AF2122/97
gcggcuucgacguc

SEQ ID NO: 3068897 - RNA, 20 nt, Mycobacterium bovis subsp bovis AF2122/97
gcggcuucgacgucggcgac

SEQ ID NO: 3068898 - RNA, 13 nt, Mycobacterium bovis subsp bovis AF2122/97
gcggcuucgcccc

SEQ ID NO: 3068899 - RNA, 17 nt, Mycobacterium bovis subsp bovis AF2122/97
gcggcuucggcagaccg

SEQ ID NO: 3068900 - RNA, 20 nt, Mycobacterium bovis subsp bovis AF2122/97
gcgggcguuggccagcaggu

SEQ ID NO: 3068901 - RNA, 15 nt, Mycobacterium bovis subsp bovis AF2122/97
gcgggcuaggcggcg

SEQ ID NO: 3068902 - RNA, 23 nt, Mycobacterium bovis subsp bovis AF2122/97
gcgggcucaacaccagccggucg

SEQ ID NO: 3068903 - RNA, 17 nt, Mycobacterium bovis subsp bovis AF2122/97
gcgggcuccccggcaac

SEQ ID NO: 3068904 - RNA, 18 nt, Mycobacterium bovis subsp bovis AF2122/97
gcgggcuccggcucgaca

SEQ ID NO: 3068905 - RNA, 12 nt, Mycobacterium bovis subsp bovis AF2122/97
gcgggcucgccc

SEQ ID NO: 3068906 - RNA, 14 nt, Mycobacterium bovis subsp bovis AF2122/97
gcgggcucgcccgc

SEQ ID NO: 3068907 - RNA, 23 nt, Mycobacterium bovis subsp bovis AF2122/97
gcgggcucuacucgcggccggcg

SEQ ID NO: 3068908 - RNA, 23 nt, Mycobacterium bovis subsp bovis AF2122/97
gcgggcugaaacauccccgagcu

SEQ ID NO: 3068909 - RNA, 16 nt, Mycobacterium bovis subsp bovis AF2122/97
gcgggcugaccaacuc

SEQ ID NO: 3068910 - RNA, 23 nt, Mycobacterium bovis subsp bovis AF2122/97
gcgggcugcagugacucgaucac

SEQ ID NO: 3068911 - RNA, 20 nt, Mycobacterium bovis subsp bovis AF2122/97
gcgggcugcgcuacccagcg

SEQ ID NO: 3068912 - RNA, 15 nt, Mycobacterium bovis subsp bovis AF2122/97
gcgggcuguaggcga

SEQ ID NO: 3068913 - RNA, 20 nt, Mycobacterium bovis subsp bovis AF2122/97
gcgggcugugaacagcgcgu

SEQ ID NO: 3068914 - RNA, 16 nt, Mycobacterium bovis subsp bovis AF2122/97
gcgggcuugagcgccg

SEQ ID NO: 3068915 - RNA, 17 nt, Mycobacterium bovis subsp bovis AF2122/97
gcgggcuugagcgccga

SEQ ID NO: 3068916 - RNA, 19 nt, Mycobacterium bovis subsp bovis AF2122/97
gcgggcuugagcgccgaug

SEQ ID NO: 3068917 - RNA, 22 nt, Mycobacterium bovis subsp bovis AF2122/97
gcgggcuugagcgccgaugugg

SEQ ID NO: 3068918 - RNA, 14 nt, Mycobacterium bovis subsp bovis AF2122/97
gcgggcuugccguc

SEQ ID NO: 3068919 - RNA, 15 nt, Mycobacterium bovis subsp bovis AF2122/97
gcgggcuugccguug

SEQ ID NO: 3068920 - RNA, 21 nt, Mycobacterium bovis subsp bovis AF2122/97
gcgggcuuggggucccgccgg

SEQ ID NO: 3068921 - RNA, 17 nt, Mycobacterium bovis subsp bovis AF2122/97
gcgggcuuugagcgccc

SEQ ID NO: 3068922 - RNA, 21 nt, Mycobacterium bovis subsp bovis AF2122/97
gcggggaaaccggccagccga

SEQ ID NO: 3068923 - RNA, 23 nt, Mycobacterium bovis subsp bovis AF2122/97
gcggggaaucacccacucgccga

SEQ ID NO: 3068924 - RNA, 18 nt, Mycobacterium bovis subsp bovis AF2122/97
gcggggaccgcggucaug

SEQ ID NO: 3068925 - RNA, 16 nt, Mycobacterium bovis subsp bovis AF2122/97
gcggggacggcggcaa

SEQ ID NO: 3068926 - RNA, 18 nt, Mycobacterium bovis subsp bovis AF2122/97
gcggggacggcggcaagg

SEQ ID NO: 3068927 - RNA, 14 nt, Mycobacterium bovis subsp bovis AF2122/97
gcggggaucagcga

SEQ ID NO: 3068928 - RNA, 16 nt, Mycobacterium bovis subsp bovis AF2122/97
gcggggaucagcgagu

SEQ ID NO: 3068929 - RNA, 16 nt, Mycobacterium bovis subsp bovis AF2122/97
gcggggaucgcuggcc

SEQ ID NO: 3068930 - RNA, 20 nt, Mycobacterium bovis subsp bovis AF2122/97
gcggggaucgcuggccgcga

SEQ ID NO: 3068931 - RNA, 23 nt, Mycobacterium bovis subsp bovis AF2122/97
gcggggauguccgcggccaccac

SEQ ID NO: 3068932 - RNA, 21 nt, Mycobacterium bovis subsp bovis AF2122/97
gcggggauguuuuuggccgcg

SEQ ID NO: 3068933 - RNA, 22 nt, Mycobacterium bovis subsp bovis AF2122/97
gcggggauguuuuuggccgcgg

SEQ ID NO: 3068934 - RNA, 20 nt, Mycobacterium bovis subsp bovis AF2122/97
gcggggauuggugcccagcg

SEQ ID NO: 3068935 - RNA, 21 nt, Mycobacterium bovis subsp bovis AF2122/97
gcggggauuggugcccagcgc

SEQ ID NO: 3068936 - RNA, 15 nt, Mycobacterium bovis subsp bovis AF2122/97
gcggggcagcgggcc

SEQ ID NO: 3068937 - RNA, 15 nt, Mycobacterium bovis subsp bovis AF2122/97
gcggggcccacacgg

SEQ ID NO: 3068938 - RNA, 15 nt, Mycobacterium bovis subsp bovis AF2122/97
gcggggccgccgcgg

SEQ ID NO: 3068939 - RNA, 16 nt, Mycobacterium bovis subsp bovis AF2122/97
gcggggccgccgcggc

SEQ ID NO: 3068940 - RNA, 13 nt, Mycobacterium bovis subsp bovis AF2122/97
gcggggccggccg

SEQ ID NO: 3068941 - RNA, 15 nt, Mycobacterium bovis subsp bovis AF2122/97
gcggggccggcggcu

SEQ ID NO: 3068942 - RNA, 16 nt, Mycobacterium bovis subsp bovis AF2122/97
gcggggccggcggcuc

SEQ ID NO: 3068943 - RNA, 13 nt, Mycobacterium bovis subsp bovis AF2122/97
gcggggccggucg

SEQ ID NO: 3068944 - RNA, 22 nt, Mycobacterium bovis subsp bovis AF2122/97
gcggggcgaaguggaucuggcg

SEQ ID NO: 3068945 - RNA, 15 nt, Mycobacterium bovis subsp bovis AF2122/97
gcggggcgaucccca

SEQ ID NO: 3068946 - RNA, 22 nt, Mycobacterium bovis subsp bovis AF2122/97
gcggggcgauccccagcaccac

SEQ ID NO: 3068947 - RNA, 21 nt, Mycobacterium bovis subsp bovis AF2122/97
gcggggcggacucacgaggca

SEQ ID NO: 3068948 - RNA, 13 nt, Mycobacterium bovis subsp bovis AF2122/97
gcggggcggcggu

SEQ ID NO: 3068949 - RNA, 17 nt, Mycobacterium bovis subsp bovis AF2122/97
gcggggcggcggugggc

SEQ ID NO: 3068950 - RNA, 17 nt, Mycobacterium bovis subsp bovis AF2122/97
gcggggcugggcgccau

SEQ ID NO: 3068951 - RNA, 15 nt, Mycobacterium bovis subsp bovis AF2122/97
gcgggggaccccgcc

SEQ ID NO: 3068952 - RNA, 20 nt, Mycobacterium bovis subsp bovis AF2122/97
gcgggggaccccgccagccg

SEQ ID NO: 3068953 - RNA, 15 nt, Mycobacterium bovis subsp bovis AF2122/97
gcgggggagcgaacg

SEQ ID NO: 3068954 - RNA, 18 nt, Mycobacterium bovis subsp bovis AF2122/97
gcgggggagcgaacggcg

SEQ ID NO: 3068955 - RNA, 12 nt, Mycobacterium bovis subsp bovis AF2122/97
gcgggggcggcg

SEQ ID NO: 3068956 - RNA, 13 nt, Mycobacterium bovis subsp bovis AF2122/97
gcgggggcggcgg

SEQ ID NO: 3068957 - RNA, 17 nt, Mycobacterium bovis subsp bovis AF2122/97
gcgggggcgucgccgcc

SEQ ID NO: 3068958 - RNA, 18 nt, Mycobacterium bovis subsp bovis AF2122/97
gcgggggcgucgccgccg

SEQ ID NO: 3068959 - RNA, 19 nt, Mycobacterium bovis subsp bovis AF2122/97
gcgggggcgucgccgccgg

SEQ ID NO: 3068960 - RNA, 21 nt, Mycobacterium bovis subsp bovis AF2122/97
gcgggggcuuaugcgucugcu

SEQ ID NO: 3068961 - RNA, 22 nt, Mycobacterium bovis subsp bovis AF2122/97
gcggggguggaaucagggucug

SEQ ID NO: 3068962 - RNA, 13 nt, Mycobacterium bovis subsp bovis AF2122/97
gcgggggugggcg

SEQ ID NO: 3068963 - RNA, 16 nt, Mycobacterium bovis subsp bovis AF2122/97
gcgggguaggcccagc

SEQ ID NO: 3068964 - RNA, 21 nt, Mycobacterium bovis subsp bovis AF2122/97
gcgggguaggcccagcaaccg

SEQ ID NO: 3068965 - RNA, 18 nt, Mycobacterium bovis subsp bovis AF2122/97
gcggggucuugacggcgc

SEQ ID NO: 3068966 - RNA, 19 nt, Mycobacterium bovis subsp bovis AF2122/97
gcggggugagggggugguc

SEQ ID NO: 3068967 - RNA, 23 nt, Mycobacterium bovis subsp bovis AF2122/97
gcggggugagugaccacgcugcu

SEQ ID NO: 3068968 - RNA, 17 nt, Mycobacterium bovis subsp bovis AF2122/97
gcgggguggaauucauc

SEQ ID NO: 3068969 - RNA, 20 nt, Mycobacterium bovis subsp bovis AF2122/97
gcgggguggcggcgcugcgc

SEQ ID NO: 3068970 - RNA, 19 nt, Mycobacterium bovis subsp bovis AF2122/97
gcgggguugaccguggucg

SEQ ID NO: 3068971 - RNA, 18 nt, Mycobacterium bovis subsp bovis AF2122/97
gcgggguugaucaccgac

SEQ ID NO: 3068972 - RNA, 15 nt, Mycobacterium bovis subsp bovis AF2122/97
gcgggguuggccgug

SEQ ID NO: 3068973 - RNA, 17 nt, Mycobacterium bovis subsp bovis AF2122/97
gcgggguugggcggagc

SEQ ID NO: 3068974 - RNA, 16 nt, Mycobacterium bovis subsp bovis AF2122/97
gcggguaaccggcucc

SEQ ID NO: 3068975 - RNA, 17 nt, Mycobacterium bovis subsp bovis AF2122/97
gcggguaaccggcuccg

SEQ ID NO: 3068976 - RNA, 15 nt, Mycobacterium bovis subsp bovis AF2122/97
gcggguaacgauugu

SEQ ID NO: 3068977 - RNA, 20 nt, Mycobacterium bovis subsp bovis AF2122/97
gcggguaagacgucggacgg

SEQ ID NO: 3068978 - RNA, 20 nt, Mycobacterium bovis subsp bovis AF2122/97
gcggguaagcgaccgacgcc

SEQ ID NO: 3068979 - RNA, 18 nt, Mycobacterium bovis subsp bovis AF2122/97
gcggguaauacggcgccu

SEQ ID NO: 3068980 - RNA, 22 nt, Mycobacterium bovis subsp bovis AF2122/97
gcggguagauguucacgccgcc

SEQ ID NO: 3068981 - RNA, 23 nt, Mycobacterium bovis subsp bovis AF2122/97
gcggguagauguucacgccgccg

SEQ ID NO: 3068982 - RNA, 14 nt, Mycobacterium bovis subsp bovis AF2122/97
gcggguaggugacg

SEQ ID NO: 3068983 - RNA, 16 nt, Mycobacterium bovis subsp bovis AF2122/97
gcggguauauggugcg

SEQ ID NO: 3068984 - RNA, 22 nt, Mycobacterium bovis subsp bovis AF2122/97
gcgggucacaaaaccugggaug

SEQ ID NO: 3068985 - RNA, 12 nt, Mycobacterium bovis subsp bovis AF2122/97
gcgggucagccu

SEQ ID NO: 3068986 - RNA, 14 nt, Mycobacterium bovis subsp bovis AF2122/97
gcgguacgccgguc

SEQ ID NO: 3068987 - RNA, 18 nt, Mycobacterium bovis subsp bovis AF2122/97
gcgguacgccggucggug

SEQ ID NO: 3068988 - RNA, 17 nt, Mycobacterium bovis subsp bovis AF2122/97
gcgguacgggucgccgg

SEQ ID NO: 3068989 - RNA, 20 nt, Mycobacterium bovis subsp bovis AF2122/97
gcgguacgggucgccggacu

SEQ ID NO: 3068990 - RNA, 20 nt, Mycobacterium bovis subsp bovis AF2122/97
gcgguacguaaucgagcgcg

SEQ ID NO: 3068991 - RNA, 17 nt, Mycobacterium bovis subsp bovis AF2122/97
gcgguacugcgcagcgc

SEQ ID NO: 3068992 - RNA, 17 nt, Mycobacterium bovis subsp bovis AF2122/97
gcgguagacgccgccgu

SEQ ID NO: 3068993 - RNA, 16 nt, Mycobacterium bovis subsp bovis AF2122/97
gcgguagagcucuggu

SEQ ID NO: 3068994 - RNA, 23 nt, Mycobacterium bovis subsp bovis AF2122/97
gcgguagccgaccagcgcuagcg

SEQ ID NO: 3068995 - RNA, 14 nt, Mycobacterium bovis subsp bovis AF2122/97
gcgguagccgacga

SEQ ID NO: 3068996 - RNA, 18 nt, Mycobacterium bovis subsp bovis AF2122/97
gcgguagccgacgacacg

SEQ ID NO: 3068997 - RNA, 16 nt, Mycobacterium bovis subsp bovis AF2122/97
gcgguagccgagcucg

SEQ ID NO: 3068998 - RNA, 17 nt, Mycobacterium bovis subsp bovis AF2122/97
gcgguagccgagcucgu

SEQ ID NO: 3068999 - RNA, 15 nt, Mycobacterium bovis subsp bovis AF2122/97
gcgguagcgccguga

SEQ ID NO: 3069000 - RNA, 15 nt, Mycobacterium bovis subsp bovis AF2122/97
gcgguagcucgucga

SEQ ID NO: 3069001 - RNA, 16 nt, Mycobacterium bovis subsp bovis AF2122/97
gcgguagcugcccagc

SEQ ID NO: 3069002 - RNA, 19 nt, Mycobacterium bovis subsp bovis AF2122/97
gcgguagcuuccgcgacgc

SEQ ID NO: 3069003 - RNA, 22 nt, Mycobacterium bovis subsp bovis AF2122/97
gcgguagcuuccgcgacgcucg

SEQ ID NO: 3069004 - RNA, 14 nt, Mycobacterium bovis subsp bovis AF2122/97
gcgguaggcgggag

SEQ ID NO: 3069005 - RNA, 14 nt, Mycobacterium bovis subsp bovis AF2122/97
gcgguaggcgguga

SEQ ID NO: 3069006 - RNA, 16 nt, Mycobacterium bovis subsp bovis AF2122/97
gcgguaguccgcugcg

SEQ ID NO: 3069007 - RNA, 13 nt, Mycobacterium bovis subsp bovis AF2122/97
gcgguagucgccg

SEQ ID NO: 3069008 - RNA, 14 nt, Mycobacterium bovis subsp bovis AF2122/97
gcgguagucgccga

SEQ ID NO: 3069009 - RNA, 16 nt, Mycobacterium bovis subsp bovis AF2122/97
gcgguagucgccgagg

SEQ ID NO: 3069010 - RNA, 16 nt, Mycobacterium bovis subsp bovis AF2122/97
gcgguagucggccagc

SEQ ID NO: 3069011 - RNA, 14 nt, Mycobacterium bovis subsp bovis AF2122/97
gcgguaguugcagu

SEQ ID NO: 3069012 - RNA, 19 nt, Mycobacterium bovis subsp bovis AF2122/97
gcgguaguugucccgccgc

SEQ ID NO: 3069013 - RNA, 22 nt, Mycobacterium bovis subsp bovis AF2122/97
gcgguaguugucccgccgcgcg

SEQ ID NO: 3069014 - RNA, 23 nt, Mycobacterium bovis subsp bovis AF2122/97
gcgguaucccccagccgcggcgc

SEQ ID NO: 3069015 - RNA, 17 nt, Mycobacterium bovis subsp bovis AF2122/97
gcgguaucggcauaccc

SEQ ID NO: 3069016 - RNA, 20 nt, Mycobacterium bovis subsp bovis AF2122/97
gcgguaucggucagccacgc

SEQ ID NO: 3069017 - RNA, 22 nt, Mycobacterium bovis subsp bovis AF2122/97
gcgguaucggucagccacgcca

SEQ ID NO: 3069018 - RNA, 13 nt, Mycobacterium bovis subsp bovis AF2122/97
gcgguaucggucg

SEQ ID NO: 3069019 - RNA, 13 nt, Mycobacterium bovis subsp bovis AF2122/97
gcgguaugcucgc

SEQ ID NO: 3069020 - RNA, 18 nt, Mycobacterium bovis subsp bovis AF2122/97
gcgguaugcucgcuggcg

SEQ ID NO: 3069021 - RNA, 19 nt, Mycobacterium bovis subsp bovis AF2122/97
gcgguaugcucgcuggcgc

SEQ ID NO: 3069022 - RNA, 19 nt, Mycobacterium bovis subsp bovis AF2122/97
gcgguauuugaacgcccgc

SEQ ID NO: 3069023 - RNA, 19 nt, Mycobacterium bovis subsp bovis AF2122/97
gcggucaaauccagcagcc

SEQ ID NO: 3069024 - RNA, 21 nt, Mycobacterium bovis subsp bovis AF2122/97
gcggucaacaagacgaugcug

SEQ ID NO: 3069025 - RNA, 16 nt, Mycobacterium bovis subsp bovis AF2122/97
gcggucaacgcugacg

SEQ ID NO: 3069026 - RNA, 22 nt, Mycobacterium bovis subsp bovis AF2122/97
gcggucaauguggcgcuucggc

SEQ ID NO: 3069027 - RNA, 17 nt, Mycobacterium bovis subsp bovis AF2122/97
gcggucaccaccgaccc

SEQ ID NO: 3069028 - RNA, 23 nt, Mycobacterium bovis subsp bovis AF2122/97
gcggucaccaccgacccgcugcc

SEQ ID NO: 3069029 - RNA, 22 nt, Mycobacterium bovis subsp bovis AF2122/97
gcggucaccaccguggcgcccg

SEQ ID NO: 3069030 - RNA, 18 nt, Mycobacterium bovis subsp bovis AF2122/97
gcggucaccacgcggcgg

SEQ ID NO: 3069031 - RNA, 21 nt, Mycobacterium bovis subsp bovis AF2122/97
gcggucaccacgcggcggucg

SEQ ID NO: 3069032 - RNA, 23 nt, Mycobacterium bovis subsp bovis AF2122/97
gcggucaccccggcucggccacc

SEQ ID NO: 3069033 - RNA, 16 nt, Mycobacterium bovis subsp bovis AF2122/97
gcggucaccgacgcag

SEQ ID NO: 3069034 - RNA, 18 nt, Mycobacterium bovis subsp bovis AF2122/97
gcggucaccgacgcagaa

SEQ ID NO: 3069035 - RNA, 17 nt, Mycobacterium bovis subsp bovis AF2122/97
gcggucagauucggcga

SEQ ID NO: 3069036 - RNA, 19 nt, Mycobacterium bovis subsp bovis AF2122/97
gcggucagauucggcgaug

SEQ ID NO: 3069037 - RNA, 19 nt, Mycobacterium bovis subsp bovis AF2122/97
gcggucagcagcgccguca

SEQ ID NO: 3069038 - RNA, 16 nt, Mycobacterium bovis subsp bovis AF2122/97
gcggucagcggccaac

SEQ ID NO: 3069039 - RNA, 20 nt, Mycobacterium bovis subsp bovis AF2122/97
gcggucagcggccaacccau

SEQ ID NO: 3069040 - RNA, 15 nt, Mycobacterium bovis subsp bovis AF2122/97
gcggucagcggcugg

SEQ ID NO: 3069041 - RNA, 13 nt, Mycobacterium bovis subsp bovis AF2122/97
gcggucagcucgg

SEQ ID NO: 3069042 - RNA, 24 nt, Mycobacterium bovis subsp bovis AF2122/97
gcggucagcucggcagcaucuccg

SEQ ID NO: 3069043 - RNA, 22 nt, Mycobacterium bovis subsp bovis AF2122/97
gcggucaggauggggaccacua

SEQ ID NO: 3069044 - RNA, 21 nt, Mycobacterium bovis subsp bovis AF2122/97
gcggucaggauuucugcgauc

SEQ ID NO: 3069045 - RNA, 21 nt, Mycobacterium bovis subsp bovis AF2122/97
gcggucaggcuaguugccaac

SEQ ID NO: 3069046 - RNA, 21 nt, Mycobacterium bovis subsp bovis AF2122/97
gcggucauauaggagcgggug

SEQ ID NO: 3069047 - RNA, 19 nt, Mycobacterium bovis subsp bovis AF2122/97
gcggucaucgagcugaccu

SEQ ID NO: 3069048 - RNA, 17 nt, Mycobacterium bovis subsp bovis AF2122/97
gcggucaucgccucggc

SEQ ID NO: 3069049 - RNA, 18 nt, Mycobacterium bovis subsp bovis AF2122/97
gcggucaucgcguccaug

SEQ ID NO: 3069050 - RNA, 15 nt, Mycobacterium bovis subsp bovis AF2122/97
gcggucaucggcgcc

SEQ ID NO: 3069051 - RNA, 14 nt, Mycobacterium bovis subsp bovis AF2122/97
gcggucauggcgac

SEQ ID NO: 3069052 - RNA, 15 nt, Mycobacterium bovis subsp bovis AF2122/97
gcggucauggcgacg

SEQ ID NO: 3069053 - RNA, 18 nt, Mycobacterium bovis subsp bovis AF2122/97
gcgguccaacagcgccag

SEQ ID NO: 3069054 - RNA, 20 nt, Mycobacterium bovis subsp bovis AF2122/97
gcgguccaacagcgccagua

SEQ ID NO: 3069055 - RNA, 23 nt, Mycobacterium bovis subsp bovis AF2122/97
gcgguccaacagcgccaguagca

SEQ ID NO: 3069056 - RNA, 13 nt, Mycobacterium bovis subsp bovis AF2122/97
gcgguccaccggc

SEQ ID NO: 3069057 - RNA, 22 nt, Mycobacterium bovis subsp bovis AF2122/97
gcgguccaccggcccucgccag

SEQ ID NO: 3069058 - RNA, 22 nt, Mycobacterium bovis subsp bovis AF2122/97
gcgguccagaaugucgcgggug

SEQ ID NO: 3069059 - RNA, 20 nt, Mycobacterium bovis subsp bovis AF2122/97
gcgguccagacaucagugcg

SEQ ID NO: 3069060 - RNA, 15 nt, Mycobacterium bovis subsp bovis AF2122/97
gcgguccagccaccg

SEQ ID NO: 3069061 - RNA, 13 nt, Mycobacterium bovis subsp bovis AF2122/97
gcgguccagcguc

SEQ ID NO: 3069062 - RNA, 15 nt, Mycobacterium bovis subsp bovis AF2122/97
gcgguccagcgucgc

SEQ ID NO: 3069063 - RNA, 20 nt, Mycobacterium bovis subsp bovis AF2122/97
gcgguccagcgucgccgcca

SEQ ID NO: 3069064 - RNA, 16 nt, Mycobacterium bovis subsp bovis AF2122/97
gcgguccaggccggca

SEQ ID NO: 3069065 - RNA, 18 nt, Mycobacterium bovis subsp bovis AF2122/97
gcgguccaggccggcacc

SEQ ID NO: 3069066 - RNA, 17 nt, Mycobacterium bovis subsp bovis AF2122/97
gcggucccacggccggc

SEQ ID NO: 3069067 - RNA, 21 nt, Mycobacterium bovis subsp bovis AF2122/97
gcggucccacucgucgucggu

SEQ ID NO: 3069068 - RNA, 16 nt, Mycobacterium bovis subsp bovis AF2122/97
gcggucccgcggaccg

SEQ ID NO: 3069069 - RNA, 19 nt, Mycobacterium bovis subsp bovis AF2122/97
gcggucccugaagccagcg

SEQ ID NO: 3069070 - RNA, 23 nt, Mycobacterium bovis subsp bovis AF2122/97
gcggucccugaagccagcgcaag

SEQ ID NO: 3069071 - RNA, 13 nt, Mycobacterium bovis subsp bovis AF2122/97
gcgguccgagcgg

SEQ ID NO: 3069072 - RNA, 15 nt, Mycobacterium bovis subsp bovis AF2122/97
gcggugacccguuca

SEQ ID NO: 3069073 - RNA, 17 nt, Mycobacterium bovis subsp bovis AF2122/97
gcggugacccguucagc

SEQ ID NO: 3069074 - RNA, 22 nt, Mycobacterium bovis subsp bovis AF2122/97
gcggugacccguucagcgacgg

SEQ ID NO: 3069075 - RNA, 19 nt, Mycobacterium bovis subsp bovis AF2122/97
gcggugaccggcucggcgg

SEQ ID NO: 3069076 - RNA, 22 nt, Mycobacterium bovis subsp bovis AF2122/97
gcggugaccggcucggcggugc

SEQ ID NO: 3069077 - RNA, 21 nt, Mycobacterium bovis subsp bovis AF2122/97
gcggugaccgugaacggcucg

SEQ ID NO: 3069078 - RNA, 16 nt, Mycobacterium bovis subsp bovis AF2122/97
gcggugacgaagccga

SEQ ID NO: 3069079 - RNA, 17 nt, Mycobacterium bovis subsp bovis AF2122/97
gcggugacgagccacca

SEQ ID NO: 3069080 - RNA, 20 nt, Mycobacterium bovis subsp bovis AF2122/97
gcggugacgagccaccaccg

SEQ ID NO: 3069081 - RNA, 15 nt, Mycobacterium bovis subsp bovis AF2122/97
gcggugacgcaacau

SEQ ID NO: 3069082 - RNA, 15 nt, Mycobacterium bovis subsp bovis AF2122/97
gcggugacgccagcc

SEQ ID NO: 3069083 - RNA, 15 nt, Mycobacterium bovis subsp bovis AF2122/97
gcggugacggcggca

SEQ ID NO: 3069084 - RNA, 16 nt, Mycobacterium bovis subsp bovis AF2122/97
gcggugacggcggcaa

SEQ ID NO: 3069085 - RNA, 15 nt, Mycobacterium bovis subsp bovis AF2122/97
gcggugacggcggcu

SEQ ID NO: 3069086 - RNA, 20 nt, Mycobacterium bovis subsp bovis AF2122/97
gcggugacggcggcugucgg

SEQ ID NO: 3069087 - RNA, 20 nt, Mycobacterium bovis subsp bovis AF2122/97
gcggugacucggccuccgcc

SEQ ID NO: 3069088 - RNA, 21 nt, Mycobacterium bovis subsp bovis AF2122/97
gcggugacucggccuccgccg

SEQ ID NO: 3069089 - RNA, 23 nt, Mycobacterium bovis subsp bovis AF2122/97
gcggugagacgaaaagccgcguc

SEQ ID NO: 3069090 - RNA, 20 nt, Mycobacterium bovis subsp bovis AF2122/97
gcggugagauggcggugagc

SEQ ID NO: 3069091 - RNA, 18 nt, Mycobacterium bovis subsp bovis AF2122/97
gcggugaggcagcgaccg

SEQ ID NO: 3069092 - RNA, 19 nt, Mycobacterium bovis subsp bovis AF2122/97
gcggugaguccgcugagcg

SEQ ID NO: 3069093 - RNA, 14 nt, Mycobacterium bovis subsp bovis AF2122/97
gcggugcacaccgu

SEQ ID NO: 3069094 - RNA, 14 nt, Mycobacterium bovis subsp bovis AF2122/97
gcggugcacacuga

SEQ ID NO: 3069095 - RNA, 23 nt, Mycobacterium bovis subsp bovis AF2122/97
gcggugcaggauucggcggucgc

SEQ ID NO: 3069096 - RNA, 16 nt, Mycobacterium bovis subsp bovis AF2122/97
gcggugcaucgccacc

SEQ ID NO: 3069097 - RNA, 19 nt, Mycobacterium bovis subsp bovis AF2122/97
gcggugcaucgccaccacc

SEQ ID NO: 3069098 - RNA, 12 nt, Mycobacterium bovis subsp bovis AF2122/97
gcggugccacca

SEQ ID NO: 3069099 - RNA, 15 nt, Mycobacterium bovis subsp bovis AF2122/97
gcggugccacgaucg

SEQ ID NO: 3069100 - RNA, 17 nt, Mycobacterium bovis subsp bovis AF2122/97
gcggugccacgaucggc

SEQ ID NO: 3069101 - RNA, 21 nt, Mycobacterium bovis subsp bovis AF2122/97
gcggugccacgaucggcgggg

SEQ ID NO: 3069102 - RNA, 13 nt, Mycobacterium bovis subsp bovis AF2122/97
gcggugcccagca

SEQ ID NO: 3069103 - RNA, 15 nt, Mycobacterium bovis subsp bovis AF2122/97
gcggugcccagcagc

SEQ ID NO: 3069104 - RNA, 16 nt, Mycobacterium bovis subsp bovis AF2122/97
gcggugcccagcagcg

SEQ ID NO: 3069105 - RNA, 16 nt, Mycobacterium bovis subsp bovis AF2122/97
gcggugcccgcccucg

SEQ ID NO: 3069106 - RNA, 15 nt, Mycobacterium bovis subsp bovis AF2122/97
gcggugcccgcgaac

SEQ ID NO: 3069107 - RNA, 19 nt, Mycobacterium bovis subsp bovis AF2122/97
gcggugcccugccggcagc

SEQ ID NO: 3069108 - RNA, 13 nt, Mycobacterium bovis subsp bovis AF2122/97
gcggugccgacgg

SEQ ID NO: 3069109 - RNA, 18 nt, Mycobacterium bovis subsp bovis AF2122/97
gcggugccgacggugggc

SEQ ID NO: 3069110 - RNA, 19 nt, Mycobacterium bovis subsp bovis AF2122/97
gcggugccgacggugggcg

SEQ ID NO: 3069111 - RNA, 20 nt, Mycobacterium bovis subsp bovis AF2122/97
gcggugccgcggcuaggcca

SEQ ID NO: 3069112 - RNA, 23 nt, Mycobacterium bovis subsp bovis AF2122/97
gcggugccgcggcuaggccaagc

SEQ ID NO: 3069113 - RNA, 20 nt, Mycobacterium bovis subsp bovis AF2122/97
gcggugccggcccugcucgg

SEQ ID NO: 3069114 - RNA, 15 nt, Mycobacterium bovis subsp bovis AF2122/97
gcggugccgggaucg

SEQ ID NO: 3069115 - RNA, 22 nt, Mycobacterium bovis subsp bovis AF2122/97
gcggugccgguggugacggcgg

SEQ ID NO: 3069116 - RNA, 14 nt, Mycobacterium bovis subsp bovis AF2122/97
gcggugccgucagc

SEQ ID NO: 3069117 - RNA, 22 nt, Mycobacterium bovis subsp bovis AF2122/97
gcggugccgucgccgcccuggc

SEQ ID NO: 3069118 - RNA, 15 nt, Mycobacterium bovis subsp bovis AF2122/97
gcggugccgugcuca

SEQ ID NO: 3069119 - RNA, 16 nt, Mycobacterium bovis subsp bovis AF2122/97
gcggugccgugcucac

SEQ ID NO: 3069120 - RNA, 15 nt, Mycobacterium bovis subsp bovis AF2122/97
gcggugccugcagcu

SEQ ID NO: 3069121 - RNA, 19 nt, Mycobacterium bovis subsp bovis AF2122/97
gcggugcgcaccaccgagc

SEQ ID NO: 3069122 - RNA, 21 nt, Mycobacterium bovis subsp bovis AF2122/97
gcggugcgcaccaccgagccg

SEQ ID NO: 3069123 - RNA, 14 nt, Mycobacterium bovis subsp bovis AF2122/97
gcggugcgcgguug

SEQ ID NO: 3069124 - RNA, 18 nt, Mycobacterium bovis subsp bovis AF2122/97
gcggugcgcucacuggcg

SEQ ID NO: 3069125 - RNA, 19 nt, Mycobacterium bovis subsp bovis AF2122/97
gcggugcggaucagaggac

SEQ ID NO: 3069126 - RNA, 17 nt, Mycobacterium bovis subsp bovis AF2122/97
gcggugcggcaacagcg

SEQ ID NO: 3069127 - RNA, 19 nt, Mycobacterium bovis subsp bovis AF2122/97
gcggugcgggcuucaacac

SEQ ID NO: 3069128 - RNA, 21 nt, Mycobacterium bovis subsp bovis AF2122/97
gcggugcucuucggcaccacc

SEQ ID NO: 3069129 - RNA, 14 nt, Mycobacterium bovis subsp bovis AF2122/97
gcggugcugguggc

SEQ ID NO: 3069130 - RNA, 16 nt, Mycobacterium bovis subsp bovis AF2122/97
gcgguggaccgcucga

SEQ ID NO: 3069131 - RNA, 21 nt, Mycobacterium bovis subsp bovis AF2122/97
gcgguggccacccggccgcgc

SEQ ID NO: 3069132 - RNA, 20 nt, Mycobacterium bovis subsp bovis AF2122/97
gcgguggccagaucgaacgc

SEQ ID NO: 3069133 - RNA, 13 nt, Mycobacterium bovis subsp bovis AF2122/97
gcgguggccggcg

SEQ ID NO: 3069134 - RNA, 14 nt, Mycobacterium bovis subsp bovis AF2122/97
gcgguggccggcga

SEQ ID NO: 3069135 - RNA, 16 nt, Mycobacterium bovis subsp bovis AF2122/97
gcgguggccgucgggu

SEQ ID NO: 3069136 - RNA, 18 nt, Mycobacterium bovis subsp bovis AF2122/97
gcgguggccucccacggc

SEQ ID NO: 3069137 - RNA, 22 nt, Mycobacterium bovis subsp bovis AF2122/97
gcgguggccucccacggcgcgu

SEQ ID NO: 3069138 - RNA, 15 nt, Mycobacterium bovis subsp bovis AF2122/97
gcgguggccugucga

SEQ ID NO: 3069139 - RNA, 13 nt, Mycobacterium bovis subsp bovis AF2122/97
gcgguggcgcgca

SEQ ID NO: 3069140 - RNA, 15 nt, Mycobacterium bovis subsp bovis AF2122/97
gcgguggcggcgagc

SEQ ID NO: 3069141 - RNA, 17 nt, Mycobacterium bovis subsp bovis AF2122/97
gcgguggcggcgagcag

SEQ ID NO: 3069142 - RNA, 19 nt, Mycobacterium bovis subsp bovis AF2122/97
gcgguggcggucuugccgc

SEQ ID NO: 3069143 - RNA, 19 nt, Mycobacterium bovis subsp bovis AF2122/97
gcgguggcggugucggcgc

SEQ ID NO: 3069144 - RNA, 12 nt, Mycobacterium bovis subsp bovis AF2122/97
gcgguggcgucg

SEQ ID NO: 3069145 - RNA, 18 nt, Mycobacterium bovis subsp bovis AF2122/97
gcgguggcgucgucggcg

SEQ ID NO: 3069146 - RNA, 15 nt, Mycobacterium bovis subsp bovis AF2122/97
gcggugggcagcagc

SEQ ID NO: 3069147 - RNA, 19 nt, Mycobacterium bovis subsp bovis AF2122/97
gcggugggccccgaucccg

SEQ ID NO: 3069148 - RNA, 18 nt, Mycobacterium bovis subsp bovis AF2122/97
gcgguggggcgcgccggc

SEQ ID NO: 3069149 - RNA, 16 nt, Mycobacterium bovis subsp bovis AF2122/97
gcgguggggucgacgc

SEQ ID NO: 3069150 - RNA, 14 nt, Mycobacterium bovis subsp bovis AF2122/97
gcggugggucgucg

SEQ ID NO: 3069151 - RNA, 16 nt, Mycobacterium bovis subsp bovis AF2122/97
gcggugguaccggcgc

SEQ ID NO: 3069152 - RNA, 17 nt, Mycobacterium bovis subsp bovis AF2122/97
gcggugguaccggcgcc

SEQ ID NO: 3069153 - RNA, 22 nt, Mycobacterium bovis subsp bovis AF2122/97
gcgguggucccgauggcgaugc

SEQ ID NO: 3069154 - RNA, 13 nt, Mycobacterium bovis subsp bovis AF2122/97
gcgguggucgcga

SEQ ID NO: 3069155 - RNA, 14 nt, Mycobacterium bovis subsp bovis AF2122/97
gcgguggucggcgc

SEQ ID NO: 3069156 - RNA, 16 nt, Mycobacterium bovis subsp bovis AF2122/97
gcgguggucggcgcgc

SEQ ID NO: 3069157 - RNA, 18 nt, Mycobacterium bovis subsp bovis AF2122/97
gcgguggucggcgcgccg

SEQ ID NO: 3069158 - RNA, 12 nt, Mycobacterium bovis subsp bovis AF2122/97
gcgguggugagu

SEQ ID NO: 3069159 - RNA, 22 nt, Mycobacterium bovis subsp bovis AF2122/97
gcguagcgaccucgccgcggcg

SEQ ID NO: 3069160 - RNA, 22 nt, Mycobacterium bovis subsp bovis AF2122/97
gcguagcgggggagcgaacggc

SEQ ID NO: 3069161 - RNA, 16 nt, Mycobacterium bovis subsp bovis AF2122/97
gcguagcuggccaggu

SEQ ID NO: 3069162 - RNA, 22 nt, Mycobacterium bovis subsp bovis AF2122/97
gcguaggcccaacgacggcaac

SEQ ID NO: 3069163 - RNA, 18 nt, Mycobacterium bovis subsp bovis AF2122/97
gcguaggccuugcucagc

SEQ ID NO: 3069164 - RNA, 20 nt, Mycobacterium bovis subsp bovis AF2122/97
gcguaggccuugcucagccg

SEQ ID NO: 3069165 - RNA, 15 nt, Mycobacterium bovis subsp bovis AF2122/97
gcguaggcgauggcg

SEQ ID NO: 3069166 - RNA, 12 nt, Mycobacterium bovis subsp bovis AF2122/97
gcguagggccag

SEQ ID NO: 3069167 - RNA, 17 nt, Mycobacterium bovis subsp bovis AF2122/97
gcguagggcuguccgac

SEQ ID NO: 3069168 - RNA, 16 nt, Mycobacterium bovis subsp bovis AF2122/97
gcguagguggcacagu

SEQ ID NO: 3069169 - RNA, 16 nt, Mycobacterium bovis subsp bovis AF2122/97
gcguagguggccagcg

SEQ ID NO: 3069170 - RNA, 17 nt, Mycobacterium bovis subsp bovis AF2122/97
gcguagguggccagcgc

SEQ ID NO: 3069171 - RNA, 21 nt, Mycobacterium bovis subsp bovis AF2122/97
gcguagguggccagcgcggcg

SEQ ID NO: 3069172 - RNA, 22 nt, Mycobacterium bovis subsp bovis AF2122/97
gcguagguggccagcgcggcga

SEQ ID NO: 3069173 - RNA, 19 nt, Mycobacterium bovis subsp bovis AF2122/97
gcguaguaaugcucgacgu

SEQ ID NO: 3069174 - RNA, 13 nt, Mycobacterium bovis subsp bovis AF2122/97
gcguaguccaggc

SEQ ID NO: 3069175 - RNA, 16 nt, Mycobacterium bovis subsp bovis AF2122/97
gcguaguccaggccgu

SEQ ID NO: 3069176 - RNA, 17 nt, Mycobacterium bovis subsp bovis AF2122/97
gcguaguccaggccguc

SEQ ID NO: 3069177 - RNA, 19 nt, Mycobacterium bovis subsp bovis AF2122/97
gcguaguccaggccgucgu

SEQ ID NO: 3069178 - RNA, 18 nt, Mycobacterium bovis subsp bovis AF2122/97
gcguagucggcggugcag

SEQ ID NO: 3069179 - RNA, 20 nt, Mycobacterium bovis subsp bovis AF2122/97
gcguagugcucgccggcacc

SEQ ID NO: 3069180 - RNA, 20 nt, Mycobacterium bovis subsp bovis AF2122/97
gcguaguuaugccaaaccga

SEQ ID NO: 3069181 - RNA, 18 nt, Mycobacterium bovis subsp bovis AF2122/97
gcguauccuugcgacguu

SEQ ID NO: 3069182 - RNA, 22 nt, Mycobacterium bovis subsp bovis AF2122/97
gcguaucgcgucugggugcagg

SEQ ID NO: 3069183 - RNA, 17 nt, Mycobacterium bovis subsp bovis AF2122/97
gcguaucgggcccccug

SEQ ID NO: 3069184 - RNA, 22 nt, Mycobacterium bovis subsp bovis AF2122/97
gcguaugccaggacuggcaccg

SEQ ID NO: 3069185 - RNA, 18 nt, Mycobacterium bovis subsp bovis AF2122/97
gcguauucggcaucgccg

SEQ ID NO: 3069186 - RNA, 17 nt, Mycobacterium bovis subsp bovis AF2122/97
gcguauugcaccgccag

SEQ ID NO: 3069187 - RNA, 15 nt, Mycobacterium bovis subsp bovis AF2122/97
gcguauugcggccug

SEQ ID NO: 3069188 - RNA, 17 nt, Mycobacterium bovis subsp bovis AF2122/97
gcgucaaccacggccgc

SEQ ID NO: 3069189 - RNA, 19 nt, Mycobacterium bovis subsp bovis AF2122/97
gcgucaaccacggccgccg

SEQ ID NO: 3069190 - RNA, 20 nt, Mycobacterium bovis subsp bovis AF2122/97
gcgucaaccacggccgccgc

SEQ ID NO: 3069191 - RNA, 21 nt, Mycobacterium bovis subsp bovis AF2122/97
gcgucaaccacggccgccgcg

SEQ ID NO: 3069192 - RNA, 19 nt, Mycobacterium bovis subsp bovis AF2122/97
gcgucaaccgaucggucgu

SEQ ID NO: 3069193 - RNA, 15 nt, Mycobacterium bovis subsp bovis AF2122/97
gcgucaacgcuguug

SEQ ID NO: 3069194 - RNA, 17 nt, Mycobacterium bovis subsp bovis AF2122/97
gcgucaacgcuguuguc

SEQ ID NO: 3069195 - RNA, 20 nt, Mycobacterium bovis subsp bovis AF2122/97
gcgucaagcacacuggccac

SEQ ID NO: 3069196 - RNA, 17 nt, Mycobacterium bovis subsp bovis AF2122/97
gcgucaaguccgagucg

SEQ ID NO: 3069197 - RNA, 19 nt, Mycobacterium bovis subsp bovis AF2122/97
gcgucaaguccgagucggc

SEQ ID NO: 3069198 - RNA, 14 nt, Mycobacterium bovis subsp bovis AF2122/97
gcgucacaccagcg

SEQ ID NO: 3069199 - RNA, 21 nt, Mycobacterium bovis subsp bovis AF2122/97
gcgucacaccagcgggcaucg

SEQ ID NO: 3069200 - RNA, 20 nt, Mycobacterium bovis subsp bovis AF2122/97
gcgucacauccgacagcagc

SEQ ID NO: 3069201 - RNA, 23 nt, Mycobacterium bovis subsp bovis AF2122/97
gcgucacauccgacagcagccgg

SEQ ID NO: 3069202 - RNA, 21 nt, Mycobacterium bovis subsp bovis AF2122/97
gcgucaccccggucccgccga

SEQ ID NO: 3069203 - RNA, 22 nt, Mycobacterium bovis subsp bovis AF2122/97
gcgucaccccggucccgccgac

SEQ ID NO: 3069204 - RNA, 23 nt, Mycobacterium bovis subsp bovis AF2122/97
gcgucaccccggucccgccgacc

SEQ ID NO: 3069205 - RNA, 13 nt, Mycobacterium bovis subsp bovis AF2122/97
gcgucacccgcaa

SEQ ID NO: 3069206 - RNA, 20 nt, Mycobacterium bovis subsp bovis AF2122/97
gcgucacccugucgcgcacc

SEQ ID NO: 3069207 - RNA, 22 nt, Mycobacterium bovis subsp bovis AF2122/97
gcgucacccugucgcgcaccgg

SEQ ID NO: 3069208 - RNA, 19 nt, Mycobacterium bovis subsp bovis AF2122/97
gcgucaccgccggugcuga

SEQ ID NO: 3069209 - RNA, 18 nt, Mycobacterium bovis subsp bovis AF2122/97
gcgucaccggaggccgcc

SEQ ID NO: 3069210 - RNA, 21 nt, Mycobacterium bovis subsp bovis AF2122/97
gcgucaccggaggccgccgcg

SEQ ID NO: 3069211 - RNA, 16 nt, Mycobacterium bovis subsp bovis AF2122/97
gcgucaccucaccgaa

SEQ ID NO: 3069212 - RNA, 15 nt, Mycobacterium bovis subsp bovis AF2122/97
gcgucacgagccaag

SEQ ID NO: 3069213 - RNA, 18 nt, Mycobacterium bovis subsp bovis AF2122/97
gcgucagauccggccguu

SEQ ID NO: 3069214 - RNA, 18 nt, Mycobacterium bovis subsp bovis AF2122/97
gcgucagccgcaccccgc

SEQ ID NO: 3069215 - RNA, 20 nt, Mycobacterium bovis subsp bovis AF2122/97
gcgucagcgccuuguggcac

SEQ ID NO: 3069216 - RNA, 14 nt, Mycobacterium bovis subsp bovis AF2122/97
gcgucagcggcgag

SEQ ID NO: 3069217 - RNA, 15 nt, Mycobacterium bovis subsp bovis AF2122/97
gcgucaggcacaacg

SEQ ID NO: 3069218 - RNA, 16 nt, Mycobacterium bovis subsp bovis AF2122/97
gcgucaggcacaacgc

SEQ ID NO: 3069219 - RNA, 18 nt, Mycobacterium bovis subsp bovis AF2122/97
gcgucaggccagagucgc

SEQ ID NO: 3069220 - RNA, 20 nt, Mycobacterium bovis subsp bovis AF2122/97
gcgucaggccagagucgccc

SEQ ID NO: 3069221 - RNA, 13 nt, Mycobacterium bovis subsp bovis AF2122/97
gcgucaggccagc

SEQ ID NO: 3069222 - RNA, 20 nt, Mycobacterium bovis subsp bovis AF2122/97
gcgucaggcccucggguguc

SEQ ID NO: 3069223 - RNA, 15 nt, Mycobacterium bovis subsp bovis AF2122/97
gcgucaggugcgcga

SEQ ID NO: 3069224 - RNA, 16 nt, Mycobacterium bovis subsp bovis AF2122/97
gcgucaggugcgcgac

SEQ ID NO: 3069225 - RNA, 20 nt, Mycobacterium bovis subsp bovis AF2122/97
gcgucaggugcgcgaccagg

SEQ ID NO: 3069226 - RNA, 19 nt, Mycobacterium bovis subsp bovis AF2122/97
gcgucaguccucaucgagc

SEQ ID NO: 3069227 - RNA, 16 nt, Mycobacterium bovis subsp bovis AF2122/97
gcgucagugcagaaga

SEQ ID NO: 3069228 - RNA, 15 nt, Mycobacterium bovis subsp bovis AF2122/97
gcgucaucgcgggug

SEQ ID NO: 3069229 - RNA, 20 nt, Mycobacterium bovis subsp bovis AF2122/97
gcgucaucgcgggugaucuc

SEQ ID NO: 3069230 - RNA, 17 nt, Mycobacterium bovis subsp bovis AF2122/97
gcgucaugaacgaucgg

SEQ ID NO: 3069231 - RNA, 19 nt, Mycobacterium bovis subsp bovis AF2122/97
gcgucaugaugucgacauc

SEQ ID NO: 3069232 - RNA, 13 nt, Mycobacterium bovis subsp bovis AF2122/97
gcgucaugcccag

SEQ ID NO: 3069233 - RNA, 21 nt, Mycobacterium bovis subsp bovis AF2122/97
gcguccaacccaggguggcga

SEQ ID NO: 3069234 - RNA, 12 nt, Mycobacterium bovis subsp bovis AF2122/97
gcguccaccacg

SEQ ID NO: 3069235 - RNA, 22 nt, Mycobacterium bovis subsp bovis AF2122/97
gcguccacccacgaucagcagc

SEQ ID NO: 3069236 - RNA, 23 nt, Mycobacterium bovis subsp bovis AF2122/97
gcguccacccacgaucagcagcg

SEQ ID NO: 3069237 - RNA, 14 nt, Mycobacterium bovis subsp bovis AF2122/97
gcguccaccggacg

SEQ ID NO: 3069238 - RNA, 14 nt, Mycobacterium bovis subsp bovis AF2122/97
gcguccacgggauc

SEQ ID NO: 3069239 - RNA, 21 nt, Mycobacterium bovis subsp bovis AF2122/97
gcguccagaccguagcggccg

SEQ ID NO: 3069240 - RNA, 22 nt, Mycobacterium bovis subsp bovis AF2122/97
gcguccagaccguagcggccgg

SEQ ID NO: 3069241 - RNA, 22 nt, Mycobacterium bovis subsp bovis AF2122/97
gcguccagcgccugcgcccagc

SEQ ID NO: 3069242 - RNA, 15 nt, Mycobacterium bovis subsp bovis AF2122/97
gcguccagcgcggcc

SEQ ID NO: 3069243 - RNA, 18 nt, Mycobacterium bovis subsp bovis AF2122/97
gcguccaggccagggcgg

SEQ ID NO: 3069244 - RNA, 22 nt, Mycobacterium bovis subsp bovis AF2122/97
gcguccaggccagggcgguggc

SEQ ID NO: 3069245 - RNA, 13 nt, Mycobacterium bovis subsp bovis AF2122/97
gcgucgccaggcc

SEQ ID NO: 3069246 - RNA, 23 nt, Mycobacterium bovis subsp bovis AF2122/97
gcgucgccauuccaucgcgcacc

SEQ ID NO: 3069247 - RNA, 16 nt, Mycobacterium bovis subsp bovis AF2122/97
gcgucgcccagugcgc

SEQ ID NO: 3069248 - RNA, 14 nt, Mycobacterium bovis subsp bovis AF2122/97
gcgucgccgccauu

SEQ ID NO: 3069249 - RNA, 12 nt, Mycobacterium bovis subsp bovis AF2122/97
gcgucgccgccg

SEQ ID NO: 3069250 - RNA, 13 nt, Mycobacterium bovis subsp bovis AF2122/97
gcgucgccgccgg

SEQ ID NO: 3069251 - RNA, 14 nt, Mycobacterium bovis subsp bovis AF2122/97
gcgucgccggcacc

SEQ ID NO: 3069252 - RNA, 17 nt, Mycobacterium bovis subsp bovis AF2122/97
gcgucgccggccccgcc

SEQ ID NO: 3069253 - RNA, 21 nt, Mycobacterium bovis subsp bovis AF2122/97
gcgucgccggccccgccggcg

SEQ ID NO: 3069254 - RNA, 22 nt, Mycobacterium bovis subsp bovis AF2122/97
gcgucgccggccccgccggcgc

SEQ ID NO: 3069255 - RNA, 20 nt, Mycobacterium bovis subsp bovis AF2122/97
gcgucgcgaaauagcugcgg

SEQ ID NO: 3069256 - RNA, 17 nt, Mycobacterium bovis subsp bovis AF2122/97
gcgucgcgaguugagaa

SEQ ID NO: 3069257 - RNA, 21 nt, Mycobacterium bovis subsp bovis AF2122/97
gcgucgcgccugcccggguga

SEQ ID NO: 3069258 - RNA, 16 nt, Mycobacterium bovis subsp bovis AF2122/97
gcgucgcgcgcggcau

SEQ ID NO: 3069259 - RNA, 18 nt, Mycobacterium bovis subsp bovis AF2122/97
gcgucgcggacggugcgg

SEQ ID NO: 3069260 - RNA, 15 nt, Mycobacterium bovis subsp bovis AF2122/97
gcgucgcuacgcaac

SEQ ID NO: 3069261 - RNA, 20 nt, Mycobacterium bovis subsp bovis AF2122/97
gcgucgcuaucgugcgccga

SEQ ID NO: 3069262 - RNA, 20 nt, Mycobacterium bovis subsp bovis AF2122/97
gcgucgcucgucgucaccga

SEQ ID NO: 3069263 - RNA, 15 nt, Mycobacterium bovis subsp bovis AF2122/97
gcgucgcugaccgcg

SEQ ID NO: 3069264 - RNA, 15 nt, Mycobacterium bovis subsp bovis AF2122/97
gcgucgcuggccagg

SEQ ID NO: 3069265 - RNA, 17 nt, Mycobacterium bovis subsp bovis AF2122/97
gcgucgcuucggcaccg

SEQ ID NO: 3069266 - RNA, 15 nt, Mycobacterium bovis subsp bovis AF2122/97
gcgucggaaauucca

SEQ ID NO: 3069267 - RNA, 20 nt, Mycobacterium bovis subsp bovis AF2122/97
gcgucggaauacaacagcug

SEQ ID NO: 3069268 - RNA, 21 nt, Mycobacterium bovis subsp bovis AF2122/97
gcgucggaccguuucgucggc

SEQ ID NO: 3069269 - RNA, 16 nt, Mycobacterium bovis subsp bovis AF2122/97
gcgucggagccgggca

SEQ ID NO: 3069270 - RNA, 13 nt, Mycobacterium bovis subsp bovis AF2122/97
gcgucggccaccc

SEQ ID NO: 3069271 - RNA, 21 nt, Mycobacterium bovis subsp bovis AF2122/97
gcgucggccacccgguccacc

SEQ ID NO: 3069272 - RNA, 20 nt, Mycobacterium bovis subsp bovis AF2122/97
gcgucggccaggaucaaccg

SEQ ID NO: 3069273 - RNA, 19 nt, Mycobacterium bovis subsp bovis AF2122/97
gcgucggcccgcggucgcg

SEQ ID NO: 3069274 - RNA, 15 nt, Mycobacterium bovis subsp bovis AF2122/97
gcgucggcccggugc

SEQ ID NO: 3069275 - RNA, 16 nt, Mycobacterium bovis subsp bovis AF2122/97
gcgucggcccggugcu

SEQ ID NO: 3069276 - RNA, 13 nt, Mycobacterium bovis subsp bovis AF2122/97
gcgucggccggca

SEQ ID NO: 3069277 - RNA, 12 nt, Mycobacterium bovis subsp bovis AF2122/97
gcgucggcgaau

SEQ ID NO: 3069278 - RNA, 13 nt, Mycobacterium bovis subsp bovis AF2122/97
gcgucggcgacgc

SEQ ID NO: 3069279 - RNA, 13 nt, Mycobacterium bovis subsp bovis AF2122/97
gcgucggcgauga

SEQ ID NO: 3069280 - RNA, 21 nt, Mycobacterium bovis subsp bovis AF2122/97
gcgucggcgcaucaccacccg

SEQ ID NO: 3069281 - RNA, 15 nt, Mycobacterium bovis subsp bovis AF2122/97
gcgucggcgcccagc

SEQ ID NO: 3069282 - RNA, 17 nt, Mycobacterium bovis subsp bovis AF2122/97
gcgucggcgcccagcuc

SEQ ID NO: 3069283 - RNA, 18 nt, Mycobacterium bovis subsp bovis AF2122/97
gcgucggcgcccagcucg

SEQ ID NO: 3069284 - RNA, 15 nt, Mycobacterium bovis subsp bovis AF2122/97
gcgucggcggccagu

SEQ ID NO: 3069285 - RNA, 15 nt, Mycobacterium bovis subsp bovis AF2122/97
gcgucggcggcgacc

SEQ ID NO: 3069286 - RNA, 21 nt, Mycobacterium bovis subsp bovis AF2122/97
gcgucggcggcgaccgccagc

SEQ ID NO: 3069287 - RNA, 15 nt, Mycobacterium bovis subsp bovis AF2122/97
gcgucggcggcuucc

SEQ ID NO: 3069288 - RNA, 15 nt, Mycobacterium bovis subsp bovis AF2122/97
gcgucggcugccgcg

SEQ ID NO: 3069289 - RNA, 17 nt, Mycobacterium bovis subsp bovis AF2122/97
gcgucggcugccgcggc

SEQ ID NO: 3069290 - RNA, 18 nt, Mycobacterium bovis subsp bovis AF2122/97
gcgucggcugccgcggcu

SEQ ID NO: 3069291 - RNA, 21 nt, Mycobacterium bovis subsp bovis AF2122/97
gcgucggcuucucgaucggcg

SEQ ID NO: 3069292 - RNA, 14 nt, Mycobacterium bovis subsp bovis AF2122/97
gcgucgggaugcgc

SEQ ID NO: 3069293 - RNA, 14 nt, Mycobacterium bovis subsp bovis AF2122/97
gcgucgggcucggc

SEQ ID NO: 3069294 - RNA, 15 nt, Mycobacterium bovis subsp bovis AF2122/97
gcgucgggcucggcg

SEQ ID NO: 3069295 - RNA, 16 nt, Mycobacterium bovis subsp bovis AF2122/97
gcgucgggcucggcga

SEQ ID NO: 3069296 - RNA, 17 nt, Mycobacterium bovis subsp bovis AF2122/97
gcgucgggcucggcgaa

SEQ ID NO: 3069297 - RNA, 14 nt, Mycobacterium bovis subsp bovis AF2122/97
gcgucggucaccga

SEQ ID NO: 3069298 - RNA, 20 nt, Mycobacterium bovis subsp bovis AF2122/97
gcgucggugaaugccgucgc

SEQ ID NO: 3069299 - RNA, 23 nt, Mycobacterium bovis subsp bovis AF2122/97
gcgucggugaaugccgucgccgg

SEQ ID NO: 3069300 - RNA, 16 nt, Mycobacterium bovis subsp bovis AF2122/97
gcgucggugaccuucg

SEQ ID NO: 3069301 - RNA, 16 nt, Mycobacterium bovis subsp bovis AF2122/97
gcgucggugagcgcgu

SEQ ID NO: 3069302 - RNA, 15 nt, Mycobacterium bovis subsp bovis AF2122/97
gcgucggugccacca

SEQ ID NO: 3069303 - RNA, 16 nt, Mycobacterium bovis subsp bovis AF2122/97
gcgucggugccaccac

SEQ ID NO: 3069304 - RNA, 17 nt, Mycobacterium bovis subsp bovis AF2122/97
gcgucggugccaccacg

SEQ ID NO: 3069305 - RNA, 18 nt, Mycobacterium bovis subsp bovis AF2122/97
gcgucggugccaccacgc

SEQ ID NO: 3069306 - RNA, 23 nt, Mycobacterium bovis subsp bovis AF2122/97
gcgucgguggcaacgggucggca

SEQ ID NO: 3069307 - RNA, 20 nt, Mycobacterium bovis subsp bovis AF2122/97
gcgucggugggucucggcgu

SEQ ID NO: 3069308 - RNA, 19 nt, Mycobacterium bovis subsp bovis AF2122/97
gcgucggugugguccucga

SEQ ID NO: 3069309 - RNA, 22 nt, Mycobacterium bovis subsp bovis AF2122/97
gcgucguaaacgucggucgggg

SEQ ID NO: 3069310 - RNA, 16 nt, Mycobacterium bovis subsp bovis AF2122/97
gcgucguaaccgucgc

SEQ ID NO: 3069311 - RNA, 17 nt, Mycobacterium bovis subsp bovis AF2122/97
gcgucguaaccgucgcc

SEQ ID NO: 3069312 - RNA, 24 nt, Mycobacterium bovis subsp bovis AF2122/97
gcgucguaaccgucgccugccgac

SEQ ID NO: 3069313 - RNA, 15 nt, Mycobacterium bovis subsp bovis AF2122/97
gcgucguagaacgug

SEQ ID NO: 3069314 - RNA, 15 nt, Mycobacterium bovis subsp bovis AF2122/97
gcgucguagccacgc

SEQ ID NO: 3069315 - RNA, 17 nt, Mycobacterium bovis subsp bovis AF2122/97
gcgucguagcgcucgug

SEQ ID NO: 3069316 - RNA, 21 nt, Mycobacterium bovis subsp bovis AF2122/97
gcgucguagcgcucgugaccg

SEQ ID NO: 3069317 - RNA, 17 nt, Mycobacterium bovis subsp bovis AF2122/97
gcgucguagucgucggc

SEQ ID NO: 3069318 - RNA, 16 nt, Mycobacterium bovis subsp bovis AF2122/97
gcgucgucacgaucgu

SEQ ID NO: 3069319 - RNA, 19 nt, Mycobacterium bovis subsp bovis AF2122/97
gcgucguccagggcgacga

SEQ ID NO: 3069320 - RNA, 16 nt, Mycobacterium bovis subsp bovis AF2122/97
gcgucgucgacgacaa

SEQ ID NO: 3069321 - RNA, 14 nt, Mycobacterium bovis subsp bovis AF2122/97
gcgucgucgacggc

SEQ ID NO: 3069322 - RNA, 20 nt, Mycobacterium bovis subsp bovis AF2122/97
gcgucgucgagaaucggcau

SEQ ID NO: 3069323 - RNA, 13 nt, Mycobacterium bovis subsp bovis AF2122/97
gcgucgucgaguu

SEQ ID NO: 3069324 - RNA, 13 nt, Mycobacterium bovis subsp bovis AF2122/97
gcgucgucgauga

SEQ ID NO: 3069325 - RNA, 14 nt, Mycobacterium bovis subsp bovis AF2122/97
gcgucgucgcgcug

SEQ ID NO: 3069326 - RNA, 16 nt, Mycobacterium bovis subsp bovis AF2122/97
gcgucgucggcggcga

SEQ ID NO: 3069327 - RNA, 22 nt, Mycobacterium bovis subsp bovis AF2122/97
gcgucgucgguaaugccgggcc

SEQ ID NO: 3069328 - RNA, 14 nt, Mycobacterium bovis subsp bovis AF2122/97
gcgucgucuucuuc

SEQ ID NO: 3069329 - RNA, 15 nt, Mycobacterium bovis subsp bovis AF2122/97
gcgucgucuugaccg

SEQ ID NO: 3069330 - RNA, 16 nt, Mycobacterium bovis subsp bovis AF2122/97
gcgucgugccacuucc

SEQ ID NO: 3069331 - RNA, 21 nt, Mycobacterium bovis subsp bovis AF2122/97
gcgucgugccacuuccacggc

SEQ ID NO: 3069332 - RNA, 21 nt, Mycobacterium bovis subsp bovis AF2122/97
gcgugcagaucacgggugugc

SEQ ID NO: 3069333 - RNA, 15 nt, Mycobacterium bovis subsp bovis AF2122/97
gcgugcagcaccccc

SEQ ID NO: 3069334 - RNA, 14 nt, Mycobacterium bovis subsp bovis AF2122/97
gcgugcagcaggaa

SEQ ID NO: 3069335 - RNA, 23 nt, Mycobacterium bovis subsp bovis AF2122/97
gcgugcagcaggaaguagccgag

SEQ ID NO: 3069336 - RNA, 13 nt, Mycobacterium bovis subsp bovis AF2122/97
gcgugcagcggcg

SEQ ID NO: 3069337 - RNA, 16 nt, Mycobacterium bovis subsp bovis AF2122/97
gcgugcagcggcgccg

SEQ ID NO: 3069338 - RNA, 16 nt, Mycobacterium bovis subsp bovis AF2122/97
gcgugcagcggcgggc

SEQ ID NO: 3069339 - RNA, 18 nt, Mycobacterium bovis subsp bovis AF2122/97
gcgugcaggcugucaauc

SEQ ID NO: 3069340 - RNA, 15 nt, Mycobacterium bovis subsp bovis AF2122/97
gcgugcauaggccgc

SEQ ID NO: 3069341 - RNA, 20 nt, Mycobacterium bovis subsp bovis AF2122/97
gcgugcauaggccgcgucga

SEQ ID NO: 3069342 - RNA, 18 nt, Mycobacterium bovis subsp bovis AF2122/97
gcgugcaucgcgauuccg

SEQ ID NO: 3069343 - RNA, 14 nt, Mycobacterium bovis subsp bovis AF2122/97
gcgugcaugagccg

SEQ ID NO: 3069344 - RNA, 16 nt, Mycobacterium bovis subsp bovis AF2122/97
gcgugccacucgaugc

SEQ ID NO: 3069345 - RNA, 12 nt, Mycobacterium bovis subsp bovis AF2122/97
gcgugccagcac

SEQ ID NO: 3069346 - RNA, 12 nt, Mycobacterium bovis subsp bovis AF2122/97
gcgugccagcgc

SEQ ID NO: 3069347 - RNA, 13 nt, Mycobacterium bovis subsp bovis AF2122/97
gcgugccagcgcc

SEQ ID NO: 3069348 - RNA, 15 nt, Mycobacterium bovis subsp bovis AF2122/97
gcgugccagcgcccc

SEQ ID NO: 3069349 - RNA, 24 nt, Mycobacterium bovis subsp bovis AF2122/97
gcgugccaucgugguuuggaccgc

SEQ ID NO: 3069350 - RNA, 14 nt, Mycobacterium bovis subsp bovis AF2122/97
gcgugcccgccacc

SEQ ID NO: 3069351 - RNA, 22 nt, Mycobacterium bovis subsp bovis AF2122/97
gcgugccgaacagggaggucgc

SEQ ID NO: 3069352 - RNA, 22 nt, Mycobacterium bovis subsp bovis AF2122/97
gcgugccgcaaccggcgaucgg

SEQ ID NO: 3069353 - RNA, 23 nt, Mycobacterium bovis subsp bovis AF2122/97
gcgugccgcaccgccugcucggc

SEQ ID NO: 3069354 - RNA, 15 nt, Mycobacterium bovis subsp bovis AF2122/97
gcgugccgcagcggc

SEQ ID NO: 3069355 - RNA, 16 nt, Mycobacterium bovis subsp bovis AF2122/97
gcgugccgcccgccuc

SEQ ID NO: 3069356 - RNA, 23 nt, Mycobacterium bovis subsp bovis AF2122/97
gcgugccgcccgccucugucuuc

SEQ ID NO: 3069357 - RNA, 15 nt, Mycobacterium bovis subsp bovis AF2122/97
gcgugccgccgcaga

SEQ ID NO: 3069358 - RNA, 21 nt, Mycobacterium bovis subsp bovis AF2122/97
gcgugccggggauaucacgac

SEQ ID NO: 3069359 - RNA, 13 nt, Mycobacterium bovis subsp bovis AF2122/97
gcgugcgcaaggc

SEQ ID NO: 3069360 - RNA, 12 nt, Mycobacterium bovis subsp bovis AF2122/97
gcgugcgcuggc

SEQ ID NO: 3069361 - RNA, 21 nt, Mycobacterium bovis subsp bovis AF2122/97
gcgugcgcuggcugacaccga

SEQ ID NO: 3069362 - RNA, 13 nt, Mycobacterium bovis subsp bovis AF2122/97
gcgugcgcuggug

SEQ ID NO: 3069363 - RNA, 20 nt, Mycobacterium bovis subsp bovis AF2122/97
gcgugcgcugguggcggcga

SEQ ID NO: 3069364 - RNA, 16 nt, Mycobacterium bovis subsp bovis AF2122/97
gcgugcggacugacgu

SEQ ID NO: 3069365 - RNA, 19 nt, Mycobacterium bovis subsp bovis AF2122/97
gcgugcggacugacgucga

SEQ ID NO: 3069366 - RNA, 13 nt, Mycobacterium bovis subsp bovis AF2122/97
gcgugcggcgaag

SEQ ID NO: 3069367 - RNA, 17 nt, Mycobacterium bovis subsp bovis AF2122/97
gcgugcggcggcccauc

SEQ ID NO: 3069368 - RNA, 14 nt, Mycobacterium bovis subsp bovis AF2122/97
gcgugcggcugcca

SEQ ID NO: 3069369 - RNA, 14 nt, Mycobacterium bovis subsp bovis AF2122/97
gcgugcgguggcgc

SEQ ID NO: 3069370 - RNA, 16 nt, Mycobacterium bovis subsp bovis AF2122/97
gcgugcgguggcgcgc

SEQ ID NO: 3069371 - RNA, 13 nt, Mycobacterium bovis subsp bovis AF2122/97
gcgugcucgacgc

SEQ ID NO: 3069372 - RNA, 16 nt, Mycobacterium bovis subsp bovis AF2122/97
gcgugcucgacgcgca

SEQ ID NO: 3069373 - RNA, 20 nt, Mycobacterium bovis subsp bovis AF2122/97
gcgugcucgagcaccucggc

SEQ ID NO: 3069374 - RNA, 23 nt, Mycobacterium bovis subsp bovis AF2122/97
gcgugcucgccguaagcaccagc

SEQ ID NO: 3069375 - RNA, 15 nt, Mycobacterium bovis subsp bovis AF2122/97
gcgugcucggccugu

SEQ ID NO: 3069376 - RNA, 13 nt, Mycobacterium bovis subsp bovis AF2122/97
gcgugcugccgcc

SEQ ID NO: 3069377 - RNA, 21 nt, Mycobacterium bovis subsp bovis AF2122/97
gcgugcugccguauccaggcg

SEQ ID NO: 3069378 - RNA, 22 nt, Mycobacterium bovis subsp bovis AF2122/97
gcgugcugcggacaagucggca

SEQ ID NO: 3069379 - RNA, 15 nt, Mycobacterium bovis subsp bovis AF2122/97
gcgugcugugcucac

SEQ ID NO: 3069380 - RNA, 19 nt, Mycobacterium bovis subsp bovis AF2122/97
gcgugcugugcucacgagc

SEQ ID NO: 3069381 - RNA, 20 nt, Mycobacterium bovis subsp bovis AF2122/97
gcgugcuguggaugccgacg

SEQ ID NO: 3069382 - RNA, 17 nt, Mycobacterium bovis subsp bovis AF2122/97
gcgugcuugaccgccug

SEQ ID NO: 3069383 - RNA, 14 nt, Mycobacterium bovis subsp bovis AF2122/97
gcgugcuuggcagc

SEQ ID NO: 3069384 - RNA, 15 nt, Mycobacterium bovis subsp bovis AF2122/97
gcguggaaaccggug

SEQ ID NO: 3069385 - RNA, 19 nt, Mycobacterium bovis subsp bovis AF2122/97
gcguggaacuugcgcaggu

SEQ ID NO: 3069386 - RNA, 19 nt, Mycobacterium bovis subsp bovis AF2122/97
gcguggaagccgacgacca

SEQ ID NO: 3069387 - RNA, 22 nt, Mycobacterium bovis subsp bovis AF2122/97
gcguggaagccgacgaccagca

SEQ ID NO: 3069388 - RNA, 18 nt, Mycobacterium bovis subsp bovis AF2122/97
gcguggaauggcgccggc

SEQ ID NO: 3069389 - RNA, 20 nt, Mycobacterium bovis subsp bovis AF2122/97
gcguggaauggcgccggccg

SEQ ID NO: 3069390 - RNA, 23 nt, Mycobacterium bovis subsp bovis AF2122/97
gcguggaguggugauccagccgu

SEQ ID NO: 3069391 - RNA, 16 nt, Mycobacterium bovis subsp bovis AF2122/97
gcguggaucuuggcca

SEQ ID NO: 3069392 - RNA, 21 nt, Mycobacterium bovis subsp bovis AF2122/97
gcguggaucuuggccagcagc

SEQ ID NO: 3069393 - RNA, 22 nt, Mycobacterium bovis subsp bovis AF2122/97
gcguggaucuuggccagcagcg

SEQ ID NO: 3069394 - RNA, 19 nt, Mycobacterium bovis subsp bovis AF2122/97
gcguggcaguacaccggcg

SEQ ID NO: 3069395 - RNA, 23 nt, Mycobacterium bovis subsp bovis AF2122/97
gcguggcaguacaccggcgugcu

SEQ ID NO: 3069396 - RNA, 19 nt, Mycobacterium bovis subsp bovis AF2122/97
gcguggcagugcaggcggc

SEQ ID NO: 3069397 - RNA, 24 nt, Mycobacterium bovis subsp bovis AF2122/97
gcguggccaacucuucagcaagcc

SEQ ID NO: 3069398 - RNA, 16 nt, Mycobacterium bovis subsp bovis AF2122/97
gcguggccaauccggc

SEQ ID NO: 3069399 - RNA, 19 nt, Mycobacterium bovis subsp bovis AF2122/97
gcguggccaauccggcggc

SEQ ID NO: 3069400 - RNA, 20 nt, Mycobacterium bovis subsp bovis AF2122/97
gcguggccaauccggcggcg

SEQ ID NO: 3069401 - RNA, 21 nt, Mycobacterium bovis subsp bovis AF2122/97
gcguggccaauccggcggcga

SEQ ID NO: 3069402 - RNA, 23 nt, Mycobacterium bovis subsp bovis AF2122/97
gcguggccaauccggcggcgacg

SEQ ID NO: 3069403 - RNA, 14 nt, Mycobacterium bovis subsp bovis AF2122/97
gcguggccccaccg

SEQ ID NO: 3069404 - RNA, 14 nt, Mycobacterium bovis subsp bovis AF2122/97
gcguggcccucggc

SEQ ID NO: 3069405 - RNA, 17 nt, Mycobacterium bovis subsp bovis AF2122/97
gcguggcccucggcgau

SEQ ID NO: 3069406 - RNA, 19 nt, Mycobacterium bovis subsp bovis AF2122/97
gcguggccgccggcgcugg

SEQ ID NO: 3069407 - RNA, 21 nt, Mycobacterium bovis subsp bovis AF2122/97
gcguggccgccggcgcuggcg

SEQ ID NO: 3069408 - RNA, 16 nt, Mycobacterium bovis subsp bovis AF2122/97
gcguggcgcaccaccg

SEQ ID NO: 3069409 - RNA, 19 nt, Mycobacterium bovis subsp bovis AF2122/97
gcguggcgcaccaccgccc

SEQ ID NO: 3069410 - RNA, 22 nt, Mycobacterium bovis subsp bovis AF2122/97
gcguggcgcaccaccgccccgc

SEQ ID NO: 3069411 - RNA, 14 nt, Mycobacterium bovis subsp bovis AF2122/97
gcguggcgccggcc

SEQ ID NO: 3069412 - RNA, 18 nt, Mycobacterium bovis subsp bovis AF2122/97
gcguggcggggccgcgcc

SEQ ID NO: 3069413 - RNA, 17 nt, Mycobacterium bovis subsp bovis AF2122/97
gcguggcugccuucggc

SEQ ID NO: 3069414 - RNA, 19 nt, Mycobacterium bovis subsp bovis AF2122/97
gcguggcugccuucggcga

SEQ ID NO: 3069415 - RNA, 22 nt, Mycobacterium bovis subsp bovis AF2122/97
gcguggcugccuucggcgagcg

SEQ ID NO: 3069416 - RNA, 15 nt, Mycobacterium bovis subsp bovis AF2122/97
gcguggcuggcggcg

SEQ ID NO: 3069417 - RNA, 19 nt, Mycobacterium bovis subsp bovis AF2122/97
gcguggcuggcggcgaccg

SEQ ID NO: 3069418 - RNA, 20 nt, Mycobacterium bovis subsp bovis AF2122/97
gcguuccauggcccgcucgu

SEQ ID NO: 3069419 - RNA, 17 nt, Mycobacterium bovis subsp bovis AF2122/97
gcguucccacuggaggu

SEQ ID NO: 3069420 - RNA, 23 nt, Mycobacterium bovis subsp bovis AF2122/97
gcguucccccacucggacccgca

SEQ ID NO: 3069421 - RNA, 16 nt, Mycobacterium bovis subsp bovis AF2122/97
gcguuccccgagaacg

SEQ ID NO: 3069422 - RNA, 22 nt, Mycobacterium bovis subsp bovis AF2122/97
gcguuccugaucgagcgccagc

SEQ ID NO: 3069423 - RNA, 18 nt, Mycobacterium bovis subsp bovis AF2122/97
gcguucgagagccccgac

SEQ ID NO: 3069424 - RNA, 14 nt, Mycobacterium bovis subsp bovis AF2122/97
gcguucgccgcccg

SEQ ID NO: 3069425 - RNA, 15 nt, Mycobacterium bovis subsp bovis AF2122/97
gcguucgccgcccgg

SEQ ID NO: 3069426 - RNA, 17 nt, Mycobacterium bovis subsp bovis AF2122/97
gcguucgccgcccggcg

SEQ ID NO: 3069427 - RNA, 16 nt, Mycobacterium bovis subsp bovis AF2122/97
gcguucggcaccuggu

SEQ ID NO: 3069428 - RNA, 14 nt, Mycobacterium bovis subsp bovis AF2122/97
gcguucggccgacu

SEQ ID NO: 3069429 - RNA, 13 nt, Mycobacterium bovis subsp bovis AF2122/97
gcguucggcgagc

SEQ ID NO: 3069430 - RNA, 14 nt, Mycobacterium bovis subsp bovis AF2122/97
gcguucggcgagca

SEQ ID NO: 3069431 - RNA, 17 nt, Mycobacterium bovis subsp bovis AF2122/97
gcguucggcgcugaucg

SEQ ID NO: 3069432 - RNA, 18 nt, Mycobacterium bovis subsp bovis AF2122/97
gcguucggcgcugaucgc

SEQ ID NO: 3069433 - RNA, 21 nt, Mycobacterium bovis subsp bovis AF2122/97
gcguucggcgcugaucgcgcg

SEQ ID NO: 3069434 - RNA, 23 nt, Mycobacterium bovis subsp bovis AF2122/97
gcguucggcgcugaucgcgcgca

SEQ ID NO: 3069435 - RNA, 23 nt, Mycobacterium bovis subsp bovis AF2122/97
gcguucggucagugggacgggcg

SEQ ID NO: 3069436 - RNA, 20 nt, Mycobacterium bovis subsp bovis AF2122/97
gcguucgucguaguccaggc

SEQ ID NO: 3069437 - RNA, 20 nt, Mycobacterium bovis subsp bovis AF2122/97
gcguugaacugugcggcagc

SEQ ID NO: 3069438 - RNA, 14 nt, Mycobacterium bovis subsp bovis AF2122/97
gcguugaaggcgcc

SEQ ID NO: 3069439 - RNA, 16 nt, Mycobacterium bovis subsp bovis AF2122/97
gcguugaaggcgccgg

SEQ ID NO: 3069440 - RNA, 20 nt, Mycobacterium bovis subsp bovis AF2122/97
gcguugaaggcgccgguguu

SEQ ID NO: 3069441 - RNA, 13 nt, Mycobacterium bovis subsp bovis AF2122/97
gcguugaccagca

SEQ ID NO: 3069442 - RNA, 20 nt, Mycobacterium bovis subsp bovis AF2122/97
gcguugaccaucacgcccug

SEQ ID NO: 3069443 - RNA, 12 nt, Mycobacterium bovis subsp bovis AF2122/97
gcguugaccgcg

SEQ ID NO: 3069444 - RNA, 17 nt, Mycobacterium bovis subsp bovis AF2122/97
gcguugacgaucagucc

SEQ ID NO: 3069445 - RNA, 22 nt, Mycobacterium bovis subsp bovis AF2122/97
gcguugacgaucuccgccaacc

SEQ ID NO: 3069446 - RNA, 23 nt, Mycobacterium bovis subsp bovis AF2122/97
gcguugacgaucuccgccaaccg

SEQ ID NO: 3069447 - RNA, 14 nt, Mycobacterium bovis subsp bovis AF2122/97
gcguugacggcggg

SEQ ID NO: 3069448 - RNA, 21 nt, Mycobacterium bovis subsp bovis AF2122/97
gcguugacggcggggcggcgg

SEQ ID NO: 3069449 - RNA, 20 nt, Mycobacterium bovis subsp bovis AF2122/97
gcguugacucugcguccacc

SEQ ID NO: 3069450 - RNA, 16 nt, Mycobacterium bovis subsp bovis AF2122/97
gcguugagcaggugcc

SEQ ID NO: 3069451 - RNA, 22 nt, Mycobacterium bovis subsp bovis AF2122/97
gcguugagcucaauggcuucga

SEQ ID NO: 3069452 - RNA, 22 nt, Mycobacterium bovis subsp bovis AF2122/97
gcguugagcuggcgguugcccg

SEQ ID NO: 3069453 - RNA, 22 nt, Mycobacterium bovis subsp bovis AF2122/97
gcguugagugcccauagccggu

SEQ ID NO: 3069454 - RNA, 17 nt, Mycobacterium bovis subsp bovis AF2122/97
gcguugauacgcgucga

SEQ ID NO: 3069455 - RNA, 23 nt, Mycobacterium bovis subsp bovis AF2122/97
gcguugauccgcaccccauacuc

SEQ ID NO: 3069456 - RNA, 22 nt, Mycobacterium bovis subsp bovis AF2122/97
gcguugaucgacaucaccaccg

SEQ ID NO: 3069457 - RNA, 17 nt, Mycobacterium bovis subsp bovis AF2122/97
gcguugaugaccgccgc

SEQ ID NO: 3069458 - RNA, 20 nt, Mycobacterium bovis subsp bovis AF2122/97
gcguugaugaccgccgccgg

SEQ ID NO: 3069459 - RNA, 16 nt, Mycobacterium bovis subsp bovis AF2122/97
gcguugcacagcagcg

SEQ ID NO: 3069460 - RNA, 22 nt, Mycobacterium bovis subsp bovis AF2122/97
gcguugcaccauucgcaccggc

SEQ ID NO: 3069461 - RNA, 14 nt, Mycobacterium bovis subsp bovis AF2122/97
gcguugcacugcug

SEQ ID NO: 3069462 - RNA, 19 nt, Mycobacterium bovis subsp bovis AF2122/97
gcguugccaggugcuguuu

SEQ ID NO: 3069463 - RNA, 16 nt, Mycobacterium bovis subsp bovis AF2122/97
gcguugcccuccuucu

SEQ ID NO: 3069464 - RNA, 15 nt, Mycobacterium bovis subsp bovis AF2122/97
gcguugccgaaaccc

SEQ ID NO: 3069465 - RNA, 16 nt, Mycobacterium bovis subsp bovis AF2122/97
gcguugccgaaacccg

SEQ ID NO: 3069466 - RNA, 13 nt, Mycobacterium bovis subsp bovis AF2122/97
gcguugccgccgg

SEQ ID NO: 3069467 - RNA, 14 nt, Mycobacterium bovis subsp bovis AF2122/97
gcguugccgccggc

SEQ ID NO: 3069468 - RNA, 23 nt, Mycobacterium bovis subsp bovis AF2122/97
gcguugccgccggcuccacccuu

SEQ ID NO: 3069469 - RNA, 21 nt, Mycobacterium bovis subsp bovis AF2122/97
gcguugccgccguccccgccg

SEQ ID NO: 3069470 - RNA, 15 nt, Mycobacterium bovis subsp bovis AF2122/97
gcguugccgccguug

SEQ ID NO: 3069471 - RNA, 21 nt, Mycobacterium bovis subsp bovis AF2122/97
gcguugccgccguugccgcca

SEQ ID NO: 3069472 - RNA, 18 nt, Mycobacterium bovis subsp bovis AF2122/97
gcguugcgcugcgcgacg

SEQ ID NO: 3069473 - RNA, 18 nt, Mycobacterium bovis subsp bovis AF2122/97
gcguugcugcagcagcgc

SEQ ID NO: 3069474 - RNA, 13 nt, Mycobacterium bovis subsp bovis AF2122/97
gcguugcuggucg

SEQ ID NO: 3069475 - RNA, 14 nt, Mycobacterium bovis subsp bovis AF2122/97
gcguugcuggucgc

SEQ ID NO: 3069476 - RNA, 17 nt, Mycobacterium bovis subsp bovis AF2122/97
gcguuggacaauucgac

SEQ ID NO: 3069477 - RNA, 14 nt, Mycobacterium bovis subsp bovis AF2122/97
gcguuggaugaagu

SEQ ID NO: 3069478 - RNA, 21 nt, Mycobacterium bovis subsp bovis AF2122/97
gcguuggccacacagucacgg

SEQ ID NO: 3069479 - RNA, 15 nt, Mycobacterium bovis subsp bovis AF2122/97
gcguuggccagcagg

SEQ ID NO: 3069480 - RNA, 16 nt, Mycobacterium bovis subsp bovis AF2122/97
gcguuggccauggcca

SEQ ID NO: 3069481 - RNA, 13 nt, Mycobacterium bovis subsp bovis AF2122/97
gcguuggcccgcc

SEQ ID NO: 3069482 - RNA, 13 nt, Mycobacterium bovis subsp bovis AF2122/97
gcguuggcgacga

SEQ ID NO: 3069483 - RNA, 20 nt, Mycobacterium bovis subsp bovis AF2122/97
gcguuggcgaucucgacggc

SEQ ID NO: 3069484 - RNA, 13 nt, Mycobacterium bovis subsp bovis AF2122/97
gcguuggcggcga

SEQ ID NO: 3069485 - RNA, 21 nt, Mycobacterium bovis subsp bovis AF2122/97
gcguuggcggcuucgccccga

SEQ ID NO: 3069486 - RNA, 12 nt, Mycobacterium bovis subsp bovis AF2122/97
gcguuggcuggu

SEQ ID NO: 3069487 - RNA, 21 nt, Mycobacterium bovis subsp bovis AF2122/97
gcguugggaucccagcgcagc

SEQ ID NO: 3069488 - RNA, 20 nt, Mycobacterium bovis subsp bovis AF2122/97
gcguugggaucgcgcagcgc

SEQ ID NO: 3069489 - RNA, 22 nt, Mycobacterium bovis subsp bovis AF2122/97
gcguugggaucgcgcagcgccg

SEQ ID NO: 3069490 - RNA, 16 nt, Mycobacterium bovis subsp bovis AF2122/97
gcguuggucaucaccc

SEQ ID NO: 3069491 - RNA, 16 nt, Mycobacterium bovis subsp bovis AF2122/97
gcguuggugcagucgg

SEQ ID NO: 3069492 - RNA, 20 nt, Mycobacterium bovis subsp bovis AF2122/97
gcguugguggucggcccucc

SEQ ID NO: 3069493 - RNA, 15 nt, Mycobacterium bovis subsp bovis AF2122/97
gcguuguagcggucc

SEQ ID NO: 3069494 - RNA, 13 nt, Mycobacterium bovis subsp bovis AF2122/97
gcguuguccacca

SEQ ID NO: 3069495 - RNA, 15 nt, Mycobacterium bovis subsp bovis AF2122/97
gcguuguccgcggcc

SEQ ID NO: 3069496 - RNA, 20 nt, Mycobacterium bovis subsp bovis AF2122/97
gcguugucgcccacccacug

SEQ ID NO: 3069497 - RNA, 18 nt, Mycobacterium bovis subsp bovis AF2122/97
gcguugucggcuggacgg

SEQ ID NO: 3069498 - RNA, 21 nt, Mycobacterium bovis subsp bovis AF2122/97
gcguugucgguuggcagccac

SEQ ID NO: 3069499 - RNA, 20 nt, Mycobacterium bovis subsp bovis AF2122/97
gcguugugaccgccgaugcc

SEQ ID NO: 3069500 - RNA, 19 nt, Mycobacterium bovis subsp bovis AF2122/97
gcguugugcccgccggccc

SEQ ID NO: 3069501 - RNA, 19 nt, Mycobacterium bovis subsp bovis AF2122/97
gcguuguuaucgaagcccg

SEQ ID NO: 3069502 - RNA, 21 nt, Mycobacterium bovis subsp bovis AF2122/97
gcguuguuaucgaagcccgag

SEQ ID NO: 3069503 - RNA, 12 nt, Mycobacterium bovis subsp bovis AF2122/97
gcguuguugacc

SEQ ID NO: 3069504 - RNA, 22 nt, Mycobacterium bovis subsp bovis AF2122/97
gcuacgguaccgagaacaccac

SEQ ID NO: 3069505 - RNA, 13 nt, Mycobacterium bovis subsp bovis AF2122/97
gcuacgucgaccg

SEQ ID NO: 3069506 - RNA, 14 nt, Mycobacterium bovis subsp bovis AF2122/97
gcuacgucgaccga

SEQ ID NO: 3069507 - RNA, 16 nt, Mycobacterium bovis subsp bovis AF2122/97
gcuacgucgaccgacg

SEQ ID NO: 3069508 - RNA, 17 nt, Mycobacterium bovis subsp bovis AF2122/97
gcuacgucgaccgacgg

SEQ ID NO: 3069509 - RNA, 16 nt, Mycobacterium bovis subsp bovis AF2122/97
gcuacguuacgccgag

SEQ ID NO: 3069510 - RNA, 17 nt, Mycobacterium bovis subsp bovis AF2122/97
gcuacguuacgccgaga

SEQ ID NO: 3069511 - RNA, 17 nt, Mycobacterium bovis subsp bovis AF2122/97
gcuacuaggcccagcac

SEQ ID NO: 3069512 - RNA, 23 nt, Mycobacterium bovis subsp bovis AF2122/97
gcuacuaugccaacgacaggcgc

SEQ ID NO: 3069513 - RNA, 20 nt, Mycobacterium bovis subsp bovis AF2122/97
gcuacucacggugaucguuc

SEQ ID NO: 3069514 - RNA, 14 nt, Mycobacterium bovis subsp bovis AF2122/97
gcuacuuggucagu

SEQ ID NO: 3069515 - RNA, 16 nt, Mycobacterium bovis subsp bovis AF2122/97
gcuagagccaguuucu

SEQ ID NO: 3069516 - RNA, 19 nt, Mycobacterium bovis subsp bovis AF2122/97
gcuagaucccaguccgaug

SEQ ID NO: 3069517 - RNA, 22 nt, Mycobacterium bovis subsp bovis AF2122/97
gcuagcagagacaugccggcga

SEQ ID NO: 3069518 - RNA, 15 nt, Mycobacterium bovis subsp bovis AF2122/97
gcuagcagcagcccg

SEQ ID NO: 3069519 - RNA, 17 nt, Mycobacterium bovis subsp bovis AF2122/97
gcuagcagcagcccgac

SEQ ID NO: 3069520 - RNA, 20 nt, Mycobacterium bovis subsp bovis AF2122/97
gcuagccaccaggcggucag

SEQ ID NO: 3069521 - RNA, 16 nt, Mycobacterium bovis subsp bovis AF2122/97
gcuagccagucggcca

SEQ ID NO: 3069522 - RNA, 18 nt, Mycobacterium bovis subsp bovis AF2122/97
gcuagccagucggccacc

SEQ ID NO: 3069523 - RNA, 24 nt, Mycobacterium bovis subsp bovis AF2122/97
gcuagccccgaucaucgacgauuc

SEQ ID NO: 3069524 - RNA, 13 nt, Mycobacterium bovis subsp bovis AF2122/97
gcuagcccggcag

SEQ ID NO: 3069525 - RNA, 14 nt, Mycobacterium bovis subsp bovis AF2122/97
gcuagcccggcagc

SEQ ID NO: 3069526 - RNA, 19 nt, Mycobacterium bovis subsp bovis AF2122/97
gcuagccgacagcucaucg

SEQ ID NO: 3069527 - RNA, 17 nt, Mycobacterium bovis subsp bovis AF2122/97
gcuagccgggcgcgccg

SEQ ID NO: 3069528 - RNA, 18 nt, Mycobacterium bovis subsp bovis AF2122/97
gcuagccgggcgcgccgg

SEQ ID NO: 3069529 - RNA, 14 nt, Mycobacterium bovis subsp bovis AF2122/97
gcuagccguucggc

SEQ ID NO: 3069530 - RNA, 23 nt, Mycobacterium bovis subsp bovis AF2122/97
gcuagcgccgaucuucgcgcgcu

SEQ ID NO: 3069531 - RNA, 15 nt, Mycobacterium bovis subsp bovis AF2122/97
gcuagcgccgccagu

SEQ ID NO: 3069532 - RNA, 13 nt, Mycobacterium bovis subsp bovis AF2122/97
gcuagcgccgcgc

SEQ ID NO: 3069533 - RNA, 16 nt, Mycobacterium bovis subsp bovis AF2122/97
gcuagcgccgcgcuug

SEQ ID NO: 3069534 - RNA, 18 nt, Mycobacterium bovis subsp bovis AF2122/97
gcuagcgccgcgcuugcg

SEQ ID NO: 3069535 - RNA, 22 nt, Mycobacterium bovis subsp bovis AF2122/97
gcuagcgcuauaggccgcaugc

SEQ ID NO: 3069536 - RNA, 15 nt, Mycobacterium bovis subsp bovis AF2122/97
gcuagcgcuugcgac

SEQ ID NO: 3069537 - RNA, 16 nt, Mycobacterium bovis subsp bovis AF2122/97
gcuagcggauucagcg

SEQ ID NO: 3069538 - RNA, 20 nt, Mycobacterium bovis subsp bovis AF2122/97
gcuagcggauucagcgucgc

SEQ ID NO: 3069539 - RNA, 22 nt, Mycobacterium bovis subsp bovis AF2122/97
gcuagcggauucagcgucgcca

SEQ ID NO: 3069540 - RNA, 24 nt, Mycobacterium bovis subsp bovis AF2122/97
gcuagcgguuuagccgcuugggcc

SEQ ID NO: 3069541 - RNA, 13 nt, Mycobacterium bovis subsp bovis AF2122/97
gcuagcucggcgg

SEQ ID NO: 3069542 - RNA, 20 nt, Mycobacterium bovis subsp bovis AF2122/97
gcuagcugaugccuggucgc

SEQ ID NO: 3069543 - RNA, 15 nt, Mycobacterium bovis subsp bovis AF2122/97
gcuagcuuggcggcc

SEQ ID NO: 3069544 - RNA, 16 nt, Mycobacterium bovis subsp bovis AF2122/97
gcuagcuuggcggcca

SEQ ID NO: 3069545 - RNA, 18 nt, Mycobacterium bovis subsp bovis AF2122/97
gcuagcuuggcggccagc

SEQ ID NO: 3069546 - RNA, 17 nt, Mycobacterium bovis subsp bovis AF2122/97
gcuaggaccaccagcgc

SEQ ID NO: 3069547 - RNA, 18 nt, Mycobacterium bovis subsp bovis AF2122/97
gcuaggaccgcgguggcc

SEQ ID NO: 3069548 - RNA, 19 nt, Mycobacterium bovis subsp bovis AF2122/97
gcuaggacggcgcgagccg

SEQ ID NO: 3069549 - RNA, 16 nt, Mycobacterium bovis subsp bovis AF2122/97
gcuaggacggcugccg

SEQ ID NO: 3069550 - RNA, 21 nt, Mycobacterium bovis subsp bovis AF2122/97
gcuaggaucggauggcggcca

SEQ ID NO: 3069551 - RNA, 20 nt, Mycobacterium bovis subsp bovis AF2122/97
gcuaggcaccagcggaucgc

SEQ ID NO: 3069552 - RNA, 17 nt, Mycobacterium bovis subsp bovis AF2122/97
gcuaggccaagccgcgg

SEQ ID NO: 3069553 - RNA, 13 nt, Mycobacterium bovis subsp bovis AF2122/97
gcuaggccaccgg

SEQ ID NO: 3069554 - RNA, 18 nt, Mycobacterium bovis subsp bovis AF2122/97
gcuaggccaccggcgacc

SEQ ID NO: 3069555 - RNA, 23 nt, Mycobacterium bovis subsp bovis AF2122/97
gcuaggccaccggcgaccgacgg

SEQ ID NO: 3069556 - RNA, 14 nt, Mycobacterium bovis subsp bovis AF2122/97
gcuaggccagcacg

SEQ ID NO: 3069557 - RNA, 14 nt, Mycobacterium bovis subsp bovis AF2122/97
gcuaggccggccgg

SEQ ID NO: 3069558 - RNA, 19 nt, Mycobacterium bovis subsp bovis AF2122/97
gcuagggcagcagcccggg

SEQ ID NO: 3069559 - RNA, 21 nt, Mycobacterium bovis subsp bovis AF2122/97
gcuagggcgaugagggcuugu

SEQ ID NO: 3069560 - RNA, 17 nt, Mycobacterium bovis subsp bovis AF2122/97
gcuaggucaguucccag

SEQ ID NO: 3069561 - RNA, 23 nt, Mycobacterium bovis subsp bovis AF2122/97
gcuaggucaguucccagaccacc

SEQ ID NO: 3069562 - RNA, 16 nt, Mycobacterium bovis subsp bovis AF2122/97
gcuaggugacgccgcc

SEQ ID NO: 3069563 - RNA, 22 nt, Mycobacterium bovis subsp bovis AF2122/97
gcuaggugacgccgccagcacc

SEQ ID NO: 3069564 - RNA, 19 nt, Mycobacterium bovis subsp bovis AF2122/97
gcuaggugcaacaggcgcg

SEQ ID NO: 3069565 - RNA, 20 nt, Mycobacterium bovis subsp bovis AF2122/97
gcuagucggggugggacagg

SEQ ID NO: 3069566 - RNA, 20 nt, Mycobacterium bovis subsp bovis AF2122/97
gcuagugcgggccgugaccc

SEQ ID NO: 3069567 - RNA, 22 nt, Mycobacterium bovis subsp bovis AF2122/97
gcuauccaggccgucaggcgug

SEQ ID NO: 3069568 - RNA, 15 nt, Mycobacterium bovis subsp bovis AF2122/97
gcuaucccaggggca

SEQ ID NO: 3069569 - RNA, 16 nt, Mycobacterium bovis subsp bovis AF2122/97
gcuauccgagugaucg

SEQ ID NO: 3069570 - RNA, 16 nt, Mycobacterium bovis subsp bovis AF2122/97
gcuauccgcgggaagu

SEQ ID NO: 3069571 - RNA, 16 nt, Mycobacterium bovis subsp bovis AF2122/97
gcuauccggcggccag

SEQ ID NO: 3069572 - RNA, 20 nt, Mycobacterium bovis subsp bovis AF2122/97
gcuaucgaggaggcggucga

SEQ ID NO: 3069573 - RNA, 12 nt, Mycobacterium bovis subsp bovis AF2122/97
gcuaucgcagaa

SEQ ID NO: 3069574 - RNA, 17 nt, Mycobacterium bovis subsp bovis AF2122/97
gcuaucgguucagcugc

SEQ ID NO: 3069575 - RNA, 22 nt, Mycobacterium bovis subsp bovis AF2122/97
gcuaucgugcgccgacggugca

SEQ ID NO: 3069576 - RNA, 15 nt, Mycobacterium bovis subsp bovis AF2122/97
gcuaugaccugcgaa

SEQ ID NO: 3069577 - RNA, 18 nt, Mycobacterium bovis subsp bovis AF2122/97
gcuaugcuggcagcucgg

SEQ ID NO: 3069578 - RNA, 17 nt, Mycobacterium bovis subsp bovis AF2122/97
gcuauggcgccgcggcu

SEQ ID NO: 3069579 - RNA, 15 nt, Mycobacterium bovis subsp bovis AF2122/97
gcuauggcggcuucg

SEQ ID NO: 3069580 - RNA, 17 nt, Mycobacterium bovis subsp bovis AF2122/97
gcuauggguucgcgguu

SEQ ID NO: 3069581 - RNA, 23 nt, Mycobacterium bovis subsp bovis AF2122/97
gcuauggugccggugauggccga

SEQ ID NO: 3069582 - RNA, 15 nt, Mycobacterium bovis subsp bovis AF2122/97
gcuauucgccagcgc

SEQ ID NO: 3069583 - RNA, 20 nt, Mycobacterium bovis subsp bovis AF2122/97
gcuauucggcggcauguuca

SEQ ID NO: 3069584 - RNA, 21 nt, Mycobacterium bovis subsp bovis AF2122/97
gcucaaaucaugcgauucugc

SEQ ID NO: 3069585 - RNA, 23 nt, Mycobacterium bovis subsp bovis AF2122/97
gcucaaccagcagacgccguagc

SEQ ID NO: 3069586 - RNA, 21 nt, Mycobacterium bovis subsp bovis AF2122/97
gcucaacggcgaaaguccugc

SEQ ID NO: 3069587 - RNA, 20 nt, Mycobacterium bovis subsp bovis AF2122/97
gcucaacggcgacaucggcc

SEQ ID NO: 3069588 - RNA, 18 nt, Mycobacterium bovis subsp bovis AF2122/97
gcucaaggcuucggcggc

SEQ ID NO: 3069589 - RNA, 20 nt, Mycobacterium bovis subsp bovis AF2122/97
gcucaaggcuucggcggccg

SEQ ID NO: 3069590 - RNA, 12 nt, Mycobacterium bovis subsp bovis AF2122/97
gcucagggcagu

SEQ ID NO: 3069591 - RNA, 21 nt, Mycobacterium bovis subsp bovis AF2122/97
gcucagggcgcaaaccacccg

SEQ ID NO: 3069592 - RNA, 22 nt, Mycobacterium bovis subsp bovis AF2122/97
gcucagggugcgccgcagcagg

SEQ ID NO: 3069593 - RNA, 23 nt, Mycobacterium bovis subsp bovis AF2122/97
gcucaggguguucacguucagcc

SEQ ID NO: 3069594 - RNA, 20 nt, Mycobacterium bovis subsp bovis AF2122/97
gcucaggucaccggccgccg

SEQ ID NO: 3069595 - RNA, 21 nt, Mycobacterium bovis subsp bovis AF2122/97
gcucaggucaucggcggcggg

SEQ ID NO: 3069596 - RNA, 24 nt, Mycobacterium bovis subsp bovis AF2122/97
gcucaggucgcagaccagacugca

SEQ ID NO: 3069597 - RNA, 22 nt, Mycobacterium bovis subsp bovis AF2122/97
gcucagguucagcuugaugucu

SEQ ID NO: 3069598 - RNA, 17 nt, Mycobacterium bovis subsp bovis AF2122/97
gcucagugaugcgcccc

SEQ ID NO: 3069599 - RNA, 16 nt, Mycobacterium bovis subsp bovis AF2122/97
gcucaguuuggcgggu

SEQ ID NO: 3069600 - RNA, 15 nt, Mycobacterium bovis subsp bovis AF2122/97
gcucauaggccggcg

SEQ ID NO: 3069601 - RNA, 16 nt, Mycobacterium bovis subsp bovis AF2122/97
gcucaucacccagcgc

SEQ ID NO: 3069602 - RNA, 19 nt, Mycobacterium bovis subsp bovis AF2122/97
gcucaucacccagcgccga

SEQ ID NO: 3069603 - RNA, 20 nt, Mycobacterium bovis subsp bovis AF2122/97
gcucaucacccagcgccgac

SEQ ID NO: 3069604 - RNA, 16 nt, Mycobacterium bovis subsp bovis AF2122/97
gcucaucaccggcgca

SEQ ID NO: 3069605 - RNA, 18 nt, Mycobacterium bovis subsp bovis AF2122/97
gcucauccagcgcgugga

SEQ ID NO: 3069606 - RNA, 22 nt, Mycobacterium bovis subsp bovis AF2122/97
gcucaucccgacccuucgggcu

SEQ ID NO: 3069607 - RNA, 13 nt, Mycobacterium bovis subsp bovis AF2122/97
gcucauccgccgg

SEQ ID NO: 3069608 - RNA, 18 nt, Mycobacterium bovis subsp bovis AF2122/97
gcucaucgaccgcggccg

SEQ ID NO: 3069609 - RNA, 20 nt, Mycobacterium bovis subsp bovis AF2122/97
gcucaucgaccgcggccggg

SEQ ID NO: 3069610 - RNA, 17 nt, Mycobacterium bovis subsp bovis AF2122/97
gcucaucgaccggggcu

SEQ ID NO: 3069611 - RNA, 16 nt, Mycobacterium bovis subsp bovis AF2122/97
gcucaucgacgagccg

SEQ ID NO: 3069612 - RNA, 14 nt, Mycobacterium bovis subsp bovis AF2122/97
gcucaucgaucccg

SEQ ID NO: 3069613 - RNA, 13 nt, Mycobacterium bovis subsp bovis AF2122/97
gcucaucgcggcg

SEQ ID NO: 3069614 - RNA, 14 nt, Mycobacterium bovis subsp bovis AF2122/97
gcucaucgcggcga

SEQ ID NO: 3069615 - RNA, 20 nt, Mycobacterium bovis subsp bovis AF2122/97
gcucaucgcggcgaacauca

SEQ ID NO: 3069616 - RNA, 15 nt, Mycobacterium bovis subsp bovis AF2122/97
gcucaucugcgcgcg

SEQ ID NO: 3069617 - RNA, 19 nt, Mycobacterium bovis subsp bovis AF2122/97
gcucaucuguaaccuccuc

SEQ ID NO: 3069618 - RNA, 21 nt, Mycobacterium bovis subsp bovis AF2122/97
gcucaucuguaaccuccucga

SEQ ID NO: 3069619 - RNA, 16 nt, Mycobacterium bovis subsp bovis AF2122/97
gcucaugaccgcucgg

SEQ ID NO: 3069620 - RNA, 20 nt, Mycobacterium bovis subsp bovis AF2122/97
gcucaugcgagucgucccag

SEQ ID NO: 3069621 - RNA, 17 nt, Mycobacterium bovis subsp bovis AF2122/97
gcuccaaaagccucagc

SEQ ID NO: 3069622 - RNA, 20 nt, Mycobacterium bovis subsp bovis AF2122/97
gcuccaaaagccucagccgc

SEQ ID NO: 3069623 - RNA, 15 nt, Mycobacterium bovis subsp bovis AF2122/97
gcuccaaaucggcau

SEQ ID NO: 3069624 - RNA, 15 nt, Mycobacterium bovis subsp bovis AF2122/97
gcuccaacacccgcc

SEQ ID NO: 3069625 - RNA, 17 nt, Mycobacterium bovis subsp bovis AF2122/97
gcuccaacacccgccgg

SEQ ID NO: 3069626 - RNA, 22 nt, Mycobacterium bovis subsp bovis AF2122/97
gcuccaacagguaagccacaua

SEQ ID NO: 3069627 - RNA, 18 nt, Mycobacterium bovis subsp bovis AF2122/97
gcuccaauugcggccgcg

SEQ ID NO: 3069628 - RNA, 16 nt, Mycobacterium bovis subsp bovis AF2122/97
gcuccacaaguagccg

SEQ ID NO: 3069629 - RNA, 18 nt, Mycobacterium bovis subsp bovis AF2122/97
gcuccacauaguccgaac

SEQ ID NO: 3069630 - RNA, 19 nt, Mycobacterium bovis subsp bovis AF2122/97
gcuccaccaggacgugguc

SEQ ID NO: 3069631 - RNA, 13 nt, Mycobacterium bovis subsp bovis AF2122/97
gcuccaccccuag

SEQ ID NO: 3069632 - RNA, 17 nt, Mycobacterium bovis subsp bovis AF2122/97
gcuccacccuugccgcu

SEQ ID NO: 3069633 - RNA, 14 nt, Mycobacterium bovis subsp bovis AF2122/97
gcuccacugaccag

SEQ ID NO: 3069634 - RNA, 21 nt, Mycobacterium bovis subsp bovis AF2122/97
gcuccacuuggggcgccaggg

SEQ ID NO: 3069635 - RNA, 19 nt, Mycobacterium bovis subsp bovis AF2122/97
gcuccagcaaaacccgcuc

SEQ ID NO: 3069636 - RNA, 23 nt, Mycobacterium bovis subsp bovis AF2122/97
gcuccagcaaaacccgcuccacc

SEQ ID NO: 3069637 - RNA, 14 nt, Mycobacterium bovis subsp bovis AF2122/97
gcuccagcacccgc

SEQ ID NO: 3069638 - RNA, 20 nt, Mycobacterium bovis subsp bovis AF2122/97
gcuccagcacccgcgcgacg

SEQ ID NO: 3069639 - RNA, 15 nt, Mycobacterium bovis subsp bovis AF2122/97
gcuccagcgcgcgcc

SEQ ID NO: 3069640 - RNA, 16 nt, Mycobacterium bovis subsp bovis AF2122/97
gcuccagcgcgcgccg

SEQ ID NO: 3069641 - RNA, 14 nt, Mycobacterium bovis subsp bovis AF2122/97
gcuccagcucggcc

SEQ ID NO: 3069642 - RNA, 22 nt, Mycobacterium bovis subsp bovis AF2122/97
gcuccagcucggccagugccgg

SEQ ID NO: 3069643 - RNA, 15 nt, Mycobacterium bovis subsp bovis AF2122/97
gcuccagcucggcgg

SEQ ID NO: 3069644 - RNA, 17 nt, Mycobacterium bovis subsp bovis AF2122/97
gcuccagcucggcgggc

SEQ ID NO: 3069645 - RNA, 18 nt, Mycobacterium bovis subsp bovis AF2122/97
gcuccagcugagcggccg

SEQ ID NO: 3069646 - RNA, 19 nt, Mycobacterium bovis subsp bovis AF2122/97
gcuccagcugagcggccgg

SEQ ID NO: 3069647 - RNA, 21 nt, Mycobacterium bovis subsp bovis AF2122/97
gcuccagcugagcggccggca

SEQ ID NO: 3069648 - RNA, 13 nt, Mycobacterium bovis subsp bovis AF2122/97
gcuccaggcgcgc

SEQ ID NO: 3069649 - RNA, 15 nt, Mycobacterium bovis subsp bovis AF2122/97
gcuccaggcgcgccg

SEQ ID NO: 3069650 - RNA, 19 nt, Mycobacterium bovis subsp bovis AF2122/97
gcuccaggcgcgccgcacc

SEQ ID NO: 3069651 - RNA, 18 nt, Mycobacterium bovis subsp bovis AF2122/97
gcuccaguggcgccaggg

SEQ ID NO: 3069652 - RNA, 12 nt, Mycobacterium bovis subsp bovis AF2122/97
gcucccacggca

SEQ ID NO: 3069653 - RNA, 15 nt, Mycobacterium bovis subsp bovis AF2122/97
gcucccacggcaccc

SEQ ID NO: 3069654 - RNA, 20 nt, Mycobacterium bovis subsp bovis AF2122/97
gcuccccagcgaaucacccg

SEQ ID NO: 3069655 - RNA, 16 nt, Mycobacterium bovis subsp bovis AF2122/97
gcucccccgcuacgcg

SEQ ID NO: 3069656 - RNA, 21 nt, Mycobacterium bovis subsp bovis AF2122/97
gcucccccgcuacgcgcgcuc

SEQ ID NO: 3069657 - RNA, 19 nt, Mycobacterium bovis subsp bovis AF2122/97
gcuccccggauuccucguc

SEQ ID NO: 3069658 - RNA, 20 nt, Mycobacterium bovis subsp bovis AF2122/97
gcucccgccacgucgccggc

SEQ ID NO: 3069659 - RNA, 15 nt, Mycobacterium bovis subsp bovis AF2122/97
gcucccggccgccga

SEQ ID NO: 3069660 - RNA, 18 nt, Mycobacterium bovis subsp bovis AF2122/97
gcucccgggcggcggccu

SEQ ID NO: 3069661 - RNA, 21 nt, Mycobacterium bovis subsp bovis AF2122/97
gcucccgguugggguggcggu

SEQ ID NO: 3069662 - RNA, 22 nt, Mycobacterium bovis subsp bovis AF2122/97
gcucccgguugggguggcggug

SEQ ID NO: 3069663 - RNA, 23 nt, Mycobacterium bovis subsp bovis AF2122/97
gcucccgguugggguggcggugc

SEQ ID NO: 3069664 - RNA, 17 nt, Mycobacterium bovis subsp bovis AF2122/97
gcucccgugcuggcgcc

SEQ ID NO: 3069665 - RNA, 22 nt, Mycobacterium bovis subsp bovis AF2122/97
gcucccgugcuggcgccgaagu

SEQ ID NO: 3069666 - RNA, 17 nt, Mycobacterium bovis subsp bovis AF2122/97
gcucccuauugcugcgg

SEQ ID NO: 3069667 - RNA, 16 nt, Mycobacterium bovis subsp bovis AF2122/97
gcucccucuacacccg

SEQ ID NO: 3069668 - RNA, 16 nt, Mycobacterium bovis subsp bovis AF2122/97
gcucccugggcgucga

SEQ ID NO: 3069669 - RNA, 18 nt, Mycobacterium bovis subsp bovis AF2122/97
gcuccgaacauggccagc

SEQ ID NO: 3069670 - RNA, 16 nt, Mycobacterium bovis subsp bovis AF2122/97
gcuccgaaguccacgc

SEQ ID NO: 3069671 - RNA, 19 nt, Mycobacterium bovis subsp bovis AF2122/97
gcuccgaaguccacgcacc

SEQ ID NO: 3069672 - RNA, 21 nt, Mycobacterium bovis subsp bovis AF2122/97
gcuccgaugcaucggugcagc

SEQ ID NO: 3069673 - RNA, 15 nt, Mycobacterium bovis subsp bovis AF2122/97
gcuccgaugugccga

SEQ ID NO: 3069674 - RNA, 17 nt, Mycobacterium bovis subsp bovis AF2122/97
gcuccgaugugccgauu

SEQ ID NO: 3069675 - RNA, 15 nt, Mycobacterium bovis subsp bovis AF2122/97
gcuccgauuccgaac

SEQ ID NO: 3069676 - RNA, 18 nt, Mycobacterium bovis subsp bovis AF2122/97
gcucgacgcccgccaccg

SEQ ID NO: 3069677 - RNA, 17 nt, Mycobacterium bovis subsp bovis AF2122/97
gcucgacggcccgccgu

SEQ ID NO: 3069678 - RNA, 19 nt, Mycobacterium bovis subsp bovis AF2122/97
gcucgacggcuccgauucc

SEQ ID NO: 3069679 - RNA, 19 nt, Mycobacterium bovis subsp bovis AF2122/97
gcucgacguauuggcgcag

SEQ ID NO: 3069680 - RNA, 20 nt, Mycobacterium bovis subsp bovis AF2122/97
gcucgacguauuggcgcagc

SEQ ID NO: 3069681 - RNA, 15 nt, Mycobacterium bovis subsp bovis AF2122/97
gcucgacugccaccg

SEQ ID NO: 3069682 - RNA, 16 nt, Mycobacterium bovis subsp bovis AF2122/97
gcucgagagcaugguc

SEQ ID NO: 3069683 - RNA, 20 nt, Mycobacterium bovis subsp bovis AF2122/97
gcucgagagcaugguccagc

SEQ ID NO: 3069684 - RNA, 19 nt, Mycobacterium bovis subsp bovis AF2122/97
gcucgagcaagaucaccuu

SEQ ID NO: 3069685 - RNA, 15 nt, Mycobacterium bovis subsp bovis AF2122/97
gcucgagcagcgcgc

SEQ ID NO: 3069686 - RNA, 16 nt, Mycobacterium bovis subsp bovis AF2122/97
gcucgagcagcgcgcc

SEQ ID NO: 3069687 - RNA, 13 nt, Mycobacterium bovis subsp bovis AF2122/97
gcucgagccgccc

SEQ ID NO: 3069688 - RNA, 15 nt, Mycobacterium bovis subsp bovis AF2122/97
gcucgagcgguggcg

SEQ ID NO: 3069689 - RNA, 21 nt, Mycobacterium bovis subsp bovis AF2122/97
gcucgagcuacgacgaguggu

SEQ ID NO: 3069690 - RNA, 15 nt, Mycobacterium bovis subsp bovis AF2122/97
gcucgagcucggcga

SEQ ID NO: 3069691 - RNA, 13 nt, Mycobacterium bovis subsp bovis AF2122/97
gcucgaggaccac

SEQ ID NO: 3069692 - RNA, 15 nt, Mycobacterium bovis subsp bovis AF2122/97
gcucgaggaccaccu

SEQ ID NO: 3069693 - RNA, 21 nt, Mycobacterium bovis subsp bovis AF2122/97
gcucgaggaccaccuggucgc

SEQ ID NO: 3069694 - RNA, 19 nt, Mycobacterium bovis subsp bovis AF2122/97
gcucgaggcccgggugcua

SEQ ID NO: 3069695 - RNA, 17 nt, Mycobacterium bovis subsp bovis AF2122/97
gcucgagucgcagcacg

SEQ ID NO: 3069696 - RNA, 15 nt, Mycobacterium bovis subsp bovis AF2122/97
gcucgauacggcccu

SEQ ID NO: 3069697 - RNA, 21 nt, Mycobacterium bovis subsp bovis AF2122/97
gcucgauaucguuggcgacca

SEQ ID NO: 3069698 - RNA, 22 nt, Mycobacterium bovis subsp bovis AF2122/97
gcucgauaucguuggcgaccac

SEQ ID NO: 3069699 - RNA, 24 nt, Mycobacterium bovis subsp bovis AF2122/97
gcucgauaucguuggcgaccaccg

SEQ ID NO: 3069700 - RNA, 16 nt, Mycobacterium bovis subsp bovis AF2122/97
gcucgaucacggcggg

SEQ ID NO: 3069701 - RNA, 14 nt, Mycobacterium bovis subsp bovis AF2122/97
gcucgaucagccgg

SEQ ID NO: 3069702 - RNA, 15 nt, Mycobacterium bovis subsp bovis AF2122/97
gcucgaucagccggg

SEQ ID NO: 3069703 - RNA, 19 nt, Mycobacterium bovis subsp bovis AF2122/97
gcucgauccacugccgcgc

SEQ ID NO: 3069704 - RNA, 22 nt, Mycobacterium bovis subsp bovis AF2122/97
gcucgauccgcaacaacgccgc

SEQ ID NO: 3069705 - RNA, 22 nt, Mycobacterium bovis subsp bovis AF2122/97
gcucgaucgcguucugcaccag

SEQ ID NO: 3069706 - RNA, 20 nt, Mycobacterium bovis subsp bovis AF2122/97
gcucgaucggcagccagggc

SEQ ID NO: 3069707 - RNA, 16 nt, Mycobacterium bovis subsp bovis AF2122/97
gcucgaucugucgcgc

SEQ ID NO: 3069708 - RNA, 18 nt, Mycobacterium bovis subsp bovis AF2122/97
gcucgaucugucgcgccg

SEQ ID NO: 3069709 - RNA, 23 nt, Mycobacterium bovis subsp bovis AF2122/97
gcucgaucugucgcgccgguggu

SEQ ID NO: 3069710 - RNA, 15 nt, Mycobacterium bovis subsp bovis AF2122/97
gcucgaugcgacgaa

SEQ ID NO: 3069711 - RNA, 20 nt, Mycobacterium bovis subsp bovis AF2122/97
gcucgaugcgaucgacgauc

SEQ ID NO: 3069712 - RNA, 14 nt, Mycobacterium bovis subsp bovis AF2122/97
gcucgauggcggcc

SEQ ID NO: 3069713 - RNA, 15 nt, Mycobacterium bovis subsp bovis AF2122/97
gcucgauggcggcca

SEQ ID NO: 3069714 - RNA, 17 nt, Mycobacterium bovis subsp bovis AF2122/97
gcucgauggcggccacc

SEQ ID NO: 3069715 - RNA, 18 nt, Mycobacterium bovis subsp bovis AF2122/97
gcucgauggcggccacca

SEQ ID NO: 3069716 - RNA, 23 nt, Mycobacterium bovis subsp bovis AF2122/97
gcucgauggcggccaccagcgcc

SEQ ID NO: 3069717 - RNA, 23 nt, Mycobacterium bovis subsp bovis AF2122/97
gcucgaugguguuauuccacucg

SEQ ID NO: 3069718 - RNA, 17 nt, Mycobacterium bovis subsp bovis AF2122/97
gcucgaugucagcggcc

SEQ ID NO: 3069719 - RNA, 18 nt, Mycobacterium bovis subsp bovis AF2122/97
gcucgaugucagcggccg

SEQ ID NO: 3069720 - RNA, 23 nt, Mycobacterium bovis subsp bovis AF2122/97
gcucgaugucagcggccgcgacg

SEQ ID NO: 3069721 - RNA, 14 nt, Mycobacterium bovis subsp bovis AF2122/97
gcucgaugucccga

SEQ ID NO: 3069722 - RNA, 15 nt, Mycobacterium bovis subsp bovis AF2122/97
gcucgcaaucguugg

SEQ ID NO: 3069723 - RNA, 15 nt, Mycobacterium bovis subsp bovis AF2122/97
gcucgcacagcacca

SEQ ID NO: 3069724 - RNA, 13 nt, Mycobacterium bovis subsp bovis AF2122/97
gcucgcaccacca

SEQ ID NO: 3069725 - RNA, 17 nt, Mycobacterium bovis subsp bovis AF2122/97
gcucgcacccgcucggc

SEQ ID NO: 3069726 - RNA, 18 nt, Mycobacterium bovis subsp bovis AF2122/97
gcucgcacccgcucggcg

SEQ ID NO: 3069727 - RNA, 20 nt, Mycobacterium bovis subsp bovis AF2122/97
gcucgcacccgcucggcgcg

SEQ ID NO: 3069728 - RNA, 21 nt, Mycobacterium bovis subsp bovis AF2122/97
gcucgcacccgcucggcgcgc

SEQ ID NO: 3069729 - RNA, 23 nt, Mycobacterium bovis subsp bovis AF2122/97
gcucgcacccgcucggcgcgcgg

SEQ ID NO: 3069730 - RNA, 17 nt, Mycobacterium bovis subsp bovis AF2122/97
gcucgcacucguugccg

SEQ ID NO: 3069731 - RNA, 21 nt, Mycobacterium bovis subsp bovis AF2122/97
gcucgcacucguugccgacca

SEQ ID NO: 3069732 - RNA, 14 nt, Mycobacterium bovis subsp bovis AF2122/97
gcucgcagcgggcg

SEQ ID NO: 3069733 - RNA, 13 nt, Mycobacterium bovis subsp bovis AF2122/97
gcucgcaggccgg

SEQ ID NO: 3069734 - RNA, 15 nt, Mycobacterium bovis subsp bovis AF2122/97
gcucgcaggccggcg

SEQ ID NO: 3069735 - RNA, 17 nt, Mycobacterium bovis subsp bovis AF2122/97
gcucgcaggccggcggc

SEQ ID NO: 3069736 - RNA, 20 nt, Mycobacterium bovis subsp bovis AF2122/97
gcucgcaggccggcggcggu

SEQ ID NO: 3069737 - RNA, 23 nt, Mycobacterium bovis subsp bovis AF2122/97
gcucgcauguucuccacgccgau

SEQ ID NO: 3069738 - RNA, 12 nt, Mycobacterium bovis subsp bovis AF2122/97
gcucgcauucgg

SEQ ID NO: 3069739 - RNA, 14 nt, Mycobacterium bovis subsp bovis AF2122/97
gcucgcauucggcg

SEQ ID NO: 3069740 - RNA, 19 nt, Mycobacterium bovis subsp bovis AF2122/97
gcucgcauucggcgagccg

SEQ ID NO: 3069741 - RNA, 22 nt, Mycobacterium bovis subsp bovis AF2122/97
gcucgccaaacccaugucggcg

SEQ ID NO: 3069742 - RNA, 13 nt, Mycobacterium bovis subsp bovis AF2122/97
gcucgccagccgg

SEQ ID NO: 3069743 - RNA, 19 nt, Mycobacterium bovis subsp bovis AF2122/97
gcucgccagccggccucag

SEQ ID NO: 3069744 - RNA, 14 nt, Mycobacterium bovis subsp bovis AF2122/97
gcucgccagcgggg

SEQ ID NO: 3069745 - RNA, 13 nt, Mycobacterium bovis subsp bovis AF2122/97
gcucgccaggcaa

SEQ ID NO: 3069746 - RNA, 21 nt, Mycobacterium bovis subsp bovis AF2122/97
gcucgccaggcaagccagcac

SEQ ID NO: 3069747 - RNA, 16 nt, Mycobacterium bovis subsp bovis AF2122/97
gcucgccaggccuagg

SEQ ID NO: 3069748 - RNA, 17 nt, Mycobacterium bovis subsp bovis AF2122/97
gcucgccaggccuaggc

SEQ ID NO: 3069749 - RNA, 15 nt, Mycobacterium bovis subsp bovis AF2122/97
gcucgccaguucgcg

SEQ ID NO: 3069750 - RNA, 14 nt, Mycobacterium bovis subsp bovis AF2122/97
gcucgcccagugaa

SEQ ID NO: 3069751 - RNA, 15 nt, Mycobacterium bovis subsp bovis AF2122/97
gcucgccccauguca

SEQ ID NO: 3069752 - RNA, 13 nt, Mycobacterium bovis subsp bovis AF2122/97
gcucgcccgccgc

SEQ ID NO: 3069753 - RNA, 14 nt, Mycobacterium bovis subsp bovis AF2122/97
gcucgcccgccgcc

SEQ ID NO: 3069754 - RNA, 15 nt, Mycobacterium bovis subsp bovis AF2122/97
gcucgcccgccgcca

SEQ ID NO: 3069755 - RNA, 18 nt, Mycobacterium bovis subsp bovis AF2122/97
gcucgcccgccgccacca

SEQ ID NO: 3069756 - RNA, 19 nt, Mycobacterium bovis subsp bovis AF2122/97
gcucgcccgccgccaccag

SEQ ID NO: 3069757 - RNA, 21 nt, Mycobacterium bovis subsp bovis AF2122/97
gcucgcccgcuacggcagccc

SEQ ID NO: 3069758 - RNA, 22 nt, Mycobacterium bovis subsp bovis AF2122/97
gcucgcccuaaccuaggcgcuc

SEQ ID NO: 3069759 - RNA, 14 nt, Mycobacterium bovis subsp bovis AF2122/97
gcucgccgaccagc

SEQ ID NO: 3069760 - RNA, 16 nt, Mycobacterium bovis subsp bovis AF2122/97
gcucgccgaccagcuu

SEQ ID NO: 3069761 - RNA, 12 nt, Mycobacterium bovis subsp bovis AF2122/97
gcucgccgaccc

SEQ ID NO: 3069762 - RNA, 15 nt, Mycobacterium bovis subsp bovis AF2122/97
gcucgccgacccgcc

SEQ ID NO: 3069763 - RNA, 23 nt, Mycobacterium bovis subsp bovis AF2122/97
gcucggaaaccgccccgugggcc

SEQ ID NO: 3069764 - RNA, 15 nt, Mycobacterium bovis subsp bovis AF2122/97
gcucggagaucgcca

SEQ ID NO: 3069765 - RNA, 17 nt, Mycobacterium bovis subsp bovis AF2122/97
gcucggagaugagcagc

SEQ ID NO: 3069766 - RNA, 13 nt, Mycobacterium bovis subsp bovis AF2122/97
gcucggauccggc

SEQ ID NO: 3069767 - RNA, 16 nt, Mycobacterium bovis subsp bovis AF2122/97
gcucggaucggcucgc

SEQ ID NO: 3069768 - RNA, 18 nt, Mycobacterium bovis subsp bovis AF2122/97
gcucggaucggcucgcca

SEQ ID NO: 3069769 - RNA, 13 nt, Mycobacterium bovis subsp bovis AF2122/97
gcucggaucgguu

SEQ ID NO: 3069770 - RNA, 17 nt, Mycobacterium bovis subsp bovis AF2122/97
gcucggcacccgccgga

SEQ ID NO: 3069771 - RNA, 12 nt, Mycobacterium bovis subsp bovis AF2122/97
gcucggcaggcc

SEQ ID NO: 3069772 - RNA, 13 nt, Mycobacterium bovis subsp bovis AF2122/97
gcucggcaggccc

SEQ ID NO: 3069773 - RNA, 20 nt, Mycobacterium bovis subsp bovis AF2122/97
gcucggcaucgagcagcccg

SEQ ID NO: 3069774 - RNA, 21 nt, Mycobacterium bovis subsp bovis AF2122/97
gcucggcaucgagcagcccgg

SEQ ID NO: 3069775 - RNA, 16 nt, Mycobacterium bovis subsp bovis AF2122/97
gcucggcaucggaagu

SEQ ID NO: 3069776 - RNA, 13 nt, Mycobacterium bovis subsp bovis AF2122/97
gcucggccaccag

SEQ ID NO: 3069777 - RNA, 15 nt, Mycobacterium bovis subsp bovis AF2122/97
gcucggccaccagcg

SEQ ID NO: 3069778 - RNA, 17 nt, Mycobacterium bovis subsp bovis AF2122/97
gcucggccaccagcgcc

SEQ ID NO: 3069779 - RNA, 19 nt, Mycobacterium bovis subsp bovis AF2122/97
gcucggccagaaagaucgg

SEQ ID NO: 3069780 - RNA, 12 nt, Mycobacterium bovis subsp bovis AF2122/97
gcucggccagca

SEQ ID NO: 3069781 - RNA, 15 nt, Mycobacterium bovis subsp bovis AF2122/97
gcucggccagcacgc

SEQ ID NO: 3069782 - RNA, 19 nt, Mycobacterium bovis subsp bovis AF2122/97
gcucggccagcacgccgcc

SEQ ID NO: 3069783 - RNA, 20 nt, Mycobacterium bovis subsp bovis AF2122/97
gcucggccagcacgccgccg

SEQ ID NO: 3069784 - RNA, 15 nt, Mycobacterium bovis subsp bovis AF2122/97
gcucggccaggcugg

SEQ ID NO: 3069785 - RNA, 18 nt, Mycobacterium bovis subsp bovis AF2122/97
gcucggccaggcuggcca

SEQ ID NO: 3069786 - RNA, 20 nt, Mycobacterium bovis subsp bovis AF2122/97
gcucggccauagcgccgcgc

SEQ ID NO: 3069787 - RNA, 22 nt, Mycobacterium bovis subsp bovis AF2122/97
gcucggccauagcgccgcgccc

SEQ ID NO: 3069788 - RNA, 12 nt, Mycobacterium bovis subsp bovis AF2122/97
gcucggcccagc

SEQ ID NO: 3069789 - RNA, 13 nt, Mycobacterium bovis subsp bovis AF2122/97
gcucggcccagcg

SEQ ID NO: 3069790 - RNA, 20 nt, Mycobacterium bovis subsp bovis AF2122/97
gcucggcccagcgcgccagc

SEQ ID NO: 3069791 - RNA, 13 nt, Mycobacterium bovis subsp bovis AF2122/97
gcucggcccccga

SEQ ID NO: 3069792 - RNA, 17 nt, Mycobacterium bovis subsp bovis AF2122/97
gcucggccccgccgccg

SEQ ID NO: 3069793 - RNA, 15 nt, Mycobacterium bovis subsp bovis AF2122/97
gcucggccgaggcgg

SEQ ID NO: 3069794 - RNA, 16 nt, Mycobacterium bovis subsp bovis AF2122/97
gcucggccgcagccag

SEQ ID NO: 3069795 - RNA, 13 nt, Mycobacterium bovis subsp bovis AF2122/97
gcucggccgccgg

SEQ ID NO: 3069796 - RNA, 22 nt, Mycobacterium bovis subsp bovis AF2122/97
gcucggccgucaggguguugcg

SEQ ID NO: 3069797 - RNA, 17 nt, Mycobacterium bovis subsp bovis AF2122/97
gcucggccuguucggcg

SEQ ID NO: 3069798 - RNA, 17 nt, Mycobacterium bovis subsp bovis AF2122/97
gcucggcgaaacccggg

SEQ ID NO: 3069799 - RNA, 11 nt, Mycobacterium bovis subsp bovis AF2122/97
gcucggcgaag

SEQ ID NO: 3069800 - RNA, 18 nt, Mycobacterium bovis subsp bovis AF2122/97
gcucggcgaaggccgcgc

SEQ ID NO: 3069801 - RNA, 16 nt, Mycobacterium bovis subsp bovis AF2122/97
gcucggcgaccgucgg

SEQ ID NO: 3069802 - RNA, 21 nt, Mycobacterium bovis subsp bovis AF2122/97
gcucggcgaccgucgggguca

SEQ ID NO: 3069803 - RNA, 14 nt, Mycobacterium bovis subsp bovis AF2122/97
gcucggcgagcuca

SEQ ID NO: 3069804 - RNA, 14 nt, Mycobacterium bovis subsp bovis AF2122/97
gcucggcgaguucg

SEQ ID NO: 3069805 - RNA, 20 nt, Mycobacterium bovis subsp bovis AF2122/97
gcucggcgaucugcguuugg

SEQ ID NO: 3069806 - RNA, 20 nt, Mycobacterium bovis subsp bovis AF2122/97
gcucggcgaugcugagccgg

SEQ ID NO: 3069807 - RNA, 12 nt, Mycobacterium bovis subsp bovis AF2122/97
gcucggcgcagc

SEQ ID NO: 3069808 - RNA, 14 nt, Mycobacterium bovis subsp bovis AF2122/97
gcucggcgcagcua

SEQ ID NO: 3069809 - RNA, 20 nt, Mycobacterium bovis subsp bovis AF2122/97
gcucggcgcagcuaacccgc

SEQ ID NO: 3069810 - RNA, 23 nt, Mycobacterium bovis subsp bovis AF2122/97
gcucggcgcagcuaacccgccac

SEQ ID NO: 3069811 - RNA, 21 nt, Mycobacterium bovis subsp bovis AF2122/97
gcucggcgccacggugucgcg

SEQ ID NO: 3069812 - RNA, 23 nt, Mycobacterium bovis subsp bovis AF2122/97
gcucggcgccacggugucgcgau

SEQ ID NO: 3069813 - RNA, 15 nt, Mycobacterium bovis subsp bovis AF2122/97
gcucggcgcccagcu

SEQ ID NO: 3069814 - RNA, 12 nt, Mycobacterium bovis subsp bovis AF2122/97
gcucggcgccgu

SEQ ID NO: 3069815 - RNA, 16 nt, Mycobacterium bovis subsp bovis AF2122/97
gcucggcgcgccgguc

SEQ ID NO: 3069816 - RNA, 14 nt, Mycobacterium bovis subsp bovis AF2122/97
gcucggcgcggugg

SEQ ID NO: 3069817 - RNA, 16 nt, Mycobacterium bovis subsp bovis AF2122/97
gcucggcggcccggcc

SEQ ID NO: 3069818 - RNA, 18 nt, Mycobacterium bovis subsp bovis AF2122/97
gcucggcggcccggccga

SEQ ID NO: 3069819 - RNA, 19 nt, Mycobacterium bovis subsp bovis AF2122/97
gcucggcggcccggccgaa

SEQ ID NO: 3069820 - RNA, 15 nt, Mycobacterium bovis subsp bovis AF2122/97
gcucggcgggcucgu

SEQ ID NO: 3069821 - RNA, 23 nt, Mycobacterium bovis subsp bovis AF2122/97
gcucggcgggggaccccgccagc

SEQ ID NO: 3069822 - RNA, 15 nt, Mycobacterium bovis subsp bovis AF2122/97
gcucggcggucggga

SEQ ID NO: 3069823 - RNA, 13 nt, Mycobacterium bovis subsp bovis AF2122/97
gcucggcggugcc

SEQ ID NO: 3069824 - RNA, 18 nt, Mycobacterium bovis subsp bovis AF2122/97
gcucggcguccgcccagc

SEQ ID NO: 3069825 - RNA, 19 nt, Mycobacterium bovis subsp bovis AF2122/97
gcucggcguccgcccagca

SEQ ID NO: 3069826 - RNA, 20 nt, Mycobacterium bovis subsp bovis AF2122/97
gcucggcguccgcccagcac

SEQ ID NO: 3069827 - RNA, 21 nt, Mycobacterium bovis subsp bovis AF2122/97
gcucggcguccgcccagcacc

SEQ ID NO: 3069828 - RNA, 19 nt, Mycobacterium bovis subsp bovis AF2122/97
gcucggcgucgccgccauu

SEQ ID NO: 3069829 - RNA, 19 nt, Mycobacterium bovis subsp bovis AF2122/97
gcucggcuauggguucgcg

SEQ ID NO: 3069830 - RNA, 23 nt, Mycobacterium bovis subsp bovis AF2122/97
gcucggcuucccuaggcuccaac

SEQ ID NO: 3069831 - RNA, 14 nt, Mycobacterium bovis subsp bovis AF2122/97
gcucgggcaaccgg

SEQ ID NO: 3069832 - RNA, 18 nt, Mycobacterium bovis subsp bovis AF2122/97
gcucgggcaaggccaccg

SEQ ID NO: 3069833 - RNA, 19 nt, Mycobacterium bovis subsp bovis AF2122/97
gcucgggcaaggccaccgg

SEQ ID NO: 3069834 - RNA, 17 nt, Mycobacterium bovis subsp bovis AF2122/97
gcucgggccgcacuuuc

SEQ ID NO: 3069835 - RNA, 15 nt, Mycobacterium bovis subsp bovis AF2122/97
gcucgggcgcacggu

SEQ ID NO: 3069836 - RNA, 21 nt, Mycobacterium bovis subsp bovis AF2122/97
gcucgggcgcgaggacgcuga

SEQ ID NO: 3069837 - RNA, 18 nt, Mycobacterium bovis subsp bovis AF2122/97
gcucgggcgugaucccgc

SEQ ID NO: 3069838 - RNA, 15 nt, Mycobacterium bovis subsp bovis AF2122/97
gcucgggggccgacc

SEQ ID NO: 3069839 - RNA, 15 nt, Mycobacterium bovis subsp bovis AF2122/97
gcucgggggcgccgg

SEQ ID NO: 3069840 - RNA, 16 nt, Mycobacterium bovis subsp bovis AF2122/97
gcucgggggcgccggc

SEQ ID NO: 3069841 - RNA, 17 nt, Mycobacterium bovis subsp bovis AF2122/97
gcucgggggcgccggcg

SEQ ID NO: 3069842 - RNA, 18 nt, Mycobacterium bovis subsp bovis AF2122/97
gcucgggggcgccggcgc

SEQ ID NO: 3069843 - RNA, 15 nt, Mycobacterium bovis subsp bovis AF2122/97
gcucggggugcagag

SEQ ID NO: 3069844 - RNA, 20 nt, Mycobacterium bovis subsp bovis AF2122/97
gcucgggguugcucgcgauc

SEQ ID NO: 3069845 - RNA, 22 nt, Mycobacterium bovis subsp bovis AF2122/97
gcucgggguugcucgcgaucgc

SEQ ID NO: 3069846 - RNA, 15 nt, Mycobacterium bovis subsp bovis AF2122/97
gcucgggucaucuug

SEQ ID NO: 3069847 - RNA, 16 nt, Mycobacterium bovis subsp bovis AF2122/97
gcucgggucgugcgug

SEQ ID NO: 3069848 - RNA, 16 nt, Mycobacterium bovis subsp bovis AF2122/97
gcucggguggccagcg

SEQ ID NO: 3069849 - RNA, 23 nt, Mycobacterium bovis subsp bovis AF2122/97
gcucgggugguuugcgaacgaau

SEQ ID NO: 3069850 - RNA, 16 nt, Mycobacterium bovis subsp bovis AF2122/97
gcucucggucaguucc

SEQ ID NO: 3069851 - RNA, 21 nt, Mycobacterium bovis subsp bovis AF2122/97
gcucucggucaguuccucuac

SEQ ID NO: 3069852 - RNA, 18 nt, Mycobacterium bovis subsp bovis AF2122/97
gcucucggucugcaugcg

SEQ ID NO: 3069853 - RNA, 18 nt, Mycobacterium bovis subsp bovis AF2122/97
gcucucguggauggccgc

SEQ ID NO: 3069854 - RNA, 14 nt, Mycobacterium bovis subsp bovis AF2122/97
gcucucguguaucg

SEQ ID NO: 3069855 - RNA, 20 nt, Mycobacterium bovis subsp bovis AF2122/97
gcucucuucgcgcgcugggc

SEQ ID NO: 3069856 - RNA, 21 nt, Mycobacterium bovis subsp bovis AF2122/97
gcucucuucgcgcgcugggcg

SEQ ID NO: 3069857 - RNA, 18 nt, Mycobacterium bovis subsp bovis AF2122/97
gcucugaggucaccggcg

SEQ ID NO: 3069858 - RNA, 22 nt, Mycobacterium bovis subsp bovis AF2122/97
gcucugaugguguacacgucgc

SEQ ID NO: 3069859 - RNA, 14 nt, Mycobacterium bovis subsp bovis AF2122/97
gcucugcgccacag

SEQ ID NO: 3069860 - RNA, 15 nt, Mycobacterium bovis subsp bovis AF2122/97
gcucugcggccacgc

SEQ ID NO: 3069861 - RNA, 22 nt, Mycobacterium bovis subsp bovis AF2122/97
gcucugcggccacgccgaugcg

SEQ ID NO: 3069862 - RNA, 17 nt, Mycobacterium bovis subsp bovis AF2122/97
gcucuggacggucaucc

SEQ ID NO: 3069863 - RNA, 15 nt, Mycobacterium bovis subsp bovis AF2122/97
gcucuguagcgucgc

SEQ ID NO: 3069864 - RNA, 17 nt, Mycobacterium bovis subsp bovis AF2122/97
gcucugugucgccgauc

SEQ ID NO: 3069865 - RNA, 14 nt, Mycobacterium bovis subsp bovis AF2122/97
gcucuucgcagcgg

SEQ ID NO: 3069866 - RNA, 14 nt, Mycobacterium bovis subsp bovis AF2122/97
gcucuucggcacca

SEQ ID NO: 3069867 - RNA, 22 nt, Mycobacterium bovis subsp bovis AF2122/97
gcucuugcgggcagccgcccgc

SEQ ID NO: 3069868 - RNA, 17 nt, Mycobacterium bovis subsp bovis AF2122/97
gcugaaaauaggccggg

SEQ ID NO: 3069869 - RNA, 14 nt, Mycobacterium bovis subsp bovis AF2122/97
gcugaaaucggugg

SEQ ID NO: 3069870 - RNA, 18 nt, Mycobacterium bovis subsp bovis AF2122/97
gcugaaaucgguggccac

SEQ ID NO: 3069871 - RNA, 22 nt, Mycobacterium bovis subsp bovis AF2122/97
gcugaaaucgguggccaccacc

SEQ ID NO: 3069872 - RNA, 12 nt, Mycobacterium bovis subsp bovis AF2122/97
gcugaacaccgc

SEQ ID NO: 3069873 - RNA, 16 nt, Mycobacterium bovis subsp bovis AF2122/97
gcugaacaccgcgggc

SEQ ID NO: 3069874 - RNA, 18 nt, Mycobacterium bovis subsp bovis AF2122/97
gcugaacaccgcgggcag

SEQ ID NO: 3069875 - RNA, 19 nt, Mycobacterium bovis subsp bovis AF2122/97
gcugaacaccgcgggcagu

SEQ ID NO: 3069876 - RNA, 15 nt, Mycobacterium bovis subsp bovis AF2122/97
gcugaacacgaaucc

SEQ ID NO: 3069877 - RNA, 17 nt, Mycobacterium bovis subsp bovis AF2122/97
gcugaacacgcagccga

SEQ ID NO: 3069878 - RNA, 23 nt, Mycobacterium bovis subsp bovis AF2122/97
gcugaacagacggcucagcgugc

SEQ ID NO: 3069879 - RNA, 13 nt, Mycobacterium bovis subsp bovis AF2122/97
gcugaacgcgagc

SEQ ID NO: 3069880 - RNA, 15 nt, Mycobacterium bovis subsp bovis AF2122/97
gcugaacggcagccg

SEQ ID NO: 3069881 - RNA, 19 nt, Mycobacterium bovis subsp bovis AF2122/97
gcugaacgggaugaauuca

SEQ ID NO: 3069882 - RNA, 14 nt, Mycobacterium bovis subsp bovis AF2122/97
gcugaacucaacgg

SEQ ID NO: 3069883 - RNA, 17 nt, Mycobacterium bovis subsp bovis AF2122/97
gcugaagaucaacaggc

SEQ ID NO: 3069884 - RNA, 19 nt, Mycobacterium bovis subsp bovis AF2122/97
gcugaagccgcuggaaguc

SEQ ID NO: 3069885 - RNA, 14 nt, Mycobacterium bovis subsp bovis AF2122/97
gcugaaggacggca

SEQ ID NO: 3069886 - RNA, 15 nt, Mycobacterium bovis subsp bovis AF2122/97
gcugaaggcccguug

SEQ ID NO: 3069887 - RNA, 22 nt, Mycobacterium bovis subsp bovis AF2122/97
gcugaaggcccguugucgaccg

SEQ ID NO: 3069888 - RNA, 21 nt, Mycobacterium bovis subsp bovis AF2122/97
gcugaaggccgguagcgcggg

SEQ ID NO: 3069889 - RNA, 22 nt, Mycobacterium bovis subsp bovis AF2122/97
gcugaaggccgguagcgcgggu

SEQ ID NO: 3069890 - RNA, 21 nt, Mycobacterium bovis subsp bovis AF2122/97
gcugaaguggcacaagcuggg

SEQ ID NO: 3069891 - RNA, 15 nt, Mycobacterium bovis subsp bovis AF2122/97
gcugaauucggcgag

SEQ ID NO: 3069892 - RNA, 17 nt, Mycobacterium bovis subsp bovis AF2122/97
gcugaauucggcgagcg

SEQ ID NO: 3069893 - RNA, 16 nt, Mycobacterium bovis subsp bovis AF2122/97
gcugaauuucgaugag

SEQ ID NO: 3069894 - RNA, 20 nt, Mycobacterium bovis subsp bovis AF2122/97
gcugacaccgaaccgccgcu

SEQ ID NO: 3069895 - RNA, 21 nt, Mycobacterium bovis subsp bovis AF2122/97
gcugacaccgauccggccgcc

SEQ ID NO: 3069896 - RNA, 14 nt, Mycobacterium bovis subsp bovis AF2122/97
gcugacacgacgaa

SEQ ID NO: 3069897 - RNA, 17 nt, Mycobacterium bovis subsp bovis AF2122/97
gcugacauuuccaccac

SEQ ID NO: 3069898 - RNA, 17 nt, Mycobacterium bovis subsp bovis AF2122/97
gcugaccaacggggcag

SEQ ID NO: 3069899 - RNA, 14 nt, Mycobacterium bovis subsp bovis AF2122/97
gcugaccaucacac

SEQ ID NO: 3069900 - RNA, 22 nt, Mycobacterium bovis subsp bovis AF2122/97
gcugaccaugaccgggcuggcc

SEQ ID NO: 3069901 - RNA, 14 nt, Mycobacterium bovis subsp bovis AF2122/97
gcugaccccgccgg

SEQ ID NO: 3069902 - RNA, 16 nt, Mycobacterium bovis subsp bovis AF2122/97
gcugaccccgccggcu

SEQ ID NO: 3069903 - RNA, 19 nt, Mycobacterium bovis subsp bovis AF2122/97
gcugaccccggcagcgccc

SEQ ID NO: 3069904 - RNA, 14 nt, Mycobacterium bovis subsp bovis AF2122/97
gcugaccgaagagc

SEQ ID NO: 3069905 - RNA, 19 nt, Mycobacterium bovis subsp bovis AF2122/97
gcugaccgaauggccgccg

SEQ ID NO: 3069906 - RNA, 21 nt, Mycobacterium bovis subsp bovis AF2122/97
gcugaccgacccggaccuggg

SEQ ID NO: 3069907 - RNA, 13 nt, Mycobacterium bovis subsp bovis AF2122/97
gcugaccgagcug

SEQ ID NO: 3069908 - RNA, 23 nt, Mycobacterium bovis subsp bovis AF2122/97
gcugaccgagcugauccgggugg

SEQ ID NO: 3069909 - RNA, 14 nt, Mycobacterium bovis subsp bovis AF2122/97
gcugaccgcaacgc

SEQ ID NO: 3069910 - RNA, 17 nt, Mycobacterium bovis subsp bovis AF2122/97
gcugaccgccagcggcc

SEQ ID NO: 3069911 - RNA, 21 nt, Mycobacterium bovis subsp bovis AF2122/97
gcugaccgcgccggacagcgc

SEQ ID NO: 3069912 - RNA, 20 nt, Mycobacterium bovis subsp bovis AF2122/97
gcugaccgcguagaccagug

SEQ ID NO: 3069913 - RNA, 22 nt, Mycobacterium bovis subsp bovis AF2122/97
gcugaccgcguagaccagugac

SEQ ID NO: 3069914 - RNA, 21 nt, Mycobacterium bovis subsp bovis AF2122/97
gcugaccgcuaccagcugggc

SEQ ID NO: 3069915 - RNA, 22 nt, Mycobacterium bovis subsp bovis AF2122/97
gcugaccgcuaccagcugggcg

SEQ ID NO: 3069916 - RNA, 20 nt, Mycobacterium bovis subsp bovis AF2122/97
gcugaccggaucugacggcg

SEQ ID NO: 3069917 - RNA, 23 nt, Mycobacterium bovis subsp bovis AF2122/97
gcugaccggaucugacggcgccg

SEQ ID NO: 3069918 - RNA, 19 nt, Mycobacterium bovis subsp bovis AF2122/97
gcugaccggggcgcccggc

SEQ ID NO: 3069919 - RNA, 21 nt, Mycobacterium bovis subsp bovis AF2122/97
gcugaccggggcgcccggcca

SEQ ID NO: 3069920 - RNA, 22 nt, Mycobacterium bovis subsp bovis AF2122/97
gcugaccggggcgcccggccag

SEQ ID NO: 3069921 - RNA, 16 nt, Mycobacterium bovis subsp bovis AF2122/97
gcugaccggggucggc

SEQ ID NO: 3069922 - RNA, 13 nt, Mycobacterium bovis subsp bovis AF2122/97
gcugaccguggcg

SEQ ID NO: 3069923 - RNA, 19 nt, Mycobacterium bovis subsp bovis AF2122/97
gcugaccguuucgaucucg

SEQ ID NO: 3069924 - RNA, 18 nt, Mycobacterium bovis subsp bovis AF2122/97
gcugaccucccacccccg

SEQ ID NO: 3069925 - RNA, 16 nt, Mycobacterium bovis subsp bovis AF2122/97
gcugaccugaaaaucc

SEQ ID NO: 3069926 - RNA, 23 nt, Mycobacterium bovis subsp bovis AF2122/97
gcugaccugggguguagccagcg

SEQ ID NO: 3069927 - RNA, 23 nt, Mycobacterium bovis subsp bovis AF2122/97
gcugaccuucaggcccugccgac

SEQ ID NO: 3069928 - RNA, 22 nt, Mycobacterium bovis subsp bovis AF2122/97
gcugaccuucucacgcaccaug

SEQ ID NO: 3069929 - RNA, 19 nt, Mycobacterium bovis subsp bovis AF2122/97
gcugaccuuguugaccacc

SEQ ID NO: 3069930 - RNA, 21 nt, Mycobacterium bovis subsp bovis AF2122/97
gcugacgaacgcugucgugcu

SEQ ID NO: 3069931 - RNA, 15 nt, Mycobacterium bovis subsp bovis AF2122/97
gcugacgaccaacca

SEQ ID NO: 3069932 - RNA, 20 nt, Mycobacterium bovis subsp bovis AF2122/97
gcugacgacgagggccagca

SEQ ID NO: 3069933 - RNA, 22 nt, Mycobacterium bovis subsp bovis AF2122/97
gcugacgacgagggccagcagc

SEQ ID NO: 3069934 - RNA, 14 nt, Mycobacterium bovis subsp bovis AF2122/97
gcugacgcccuccu

SEQ ID NO: 3069935 - RNA, 15 nt, Mycobacterium bovis subsp bovis AF2122/97
gcugacgcccuccug

SEQ ID NO: 3069936 - RNA, 22 nt, Mycobacterium bovis subsp bovis AF2122/97
gcugcaaccgacuucgauggug

SEQ ID NO: 3069937 - RNA, 18 nt, Mycobacterium bovis subsp bovis AF2122/97
gcugcaacgauugaacuc

SEQ ID NO: 3069938 - RNA, 15 nt, Mycobacterium bovis subsp bovis AF2122/97
gcugcaaugacugga

SEQ ID NO: 3069939 - RNA, 18 nt, Mycobacterium bovis subsp bovis AF2122/97
gcugcaccaagucguaau

SEQ ID NO: 3069940 - RNA, 14 nt, Mycobacterium bovis subsp bovis AF2122/97
gcugcaccagcugc

SEQ ID NO: 3069941 - RNA, 22 nt, Mycobacterium bovis subsp bovis AF2122/97
gcugcacccggagaaucggucc

SEQ ID NO: 3069942 - RNA, 21 nt, Mycobacterium bovis subsp bovis AF2122/97
gcugcaccgauucgggcuucu

SEQ ID NO: 3069943 - RNA, 14 nt, Mycobacterium bovis subsp bovis AF2122/97
gcugcaccggguca

SEQ ID NO: 3069944 - RNA, 22 nt, Mycobacterium bovis subsp bovis AF2122/97
gcugcaccguuuccggcgcucc

SEQ ID NO: 3069945 - RNA, 18 nt, Mycobacterium bovis subsp bovis AF2122/97
gcugcaccuccgacggcc

SEQ ID NO: 3069946 - RNA, 22 nt, Mycobacterium bovis subsp bovis AF2122/97
gcugcaccuccgacggccgcgg

SEQ ID NO: 3069947 - RNA, 16 nt, Mycobacterium bovis subsp bovis AF2122/97
gcugcaccuggcgcag

SEQ ID NO: 3069948 - RNA, 14 nt, Mycobacterium bovis subsp bovis AF2122/97
gcugcacgcucguu

SEQ ID NO: 3069949 - RNA, 13 nt, Mycobacterium bovis subsp bovis AF2122/97
gcugcacgcugcg

SEQ ID NO: 3069950 - RNA, 17 nt, Mycobacterium bovis subsp bovis AF2122/97
gcugcacggaaucgcau

SEQ ID NO: 3069951 - RNA, 14 nt, Mycobacterium bovis subsp bovis AF2122/97
gcugcacggccaug

SEQ ID NO: 3069952 - RNA, 15 nt, Mycobacterium bovis subsp bovis AF2122/97
gcugcacguggccac

SEQ ID NO: 3069953 - RNA, 16 nt, Mycobacterium bovis subsp bovis AF2122/97
gcugcacguggccacg

SEQ ID NO: 3069954 - RNA, 15 nt, Mycobacterium bovis subsp bovis AF2122/97
gcugcagaaaggcca

SEQ ID NO: 3069955 - RNA, 13 nt, Mycobacterium bovis subsp bovis AF2122/97
gcugcagacccgu

SEQ ID NO: 3069956 - RNA, 13 nt, Mycobacterium bovis subsp bovis AF2122/97
gcugcagaggcgc

SEQ ID NO: 3069957 - RNA, 14 nt, Mycobacterium bovis subsp bovis AF2122/97
gcugcagcaccgca

SEQ ID NO: 3069958 - RNA, 19 nt, Mycobacterium bovis subsp bovis AF2122/97
gcugcagcaccgcagcgac

SEQ ID NO: 3069959 - RNA, 14 nt, Mycobacterium bovis subsp bovis AF2122/97
gcugcagcacggcu

SEQ ID NO: 3069960 - RNA, 14 nt, Mycobacterium bovis subsp bovis AF2122/97
gcugcagcagaccc

SEQ ID NO: 3069961 - RNA, 20 nt, Mycobacterium bovis subsp bovis AF2122/97
gcugcagcagacccgguggc

SEQ ID NO: 3069962 - RNA, 14 nt, Mycobacterium bovis subsp bovis AF2122/97
gcugcagcagggcu

SEQ ID NO: 3069963 - RNA, 23 nt, Mycobacterium bovis subsp bovis AF2122/97
gcugcagcauggcuccgaagucc

SEQ ID NO: 3069964 - RNA, 14 nt, Mycobacterium bovis subsp bovis AF2122/97
gcugcaggcggccg

SEQ ID NO: 3069965 - RNA, 15 nt, Mycobacterium bovis subsp bovis AF2122/97
gcugcagggccuggc

SEQ ID NO: 3069966 - RNA, 16 nt, Mycobacterium bovis subsp bovis AF2122/97
gcugcagguccagggu

SEQ ID NO: 3069967 - RNA, 23 nt, Mycobacterium bovis subsp bovis AF2122/97
gcugcagguccaggguggucguc

SEQ ID NO: 3069968 - RNA, 18 nt, Mycobacterium bovis subsp bovis AF2122/97
gcugcagugacucgauca

SEQ ID NO: 3069969 - RNA, 17 nt, Mycobacterium bovis subsp bovis AF2122/97
gcugcauacaaccccgc

SEQ ID NO: 3069970 - RNA, 14 nt, Mycobacterium bovis subsp bovis AF2122/97
gcugcauccgcagc

SEQ ID NO: 3069971 - RNA, 19 nt, Mycobacterium bovis subsp bovis AF2122/97
gcugcauccgcagcaccaa

SEQ ID NO: 3069972 - RNA, 22 nt, Mycobacterium bovis subsp bovis AF2122/97
gcugcauccuccucgucgacgu

SEQ ID NO: 3069973 - RNA, 16 nt, Mycobacterium bovis subsp bovis AF2122/97
gcugcauguuaugggu

SEQ ID NO: 3069974 - RNA, 20 nt, Mycobacterium bovis subsp bovis AF2122/97
gcugccaaacuaacggcagc

SEQ ID NO: 3069975 - RNA, 22 nt, Mycobacterium bovis subsp bovis AF2122/97
gcugccaacgcccguguugaag

SEQ ID NO: 3069976 - RNA, 14 nt, Mycobacterium bovis subsp bovis AF2122/97
gcugccaacgggcc

SEQ ID NO: 3069977 - RNA, 17 nt, Mycobacterium bovis subsp bovis AF2122/97
gcugccacaggugaccu

SEQ ID NO: 3069978 - RNA, 20 nt, Mycobacterium bovis subsp bovis AF2122/97
gcugccaccagggccgcagu

SEQ ID NO: 3069979 - RNA, 14 nt, Mycobacterium bovis subsp bovis AF2122/97
gcugccacccaucg

SEQ ID NO: 3069980 - RNA, 16 nt, Mycobacterium bovis subsp bovis AF2122/97
gcugccaccgcggugg

SEQ ID NO: 3069981 - RNA, 21 nt, Mycobacterium bovis subsp bovis AF2122/97
gcugccaccgcgguggcggcg

SEQ ID NO: 3069982 - RNA, 11 nt, Mycobacterium bovis subsp bovis AF2122/97
gcugccaccgg

SEQ ID NO: 3069983 - RNA, 13 nt, Mycobacterium bovis subsp bovis AF2122/97
gcugccaccggcc

SEQ ID NO: 3069984 - RNA, 20 nt, Mycobacterium bovis subsp bovis AF2122/97
gcugccagaucggucggcca

SEQ ID NO: 3069985 - RNA, 18 nt, Mycobacterium bovis subsp bovis AF2122/97
gcugccagccauggccgc

SEQ ID NO: 3069986 - RNA, 17 nt, Mycobacterium bovis subsp bovis AF2122/97
gcugccagccgaagccg

SEQ ID NO: 3069987 - RNA, 15 nt, Mycobacterium bovis subsp bovis AF2122/97
gcugccagccguucc

SEQ ID NO: 3069988 - RNA, 16 nt, Mycobacterium bovis subsp bovis AF2122/97
gcugccagcgccgccg

SEQ ID NO: 3069989 - RNA, 12 nt, Mycobacterium bovis subsp bovis AF2122/97
gcugccagcggc

SEQ ID NO: 3069990 - RNA, 15 nt, Mycobacterium bovis subsp bovis AF2122/97
gcugccagcggccgg

SEQ ID NO: 3069991 - RNA, 17 nt, Mycobacterium bovis subsp bovis AF2122/97
gcugccagcggccgggc

SEQ ID NO: 3069992 - RNA, 17 nt, Mycobacterium bovis subsp bovis AF2122/97
gcugccagggugcgccg

SEQ ID NO: 3069993 - RNA, 19 nt, Mycobacterium bovis subsp bovis AF2122/97
gcugccagugccgcccacc

SEQ ID NO: 3069994 - RNA, 22 nt, Mycobacterium bovis subsp bovis AF2122/97
gcugccagugccgcccaccaca

SEQ ID NO: 3069995 - RNA, 18 nt, Mycobacterium bovis subsp bovis AF2122/97
gcugccaucccgaucccg

SEQ ID NO: 3069996 - RNA, 18 nt, Mycobacterium bovis subsp bovis AF2122/97
gcugccaucggcaccagc

SEQ ID NO: 3069997 - RNA, 19 nt, Mycobacterium bovis subsp bovis AF2122/97
gcugccaucggcaccagcg

SEQ ID NO: 3069998 - RNA, 15 nt, Mycobacterium bovis subsp bovis AF2122/97
gcugccauuccagau

SEQ ID NO: 3069999 - RNA, 17 nt, Mycobacterium bovis subsp bovis AF2122/97
gcugccauugccgaugg

SEQ ID NO: 3070000 - RNA, 12 nt, Mycobacterium bovis subsp bovis AF2122/97
gcugcccaaaag

SEQ ID NO: 3070001 - RNA, 14 nt, Mycobacterium bovis subsp bovis AF2122/97
gcugcccaaaagcg

SEQ ID NO: 3070002 - RNA, 18 nt, Mycobacterium bovis subsp bovis AF2122/97
gcugcccaaaagcgcggc

SEQ ID NO: 3070003 - RNA, 19 nt, Mycobacterium bovis subsp bovis AF2122/97
gcugcccaaaagcgcggca

SEQ ID NO: 3070004 - RNA, 20 nt, Mycobacterium bovis subsp bovis AF2122/97
gcugcccaaaaggaagaccu

SEQ ID NO: 3070005 - RNA, 21 nt, Mycobacterium bovis subsp bovis AF2122/97
gcugcccaaaaggaagaccuc

SEQ ID NO: 3070006 - RNA, 21 nt, Mycobacterium bovis subsp bovis AF2122/97
gcugcccaacggaagaccgcg

SEQ ID NO: 3070007 - RNA, 17 nt, Mycobacterium bovis subsp bovis AF2122/97
gcugcccacgggccggc

SEQ ID NO: 3070008 - RNA, 13 nt, Mycobacterium bovis subsp bovis AF2122/97
gcugcccagcguc

SEQ ID NO: 3070009 - RNA, 17 nt, Mycobacterium bovis subsp bovis AF2122/97
gcugcccaucacacccg

SEQ ID NO: 3070010 - RNA, 16 nt, Mycobacterium bovis subsp bovis AF2122/97
gcugcccaucccggcc

SEQ ID NO: 3070011 - RNA, 21 nt, Mycobacterium bovis subsp bovis AF2122/97
gcugcccaugcggcaggugcc

SEQ ID NO: 3070012 - RNA, 15 nt, Mycobacterium bovis subsp bovis AF2122/97
gcugccccccagaca

SEQ ID NO: 3070013 - RNA, 16 nt, Mycobacterium bovis subsp bovis AF2122/97
gcugccccgccaccuc

SEQ ID NO: 3070014 - RNA, 21 nt, Mycobacterium bovis subsp bovis AF2122/97
gcugccccgccaccucgccgg

SEQ ID NO: 3070015 - RNA, 23 nt, Mycobacterium bovis subsp bovis AF2122/97
gcugccccgccaccucgccggcc

SEQ ID NO: 3070016 - RNA, 13 nt, Mycobacterium bovis subsp bovis AF2122/97
gcugcccgacacc

SEQ ID NO: 3070017 - RNA, 14 nt, Mycobacterium bovis subsp bovis AF2122/97
gcugcccgccagcg

SEQ ID NO: 3070018 - RNA, 18 nt, Mycobacterium bovis subsp bovis AF2122/97
gcugcccgccagcgccgc

SEQ ID NO: 3070019 - RNA, 22 nt, Mycobacterium bovis subsp bovis AF2122/97
gcugcccgccagcgccgccgcg

SEQ ID NO: 3070020 - RNA, 13 nt, Mycobacterium bovis subsp bovis AF2122/97
gcugcccgccgcc

SEQ ID NO: 3070021 - RNA, 14 nt, Mycobacterium bovis subsp bovis AF2122/97
gcugcccgccgccc

SEQ ID NO: 3070022 - RNA, 19 nt, Mycobacterium bovis subsp bovis AF2122/97
gcugcccgcggacgugccg

SEQ ID NO: 3070023 - RNA, 18 nt, Mycobacterium bovis subsp bovis AF2122/97
gcugcgacaaaucggcgg

SEQ ID NO: 3070024 - RNA, 19 nt, Mycobacterium bovis subsp bovis AF2122/97
gcugcgacaggacgucggc

SEQ ID NO: 3070025 - RNA, 20 nt, Mycobacterium bovis subsp bovis AF2122/97
gcugcgacaggacgucggcg

SEQ ID NO: 3070026 - RNA, 22 nt, Mycobacterium bovis subsp bovis AF2122/97
gcugcgacaggacgucggcgaa

SEQ ID NO: 3070027 - RNA, 15 nt, Mycobacterium bovis subsp bovis AF2122/97
gcugcgacgaugccg

SEQ ID NO: 3070028 - RNA, 12 nt, Mycobacterium bovis subsp bovis AF2122/97
gcugcgacuggu

SEQ ID NO: 3070029 - RNA, 19 nt, Mycobacterium bovis subsp bovis AF2122/97
gcugcgagaucgcggcgac

SEQ ID NO: 3070030 - RNA, 20 nt, Mycobacterium bovis subsp bovis AF2122/97
gcugcgagaucgcggcgacc

SEQ ID NO: 3070031 - RNA, 21 nt, Mycobacterium bovis subsp bovis AF2122/97
gcugcgagaucgcggcgaccc

SEQ ID NO: 3070032 - RNA, 23 nt, Mycobacterium bovis subsp bovis AF2122/97
gcugcgagaucgcggcgacccgg

SEQ ID NO: 3070033 - RNA, 15 nt, Mycobacterium bovis subsp bovis AF2122/97
gcugcgagucgucgc

SEQ ID NO: 3070034 - RNA, 15 nt, Mycobacterium bovis subsp bovis AF2122/97
gcugcgaucaccccc

SEQ ID NO: 3070035 - RNA, 14 nt, Mycobacterium bovis subsp bovis AF2122/97
gcugcgaucgccgc

SEQ ID NO: 3070036 - RNA, 19 nt, Mycobacterium bovis subsp bovis AF2122/97
gcugcgcaacaccaucagc

SEQ ID NO: 3070037 - RNA, 22 nt, Mycobacterium bovis subsp bovis AF2122/97
gcugcgcaacaccaucagcgac

SEQ ID NO: 3070038 - RNA, 17 nt, Mycobacterium bovis subsp bovis AF2122/97
gcugcgcaauagcgaca

SEQ ID NO: 3070039 - RNA, 17 nt, Mycobacterium bovis subsp bovis AF2122/97
gcugcgcaccaaggccg

SEQ ID NO: 3070040 - RNA, 16 nt, Mycobacterium bovis subsp bovis AF2122/97
gcugcgcaccgccgcg

SEQ ID NO: 3070041 - RNA, 19 nt, Mycobacterium bovis subsp bovis AF2122/97
gcugcgcaccgccgcgcga

SEQ ID NO: 3070042 - RNA, 22 nt, Mycobacterium bovis subsp bovis AF2122/97
gcugcgcagaaucgccugcgac

SEQ ID NO: 3070043 - RNA, 17 nt, Mycobacterium bovis subsp bovis AF2122/97
gcugcgcagcgcaacau

SEQ ID NO: 3070044 - RNA, 16 nt, Mycobacterium bovis subsp bovis AF2122/97
gcugcgcaucgccacc

SEQ ID NO: 3070045 - RNA, 16 nt, Mycobacterium bovis subsp bovis AF2122/97
gcugcgccgaacacca

SEQ ID NO: 3070046 - RNA, 18 nt, Mycobacterium bovis subsp bovis AF2122/97
gcugcgccgaacaccaca

SEQ ID NO: 3070047 - RNA, 12 nt, Mycobacterium bovis subsp bovis AF2122/97
gcugcgccgagg

SEQ ID NO: 3070048 - RNA, 14 nt, Mycobacterium bovis subsp bovis AF2122/97
gcugcgccgaggca

SEQ ID NO: 3070049 - RNA, 21 nt, Mycobacterium bovis subsp bovis AF2122/97
gcugcgccgauacccagcggg

SEQ ID NO: 3070050 - RNA, 23 nt, Mycobacterium bovis subsp bovis AF2122/97
gcugcgccgauacccagcggguc

SEQ ID NO: 3070051 - RNA, 14 nt, Mycobacterium bovis subsp bovis AF2122/97
gcugcgcgaagggg

SEQ ID NO: 3070052 - RNA, 18 nt, Mycobacterium bovis subsp bovis AF2122/97
gcugcgcgaaucgcgucg

SEQ ID NO: 3070053 - RNA, 16 nt, Mycobacterium bovis subsp bovis AF2122/97
gcugcgcgaucccaac

SEQ ID NO: 3070054 - RNA, 15 nt, Mycobacterium bovis subsp bovis AF2122/97
gcugcgcgcccaccg

SEQ ID NO: 3070055 - RNA, 13 nt, Mycobacterium bovis subsp bovis AF2122/97
gcugcgcgcggcg

SEQ ID NO: 3070056 - RNA, 13 nt, Mycobacterium bovis subsp bovis AF2122/97
gcugcgcgcucgg

SEQ ID NO: 3070057 - RNA, 14 nt, Mycobacterium bovis subsp bovis AF2122/97
gcugcgcgcucggc

SEQ ID NO: 3070058 - RNA, 15 nt, Mycobacterium bovis subsp bovis AF2122/97
gcugcgcgcucggcc

SEQ ID NO: 3070059 - RNA, 21 nt, Mycobacterium bovis subsp bovis AF2122/97
gcugcgcgcucggccagcauc

SEQ ID NO: 3070060 - RNA, 19 nt, Mycobacterium bovis subsp bovis AF2122/97
gcugcgcggugccggccgu

SEQ ID NO: 3070061 - RNA, 16 nt, Mycobacterium bovis subsp bovis AF2122/97
gcugcgcguugcugca

SEQ ID NO: 3070062 - RNA, 21 nt, Mycobacterium bovis subsp bovis AF2122/97
gcugcgcuucgaccgaguacc

SEQ ID NO: 3070063 - RNA, 21 nt, Mycobacterium bovis subsp bovis AF2122/97
gcugcggacaagucggcaccg

SEQ ID NO: 3070064 - RNA, 21 nt, Mycobacterium bovis subsp bovis AF2122/97
gcugcggauacagccgccgcc

SEQ ID NO: 3070065 - RNA, 22 nt, Mycobacterium bovis subsp bovis AF2122/97
gcugcggauacagccgccgccg

SEQ ID NO: 3070066 - RNA, 17 nt, Mycobacterium bovis subsp bovis AF2122/97
gcugcggauccaccacg

SEQ ID NO: 3070067 - RNA, 20 nt, Mycobacterium bovis subsp bovis AF2122/97
gcugcggauccaccacgcug

SEQ ID NO: 3070068 - RNA, 17 nt, Mycobacterium bovis subsp bovis AF2122/97
gcugcggaugcgcggcg

SEQ ID NO: 3070069 - RNA, 19 nt, Mycobacterium bovis subsp bovis AF2122/97
gcugcggauuaagucggcg

SEQ ID NO: 3070070 - RNA, 14 nt, Mycobacterium bovis subsp bovis AF2122/97
gcugcggcaacgag

SEQ ID NO: 3070071 - RNA, 18 nt, Mycobacterium bovis subsp bovis AF2122/97
gcugcggcaacgaggucu

SEQ ID NO: 3070072 - RNA, 14 nt, Mycobacterium bovis subsp bovis AF2122/97
gcugcggcaccacc

SEQ ID NO: 3070073 - RNA, 21 nt, Mycobacterium bovis subsp bovis AF2122/97
gcugcggccagcgcggcgcgc

SEQ ID NO: 3070074 - RNA, 13 nt, Mycobacterium bovis subsp bovis AF2122/97
gcugcggcccaca

SEQ ID NO: 3070075 - RNA, 15 nt, Mycobacterium bovis subsp bovis AF2122/97
gcugcggcccacacc

SEQ ID NO: 3070076 - RNA, 20 nt, Mycobacterium bovis subsp bovis AF2122/97
gcugcggcccacaccagcgc

SEQ ID NO: 3070077 - RNA, 23 nt, Mycobacterium bovis subsp bovis AF2122/97
gcugcggcccacaccagcgcagc

SEQ ID NO: 3070078 - RNA, 12 nt, Mycobacterium bovis subsp bovis AF2122/97
gcugcggccgcg

SEQ ID NO: 3070079 - RNA, 19 nt, Mycobacterium bovis subsp bovis AF2122/97
gcugcggcgugccgggugg

SEQ ID NO: 3070080 - RNA, 12 nt, Mycobacterium bovis subsp bovis AF2122/97
gcugcggcuggu

SEQ ID NO: 3070081 - RNA, 19 nt, Mycobacterium bovis subsp bovis AF2122/97
gcugcggcuuggccaucac

SEQ ID NO: 3070082 - RNA, 18 nt, Mycobacterium bovis subsp bovis AF2122/97
gcugcggcuuucagcgcu

SEQ ID NO: 3070083 - RNA, 22 nt, Mycobacterium bovis subsp bovis AF2122/97
gcugcggggcgauccccagcac

SEQ ID NO: 3070084 - RNA, 16 nt, Mycobacterium bovis subsp bovis AF2122/97
gcugcgggguaaggcu

SEQ ID NO: 3070085 - RNA, 24 nt, Mycobacterium bovis subsp bovis AF2122/97
gcugcgggucgcguuucgcagccg

SEQ ID NO: 3070086 - RNA, 13 nt, Mycobacterium bovis subsp bovis AF2122/97
gcugcgggucucg

SEQ ID NO: 3070087 - RNA, 17 nt, Mycobacterium bovis subsp bovis AF2122/97
gcugcgggucucgccga

SEQ ID NO: 3070088 - RNA, 21 nt, Mycobacterium bovis subsp bovis AF2122/97
gcugcgggugauugagcucag

SEQ ID NO: 3070089 - RNA, 20 nt, Mycobacterium bovis subsp bovis AF2122/97
gcugcgguaagaaucgaagc

SEQ ID NO: 3070090 - RNA, 19 nt, Mycobacterium bovis subsp bovis AF2122/97
gcugcgguaaucgccaccg

SEQ ID NO: 3070091 - RNA, 16 nt, Mycobacterium bovis subsp bovis AF2122/97
gcugcggucgcggcug

SEQ ID NO: 3070092 - RNA, 12 nt, Mycobacterium bovis subsp bovis AF2122/97
gcugcggugccg

SEQ ID NO: 3070093 - RNA, 15 nt, Mycobacterium bovis subsp bovis AF2122/97
gcugcggugccggcc

SEQ ID NO: 3070094 - RNA, 16 nt, Mycobacterium bovis subsp bovis AF2122/97
gcugcggugccggccc

SEQ ID NO: 3070095 - RNA, 17 nt, Mycobacterium bovis subsp bovis AF2122/97
gcugcggugccggcccu

SEQ ID NO: 3070096 - RNA, 23 nt, Mycobacterium bovis subsp bovis AF2122/97
gcugcgguggaaccuggcgauag

SEQ ID NO: 3070097 - RNA, 14 nt, Mycobacterium bovis subsp bovis AF2122/97
gcugcggugggcca

SEQ ID NO: 3070098 - RNA, 14 nt, Mycobacterium bovis subsp bovis AF2122/97
gcugcguccggaac

SEQ ID NO: 3070099 - RNA, 13 nt, Mycobacterium bovis subsp bovis AF2122/97
gcugcguccugga

SEQ ID NO: 3070100 - RNA, 14 nt, Mycobacterium bovis subsp bovis AF2122/97
gcugcguccuggau

SEQ ID NO: 3070101 - RNA, 23 nt, Mycobacterium bovis subsp bovis AF2122/97
gcugcgugucaaagaauucguuc

SEQ ID NO: 3070102 - RNA, 14 nt, Mycobacterium bovis subsp bovis AF2122/97
gcugcuagugcggg

SEQ ID NO: 3070103 - RNA, 18 nt, Mycobacterium bovis subsp bovis AF2122/97
gcugcucaucgcgcccgc

SEQ ID NO: 3070104 - RNA, 22 nt, Mycobacterium bovis subsp bovis AF2122/97
gcugcucccgaaaagcgccucg

SEQ ID NO: 3070105 - RNA, 16 nt, Mycobacterium bovis subsp bovis AF2122/97
gcugcuccgucgccga

SEQ ID NO: 3070106 - RNA, 14 nt, Mycobacterium bovis subsp bovis AF2122/97
gcugcuccuggaag

SEQ ID NO: 3070107 - RNA, 22 nt, Mycobacterium bovis subsp bovis AF2122/97
gcugcuccuggaaguacacggc

SEQ ID NO: 3070108 - RNA, 13 nt, Mycobacterium bovis subsp bovis AF2122/97
gcugcucgacggc

SEQ ID NO: 3070109 - RNA, 22 nt, Mycobacterium bovis subsp bovis AF2122/97
gcugcucgaucaucgggagccg

SEQ ID NO: 3070110 - RNA, 19 nt, Mycobacterium bovis subsp bovis AF2122/97
gcuggcccugcuccucgcg

SEQ ID NO: 3070111 - RNA, 16 nt, Mycobacterium bovis subsp bovis AF2122/97
gcuggccgacucgagg

SEQ ID NO: 3070112 - RNA, 20 nt, Mycobacterium bovis subsp bovis AF2122/97
gcuggccgauguaguccggc

SEQ ID NO: 3070113 - RNA, 20 nt, Mycobacterium bovis subsp bovis AF2122/97
gcuggccgaugugggcggag

SEQ ID NO: 3070114 - RNA, 14 nt, Mycobacterium bovis subsp bovis AF2122/97
gcuggccgccaccg

SEQ ID NO: 3070115 - RNA, 19 nt, Mycobacterium bovis subsp bovis AF2122/97
gcuggccgccaccgcacgc

SEQ ID NO: 3070116 - RNA, 20 nt, Mycobacterium bovis subsp bovis AF2122/97
gcuggccgccuccgcggcau

SEQ ID NO: 3070117 - RNA, 14 nt, Mycobacterium bovis subsp bovis AF2122/97
gcuggccgcggccu

SEQ ID NO: 3070118 - RNA, 13 nt, Mycobacterium bovis subsp bovis AF2122/97
gcuggccgcggcg

SEQ ID NO: 3070119 - RNA, 14 nt, Mycobacterium bovis subsp bovis AF2122/97
gcuggccggcaccg

SEQ ID NO: 3070120 - RNA, 14 nt, Mycobacterium bovis subsp bovis AF2122/97
gcuggccguaacgc

SEQ ID NO: 3070121 - RNA, 21 nt, Mycobacterium bovis subsp bovis AF2122/97
gcuggccguaacgcggaucgg

SEQ ID NO: 3070122 - RNA, 20 nt, Mycobacterium bovis subsp bovis AF2122/97
gcuggccguauaggcccggg

SEQ ID NO: 3070123 - RNA, 22 nt, Mycobacterium bovis subsp bovis AF2122/97
gcuggccguauaggcccgggcg

SEQ ID NO: 3070124 - RNA, 19 nt, Mycobacterium bovis subsp bovis AF2122/97
gcuggccgucagcgucggc

SEQ ID NO: 3070125 - RNA, 14 nt, Mycobacterium bovis subsp bovis AF2122/97
gcuggccgucgaag

SEQ ID NO: 3070126 - RNA, 16 nt, Mycobacterium bovis subsp bovis AF2122/97
gcuggccuccagcuug

SEQ ID NO: 3070127 - RNA, 17 nt, Mycobacterium bovis subsp bovis AF2122/97
gcuggccuccagcuugg

SEQ ID NO: 3070128 - RNA, 20 nt, Mycobacterium bovis subsp bovis AF2122/97
gcuggccuccagcuuggcga

SEQ ID NO: 3070129 - RNA, 22 nt, Mycobacterium bovis subsp bovis AF2122/97
gcuggcgaacucgaggucgagc

SEQ ID NO: 3070130 - RNA, 16 nt, Mycobacterium bovis subsp bovis AF2122/97
gcuggcgaccuggucg

SEQ ID NO: 3070131 - RNA, 22 nt, Mycobacterium bovis subsp bovis AF2122/97
gcuggcgaccuggucgcuggug

SEQ ID NO: 3070132 - RNA, 17 nt, Mycobacterium bovis subsp bovis AF2122/97
gcuggcgagcagacgcg

SEQ ID NO: 3070133 - RNA, 18 nt, Mycobacterium bovis subsp bovis AF2122/97
gcuggcgagcagacgcga

SEQ ID NO: 3070134 - RNA, 14 nt, Mycobacterium bovis subsp bovis AF2122/97
gcuggcgcaaccaa

SEQ ID NO: 3070135 - RNA, 14 nt, Mycobacterium bovis subsp bovis AF2122/97
gcuggcgcagccug

SEQ ID NO: 3070136 - RNA, 16 nt, Mycobacterium bovis subsp bovis AF2122/97
gcuggcgcagcgccau

SEQ ID NO: 3070137 - RNA, 17 nt, Mycobacterium bovis subsp bovis AF2122/97
gcuggcgcagcgccauc

SEQ ID NO: 3070138 - RNA, 13 nt, Mycobacterium bovis subsp bovis AF2122/97
gcuggcgcccccg

SEQ ID NO: 3070139 - RNA, 14 nt, Mycobacterium bovis subsp bovis AF2122/97
gcuggcgcccccgc

SEQ ID NO: 3070140 - RNA, 16 nt, Mycobacterium bovis subsp bovis AF2122/97
gcuggcgcccccgcca

SEQ ID NO: 3070141 - RNA, 17 nt, Mycobacterium bovis subsp bovis AF2122/97
gcuggcgcccccgccau

SEQ ID NO: 3070142 - RNA, 22 nt, Mycobacterium bovis subsp bovis AF2122/97
gcuggcgccgccggugccaccg

SEQ ID NO: 3070143 - RNA, 23 nt, Mycobacterium bovis subsp bovis AF2122/97
gcuggcgccggccagccagcgau

SEQ ID NO: 3070144 - RNA, 21 nt, Mycobacterium bovis subsp bovis AF2122/97
gcuggcgcgcgggguggcggc

SEQ ID NO: 3070145 - RNA, 21 nt, Mycobacterium bovis subsp bovis AF2122/97
gcuggcgcucauaggccggcg

SEQ ID NO: 3070146 - RNA, 22 nt, Mycobacterium bovis subsp bovis AF2122/97
gcuggcgcucauaggccggcgg

SEQ ID NO: 3070147 - RNA, 19 nt, Mycobacterium bovis subsp bovis AF2122/97
gcuggcgcugaugcuggcc

SEQ ID NO: 3070148 - RNA, 21 nt, Mycobacterium bovis subsp bovis AF2122/97
gcuggcgcugaugcuggccau

SEQ ID NO: 3070149 - RNA, 16 nt, Mycobacterium bovis subsp bovis AF2122/97
gcuggcgcuuugggcu

SEQ ID NO: 3070150 - RNA, 22 nt, Mycobacterium bovis subsp bovis AF2122/97
gcuggcggaacuugccggugcg

SEQ ID NO: 3070151 - RNA, 15 nt, Mycobacterium bovis subsp bovis AF2122/97
gcuggcggccagcau

SEQ ID NO: 3070152 - RNA, 16 nt, Mycobacterium bovis subsp bovis AF2122/97
gcuggcggccagcauc

SEQ ID NO: 3070153 - RNA, 18 nt, Mycobacterium bovis subsp bovis AF2122/97
gcuggcggccagcaucgg

SEQ ID NO: 3070154 - RNA, 14 nt, Mycobacterium bovis subsp bovis AF2122/97
gcuggcggccucgc

SEQ ID NO: 3070155 - RNA, 18 nt, Mycobacterium bovis subsp bovis AF2122/97
gcuggcggccucgccggc

SEQ ID NO: 3070156 - RNA, 15 nt, Mycobacterium bovis subsp bovis AF2122/97
gcuggcggcgcgaca

SEQ ID NO: 3070157 - RNA, 22 nt, Mycobacterium bovis subsp bovis AF2122/97
gcuggcggcguggcgccggcca

SEQ ID NO: 3070158 - RNA, 23 nt, Mycobacterium bovis subsp bovis AF2122/97
gcuggcgggcagcuguucggcca

SEQ ID NO: 3070159 - RNA, 13 nt, Mycobacterium bovis subsp bovis AF2122/97
gcuggcgggcgau

SEQ ID NO: 3070160 - RNA, 16 nt, Mycobacterium bovis subsp bovis AF2122/97
gcuggcgggcgaucgc

SEQ ID NO: 3070161 - RNA, 17 nt, Mycobacterium bovis subsp bovis AF2122/97
gcuggcguucccgcucg

SEQ ID NO: 3070162 - RNA, 18 nt, Mycobacterium bovis subsp bovis AF2122/97
gcuggcguucccgcucgg

SEQ ID NO: 3070163 - RNA, 19 nt, Mycobacterium bovis subsp bovis AF2122/97
gcuggcguucccgcucggc

SEQ ID NO: 3070164 - RNA, 23 nt, Mycobacterium bovis subsp bovis AF2122/97
gcuggcguugcugaugucgccgg

SEQ ID NO: 3070165 - RNA, 14 nt, Mycobacterium bovis subsp bovis AF2122/97
gcuggcuacccacc

SEQ ID NO: 3070166 - RNA, 21 nt, Mycobacterium bovis subsp bovis AF2122/97
gcuggcucaccgacaugacgc

SEQ ID NO: 3070167 - RNA, 22 nt, Mycobacterium bovis subsp bovis AF2122/97
gcuggcucaucgaagcuucggc

SEQ ID NO: 3070168 - RNA, 14 nt, Mycobacterium bovis subsp bovis AF2122/97
gcuggcugacaccg

SEQ ID NO: 3070169 - RNA, 23 nt, Mycobacterium bovis subsp bovis AF2122/97
gcuggcugccacgaacgcuucca

SEQ ID NO: 3070170 - RNA, 14 nt, Mycobacterium bovis subsp bovis AF2122/97
gcuggcuguggcug

SEQ ID NO: 3070171 - RNA, 16 nt, Mycobacterium bovis subsp bovis AF2122/97
gcuggcuguggcugaa

SEQ ID NO: 3070172 - RNA, 21 nt, Mycobacterium bovis subsp bovis AF2122/97
gcuggcuguggcugaacaccg

SEQ ID NO: 3070173 - RNA, 16 nt, Mycobacterium bovis subsp bovis AF2122/97
gcuggcuugggccagc

SEQ ID NO: 3070174 - RNA, 13 nt, Mycobacterium bovis subsp bovis AF2122/97
gcugggaaagcau

SEQ ID NO: 3070175 - RNA, 16 nt, Mycobacterium bovis subsp bovis AF2122/97
gcugggaaaucccgac

SEQ ID NO: 3070176 - RNA, 20 nt, Mycobacterium bovis subsp bovis AF2122/97
gcugggaaaucccgaccacc

SEQ ID NO: 3070177 - RNA, 20 nt, Mycobacterium bovis subsp bovis AF2122/97
gcugggaagcucgguccaau

SEQ ID NO: 3070178 - RNA, 17 nt, Mycobacterium bovis subsp bovis AF2122/97
gcugggacgggcgcguc

SEQ ID NO: 3070179 - RNA, 15 nt, Mycobacterium bovis subsp bovis AF2122/97
gcugggagcggaugu

SEQ ID NO: 3070180 - RNA, 13 nt, Mycobacterium bovis subsp bovis AF2122/97
gcugggaggcgcg

SEQ ID NO: 3070181 - RNA, 17 nt, Mycobacterium bovis subsp bovis AF2122/97
gcugggagggaccaccc

SEQ ID NO: 3070182 - RNA, 21 nt, Mycobacterium bovis subsp bovis AF2122/97
gcugggauagcgcgguuggcu

SEQ ID NO: 3070183 - RNA, 22 nt, Mycobacterium bovis subsp bovis AF2122/97
gcugggauguucgaucagcgac

SEQ ID NO: 3070184 - RNA, 19 nt, Mycobacterium bovis subsp bovis AF2122/97
gcugggcagaccgaucggc

SEQ ID NO: 3070185 - RNA, 20 nt, Mycobacterium bovis subsp bovis AF2122/97
gcugggcagaccgaucggca

SEQ ID NO: 3070186 - RNA, 14 nt, Mycobacterium bovis subsp bovis AF2122/97
gcugggcaucaccg

SEQ ID NO: 3070187 - RNA, 18 nt, Mycobacterium bovis subsp bovis AF2122/97
gcugggcaucaccgacgc

SEQ ID NO: 3070188 - RNA, 22 nt, Mycobacterium bovis subsp bovis AF2122/97
gcugggcaucaccgacgcgucg

SEQ ID NO: 3070189 - RNA, 17 nt, Mycobacterium bovis subsp bovis AF2122/97
gcugggcaucaccgccg

SEQ ID NO: 3070190 - RNA, 19 nt, Mycobacterium bovis subsp bovis AF2122/97
gcugggcccgagcgcgcgc

SEQ ID NO: 3070191 - RNA, 22 nt, Mycobacterium bovis subsp bovis AF2122/97
gcugggcccgccagcccagcac

SEQ ID NO: 3070192 - RNA, 23 nt, Mycobacterium bovis subsp bovis AF2122/97
gcugggcccgccagcccagcacg

SEQ ID NO: 3070193 - RNA, 14 nt, Mycobacterium bovis subsp bovis AF2122/97
gcugggcccgccgu

SEQ ID NO: 3070194 - RNA, 21 nt, Mycobacterium bovis subsp bovis AF2122/97
gcugggccgacgggacaaccc

SEQ ID NO: 3070195 - RNA, 21 nt, Mycobacterium bovis subsp bovis AF2122/97
gcugggccgcaucggauggcc

SEQ ID NO: 3070196 - RNA, 20 nt, Mycobacterium bovis subsp bovis AF2122/97
gcugucaauccgcccuaaug

SEQ ID NO: 3070197 - RNA, 16 nt, Mycobacterium bovis subsp bovis AF2122/97
gcugucaccgcaaccg

SEQ ID NO: 3070198 - RNA, 22 nt, Mycobacterium bovis subsp bovis AF2122/97
gcugucacguagcgagcccacg

SEQ ID NO: 3070199 - RNA, 19 nt, Mycobacterium bovis subsp bovis AF2122/97
gcugucaguucccgcuuga

SEQ ID NO: 3070200 - RNA, 19 nt, Mycobacterium bovis subsp bovis AF2122/97
gcugucauccccggccagc

SEQ ID NO: 3070201 - RNA, 20 nt, Mycobacterium bovis subsp bovis AF2122/97
gcugucauccccggccagcc

SEQ ID NO: 3070202 - RNA, 11 nt, Mycobacterium bovis subsp bovis AF2122/97
gcuguccaccg

SEQ ID NO: 3070203 - RNA, 17 nt, Mycobacterium bovis subsp bovis AF2122/97
gcuguccaggucugggc

SEQ ID NO: 3070204 - RNA, 13 nt, Mycobacterium bovis subsp bovis AF2122/97
gcugucccagccc

SEQ ID NO: 3070205 - RNA, 14 nt, Mycobacterium bovis subsp bovis AF2122/97
gcuguccccgccga

SEQ ID NO: 3070206 - RNA, 18 nt, Mycobacterium bovis subsp bovis AF2122/97
gcuguccgacuucuccag

SEQ ID NO: 3070207 - RNA, 14 nt, Mycobacterium bovis subsp bovis AF2122/97
gcuguccgacuugu

SEQ ID NO: 3070208 - RNA, 20 nt, Mycobacterium bovis subsp bovis AF2122/97
gcugucgacgucggcaaucu

SEQ ID NO: 3070209 - RNA, 14 nt, Mycobacterium bovis subsp bovis AF2122/97
gcugucgaucagcg

SEQ ID NO: 3070210 - RNA, 16 nt, Mycobacterium bovis subsp bovis AF2122/97
gcugucgaucagcgac

SEQ ID NO: 3070211 - RNA, 18 nt, Mycobacterium bovis subsp bovis AF2122/97
gcugucgcaacgcaucga

SEQ ID NO: 3070212 - RNA, 22 nt, Mycobacterium bovis subsp bovis AF2122/97
gcugucgcccucgaucgccacg

SEQ ID NO: 3070213 - RNA, 13 nt, Mycobacterium bovis subsp bovis AF2122/97
gcugucgcgggcc

SEQ ID NO: 3070214 - RNA, 18 nt, Mycobacterium bovis subsp bovis AF2122/97
gcugucgcgggccaccac

SEQ ID NO: 3070215 - RNA, 19 nt, Mycobacterium bovis subsp bovis AF2122/97
gcugucgcgggccaccacc

SEQ ID NO: 3070216 - RNA, 17 nt, Mycobacterium bovis subsp bovis AF2122/97
gcugucggcaugccggu

SEQ ID NO: 3070217 - RNA, 14 nt, Mycobacterium bovis subsp bovis AF2122/97
gcugucggcuuccu

SEQ ID NO: 3070218 - RNA, 14 nt, Mycobacterium bovis subsp bovis AF2122/97
gcugucgggcagcu

SEQ ID NO: 3070219 - RNA, 16 nt, Mycobacterium bovis subsp bovis AF2122/97
gcugucgggcagcugg

SEQ ID NO: 3070220 - RNA, 12 nt, Mycobacterium bovis subsp bovis AF2122/97
gcugucggugcc

SEQ ID NO: 3070221 - RNA, 15 nt, Mycobacterium bovis subsp bovis AF2122/97
gcugucguaccgcgg

SEQ ID NO: 3070222 - RNA, 19 nt, Mycobacterium bovis subsp bovis AF2122/97
gcugucgucuuggcgaucg

SEQ ID NO: 3070223 - RNA, 23 nt, Mycobacterium bovis subsp bovis AF2122/97
gcugucgucuuggcgaucggguu

SEQ ID NO: 3070224 - RNA, 23 nt, Mycobacterium bovis subsp bovis AF2122/97
gcugucgugauacagcucggugc

SEQ ID NO: 3070225 - RNA, 19 nt, Mycobacterium bovis subsp bovis AF2122/97
gcugucguugaucggcacg

SEQ ID NO: 3070226 - RNA, 18 nt, Mycobacterium bovis subsp bovis AF2122/97
gcugugaacagcgcgucg

SEQ ID NO: 3070227 - RNA, 21 nt, Mycobacterium bovis subsp bovis AF2122/97
gcugugagcuuggucgccaug

SEQ ID NO: 3070228 - RNA, 13 nt, Mycobacterium bovis subsp bovis AF2122/97
gcugugauagcgc

SEQ ID NO: 3070229 - RNA, 13 nt, Mycobacterium bovis subsp bovis AF2122/97
gcugugcaggcgg

SEQ ID NO: 3070230 - RNA, 18 nt, Mycobacterium bovis subsp bovis AF2122/97
gcugugcaggcgggaacg

SEQ ID NO: 3070231 - RNA, 13 nt, Mycobacterium bovis subsp bovis AF2122/97
gcugugccccagg

SEQ ID NO: 3070232 - RNA, 23 nt, Mycobacterium bovis subsp bovis AF2122/97
gcugugcccgaucagccguggca

SEQ ID NO: 3070233 - RNA, 19 nt, Mycobacterium bovis subsp bovis AF2122/97
gcugugccgagaugccggc

SEQ ID NO: 3070234 - RNA, 19 nt, Mycobacterium bovis subsp bovis AF2122/97
gcugugccgugcgaucacc

SEQ ID NO: 3070235 - RNA, 18 nt, Mycobacterium bovis subsp bovis AF2122/97
gcugugcgcagacaucgg

SEQ ID NO: 3070236 - RNA, 14 nt, Mycobacterium bovis subsp bovis AF2122/97
gcugugcgguaucg

SEQ ID NO: 3070237 - RNA, 23 nt, Mycobacterium bovis subsp bovis AF2122/97
gcugugcucacgagcaaaccaga

SEQ ID NO: 3070238 - RNA, 11 nt, Mycobacterium bovis subsp bovis AF2122/97
gcugugcucga

SEQ ID NO: 3070239 - RNA, 20 nt, Mycobacterium bovis subsp bovis AF2122/97
gcugugcuucguugucggcg

SEQ ID NO: 3070240 - RNA, 21 nt, Mycobacterium bovis subsp bovis AF2122/97
gcugugcuucguugucggcgg

SEQ ID NO: 3070241 - RNA, 17 nt, Mycobacterium bovis subsp bovis AF2122/97
gcuguggaucgacaccg

SEQ ID NO: 3070242 - RNA, 17 nt, Mycobacterium bovis subsp bovis AF2122/97
gcuguggaugccgacgg

SEQ ID NO: 3070243 - RNA, 13 nt, Mycobacterium bovis subsp bovis AF2122/97
gcuguggcccgcg

SEQ ID NO: 3070244 - RNA, 17 nt, Mycobacterium bovis subsp bovis AF2122/97
gcuguggcgggagaucg

SEQ ID NO: 3070245 - RNA, 12 nt, Mycobacterium bovis subsp bovis AF2122/97
gcuguggcucga

SEQ ID NO: 3070246 - RNA, 15 nt, Mycobacterium bovis subsp bovis AF2122/97
gcuguggcucgacga

SEQ ID NO: 3070247 - RNA, 22 nt, Mycobacterium bovis subsp bovis AF2122/97
gcugugguaggccggugcguca

SEQ ID NO: 3070248 - RNA, 17 nt, Mycobacterium bovis subsp bovis AF2122/97
gcuguggucgcugcugc

SEQ ID NO: 3070249 - RNA, 19 nt, Mycobacterium bovis subsp bovis AF2122/97
gcuguggucgcugcugccg

SEQ ID NO: 3070250 - RNA, 14 nt, Mycobacterium bovis subsp bovis AF2122/97
gcuguggucggugc

SEQ ID NO: 3070251 - RNA, 15 nt, Mycobacterium bovis subsp bovis AF2122/97
gcuguggucggugcc

SEQ ID NO: 3070252 - RNA, 16 nt, Mycobacterium bovis subsp bovis AF2122/97
gcuguggucggugcca

SEQ ID NO: 3070253 - RNA, 21 nt, Mycobacterium bovis subsp bovis AF2122/97
gcuguggucggugccagcacc

SEQ ID NO: 3070254 - RNA, 22 nt, Mycobacterium bovis subsp bovis AF2122/97
gcuguggugacagauccgcccc

SEQ ID NO: 3070255 - RNA, 21 nt, Mycobacterium bovis subsp bovis AF2122/97
gcugugguggugaugggcaug

SEQ ID NO: 3070256 - RNA, 19 nt, Mycobacterium bovis subsp bovis AF2122/97
gcuguucgagccgcguucg

SEQ ID NO: 3070257 - RNA, 16 nt, Mycobacterium bovis subsp bovis AF2122/97
gcuguucggccauggc

SEQ ID NO: 3070258 - RNA, 19 nt, Mycobacterium bovis subsp bovis AF2122/97
gcuguucggucuugccggc

SEQ ID NO: 3070259 - RNA, 14 nt, Mycobacterium bovis subsp bovis AF2122/97
gcuguugaccgugu

SEQ ID NO: 3070260 - RNA, 18 nt, Mycobacterium bovis subsp bovis AF2122/97
gcuguugacuaccaccgc

SEQ ID NO: 3070261 - RNA, 19 nt, Mycobacterium bovis subsp bovis AF2122/97
gcuguugacuaccaccgcg

SEQ ID NO: 3070262 - RNA, 17 nt, Mycobacterium bovis subsp bovis AF2122/97
gcuguugcaucgccgcg

SEQ ID NO: 3070263 - RNA, 15 nt, Mycobacterium bovis subsp bovis AF2122/97
gcuguugcgcggucg

SEQ ID NO: 3070264 - RNA, 16 nt, Mycobacterium bovis subsp bovis AF2122/97
gcuguugcgcggucgc

SEQ ID NO: 3070265 - RNA, 16 nt, Mycobacterium bovis subsp bovis AF2122/97
gcuguugcggcggcgc

SEQ ID NO: 3070266 - RNA, 15 nt, Mycobacterium bovis subsp bovis AF2122/97
gcuguugcggggugc

SEQ ID NO: 3070267 - RNA, 18 nt, Mycobacterium bovis subsp bovis AF2122/97
gcuguugcggggugcuca

SEQ ID NO: 3070268 - RNA, 20 nt, Mycobacterium bovis subsp bovis AF2122/97
gcuguugcggggugcucagc

SEQ ID NO: 3070269 - RNA, 14 nt, Mycobacterium bovis subsp bovis AF2122/97
gcuguuggccagcc

SEQ ID NO: 3070270 - RNA, 15 nt, Mycobacterium bovis subsp bovis AF2122/97
gcuguuggccagccg

SEQ ID NO: 3070271 - RNA, 16 nt, Mycobacterium bovis subsp bovis AF2122/97
gcuguuggccagccga

SEQ ID NO: 3070272 - RNA, 23 nt, Mycobacterium bovis subsp bovis AF2122/97
gcuguuguacggcccaaacggcg

SEQ ID NO: 3070273 - RNA, 19 nt, Mycobacterium bovis subsp bovis AF2122/97
gcuguuguugucgggauug

SEQ ID NO: 3070274 - RNA, 20 nt, Mycobacterium bovis subsp bovis AF2122/97
gcuguuugguugcgccagga

SEQ ID NO: 3070275 - RNA, 22 nt, Mycobacterium bovis subsp bovis AF2122/97
gcuuaacagcggguccuucugc

SEQ ID NO: 3070276 - RNA, 20 nt, Mycobacterium bovis subsp bovis AF2122/97
gcuuaaggcccuggccgcgc

SEQ ID NO: 3070277 - RNA, 17 nt, Mycobacterium bovis subsp bovis AF2122/97
gcuuacaugcccugcgc

SEQ ID NO: 3070278 - RNA, 15 nt, Mycobacterium bovis subsp bovis AF2122/97
gcuuaccggcgggcg

SEQ ID NO: 3070279 - RNA, 22 nt, Mycobacterium bovis subsp bovis AF2122/97
gcuuacgggugucgggcgcgcu

SEQ ID NO: 3070280 - RNA, 17 nt, Mycobacterium bovis subsp bovis AF2122/97
gcuuagaacgugcuggu

SEQ ID NO: 3070281 - RNA, 13 nt, Mycobacterium bovis subsp bovis AF2122/97
gcuuagcaaucgg

SEQ ID NO: 3070282 - RNA, 15 nt, Mycobacterium bovis subsp bovis AF2122/97
gcuuagcgcaugggc

SEQ ID NO: 3070283 - RNA, 21 nt, Mycobacterium bovis subsp bovis AF2122/97
gcuucucgucggugcgcgcgg

SEQ ID NO: 3070284 - RNA, 23 nt, Mycobacterium bovis subsp bovis AF2122/97
gcuucucgucggugcgcgcggcg

SEQ ID NO: 3070285 - RNA, 15 nt, Mycobacterium bovis subsp bovis AF2122/97
gcuucugccugcgca

SEQ ID NO: 3070286 - RNA, 20 nt, Mycobacterium bovis subsp bovis AF2122/97
gcuucugcgucagccgacaa

SEQ ID NO: 3070287 - RNA, 16 nt, Mycobacterium bovis subsp bovis AF2122/97
gcuucugcgucugcuc

SEQ ID NO: 3070288 - RNA, 19 nt, Mycobacterium bovis subsp bovis AF2122/97
gcuucugcgucugcucgcg

SEQ ID NO: 3070289 - RNA, 22 nt, Mycobacterium bovis subsp bovis AF2122/97
gcuucugcuacccgagccggca

SEQ ID NO: 3070290 - RNA, 21 nt, Mycobacterium bovis subsp bovis AF2122/97
gcuucugggcuuucugcaccc

SEQ ID NO: 3070291 - RNA, 18 nt, Mycobacterium bovis subsp bovis AF2122/97
gcuucugggguuggcucg

SEQ ID NO: 3070292 - RNA, 18 nt, Mycobacterium bovis subsp bovis AF2122/97
gcuucuuaccgcgggccg

SEQ ID NO: 3070293 - RNA, 21 nt, Mycobacterium bovis subsp bovis AF2122/97
gcuucuuaccgcgggccgcca

SEQ ID NO: 3070294 - RNA, 20 nt, Mycobacterium bovis subsp bovis AF2122/97
gcuucuuccgcgcgccggcg

SEQ ID NO: 3070295 - RNA, 22 nt, Mycobacterium bovis subsp bovis AF2122/97
gcuucuucggacagcagccggc

SEQ ID NO: 3070296 - RNA, 23 nt, Mycobacterium bovis subsp bovis AF2122/97
gcuucuucggacagcagccggcg

SEQ ID NO: 3070297 - RNA, 20 nt, Mycobacterium bovis subsp bovis AF2122/97
gcuucuuguggauuguccga

SEQ ID NO: 3070298 - RNA, 17 nt, Mycobacterium bovis subsp bovis AF2122/97
gcuugaacagcugaucc

SEQ ID NO: 3070299 - RNA, 20 nt, Mycobacterium bovis subsp bovis AF2122/97
gcuugaacgcauacagcgcc

SEQ ID NO: 3070300 - RNA, 23 nt, Mycobacterium bovis subsp bovis AF2122/97
gcuugaacgcauacagcgcccgg

SEQ ID NO: 3070301 - RNA, 16 nt, Mycobacterium bovis subsp bovis AF2122/97
gcuugacaacccuguu

SEQ ID NO: 3070302 - RNA, 15 nt, Mycobacterium bovis subsp bovis AF2122/97
gcuugacaucgguca

SEQ ID NO: 3070303 - RNA, 19 nt, Mycobacterium bovis subsp bovis AF2122/97
gcuugacccacgagagcgc

SEQ ID NO: 3070304 - RNA, 20 nt, Mycobacterium bovis subsp bovis AF2122/97
gcuugacccacgagagcgcu

SEQ ID NO: 3070305 - RNA, 21 nt, Mycobacterium bovis subsp bovis AF2122/97
gcuugaccccuggccgccggc

SEQ ID NO: 3070306 - RNA, 21 nt, Mycobacterium bovis subsp bovis AF2122/97
gcuugacccuugggcaccacc

SEQ ID NO: 3070307 - RNA, 21 nt, Mycobacterium bovis subsp bovis AF2122/97
gcuugacuccgcgcgcugggc

SEQ ID NO: 3070308 - RNA, 15 nt, Mycobacterium bovis subsp bovis AF2122/97
gcuugacugcacacc

SEQ ID NO: 3070309 - RNA, 16 nt, Mycobacterium bovis subsp bovis AF2122/97
gcuugacugcacacca

SEQ ID NO: 3070310 - RNA, 17 nt, Mycobacterium bovis subsp bovis AF2122/97
gcuugacugcacaccac

SEQ ID NO: 3070311 - RNA, 17 nt, Mycobacterium bovis subsp bovis AF2122/97
gcuugagccgcagcacc

SEQ ID NO: 3070312 - RNA, 14 nt, Mycobacterium bovis subsp bovis AF2122/97
gcuugagcgccgau

SEQ ID NO: 3070313 - RNA, 20 nt, Mycobacterium bovis subsp bovis AF2122/97
gcuugagcgugagcgccgcg

SEQ ID NO: 3070314 - RNA, 23 nt, Mycobacterium bovis subsp bovis AF2122/97
gcuugaguugguugaugcccuug

SEQ ID NO: 3070315 - RNA, 19 nt, Mycobacterium bovis subsp bovis AF2122/97
gcuugaucagccgccaacc

SEQ ID NO: 3070316 - RNA, 14 nt, Mycobacterium bovis subsp bovis AF2122/97
gcuugaucgccgag

SEQ ID NO: 3070317 - RNA, 15 nt, Mycobacterium bovis subsp bovis AF2122/97
gcuugaucgccgagg

SEQ ID NO: 3070318 - RNA, 14 nt, Mycobacterium bovis subsp bovis AF2122/97
gcuugaugccggcc

SEQ ID NO: 3070319 - RNA, 21 nt, Mycobacterium bovis subsp bovis AF2122/97
gcuugaugucuuuggcguacu

SEQ ID NO: 3070320 - RNA, 16 nt, Mycobacterium bovis subsp bovis AF2122/97
gcuugcaauugcgcgg

SEQ ID NO: 3070321 - RNA, 18 nt, Mycobacterium bovis subsp bovis AF2122/97
gcuugcaggcgaucuggc

SEQ ID NO: 3070322 - RNA, 14 nt, Mycobacterium bovis subsp bovis AF2122/97
gcuugcagggccac

SEQ ID NO: 3070323 - RNA, 19 nt, Mycobacterium bovis subsp bovis AF2122/97
gcuugccccaucguucguu

SEQ ID NO: 3070324 - RNA, 14 nt, Mycobacterium bovis subsp bovis AF2122/97
gcuugccccgccgu

SEQ ID NO: 3070325 - RNA, 18 nt, Mycobacterium bovis subsp bovis AF2122/97
gcuugccccgccuuggcc

SEQ ID NO: 3070326 - RNA, 19 nt, Mycobacterium bovis subsp bovis AF2122/97
gcuugccccgccuuggcca

SEQ ID NO: 3070327 - RNA, 18 nt, Mycobacterium bovis subsp bovis AF2122/97
gcuugcccgacggcgucu

SEQ ID NO: 3070328 - RNA, 14 nt, Mycobacterium bovis subsp bovis AF2122/97
gcuugccgaccugc

SEQ ID NO: 3070329 - RNA, 15 nt, Mycobacterium bovis subsp bovis AF2122/97
gcuugccgcugagcc

SEQ ID NO: 3070330 - RNA, 16 nt, Mycobacterium bovis subsp bovis AF2122/97
gcuugccggggugugc

SEQ ID NO: 3070331 - RNA, 15 nt, Mycobacterium bovis subsp bovis AF2122/97
gcuugccgucgcuga

SEQ ID NO: 3070332 - RNA, 19 nt, Mycobacterium bovis subsp bovis AF2122/97
gcuugccgucuucgccgcc

SEQ ID NO: 3070333 - RNA, 18 nt, Mycobacterium bovis subsp bovis AF2122/97
gcuugcgaccccggcugc

SEQ ID NO: 3070334 - RNA, 14 nt, Mycobacterium bovis subsp bovis AF2122/97
gcuugcgcagcagc

SEQ ID NO: 3070335 - RNA, 15 nt, Mycobacterium bovis subsp bovis AF2122/97
gcuugcgcagcagcg

SEQ ID NO: 3070336 - RNA, 17 nt, Mycobacterium bovis subsp bovis AF2122/97
gcuugcgcagccgcagc

SEQ ID NO: 3070337 - RNA, 14 nt, Mycobacterium bovis subsp bovis AF2122/97
gcuugcgcccggcc

SEQ ID NO: 3070338 - RNA, 17 nt, Mycobacterium bovis subsp bovis AF2122/97
gcuugcgcccggccugc

SEQ ID NO: 3070339 - RNA, 14 nt, Mycobacterium bovis subsp bovis AF2122/97
gcuugcgccgcagc

SEQ ID NO: 3070340 - RNA, 15 nt, Mycobacterium bovis subsp bovis AF2122/97
gcuugcgccgcagcg

SEQ ID NO: 3070341 - RNA, 14 nt, Mycobacterium bovis subsp bovis AF2122/97
gcuugcgcggcuug

SEQ ID NO: 3070342 - RNA, 22 nt, Mycobacterium bovis subsp bovis AF2122/97
gcuugcgcucguugguucagcu

SEQ ID NO: 3070343 - RNA, 14 nt, Mycobacterium bovis subsp bovis AF2122/97
gcuugcggagccgc

SEQ ID NO: 3070344 - RNA, 14 nt, Mycobacterium bovis subsp bovis AF2122/97
gcuugcggcaccca

SEQ ID NO: 3070345 - RNA, 21 nt, Mycobacterium bovis subsp bovis AF2122/97
gcuugcggcacccagucggcg

SEQ ID NO: 3070346 - RNA, 20 nt, Mycobacterium bovis subsp bovis AF2122/97
gcuugcggccgaauuccuca

SEQ ID NO: 3070347 - RNA, 18 nt, Mycobacterium bovis subsp bovis AF2122/97
gcuugcggccgcgcgccg

SEQ ID NO: 3070348 - RNA, 22 nt, Mycobacterium bovis subsp bovis AF2122/97
gcuugcggggccgggcgaucgc

SEQ ID NO: 3070349 - RNA, 19 nt, Mycobacterium bovis subsp bovis AF2122/97
gcuugcggugaucccacga

SEQ ID NO: 3070350 - RNA, 14 nt, Mycobacterium bovis subsp bovis AF2122/97
gcuugcguagcuca

SEQ ID NO: 3070351 - RNA, 13 nt, Mycobacterium bovis subsp bovis AF2122/97
gcuuggaccagcg

SEQ ID NO: 3070352 - RNA, 15 nt, Mycobacterium bovis subsp bovis AF2122/97
gcuuggagaucgccg

SEQ ID NO: 3070353 - RNA, 19 nt, Mycobacterium bovis subsp bovis AF2122/97
gcuuggagaucgccgccgg

SEQ ID NO: 3070354 - RNA, 21 nt, Mycobacterium bovis subsp bovis AF2122/97
gcuuggagaucgccgccggcg

SEQ ID NO: 3070355 - RNA, 16 nt, Mycobacterium bovis subsp bovis AF2122/97
gcuuggcagcggugua

SEQ ID NO: 3070356 - RNA, 17 nt, Mycobacterium bovis subsp bovis AF2122/97
gcuuggcauugaccacc

SEQ ID NO: 3070357 - RNA, 18 nt, Mycobacterium bovis subsp bovis AF2122/97
gcuuggcauugaccaccg

SEQ ID NO: 3070358 - RNA, 15 nt, Mycobacterium bovis subsp bovis AF2122/97
gcuuggccgccgcca

SEQ ID NO: 3070359 - RNA, 16 nt, Mycobacterium bovis subsp bovis AF2122/97
gcuuggccgcgcaggc

SEQ ID NO: 3070360 - RNA, 14 nt, Mycobacterium bovis subsp bovis AF2122/97
gcuuggccgcgccg

SEQ ID NO: 3070361 - RNA, 19 nt, Mycobacterium bovis subsp bovis AF2122/97
gcuuggccguaggcggcga

SEQ ID NO: 3070362 - RNA, 21 nt, Mycobacterium bovis subsp bovis AF2122/97
gcuuggccuagccgcggcacc

SEQ ID NO: 3070363 - RNA, 22 nt, Mycobacterium bovis subsp bovis AF2122/97
gcuuggccuagccgcggcaccg

SEQ ID NO: 3070364 - RNA, 18 nt, Mycobacterium bovis subsp bovis AF2122/97
gcuuggccucagccaccg

SEQ ID NO: 3070365 - RNA, 16 nt, Mycobacterium bovis subsp bovis AF2122/97
gcuuggcgagccacgg

SEQ ID NO: 3070366 - RNA, 21 nt, Mycobacterium bovis subsp bovis AF2122/97
gcuuggcgaucucaccuggag

SEQ ID NO: 3070367 - RNA, 14 nt, Mycobacterium bovis subsp bovis AF2122/97
gcuuggcgccgaug

SEQ ID NO: 3070368 - RNA, 19 nt, Mycobacterium bovis subsp bovis AF2122/97
gcuuggcgccgaugccggc

SEQ ID NO: 3070369 - RNA, 16 nt, Mycobacterium bovis subsp bovis AF2122/97
ggaaacccggccagcu

SEQ ID NO: 3070370 - RNA, 16 nt, Mycobacterium bovis subsp bovis AF2122/97
ggaaacccggccgccg

SEQ ID NO: 3070371 - RNA, 19 nt, Mycobacterium bovis subsp bovis AF2122/97
ggaaacccggccgccgaga

SEQ ID NO: 3070372 - RNA, 14 nt, Mycobacterium bovis subsp bovis AF2122/97
ggaaacccugcacc

SEQ ID NO: 3070373 - RNA, 17 nt, Mycobacterium bovis subsp bovis AF2122/97
ggaaaccgcugggggcg

SEQ ID NO: 3070374 - RNA, 18 nt, Mycobacterium bovis subsp bovis AF2122/97
ggaaaccggccagccgac

SEQ ID NO: 3070375 - RNA, 23 nt, Mycobacterium bovis subsp bovis AF2122/97
ggaaaccucuucgggugcagcca

SEQ ID NO: 3070376 - RNA, 16 nt, Mycobacterium bovis subsp bovis AF2122/97
ggaaacggagccgagc

SEQ ID NO: 3070377 - RNA, 16 nt, Mycobacterium bovis subsp bovis AF2122/97
ggaaacuccgcggcgc

SEQ ID NO: 3070378 - RNA, 15 nt, Mycobacterium bovis subsp bovis AF2122/97
ggaaagcagcagcgg

SEQ ID NO: 3070379 - RNA, 11 nt, Mycobacterium bovis subsp bovis AF2122/97
ggaaagcucuc

SEQ ID NO: 3070380 - RNA, 20 nt, Mycobacterium bovis subsp bovis AF2122/97
ggaaaggcuuccgcgugcga

SEQ ID NO: 3070381 - RNA, 14 nt, Mycobacterium bovis subsp bovis AF2122/97
ggaaagggccgccg

SEQ ID NO: 3070382 - RNA, 18 nt, Mycobacterium bovis subsp bovis AF2122/97
ggaaaggucggccugcga

SEQ ID NO: 3070383 - RNA, 22 nt, Mycobacterium bovis subsp bovis AF2122/97
ggaaauacuuuggaugcccgua

SEQ ID NO: 3070384 - RNA, 16 nt, Mycobacterium bovis subsp bovis AF2122/97
ggaaaucggacgacuc

SEQ ID NO: 3070385 - RNA, 22 nt, Mycobacterium bovis subsp bovis AF2122/97
ggaaaucgggaucugcgccgcg

SEQ ID NO: 3070386 - RNA, 23 nt, Mycobacterium bovis subsp bovis AF2122/97
ggaaaugaccuccuggcaaccga

SEQ ID NO: 3070387 - RNA, 19 nt, Mycobacterium bovis subsp bovis AF2122/97
ggaaauggcgucgccggca

SEQ ID NO: 3070388 - RNA, 17 nt, Mycobacterium bovis subsp bovis AF2122/97
ggaaauuucaguucggc

SEQ ID NO: 3070389 - RNA, 19 nt, Mycobacterium bovis subsp bovis AF2122/97
ggaacaaguagccgucguc

SEQ ID NO: 3070390 - RNA, 18 nt, Mycobacterium bovis subsp bovis AF2122/97
ggaacaaugagaucggga

SEQ ID NO: 3070391 - RNA, 15 nt, Mycobacterium bovis subsp bovis AF2122/97
ggaacaccaccaggc

SEQ ID NO: 3070392 - RNA, 13 nt, Mycobacterium bovis subsp bovis AF2122/97
ggaacacgaugcg

SEQ ID NO: 3070393 - RNA, 19 nt, Mycobacterium bovis subsp bovis AF2122/97
ggaacacgaugcgcggugc

SEQ ID NO: 3070394 - RNA, 15 nt, Mycobacterium bovis subsp bovis AF2122/97
ggaacagccuauucc

SEQ ID NO: 3070395 - RNA, 15 nt, Mycobacterium bovis subsp bovis AF2122/97
ggaacagcuucgcgc

SEQ ID NO: 3070396 - RNA, 13 nt, Mycobacterium bovis subsp bovis AF2122/97
ggaaccaccagca

SEQ ID NO: 3070397 - RNA, 19 nt, Mycobacterium bovis subsp bovis AF2122/97
ggaaccaccagcacggcga

SEQ ID NO: 3070398 - RNA, 22 nt, Mycobacterium bovis subsp bovis AF2122/97
ggaaccaccaguaccaccggca

SEQ ID NO: 3070399 - RNA, 17 nt, Mycobacterium bovis subsp bovis AF2122/97
ggaaccacccaccggcc

SEQ ID NO: 3070400 - RNA, 13 nt, Mycobacterium bovis subsp bovis AF2122/97
ggaaccacggcgc

SEQ ID NO: 3070401 - RNA, 15 nt, Mycobacterium bovis subsp bovis AF2122/97
ggaaccacggcgcag

SEQ ID NO: 3070402 - RNA, 19 nt, Mycobacterium bovis subsp bovis AF2122/97
ggaaccacggucagcacgc

SEQ ID NO: 3070403 - RNA, 17 nt, Mycobacterium bovis subsp bovis AF2122/97
ggaaccagaugaacccc

SEQ ID NO: 3070404 - RNA, 14 nt, Mycobacterium bovis subsp bovis AF2122/97
ggaacccagcacug

SEQ ID NO: 3070405 - RNA, 16 nt, Mycobacterium bovis subsp bovis AF2122/97
ggaacccagcacuggg

SEQ ID NO: 3070406 - RNA, 14 nt, Mycobacterium bovis subsp bovis AF2122/97
ggaacccccagcug

SEQ ID NO: 3070407 - RNA, 10 nt, Mycobacterium bovis subsp bovis AF2122/97
ggaaccccga

SEQ ID NO: 3070408 - RNA, 23 nt, Mycobacterium bovis subsp bovis AF2122/97
ggaacccgaaucccacagcagga

SEQ ID NO: 3070409 - RNA, 22 nt, Mycobacterium bovis subsp bovis AF2122/97
ggaacccuccggacccacccgc

SEQ ID NO: 3070410 - RNA, 17 nt, Mycobacterium bovis subsp bovis AF2122/97
ggaaccgagggccguca

SEQ ID NO: 3070411 - RNA, 17 nt, Mycobacterium bovis subsp bovis AF2122/97
ggaaccgauaccucgcc

SEQ ID NO: 3070412 - RNA, 13 nt, Mycobacterium bovis subsp bovis AF2122/97
ggaaccggcgugc

SEQ ID NO: 3070413 - RNA, 16 nt, Mycobacterium bovis subsp bovis AF2122/97
ggaaccggcgugcagc

SEQ ID NO: 3070414 - RNA, 18 nt, Mycobacterium bovis subsp bovis AF2122/97
ggaaccgggcaaaucaag

SEQ ID NO: 3070415 - RNA, 18 nt, Mycobacterium bovis subsp bovis AF2122/97
ggaaccucgaccgucacc

SEQ ID NO: 3070416 - RNA, 21 nt, Mycobacterium bovis subsp bovis AF2122/97
ggaaccuugaccgaccagcug

SEQ ID NO: 3070417 - RNA, 20 nt, Mycobacterium bovis subsp bovis AF2122/97
ggaacgaaugucaccccgcc

SEQ ID NO: 3070418 - RNA, 24 nt, Mycobacterium bovis subsp bovis AF2122/97
ggaacgaaugucaccccgcccagc

SEQ ID NO: 3070419 - RNA, 13 nt, Mycobacterium bovis subsp bovis AF2122/97
ggaacgaccccac

SEQ ID NO: 3070420 - RNA, 14 nt, Mycobacterium bovis subsp bovis AF2122/97
ggaacgagccacgc

SEQ ID NO: 3070421 - RNA, 15 nt, Mycobacterium bovis subsp bovis AF2122/97
ggaacgaucgaugac

SEQ ID NO: 3070422 - RNA, 16 nt, Mycobacterium bovis subsp bovis AF2122/97
ggaacgaugccgccgg

SEQ ID NO: 3070423 - RNA, 17 nt, Mycobacterium bovis subsp bovis AF2122/97
ggaacgaugccgccggc

SEQ ID NO: 3070424 - RNA, 13 nt, Mycobacterium bovis subsp bovis AF2122/97
ggaacgccgagca

SEQ ID NO: 3070425 - RNA, 13 nt, Mycobacterium bovis subsp bovis AF2122/97
ggaacgccggcau

SEQ ID NO: 3070426 - RNA, 20 nt, Mycobacterium bovis subsp bovis AF2122/97
ggaacgccggcaucgcgcgc

SEQ ID NO: 3070427 - RNA, 19 nt, Mycobacterium bovis subsp bovis AF2122/97
ggaacgccgugccguacgc

SEQ ID NO: 3070428 - RNA, 22 nt, Mycobacterium bovis subsp bovis AF2122/97
ggaacgccgugccguacgccca

SEQ ID NO: 3070429 - RNA, 17 nt, Mycobacterium bovis subsp bovis AF2122/97
ggaacgccucaggggcg

SEQ ID NO: 3070430 - RNA, 12 nt, Mycobacterium bovis subsp bovis AF2122/97
ggaacgcggcga

SEQ ID NO: 3070431 - RNA, 12 nt, Mycobacterium bovis subsp bovis AF2122/97
ggaacgcggcgg

SEQ ID NO: 3070432 - RNA, 18 nt, Mycobacterium bovis subsp bovis AF2122/97
ggaacgcgucgccgacgc

SEQ ID NO: 3070433 - RNA, 18 nt, Mycobacterium bovis subsp bovis AF2122/97
ggaacgcuaaacccgugu

SEQ ID NO: 3070434 - RNA, 15 nt, Mycobacterium bovis subsp bovis AF2122/97
ggaacgcuaggcgau

SEQ ID NO: 3070435 - RNA, 14 nt, Mycobacterium bovis subsp bovis AF2122/97
ggaacgcucgucga

SEQ ID NO: 3070436 - RNA, 18 nt, Mycobacterium bovis subsp bovis AF2122/97
ggaacgcucgucgacagu

SEQ ID NO: 3070437 - RNA, 13 nt, Mycobacterium bovis subsp bovis AF2122/97
ggaacggccagga

SEQ ID NO: 3070438 - RNA, 13 nt, Mycobacterium bovis subsp bovis AF2122/97
ggaacggcgucgu

SEQ ID NO: 3070439 - RNA, 14 nt, Mycobacterium bovis subsp bovis AF2122/97
ggaacggcucggcc

SEQ ID NO: 3070440 - RNA, 17 nt, Mycobacterium bovis subsp bovis AF2122/97
ggaacggugcacagcag

SEQ ID NO: 3070441 - RNA, 20 nt, Mycobacterium bovis subsp bovis AF2122/97
ggaacggugcacagcaguga

SEQ ID NO: 3070442 - RNA, 14 nt, Mycobacterium bovis subsp bovis AF2122/97
ggaacguccagccg

SEQ ID NO: 3070443 - RNA, 18 nt, Mycobacterium bovis subsp bovis AF2122/97
ggaacguccagccguggc

SEQ ID NO: 3070444 - RNA, 20 nt, Mycobacterium bovis subsp bovis AF2122/97
ggaacguccagccguggcgg

SEQ ID NO: 3070445 - RNA, 15 nt, Mycobacterium bovis subsp bovis AF2122/97
ggaacguccgcgccg

SEQ ID NO: 3070446 - RNA, 18 nt, Mycobacterium bovis subsp bovis AF2122/97
ggaacguccgcgccgagc

SEQ ID NO: 3070447 - RNA, 19 nt, Mycobacterium bovis subsp bovis AF2122/97
ggaacguccgcgccgagcc

SEQ ID NO: 3070448 - RNA, 21 nt, Mycobacterium bovis subsp bovis AF2122/97
ggaacgugacccccagcaggg

SEQ ID NO: 3070449 - RNA, 21 nt, Mycobacterium bovis subsp bovis AF2122/97
ggaacguuccugcacagacag

SEQ ID NO: 3070450 - RNA, 19 nt, Mycobacterium bovis subsp bovis AF2122/97
ggaacucgucgcugcccau

SEQ ID NO: 3070451 - RNA, 18 nt, Mycobacterium bovis subsp bovis AF2122/97
ggaacugaaacgcuuggc

SEQ ID NO: 3070452 - RNA, 17 nt, Mycobacterium bovis subsp bovis AF2122/97
ggaacuggaccacagcc

SEQ ID NO: 3070453 - RNA, 20 nt, Mycobacterium bovis subsp bovis AF2122/97
ggaacuguaggucacagcug

SEQ ID NO: 3070454 - RNA, 19 nt, Mycobacterium bovis subsp bovis AF2122/97
ggaacuguggugccugcgg

SEQ ID NO: 3070455 - RNA, 15 nt, Mycobacterium bovis subsp bovis AF2122/97
ggaacuugugccggg

SEQ ID NO: 3070456 - RNA, 20 nt, Mycobacterium bovis subsp bovis AF2122/97
ggacaagcacagcgaacaga

SEQ ID NO: 3070457 - RNA, 15 nt, Mycobacterium bovis subsp bovis AF2122/97
ggacaagccgcugau

SEQ ID NO: 3070458 - RNA, 17 nt, Mycobacterium bovis subsp bovis AF2122/97
ggacaagcuccucgcga

SEQ ID NO: 3070459 - RNA, 17 nt, Mycobacterium bovis subsp bovis AF2122/97
ggacaaggucaucggca

SEQ ID NO: 3070460 - RNA, 22 nt, Mycobacterium bovis subsp bovis AF2122/97
ggacaaggucaucggcauccgc

SEQ ID NO: 3070461 - RNA, 14 nt, Mycobacterium bovis subsp bovis AF2122/97
ggacaagucggcac

SEQ ID NO: 3070462 - RNA, 15 nt, Mycobacterium bovis subsp bovis AF2122/97
ggacaagucggcacc

SEQ ID NO: 3070463 - RNA, 14 nt, Mycobacterium bovis subsp bovis AF2122/97
ggacaagugccggc

SEQ ID NO: 3070464 - RNA, 16 nt, Mycobacterium bovis subsp bovis AF2122/97
ggacaagugccggcgc

SEQ ID NO: 3070465 - RNA, 15 nt, Mycobacterium bovis subsp bovis AF2122/97
ggacaaucucggccg

SEQ ID NO: 3070466 - RNA, 15 nt, Mycobacterium bovis subsp bovis AF2122/97
ggacaauucgacgaa

SEQ ID NO: 3070467 - RNA, 23 nt, Mycobacterium bovis subsp bovis AF2122/97
ggacacaauccacgucgcggcgu

SEQ ID NO: 3070468 - RNA, 19 nt, Mycobacterium bovis subsp bovis AF2122/97
ggacacagcguccgucguc

SEQ ID NO: 3070469 - RNA, 15 nt, Mycobacterium bovis subsp bovis AF2122/97
ggacacauugaccag

SEQ ID NO: 3070470 - RNA, 18 nt, Mycobacterium bovis subsp bovis AF2122/97
ggacacauugaccaggug

SEQ ID NO: 3070471 - RNA, 19 nt, Mycobacterium bovis subsp bovis AF2122/97
ggacaccaacccacccccc

SEQ ID NO: 3070472 - RNA, 15 nt, Mycobacterium bovis subsp bovis AF2122/97
ggacaccaccguggc

SEQ ID NO: 3070473 - RNA, 14 nt, Mycobacterium bovis subsp bovis AF2122/97
ggacaccacgagcg

SEQ ID NO: 3070474 - RNA, 13 nt, Mycobacterium bovis subsp bovis AF2122/97
ggacaccagccag

SEQ ID NO: 3070475 - RNA, 11 nt, Mycobacterium bovis subsp bovis AF2122/97
ggacaccagcu

SEQ ID NO: 3070476 - RNA, 11 nt, Mycobacterium bovis subsp bovis AF2122/97
ggacaccagga

SEQ ID NO: 3070477 - RNA, 19 nt, Mycobacterium bovis subsp bovis AF2122/97
ggacaccaucuccgccguc

SEQ ID NO: 3070478 - RNA, 21 nt, Mycobacterium bovis subsp bovis AF2122/97
ggacaccaucuccgccgucgc

SEQ ID NO: 3070479 - RNA, 15 nt, Mycobacterium bovis subsp bovis AF2122/97
ggacaccgcggcgau

SEQ ID NO: 3070480 - RNA, 18 nt, Mycobacterium bovis subsp bovis AF2122/97
ggacaccgcggcgaucug

SEQ ID NO: 3070481 - RNA, 12 nt, Mycobacterium bovis subsp bovis AF2122/97
ggacaccgugga

SEQ ID NO: 3070482 - RNA, 23 nt, Mycobacterium bovis subsp bovis AF2122/97
ggacaccguggaucggcagcccg

SEQ ID NO: 3070483 - RNA, 15 nt, Mycobacterium bovis subsp bovis AF2122/97
ggacaccugcugcac

SEQ ID NO: 3070484 - RNA, 16 nt, Mycobacterium bovis subsp bovis AF2122/97
ggacaccugcugcacc

SEQ ID NO: 3070485 - RNA, 21 nt, Mycobacterium bovis subsp bovis AF2122/97
ggacaccuguaguucgaugac

SEQ ID NO: 3070486 - RNA, 17 nt, Mycobacterium bovis subsp bovis AF2122/97
ggacacguugcgacguc

SEQ ID NO: 3070487 - RNA, 13 nt, Mycobacterium bovis subsp bovis AF2122/97
ggacacuccugca

SEQ ID NO: 3070488 - RNA, 20 nt, Mycobacterium bovis subsp bovis AF2122/97
ggacagaugcauccagcugc

SEQ ID NO: 3070489 - RNA, 15 nt, Mycobacterium bovis subsp bovis AF2122/97
ggacagauggcggcc

SEQ ID NO: 3070490 - RNA, 15 nt, Mycobacterium bovis subsp bovis AF2122/97
ggacagcagcagauc

SEQ ID NO: 3070491 - RNA, 11 nt, Mycobacterium bovis subsp bovis AF2122/97
ggacagcagcc

SEQ ID NO: 3070492 - RNA, 18 nt, Mycobacterium bovis subsp bovis AF2122/97
ggacagcagccgccggcc

SEQ ID NO: 3070493 - RNA, 20 nt, Mycobacterium bovis subsp bovis AF2122/97
ggacagcagccgccggccgg

SEQ ID NO: 3070494 - RNA, 22 nt, Mycobacterium bovis subsp bovis AF2122/97
ggacagcagccgccggccggca

SEQ ID NO: 3070495 - RNA, 16 nt, Mycobacterium bovis subsp bovis AF2122/97
ggacagcagccggcgu

SEQ ID NO: 3070496 - RNA, 12 nt, Mycobacterium bovis subsp bovis AF2122/97
ggacagcgaguu

SEQ ID NO: 3070497 - RNA, 11 nt, Mycobacterium bovis subsp bovis AF2122/97
ggacagcgccg

SEQ ID NO: 3070498 - RNA, 16 nt, Mycobacterium bovis subsp bovis AF2122/97
ggacagcgccuggccg

SEQ ID NO: 3070499 - RNA, 17 nt, Mycobacterium bovis subsp bovis AF2122/97
ggacagcgccuggccgg

SEQ ID NO: 3070500 - RNA, 15 nt, Mycobacterium bovis subsp bovis AF2122/97
ggacagcuguugauu

SEQ ID NO: 3070501 - RNA, 15 nt, Mycobacterium bovis subsp bovis AF2122/97
ggacaggauauugac

SEQ ID NO: 3070502 - RNA, 13 nt, Mycobacterium bovis subsp bovis AF2122/97
ggacagggcggca

SEQ ID NO: 3070503 - RNA, 19 nt, Mycobacterium bovis subsp bovis AF2122/97
ggacagggcggcaacggcg

SEQ ID NO: 3070504 - RNA, 13 nt, Mycobacterium bovis subsp bovis AF2122/97
ggacagggcggcg

SEQ ID NO: 3070505 - RNA, 12 nt, Mycobacterium bovis subsp bovis AF2122/97
ggacagggugcg

SEQ ID NO: 3070506 - RNA, 14 nt, Mycobacterium bovis subsp bovis AF2122/97
ggacagggugcgcu

SEQ ID NO: 3070507 - RNA, 16 nt, Mycobacterium bovis subsp bovis AF2122/97
ggacagggugcgcuug

SEQ ID NO: 3070508 - RNA, 18 nt, Mycobacterium bovis subsp bovis AF2122/97
ggacagguaacgcgguuc

SEQ ID NO: 3070509 - RNA, 21 nt, Mycobacterium bovis subsp bovis AF2122/97
ggacaggucgaaugggggcug

SEQ ID NO: 3070510 - RNA, 15 nt, Mycobacterium bovis subsp bovis AF2122/97
ggacaggucgcccaa

SEQ ID NO: 3070511 - RNA, 18 nt, Mycobacterium bovis subsp bovis AF2122/97
ggacaggucgcccaacac

SEQ ID NO: 3070512 - RNA, 21 nt, Mycobacterium bovis subsp bovis AF2122/97
ggacaggucgcccaacaccgc

SEQ ID NO: 3070513 - RNA, 20 nt, Mycobacterium bovis subsp bovis AF2122/97
ggacaggucggggcgucguu

SEQ ID NO: 3070514 - RNA, 20 nt, Mycobacterium bovis subsp bovis AF2122/97
ggacaguuccccgggcucgg

SEQ ID NO: 3070515 - RNA, 14 nt, Mycobacterium bovis subsp bovis AF2122/97
ggacauaccggccc

SEQ ID NO: 3070516 - RNA, 20 nt, Mycobacterium bovis subsp bovis AF2122/97
ggacauccgcuuacgggugu

SEQ ID NO: 3070517 - RNA, 13 nt, Mycobacterium bovis subsp bovis AF2122/97
ggacauccggcgc

SEQ ID NO: 3070518 - RNA, 15 nt, Mycobacterium bovis subsp bovis AF2122/97
ggacauccggcgccg

SEQ ID NO: 3070519 - RNA, 18 nt, Mycobacterium bovis subsp bovis AF2122/97
ggacauccgggccgagcg

SEQ ID NO: 3070520 - RNA, 22 nt, Mycobacterium bovis subsp bovis AF2122/97
ggacauccgggccgagcgcacc

SEQ ID NO: 3070521 - RNA, 16 nt, Mycobacterium bovis subsp bovis AF2122/97
ggacaucggccggcgu

SEQ ID NO: 3070522 - RNA, 21 nt, Mycobacterium bovis subsp bovis AF2122/97
ggacaugacagccccgccgcc

SEQ ID NO: 3070523 - RNA, 14 nt, Mycobacterium bovis subsp bovis AF2122/97
ggacaugcgggcag

SEQ ID NO: 3070524 - RNA, 20 nt, Mycobacterium bovis subsp bovis AF2122/97
ggacaugcgggcagcacucu

SEQ ID NO: 3070525 - RNA, 16 nt, Mycobacterium bovis subsp bovis AF2122/97
ggaccaacgccaacgc

SEQ ID NO: 3070526 - RNA, 17 nt, Mycobacterium bovis subsp bovis AF2122/97
ggaccaacgccaacgcc

SEQ ID NO: 3070527 - RNA, 15 nt, Mycobacterium bovis subsp bovis AF2122/97
ggaccacaccgucac

SEQ ID NO: 3070528 - RNA, 18 nt, Mycobacterium bovis subsp bovis AF2122/97
ggaccacaccgucaccga

SEQ ID NO: 3070529 - RNA, 21 nt, Mycobacterium bovis subsp bovis AF2122/97
ggaccaccacuaggucgccgg

SEQ ID NO: 3070530 - RNA, 12 nt, Mycobacterium bovis subsp bovis AF2122/97
ggaccaccagcg

SEQ ID NO: 3070531 - RNA, 14 nt, Mycobacterium bovis subsp bovis AF2122/97
ggaccaccagcgcu

SEQ ID NO: 3070532 - RNA, 22 nt, Mycobacterium bovis subsp bovis AF2122/97
ggaccaccagcgcuccagcacc

SEQ ID NO: 3070533 - RNA, 16 nt, Mycobacterium bovis subsp bovis AF2122/97
ggaccaccgccgaagc

SEQ ID NO: 3070534 - RNA, 14 nt, Mycobacterium bovis subsp bovis AF2122/97
ggaccaccgcucgc

SEQ ID NO: 3070535 - RNA, 16 nt, Mycobacterium bovis subsp bovis AF2122/97
ggaccaccgggauggc

SEQ ID NO: 3070536 - RNA, 12 nt, Mycobacterium bovis subsp bovis AF2122/97
ggaccacggcgu

SEQ ID NO: 3070537 - RNA, 20 nt, Mycobacterium bovis subsp bovis AF2122/97
ggaccacgugaucgacgacc

SEQ ID NO: 3070538 - RNA, 14 nt, Mycobacterium bovis subsp bovis AF2122/97
ggaccacucgccgg

SEQ ID NO: 3070539 - RNA, 16 nt, Mycobacterium bovis subsp bovis AF2122/97
ggaccacucgccggcg

SEQ ID NO: 3070540 - RNA, 14 nt, Mycobacterium bovis subsp bovis AF2122/97
ggaccacuguuggu

SEQ ID NO: 3070541 - RNA, 15 nt, Mycobacterium bovis subsp bovis AF2122/97
ggaccagaguggugg

SEQ ID NO: 3070542 - RNA, 18 nt, Mycobacterium bovis subsp bovis AF2122/97
ggaccagagugguggcga

SEQ ID NO: 3070543 - RNA, 13 nt, Mycobacterium bovis subsp bovis AF2122/97
ggacgacccgggc

SEQ ID NO: 3070544 - RNA, 14 nt, Mycobacterium bovis subsp bovis AF2122/97
ggacgacccgggcc

SEQ ID NO: 3070545 - RNA, 16 nt, Mycobacterium bovis subsp bovis AF2122/97
ggacgacccgggccgg

SEQ ID NO: 3070546 - RNA, 21 nt, Mycobacterium bovis subsp bovis AF2122/97
ggacgacccgggccggucggu

SEQ ID NO: 3070547 - RNA, 13 nt, Mycobacterium bovis subsp bovis AF2122/97
ggacgaccgcgcg

SEQ ID NO: 3070548 - RNA, 17 nt, Mycobacterium bovis subsp bovis AF2122/97
ggacgacgaucaagccu

SEQ ID NO: 3070549 - RNA, 19 nt, Mycobacterium bovis subsp bovis AF2122/97
ggacgacgccgacgaugac

SEQ ID NO: 3070550 - RNA, 17 nt, Mycobacterium bovis subsp bovis AF2122/97
ggacgauacgcgcaccg

SEQ ID NO: 3070551 - RNA, 21 nt, Mycobacterium bovis subsp bovis AF2122/97
ggacgauacgcgcaccguggc

SEQ ID NO: 3070552 - RNA, 23 nt, Mycobacterium bovis subsp bovis AF2122/97
ggacgaucaacccgguccagccg

SEQ ID NO: 3070553 - RNA, 15 nt, Mycobacterium bovis subsp bovis AF2122/97
ggacgaugaugauca

SEQ ID NO: 3070554 - RNA, 17 nt, Mycobacterium bovis subsp bovis AF2122/97
ggacgauuccgcccaca

SEQ ID NO: 3070555 - RNA, 19 nt, Mycobacterium bovis subsp bovis AF2122/97
ggacgcagagucaacgaac

SEQ ID NO: 3070556 - RNA, 12 nt, Mycobacterium bovis subsp bovis AF2122/97
ggacgccacgga

SEQ ID NO: 3070557 - RNA, 13 nt, Mycobacterium bovis subsp bovis AF2122/97
ggacgccagcaau

SEQ ID NO: 3070558 - RNA, 22 nt, Mycobacterium bovis subsp bovis AF2122/97
ggacgccagcaaugcccgcacc

SEQ ID NO: 3070559 - RNA, 17 nt, Mycobacterium bovis subsp bovis AF2122/97
ggacgccauggugaacg

SEQ ID NO: 3070560 - RNA, 22 nt, Mycobacterium bovis subsp bovis AF2122/97
ggacgcccacaugcucagggca

SEQ ID NO: 3070561 - RNA, 20 nt, Mycobacterium bovis subsp bovis AF2122/97
ggacgccccgucuggcauga

SEQ ID NO: 3070562 - RNA, 20 nt, Mycobacterium bovis subsp bovis AF2122/97
ggacgcccgaguugaagaau

SEQ ID NO: 3070563 - RNA, 21 nt, Mycobacterium bovis subsp bovis AF2122/97
ggacgcccgcccgcacgacga

SEQ ID NO: 3070564 - RNA, 22 nt, Mycobacterium bovis subsp bovis AF2122/97
ggacgcccgcccgcacgacgaa

SEQ ID NO: 3070565 - RNA, 16 nt, Mycobacterium bovis subsp bovis AF2122/97
ggacgcccgugcggcu

SEQ ID NO: 3070566 - RNA, 22 nt, Mycobacterium bovis subsp bovis AF2122/97
ggacgcccgugcggcucgccgg

SEQ ID NO: 3070567 - RNA, 12 nt, Mycobacterium bovis subsp bovis AF2122/97
ggacgccgcgcc

SEQ ID NO: 3070568 - RNA, 14 nt, Mycobacterium bovis subsp bovis AF2122/97
ggacgccgcggcgc

SEQ ID NO: 3070569 - RNA, 15 nt, Mycobacterium bovis subsp bovis AF2122/97
ggacgccgcggcgcc

SEQ ID NO: 3070570 - RNA, 17 nt, Mycobacterium bovis subsp bovis AF2122/97
ggacgccgcggcgccgg

SEQ ID NO: 3070571 - RNA, 21 nt, Mycobacterium bovis subsp bovis AF2122/97
ggacgccgcggcgccgguggg

SEQ ID NO: 3070572 - RNA, 15 nt, Mycobacterium bovis subsp bovis AF2122/97
ggacgccuugcacaa

SEQ ID NO: 3070573 - RNA, 20 nt, Mycobacterium bovis subsp bovis AF2122/97
ggacgcgaaauccccugcgc

SEQ ID NO: 3070574 - RNA, 12 nt, Mycobacterium bovis subsp bovis AF2122/97
ggacgcgagugc

SEQ ID NO: 3070575 - RNA, 16 nt, Mycobacterium bovis subsp bovis AF2122/97
ggacgcgagugcguga

SEQ ID NO: 3070576 - RNA, 17 nt, Mycobacterium bovis subsp bovis AF2122/97
ggacgcgaugaccgcac

SEQ ID NO: 3070577 - RNA, 17 nt, Mycobacterium bovis subsp bovis AF2122/97
ggacgcgaugaucauga

SEQ ID NO: 3070578 - RNA, 12 nt, Mycobacterium bovis subsp bovis AF2122/97
ggacgcgcagca

SEQ ID NO: 3070579 - RNA, 14 nt, Mycobacterium bovis subsp bovis AF2122/97
ggacgcgccggcgu

SEQ ID NO: 3070580 - RNA, 19 nt, Mycobacterium bovis subsp bovis AF2122/97
ggacgcgcggauggccucg

SEQ ID NO: 3070581 - RNA, 21 nt, Mycobacterium bovis subsp bovis AF2122/97
ggacgcgcggauuucgccgug

SEQ ID NO: 3070582 - RNA, 22 nt, Mycobacterium bovis subsp bovis AF2122/97
ggacgcggccaauggccgcggc

SEQ ID NO: 3070583 - RNA, 12 nt, Mycobacterium bovis subsp bovis AF2122/97
ggacgcgggccg

SEQ ID NO: 3070584 - RNA, 14 nt, Mycobacterium bovis subsp bovis AF2122/97
ggacgcugaucgaa

SEQ ID NO: 3070585 - RNA, 21 nt, Mycobacterium bovis subsp bovis AF2122/97
ggacggagcccaaaaccgcga

SEQ ID NO: 3070586 - RNA, 16 nt, Mycobacterium bovis subsp bovis AF2122/97
ggacggauaguucacc

SEQ ID NO: 3070587 - RNA, 15 nt, Mycobacterium bovis subsp bovis AF2122/97
ggacggcaccggccc

SEQ ID NO: 3070588 - RNA, 19 nt, Mycobacterium bovis subsp bovis AF2122/97
ggacggcagccaccagcga

SEQ ID NO: 3070589 - RNA, 17 nt, Mycobacterium bovis subsp bovis AF2122/97
ggacggcagccgggcgg

SEQ ID NO: 3070590 - RNA, 14 nt, Mycobacterium bovis subsp bovis AF2122/97
ggacggcaggcggc

SEQ ID NO: 3070591 - RNA, 17 nt, Mycobacterium bovis subsp bovis AF2122/97
ggacggcaggcuggcga

SEQ ID NO: 3070592 - RNA, 18 nt, Mycobacterium bovis subsp bovis AF2122/97
ggacggcaggcuggcgag

SEQ ID NO: 3070593 - RNA, 16 nt, Mycobacterium bovis subsp bovis AF2122/97
ggacggcauagcagcc

SEQ ID NO: 3070594 - RNA, 17 nt, Mycobacterium bovis subsp bovis AF2122/97
ggacggccaacagggcg

SEQ ID NO: 3070595 - RNA, 16 nt, Mycobacterium bovis subsp bovis AF2122/97
ggacggccaucgccag

SEQ ID NO: 3070596 - RNA, 15 nt, Mycobacterium bovis subsp bovis AF2122/97
ggacggcgcgagccg

SEQ ID NO: 3070597 - RNA, 14 nt, Mycobacterium bovis subsp bovis AF2122/97
ggacggcgggccgc

SEQ ID NO: 3070598 - RNA, 16 nt, Mycobacterium bovis subsp bovis AF2122/97
ggacggcgggccgcgc

SEQ ID NO: 3070599 - RNA, 18 nt, Mycobacterium bovis subsp bovis AF2122/97
ggacggcgggccgcgcgg

SEQ ID NO: 3070600 - RNA, 21 nt, Mycobacterium bovis subsp bovis AF2122/97
ggacggcgggccgcgcggcga

SEQ ID NO: 3070601 - RNA, 16 nt, Mycobacterium bovis subsp bovis AF2122/97
ggacggcguagacguc

SEQ ID NO: 3070602 - RNA, 21 nt, Mycobacterium bovis subsp bovis AF2122/97
ggacggcguuuccuucgacga

SEQ ID NO: 3070603 - RNA, 22 nt, Mycobacterium bovis subsp bovis AF2122/97
ggacggcuugagccgcagcacc

SEQ ID NO: 3070604 - RNA, 17 nt, Mycobacterium bovis subsp bovis AF2122/97
ggacgggaugcuugguc

SEQ ID NO: 3070605 - RNA, 21 nt, Mycobacterium bovis subsp bovis AF2122/97
ggacgggaugcuuggucucga

SEQ ID NO: 3070606 - RNA, 17 nt, Mycobacterium bovis subsp bovis AF2122/97
ggacgggcgcgucggcg

SEQ ID NO: 3070607 - RNA, 12 nt, Mycobacterium bovis subsp bovis AF2122/97
ggacgggcggcc

SEQ ID NO: 3070608 - RNA, 12 nt, Mycobacterium bovis subsp bovis AF2122/97
ggacggggaggu

SEQ ID NO: 3070609 - RNA, 19 nt, Mycobacterium bovis subsp bovis AF2122/97
ggacgggggcuguccaccg

SEQ ID NO: 3070610 - RNA, 17 nt, Mycobacterium bovis subsp bovis AF2122/97
ggacgggguacugcggc

SEQ ID NO: 3070611 - RNA, 13 nt, Mycobacterium bovis subsp bovis AF2122/97
ggacgggucggca

SEQ ID NO: 3070612 - RNA, 18 nt, Mycobacterium bovis subsp bovis AF2122/97
ggacgggucucgcgagcg

SEQ ID NO: 3070613 - RNA, 14 nt, Mycobacterium bovis subsp bovis AF2122/97
ggacgggugcagcg

SEQ ID NO: 3070614 - RNA, 21 nt, Mycobacterium bovis subsp bovis AF2122/97
ggacggucauccggccgucgg

SEQ ID NO: 3070615 - RNA, 22 nt, Mycobacterium bovis subsp bovis AF2122/97
ggacggucauccggccgucggc

SEQ ID NO: 3070616 - RNA, 12 nt, Mycobacterium bovis subsp bovis AF2122/97
ggacggucgcca

SEQ ID NO: 3070617 - RNA, 13 nt, Mycobacterium bovis subsp bovis AF2122/97
ggacggucgccag

SEQ ID NO: 3070618 - RNA, 14 nt, Mycobacterium bovis subsp bovis AF2122/97
ggacggucgcucgg

SEQ ID NO: 3070619 - RNA, 18 nt, Mycobacterium bovis subsp bovis AF2122/97
ggacggucgcucggcaug

SEQ ID NO: 3070620 - RNA, 13 nt, Mycobacterium bovis subsp bovis AF2122/97
ggacggugaaacc

SEQ ID NO: 3070621 - RNA, 18 nt, Mycobacterium bovis subsp bovis AF2122/97
ggacggugaaaccggccu

SEQ ID NO: 3070622 - RNA, 16 nt, Mycobacterium bovis subsp bovis AF2122/97
ggacggugcgcagggc

SEQ ID NO: 3070623 - RNA, 21 nt, Mycobacterium bovis subsp bovis AF2122/97
ggacgguguacaggucgccgg

SEQ ID NO: 3070624 - RNA, 19 nt, Mycobacterium bovis subsp bovis AF2122/97
ggacgguugguccgccguc

SEQ ID NO: 3070625 - RNA, 21 nt, Mycobacterium bovis subsp bovis AF2122/97
ggacgguugguccgccgucga

SEQ ID NO: 3070626 - RNA, 21 nt, Mycobacterium bovis subsp bovis AF2122/97
ggacguaggcaccccggugcc

SEQ ID NO: 3070627 - RNA, 23 nt, Mycobacterium bovis subsp bovis AF2122/97
ggacgucaccgucaguucggugu

SEQ ID NO: 3070628 - RNA, 15 nt, Mycobacterium bovis subsp bovis AF2122/97
ggacgucggcgaauc

SEQ ID NO: 3070629 - RNA, 14 nt, Mycobacterium bovis subsp bovis AF2122/97
ggacgucggcgaua

SEQ ID NO: 3070630 - RNA, 23 nt, Mycobacterium bovis subsp bovis AF2122/97
ggagccgcccaagccgccggcgc

SEQ ID NO: 3070631 - RNA, 13 nt, Mycobacterium bovis subsp bovis AF2122/97
ggagccgccggcg

SEQ ID NO: 3070632 - RNA, 16 nt, Mycobacterium bovis subsp bovis AF2122/97
ggagccgccggcggug

SEQ ID NO: 3070633 - RNA, 20 nt, Mycobacterium bovis subsp bovis AF2122/97
ggagccggccaccucggugc

SEQ ID NO: 3070634 - RNA, 22 nt, Mycobacterium bovis subsp bovis AF2122/97
ggagccggccaccucggugcgg

SEQ ID NO: 3070635 - RNA, 12 nt, Mycobacterium bovis subsp bovis AF2122/97
ggagccggcgca

SEQ ID NO: 3070636 - RNA, 22 nt, Mycobacterium bovis subsp bovis AF2122/97
ggagccgggccguccggguaga

SEQ ID NO: 3070637 - RNA, 22 nt, Mycobacterium bovis subsp bovis AF2122/97
ggagccgggugaggcgggucgc

SEQ ID NO: 3070638 - RNA, 13 nt, Mycobacterium bovis subsp bovis AF2122/97
ggagccgucacgc

SEQ ID NO: 3070639 - RNA, 17 nt, Mycobacterium bovis subsp bovis AF2122/97
ggagccgucgagcagcc

SEQ ID NO: 3070640 - RNA, 22 nt, Mycobacterium bovis subsp bovis AF2122/97
ggagccgucgcaucaggucggu

SEQ ID NO: 3070641 - RNA, 16 nt, Mycobacterium bovis subsp bovis AF2122/97
ggagccgugcggucgc

SEQ ID NO: 3070642 - RNA, 13 nt, Mycobacterium bovis subsp bovis AF2122/97
ggagccuccagcg

SEQ ID NO: 3070643 - RNA, 20 nt, Mycobacterium bovis subsp bovis AF2122/97
ggagccuugguagccggccg

SEQ ID NO: 3070644 - RNA, 21 nt, Mycobacterium bovis subsp bovis AF2122/97
ggagcgcaccugaaggcggcg

SEQ ID NO: 3070645 - RNA, 22 nt, Mycobacterium bovis subsp bovis AF2122/97
ggagcgcaccugaaggcggcga

SEQ ID NO: 3070646 - RNA, 15 nt, Mycobacterium bovis subsp bovis AF2122/97
ggagcgccagccgcu

SEQ ID NO: 3070647 - RNA, 17 nt, Mycobacterium bovis subsp bovis AF2122/97
ggagcgccagccgcugc

SEQ ID NO: 3070648 - RNA, 12 nt, Mycobacterium bovis subsp bovis AF2122/97
ggagcgccgagc

SEQ ID NO: 3070649 - RNA, 18 nt, Mycobacterium bovis subsp bovis AF2122/97
ggagcgcgaugaccucgg

SEQ ID NO: 3070650 - RNA, 21 nt, Mycobacterium bovis subsp bovis AF2122/97
ggagcgcgaugaccucggcga

SEQ ID NO: 3070651 - RNA, 20 nt, Mycobacterium bovis subsp bovis AF2122/97
ggagcgcgccucgcccagca

SEQ ID NO: 3070652 - RNA, 15 nt, Mycobacterium bovis subsp bovis AF2122/97
ggagcgcggcccgcc

SEQ ID NO: 3070653 - RNA, 17 nt, Mycobacterium bovis subsp bovis AF2122/97
ggagcgcggcccgccuc

SEQ ID NO: 3070654 - RNA, 18 nt, Mycobacterium bovis subsp bovis AF2122/97
ggagcggaauggcgccgg

SEQ ID NO: 3070655 - RNA, 24 nt, Mycobacterium bovis subsp bovis AF2122/97
ggagcggaauggcgccggccggcg

SEQ ID NO: 3070656 - RNA, 22 nt, Mycobacterium bovis subsp bovis AF2122/97
ggagcggaguguagacaggacc

SEQ ID NO: 3070657 - RNA, 13 nt, Mycobacterium bovis subsp bovis AF2122/97
ggagcggccgccg

SEQ ID NO: 3070658 - RNA, 16 nt, Mycobacterium bovis subsp bovis AF2122/97
ggagcggcgcgggggu

SEQ ID NO: 3070659 - RNA, 12 nt, Mycobacterium bovis subsp bovis AF2122/97
ggagcggcugca

SEQ ID NO: 3070660 - RNA, 13 nt, Mycobacterium bovis subsp bovis AF2122/97
ggagcggcugcac

SEQ ID NO: 3070661 - RNA, 14 nt, Mycobacterium bovis subsp bovis AF2122/97
ggagcggcugcacg

SEQ ID NO: 3070662 - RNA, 17 nt, Mycobacterium bovis subsp bovis AF2122/97
ggagcggcugcacgccu

SEQ ID NO: 3070663 - RNA, 13 nt, Mycobacterium bovis subsp bovis AF2122/97
ggagcggcugcgg

SEQ ID NO: 3070664 - RNA, 18 nt, Mycobacterium bovis subsp bovis AF2122/97
ggagcgggauucuggcgc

SEQ ID NO: 3070665 - RNA, 17 nt, Mycobacterium bovis subsp bovis AF2122/97
ggagcgggccagcaccc

SEQ ID NO: 3070666 - RNA, 20 nt, Mycobacterium bovis subsp bovis AF2122/97
ggagcggguccccaccgguu

SEQ ID NO: 3070667 - RNA, 14 nt, Mycobacterium bovis subsp bovis AF2122/97
ggagcgggugcggg

SEQ ID NO: 3070668 - RNA, 17 nt, Mycobacterium bovis subsp bovis AF2122/97
ggagcggguggccggga

SEQ ID NO: 3070669 - RNA, 18 nt, Mycobacterium bovis subsp bovis AF2122/97
ggagcggguggccgggau

SEQ ID NO: 3070670 - RNA, 16 nt, Mycobacterium bovis subsp bovis AF2122/97
ggagcggugccgacgg

SEQ ID NO: 3070671 - RNA, 15 nt, Mycobacterium bovis subsp bovis AF2122/97
ggagcgugcacgggg

SEQ ID NO: 3070672 - RNA, 15 nt, Mycobacterium bovis subsp bovis AF2122/97
ggagcgugucggccg

SEQ ID NO: 3070673 - RNA, 15 nt, Mycobacterium bovis subsp bovis AF2122/97
ggagcucgcggcgca

SEQ ID NO: 3070674 - RNA, 19 nt, Mycobacterium bovis subsp bovis AF2122/97
ggagcucuugcgggcagcc

SEQ ID NO: 3070675 - RNA, 22 nt, Mycobacterium bovis subsp bovis AF2122/97
ggagcucuugcgggcagccgcc

SEQ ID NO: 3070676 - RNA, 15 nt, Mycobacterium bovis subsp bovis AF2122/97
ggagcugaucacgca

SEQ ID NO: 3070677 - RNA, 19 nt, Mycobacterium bovis subsp bovis AF2122/97
ggagcugggcugauggacg

SEQ ID NO: 3070678 - RNA, 14 nt, Mycobacterium bovis subsp bovis AF2122/97
ggaggaaccccgcg

SEQ ID NO: 3070679 - RNA, 18 nt, Mycobacterium bovis subsp bovis AF2122/97
ggaggaaggucgaaucgc

SEQ ID NO: 3070680 - RNA, 13 nt, Mycobacterium bovis subsp bovis AF2122/97
ggaggcagcgcga

SEQ ID NO: 3070681 - RNA, 16 nt, Mycobacterium bovis subsp bovis AF2122/97
ggaggccaacccugcg

SEQ ID NO: 3070682 - RNA, 23 nt, Mycobacterium bovis subsp bovis AF2122/97
ggaggccaacccugcggcgucgu

SEQ ID NO: 3070683 - RNA, 13 nt, Mycobacterium bovis subsp bovis AF2122/97
ggaggccaucauc

SEQ ID NO: 3070684 - RNA, 15 nt, Mycobacterium bovis subsp bovis AF2122/97
ggaggccaucauccc

SEQ ID NO: 3070685 - RNA, 20 nt, Mycobacterium bovis subsp bovis AF2122/97
ggaggcccgccacaacggcg

SEQ ID NO: 3070686 - RNA, 18 nt, Mycobacterium bovis subsp bovis AF2122/97
ggaggcggaccaggccgc

SEQ ID NO: 3070687 - RNA, 17 nt, Mycobacterium bovis subsp bovis AF2122/97
ggaggcguugcacugcu

SEQ ID NO: 3070688 - RNA, 12 nt, Mycobacterium bovis subsp bovis AF2122/97
ggaggcugggcu

SEQ ID NO: 3070689 - RNA, 18 nt, Mycobacterium bovis subsp bovis AF2122/97
ggagggcccggccggacg

SEQ ID NO: 3070690 - RNA, 17 nt, Mycobacterium bovis subsp bovis AF2122/97
ggagggccgcgaucgac

SEQ ID NO: 3070691 - RNA, 12 nt, Mycobacterium bovis subsp bovis AF2122/97
ggagggcgagca

SEQ ID NO: 3070692 - RNA, 21 nt, Mycobacterium bovis subsp bovis AF2122/97
ggagggcgagcaacucgucca

SEQ ID NO: 3070693 - RNA, 17 nt, Mycobacterium bovis subsp bovis AF2122/97
ggaggggacccagcggc

SEQ ID NO: 3070694 - RNA, 23 nt, Mycobacterium bovis subsp bovis AF2122/97
ggaggguucgccgaagccggacc

SEQ ID NO: 3070695 - RNA, 15 nt, Mycobacterium bovis subsp bovis AF2122/97
ggaggguugccgccg

SEQ ID NO: 3070696 - RNA, 15 nt, Mycobacterium bovis subsp bovis AF2122/97
ggaggugcgccgcgg

SEQ ID NO: 3070697 - RNA, 21 nt, Mycobacterium bovis subsp bovis AF2122/97
ggaggugguucacggggacca

SEQ ID NO: 3070698 - RNA, 19 nt, Mycobacterium bovis subsp bovis AF2122/97
ggaguacgggagccggcug

SEQ ID NO: 3070699 - RNA, 15 nt, Mycobacterium bovis subsp bovis AF2122/97
ggaguagccgcagcu

SEQ ID NO: 3070700 - RNA, 21 nt, Mycobacterium bovis subsp bovis AF2122/97
ggaguagccgcagcugagccg

SEQ ID NO: 3070701 - RNA, 17 nt, Mycobacterium bovis subsp bovis AF2122/97
ggaguaggugugcggga

SEQ ID NO: 3070702 - RNA, 16 nt, Mycobacterium bovis subsp bovis AF2122/97
ggaguaguggugggcg

SEQ ID NO: 3070703 - RNA, 13 nt, Mycobacterium bovis subsp bovis AF2122/97
ggagucaccagca

SEQ ID NO: 3070704 - RNA, 15 nt, Mycobacterium bovis subsp bovis AF2122/97
ggagucaccagcaac

SEQ ID NO: 3070705 - RNA, 14 nt, Mycobacterium bovis subsp bovis AF2122/97
ggagucacgcagcc

SEQ ID NO: 3070706 - RNA, 13 nt, Mycobacterium bovis subsp bovis AF2122/97
ggagucccaccau

SEQ ID NO: 3070707 - RNA, 19 nt, Mycobacterium bovis subsp bovis AF2122/97
ggaguccgucgacaccgcg

SEQ ID NO: 3070708 - RNA, 16 nt, Mycobacterium bovis subsp bovis AF2122/97
ggagucgacccugccc

SEQ ID NO: 3070709 - RNA, 23 nt, Mycobacterium bovis subsp bovis AF2122/97
ggagucgacccugcccagcaccc

SEQ ID NO: 3070710 - RNA, 14 nt, Mycobacterium bovis subsp bovis AF2122/97
ggagucgacgacgu

SEQ ID NO: 3070711 - RNA, 22 nt, Mycobacterium bovis subsp bovis AF2122/97
ggagucgacgguuugcaccgcg

SEQ ID NO: 3070712 - RNA, 19 nt, Mycobacterium bovis subsp bovis AF2122/97
ggagucgaucagcuugggc

SEQ ID NO: 3070713 - RNA, 15 nt, Mycobacterium bovis subsp bovis AF2122/97
ggagucgcccggucc

SEQ ID NO: 3070714 - RNA, 16 nt, Mycobacterium bovis subsp bovis AF2122/97
ggagucgcgcagggcg

SEQ ID NO: 3070715 - RNA, 17 nt, Mycobacterium bovis subsp bovis AF2122/97
ggagucgguaucggcag

SEQ ID NO: 3070716 - RNA, 20 nt, Mycobacterium bovis subsp bovis AF2122/97
ggagucgucggcaugggccg

SEQ ID NO: 3070717 - RNA, 12 nt, Mycobacterium bovis subsp bovis AF2122/97
ggauccggcggc

SEQ ID NO: 3070718 - RNA, 13 nt, Mycobacterium bovis subsp bovis AF2122/97
ggauccggcggca

SEQ ID NO: 3070719 - RNA, 19 nt, Mycobacterium bovis subsp bovis AF2122/97
ggauccgggcgugguggau

SEQ ID NO: 3070720 - RNA, 17 nt, Mycobacterium bovis subsp bovis AF2122/97
ggauccguagaaggcga

SEQ ID NO: 3070721 - RNA, 22 nt, Mycobacterium bovis subsp bovis AF2122/97
ggauccuccggguuggcgacga

SEQ ID NO: 3070722 - RNA, 16 nt, Mycobacterium bovis subsp bovis AF2122/97
ggaucgaagaccagca

SEQ ID NO: 3070723 - RNA, 18 nt, Mycobacterium bovis subsp bovis AF2122/97
ggaucgaagaccagcaac

SEQ ID NO: 3070724 - RNA, 17 nt, Mycobacterium bovis subsp bovis AF2122/97
ggaucgacaccgacgcg

SEQ ID NO: 3070725 - RNA, 24 nt, Mycobacterium bovis subsp bovis AF2122/97
ggaucgaccaauucgaccgcgcgg

SEQ ID NO: 3070726 - RNA, 19 nt, Mycobacterium bovis subsp bovis AF2122/97
ggaucgaccauggucgauu

SEQ ID NO: 3070727 - RNA, 14 nt, Mycobacterium bovis subsp bovis AF2122/97
ggaucgaccgccag

SEQ ID NO: 3070728 - RNA, 19 nt, Mycobacterium bovis subsp bovis AF2122/97
ggaucgaccgccagcgccg

SEQ ID NO: 3070729 - RNA, 18 nt, Mycobacterium bovis subsp bovis AF2122/97
ggaucgacuucgacgaca

SEQ ID NO: 3070730 - RNA, 22 nt, Mycobacterium bovis subsp bovis AF2122/97
ggaucgacuucgacgacacguu

SEQ ID NO: 3070731 - RNA, 17 nt, Mycobacterium bovis subsp bovis AF2122/97
ggaucgagagccgaccg

SEQ ID NO: 3070732 - RNA, 19 nt, Mycobacterium bovis subsp bovis AF2122/97
ggaucgagagccgaccggg

SEQ ID NO: 3070733 - RNA, 20 nt, Mycobacterium bovis subsp bovis AF2122/97
ggaucgagagccgaccgggu

SEQ ID NO: 3070734 - RNA, 16 nt, Mycobacterium bovis subsp bovis AF2122/97
ggaucgaucugcggag

SEQ ID NO: 3070735 - RNA, 24 nt, Mycobacterium bovis subsp bovis AF2122/97
ggaucgcaagccguugcacggccg

SEQ ID NO: 3070736 - RNA, 13 nt, Mycobacterium bovis subsp bovis AF2122/97
ggaucgcagcgcc

SEQ ID NO: 3070737 - RNA, 21 nt, Mycobacterium bovis subsp bovis AF2122/97
ggaucgcagggaucaccccgg

SEQ ID NO: 3070738 - RNA, 14 nt, Mycobacterium bovis subsp bovis AF2122/97
ggaucgccaccggc

SEQ ID NO: 3070739 - RNA, 15 nt, Mycobacterium bovis subsp bovis AF2122/97
ggaucgccaccggcg

SEQ ID NO: 3070740 - RNA, 13 nt, Mycobacterium bovis subsp bovis AF2122/97
ggaucgccaggcc

SEQ ID NO: 3070741 - RNA, 15 nt, Mycobacterium bovis subsp bovis AF2122/97
ggaucgcccaggcgc

SEQ ID NO: 3070742 - RNA, 24 nt, Mycobacterium bovis subsp bovis AF2122/97
ggaucgcccaggcgcgacguacga

SEQ ID NO: 3070743 - RNA, 16 nt, Mycobacterium bovis subsp bovis AF2122/97
ggaucgccggggacgc

SEQ ID NO: 3070744 - RNA, 18 nt, Mycobacterium bovis subsp bovis AF2122/97
ggaucgccggggacgccg

SEQ ID NO: 3070745 - RNA, 23 nt, Mycobacterium bovis subsp bovis AF2122/97
ggaucgccggggacgccgcggcg

SEQ ID NO: 3070746 - RNA, 16 nt, Mycobacterium bovis subsp bovis AF2122/97
ggaucgccgucggcgg

SEQ ID NO: 3070747 - RNA, 14 nt, Mycobacterium bovis subsp bovis AF2122/97
ggaucgccugagcg

SEQ ID NO: 3070748 - RNA, 17 nt, Mycobacterium bovis subsp bovis AF2122/97
ggaucgccugagcgccg

SEQ ID NO: 3070749 - RNA, 20 nt, Mycobacterium bovis subsp bovis AF2122/97
ggaucgccugagcgccgcgg

SEQ ID NO: 3070750 - RNA, 22 nt, Mycobacterium bovis subsp bovis AF2122/97
ggaucgccugagcgccgcggcg

SEQ ID NO: 3070751 - RNA, 23 nt, Mycobacterium bovis subsp bovis AF2122/97
ggaucgccugagcgccgcggcgg

SEQ ID NO: 3070752 - RNA, 21 nt, Mycobacterium bovis subsp bovis AF2122/97
ggaucgccuuggcgcccgcga

SEQ ID NO: 3070753 - RNA, 14 nt, Mycobacterium bovis subsp bovis AF2122/97
ggaucgcgcagcgc

SEQ ID NO: 3070754 - RNA, 15 nt, Mycobacterium bovis subsp bovis AF2122/97
ggaucgcgcccaccg

SEQ ID NO: 3070755 - RNA, 12 nt, Mycobacterium bovis subsp bovis AF2122/97
ggaucgcggcgc

SEQ ID NO: 3070756 - RNA, 13 nt, Mycobacterium bovis subsp bovis AF2122/97
ggaucgcggcgcc

SEQ ID NO: 3070757 - RNA, 15 nt, Mycobacterium bovis subsp bovis AF2122/97
ggaucgcggcgccgu

SEQ ID NO: 3070758 - RNA, 18 nt, Mycobacterium bovis subsp bovis AF2122/97
ggaucgcggcgccgucgu

SEQ ID NO: 3070759 - RNA, 13 nt, Mycobacterium bovis subsp bovis AF2122/97
ggaucgcggcggc

SEQ ID NO: 3070760 - RNA, 14 nt, Mycobacterium bovis subsp bovis AF2122/97
ggaucgcggcggcg

SEQ ID NO: 3070761 - RNA, 12 nt, Mycobacterium bovis subsp bovis AF2122/97
ggaucgcggugg

SEQ ID NO: 3070762 - RNA, 14 nt, Mycobacterium bovis subsp bovis AF2122/97
ggaucgcguggcgc

SEQ ID NO: 3070763 - RNA, 23 nt, Mycobacterium bovis subsp bovis AF2122/97
ggaucgcguggcgcaccaccgcc

SEQ ID NO: 3070764 - RNA, 18 nt, Mycobacterium bovis subsp bovis AF2122/97
ggaucgcugccagcggcc

SEQ ID NO: 3070765 - RNA, 18 nt, Mycobacterium bovis subsp bovis AF2122/97
ggaucggcaccccacgcc

SEQ ID NO: 3070766 - RNA, 15 nt, Mycobacterium bovis subsp bovis AF2122/97
ggaucggcagcagag

SEQ ID NO: 3070767 - RNA, 19 nt, Mycobacterium bovis subsp bovis AF2122/97
ggaucggcggaccgcagcg

SEQ ID NO: 3070768 - RNA, 22 nt, Mycobacterium bovis subsp bovis AF2122/97
ggaucggcggccgcgaccagcg

SEQ ID NO: 3070769 - RNA, 18 nt, Mycobacterium bovis subsp bovis AF2122/97
ggaucggcggccggcgcc

SEQ ID NO: 3070770 - RNA, 21 nt, Mycobacterium bovis subsp bovis AF2122/97
ggaucggcggggucgaacagc

SEQ ID NO: 3070771 - RNA, 22 nt, Mycobacterium bovis subsp bovis AF2122/97
ggaucggcuaccuaacccgcac

SEQ ID NO: 3070772 - RNA, 15 nt, Mycobacterium bovis subsp bovis AF2122/97
ggaucggcugcgcgc

SEQ ID NO: 3070773 - RNA, 14 nt, Mycobacterium bovis subsp bovis AF2122/97
ggaucgggaccggg

SEQ ID NO: 3070774 - RNA, 17 nt, Mycobacterium bovis subsp bovis AF2122/97
ggaucgggcccuccggc

SEQ ID NO: 3070775 - RNA, 19 nt, Mycobacterium bovis subsp bovis AF2122/97
ggaucgggcccuccggcgc

SEQ ID NO: 3070776 - RNA, 14 nt, Mycobacterium bovis subsp bovis AF2122/97
ggaucggggcacug

SEQ ID NO: 3070777 - RNA, 18 nt, Mycobacterium bovis subsp bovis AF2122/97
ggaucgguuucugcggcc

SEQ ID NO: 3070778 - RNA, 19 nt, Mycobacterium bovis subsp bovis AF2122/97
ggaucgguuucugcggccc

SEQ ID NO: 3070779 - RNA, 22 nt, Mycobacterium bovis subsp bovis AF2122/97
ggaucgguuucugcggccccga

SEQ ID NO: 3070780 - RNA, 23 nt, Mycobacterium bovis subsp bovis AF2122/97
ggaucgucaggcccauggcagcc

SEQ ID NO: 3070781 - RNA, 17 nt, Mycobacterium bovis subsp bovis AF2122/97
ggaucguccggccgggg

SEQ ID NO: 3070782 - RNA, 20 nt, Mycobacterium bovis subsp bovis AF2122/97
ggaucgucgaacagcaccgc

SEQ ID NO: 3070783 - RNA, 14 nt, Mycobacterium bovis subsp bovis AF2122/97
ggaucgucgcugug

SEQ ID NO: 3070784 - RNA, 21 nt, Mycobacterium bovis subsp bovis AF2122/97
ggaucgucgugcacggcggcc

SEQ ID NO: 3070785 - RNA, 23 nt, Mycobacterium bovis subsp bovis AF2122/97
ggaucgucguugucagcgaacgg

SEQ ID NO: 3070786 - RNA, 17 nt, Mycobacterium bovis subsp bovis AF2122/97
ggaucgucucgcgcacc

SEQ ID NO: 3070787 - RNA, 13 nt, Mycobacterium bovis subsp bovis AF2122/97
ggaucgugccggc

SEQ ID NO: 3070788 - RNA, 15 nt, Mycobacterium bovis subsp bovis AF2122/97
ggaucgugccggcga

SEQ ID NO: 3070789 - RNA, 23 nt, Mycobacterium bovis subsp bovis AF2122/97
ggaucguucgcgugccagcgccc

SEQ ID NO: 3070790 - RNA, 22 nt, Mycobacterium bovis subsp bovis AF2122/97
ggaucuagaggcggcccccggc

SEQ ID NO: 3070791 - RNA, 17 nt, Mycobacterium bovis subsp bovis AF2122/97
ggaucuauuggaugcga

SEQ ID NO: 3070792 - RNA, 20 nt, Mycobacterium bovis subsp bovis AF2122/97
ggaucucaccacccgucggc

SEQ ID NO: 3070793 - RNA, 21 nt, Mycobacterium bovis subsp bovis AF2122/97
ggaucucaucgggccacagca

SEQ ID NO: 3070794 - RNA, 15 nt, Mycobacterium bovis subsp bovis AF2122/97
ggaucucgagccgcg

SEQ ID NO: 3070795 - RNA, 18 nt, Mycobacterium bovis subsp bovis AF2122/97
ggaucucggcguaggcga

SEQ ID NO: 3070796 - RNA, 15 nt, Mycobacterium bovis subsp bovis AF2122/97
ggaucugacggcgcc

SEQ ID NO: 3070797 - RNA, 17 nt, Mycobacterium bovis subsp bovis AF2122/97
ggaucugacggcgccgu

SEQ ID NO: 3070798 - RNA, 14 nt, Mycobacterium bovis subsp bovis AF2122/97
ggaucugcgccgcg

SEQ ID NO: 3070799 - RNA, 15 nt, Mycobacterium bovis subsp bovis AF2122/97
ggaucugcgccgcgc

SEQ ID NO: 3070800 - RNA, 21 nt, Mycobacterium bovis subsp bovis AF2122/97
ggaucugcgccgcgcgcggcg

SEQ ID NO: 3070801 - RNA, 14 nt, Mycobacterium bovis subsp bovis AF2122/97
ggaucugcggaggc

SEQ ID NO: 3070802 - RNA, 16 nt, Mycobacterium bovis subsp bovis AF2122/97
ggaucugcuccgcagc

SEQ ID NO: 3070803 - RNA, 17 nt, Mycobacterium bovis subsp bovis AF2122/97
ggauugcgggccugcac

SEQ ID NO: 3070804 - RNA, 19 nt, Mycobacterium bovis subsp bovis AF2122/97
ggauugcgggccugcacgc

SEQ ID NO: 3070805 - RNA, 20 nt, Mycobacterium bovis subsp bovis AF2122/97
ggauugcuguacugcggugc

SEQ ID NO: 3070806 - RNA, 13 nt, Mycobacterium bovis subsp bovis AF2122/97
ggauuggcgacgu

SEQ ID NO: 3070807 - RNA, 16 nt, Mycobacterium bovis subsp bovis AF2122/97
ggauuggcgucagcag

SEQ ID NO: 3070808 - RNA, 18 nt, Mycobacterium bovis subsp bovis AF2122/97
ggauuggcgucagcagca

SEQ ID NO: 3070809 - RNA, 18 nt, Mycobacterium bovis subsp bovis AF2122/97
ggauuggugggccagcag

SEQ ID NO: 3070810 - RNA, 12 nt, Mycobacterium bovis subsp bovis AF2122/97
ggcaaacaccag

SEQ ID NO: 3070811 - RNA, 17 nt, Mycobacterium bovis subsp bovis AF2122/97
ggcaaacugggcaccgg

SEQ ID NO: 3070812 - RNA, 15 nt, Mycobacterium bovis subsp bovis AF2122/97
ggcaaaguaucgcag

SEQ ID NO: 3070813 - RNA, 16 nt, Mycobacterium bovis subsp bovis AF2122/97
ggcaaaguaucgcagc

SEQ ID NO: 3070814 - RNA, 22 nt, Mycobacterium bovis subsp bovis AF2122/97
ggcaaaguaucgcagcaucugc

SEQ ID NO: 3070815 - RNA, 13 nt, Mycobacterium bovis subsp bovis AF2122/97
ggcaaaucaagca

SEQ ID NO: 3070816 - RNA, 22 nt, Mycobacterium bovis subsp bovis AF2122/97
ggcaaaucaagcacagcccggc

SEQ ID NO: 3070817 - RNA, 18 nt, Mycobacterium bovis subsp bovis AF2122/97
ggcaaaucggugcgaucc

SEQ ID NO: 3070818 - RNA, 19 nt, Mycobacterium bovis subsp bovis AF2122/97
ggcaacagcaccagugugg

SEQ ID NO: 3070819 - RNA, 15 nt, Mycobacterium bovis subsp bovis AF2122/97
ggcaacaucagcagg

SEQ ID NO: 3070820 - RNA, 18 nt, Mycobacterium bovis subsp bovis AF2122/97
ggcaacauccuccgggca

SEQ ID NO: 3070821 - RNA, 16 nt, Mycobacterium bovis subsp bovis AF2122/97
ggcaacaucggguucu

SEQ ID NO: 3070822 - RNA, 15 nt, Mycobacterium bovis subsp bovis AF2122/97
ggcaaccaccggccg

SEQ ID NO: 3070823 - RNA, 19 nt, Mycobacterium bovis subsp bovis AF2122/97
ggcaaccaccggccgcgca

SEQ ID NO: 3070824 - RNA, 21 nt, Mycobacterium bovis subsp bovis AF2122/97
ggcaaccaccggccgcgcaga

SEQ ID NO: 3070825 - RNA, 19 nt, Mycobacterium bovis subsp bovis AF2122/97
ggcaaccacguccgcaacc

SEQ ID NO: 3070826 - RNA, 14 nt, Mycobacterium bovis subsp bovis AF2122/97
ggcaaccagcagca

SEQ ID NO: 3070827 - RNA, 15 nt, Mycobacterium bovis subsp bovis AF2122/97
ggcaaccagcagcag

SEQ ID NO: 3070828 - RNA, 13 nt, Mycobacterium bovis subsp bovis AF2122/97
ggcaaccagcgag

SEQ ID NO: 3070829 - RNA, 14 nt, Mycobacterium bovis subsp bovis AF2122/97
ggcaaccagcgagc

SEQ ID NO: 3070830 - RNA, 22 nt, Mycobacterium bovis subsp bovis AF2122/97
ggcaaccagcuucucagcacca

SEQ ID NO: 3070831 - RNA, 22 nt, Mycobacterium bovis subsp bovis AF2122/97
ggcaacccagugucagcaagau

SEQ ID NO: 3070832 - RNA, 17 nt, Mycobacterium bovis subsp bovis AF2122/97
ggcaacccccgccggcg

SEQ ID NO: 3070833 - RNA, 22 nt, Mycobacterium bovis subsp bovis AF2122/97
ggcaacccccgccggcgcccga

SEQ ID NO: 3070834 - RNA, 23 nt, Mycobacterium bovis subsp bovis AF2122/97
ggcaacccccgccggcgcccgag

SEQ ID NO: 3070835 - RNA, 21 nt, Mycobacterium bovis subsp bovis AF2122/97
ggcaaccccgagcggagccgc

SEQ ID NO: 3070836 - RNA, 22 nt, Mycobacterium bovis subsp bovis AF2122/97
ggcaaccccgagcggagccgcc

SEQ ID NO: 3070837 - RNA, 17 nt, Mycobacterium bovis subsp bovis AF2122/97
ggcaacccugcccggcc

SEQ ID NO: 3070838 - RNA, 20 nt, Mycobacterium bovis subsp bovis AF2122/97
ggcaacccugcccggcccgc

SEQ ID NO: 3070839 - RNA, 17 nt, Mycobacterium bovis subsp bovis AF2122/97
ggcaaccgaauugaacu

SEQ ID NO: 3070840 - RNA, 14 nt, Mycobacterium bovis subsp bovis AF2122/97
ggcaaccgaugacg

SEQ ID NO: 3070841 - RNA, 14 nt, Mycobacterium bovis subsp bovis AF2122/97
ggcaaccgccgcca

SEQ ID NO: 3070842 - RNA, 17 nt, Mycobacterium bovis subsp bovis AF2122/97
ggcaaccgccgccacca

SEQ ID NO: 3070843 - RNA, 18 nt, Mycobacterium bovis subsp bovis AF2122/97
ggcaaccgccgccaccag

SEQ ID NO: 3070844 - RNA, 22 nt, Mycobacterium bovis subsp bovis AF2122/97
ggcaaccgucccaaugcaacaa

SEQ ID NO: 3070845 - RNA, 16 nt, Mycobacterium bovis subsp bovis AF2122/97
ggcaaccuggacuggg

SEQ ID NO: 3070846 - RNA, 22 nt, Mycobacterium bovis subsp bovis AF2122/97
ggcaacgaagagggcgccgcgc

SEQ ID NO: 3070847 - RNA, 12 nt, Mycobacterium bovis subsp bovis AF2122/97
ggcaacgacacg

SEQ ID NO: 3070848 - RNA, 16 nt, Mycobacterium bovis subsp bovis AF2122/97
ggcaacgacccgccgc

SEQ ID NO: 3070849 - RNA, 17 nt, Mycobacterium bovis subsp bovis AF2122/97
ggcaacgacccgccgcc

SEQ ID NO: 3070850 - RNA, 17 nt, Mycobacterium bovis subsp bovis AF2122/97
ggcaacgaggucugcgg

SEQ ID NO: 3070851 - RNA, 12 nt, Mycobacterium bovis subsp bovis AF2122/97
ggcaacgaucag

SEQ ID NO: 3070852 - RNA, 15 nt, Mycobacterium bovis subsp bovis AF2122/97
ggcaacgcgaaccgg

SEQ ID NO: 3070853 - RNA, 17 nt, Mycobacterium bovis subsp bovis AF2122/97
ggcaacgcgaaccggcc

SEQ ID NO: 3070854 - RNA, 14 nt, Mycobacterium bovis subsp bovis AF2122/97
ggcaacgcggccuu

SEQ ID NO: 3070855 - RNA, 14 nt, Mycobacterium bovis subsp bovis AF2122/97
ggcaacgcggucug

SEQ ID NO: 3070856 - RNA, 17 nt, Mycobacterium bovis subsp bovis AF2122/97
ggcaacgcggucugcuc

SEQ ID NO: 3070857 - RNA, 18 nt, Mycobacterium bovis subsp bovis AF2122/97
ggcaacgcggucugcucc

SEQ ID NO: 3070858 - RNA, 22 nt, Mycobacterium bovis subsp bovis AF2122/97
ggcaacggacgggaucgcccag

SEQ ID NO: 3070859 - RNA, 21 nt, Mycobacterium bovis subsp bovis AF2122/97
ggcaacggaggugccggcgcc

SEQ ID NO: 3070860 - RNA, 22 nt, Mycobacterium bovis subsp bovis AF2122/97
ggcaacggaggugccggcgcca

SEQ ID NO: 3070861 - RNA, 13 nt, Mycobacterium bovis subsp bovis AF2122/97
ggcaacggccgcu

SEQ ID NO: 3070862 - RNA, 15 nt, Mycobacterium bovis subsp bovis AF2122/97
ggcaacggcgcgccg

SEQ ID NO: 3070863 - RNA, 16 nt, Mycobacterium bovis subsp bovis AF2122/97
ggcaacggcggcaucg

SEQ ID NO: 3070864 - RNA, 19 nt, Mycobacterium bovis subsp bovis AF2122/97
ggcaacggcggcaucggcg

SEQ ID NO: 3070865 - RNA, 20 nt, Mycobacterium bovis subsp bovis AF2122/97
ggcaacggcggcaucggcgg

SEQ ID NO: 3070866 - RNA, 20 nt, Mycobacterium bovis subsp bovis AF2122/97
ggcaacggcggcgacggcgg

SEQ ID NO: 3070867 - RNA, 21 nt, Mycobacterium bovis subsp bovis AF2122/97
ggcaacggcggggccggcggc

SEQ ID NO: 3070868 - RNA, 17 nt, Mycobacterium bovis subsp bovis AF2122/97
ggcaacgggggcgccgg

SEQ ID NO: 3070869 - RNA, 18 nt, Mycobacterium bovis subsp bovis AF2122/97
ggcaacggguccgacggu

SEQ ID NO: 3070870 - RNA, 20 nt, Mycobacterium bovis subsp bovis AF2122/97
ggcaacggguccgacggugu

SEQ ID NO: 3070871 - RNA, 18 nt, Mycobacterium bovis subsp bovis AF2122/97
ggcaacgguggcaacgga

SEQ ID NO: 3070872 - RNA, 19 nt, Mycobacterium bovis subsp bovis AF2122/97
ggcaacgguggcaacggag

SEQ ID NO: 3070873 - RNA, 22 nt, Mycobacterium bovis subsp bovis AF2122/97
ggcaacgugccucucuccgcgc

SEQ ID NO: 3070874 - RNA, 22 nt, Mycobacterium bovis subsp bovis AF2122/97
ggcaacuccggucaacacccgc

SEQ ID NO: 3070875 - RNA, 12 nt, Mycobacterium bovis subsp bovis AF2122/97
ggcaacugcagc

SEQ ID NO: 3070876 - RNA, 18 nt, Mycobacterium bovis subsp bovis AF2122/97
ggcaagaacccgauaaca

SEQ ID NO: 3070877 - RNA, 15 nt, Mycobacterium bovis subsp bovis AF2122/97
ggcaagaacccggua

SEQ ID NO: 3070878 - RNA, 18 nt, Mycobacterium bovis subsp bovis AF2122/97
ggcaagaccgaacagcgg

SEQ ID NO: 3070879 - RNA, 19 nt, Mycobacterium bovis subsp bovis AF2122/97
ggcaagaccgaacagcggc

SEQ ID NO: 3070880 - RNA, 16 nt, Mycobacterium bovis subsp bovis AF2122/97
ggcaagacgcggucga

SEQ ID NO: 3070881 - RNA, 23 nt, Mycobacterium bovis subsp bovis AF2122/97
ggcaagaguugccggaucgacgu

SEQ ID NO: 3070882 - RNA, 13 nt, Mycobacterium bovis subsp bovis AF2122/97
ggcaagaugaucg

SEQ ID NO: 3070883 - RNA, 16 nt, Mycobacterium bovis subsp bovis AF2122/97
ggcaagcaaccggugc

SEQ ID NO: 3070884 - RNA, 16 nt, Mycobacterium bovis subsp bovis AF2122/97
ggcaagcacaccgcca

SEQ ID NO: 3070885 - RNA, 19 nt, Mycobacterium bovis subsp bovis AF2122/97
ggcaagcacaccgccagcg

SEQ ID NO: 3070886 - RNA, 20 nt, Mycobacterium bovis subsp bovis AF2122/97
ggcaagcacaccgccagcgg

SEQ ID NO: 3070887 - RNA, 21 nt, Mycobacterium bovis subsp bovis AF2122/97
ggcaagcacaccgccagcggc

SEQ ID NO: 3070888 - RNA, 22 nt, Mycobacterium bovis subsp bovis AF2122/97
ggcaagcacaccgccagcggca

SEQ ID NO: 3070889 - RNA, 21 nt, Mycobacterium bovis subsp bovis AF2122/97
ggcaccacccgauuggccaac

SEQ ID NO: 3070890 - RNA, 23 nt, Mycobacterium bovis subsp bovis AF2122/97
ggcaccacgaucaacucgugcgg

SEQ ID NO: 3070891 - RNA, 16 nt, Mycobacterium bovis subsp bovis AF2122/97
ggcaccagcagccagc

SEQ ID NO: 3070892 - RNA, 15 nt, Mycobacterium bovis subsp bovis AF2122/97
ggcaccagccgguga

SEQ ID NO: 3070893 - RNA, 13 nt, Mycobacterium bovis subsp bovis AF2122/97
ggcaccagcgaau

SEQ ID NO: 3070894 - RNA, 14 nt, Mycobacterium bovis subsp bovis AF2122/97
ggcaccagcgcgcg

SEQ ID NO: 3070895 - RNA, 21 nt, Mycobacterium bovis subsp bovis AF2122/97
ggcaccagcgcgcgccgagcc

SEQ ID NO: 3070896 - RNA, 13 nt, Mycobacterium bovis subsp bovis AF2122/97
ggcaccagcggca

SEQ ID NO: 3070897 - RNA, 16 nt, Mycobacterium bovis subsp bovis AF2122/97
ggcaccagcggcaccg

SEQ ID NO: 3070898 - RNA, 18 nt, Mycobacterium bovis subsp bovis AF2122/97
ggcaccagcggcaccgcg

SEQ ID NO: 3070899 - RNA, 19 nt, Mycobacterium bovis subsp bovis AF2122/97
ggcaccagcggcaccgcgg

SEQ ID NO: 3070900 - RNA, 19 nt, Mycobacterium bovis subsp bovis AF2122/97
ggcaccagguugccgaggu

SEQ ID NO: 3070901 - RNA, 14 nt, Mycobacterium bovis subsp bovis AF2122/97
ggcaccauaucgug

SEQ ID NO: 3070902 - RNA, 18 nt, Mycobacterium bovis subsp bovis AF2122/97
ggcaccauguacaggcug

SEQ ID NO: 3070903 - RNA, 19 nt, Mycobacterium bovis subsp bovis AF2122/97
ggcacccaaccaggccgcg

SEQ ID NO: 3070904 - RNA, 22 nt, Mycobacterium bovis subsp bovis AF2122/97
ggcacccaaccaggccgcgaca

SEQ ID NO: 3070905 - RNA, 23 nt, Mycobacterium bovis subsp bovis AF2122/97
ggcacccaucccguucagcgacc

SEQ ID NO: 3070906 - RNA, 15 nt, Mycobacterium bovis subsp bovis AF2122/97
ggcaccccacggcca

SEQ ID NO: 3070907 - RNA, 15 nt, Mycobacterium bovis subsp bovis AF2122/97
ggcacccccgacgag

SEQ ID NO: 3070908 - RNA, 15 nt, Mycobacterium bovis subsp bovis AF2122/97
ggcacccccgucgcc

SEQ ID NO: 3070909 - RNA, 21 nt, Mycobacterium bovis subsp bovis AF2122/97
ggcaccccgaucacccgcagg

SEQ ID NO: 3070910 - RNA, 23 nt, Mycobacterium bovis subsp bovis AF2122/97
ggcaccccgaucacccgcaggua

SEQ ID NO: 3070911 - RNA, 15 nt, Mycobacterium bovis subsp bovis AF2122/97
ggcaccccggccacu

SEQ ID NO: 3070912 - RNA, 22 nt, Mycobacterium bovis subsp bovis AF2122/97
ggcaccccuuugacgccgagca

SEQ ID NO: 3070913 - RNA, 12 nt, Mycobacterium bovis subsp bovis AF2122/97
ggcacccgaaaa

SEQ ID NO: 3070914 - RNA, 14 nt, Mycobacterium bovis subsp bovis AF2122/97
ggcacccgacucgu

SEQ ID NO: 3070915 - RNA, 17 nt, Mycobacterium bovis subsp bovis AF2122/97
ggcacccgacucgucgg

SEQ ID NO: 3070916 - RNA, 13 nt, Mycobacterium bovis subsp bovis AF2122/97
ggcacccgagccg

SEQ ID NO: 3070917 - RNA, 19 nt, Mycobacterium bovis subsp bovis AF2122/97
ggcacccgcacggccuccg

SEQ ID NO: 3070918 - RNA, 16 nt, Mycobacterium bovis subsp bovis AF2122/97
ggcacccgccgugccc

SEQ ID NO: 3070919 - RNA, 22 nt, Mycobacterium bovis subsp bovis AF2122/97
ggcacccgccgugcccccggcu

SEQ ID NO: 3070920 - RNA, 23 nt, Mycobacterium bovis subsp bovis AF2122/97
ggcacccgcgucgagugccgcca

SEQ ID NO: 3070921 - RNA, 15 nt, Mycobacterium bovis subsp bovis AF2122/97
ggcacccgcuggcgg

SEQ ID NO: 3070922 - RNA, 15 nt, Mycobacterium bovis subsp bovis AF2122/97
ggcacccggcagagc

SEQ ID NO: 3070923 - RNA, 15 nt, Mycobacterium bovis subsp bovis AF2122/97
ggcacccggggugcc

SEQ ID NO: 3070924 - RNA, 21 nt, Mycobacterium bovis subsp bovis AF2122/97
ggcacccggugagaagaagcc

SEQ ID NO: 3070925 - RNA, 23 nt, Mycobacterium bovis subsp bovis AF2122/97
ggcacccggugagaagaagccca

SEQ ID NO: 3070926 - RNA, 16 nt, Mycobacterium bovis subsp bovis AF2122/97
ggcacccuccgccggu

SEQ ID NO: 3070927 - RNA, 16 nt, Mycobacterium bovis subsp bovis AF2122/97
ggcacccugcggcacc

SEQ ID NO: 3070928 - RNA, 16 nt, Mycobacterium bovis subsp bovis AF2122/97
ggcaccgaaaaacacc

SEQ ID NO: 3070929 - RNA, 20 nt, Mycobacterium bovis subsp bovis AF2122/97
ggcaccgaaaaacaccagcg

SEQ ID NO: 3070930 - RNA, 24 nt, Mycobacterium bovis subsp bovis AF2122/97
ggcaccgaaaaacaccagcgaggc

SEQ ID NO: 3070931 - RNA, 21 nt, Mycobacterium bovis subsp bovis AF2122/97
ggcaccgacgguaggcccgcg

SEQ ID NO: 3070932 - RNA, 17 nt, Mycobacterium bovis subsp bovis AF2122/97
ggcaccgacgucggcuu

SEQ ID NO: 3070933 - RNA, 16 nt, Mycobacterium bovis subsp bovis AF2122/97
ggcaccgagcugagcg

SEQ ID NO: 3070934 - RNA, 19 nt, Mycobacterium bovis subsp bovis AF2122/97
ggcaccgaucggugccggc

SEQ ID NO: 3070935 - RNA, 14 nt, Mycobacterium bovis subsp bovis AF2122/97
ggcaccgaugcacu

SEQ ID NO: 3070936 - RNA, 13 nt, Mycobacterium bovis subsp bovis AF2122/97
ggcaccgauggcg

SEQ ID NO: 3070937 - RNA, 19 nt, Mycobacterium bovis subsp bovis AF2122/97
ggcaccgauggcgcaccgg

SEQ ID NO: 3070938 - RNA, 20 nt, Mycobacterium bovis subsp bovis AF2122/97
ggcaccgauggcgcaccggc

SEQ ID NO: 3070939 - RNA, 22 nt, Mycobacterium bovis subsp bovis AF2122/97
ggcaccgauggcgcaccggcgu

SEQ ID NO: 3070940 - RNA, 12 nt, Mycobacterium bovis subsp bovis AF2122/97
ggcaccgcagcg

SEQ ID NO: 3070941 - RNA, 13 nt, Mycobacterium bovis subsp bovis AF2122/97
ggcaccgccagcc

SEQ ID NO: 3070942 - RNA, 16 nt, Mycobacterium bovis subsp bovis AF2122/97
ggcaccgccagccacc

SEQ ID NO: 3070943 - RNA, 20 nt, Mycobacterium bovis subsp bovis AF2122/97
ggcaccgccagugcccgcac

SEQ ID NO: 3070944 - RNA, 18 nt, Mycobacterium bovis subsp bovis AF2122/97
ggcaccgcccccgucggc

SEQ ID NO: 3070945 - RNA, 19 nt, Mycobacterium bovis subsp bovis AF2122/97
ggcaccgcccccgucggcc

SEQ ID NO: 3070946 - RNA, 12 nt, Mycobacterium bovis subsp bovis AF2122/97
ggcaccgccgag

SEQ ID NO: 3070947 - RNA, 19 nt, Mycobacterium bovis subsp bovis AF2122/97
ggcaccgccgcccccgccg

SEQ ID NO: 3070948 - RNA, 21 nt, Mycobacterium bovis subsp bovis AF2122/97
ggcaccgccgcccccgccggc

SEQ ID NO: 3070949 - RNA, 22 nt, Mycobacterium bovis subsp bovis AF2122/97
ggcaccgccgcccccgccggcc

SEQ ID NO: 3070950 - RNA, 12 nt, Mycobacterium bovis subsp bovis AF2122/97
ggcaccgccggc

SEQ ID NO: 3070951 - RNA, 17 nt, Mycobacterium bovis subsp bovis AF2122/97
ggcaccgccggcaccgc

SEQ ID NO: 3070952 - RNA, 20 nt, Mycobacterium bovis subsp bovis AF2122/97
ggcaccgccggcaccgccgg

SEQ ID NO: 3070953 - RNA, 15 nt, Mycobacterium bovis subsp bovis AF2122/97
ggcaccgccggcgcc

SEQ ID NO: 3070954 - RNA, 18 nt, Mycobacterium bovis subsp bovis AF2122/97
ggcaccgccggcgccacc

SEQ ID NO: 3070955 - RNA, 19 nt, Mycobacterium bovis subsp bovis AF2122/97
ggcaccgccggcgccaccg

SEQ ID NO: 3070956 - RNA, 23 nt, Mycobacterium bovis subsp bovis AF2122/97
ggcaccgccggcgcccaggccga

SEQ ID NO: 3070957 - RNA, 20 nt, Mycobacterium bovis subsp bovis AF2122/97
ggcaccgccggcuccgccgu

SEQ ID NO: 3070958 - RNA, 14 nt, Mycobacterium bovis subsp bovis AF2122/97
ggcaccgccggugg

SEQ ID NO: 3070959 - RNA, 15 nt, Mycobacterium bovis subsp bovis AF2122/97
ggcaccgccgguggc

SEQ ID NO: 3070960 - RNA, 20 nt, Mycobacterium bovis subsp bovis AF2122/97
ggcaccgccgguggcgccgg

SEQ ID NO: 3070961 - RNA, 21 nt, Mycobacterium bovis subsp bovis AF2122/97
ggcaccgccgguggcgccggg

SEQ ID NO: 3070962 - RNA, 17 nt, Mycobacterium bovis subsp bovis AF2122/97
ggcaccgccugcgccgc

SEQ ID NO: 3070963 - RNA, 22 nt, Mycobacterium bovis subsp bovis AF2122/97
ggcaccgcgcccaccagcggcg

SEQ ID NO: 3070964 - RNA, 14 nt, Mycobacterium bovis subsp bovis AF2122/97
ggcaccgcgccggc

SEQ ID NO: 3070965 - RNA, 16 nt, Mycobacterium bovis subsp bovis AF2122/97
ggcaccgcgcgcucca

SEQ ID NO: 3070966 - RNA, 15 nt, Mycobacterium bovis subsp bovis AF2122/97
ggcaccgcggccagc

SEQ ID NO: 3070967 - RNA, 16 nt, Mycobacterium bovis subsp bovis AF2122/97
ggcaccgcggccagcg

SEQ ID NO: 3070968 - RNA, 15 nt, Mycobacterium bovis subsp bovis AF2122/97
ggcaccgcggccgcg

SEQ ID NO: 3070969 - RNA, 16 nt, Mycobacterium bovis subsp bovis AF2122/97
ggcaccgcggccgcgg

SEQ ID NO: 3070970 - RNA, 15 nt, Mycobacterium bovis subsp bovis AF2122/97
ggcaccggccggugg

SEQ ID NO: 3070971 - RNA, 15 nt, Mycobacterium bovis subsp bovis AF2122/97
ggcaccggccgugcc

SEQ ID NO: 3070972 - RNA, 20 nt, Mycobacterium bovis subsp bovis AF2122/97
ggcaccggccgugccgccga

SEQ ID NO: 3070973 - RNA, 19 nt, Mycobacterium bovis subsp bovis AF2122/97
ggcaccggccuugcccuca

SEQ ID NO: 3070974 - RNA, 12 nt, Mycobacterium bovis subsp bovis AF2122/97
ggcaccggcgau

SEQ ID NO: 3070975 - RNA, 12 nt, Mycobacterium bovis subsp bovis AF2122/97
ggcacucccgga

SEQ ID NO: 3070976 - RNA, 21 nt, Mycobacterium bovis subsp bovis AF2122/97
ggcacucccggaguggccagu

SEQ ID NO: 3070977 - RNA, 17 nt, Mycobacterium bovis subsp bovis AF2122/97
ggcacugacgcgcccga

SEQ ID NO: 3070978 - RNA, 12 nt, Mycobacterium bovis subsp bovis AF2122/97
ggcacugaucgg

SEQ ID NO: 3070979 - RNA, 17 nt, Mycobacterium bovis subsp bovis AF2122/97
ggcacugcccagcagac

SEQ ID NO: 3070980 - RNA, 13 nt, Mycobacterium bovis subsp bovis AF2122/97
ggcacugccggca

SEQ ID NO: 3070981 - RNA, 14 nt, Mycobacterium bovis subsp bovis AF2122/97
ggcacugccggcac

SEQ ID NO: 3070982 - RNA, 16 nt, Mycobacterium bovis subsp bovis AF2122/97
ggcacugccggcacgc

SEQ ID NO: 3070983 - RNA, 15 nt, Mycobacterium bovis subsp bovis AF2122/97
ggcacugcgaucgcg

SEQ ID NO: 3070984 - RNA, 16 nt, Mycobacterium bovis subsp bovis AF2122/97
ggcacuggauccggga

SEQ ID NO: 3070985 - RNA, 22 nt, Mycobacterium bovis subsp bovis AF2122/97
ggcacuggggucugauggcggc

SEQ ID NO: 3070986 - RNA, 20 nt, Mycobacterium bovis subsp bovis AF2122/97
ggcacuggguccacgcgcuc

SEQ ID NO: 3070987 - RNA, 22 nt, Mycobacterium bovis subsp bovis AF2122/97
ggcacugugcguccgcaacagg

SEQ ID NO: 3070988 - RNA, 17 nt, Mycobacterium bovis subsp bovis AF2122/97
ggcacuugcccgucggc

SEQ ID NO: 3070989 - RNA, 19 nt, Mycobacterium bovis subsp bovis AF2122/97
ggcacuugcccgucggcgc

SEQ ID NO: 3070990 - RNA, 20 nt, Mycobacterium bovis subsp bovis AF2122/97
ggcacuuuguagcccgcgau

SEQ ID NO: 3070991 - RNA, 22 nt, Mycobacterium bovis subsp bovis AF2122/97
ggcagaagucguugcgcggucu

SEQ ID NO: 3070992 - RNA, 19 nt, Mycobacterium bovis subsp bovis AF2122/97
ggcagaaucggugggcggg

SEQ ID NO: 3070993 - RNA, 17 nt, Mycobacterium bovis subsp bovis AF2122/97
ggcagaauugucaacga

SEQ ID NO: 3070994 - RNA, 17 nt, Mycobacterium bovis subsp bovis AF2122/97
ggcagacacgcugcagg

SEQ ID NO: 3070995 - RNA, 23 nt, Mycobacterium bovis subsp bovis AF2122/97
ggcagacacgcugcaggcggccg

SEQ ID NO: 3070996 - RNA, 16 nt, Mycobacterium bovis subsp bovis AF2122/97
ggcagacaucugggug

SEQ ID NO: 3070997 - RNA, 19 nt, Mycobacterium bovis subsp bovis AF2122/97
ggcagacauggcaagucaa

SEQ ID NO: 3070998 - RNA, 20 nt, Mycobacterium bovis subsp bovis AF2122/97
ggcagaccaagcccgucguc

SEQ ID NO: 3070999 - RNA, 22 nt, Mycobacterium bovis subsp bovis AF2122/97
ggcagaccaagcccgucgucgu

SEQ ID NO: 3071000 - RNA, 14 nt, Mycobacterium bovis subsp bovis AF2122/97
ggcagaccggcauc

SEQ ID NO: 3071001 - RNA, 22 nt, Mycobacterium bovis subsp bovis AF2122/97
ggcagaccggugcugucgacgu

SEQ ID NO: 3071002 - RNA, 22 nt, Mycobacterium bovis subsp bovis AF2122/97
ggcagacgcguuucgucgaccg

SEQ ID NO: 3071003 - RNA, 13 nt, Mycobacterium bovis subsp bovis AF2122/97
ggcagagccgacu

SEQ ID NO: 3071004 - RNA, 13 nt, Mycobacterium bovis subsp bovis AF2122/97
ggcagagccgccg

SEQ ID NO: 3071005 - RNA, 23 nt, Mycobacterium bovis subsp bovis AF2122/97
ggcagagccgccguugccgccgg

SEQ ID NO: 3071006 - RNA, 21 nt, Mycobacterium bovis subsp bovis AF2122/97
ggcagaucccacgccaggauc

SEQ ID NO: 3071007 - RNA, 18 nt, Mycobacterium bovis subsp bovis AF2122/97
ggcagaugaauugccggg

SEQ ID NO: 3071008 - RNA, 18 nt, Mycobacterium bovis subsp bovis AF2122/97
ggcagauucuucacccaa

SEQ ID NO: 3071009 - RNA, 12 nt, Mycobacterium bovis subsp bovis AF2122/97
ggcagcaacagg

SEQ ID NO: 3071010 - RNA, 16 nt, Mycobacterium bovis subsp bovis AF2122/97
ggcagcaacaggccca

SEQ ID NO: 3071011 - RNA, 22 nt, Mycobacterium bovis subsp bovis AF2122/97
ggcagcaacgacgucgucgccg

SEQ ID NO: 3071012 - RNA, 12 nt, Mycobacterium bovis subsp bovis AF2122/97
ggcagcacaggc

SEQ ID NO: 3071013 - RNA, 17 nt, Mycobacterium bovis subsp bovis AF2122/97
ggcagcacaggcuggcg

SEQ ID NO: 3071014 - RNA, 13 nt, Mycobacterium bovis subsp bovis AF2122/97
ggcagcaccagcg

SEQ ID NO: 3071015 - RNA, 16 nt, Mycobacterium bovis subsp bovis AF2122/97
ggcagcaccagcgccu

SEQ ID NO: 3071016 - RNA, 16 nt, Mycobacterium bovis subsp bovis AF2122/97
ggcagcacccgcacgg

SEQ ID NO: 3071017 - RNA, 17 nt, Mycobacterium bovis subsp bovis AF2122/97
ggcagcaccgcacggag

SEQ ID NO: 3071018 - RNA, 13 nt, Mycobacterium bovis subsp bovis AF2122/97
ggcagcacgaccu

SEQ ID NO: 3071019 - RNA, 18 nt, Mycobacterium bovis subsp bovis AF2122/97
ggcagcacgccagcccca

SEQ ID NO: 3071020 - RNA, 20 nt, Mycobacterium bovis subsp bovis AF2122/97
ggcagcacggucugggucuu

SEQ ID NO: 3071021 - RNA, 19 nt, Mycobacterium bovis subsp bovis AF2122/97
ggcagcacucuucgaugaa

SEQ ID NO: 3071022 - RNA, 24 nt, Mycobacterium bovis subsp bovis AF2122/97
ggcagcacuuggacccggccggcc

SEQ ID NO: 3071023 - RNA, 21 nt, Mycobacterium bovis subsp bovis AF2122/97
ggcagcagcaaaacccgagcc

SEQ ID NO: 3071024 - RNA, 14 nt, Mycobacterium bovis subsp bovis AF2122/97
ggcagcagcccggg

SEQ ID NO: 3071025 - RNA, 14 nt, Mycobacterium bovis subsp bovis AF2122/97
ggcagcagccggcg

SEQ ID NO: 3071026 - RNA, 16 nt, Mycobacterium bovis subsp bovis AF2122/97
ggcagcagccggcggg

SEQ ID NO: 3071027 - RNA, 17 nt, Mycobacterium bovis subsp bovis AF2122/97
ggcagcagccggcgggc

SEQ ID NO: 3071028 - RNA, 22 nt, Mycobacterium bovis subsp bovis AF2122/97
ggcagcagcgcaacggccagcg

SEQ ID NO: 3071029 - RNA, 14 nt, Mycobacterium bovis subsp bovis AF2122/97
ggcagcagcgccgu

SEQ ID NO: 3071030 - RNA, 13 nt, Mycobacterium bovis subsp bovis AF2122/97
ggcagcagcgcgc

SEQ ID NO: 3071031 - RNA, 11 nt, Mycobacterium bovis subsp bovis AF2122/97
ggcagcagcgg

SEQ ID NO: 3071032 - RNA, 14 nt, Mycobacterium bovis subsp bovis AF2122/97
ggcagcagcgggcg

SEQ ID NO: 3071033 - RNA, 16 nt, Mycobacterium bovis subsp bovis AF2122/97
ggcagcagcgggcgcg

SEQ ID NO: 3071034 - RNA, 12 nt, Mycobacterium bovis subsp bovis AF2122/97
ggcagcagcggu

SEQ ID NO: 3071035 - RNA, 19 nt, Mycobacterium bovis subsp bovis AF2122/97
ggcagcagcggugcagccc

SEQ ID NO: 3071036 - RNA, 12 nt, Mycobacterium bovis subsp bovis AF2122/97
ggcagcagcugg

SEQ ID NO: 3071037 - RNA, 16 nt, Mycobacterium bovis subsp bovis AF2122/97
ggcagcaggcccaccc

SEQ ID NO: 3071038 - RNA, 21 nt, Mycobacterium bovis subsp bovis AF2122/97
ggcagcauauccgccggcgac

SEQ ID NO: 3071039 - RNA, 15 nt, Mycobacterium bovis subsp bovis AF2122/97
ggcagcaucaacacc

SEQ ID NO: 3071040 - RNA, 17 nt, Mycobacterium bovis subsp bovis AF2122/97
ggcagcaucaacaccgg

SEQ ID NO: 3071041 - RNA, 18 nt, Mycobacterium bovis subsp bovis AF2122/97
ggcagcaucuccgucggc

SEQ ID NO: 3071042 - RNA, 19 nt, Mycobacterium bovis subsp bovis AF2122/97
ggcagcaucuccgucggcc

SEQ ID NO: 3071043 - RNA, 23 nt, Mycobacterium bovis subsp bovis AF2122/97
ggcagcaucuccgucggccaggc

SEQ ID NO: 3071044 - RNA, 20 nt, Mycobacterium bovis subsp bovis AF2122/97
ggcagccaaaaacgcugccg

SEQ ID NO: 3071045 - RNA, 21 nt, Mycobacterium bovis subsp bovis AF2122/97
ggcagccaaaaacgcugccgc

SEQ ID NO: 3071046 - RNA, 16 nt, Mycobacterium bovis subsp bovis AF2122/97
ggcagccaaccggcgc

SEQ ID NO: 3071047 - RNA, 13 nt, Mycobacterium bovis subsp bovis AF2122/97
ggcagccaccagc

SEQ ID NO: 3071048 - RNA, 14 nt, Mycobacterium bovis subsp bovis AF2122/97
ggcagccaccagcg

SEQ ID NO: 3071049 - RNA, 13 nt, Mycobacterium bovis subsp bovis AF2122/97
ggcagccagcggc

SEQ ID NO: 3071050 - RNA, 14 nt, Mycobacterium bovis subsp bovis AF2122/97
ggcagccagcggcg

SEQ ID NO: 3071051 - RNA, 12 nt, Mycobacterium bovis subsp bovis AF2122/97
ggcagccagggc

SEQ ID NO: 3071052 - RNA, 17 nt, Mycobacterium bovis subsp bovis AF2122/97
ggcagccagggcgccga

SEQ ID NO: 3071053 - RNA, 14 nt, Mycobacterium bovis subsp bovis AF2122/97
ggcagccaugcggc

SEQ ID NO: 3071054 - RNA, 22 nt, Mycobacterium bovis subsp bovis AF2122/97
ggcagcccaaagcgccagcagc

SEQ ID NO: 3071055 - RNA, 24 nt, Mycobacterium bovis subsp bovis AF2122/97
ggcagcccaaagcgccagcagcca

SEQ ID NO: 3071056 - RNA, 17 nt, Mycobacterium bovis subsp bovis AF2122/97
ggcagccccagcuugcg

SEQ ID NO: 3071057 - RNA, 12 nt, Mycobacterium bovis subsp bovis AF2122/97
ggcagcccccgg

SEQ ID NO: 3071058 - RNA, 15 nt, Mycobacterium bovis subsp bovis AF2122/97
ggcagcccccggauc

SEQ ID NO: 3071059 - RNA, 22 nt, Mycobacterium bovis subsp bovis AF2122/97
ggcagcccccggauccgucgcg

SEQ ID NO: 3071060 - RNA, 13 nt, Mycobacterium bovis subsp bovis AF2122/97
ggcagcccgcugg

SEQ ID NO: 3071061 - RNA, 16 nt, Mycobacterium bovis subsp bovis AF2122/97
ggcagcccgcuggccu

SEQ ID NO: 3071062 - RNA, 20 nt, Mycobacterium bovis subsp bovis AF2122/97
ggcaggagaacacauccgcu

SEQ ID NO: 3071063 - RNA, 12 nt, Mycobacterium bovis subsp bovis AF2122/97
ggcaggagcagc

SEQ ID NO: 3071064 - RNA, 21 nt, Mycobacterium bovis subsp bovis AF2122/97
ggcaggaucgaggcgucggca

SEQ ID NO: 3071065 - RNA, 13 nt, Mycobacterium bovis subsp bovis AF2122/97
ggcaggccagcau

SEQ ID NO: 3071066 - RNA, 14 nt, Mycobacterium bovis subsp bovis AF2122/97
ggcaggcccgacgg

SEQ ID NO: 3071067 - RNA, 20 nt, Mycobacterium bovis subsp bovis AF2122/97
ggcaggcccgacggcgccca

SEQ ID NO: 3071068 - RNA, 21 nt, Mycobacterium bovis subsp bovis AF2122/97
ggcaggcccgacggcgcccag

SEQ ID NO: 3071069 - RNA, 23 nt, Mycobacterium bovis subsp bovis AF2122/97
ggcaggccgcugggccgaccgcc

SEQ ID NO: 3071070 - RNA, 22 nt, Mycobacterium bovis subsp bovis AF2122/97
ggcaggccggccaccgagucga

SEQ ID NO: 3071071 - RNA, 12 nt, Mycobacterium bovis subsp bovis AF2122/97
ggcaggccggcg

SEQ ID NO: 3071072 - RNA, 13 nt, Mycobacterium bovis subsp bovis AF2122/97
ggcaggccggcgu

SEQ ID NO: 3071073 - RNA, 14 nt, Mycobacterium bovis subsp bovis AF2122/97
ggcaggccggcguc

SEQ ID NO: 3071074 - RNA, 15 nt, Mycobacterium bovis subsp bovis AF2122/97
ggcaggccggcgucg

SEQ ID NO: 3071075 - RNA, 12 nt, Mycobacterium bovis subsp bovis AF2122/97
ggcaggccgggc

SEQ ID NO: 3071076 - RNA, 15 nt, Mycobacterium bovis subsp bovis AF2122/97
ggcaggccucggcgc

SEQ ID NO: 3071077 - RNA, 16 nt, Mycobacterium bovis subsp bovis AF2122/97
ggcaggccucggcgcc

SEQ ID NO: 3071078 - RNA, 23 nt, Mycobacterium bovis subsp bovis AF2122/97
ggcaggccucggcgccgcccagc

SEQ ID NO: 3071079 - RNA, 21 nt, Mycobacterium bovis subsp bovis AF2122/97
ggcaggcgaaggcggcuucgc

SEQ ID NO: 3071080 - RNA, 14 nt, Mycobacterium bovis subsp bovis AF2122/97
ggcaggcggccgcc

SEQ ID NO: 3071081 - RNA, 16 nt, Mycobacterium bovis subsp bovis AF2122/97
ggcaggcggccgccgg

SEQ ID NO: 3071082 - RNA, 20 nt, Mycobacterium bovis subsp bovis AF2122/97
ggcaggcuaaucagccaggc

SEQ ID NO: 3071083 - RNA, 15 nt, Mycobacterium bovis subsp bovis AF2122/97
ggcaggcuggcgagg

SEQ ID NO: 3071084 - RNA, 17 nt, Mycobacterium bovis subsp bovis AF2122/97
ggcaggcuggcgagggc

SEQ ID NO: 3071085 - RNA, 19 nt, Mycobacterium bovis subsp bovis AF2122/97
ggcaggcuggcgagggcug

SEQ ID NO: 3071086 - RNA, 22 nt, Mycobacterium bovis subsp bovis AF2122/97
ggcaggcuuagcuuccggguuc

SEQ ID NO: 3071087 - RNA, 16 nt, Mycobacterium bovis subsp bovis AF2122/97
ggcagggcagcccggc

SEQ ID NO: 3071088 - RNA, 15 nt, Mycobacterium bovis subsp bovis AF2122/97
ggcagggccagcggc

SEQ ID NO: 3071089 - RNA, 16 nt, Mycobacterium bovis subsp bovis AF2122/97
ggcagggccagcggca

SEQ ID NO: 3071090 - RNA, 21 nt, Mycobacterium bovis subsp bovis AF2122/97
ggcagggcccccaguucggcg

SEQ ID NO: 3071091 - RNA, 19 nt, Mycobacterium bovis subsp bovis AF2122/97
ggcaggguggccagcaggc

SEQ ID NO: 3071092 - RNA, 21 nt, Mycobacterium bovis subsp bovis AF2122/97
ggcaggguggccagcaggcgg

SEQ ID NO: 3071093 - RNA, 13 nt, Mycobacterium bovis subsp bovis AF2122/97
ggcaggguggggc

SEQ ID NO: 3071094 - RNA, 20 nt, Mycobacterium bovis subsp bovis AF2122/97
ggcaggguguuuauggcccu

SEQ ID NO: 3071095 - RNA, 15 nt, Mycobacterium bovis subsp bovis AF2122/97
ggcagguaacacucg

SEQ ID NO: 3071096 - RNA, 19 nt, Mycobacterium bovis subsp bovis AF2122/97
ggcagguaacacucgaagu

SEQ ID NO: 3071097 - RNA, 22 nt, Mycobacterium bovis subsp bovis AF2122/97
ggcagguaccaccgcggugugg

SEQ ID NO: 3071098 - RNA, 19 nt, Mycobacterium bovis subsp bovis AF2122/97
ggcagguccaucuggcgcg

SEQ ID NO: 3071099 - RNA, 21 nt, Mycobacterium bovis subsp bovis AF2122/97
ggcagguccaucuggcgcgcc

SEQ ID NO: 3071100 - RNA, 13 nt, Mycobacterium bovis subsp bovis AF2122/97
ggcaggucgagcg

SEQ ID NO: 3071101 - RNA, 15 nt, Mycobacterium bovis subsp bovis AF2122/97
ggcaggucgaugcug

SEQ ID NO: 3071102 - RNA, 19 nt, Mycobacterium bovis subsp bovis AF2122/97
ggcaggucuucgcugucga

SEQ ID NO: 3071103 - RNA, 16 nt, Mycobacterium bovis subsp bovis AF2122/97
ggcaggugcggcggca

SEQ ID NO: 3071104 - RNA, 18 nt, Mycobacterium bovis subsp bovis AF2122/97
ggcagguugcguugcagg

SEQ ID NO: 3071105 - RNA, 19 nt, Mycobacterium bovis subsp bovis AF2122/97
ggcagguugcguugcagga

SEQ ID NO: 3071106 - RNA, 21 nt, Mycobacterium bovis subsp bovis AF2122/97
ggcagguugcguugcaggaaa

SEQ ID NO: 3071107 - RNA, 13 nt, Mycobacterium bovis subsp bovis AF2122/97
ggcaguacaccgg

SEQ ID NO: 3071108 - RNA, 22 nt, Mycobacterium bovis subsp bovis AF2122/97
ggcaguacaccggcgugcugug

SEQ ID NO: 3071109 - RNA, 15 nt, Mycobacterium bovis subsp bovis AF2122/97
ggcaguagcuguggc

SEQ ID NO: 3071110 - RNA, 21 nt, Mycobacterium bovis subsp bovis AF2122/97
ggcaguagcuguggcccgcgg

SEQ ID NO: 3071111 - RNA, 17 nt, Mycobacterium bovis subsp bovis AF2122/97
ggcaguaucaucggcgc

SEQ ID NO: 3071112 - RNA, 15 nt, Mycobacterium bovis subsp bovis AF2122/97
ggcaguccaccgcgc

SEQ ID NO: 3071113 - RNA, 21 nt, Mycobacterium bovis subsp bovis AF2122/97
ggcaguccaccgcgcggcgca

SEQ ID NO: 3071114 - RNA, 23 nt, Mycobacterium bovis subsp bovis AF2122/97
ggcaguccaccgcgcggcgcagc

SEQ ID NO: 3071115 - RNA, 14 nt, Mycobacterium bovis subsp bovis AF2122/97
ggcaguccagccgg

SEQ ID NO: 3071116 - RNA, 18 nt, Mycobacterium bovis subsp bovis AF2122/97
ggcaguccagccgggugc

SEQ ID NO: 3071117 - RNA, 14 nt, Mycobacterium bovis subsp bovis AF2122/97
ggcagucccagcgc

SEQ ID NO: 3071118 - RNA, 21 nt, Mycobacterium bovis subsp bovis AF2122/97
ggcagugaaauugccgccgcc

SEQ ID NO: 3071119 - RNA, 20 nt, Mycobacterium bovis subsp bovis AF2122/97
ggcagugagggucccacggc

SEQ ID NO: 3071120 - RNA, 22 nt, Mycobacterium bovis subsp bovis AF2122/97
ggcagugagggucccacggcgg

SEQ ID NO: 3071121 - RNA, 14 nt, Mycobacterium bovis subsp bovis AF2122/97
ggcagugcaggcgg

SEQ ID NO: 3071122 - RNA, 17 nt, Mycobacterium bovis subsp bovis AF2122/97
ggcagugcaggcggccg

SEQ ID NO: 3071123 - RNA, 23 nt, Mycobacterium bovis subsp bovis AF2122/97
ggcagugcgaaaaucgcgcgcga

SEQ ID NO: 3071124 - RNA, 16 nt, Mycobacterium bovis subsp bovis AF2122/97
ggcaguggcagcccgu

SEQ ID NO: 3071125 - RNA, 16 nt, Mycobacterium bovis subsp bovis AF2122/97
ggcaguggccagaccc

SEQ ID NO: 3071126 - RNA, 18 nt, Mycobacterium bovis subsp bovis AF2122/97
ggcaguggccagacccga

SEQ ID NO: 3071127 - RNA, 16 nt, Mycobacterium bovis subsp bovis AF2122/97
ggcaguggcgcggcga

SEQ ID NO: 3071128 - RNA, 23 nt, Mycobacterium bovis subsp bovis AF2122/97
ggcagugggggugguaccggcgg

SEQ ID NO: 3071129 - RNA, 22 nt, Mycobacterium bovis subsp bovis AF2122/97
ggcaguucaacgaggccgacga

SEQ ID NO: 3071130 - RNA, 14 nt, Mycobacterium bovis subsp bovis AF2122/97
ggcaguucgcggcc

SEQ ID NO: 3071131 - RNA, 22 nt, Mycobacterium bovis subsp bovis AF2122/97
ggcaguugaacucgaccaccgc

SEQ ID NO: 3071132 - RNA, 15 nt, Mycobacterium bovis subsp bovis AF2122/97
ggcaguugacccaug

SEQ ID NO: 3071133 - RNA, 18 nt, Mycobacterium bovis subsp bovis AF2122/97
ggcaguugacccaugccg

SEQ ID NO: 3071134 - RNA, 23 nt, Mycobacterium bovis subsp bovis AF2122/97
ggcauaaacaucgguggcgccga

SEQ ID NO: 3071135 - RNA, 19 nt, Mycobacterium bovis subsp bovis AF2122/97
ggcauaaaccgcguccgcg

SEQ ID NO: 3071136 - RNA, 16 nt, Mycobacterium bovis subsp bovis AF2122/97
ggcauaacccuggccg

SEQ ID NO: 3071137 - RNA, 14 nt, Mycobacterium bovis subsp bovis AF2122/97
ggcauacaccguga

SEQ ID NO: 3071138 - RNA, 21 nt, Mycobacterium bovis subsp bovis AF2122/97
ggcauacagcaugucgcggac

SEQ ID NO: 3071139 - RNA, 21 nt, Mycobacterium bovis subsp bovis AF2122/97
ggcauacauccaggcuguggc

SEQ ID NO: 3071140 - RNA, 14 nt, Mycobacterium bovis subsp bovis AF2122/97
ggcauacaucgccu

SEQ ID NO: 3071141 - RNA, 23 nt, Mycobacterium bovis subsp bovis AF2122/97
ggcauacaucgccuugcccagcg

SEQ ID NO: 3071142 - RNA, 20 nt, Mycobacterium bovis subsp bovis AF2122/97
ggcauacccaucaacaucgg

SEQ ID NO: 3071143 - RNA, 17 nt, Mycobacterium bovis subsp bovis AF2122/97
ggcauaccgaacagcac

SEQ ID NO: 3071144 - RNA, 19 nt, Mycobacterium bovis subsp bovis AF2122/97
ggcauaccgaacagcaccu

SEQ ID NO: 3071145 - RNA, 18 nt, Mycobacterium bovis subsp bovis AF2122/97
ggcauagccgaacagcgg

SEQ ID NO: 3071146 - RNA, 19 nt, Mycobacterium bovis subsp bovis AF2122/97
ggcaucaacgcgggcgcuu

SEQ ID NO: 3071147 - RNA, 21 nt, Mycobacterium bovis subsp bovis AF2122/97
ggcaucaagaaacguggugac

SEQ ID NO: 3071148 - RNA, 23 nt, Mycobacterium bovis subsp bovis AF2122/97
ggcaugugacaucgggccgccga

SEQ ID NO: 3071149 - RNA, 13 nt, Mycobacterium bovis subsp bovis AF2122/97
ggcauguucaucg

SEQ ID NO: 3071150 - RNA, 19 nt, Mycobacterium bovis subsp bovis AF2122/97
ggcauguuccuugcggccg

SEQ ID NO: 3071151 - RNA, 21 nt, Mycobacterium bovis subsp bovis AF2122/97
ggcauguugcggaccaguucg

SEQ ID NO: 3071152 - RNA, 21 nt, Mycobacterium bovis subsp bovis AF2122/97
ggcauuaccacuucggcgucc

SEQ ID NO: 3071153 - RNA, 16 nt, Mycobacterium bovis subsp bovis AF2122/97
ggcauucccgcucgca

SEQ ID NO: 3071154 - RNA, 22 nt, Mycobacterium bovis subsp bovis AF2122/97
ggcauuccggugugcuugcucg

SEQ ID NO: 3071155 - RNA, 21 nt, Mycobacterium bovis subsp bovis AF2122/97
ggcauuccuugauaacgaccc

SEQ ID NO: 3071156 - RNA, 18 nt, Mycobacterium bovis subsp bovis AF2122/97
ggcauucgagcacgucgg

SEQ ID NO: 3071157 - RNA, 14 nt, Mycobacterium bovis subsp bovis AF2122/97
ggcauugaccaccg

SEQ ID NO: 3071158 - RNA, 15 nt, Mycobacterium bovis subsp bovis AF2122/97
ggcauugcccgagcc

SEQ ID NO: 3071159 - RNA, 20 nt, Mycobacterium bovis subsp bovis AF2122/97
ggcauugcccgagcccagcg

SEQ ID NO: 3071160 - RNA, 16 nt, Mycobacterium bovis subsp bovis AF2122/97
ggcauugcgcccaccg

SEQ ID NO: 3071161 - RNA, 17 nt, Mycobacterium bovis subsp bovis AF2122/97
ggcauugcgcccaccga

SEQ ID NO: 3071162 - RNA, 14 nt, Mycobacterium bovis subsp bovis AF2122/97
ggcauuggcgucgu

SEQ ID NO: 3071163 - RNA, 18 nt, Mycobacterium bovis subsp bovis AF2122/97
ggcauuucagcgcgccgc

SEQ ID NO: 3071164 - RNA, 13 nt, Mycobacterium bovis subsp bovis AF2122/97
ggccaaaauggcg

SEQ ID NO: 3071165 - RNA, 22 nt, Mycobacterium bovis subsp bovis AF2122/97
ggccaaaauuuugucggccgcc

SEQ ID NO: 3071166 - RNA, 23 nt, Mycobacterium bovis subsp bovis AF2122/97
ggccaaaauuuugucggccgccu

SEQ ID NO: 3071167 - RNA, 21 nt, Mycobacterium bovis subsp bovis AF2122/97
ggccaaaccccugcacggugc

SEQ ID NO: 3071168 - RNA, 15 nt, Mycobacterium bovis subsp bovis AF2122/97
ggccaaacgccauca

SEQ ID NO: 3071169 - RNA, 21 nt, Mycobacterium bovis subsp bovis AF2122/97
ggccaaagacccggcacccag

SEQ ID NO: 3071170 - RNA, 14 nt, Mycobacterium bovis subsp bovis AF2122/97
ggccaaagcgcggg

SEQ ID NO: 3071171 - RNA, 18 nt, Mycobacterium bovis subsp bovis AF2122/97
ggccaaauaacgcgggau

SEQ ID NO: 3071172 - RNA, 21 nt, Mycobacterium bovis subsp bovis AF2122/97
ggccaacaccacuagcggcuc

SEQ ID NO: 3071173 - RNA, 17 nt, Mycobacterium bovis subsp bovis AF2122/97
ggccaacaccgccagca

SEQ ID NO: 3071174 - RNA, 13 nt, Mycobacterium bovis subsp bovis AF2122/97
ggccaacagucgc

SEQ ID NO: 3071175 - RNA, 20 nt, Mycobacterium bovis subsp bovis AF2122/97
ggccaacagucgcagcacgg

SEQ ID NO: 3071176 - RNA, 23 nt, Mycobacterium bovis subsp bovis AF2122/97
ggccaacauccgguggugcucgu

SEQ ID NO: 3071177 - RNA, 19 nt, Mycobacterium bovis subsp bovis AF2122/97
ggccaacccauuucgucag

SEQ ID NO: 3071178 - RNA, 15 nt, Mycobacterium bovis subsp bovis AF2122/97
ggccaacccgggccg

SEQ ID NO: 3071179 - RNA, 20 nt, Mycobacterium bovis subsp bovis AF2122/97
ggccaacccugcggcgucgu

SEQ ID NO: 3071180 - RNA, 18 nt, Mycobacterium bovis subsp bovis AF2122/97
ggccaaccgggugugcgu

SEQ ID NO: 3071181 - RNA, 15 nt, Mycobacterium bovis subsp bovis AF2122/97
ggccaaccggucguc

SEQ ID NO: 3071182 - RNA, 16 nt, Mycobacterium bovis subsp bovis AF2122/97
ggccaaccggucgucu

SEQ ID NO: 3071183 - RNA, 16 nt, Mycobacterium bovis subsp bovis AF2122/97
ggccaacgaacgugcc

SEQ ID NO: 3071184 - RNA, 15 nt, Mycobacterium bovis subsp bovis AF2122/97
ggccaacgacggccg

SEQ ID NO: 3071185 - RNA, 18 nt, Mycobacterium bovis subsp bovis AF2122/97
ggccaacgacggccgaca

SEQ ID NO: 3071186 - RNA, 19 nt, Mycobacterium bovis subsp bovis AF2122/97
ggccaacgacggccgacaa

SEQ ID NO: 3071187 - RNA, 14 nt, Mycobacterium bovis subsp bovis AF2122/97
ggccaacgccgccg

SEQ ID NO: 3071188 - RNA, 17 nt, Mycobacterium bovis subsp bovis AF2122/97
ggccaacggcgcugccg

SEQ ID NO: 3071189 - RNA, 13 nt, Mycobacterium bovis subsp bovis AF2122/97
ggccaacggcucc

SEQ ID NO: 3071190 - RNA, 21 nt, Mycobacterium bovis subsp bovis AF2122/97
ggccaacggcuccgggcgcuc

SEQ ID NO: 3071191 - RNA, 20 nt, Mycobacterium bovis subsp bovis AF2122/97
ggccaacucuucagcaagcc

SEQ ID NO: 3071192 - RNA, 18 nt, Mycobacterium bovis subsp bovis AF2122/97
ggccaacugggccgagcg

SEQ ID NO: 3071193 - RNA, 19 nt, Mycobacterium bovis subsp bovis AF2122/97
ggccaacuucugcacgaac

SEQ ID NO: 3071194 - RNA, 20 nt, Mycobacterium bovis subsp bovis AF2122/97
ggccaacuucugcacgaacg

SEQ ID NO: 3071195 - RNA, 17 nt, Mycobacterium bovis subsp bovis AF2122/97
ggccaacuuggcggcca

SEQ ID NO: 3071196 - RNA, 20 nt, Mycobacterium bovis subsp bovis AF2122/97
ggccaacuuggcggccagcc

SEQ ID NO: 3071197 - RNA, 21 nt, Mycobacterium bovis subsp bovis AF2122/97
ggccaagaaugugggcgacgg

SEQ ID NO: 3071198 - RNA, 21 nt, Mycobacterium bovis subsp bovis AF2122/97
ggccaagaucggcgccccugc

SEQ ID NO: 3071199 - RNA, 13 nt, Mycobacterium bovis subsp bovis AF2122/97
ggccaagauggcg

SEQ ID NO: 3071200 - RNA, 14 nt, Mycobacterium bovis subsp bovis AF2122/97
ggccaagccgcggc

SEQ ID NO: 3071201 - RNA, 14 nt, Mycobacterium bovis subsp bovis AF2122/97
ggccaagcgccaac

SEQ ID NO: 3071202 - RNA, 13 nt, Mycobacterium bovis subsp bovis AF2122/97
ggccaagggugcu

SEQ ID NO: 3071203 - RNA, 15 nt, Mycobacterium bovis subsp bovis AF2122/97
ggccaaggucgaccc

SEQ ID NO: 3071204 - RNA, 15 nt, Mycobacterium bovis subsp bovis AF2122/97
ggccaagguggccac

SEQ ID NO: 3071205 - RNA, 17 nt, Mycobacterium bovis subsp bovis AF2122/97
ggccaagguggccacca

SEQ ID NO: 3071206 - RNA, 18 nt, Mycobacterium bovis subsp bovis AF2122/97
ggccaagucagcccgaag

SEQ ID NO: 3071207 - RNA, 17 nt, Mycobacterium bovis subsp bovis AF2122/97
ggccaaguugcagcggg

SEQ ID NO: 3071208 - RNA, 18 nt, Mycobacterium bovis subsp bovis AF2122/97
ggccaauagaagcacguc

SEQ ID NO: 3071209 - RNA, 15 nt, Mycobacterium bovis subsp bovis AF2122/97
ggccaaucagcccgc

SEQ ID NO: 3071210 - RNA, 17 nt, Mycobacterium bovis subsp bovis AF2122/97
ggccaaucagcccgccg

SEQ ID NO: 3071211 - RNA, 18 nt, Mycobacterium bovis subsp bovis AF2122/97
ggccaauccggcggcgac

SEQ ID NO: 3071212 - RNA, 12 nt, Mycobacterium bovis subsp bovis AF2122/97
ggccaauccggg

SEQ ID NO: 3071213 - RNA, 22 nt, Mycobacterium bovis subsp bovis AF2122/97
ggccaaugacgucggaccagcu

SEQ ID NO: 3071214 - RNA, 22 nt, Mycobacterium bovis subsp bovis AF2122/97
ggccaaugccuugagcaaaaug

SEQ ID NO: 3071215 - RNA, 15 nt, Mycobacterium bovis subsp bovis AF2122/97
ggccaauggccugca

SEQ ID NO: 3071216 - RNA, 18 nt, Mycobacterium bovis subsp bovis AF2122/97
ggccaauggccugcagcg

SEQ ID NO: 3071217 - RNA, 15 nt, Mycobacterium bovis subsp bovis AF2122/97
ggccacaaccucguc

SEQ ID NO: 3071218 - RNA, 20 nt, Mycobacterium bovis subsp bovis AF2122/97
ggccacacucagcacccaau

SEQ ID NO: 3071219 - RNA, 22 nt, Mycobacterium bovis subsp bovis AF2122/97
ggccacagcaacgugugcacca

SEQ ID NO: 3071220 - RNA, 14 nt, Mycobacterium bovis subsp bovis AF2122/97
ggccacagcccggc

SEQ ID NO: 3071221 - RNA, 23 nt, Mycobacterium bovis subsp bovis AF2122/97
ggccacaggaagcgaccgucguc

SEQ ID NO: 3071222 - RNA, 12 nt, Mycobacterium bovis subsp bovis AF2122/97
ggccacagugca

SEQ ID NO: 3071223 - RNA, 13 nt, Mycobacterium bovis subsp bovis AF2122/97
ggccacagugcau

SEQ ID NO: 3071224 - RNA, 14 nt, Mycobacterium bovis subsp bovis AF2122/97
ggccacauaccacc

SEQ ID NO: 3071225 - RNA, 15 nt, Mycobacterium bovis subsp bovis AF2122/97
ggccacauccagcgc

SEQ ID NO: 3071226 - RNA, 13 nt, Mycobacterium bovis subsp bovis AF2122/97
ggccaccacaacg

SEQ ID NO: 3071227 - RNA, 17 nt, Mycobacterium bovis subsp bovis AF2122/97
ggccaccaccacggcca

SEQ ID NO: 3071228 - RNA, 18 nt, Mycobacterium bovis subsp bovis AF2122/97
ggccaccaccaggcugac

SEQ ID NO: 3071229 - RNA, 15 nt, Mycobacterium bovis subsp bovis AF2122/97
ggccaccaccgccgc

SEQ ID NO: 3071230 - RNA, 17 nt, Mycobacterium bovis subsp bovis AF2122/97
ggccaccaccgccgccg

SEQ ID NO: 3071231 - RNA, 19 nt, Mycobacterium bovis subsp bovis AF2122/97
ggccaccaccgccgccggc

SEQ ID NO: 3071232 - RNA, 21 nt, Mycobacterium bovis subsp bovis AF2122/97
ggccaccaccgccgccggcac

SEQ ID NO: 3071233 - RNA, 16 nt, Mycobacterium bovis subsp bovis AF2122/97
ggccaccaccgcgccg

SEQ ID NO: 3071234 - RNA, 12 nt, Mycobacterium bovis subsp bovis AF2122/97
ggccaccaccgu

SEQ ID NO: 3071235 - RNA, 18 nt, Mycobacterium bovis subsp bovis AF2122/97
ggccacguagcagcgccg

SEQ ID NO: 3071236 - RNA, 16 nt, Mycobacterium bovis subsp bovis AF2122/97
ggccacguccucagcc

SEQ ID NO: 3071237 - RNA, 16 nt, Mycobacterium bovis subsp bovis AF2122/97
ggccacguccugcccg

SEQ ID NO: 3071238 - RNA, 21 nt, Mycobacterium bovis subsp bovis AF2122/97
ggccacguccugcccgucguc

SEQ ID NO: 3071239 - RNA, 15 nt, Mycobacterium bovis subsp bovis AF2122/97
ggccacgucgagcac

SEQ ID NO: 3071240 - RNA, 21 nt, Mycobacterium bovis subsp bovis AF2122/97
ggccacguugcgcauaggcga

SEQ ID NO: 3071241 - RNA, 20 nt, Mycobacterium bovis subsp bovis AF2122/97
ggccacucacauuggccagg

SEQ ID NO: 3071242 - RNA, 21 nt, Mycobacterium bovis subsp bovis AF2122/97
ggccacucacauuggccaggu

SEQ ID NO: 3071243 - RNA, 14 nt, Mycobacterium bovis subsp bovis AF2122/97
ggccacucccagcc

SEQ ID NO: 3071244 - RNA, 21 nt, Mycobacterium bovis subsp bovis AF2122/97
ggccacuccgguggccaacac

SEQ ID NO: 3071245 - RNA, 22 nt, Mycobacterium bovis subsp bovis AF2122/97
ggccacugaaccguagcgccca

SEQ ID NO: 3071246 - RNA, 23 nt, Mycobacterium bovis subsp bovis AF2122/97
ggccacugagucugauggccucg

SEQ ID NO: 3071247 - RNA, 21 nt, Mycobacterium bovis subsp bovis AF2122/97
ggccacugcguuccaucgccg

SEQ ID NO: 3071248 - RNA, 19 nt, Mycobacterium bovis subsp bovis AF2122/97
ggccacuugaugcucgaug

SEQ ID NO: 3071249 - RNA, 21 nt, Mycobacterium bovis subsp bovis AF2122/97
ggccacuugaugcucgaugcg

SEQ ID NO: 3071250 - RNA, 18 nt, Mycobacterium bovis subsp bovis AF2122/97
ggccacuugcucggugag

SEQ ID NO: 3071251 - RNA, 19 nt, Mycobacterium bovis subsp bovis AF2122/97
ggccagaaacgcgauggug

SEQ ID NO: 3071252 - RNA, 19 nt, Mycobacterium bovis subsp bovis AF2122/97
ggccagacccaccaccgca

SEQ ID NO: 3071253 - RNA, 12 nt, Mycobacterium bovis subsp bovis AF2122/97
ggccagaccgaa

SEQ ID NO: 3071254 - RNA, 15 nt, Mycobacterium bovis subsp bovis AF2122/97
ggccagaccgcgcgc

SEQ ID NO: 3071255 - RNA, 16 nt, Mycobacterium bovis subsp bovis AF2122/97
ggccagacggugcagc

SEQ ID NO: 3071256 - RNA, 23 nt, Mycobacterium bovis subsp bovis AF2122/97
ggccagacggugcagcuccccgc

SEQ ID NO: 3071257 - RNA, 13 nt, Mycobacterium bovis subsp bovis AF2122/97
ggccagagccgcg

SEQ ID NO: 3071258 - RNA, 16 nt, Mycobacterium bovis subsp bovis AF2122/97
ggccagagucgcccgc

SEQ ID NO: 3071259 - RNA, 20 nt, Mycobacterium bovis subsp bovis AF2122/97
ggccagaguuaccaggucgg

SEQ ID NO: 3071260 - RNA, 16 nt, Mycobacterium bovis subsp bovis AF2122/97
ggccagaucgaagcgc

SEQ ID NO: 3071261 - RNA, 14 nt, Mycobacterium bovis subsp bovis AF2122/97
ggccagaucgccgg

SEQ ID NO: 3071262 - RNA, 22 nt, Mycobacterium bovis subsp bovis AF2122/97
ggccagauuucugggagccggu

SEQ ID NO: 3071263 - RNA, 22 nt, Mycobacterium bovis subsp bovis AF2122/97
ggccagcaacugccgcacccgg

SEQ ID NO: 3071264 - RNA, 22 nt, Mycobacterium bovis subsp bovis AF2122/97
ggccagcaacuuugagcagaag

SEQ ID NO: 3071265 - RNA, 17 nt, Mycobacterium bovis subsp bovis AF2122/97
ggccagcaaguacgcgu

SEQ ID NO: 3071266 - RNA, 19 nt, Mycobacterium bovis subsp bovis AF2122/97
ggccagcaccacggccagc

SEQ ID NO: 3071267 - RNA, 20 nt, Mycobacterium bovis subsp bovis AF2122/97
ggccagcaccacggccagcg

SEQ ID NO: 3071268 - RNA, 22 nt, Mycobacterium bovis subsp bovis AF2122/97
ggccagcaccacggccagcggg

SEQ ID NO: 3071269 - RNA, 13 nt, Mycobacterium bovis subsp bovis AF2122/97
ggccagcacccga

SEQ ID NO: 3071270 - RNA, 18 nt, Mycobacterium bovis subsp bovis AF2122/97
ggccagcacccgaaccgg

SEQ ID NO: 3071271 - RNA, 21 nt, Mycobacterium bovis subsp bovis AF2122/97
ggccagcacccgaaccgggga

SEQ ID NO: 3071272 - RNA, 22 nt, Mycobacterium bovis subsp bovis AF2122/97
ggccagcacccgcuccagcucg

SEQ ID NO: 3071273 - RNA, 14 nt, Mycobacterium bovis subsp bovis AF2122/97
ggccagcaccucga

SEQ ID NO: 3071274 - RNA, 18 nt, Mycobacterium bovis subsp bovis AF2122/97
ggccagcaccucgaccgc

SEQ ID NO: 3071275 - RNA, 20 nt, Mycobacterium bovis subsp bovis AF2122/97
ggccagcaccucgaccgcca

SEQ ID NO: 3071276 - RNA, 13 nt, Mycobacterium bovis subsp bovis AF2122/97
ggccagcacgccg

SEQ ID NO: 3071277 - RNA, 14 nt, Mycobacterium bovis subsp bovis AF2122/97
ggccagcacgccgc

SEQ ID NO: 3071278 - RNA, 16 nt, Mycobacterium bovis subsp bovis AF2122/97
ggccagcacgccgccg

SEQ ID NO: 3071279 - RNA, 17 nt, Mycobacterium bovis subsp bovis AF2122/97
ggccagcacgccgccgg

SEQ ID NO: 3071280 - RNA, 19 nt, Mycobacterium bovis subsp bovis AF2122/97
ggccagcacgccgccggcc

SEQ ID NO: 3071281 - RNA, 24 nt, Mycobacterium bovis subsp bovis AF2122/97
ggccagcacgccgccggccgccag

SEQ ID NO: 3071282 - RNA, 11 nt, Mycobacterium bovis subsp bovis AF2122/97
ggccagcacgg

SEQ ID NO: 3071283 - RNA, 21 nt, Mycobacterium bovis subsp bovis AF2122/97
ggccagcacuccgcgggguug

SEQ ID NO: 3071284 - RNA, 21 nt, Mycobacterium bovis subsp bovis AF2122/97
ggccagcagaaacaucgacag

SEQ ID NO: 3071285 - RNA, 11 nt, Mycobacterium bovis subsp bovis AF2122/97
ggccagcagca

SEQ ID NO: 3071286 - RNA, 12 nt, Mycobacterium bovis subsp bovis AF2122/97
ggccagcagcaa

SEQ ID NO: 3071287 - RNA, 19 nt, Mycobacterium bovis subsp bovis AF2122/97
ggccagcagcaaccgccau

SEQ ID NO: 3071288 - RNA, 14 nt, Mycobacterium bovis subsp bovis AF2122/97
ggccagcagcagau

SEQ ID NO: 3071289 - RNA, 13 nt, Mycobacterium bovis subsp bovis AF2122/97
ggccagcagcagc

SEQ ID NO: 3071290 - RNA, 21 nt, Mycobacterium bovis subsp bovis AF2122/97
ggccagcagcagugccaccgg

SEQ ID NO: 3071291 - RNA, 15 nt, Mycobacterium bovis subsp bovis AF2122/97
ggccagcagccgcga

SEQ ID NO: 3071292 - RNA, 17 nt, Mycobacterium bovis subsp bovis AF2122/97
ggccagcagccgcgacg

SEQ ID NO: 3071293 - RNA, 21 nt, Mycobacterium bovis subsp bovis AF2122/97
ggccagcagccgcgacgcggc

SEQ ID NO: 3071294 - RNA, 22 nt, Mycobacterium bovis subsp bovis AF2122/97
ggccagcagccgcgacgcggcg

SEQ ID NO: 3071295 - RNA, 21 nt, Mycobacterium bovis subsp bovis AF2122/97
ggccagcagcgacuccagcgc

SEQ ID NO: 3071296 - RNA, 14 nt, Mycobacterium bovis subsp bovis AF2122/97
ggccagcagcgcgg

SEQ ID NO: 3071297 - RNA, 13 nt, Mycobacterium bovis subsp bovis AF2122/97
ggccagcaggaug

SEQ ID NO: 3071298 - RNA, 19 nt, Mycobacterium bovis subsp bovis AF2122/97
ggccagcagggccaccacc

SEQ ID NO: 3071299 - RNA, 20 nt, Mycobacterium bovis subsp bovis AF2122/97
ggccagcagggccaccacca

SEQ ID NO: 3071300 - RNA, 13 nt, Mycobacterium bovis subsp bovis AF2122/97
ggccagcaggguu

SEQ ID NO: 3071301 - RNA, 12 nt, Mycobacterium bovis subsp bovis AF2122/97
ggccagcaggua

SEQ ID NO: 3071302 - RNA, 15 nt, Mycobacterium bovis subsp bovis AF2122/97
ggccagcagugcggu

SEQ ID NO: 3071303 - RNA, 20 nt, Mycobacterium bovis subsp bovis AF2122/97
ggccagcaucagcgccagcg

SEQ ID NO: 3071304 - RNA, 17 nt, Mycobacterium bovis subsp bovis AF2122/97
ggccagcaucagcucga

SEQ ID NO: 3071305 - RNA, 22 nt, Mycobacterium bovis subsp bovis AF2122/97
ggccagcaucagcucgaugccg

SEQ ID NO: 3071306 - RNA, 14 nt, Mycobacterium bovis subsp bovis AF2122/97
ggccagcaucauca

SEQ ID NO: 3071307 - RNA, 16 nt, Mycobacterium bovis subsp bovis AF2122/97
ggccagcaucgcggug

SEQ ID NO: 3071308 - RNA, 18 nt, Mycobacterium bovis subsp bovis AF2122/97
ggccagcaugucgggccg

SEQ ID NO: 3071309 - RNA, 20 nt, Mycobacterium bovis subsp bovis AF2122/97
ggccagcaugucgggccgcu

SEQ ID NO: 3071310 - RNA, 14 nt, Mycobacterium bovis subsp bovis AF2122/97
ggccagccagcgau

SEQ ID NO: 3071311 - RNA, 21 nt, Mycobacterium bovis subsp bovis AF2122/97
ggccagccagcgggcgaugag

SEQ ID NO: 3071312 - RNA, 23 nt, Mycobacterium bovis subsp bovis AF2122/97
ggccagccagcgggcgaugagcg

SEQ ID NO: 3071313 - RNA, 12 nt, Mycobacterium bovis subsp bovis AF2122/97
ggccagccaugg

SEQ ID NO: 3071314 - RNA, 19 nt, Mycobacterium bovis subsp bovis AF2122/97
ggccagccauggcagcgcc

SEQ ID NO: 3071315 - RNA, 12 nt, Mycobacterium bovis subsp bovis AF2122/97
ggccagcccagc

SEQ ID NO: 3071316 - RNA, 15 nt, Mycobacterium bovis subsp bovis AF2122/97
ggccagcccagccgg

SEQ ID NO: 3071317 - RNA, 13 nt, Mycobacterium bovis subsp bovis AF2122/97
ggccagcccgagc

SEQ ID NO: 3071318 - RNA, 14 nt, Mycobacterium bovis subsp bovis AF2122/97
ggccagcccgagcu

SEQ ID NO: 3071319 - RNA, 17 nt, Mycobacterium bovis subsp bovis AF2122/97
ggccagcccgagcucgg

SEQ ID NO: 3071320 - RNA, 14 nt, Mycobacterium bovis subsp bovis AF2122/97
ggccagcccgccca

SEQ ID NO: 3071321 - RNA, 18 nt, Mycobacterium bovis subsp bovis AF2122/97
ggccagguuguagacggc

SEQ ID NO: 3071322 - RNA, 17 nt, Mycobacterium bovis subsp bovis AF2122/97
ggccaguacgucgauca

SEQ ID NO: 3071323 - RNA, 15 nt, Mycobacterium bovis subsp bovis AF2122/97
ggccaguaugcggug

SEQ ID NO: 3071324 - RNA, 20 nt, Mycobacterium bovis subsp bovis AF2122/97
ggccagucaggaaaccggcg

SEQ ID NO: 3071325 - RNA, 23 nt, Mycobacterium bovis subsp bovis AF2122/97
ggccagucaggaaaccggcgcgg

SEQ ID NO: 3071326 - RNA, 18 nt, Mycobacterium bovis subsp bovis AF2122/97
ggccagugacucaccgug

SEQ ID NO: 3071327 - RNA, 14 nt, Mycobacterium bovis subsp bovis AF2122/97
ggccagugccaccu

SEQ ID NO: 3071328 - RNA, 16 nt, Mycobacterium bovis subsp bovis AF2122/97
ggccagugccaucgcc

SEQ ID NO: 3071329 - RNA, 22 nt, Mycobacterium bovis subsp bovis AF2122/97
ggccagugccgguucgauggca

SEQ ID NO: 3071330 - RNA, 14 nt, Mycobacterium bovis subsp bovis AF2122/97
ggccagugcgacgu

SEQ ID NO: 3071331 - RNA, 16 nt, Mycobacterium bovis subsp bovis AF2122/97
ggccaguucggcggcc

SEQ ID NO: 3071332 - RNA, 18 nt, Mycobacterium bovis subsp bovis AF2122/97
ggccaguucggugagccg

SEQ ID NO: 3071333 - RNA, 20 nt, Mycobacterium bovis subsp bovis AF2122/97
ggccaguucggugagccggg

SEQ ID NO: 3071334 - RNA, 23 nt, Mycobacterium bovis subsp bovis AF2122/97
ggccaguucggugagccgggcgg

SEQ ID NO: 3071335 - RNA, 13 nt, Mycobacterium bovis subsp bovis AF2122/97
ggccauagcgccg

SEQ ID NO: 3071336 - RNA, 23 nt, Mycobacterium bovis subsp bovis AF2122/97
ggccauagucagacgacgaugau

SEQ ID NO: 3071337 - RNA, 19 nt, Mycobacterium bovis subsp bovis AF2122/97
ggccaucagaaccuccucg

SEQ ID NO: 3071338 - RNA, 14 nt, Mycobacterium bovis subsp bovis AF2122/97
ggccauccaccgca

SEQ ID NO: 3071339 - RNA, 17 nt, Mycobacterium bovis subsp bovis AF2122/97
ggccauccgggcugcca

SEQ ID NO: 3071340 - RNA, 14 nt, Mycobacterium bovis subsp bovis AF2122/97
ggccaucgaccguc

SEQ ID NO: 3071341 - RNA, 23 nt, Mycobacterium bovis subsp bovis AF2122/97
ggccaucgaccguccgggucacc

SEQ ID NO: 3071342 - RNA, 15 nt, Mycobacterium bovis subsp bovis AF2122/97
ggccaucgacgacac

SEQ ID NO: 3071343 - RNA, 13 nt, Mycobacterium bovis subsp bovis AF2122/97
ggccaucgagggc

SEQ ID NO: 3071344 - RNA, 17 nt, Mycobacterium bovis subsp bovis AF2122/97
ggccaucgaguccacca

SEQ ID NO: 3071345 - RNA, 19 nt, Mycobacterium bovis subsp bovis AF2122/97
ggccaucgcauccccagca

SEQ ID NO: 3071346 - RNA, 22 nt, Mycobacterium bovis subsp bovis AF2122/97
ggccaucgcauccccagcacaa

SEQ ID NO: 3071347 - RNA, 17 nt, Mycobacterium bovis subsp bovis AF2122/97
ggccaucgcccgaugcg

SEQ ID NO: 3071348 - RNA, 21 nt, Mycobacterium bovis subsp bovis AF2122/97
ggccaucgcgcggaccagagu

SEQ ID NO: 3071349 - RNA, 23 nt, Mycobacterium bovis subsp bovis AF2122/97
ggccaucgggauggacaccaccu

SEQ ID NO: 3071350 - RNA, 21 nt, Mycobacterium bovis subsp bovis AF2122/97
ggccaucgucaggaaccaccc

SEQ ID NO: 3071351 - RNA, 17 nt, Mycobacterium bovis subsp bovis AF2122/97
ggccaucguccagcagg

SEQ ID NO: 3071352 - RNA, 13 nt, Mycobacterium bovis subsp bovis AF2122/97
ggccaucgugcgg

SEQ ID NO: 3071353 - RNA, 21 nt, Mycobacterium bovis subsp bovis AF2122/97
ggccaucgugcggcacucccu

SEQ ID NO: 3071354 - RNA, 17 nt, Mycobacterium bovis subsp bovis AF2122/97
ggccaucucgucgaugu

SEQ ID NO: 3071355 - RNA, 15 nt, Mycobacterium bovis subsp bovis AF2122/97
ggccaucugauccgg

SEQ ID NO: 3071356 - RNA, 13 nt, Mycobacterium bovis subsp bovis AF2122/97
ggccaucugcucg

SEQ ID NO: 3071357 - RNA, 14 nt, Mycobacterium bovis subsp bovis AF2122/97
ggccaucugcucgu

SEQ ID NO: 3071358 - RNA, 16 nt, Mycobacterium bovis subsp bovis AF2122/97
ggccaucugcucgugg

SEQ ID NO: 3071359 - RNA, 21 nt, Mycobacterium bovis subsp bovis AF2122/97
ggccaucugcucguggguacc

SEQ ID NO: 3071360 - RNA, 17 nt, Mycobacterium bovis subsp bovis AF2122/97
ggccaugaaaaucggca

SEQ ID NO: 3071361 - RNA, 16 nt, Mycobacterium bovis subsp bovis AF2122/97
ggccaugccacaacgc

SEQ ID NO: 3071362 - RNA, 22 nt, Mycobacterium bovis subsp bovis AF2122/97
ggccaugcuaggaccaccagcg

SEQ ID NO: 3071363 - RNA, 13 nt, Mycobacterium bovis subsp bovis AF2122/97
ggccaugcugguc

SEQ ID NO: 3071364 - RNA, 21 nt, Mycobacterium bovis subsp bovis AF2122/97
ggccaugcuggucagcggcgc

SEQ ID NO: 3071365 - RNA, 18 nt, Mycobacterium bovis subsp bovis AF2122/97
ggccauggcagcgcgcug

SEQ ID NO: 3071366 - RNA, 17 nt, Mycobacterium bovis subsp bovis AF2122/97
ggccauggcggcgccgg

SEQ ID NO: 3071367 - RNA, 20 nt, Mycobacterium bovis subsp bovis AF2122/97
ggccauggcggcgccggugg

SEQ ID NO: 3071368 - RNA, 22 nt, Mycobacterium bovis subsp bovis AF2122/97
ggccaugguccaagugggccgg

SEQ ID NO: 3071369 - RNA, 20 nt, Mycobacterium bovis subsp bovis AF2122/97
ggccaugguggcgccgacgu

SEQ ID NO: 3071370 - RNA, 22 nt, Mycobacterium bovis subsp bovis AF2122/97
ggccauguagccguugccgccg

SEQ ID NO: 3071371 - RNA, 16 nt, Mycobacterium bovis subsp bovis AF2122/97
ggccaugucagcggcc

SEQ ID NO: 3071372 - RNA, 20 nt, Mycobacterium bovis subsp bovis AF2122/97
ggccaugucagcggccugcu

SEQ ID NO: 3071373 - RNA, 22 nt, Mycobacterium bovis subsp bovis AF2122/97
ggccaugucagcggccugcucg

SEQ ID NO: 3071374 - RNA, 15 nt, Mycobacterium bovis subsp bovis AF2122/97
ggccauguggggacc

SEQ ID NO: 3071375 - RNA, 17 nt, Mycobacterium bovis subsp bovis AF2122/97
ggccauuagcagcaccc

SEQ ID NO: 3071376 - RNA, 21 nt, Mycobacterium bovis subsp bovis AF2122/97
ggccauucuuggugaucgcga

SEQ ID NO: 3071377 - RNA, 20 nt, Mycobacterium bovis subsp bovis AF2122/97
ggccauugcgggcucaacac

SEQ ID NO: 3071378 - RNA, 23 nt, Mycobacterium bovis subsp bovis AF2122/97
ggcccaaccgcauucggacgcca

SEQ ID NO: 3071379 - RNA, 15 nt, Mycobacterium bovis subsp bovis AF2122/97
ggcccaacgacggca

SEQ ID NO: 3071380 - RNA, 21 nt, Mycobacterium bovis subsp bovis AF2122/97
ggcccaacucccagaacgccg

SEQ ID NO: 3071381 - RNA, 18 nt, Mycobacterium bovis subsp bovis AF2122/97
ggcccaagccguggccgg

SEQ ID NO: 3071382 - RNA, 18 nt, Mycobacterium bovis subsp bovis AF2122/97
ggcccaaggaacggcguc

SEQ ID NO: 3071383 - RNA, 16 nt, Mycobacterium bovis subsp bovis AF2122/97
ggcccaauugcgccga

SEQ ID NO: 3071384 - RNA, 14 nt, Mycobacterium bovis subsp bovis AF2122/97
ggcccacaccagcg

SEQ ID NO: 3071385 - RNA, 17 nt, Mycobacterium bovis subsp bovis AF2122/97
ggcccacaccagcgcag

SEQ ID NO: 3071386 - RNA, 16 nt, Mycobacterium bovis subsp bovis AF2122/97
ggcccacacggucguc

SEQ ID NO: 3071387 - RNA, 20 nt, Mycobacterium bovis subsp bovis AF2122/97
ggcccacacggucgucgcga

SEQ ID NO: 3071388 - RNA, 18 nt, Mycobacterium bovis subsp bovis AF2122/97
ggcccacacuaggcccca

SEQ ID NO: 3071389 - RNA, 19 nt, Mycobacterium bovis subsp bovis AF2122/97
ggcccacauguccagcguc

SEQ ID NO: 3071390 - RNA, 13 nt, Mycobacterium bovis subsp bovis AF2122/97
ggcccaccagcgc

SEQ ID NO: 3071391 - RNA, 15 nt, Mycobacterium bovis subsp bovis AF2122/97
ggcccaccaggccca

SEQ ID NO: 3071392 - RNA, 15 nt, Mycobacterium bovis subsp bovis AF2122/97
ggcccaccgccguug

SEQ ID NO: 3071393 - RNA, 15 nt, Mycobacterium bovis subsp bovis AF2122/97
ggcccaccggccacu

SEQ ID NO: 3071394 - RNA, 14 nt, Mycobacterium bovis subsp bovis AF2122/97
ggcccaccggucgc

SEQ ID NO: 3071395 - RNA, 18 nt, Mycobacterium bovis subsp bovis AF2122/97
ggcccacggcagcgccgg

SEQ ID NO: 3071396 - RNA, 13 nt, Mycobacterium bovis subsp bovis AF2122/97
ggcccacggcgac

SEQ ID NO: 3071397 - RNA, 15 nt, Mycobacterium bovis subsp bovis AF2122/97
ggcccacggcgacca

SEQ ID NO: 3071398 - RNA, 18 nt, Mycobacterium bovis subsp bovis AF2122/97
ggcccacguuggccccgc

SEQ ID NO: 3071399 - RNA, 19 nt, Mycobacterium bovis subsp bovis AF2122/97
ggcccagaucgguugaucg

SEQ ID NO: 3071400 - RNA, 13 nt, Mycobacterium bovis subsp bovis AF2122/97
ggcccagcacggu

SEQ ID NO: 3071401 - RNA, 14 nt, Mycobacterium bovis subsp bovis AF2122/97
ggcccagcagcgca

SEQ ID NO: 3071402 - RNA, 21 nt, Mycobacterium bovis subsp bovis AF2122/97
ggcccagccgagcggcggcac

SEQ ID NO: 3071403 - RNA, 22 nt, Mycobacterium bovis subsp bovis AF2122/97
ggcccagccggaccgcgacggc

SEQ ID NO: 3071404 - RNA, 18 nt, Mycobacterium bovis subsp bovis AF2122/97
ggcccagcgcccccagca

SEQ ID NO: 3071405 - RNA, 17 nt, Mycobacterium bovis subsp bovis AF2122/97
ggcccagcgcgccagcu

SEQ ID NO: 3071406 - RNA, 18 nt, Mycobacterium bovis subsp bovis AF2122/97
ggcccagcgcgccagcuu

SEQ ID NO: 3071407 - RNA, 20 nt, Mycobacterium bovis subsp bovis AF2122/97
ggcccgaaaugccgggcccg

SEQ ID NO: 3071408 - RNA, 16 nt, Mycobacterium bovis subsp bovis AF2122/97
ggcccgacccggccga

SEQ ID NO: 3071409 - RNA, 13 nt, Mycobacterium bovis subsp bovis AF2122/97
ggcccgaccggga

SEQ ID NO: 3071410 - RNA, 12 nt, Mycobacterium bovis subsp bovis AF2122/97
ggcccgaccugu

SEQ ID NO: 3071411 - RNA, 15 nt, Mycobacterium bovis subsp bovis AF2122/97
ggcccgacgacgacg

SEQ ID NO: 3071412 - RNA, 14 nt, Mycobacterium bovis subsp bovis AF2122/97
ggcccgacggcgcc

SEQ ID NO: 3071413 - RNA, 20 nt, Mycobacterium bovis subsp bovis AF2122/97
ggcccgacggcgcccagcgc

SEQ ID NO: 3071414 - RNA, 21 nt, Mycobacterium bovis subsp bovis AF2122/97
ggcccgagccgcgugggccgc

SEQ ID NO: 3071415 - RNA, 22 nt, Mycobacterium bovis subsp bovis AF2122/97
ggcccgagccgcgugggccgcu

SEQ ID NO: 3071416 - RNA, 15 nt, Mycobacterium bovis subsp bovis AF2122/97
ggcccgagcgcgcgc

SEQ ID NO: 3071417 - RNA, 17 nt, Mycobacterium bovis subsp bovis AF2122/97
ggcccgaggcggguaca

SEQ ID NO: 3071418 - RNA, 20 nt, Mycobacterium bovis subsp bovis AF2122/97
ggcccgaggcucgggccgca

SEQ ID NO: 3071419 - RNA, 23 nt, Mycobacterium bovis subsp bovis AF2122/97
ggcccgaggugccggggccccau

SEQ ID NO: 3071420 - RNA, 22 nt, Mycobacterium bovis subsp bovis AF2122/97
ggcccgaguuggcgaagcccga

SEQ ID NO: 3071421 - RNA, 20 nt, Mycobacterium bovis subsp bovis AF2122/97
ggcccgauagaucgcgugga

SEQ ID NO: 3071422 - RNA, 16 nt, Mycobacterium bovis subsp bovis AF2122/97
ggcccgaucaccaucc

SEQ ID NO: 3071423 - RNA, 13 nt, Mycobacterium bovis subsp bovis AF2122/97
ggcccgauccagu

SEQ ID NO: 3071424 - RNA, 15 nt, Mycobacterium bovis subsp bovis AF2122/97
ggcccgaucgaccgc

SEQ ID NO: 3071425 - RNA, 19 nt, Mycobacterium bovis subsp bovis AF2122/97
ggcccgaucgaccgcugga

SEQ ID NO: 3071426 - RNA, 16 nt, Mycobacterium bovis subsp bovis AF2122/97
ggcccgaugucgucga

SEQ ID NO: 3071427 - RNA, 21 nt, Mycobacterium bovis subsp bovis AF2122/97
ggcccgaugucgucgacgagg

SEQ ID NO: 3071428 - RNA, 21 nt, Mycobacterium bovis subsp bovis AF2122/97
ggcccgauugaguucggcggc

SEQ ID NO: 3071429 - RNA, 22 nt, Mycobacterium bovis subsp bovis AF2122/97
ggcccgauugaguucggcggcc

SEQ ID NO: 3071430 - RNA, 23 nt, Mycobacterium bovis subsp bovis AF2122/97
ggcccgauugaguucggcggcca

SEQ ID NO: 3071431 - RNA, 20 nt, Mycobacterium bovis subsp bovis AF2122/97
ggcccgcaacaucgggucgc

SEQ ID NO: 3071432 - RNA, 21 nt, Mycobacterium bovis subsp bovis AF2122/97
ggcccgcaccgcugaccccgg

SEQ ID NO: 3071433 - RNA, 16 nt, Mycobacterium bovis subsp bovis AF2122/97
ggcccgcacgaaccgg

SEQ ID NO: 3071434 - RNA, 20 nt, Mycobacterium bovis subsp bovis AF2122/97
ggcccgcagcagcaucggca

SEQ ID NO: 3071435 - RNA, 23 nt, Mycobacterium bovis subsp bovis AF2122/97
ggcccgcagcccgccgggcucca

SEQ ID NO: 3071436 - RNA, 14 nt, Mycobacterium bovis subsp bovis AF2122/97
ggcccgcagcgugu

SEQ ID NO: 3071437 - RNA, 12 nt, Mycobacterium bovis subsp bovis AF2122/97
ggcccgcagguc

SEQ ID NO: 3071438 - RNA, 15 nt, Mycobacterium bovis subsp bovis AF2122/97
ggcccgcauccgcac

SEQ ID NO: 3071439 - RNA, 20 nt, Mycobacterium bovis subsp bovis AF2122/97
ggcccgccacaacggcggcg

SEQ ID NO: 3071440 - RNA, 17 nt, Mycobacterium bovis subsp bovis AF2122/97
ggcccgccacgaugucg

SEQ ID NO: 3071441 - RNA, 19 nt, Mycobacterium bovis subsp bovis AF2122/97
ggcccgccagcccagcacg

SEQ ID NO: 3071442 - RNA, 20 nt, Mycobacterium bovis subsp bovis AF2122/97
ggcccgccagcccagcacgc

SEQ ID NO: 3071443 - RNA, 12 nt, Mycobacterium bovis subsp bovis AF2122/97
ggcccgcccgua

SEQ ID NO: 3071444 - RNA, 11 nt, Mycobacterium bovis subsp bovis AF2122/97
ggcccgccggc

SEQ ID NO: 3071445 - RNA, 14 nt, Mycobacterium bovis subsp bovis AF2122/97
ggcccgccggcccc

SEQ ID NO: 3071446 - RNA, 15 nt, Mycobacterium bovis subsp bovis AF2122/97
ggcccgccggccccg

SEQ ID NO: 3071447 - RNA, 16 nt, Mycobacterium bovis subsp bovis AF2122/97
ggcccgccggccccgc

SEQ ID NO: 3071448 - RNA, 21 nt, Mycobacterium bovis subsp bovis AF2122/97
ggcccgccgucaccgccguug

SEQ ID NO: 3071449 - RNA, 17 nt, Mycobacterium bovis subsp bovis AF2122/97
ggcccgccguccggcgc

SEQ ID NO: 3071450 - RNA, 18 nt, Mycobacterium bovis subsp bovis AF2122/97
ggcccgccucggcggcgg

SEQ ID NO: 3071451 - RNA, 17 nt, Mycobacterium bovis subsp bovis AF2122/97
ggcccgcgagauagcac

SEQ ID NO: 3071452 - RNA, 12 nt, Mycobacterium bovis subsp bovis AF2122/97
ggcccgcgcgua

SEQ ID NO: 3071453 - RNA, 22 nt, Mycobacterium bovis subsp bovis AF2122/97
ggcccgcgcguacccgaucagc

SEQ ID NO: 3071454 - RNA, 16 nt, Mycobacterium bovis subsp bovis AF2122/97
ggcccgcgggcaagcc

SEQ ID NO: 3071455 - RNA, 12 nt, Mycobacterium bovis subsp bovis AF2122/97
ggcccgcgguga

SEQ ID NO: 3071456 - RNA, 21 nt, Mycobacterium bovis subsp bovis AF2122/97
ggcccgcggugacgcaacauc

SEQ ID NO: 3071457 - RNA, 12 nt, Mycobacterium bovis subsp bovis AF2122/97
ggcccgcggugg

SEQ ID NO: 3071458 - RNA, 19 nt, Mycobacterium bovis subsp bovis AF2122/97
ggcccgcguucucggcacc

SEQ ID NO: 3071459 - RNA, 14 nt, Mycobacterium bovis subsp bovis AF2122/97
ggcccgcucagccg

SEQ ID NO: 3071460 - RNA, 15 nt, Mycobacterium bovis subsp bovis AF2122/97
ggcccgcucagccgu

SEQ ID NO: 3071461 - RNA, 19 nt, Mycobacterium bovis subsp bovis AF2122/97
ggcccgcuccacggucagg

SEQ ID NO: 3071462 - RNA, 22 nt, Mycobacterium bovis subsp bovis AF2122/97
ggcccgcuccacggucaggcgu

SEQ ID NO: 3071463 - RNA, 13 nt, Mycobacterium bovis subsp bovis AF2122/97
ggcccgcucccug

SEQ ID NO: 3071464 - RNA, 14 nt, Mycobacterium bovis subsp bovis AF2122/97
ggcccgcucccugc

SEQ ID NO: 3071465 - RNA, 17 nt, Mycobacterium bovis subsp bovis AF2122/97
ggcccgcucccugcacc

SEQ ID NO: 3071466 - RNA, 15 nt, Mycobacterium bovis subsp bovis AF2122/97
ggcccgcucgaaagc

SEQ ID NO: 3071467 - RNA, 20 nt, Mycobacterium bovis subsp bovis AF2122/97
ggcccgcucgaucggcagcc

SEQ ID NO: 3071468 - RNA, 14 nt, Mycobacterium bovis subsp bovis AF2122/97
ggcccgcucggggu

SEQ ID NO: 3071469 - RNA, 22 nt, Mycobacterium bovis subsp bovis AF2122/97
ggcccgcucgggguugcucgcg

SEQ ID NO: 3071470 - RNA, 20 nt, Mycobacterium bovis subsp bovis AF2122/97
ggcccgcugaccaucacacc

SEQ ID NO: 3071471 - RNA, 20 nt, Mycobacterium bovis subsp bovis AF2122/97
ggcccggacaugcgggcagc

SEQ ID NO: 3071472 - RNA, 17 nt, Mycobacterium bovis subsp bovis AF2122/97
ggcccggacgucggcgg

SEQ ID NO: 3071473 - RNA, 19 nt, Mycobacterium bovis subsp bovis AF2122/97
ggcccggacgucggcggcc

SEQ ID NO: 3071474 - RNA, 23 nt, Mycobacterium bovis subsp bovis AF2122/97
ggcccggacgucggcggccguca

SEQ ID NO: 3071475 - RNA, 13 nt, Mycobacterium bovis subsp bovis AF2122/97
ggcccggcaccgc

SEQ ID NO: 3071476 - RNA, 14 nt, Mycobacterium bovis subsp bovis AF2122/97
ggcccggcaggacu

SEQ ID NO: 3071477 - RNA, 18 nt, Mycobacterium bovis subsp bovis AF2122/97
ggcccggcccuccgggcc

SEQ ID NO: 3071478 - RNA, 15 nt, Mycobacterium bovis subsp bovis AF2122/97
ggcccggccggacgg

SEQ ID NO: 3071479 - RNA, 19 nt, Mycobacterium bovis subsp bovis AF2122/97
ggcccggcgaacaggcgac

SEQ ID NO: 3071480 - RNA, 23 nt, Mycobacterium bovis subsp bovis AF2122/97
ggcccggcgaacaggcgaccggg

SEQ ID NO: 3071481 - RNA, 13 nt, Mycobacterium bovis subsp bovis AF2122/97
ggcccggcgagcu

SEQ ID NO: 3071482 - RNA, 17 nt, Mycobacterium bovis subsp bovis AF2122/97
ggcccggcgcggccgca

SEQ ID NO: 3071483 - RNA, 19 nt, Mycobacterium bovis subsp bovis AF2122/97
ggcccggcgcggccgcaag

SEQ ID NO: 3071484 - RNA, 18 nt, Mycobacterium bovis subsp bovis AF2122/97
ggcccggcuacgacggcg

SEQ ID NO: 3071485 - RNA, 21 nt, Mycobacterium bovis subsp bovis AF2122/97
ggcccggcuacgacggcgcca

SEQ ID NO: 3071486 - RNA, 20 nt, Mycobacterium bovis subsp bovis AF2122/97
ggcccggcucacagcacagc

SEQ ID NO: 3071487 - RNA, 13 nt, Mycobacterium bovis subsp bovis AF2122/97
ggcccggcucggu

SEQ ID NO: 3071488 - RNA, 15 nt, Mycobacterium bovis subsp bovis AF2122/97
ggcccggcucggugc

SEQ ID NO: 3071489 - RNA, 19 nt, Mycobacterium bovis subsp bovis AF2122/97
ggcccggcucggugcgcca

SEQ ID NO: 3071490 - RNA, 14 nt, Mycobacterium bovis subsp bovis AF2122/97
ggcccgggccaccg

SEQ ID NO: 3071491 - RNA, 15 nt, Mycobacterium bovis subsp bovis AF2122/97
ggcccgggccaccgg

SEQ ID NO: 3071492 - RNA, 13 nt, Mycobacterium bovis subsp bovis AF2122/97
ggcccgggcccgc

SEQ ID NO: 3071493 - RNA, 17 nt, Mycobacterium bovis subsp bovis AF2122/97
ggcccgggccgaagcgc

SEQ ID NO: 3071494 - RNA, 13 nt, Mycobacterium bovis subsp bovis AF2122/97
ggccgaagaaaac

SEQ ID NO: 3071495 - RNA, 18 nt, Mycobacterium bovis subsp bovis AF2122/97
ggccgaagacgugccggc

SEQ ID NO: 3071496 - RNA, 18 nt, Mycobacterium bovis subsp bovis AF2122/97
ggccgaagcccgaucggc

SEQ ID NO: 3071497 - RNA, 20 nt, Mycobacterium bovis subsp bovis AF2122/97
ggccgaagcucacacuggcu

SEQ ID NO: 3071498 - RNA, 18 nt, Mycobacterium bovis subsp bovis AF2122/97
ggccgaauccguccgacg

SEQ ID NO: 3071499 - RNA, 19 nt, Mycobacterium bovis subsp bovis AF2122/97
ggccgaaucuccgccguga

SEQ ID NO: 3071500 - RNA, 14 nt, Mycobacterium bovis subsp bovis AF2122/97
ggccgacaacccgg

SEQ ID NO: 3071501 - RNA, 17 nt, Mycobacterium bovis subsp bovis AF2122/97
ggccgacaaugucggcg

SEQ ID NO: 3071502 - RNA, 11 nt, Mycobacterium bovis subsp bovis AF2122/97
ggccgacaccg

SEQ ID NO: 3071503 - RNA, 20 nt, Mycobacterium bovis subsp bovis AF2122/97
ggccgacaccgccaccacgc

SEQ ID NO: 3071504 - RNA, 17 nt, Mycobacterium bovis subsp bovis AF2122/97
ggccgacacgccgaugc

SEQ ID NO: 3071505 - RNA, 17 nt, Mycobacterium bovis subsp bovis AF2122/97
ggccgacagccaccgcg

SEQ ID NO: 3071506 - RNA, 13 nt, Mycobacterium bovis subsp bovis AF2122/97
ggccgaccagagc

SEQ ID NO: 3071507 - RNA, 18 nt, Mycobacterium bovis subsp bovis AF2122/97
ggccgaccagagcuucgc

SEQ ID NO: 3071508 - RNA, 13 nt, Mycobacterium bovis subsp bovis AF2122/97
ggccgaccagcac

SEQ ID NO: 3071509 - RNA, 16 nt, Mycobacterium bovis subsp bovis AF2122/97
ggccgacccggauguc

SEQ ID NO: 3071510 - RNA, 18 nt, Mycobacterium bovis subsp bovis AF2122/97
ggccgaccgcgacccggc

SEQ ID NO: 3071511 - RNA, 21 nt, Mycobacterium bovis subsp bovis AF2122/97
ggccgaccgcgacccggccca

SEQ ID NO: 3071512 - RNA, 22 nt, Mycobacterium bovis subsp bovis AF2122/97
ggccgaccgcgacccggcccag

SEQ ID NO: 3071513 - RNA, 20 nt, Mycobacterium bovis subsp bovis AF2122/97
ggccgaccuguaugccgcgg

SEQ ID NO: 3071514 - RNA, 18 nt, Mycobacterium bovis subsp bovis AF2122/97
ggccgacgaacagcggug

SEQ ID NO: 3071515 - RNA, 22 nt, Mycobacterium bovis subsp bovis AF2122/97
ggccgacgcugcugauggugac

SEQ ID NO: 3071516 - RNA, 16 nt, Mycobacterium bovis subsp bovis AF2122/97
ggccgacgggacaacc

SEQ ID NO: 3071517 - RNA, 18 nt, Mycobacterium bovis subsp bovis AF2122/97
ggccgacgucgaccacug

SEQ ID NO: 3071518 - RNA, 19 nt, Mycobacterium bovis subsp bovis AF2122/97
ggccgacgucgaccacugc

SEQ ID NO: 3071519 - RNA, 16 nt, Mycobacterium bovis subsp bovis AF2122/97
ggccgacgugaccagc

SEQ ID NO: 3071520 - RNA, 17 nt, Mycobacterium bovis subsp bovis AF2122/97
ggccgacgugaccagcu

SEQ ID NO: 3071521 - RNA, 14 nt, Mycobacterium bovis subsp bovis AF2122/97
ggccgacucgaggu

SEQ ID NO: 3071522 - RNA, 16 nt, Mycobacterium bovis subsp bovis AF2122/97
ggccgacuuggugacc

SEQ ID NO: 3071523 - RNA, 20 nt, Mycobacterium bovis subsp bovis AF2122/97
ggccgagaucacgccgggcg

SEQ ID NO: 3071524 - RNA, 18 nt, Mycobacterium bovis subsp bovis AF2122/97
ggccgagcagggccggca

SEQ ID NO: 3071525 - RNA, 14 nt, Mycobacterium bovis subsp bovis AF2122/97
ggccgagcccggug

SEQ ID NO: 3071526 - RNA, 12 nt, Mycobacterium bovis subsp bovis AF2122/97
ggccgagccgac

SEQ ID NO: 3071527 - RNA, 13 nt, Mycobacterium bovis subsp bovis AF2122/97
ggccgagccgcgg

SEQ ID NO: 3071528 - RNA, 16 nt, Mycobacterium bovis subsp bovis AF2122/97
ggccgagccgcgguca

SEQ ID NO: 3071529 - RNA, 18 nt, Mycobacterium bovis subsp bovis AF2122/97
ggccgagcgcaccacggc

SEQ ID NO: 3071530 - RNA, 19 nt, Mycobacterium bovis subsp bovis AF2122/97
ggccgagcgcaccacggcg

SEQ ID NO: 3071531 - RNA, 15 nt, Mycobacterium bovis subsp bovis AF2122/97
ggccgagcgcaccgc

SEQ ID NO: 3071532 - RNA, 17 nt, Mycobacterium bovis subsp bovis AF2122/97
ggccgagcgcaccgcug

SEQ ID NO: 3071533 - RNA, 15 nt, Mycobacterium bovis subsp bovis AF2122/97
ggccgagcgcgauga

SEQ ID NO: 3071534 - RNA, 14 nt, Mycobacterium bovis subsp bovis AF2122/97
ggccgagcgcgccg

SEQ ID NO: 3071535 - RNA, 22 nt, Mycobacterium bovis subsp bovis AF2122/97
ggccgagcucguugcuggcggc

SEQ ID NO: 3071536 - RNA, 15 nt, Mycobacterium bovis subsp bovis AF2122/97
ggccgaggccgucgc

SEQ ID NO: 3071537 - RNA, 16 nt, Mycobacterium bovis subsp bovis AF2122/97
ggccgaggccgucgcg

SEQ ID NO: 3071538 - RNA, 22 nt, Mycobacterium bovis subsp bovis AF2122/97
ggccgaguaccagcccaccggc

SEQ ID NO: 3071539 - RNA, 23 nt, Mycobacterium bovis subsp bovis AF2122/97
ggccgaguaccagcccaccggcg

SEQ ID NO: 3071540 - RNA, 16 nt, Mycobacterium bovis subsp bovis AF2122/97
ggccgaguagaugguc

SEQ ID NO: 3071541 - RNA, 13 nt, Mycobacterium bovis subsp bovis AF2122/97
ggccgaguccggc

SEQ ID NO: 3071542 - RNA, 16 nt, Mycobacterium bovis subsp bovis AF2122/97
ggccgaguucgucagc

SEQ ID NO: 3071543 - RNA, 19 nt, Mycobacterium bovis subsp bovis AF2122/97
ggccgaucaccccggugga

SEQ ID NO: 3071544 - RNA, 13 nt, Mycobacterium bovis subsp bovis AF2122/97
ggccgaucagcgc

SEQ ID NO: 3071545 - RNA, 17 nt, Mycobacterium bovis subsp bovis AF2122/97
ggccgaucagcgcggcg

SEQ ID NO: 3071546 - RNA, 13 nt, Mycobacterium bovis subsp bovis AF2122/97
ggccgaucagcgu

SEQ ID NO: 3071547 - RNA, 22 nt, Mycobacterium bovis subsp bovis AF2122/97
ggccgaucagcguggcgcccgu

SEQ ID NO: 3071548 - RNA, 16 nt, Mycobacterium bovis subsp bovis AF2122/97
ggccgaucccaccggc

SEQ ID NO: 3071549 - RNA, 20 nt, Mycobacterium bovis subsp bovis AF2122/97
ggccgaucucuccggcggcg

SEQ ID NO: 3071550 - RNA, 21 nt, Mycobacterium bovis subsp bovis AF2122/97
ggccgaugacgaugccgccga

SEQ ID NO: 3071551 - RNA, 14 nt, Mycobacterium bovis subsp bovis AF2122/97
ggccgaugagccca

SEQ ID NO: 3071552 - RNA, 16 nt, Mycobacterium bovis subsp bovis AF2122/97
ggccgaugagcccagc

SEQ ID NO: 3071553 - RNA, 20 nt, Mycobacterium bovis subsp bovis AF2122/97
ggccgaugagcccagccgcg

SEQ ID NO: 3071554 - RNA, 21 nt, Mycobacterium bovis subsp bovis AF2122/97
ggccgaugagcccagccgcgg

SEQ ID NO: 3071555 - RNA, 23 nt, Mycobacterium bovis subsp bovis AF2122/97
ggccgaugagcccagccgcgggc

SEQ ID NO: 3071556 - RNA, 21 nt, Mycobacterium bovis subsp bovis AF2122/97
ggccgaugcgcagugcaccgc

SEQ ID NO: 3071557 - RNA, 12 nt, Mycobacterium bovis subsp bovis AF2122/97
ggccgauggcgu

SEQ ID NO: 3071558 - RNA, 17 nt, Mycobacterium bovis subsp bovis AF2122/97
ggccgauggcgucaagc

SEQ ID NO: 3071559 - RNA, 18 nt, Mycobacterium bovis subsp bovis AF2122/97
ggccgaugugucgaugag

SEQ ID NO: 3071560 - RNA, 20 nt, Mycobacterium bovis subsp bovis AF2122/97
ggccgcaacugcagguucuu

SEQ ID NO: 3071561 - RNA, 22 nt, Mycobacterium bovis subsp bovis AF2122/97
ggccgcaaggcgccgauaccgg

SEQ ID NO: 3071562 - RNA, 21 nt, Mycobacterium bovis subsp bovis AF2122/97
ggccgcaaucaugucagcgcu

SEQ ID NO: 3071563 - RNA, 15 nt, Mycobacterium bovis subsp bovis AF2122/97
ggccgcaaugcguug

SEQ ID NO: 3071564 - RNA, 22 nt, Mycobacterium bovis subsp bovis AF2122/97
ggccgcacaaguggucgaugaa

SEQ ID NO: 3071565 - RNA, 13 nt, Mycobacterium bovis subsp bovis AF2122/97
ggccgcaccagca

SEQ ID NO: 3071566 - RNA, 14 nt, Mycobacterium bovis subsp bovis AF2122/97
ggccgcaccagcau

SEQ ID NO: 3071567 - RNA, 15 nt, Mycobacterium bovis subsp bovis AF2122/97
ggccgcaccagcauu

SEQ ID NO: 3071568 - RNA, 16 nt, Mycobacterium bovis subsp bovis AF2122/97
ggccgcacgccgacca

SEQ ID NO: 3071569 - RNA, 19 nt, Mycobacterium bovis subsp bovis AF2122/97
ggccgcacgccgaccagca

SEQ ID NO: 3071570 - RNA, 22 nt, Mycobacterium bovis subsp bovis AF2122/97
ggccgcacgccgaccagcaccc

SEQ ID NO: 3071571 - RNA, 18 nt, Mycobacterium bovis subsp bovis AF2122/97
ggccgcacgccggccagc

SEQ ID NO: 3071572 - RNA, 19 nt, Mycobacterium bovis subsp bovis AF2122/97
ggccgcacgccggccagcg

SEQ ID NO: 3071573 - RNA, 22 nt, Mycobacterium bovis subsp bovis AF2122/97
ggccgcacguauccacggucga

SEQ ID NO: 3071574 - RNA, 13 nt, Mycobacterium bovis subsp bovis AF2122/97
ggccgcacgucga

SEQ ID NO: 3071575 - RNA, 16 nt, Mycobacterium bovis subsp bovis AF2122/97
ggccgcacugcugguc

SEQ ID NO: 3071576 - RNA, 15 nt, Mycobacterium bovis subsp bovis AF2122/97
ggccgcacugggugc

SEQ ID NO: 3071577 - RNA, 22 nt, Mycobacterium bovis subsp bovis AF2122/97
ggccgcagccagcaagucugcc

SEQ ID NO: 3071578 - RNA, 21 nt, Mycobacterium bovis subsp bovis AF2122/97
ggccgcagcggccagcccagc

SEQ ID NO: 3071579 - RNA, 15 nt, Mycobacterium bovis subsp bovis AF2122/97
ggccgcaguggcaag

SEQ ID NO: 3071580 - RNA, 18 nt, Mycobacterium bovis subsp bovis AF2122/97
ggccgcauauugcggcgc

SEQ ID NO: 3071581 - RNA, 13 nt, Mycobacterium bovis subsp bovis AF2122/97
ggccgccggcgcc

SEQ ID NO: 3071582 - RNA, 21 nt, Mycobacterium bovis subsp bovis AF2122/97
ggccgccggguccggaaccgg

SEQ ID NO: 3071583 - RNA, 12 nt, Mycobacterium bovis subsp bovis AF2122/97
ggccgccguccc

SEQ ID NO: 3071584 - RNA, 17 nt, Mycobacterium bovis subsp bovis AF2122/97
ggccgccguccccgccg

SEQ ID NO: 3071585 - RNA, 14 nt, Mycobacterium bovis subsp bovis AF2122/97
ggccgccgugguga

SEQ ID NO: 3071586 - RNA, 14 nt, Mycobacterium bovis subsp bovis AF2122/97
ggccgccguugccg

SEQ ID NO: 3071587 - RNA, 16 nt, Mycobacterium bovis subsp bovis AF2122/97
ggccgccuccgcggca

SEQ ID NO: 3071588 - RNA, 15 nt, Mycobacterium bovis subsp bovis AF2122/97
ggccgccucgcggau

SEQ ID NO: 3071589 - RNA, 17 nt, Mycobacterium bovis subsp bovis AF2122/97
ggccgccucgcggauga

SEQ ID NO: 3071590 - RNA, 19 nt, Mycobacterium bovis subsp bovis AF2122/97
ggccgccuucuccggcguc

SEQ ID NO: 3071591 - RNA, 23 nt, Mycobacterium bovis subsp bovis AF2122/97
ggccgccuucuccggcgucacgg

SEQ ID NO: 3071592 - RNA, 20 nt, Mycobacterium bovis subsp bovis AF2122/97
ggccgccuugaggcccugcg

SEQ ID NO: 3071593 - RNA, 23 nt, Mycobacterium bovis subsp bovis AF2122/97
ggccgccuugaggcccugcggcc

SEQ ID NO: 3071594 - RNA, 22 nt, Mycobacterium bovis subsp bovis AF2122/97
ggccgcgaaugcugugccgaga

SEQ ID NO: 3071595 - RNA, 13 nt, Mycobacterium bovis subsp bovis AF2122/97
ggccgcgaccagc

SEQ ID NO: 3071596 - RNA, 14 nt, Mycobacterium bovis subsp bovis AF2122/97
ggccgcgaccagcg

SEQ ID NO: 3071597 - RNA, 17 nt, Mycobacterium bovis subsp bovis AF2122/97
ggccgcgaccagcgccg

SEQ ID NO: 3071598 - RNA, 13 nt, Mycobacterium bovis subsp bovis AF2122/97
ggccgcgaccgcg

SEQ ID NO: 3071599 - RNA, 15 nt, Mycobacterium bovis subsp bovis AF2122/97
ggccgcgacgacacg

SEQ ID NO: 3071600 - RNA, 17 nt, Mycobacterium bovis subsp bovis AF2122/97
ggccgcgacguugaacu

SEQ ID NO: 3071601 - RNA, 15 nt, Mycobacterium bovis subsp bovis AF2122/97
ggccgcgagguaccc

SEQ ID NO: 3071602 - RNA, 17 nt, Mycobacterium bovis subsp bovis AF2122/97
ggccgcgauccagcgcu

SEQ ID NO: 3071603 - RNA, 21 nt, Mycobacterium bovis subsp bovis AF2122/97
ggccgcgaucccggccgucgc

SEQ ID NO: 3071604 - RNA, 21 nt, Mycobacterium bovis subsp bovis AF2122/97
ggccgcgcacccguccgccgc

SEQ ID NO: 3071605 - RNA, 15 nt, Mycobacterium bovis subsp bovis AF2122/97
ggccgcgcaggggcg

SEQ ID NO: 3071606 - RNA, 19 nt, Mycobacterium bovis subsp bovis AF2122/97
ggccgcgcaggggcggcgu

SEQ ID NO: 3071607 - RNA, 14 nt, Mycobacterium bovis subsp bovis AF2122/97
ggccgcgcaugguc

SEQ ID NO: 3071608 - RNA, 12 nt, Mycobacterium bovis subsp bovis AF2122/97
ggccgcgcccgc

SEQ ID NO: 3071609 - RNA, 16 nt, Mycobacterium bovis subsp bovis AF2122/97
ggccgcgccggccccg

SEQ ID NO: 3071610 - RNA, 13 nt, Mycobacterium bovis subsp bovis AF2122/97
ggccgcgccgggg

SEQ ID NO: 3071611 - RNA, 14 nt, Mycobacterium bovis subsp bovis AF2122/97
ggccgcgccgggga

SEQ ID NO: 3071612 - RNA, 21 nt, Mycobacterium bovis subsp bovis AF2122/97
ggccgcgcgacaacccggcgu

SEQ ID NO: 3071613 - RNA, 22 nt, Mycobacterium bovis subsp bovis AF2122/97
ggccgcgcgacaacccggcguc

SEQ ID NO: 3071614 - RNA, 15 nt, Mycobacterium bovis subsp bovis AF2122/97
ggccgcgcgcaccgg

SEQ ID NO: 3071615 - RNA, 14 nt, Mycobacterium bovis subsp bovis AF2122/97
ggccgcgcgcucga

SEQ ID NO: 3071616 - RNA, 12 nt, Mycobacterium bovis subsp bovis AF2122/97
ggccgcgcggcg

SEQ ID NO: 3071617 - RNA, 13 nt, Mycobacterium bovis subsp bovis AF2122/97
ggccgcgcggcga

SEQ ID NO: 3071618 - RNA, 13 nt, Mycobacterium bovis subsp bovis AF2122/97
ggccgcgcggcgg

SEQ ID NO: 3071619 - RNA, 16 nt, Mycobacterium bovis subsp bovis AF2122/97
ggccgcgcggcggcgc

SEQ ID NO: 3071620 - RNA, 19 nt, Mycobacterium bovis subsp bovis AF2122/97
ggccgcgcggcggcgccgg

SEQ ID NO: 3071621 - RNA, 22 nt, Mycobacterium bovis subsp bovis AF2122/97
ggccgcgcggcggcgccggcgc

SEQ ID NO: 3071622 - RNA, 20 nt, Mycobacterium bovis subsp bovis AF2122/97
ggccgcgcucaucgcggcga

SEQ ID NO: 3071623 - RNA, 22 nt, Mycobacterium bovis subsp bovis AF2122/97
ggccgcgcucaucgcggcgaac

SEQ ID NO: 3071624 - RNA, 15 nt, Mycobacterium bovis subsp bovis AF2122/97
ggccgcgcucgucga

SEQ ID NO: 3071625 - RNA, 19 nt, Mycobacterium bovis subsp bovis AF2122/97
ggccgcgcugcagcacggc

SEQ ID NO: 3071626 - RNA, 23 nt, Mycobacterium bovis subsp bovis AF2122/97
ggccgcggagaaggcgcgggcga

SEQ ID NO: 3071627 - RNA, 15 nt, Mycobacterium bovis subsp bovis AF2122/97
ggccgcggcacccag

SEQ ID NO: 3071628 - RNA, 20 nt, Mycobacterium bovis subsp bovis AF2122/97
ggccgcggcacccagguguc

SEQ ID NO: 3071629 - RNA, 18 nt, Mycobacterium bovis subsp bovis AF2122/97
ggccgcggccucccgcaa

SEQ ID NO: 3071630 - RNA, 13 nt, Mycobacterium bovis subsp bovis AF2122/97
ggccgcggcgauc

SEQ ID NO: 3071631 - RNA, 22 nt, Mycobacterium bovis subsp bovis AF2122/97
ggccgcggcgccuagcacgaag

SEQ ID NO: 3071632 - RNA, 17 nt, Mycobacterium bovis subsp bovis AF2122/97
ggccgcggcggccagcg

SEQ ID NO: 3071633 - RNA, 22 nt, Mycobacterium bovis subsp bovis AF2122/97
ggccgcggcggucugggugagc

SEQ ID NO: 3071634 - RNA, 12 nt, Mycobacterium bovis subsp bovis AF2122/97
ggccgcggcguc

SEQ ID NO: 3071635 - RNA, 14 nt, Mycobacterium bovis subsp bovis AF2122/97
ggccgcggcgucgu

SEQ ID NO: 3071636 - RNA, 23 nt, Mycobacterium bovis subsp bovis AF2122/97
ggccgcggcuggugucgggcguc

SEQ ID NO: 3071637 - RNA, 14 nt, Mycobacterium bovis subsp bovis AF2122/97
ggccgcgggcgcgc

SEQ ID NO: 3071638 - RNA, 16 nt, Mycobacterium bovis subsp bovis AF2122/97
ggccgcgggcgcggcc

SEQ ID NO: 3071639 - RNA, 15 nt, Mycobacterium bovis subsp bovis AF2122/97
ggccgcgggcguugc

SEQ ID NO: 3071640 - RNA, 15 nt, Mycobacterium bovis subsp bovis AF2122/97
ggccgcgggucccgg

SEQ ID NO: 3071641 - RNA, 17 nt, Mycobacterium bovis subsp bovis AF2122/97
ggccgcgggucgcugcg

SEQ ID NO: 3071642 - RNA, 19 nt, Mycobacterium bovis subsp bovis AF2122/97
ggccgcgggucgcugcgac

SEQ ID NO: 3071643 - RNA, 17 nt, Mycobacterium bovis subsp bovis AF2122/97
ggccgcggucggccacc

SEQ ID NO: 3071644 - RNA, 13 nt, Mycobacterium bovis subsp bovis AF2122/97
ggccgcggugacg

SEQ ID NO: 3071645 - RNA, 15 nt, Mycobacterium bovis subsp bovis AF2122/97
ggccgcggugcccgu

SEQ ID NO: 3071646 - RNA, 24 nt, Mycobacterium bovis subsp bovis AF2122/97
ggccgcgguguauccgacgucggu

SEQ ID NO: 3071647 - RNA, 16 nt, Mycobacterium bovis subsp bovis AF2122/97
ggccgcgucacggacc

SEQ ID NO: 3071648 - RNA, 22 nt, Mycobacterium bovis subsp bovis AF2122/97
ggccgcgucucggugcagcagc

SEQ ID NO: 3071649 - RNA, 22 nt, Mycobacterium bovis subsp bovis AF2122/97
ggccgcgucuuggugcgcguca

SEQ ID NO: 3071650 - RNA, 17 nt, Mycobacterium bovis subsp bovis AF2122/97
ggccgcgugccgcccgc

SEQ ID NO: 3071651 - RNA, 21 nt, Mycobacterium bovis subsp bovis AF2122/97
ggccgcguucguggaucucuu

SEQ ID NO: 3071652 - RNA, 19 nt, Mycobacterium bovis subsp bovis AF2122/97
ggccgcguugggguuggca

SEQ ID NO: 3071653 - RNA, 23 nt, Mycobacterium bovis subsp bovis AF2122/97
ggccgcucacaagccgugcagcu

SEQ ID NO: 3071654 - RNA, 12 nt, Mycobacterium bovis subsp bovis AF2122/97
ggccgcuccacc

SEQ ID NO: 3071655 - RNA, 13 nt, Mycobacterium bovis subsp bovis AF2122/97
ggccgcuccacca

SEQ ID NO: 3071656 - RNA, 16 nt, Mycobacterium bovis subsp bovis AF2122/97
ggccgcuccaccucgg

SEQ ID NO: 3071657 - RNA, 20 nt, Mycobacterium bovis subsp bovis AF2122/97
ggccgcuccagguagagucc

SEQ ID NO: 3071658 - RNA, 20 nt, Mycobacterium bovis subsp bovis AF2122/97
ggccgcucgccucgauggcg

SEQ ID NO: 3071659 - RNA, 18 nt, Mycobacterium bovis subsp bovis AF2122/97
ggccgcucgggccagcga

SEQ ID NO: 3071660 - RNA, 19 nt, Mycobacterium bovis subsp bovis AF2122/97
ggccgcucguuacgccgag

SEQ ID NO: 3071661 - RNA, 13 nt, Mycobacterium bovis subsp bovis AF2122/97
ggccgcugacacc

SEQ ID NO: 3071662 - RNA, 15 nt, Mycobacterium bovis subsp bovis AF2122/97
ggccgcugacacccg

SEQ ID NO: 3071663 - RNA, 14 nt, Mycobacterium bovis subsp bovis AF2122/97
ggccgcugacgccg

SEQ ID NO: 3071664 - RNA, 13 nt, Mycobacterium bovis subsp bovis AF2122/97
ggccgcugaucaa

SEQ ID NO: 3071665 - RNA, 14 nt, Mycobacterium bovis subsp bovis AF2122/97
ggccgcugccacua

SEQ ID NO: 3071666 - RNA, 17 nt, Mycobacterium bovis subsp bovis AF2122/97
ggccgcugccacuagca

SEQ ID NO: 3071667 - RNA, 19 nt, Mycobacterium bovis subsp bovis AF2122/97
ggccgcuggaggcggcgcc

SEQ ID NO: 3071668 - RNA, 19 nt, Mycobacterium bovis subsp bovis AF2122/97
ggccgggacagcgccgggg

SEQ ID NO: 3071669 - RNA, 14 nt, Mycobacterium bovis subsp bovis AF2122/97
ggccgggacggcga

SEQ ID NO: 3071670 - RNA, 18 nt, Mycobacterium bovis subsp bovis AF2122/97
ggccgggaucucgaaggc

SEQ ID NO: 3071671 - RNA, 15 nt, Mycobacterium bovis subsp bovis AF2122/97
ggccgggcaccaaua

SEQ ID NO: 3071672 - RNA, 17 nt, Mycobacterium bovis subsp bovis AF2122/97
ggccgggcaccaauacc

SEQ ID NO: 3071673 - RNA, 13 nt, Mycobacterium bovis subsp bovis AF2122/97
ggccgggcagugc

SEQ ID NO: 3071674 - RNA, 15 nt, Mycobacterium bovis subsp bovis AF2122/97
ggccgggcagugcgc

SEQ ID NO: 3071675 - RNA, 22 nt, Mycobacterium bovis subsp bovis AF2122/97
ggccgggcccuccacugcgagc

SEQ ID NO: 3071676 - RNA, 13 nt, Mycobacterium bovis subsp bovis AF2122/97
ggccgggccgagu

SEQ ID NO: 3071677 - RNA, 18 nt, Mycobacterium bovis subsp bovis AF2122/97
ggccgggccgagugccca

SEQ ID NO: 3071678 - RNA, 15 nt, Mycobacterium bovis subsp bovis AF2122/97
ggccgggccggccac

SEQ ID NO: 3071679 - RNA, 23 nt, Mycobacterium bovis subsp bovis AF2122/97
ggccgggcgaucgccugggcuug

SEQ ID NO: 3071680 - RNA, 21 nt, Mycobacterium bovis subsp bovis AF2122/97
ggccgggcgcaagcagcccgg

SEQ ID NO: 3071681 - RNA, 12 nt, Mycobacterium bovis subsp bovis AF2122/97
ggccgggcggcc

SEQ ID NO: 3071682 - RNA, 16 nt, Mycobacterium bovis subsp bovis AF2122/97
ggccgggcggccaggc

SEQ ID NO: 3071683 - RNA, 14 nt, Mycobacterium bovis subsp bovis AF2122/97
ggccgggcucccca

SEQ ID NO: 3071684 - RNA, 14 nt, Mycobacterium bovis subsp bovis AF2122/97
ggccggggccaccc

SEQ ID NO: 3071685 - RNA, 17 nt, Mycobacterium bovis subsp bovis AF2122/97
ggccggggccacccgca

SEQ ID NO: 3071686 - RNA, 18 nt, Mycobacterium bovis subsp bovis AF2122/97
ggccggggccacccgcag

SEQ ID NO: 3071687 - RNA, 16 nt, Mycobacterium bovis subsp bovis AF2122/97
ggccggggcgaacggc

SEQ ID NO: 3071688 - RNA, 19 nt, Mycobacterium bovis subsp bovis AF2122/97
ggccggggcgaacggcacc

SEQ ID NO: 3071689 - RNA, 17 nt, Mycobacterium bovis subsp bovis AF2122/97
ggccggggugccggcga

SEQ ID NO: 3071690 - RNA, 23 nt, Mycobacterium bovis subsp bovis AF2122/97
ggccgggucgaacaggccggccg

SEQ ID NO: 3071691 - RNA, 21 nt, Mycobacterium bovis subsp bovis AF2122/97
ggccgggucgaacuugaucac

SEQ ID NO: 3071692 - RNA, 17 nt, Mycobacterium bovis subsp bovis AF2122/97
ggccgggucgaucaccg

SEQ ID NO: 3071693 - RNA, 17 nt, Mycobacterium bovis subsp bovis AF2122/97
ggccgggucgcgcuggc

SEQ ID NO: 3071694 - RNA, 23 nt, Mycobacterium bovis subsp bovis AF2122/97
ggccgggucgcgcuggcgccggc

SEQ ID NO: 3071695 - RNA, 18 nt, Mycobacterium bovis subsp bovis AF2122/97
ggccgggucgucuuccag

SEQ ID NO: 3071696 - RNA, 21 nt, Mycobacterium bovis subsp bovis AF2122/97
ggccggguuaucggcagcagg

SEQ ID NO: 3071697 - RNA, 17 nt, Mycobacterium bovis subsp bovis AF2122/97
ggccggguuccagcggc

SEQ ID NO: 3071698 - RNA, 19 nt, Mycobacterium bovis subsp bovis AF2122/97
ggccggguuccagcggcac

SEQ ID NO: 3071699 - RNA, 21 nt, Mycobacterium bovis subsp bovis AF2122/97
ggccggguuccagcggcaccg

SEQ ID NO: 3071700 - RNA, 18 nt, Mycobacterium bovis subsp bovis AF2122/97
ggccggguucgcgucuga

SEQ ID NO: 3071701 - RNA, 23 nt, Mycobacterium bovis subsp bovis AF2122/97
ggccgguacacguccaguggcag

SEQ ID NO: 3071702 - RNA, 16 nt, Mycobacterium bovis subsp bovis AF2122/97
ggccgguaccgggacg

SEQ ID NO: 3071703 - RNA, 21 nt, Mycobacterium bovis subsp bovis AF2122/97
ggccgguaccgggacgaaucc

SEQ ID NO: 3071704 - RNA, 17 nt, Mycobacterium bovis subsp bovis AF2122/97
ggccgguagcgcgggug

SEQ ID NO: 3071705 - RNA, 16 nt, Mycobacterium bovis subsp bovis AF2122/97
ggccgguaguagcuga

SEQ ID NO: 3071706 - RNA, 17 nt, Mycobacterium bovis subsp bovis AF2122/97
ggccggucacguccgcg

SEQ ID NO: 3071707 - RNA, 16 nt, Mycobacterium bovis subsp bovis AF2122/97
ggccgguccacggugu

SEQ ID NO: 3071708 - RNA, 15 nt, Mycobacterium bovis subsp bovis AF2122/97
ggccgguccggggca

SEQ ID NO: 3071709 - RNA, 21 nt, Mycobacterium bovis subsp bovis AF2122/97
ggccgguccggggcaacgauc

SEQ ID NO: 3071710 - RNA, 13 nt, Mycobacterium bovis subsp bovis AF2122/97
ggccggucgggca

SEQ ID NO: 3071711 - RNA, 13 nt, Mycobacterium bovis subsp bovis AF2122/97
ggccggucgguga

SEQ ID NO: 3071712 - RNA, 12 nt, Mycobacterium bovis subsp bovis AF2122/97
ggccggugaacg

SEQ ID NO: 3071713 - RNA, 16 nt, Mycobacterium bovis subsp bovis AF2122/97
ggccggugcagcacgu

SEQ ID NO: 3071714 - RNA, 14 nt, Mycobacterium bovis subsp bovis AF2122/97
ggccggugccaguc

SEQ ID NO: 3071715 - RNA, 20 nt, Mycobacterium bovis subsp bovis AF2122/97
ggccggugcgaauggugcaa

SEQ ID NO: 3071716 - RNA, 13 nt, Mycobacterium bovis subsp bovis AF2122/97
ggccggugcgccc

SEQ ID NO: 3071717 - RNA, 20 nt, Mycobacterium bovis subsp bovis AF2122/97
ggccggugcgucacagccgg

SEQ ID NO: 3071718 - RNA, 20 nt, Mycobacterium bovis subsp bovis AF2122/97
ggccgguggaaaagccacgg

SEQ ID NO: 3071719 - RNA, 16 nt, Mycobacterium bovis subsp bovis AF2122/97
ggccggugggccgccc

SEQ ID NO: 3071720 - RNA, 19 nt, Mycobacterium bovis subsp bovis AF2122/97
ggccgguggguagccagcg

SEQ ID NO: 3071721 - RNA, 21 nt, Mycobacterium bovis subsp bovis AF2122/97
ggccggugugcaggaucacgc

SEQ ID NO: 3071722 - RNA, 17 nt, Mycobacterium bovis subsp bovis AF2122/97
ggccgguucaggggugg

SEQ ID NO: 3071723 - RNA, 15 nt, Mycobacterium bovis subsp bovis AF2122/97
ggccguaacgcggau

SEQ ID NO: 3071724 - RNA, 14 nt, Mycobacterium bovis subsp bovis AF2122/97
ggccguacggcgcg

SEQ ID NO: 3071725 - RNA, 15 nt, Mycobacterium bovis subsp bovis AF2122/97
ggccguacggcgcgu

SEQ ID NO: 3071726 - RNA, 13 nt, Mycobacterium bovis subsp bovis AF2122/97
ggccguacucgau

SEQ ID NO: 3071727 - RNA, 18 nt, Mycobacterium bovis subsp bovis AF2122/97
ggccguagcccacgacga

SEQ ID NO: 3071728 - RNA, 19 nt, Mycobacterium bovis subsp bovis AF2122/97
ggccguagcccacgacgaa

SEQ ID NO: 3071729 - RNA, 14 nt, Mycobacterium bovis subsp bovis AF2122/97
ggccguaggcggcg

SEQ ID NO: 3071730 - RNA, 15 nt, Mycobacterium bovis subsp bovis AF2122/97
ggccguaggcggcga

SEQ ID NO: 3071731 - RNA, 17 nt, Mycobacterium bovis subsp bovis AF2122/97
ggccguaggcggcgacc

SEQ ID NO: 3071732 - RNA, 19 nt, Mycobacterium bovis subsp bovis AF2122/97
ggccguaggcggcgacccg

SEQ ID NO: 3071733 - RNA, 20 nt, Mycobacterium bovis subsp bovis AF2122/97
ggccguaggcggcgacccgc

SEQ ID NO: 3071734 - RNA, 24 nt, Mycobacterium bovis subsp bovis AF2122/97
ggccguagucggcgaugcgcacca

SEQ ID NO: 3071735 - RNA, 15 nt, Mycobacterium bovis subsp bovis AF2122/97
ggccguagugcacgu

SEQ ID NO: 3071736 - RNA, 21 nt, Mycobacterium bovis subsp bovis AF2122/97
ggccguagugcacgucggcgg

SEQ ID NO: 3071737 - RNA, 22 nt, Mycobacterium bovis subsp bovis AF2122/97
ggccguaguugguucuccccgc

SEQ ID NO: 3071738 - RNA, 22 nt, Mycobacterium bovis subsp bovis AF2122/97
ggccguauaggcccgggcggcc

SEQ ID NO: 3071739 - RNA, 17 nt, Mycobacterium bovis subsp bovis AF2122/97
ggccgucaccggucggc

SEQ ID NO: 3071740 - RNA, 23 nt, Mycobacterium bovis subsp bovis AF2122/97
ggccgucagccaggugcccaagc

SEQ ID NO: 3071741 - RNA, 14 nt, Mycobacterium bovis subsp bovis AF2122/97
ggccgucagcgucg

SEQ ID NO: 3071742 - RNA, 17 nt, Mycobacterium bovis subsp bovis AF2122/97
ggccgucagcgucggcg

SEQ ID NO: 3071743 - RNA, 21 nt, Mycobacterium bovis subsp bovis AF2122/97
ggccgucagcgucggcgcauc

SEQ ID NO: 3071744 - RNA, 20 nt, Mycobacterium bovis subsp bovis AF2122/97
ggccgucaggcgugccgggg

SEQ ID NO: 3071745 - RNA, 21 nt, Mycobacterium bovis subsp bovis AF2122/97
ggccgucaggcgugccgggga

SEQ ID NO: 3071746 - RNA, 17 nt, Mycobacterium bovis subsp bovis AF2122/97
ggccgucaucgccgggu

SEQ ID NO: 3071747 - RNA, 16 nt, Mycobacterium bovis subsp bovis AF2122/97
ggccgucccaccagcc

SEQ ID NO: 3071748 - RNA, 18 nt, Mycobacterium bovis subsp bovis AF2122/97
ggccgucccaccagccga

SEQ ID NO: 3071749 - RNA, 18 nt, Mycobacterium bovis subsp bovis AF2122/97
ggccgucccgcgagcagc

SEQ ID NO: 3071750 - RNA, 21 nt, Mycobacterium bovis subsp bovis AF2122/97
ggccgucccgcgagcagcccg

SEQ ID NO: 3071751 - RNA, 23 nt, Mycobacterium bovis subsp bovis AF2122/97
ggccguccggcuuggcggcgauc

SEQ ID NO: 3071752 - RNA, 21 nt, Mycobacterium bovis subsp bovis AF2122/97
ggccguccucggucagcucgu

SEQ ID NO: 3071753 - RNA, 19 nt, Mycobacterium bovis subsp bovis AF2122/97
ggccgucgaacgguagcac

SEQ ID NO: 3071754 - RNA, 15 nt, Mycobacterium bovis subsp bovis AF2122/97
ggccucgaccgccag

SEQ ID NO: 3071755 - RNA, 17 nt, Mycobacterium bovis subsp bovis AF2122/97
ggccucgaccgccagcc

SEQ ID NO: 3071756 - RNA, 12 nt, Mycobacterium bovis subsp bovis AF2122/97
ggccucgaucag

SEQ ID NO: 3071757 - RNA, 15 nt, Mycobacterium bovis subsp bovis AF2122/97
ggccucgaucagcgc

SEQ ID NO: 3071758 - RNA, 12 nt, Mycobacterium bovis subsp bovis AF2122/97
ggccucgccggc

SEQ ID NO: 3071759 - RNA, 14 nt, Mycobacterium bovis subsp bovis AF2122/97
ggccucgccggcgc

SEQ ID NO: 3071760 - RNA, 22 nt, Mycobacterium bovis subsp bovis AF2122/97
ggccucgccggggcaaacgggg

SEQ ID NO: 3071761 - RNA, 13 nt, Mycobacterium bovis subsp bovis AF2122/97
ggccucgcgagaa

SEQ ID NO: 3071762 - RNA, 13 nt, Mycobacterium bovis subsp bovis AF2122/97
ggccucgcugggc

SEQ ID NO: 3071763 - RNA, 19 nt, Mycobacterium bovis subsp bovis AF2122/97
ggccucgcugggcucaugg

SEQ ID NO: 3071764 - RNA, 14 nt, Mycobacterium bovis subsp bovis AF2122/97
ggccucggccagcg

SEQ ID NO: 3071765 - RNA, 18 nt, Mycobacterium bovis subsp bovis AF2122/97
ggccucggccagcgucag

SEQ ID NO: 3071766 - RNA, 23 nt, Mycobacterium bovis subsp bovis AF2122/97
ggccucggccagcgucagcuguu

SEQ ID NO: 3071767 - RNA, 12 nt, Mycobacterium bovis subsp bovis AF2122/97
ggccucggcgac

SEQ ID NO: 3071768 - RNA, 16 nt, Mycobacterium bovis subsp bovis AF2122/97
ggccucggcgagcacg

SEQ ID NO: 3071769 - RNA, 13 nt, Mycobacterium bovis subsp bovis AF2122/97
ggccucggcgaua

SEQ ID NO: 3071770 - RNA, 15 nt, Mycobacterium bovis subsp bovis AF2122/97
ggccucggcgauacc

SEQ ID NO: 3071771 - RNA, 20 nt, Mycobacterium bovis subsp bovis AF2122/97
ggccucggcgauaccgagga

SEQ ID NO: 3071772 - RNA, 14 nt, Mycobacterium bovis subsp bovis AF2122/97
ggccucggcgccgc

SEQ ID NO: 3071773 - RNA, 14 nt, Mycobacterium bovis subsp bovis AF2122/97
ggccucggcgccgu

SEQ ID NO: 3071774 - RNA, 17 nt, Mycobacterium bovis subsp bovis AF2122/97
ggccucggcgccgucgg

SEQ ID NO: 3071775 - RNA, 18 nt, Mycobacterium bovis subsp bovis AF2122/97
ggccucggcggccguggc

SEQ ID NO: 3071776 - RNA, 20 nt, Mycobacterium bovis subsp bovis AF2122/97
ggccucggcggccguggccu

SEQ ID NO: 3071777 - RNA, 15 nt, Mycobacterium bovis subsp bovis AF2122/97
ggccucggcggucgc

SEQ ID NO: 3071778 - RNA, 14 nt, Mycobacterium bovis subsp bovis AF2122/97
ggccucgggacucc

SEQ ID NO: 3071779 - RNA, 23 nt, Mycobacterium bovis subsp bovis AF2122/97
ggccucggucugguggucggcga

SEQ ID NO: 3071780 - RNA, 23 nt, Mycobacterium bovis subsp bovis AF2122/97
ggccucgucccggacaauuccgc

SEQ ID NO: 3071781 - RNA, 21 nt, Mycobacterium bovis subsp bovis AF2122/97
ggccucgucgauguucgccgc

SEQ ID NO: 3071782 - RNA, 21 nt, Mycobacterium bovis subsp bovis AF2122/97
ggccucgucgugcaccucguc

SEQ ID NO: 3071783 - RNA, 23 nt, Mycobacterium bovis subsp bovis AF2122/97
ggccucgucgugcaccucguccc

SEQ ID NO: 3071784 - RNA, 23 nt, Mycobacterium bovis subsp bovis AF2122/97
ggccucguugaccgggucgccga

SEQ ID NO: 3071785 - RNA, 17 nt, Mycobacterium bovis subsp bovis AF2122/97
ggccucguuguagccga

SEQ ID NO: 3071786 - RNA, 19 nt, Mycobacterium bovis subsp bovis AF2122/97
ggccucuggaucacgucga

SEQ ID NO: 3071787 - RNA, 16 nt, Mycobacterium bovis subsp bovis AF2122/97
ggccugaaccacgcgu

SEQ ID NO: 3071788 - RNA, 16 nt, Mycobacterium bovis subsp bovis AF2122/97
ggccugaccggcucgc

SEQ ID NO: 3071789 - RNA, 16 nt, Mycobacterium bovis subsp bovis AF2122/97
ggccugagcggccauc

SEQ ID NO: 3071790 - RNA, 19 nt, Mycobacterium bovis subsp bovis AF2122/97
ggccugauuccacugggcc

SEQ ID NO: 3071791 - RNA, 23 nt, Mycobacterium bovis subsp bovis AF2122/97
ggccugauuccacugggccugcc

SEQ ID NO: 3071792 - RNA, 20 nt, Mycobacterium bovis subsp bovis AF2122/97
ggccugauuguugagccacg

SEQ ID NO: 3071793 - RNA, 22 nt, Mycobacterium bovis subsp bovis AF2122/97
ggccugcaacgucacucccugg

SEQ ID NO: 3071794 - RNA, 15 nt, Mycobacterium bovis subsp bovis AF2122/97
ggccugcaccacggc

SEQ ID NO: 3071795 - RNA, 18 nt, Mycobacterium bovis subsp bovis AF2122/97
ggccugcaccacggcggc

SEQ ID NO: 3071796 - RNA, 22 nt, Mycobacterium bovis subsp bovis AF2122/97
ggccugcaccacggcggccacc

SEQ ID NO: 3071797 - RNA, 15 nt, Mycobacterium bovis subsp bovis AF2122/97
ggccugcacgccggc

SEQ ID NO: 3071798 - RNA, 20 nt, Mycobacterium bovis subsp bovis AF2122/97
ggccugcacggcgcugacga

SEQ ID NO: 3071799 - RNA, 17 nt, Mycobacterium bovis subsp bovis AF2122/97
ggccugcagcgaugacg

SEQ ID NO: 3071800 - RNA, 14 nt, Mycobacterium bovis subsp bovis AF2122/97
ggccugcagcgcga

SEQ ID NO: 3071801 - RNA, 18 nt, Mycobacterium bovis subsp bovis AF2122/97
ggccugcagcgcgacccg

SEQ ID NO: 3071802 - RNA, 20 nt, Mycobacterium bovis subsp bovis AF2122/97
ggccugcagcgcgacccgua

SEQ ID NO: 3071803 - RNA, 21 nt, Mycobacterium bovis subsp bovis AF2122/97
ggccugccauaggcccacggc

SEQ ID NO: 3071804 - RNA, 22 nt, Mycobacterium bovis subsp bovis AF2122/97
ggccugcccagcaccaccgcgg

SEQ ID NO: 3071805 - RNA, 14 nt, Mycobacterium bovis subsp bovis AF2122/97
ggccugcccccggc

SEQ ID NO: 3071806 - RNA, 21 nt, Mycobacterium bovis subsp bovis AF2122/97
ggccugcccccggcgcggcgg

SEQ ID NO: 3071807 - RNA, 16 nt, Mycobacterium bovis subsp bovis AF2122/97
ggccugccgcacuggg

SEQ ID NO: 3071808 - RNA, 14 nt, Mycobacterium bovis subsp bovis AF2122/97
ggccugccgcucgc

SEQ ID NO: 3071809 - RNA, 15 nt, Mycobacterium bovis subsp bovis AF2122/97
ggccugccgcucgcc

SEQ ID NO: 3071810 - RNA, 16 nt, Mycobacterium bovis subsp bovis AF2122/97
ggccugccgcucgccg

SEQ ID NO: 3071811 - RNA, 15 nt, Mycobacterium bovis subsp bovis AF2122/97
ggccugccguuccag

SEQ ID NO: 3071812 - RNA, 19 nt, Mycobacterium bovis subsp bovis AF2122/97
ggccugccguuccagcauc

SEQ ID NO: 3071813 - RNA, 20 nt, Mycobacterium bovis subsp bovis AF2122/97
ggccugcgaacacgcgauga

SEQ ID NO: 3071814 - RNA, 19 nt, Mycobacterium bovis subsp bovis AF2122/97
ggccugcgagucgcgcuug

SEQ ID NO: 3071815 - RNA, 13 nt, Mycobacterium bovis subsp bovis AF2122/97
ggccugcgccggc

SEQ ID NO: 3071816 - RNA, 13 nt, Mycobacterium bovis subsp bovis AF2122/97
ggccugcgcgacc

SEQ ID NO: 3071817 - RNA, 16 nt, Mycobacterium bovis subsp bovis AF2122/97
ggccugcgcgaccgac

SEQ ID NO: 3071818 - RNA, 20 nt, Mycobacterium bovis subsp bovis AF2122/97
ggccugcgcgaccgaccagc

SEQ ID NO: 3071819 - RNA, 15 nt, Mycobacterium bovis subsp bovis AF2122/97
ggccugcgcgauccg

SEQ ID NO: 3071820 - RNA, 17 nt, Mycobacterium bovis subsp bovis AF2122/97
ggccugcgcgauccgcg

SEQ ID NO: 3071821 - RNA, 19 nt, Mycobacterium bovis subsp bovis AF2122/97
ggccugcgcgauccgcgcg

SEQ ID NO: 3071822 - RNA, 22 nt, Mycobacterium bovis subsp bovis AF2122/97
ggccugcgcuucguccagcgau

SEQ ID NO: 3071823 - RNA, 13 nt, Mycobacterium bovis subsp bovis AF2122/97
ggccugcggcaac

SEQ ID NO: 3071824 - RNA, 15 nt, Mycobacterium bovis subsp bovis AF2122/97
ggccugcggcaccgg

SEQ ID NO: 3071825 - RNA, 24 nt, Mycobacterium bovis subsp bovis AF2122/97
ggccugcuaaccacggugugcuac

SEQ ID NO: 3071826 - RNA, 14 nt, Mycobacterium bovis subsp bovis AF2122/97
ggccugcucgacca

SEQ ID NO: 3071827 - RNA, 21 nt, Mycobacterium bovis subsp bovis AF2122/97
ggccugcucggcgaguucggc

SEQ ID NO: 3071828 - RNA, 22 nt, Mycobacterium bovis subsp bovis AF2122/97
ggccugcucgggggccgaccag

SEQ ID NO: 3071829 - RNA, 16 nt, Mycobacterium bovis subsp bovis AF2122/97
ggccugcuggucacca

SEQ ID NO: 3071830 - RNA, 19 nt, Mycobacterium bovis subsp bovis AF2122/97
ggccugcuggucaccauca

SEQ ID NO: 3071831 - RNA, 19 nt, Mycobacterium bovis subsp bovis AF2122/97
ggccugcuugucaacccgg

SEQ ID NO: 3071832 - RNA, 20 nt, Mycobacterium bovis subsp bovis AF2122/97
ggccuggaagacggugcggg

SEQ ID NO: 3071833 - RNA, 13 nt, Mycobacterium bovis subsp bovis AF2122/97
ggccuggcacccg

SEQ ID NO: 3071834 - RNA, 15 nt, Mycobacterium bovis subsp bovis AF2122/97
ggccuggcagggugg

SEQ ID NO: 3071835 - RNA, 19 nt, Mycobacterium bovis subsp bovis AF2122/97
ggccuggccacacucagca

SEQ ID NO: 3071836 - RNA, 17 nt, Mycobacterium bovis subsp bovis AF2122/97
ggccuggccccggcugu

SEQ ID NO: 3071837 - RNA, 13 nt, Mycobacterium bovis subsp bovis AF2122/97
ggccuggccugcc

SEQ ID NO: 3071838 - RNA, 18 nt, Mycobacterium bovis subsp bovis AF2122/97
ggccuggcucguccgggu

SEQ ID NO: 3071839 - RNA, 16 nt, Mycobacterium bovis subsp bovis AF2122/97
ggccugggacggcggc

SEQ ID NO: 3071840 - RNA, 16 nt, Mycobacterium bovis subsp bovis AF2122/97
ggccugggccagccgc

SEQ ID NO: 3071841 - RNA, 16 nt, Mycobacterium bovis subsp bovis AF2122/97
ggcgaauccgcacagg

SEQ ID NO: 3071842 - RNA, 23 nt, Mycobacterium bovis subsp bovis AF2122/97
ggcgaaucuuugguagucugcac

SEQ ID NO: 3071843 - RNA, 16 nt, Mycobacterium bovis subsp bovis AF2122/97
ggcgaaugacggccag

SEQ ID NO: 3071844 - RNA, 17 nt, Mycobacterium bovis subsp bovis AF2122/97
ggcgaaugacggccagu

SEQ ID NO: 3071845 - RNA, 14 nt, Mycobacterium bovis subsp bovis AF2122/97
ggcgaaugcggucc

SEQ ID NO: 3071846 - RNA, 23 nt, Mycobacterium bovis subsp bovis AF2122/97
ggcgaaugucuucgccgucacgc

SEQ ID NO: 3071847 - RNA, 18 nt, Mycobacterium bovis subsp bovis AF2122/97
ggcgaauucgaccacucg

SEQ ID NO: 3071848 - RNA, 17 nt, Mycobacterium bovis subsp bovis AF2122/97
ggcgaauugcaggacgc

SEQ ID NO: 3071849 - RNA, 22 nt, Mycobacterium bovis subsp bovis AF2122/97
ggcgaauugcaggacgcgggcu

SEQ ID NO: 3071850 - RNA, 18 nt, Mycobacterium bovis subsp bovis AF2122/97
ggcgacaaucgagaacgc

SEQ ID NO: 3071851 - RNA, 20 nt, Mycobacterium bovis subsp bovis AF2122/97
ggcgacacgccagccgugcc

SEQ ID NO: 3071852 - RNA, 21 nt, Mycobacterium bovis subsp bovis AF2122/97
ggcgacacgccagccgugccg

SEQ ID NO: 3071853 - RNA, 22 nt, Mycobacterium bovis subsp bovis AF2122/97
ggcgacacgccaggugaugccg

SEQ ID NO: 3071854 - RNA, 12 nt, Mycobacterium bovis subsp bovis AF2122/97
ggcgacagcgcg

SEQ ID NO: 3071855 - RNA, 17 nt, Mycobacterium bovis subsp bovis AF2122/97
ggcgacagcgcggcggu

SEQ ID NO: 3071856 - RNA, 18 nt, Mycobacterium bovis subsp bovis AF2122/97
ggcgacagcgcggcgguc

SEQ ID NO: 3071857 - RNA, 22 nt, Mycobacterium bovis subsp bovis AF2122/97
ggcgacaggagacgguacgcca

SEQ ID NO: 3071858 - RNA, 16 nt, Mycobacterium bovis subsp bovis AF2122/97
ggcgacaucgagaucg

SEQ ID NO: 3071859 - RNA, 21 nt, Mycobacterium bovis subsp bovis AF2122/97
ggcgacaucgagaucgccguu

SEQ ID NO: 3071860 - RNA, 21 nt, Mycobacterium bovis subsp bovis AF2122/97
ggcgacaugaucugccaccgc

SEQ ID NO: 3071861 - RNA, 21 nt, Mycobacterium bovis subsp bovis AF2122/97
ggcgacaugcagcgccaacgc

SEQ ID NO: 3071862 - RNA, 20 nt, Mycobacterium bovis subsp bovis AF2122/97
ggcgaccaaggccgaccugu

SEQ ID NO: 3071863 - RNA, 12 nt, Mycobacterium bovis subsp bovis AF2122/97
ggcgaccaccac

SEQ ID NO: 3071864 - RNA, 15 nt, Mycobacterium bovis subsp bovis AF2122/97
ggcgaccaccaccgc

SEQ ID NO: 3071865 - RNA, 23 nt, Mycobacterium bovis subsp bovis AF2122/97
ggcgaccaccaccgccgccgaag

SEQ ID NO: 3071866 - RNA, 14 nt, Mycobacterium bovis subsp bovis AF2122/97
ggcgaccaccagcg

SEQ ID NO: 3071867 - RNA, 18 nt, Mycobacterium bovis subsp bovis AF2122/97
ggcgaccaccagcgccga

SEQ ID NO: 3071868 - RNA, 13 nt, Mycobacterium bovis subsp bovis AF2122/97
ggcgaccaccccc

SEQ ID NO: 3071869 - RNA, 16 nt, Mycobacterium bovis subsp bovis AF2122/97
ggcgaccacccccggc

SEQ ID NO: 3071870 - RNA, 20 nt, Mycobacterium bovis subsp bovis AF2122/97
ggcgaccacccccggcaggc

SEQ ID NO: 3071871 - RNA, 12 nt, Mycobacterium bovis subsp bovis AF2122/97
ggcgaccaccgc

SEQ ID NO: 3071872 - RNA, 13 nt, Mycobacterium bovis subsp bovis AF2122/97
ggcgaccaccgcg

SEQ ID NO: 3071873 - RNA, 22 nt, Mycobacterium bovis subsp bovis AF2122/97
ggcgaccaccgcgucgggccgc

SEQ ID NO: 3071874 - RNA, 11 nt, Mycobacterium bovis subsp bovis AF2122/97
ggcgaccacgc

SEQ ID NO: 3071875 - RNA, 18 nt, Mycobacterium bovis subsp bovis AF2122/97
ggcgaccacgccgccggc

SEQ ID NO: 3071876 - RNA, 19 nt, Mycobacterium bovis subsp bovis AF2122/97
ggcgaccacgccgccggcg

SEQ ID NO: 3071877 - RNA, 20 nt, Mycobacterium bovis subsp bovis AF2122/97
ggcgaccacgccgccggcgc

SEQ ID NO: 3071878 - RNA, 22 nt, Mycobacterium bovis subsp bovis AF2122/97
ggcgaccacgccgccggcgcug

SEQ ID NO: 3071879 - RNA, 12 nt, Mycobacterium bovis subsp bovis AF2122/97
ggcgaccagaua

SEQ ID NO: 3071880 - RNA, 16 nt, Mycobacterium bovis subsp bovis AF2122/97
ggcgaccagccgagcg

SEQ ID NO: 3071881 - RNA, 20 nt, Mycobacterium bovis subsp bovis AF2122/97
ggcgaccagcucagcugcgg

SEQ ID NO: 3071882 - RNA, 22 nt, Mycobacterium bovis subsp bovis AF2122/97
ggcgaccaucugaucgggcccg

SEQ ID NO: 3071883 - RNA, 16 nt, Mycobacterium bovis subsp bovis AF2122/97
ggcgaccaugcuccua

SEQ ID NO: 3071884 - RNA, 14 nt, Mycobacterium bovis subsp bovis AF2122/97
ggcgacccagcggu

SEQ ID NO: 3071885 - RNA, 22 nt, Mycobacterium bovis subsp bovis AF2122/97
ggcgaccccgaacauccgccgc

SEQ ID NO: 3071886 - RNA, 23 nt, Mycobacterium bovis subsp bovis AF2122/97
ggcgaccccgaacauccgccgcc

SEQ ID NO: 3071887 - RNA, 21 nt, Mycobacterium bovis subsp bovis AF2122/97
ggcgaccccggccccgacggu

SEQ ID NO: 3071888 - RNA, 22 nt, Mycobacterium bovis subsp bovis AF2122/97
ggcgacccggguagacaccgcg

SEQ ID NO: 3071889 - RNA, 20 nt, Mycobacterium bovis subsp bovis AF2122/97
ggcgacccggucacucuggc

SEQ ID NO: 3071890 - RNA, 21 nt, Mycobacterium bovis subsp bovis AF2122/97
ggcgacccggucacucuggcg

SEQ ID NO: 3071891 - RNA, 15 nt, Mycobacterium bovis subsp bovis AF2122/97
ggcgaccgacgccgg

SEQ ID NO: 3071892 - RNA, 19 nt, Mycobacterium bovis subsp bovis AF2122/97
ggcgaccgagacggcgucg

SEQ ID NO: 3071893 - RNA, 15 nt, Mycobacterium bovis subsp bovis AF2122/97
ggcgaccgcauccgg

SEQ ID NO: 3071894 - RNA, 18 nt, Mycobacterium bovis subsp bovis AF2122/97
ggcgaccgccagcgugga

SEQ ID NO: 3071895 - RNA, 22 nt, Mycobacterium bovis subsp bovis AF2122/97
ggcgaccgccaucacgaccagg

SEQ ID NO: 3071896 - RNA, 13 nt, Mycobacterium bovis subsp bovis AF2122/97
ggcgaccgccauu

SEQ ID NO: 3071897 - RNA, 22 nt, Mycobacterium bovis subsp bovis AF2122/97
ggcgaccgccauuucgcccgag

SEQ ID NO: 3071898 - RNA, 19 nt, Mycobacterium bovis subsp bovis AF2122/97
ggcgaccgcccccagcggu

SEQ ID NO: 3071899 - RNA, 17 nt, Mycobacterium bovis subsp bovis AF2122/97
ggcgaccgccugcgcgg

SEQ ID NO: 3071900 - RNA, 18 nt, Mycobacterium bovis subsp bovis AF2122/97
ggcgaccgcgcucaccgg

SEQ ID NO: 3071901 - RNA, 15 nt, Mycobacterium bovis subsp bovis AF2122/97
ggcgaccgcgucguc

SEQ ID NO: 3071902 - RNA, 20 nt, Mycobacterium bovis subsp bovis AF2122/97
ggcgaccgcgucgucccagu

SEQ ID NO: 3071903 - RNA, 13 nt, Mycobacterium bovis subsp bovis AF2122/97
ggcgaccggccgg

SEQ ID NO: 3071904 - RNA, 17 nt, Mycobacterium bovis subsp bovis AF2122/97
ggcgaccggccggccgc

SEQ ID NO: 3071905 - RNA, 22 nt, Mycobacterium bovis subsp bovis AF2122/97
ggcgaccggccggccgcgggcg

SEQ ID NO: 3071906 - RNA, 13 nt, Mycobacterium bovis subsp bovis AF2122/97
ggcgaccggcgac

SEQ ID NO: 3071907 - RNA, 20 nt, Mycobacterium bovis subsp bovis AF2122/97
ggcgaccggcgaccggcgag

SEQ ID NO: 3071908 - RNA, 21 nt, Mycobacterium bovis subsp bovis AF2122/97
ggcgaccggcgagcccgcauc

SEQ ID NO: 3071909 - RNA, 18 nt, Mycobacterium bovis subsp bovis AF2122/97
ggcgaccggggaucgggg

SEQ ID NO: 3071910 - RNA, 17 nt, Mycobacterium bovis subsp bovis AF2122/97
ggcgaccggguccggcg

SEQ ID NO: 3071911 - RNA, 12 nt, Mycobacterium bovis subsp bovis AF2122/97
ggcgaccggugc

SEQ ID NO: 3071912 - RNA, 22 nt, Mycobacterium bovis subsp bovis AF2122/97
ggcgaccuccggaaucgcccgg

SEQ ID NO: 3071913 - RNA, 16 nt, Mycobacterium bovis subsp bovis AF2122/97
ggcgaccucggcggcg

SEQ ID NO: 3071914 - RNA, 20 nt, Mycobacterium bovis subsp bovis AF2122/97
ggcgaccugccggaccgcgg

SEQ ID NO: 3071915 - RNA, 22 nt, Mycobacterium bovis subsp bovis AF2122/97
ggcgaccugcgcgagguuggcg

SEQ ID NO: 3071916 - RNA, 14 nt, Mycobacterium bovis subsp bovis AF2122/97
ggcgaccugcucgc

SEQ ID NO: 3071917 - RNA, 16 nt, Mycobacterium bovis subsp bovis AF2122/97
ggcgaccugcucgcug

SEQ ID NO: 3071918 - RNA, 17 nt, Mycobacterium bovis subsp bovis AF2122/97
ggcgaccugcucgcugg

SEQ ID NO: 3071919 - RNA, 20 nt, Mycobacterium bovis subsp bovis AF2122/97
ggcgaccugcucgcugguga

SEQ ID NO: 3071920 - RNA, 22 nt, Mycobacterium bovis subsp bovis AF2122/97
ggcgaccuggcucaucgaugcg

SEQ ID NO: 3071921 - RNA, 15 nt, Mycobacterium bovis subsp bovis AF2122/97
ggcgaccuugacccg

SEQ ID NO: 3071922 - RNA, 18 nt, Mycobacterium bovis subsp bovis AF2122/97
ggcgacgaacugaagccc

SEQ ID NO: 3071923 - RNA, 23 nt, Mycobacterium bovis subsp bovis AF2122/97
ggcgacgaagaagaacucggcgu

SEQ ID NO: 3071924 - RNA, 16 nt, Mycobacterium bovis subsp bovis AF2122/97
ggcgacgaaguccccg

SEQ ID NO: 3071925 - RNA, 19 nt, Mycobacterium bovis subsp bovis AF2122/97
ggcgacgaaguccccguag

SEQ ID NO: 3071926 - RNA, 21 nt, Mycobacterium bovis subsp bovis AF2122/97
ggcgacgaaguccccguaguc

SEQ ID NO: 3071927 - RNA, 22 nt, Mycobacterium bovis subsp bovis AF2122/97
ggcgagcucggccccgccgccg

SEQ ID NO: 3071928 - RNA, 23 nt, Mycobacterium bovis subsp bovis AF2122/97
ggcgagcucggccccgccgccgg

SEQ ID NO: 3071929 - RNA, 14 nt, Mycobacterium bovis subsp bovis AF2122/97
ggcgagcucgucga

SEQ ID NO: 3071930 - RNA, 17 nt, Mycobacterium bovis subsp bovis AF2122/97
ggcgagcuggcguuccc

SEQ ID NO: 3071931 - RNA, 14 nt, Mycobacterium bovis subsp bovis AF2122/97
ggcgaggcagcacc

SEQ ID NO: 3071932 - RNA, 22 nt, Mycobacterium bovis subsp bovis AF2122/97
ggcgaggccucggcggccgugg

SEQ ID NO: 3071933 - RNA, 13 nt, Mycobacterium bovis subsp bovis AF2122/97
ggcgaggcucccg

SEQ ID NO: 3071934 - RNA, 19 nt, Mycobacterium bovis subsp bovis AF2122/97
ggcgagggccacggcugcg

SEQ ID NO: 3071935 - RNA, 13 nt, Mycobacterium bovis subsp bovis AF2122/97
ggcgaggucccgg

SEQ ID NO: 3071936 - RNA, 17 nt, Mycobacterium bovis subsp bovis AF2122/97
ggcgaggucccggccga

SEQ ID NO: 3071937 - RNA, 20 nt, Mycobacterium bovis subsp bovis AF2122/97
ggcgaggucccggccgagcg

SEQ ID NO: 3071938 - RNA, 23 nt, Mycobacterium bovis subsp bovis AF2122/97
ggcgaggucccggccgagcgugg

SEQ ID NO: 3071939 - RNA, 18 nt, Mycobacterium bovis subsp bovis AF2122/97
ggcgaguacaggcgcagc

SEQ ID NO: 3071940 - RNA, 18 nt, Mycobacterium bovis subsp bovis AF2122/97
ggcgaguacggccugccg

SEQ ID NO: 3071941 - RNA, 16 nt, Mycobacterium bovis subsp bovis AF2122/97
ggcgaguagucgacgu

SEQ ID NO: 3071942 - RNA, 15 nt, Mycobacterium bovis subsp bovis AF2122/97
ggcgagucgggggcc

SEQ ID NO: 3071943 - RNA, 20 nt, Mycobacterium bovis subsp bovis AF2122/97
ggcgagugggauucugacga

SEQ ID NO: 3071944 - RNA, 22 nt, Mycobacterium bovis subsp bovis AF2122/97
ggcgagugucuuagccagcagc

SEQ ID NO: 3071945 - RNA, 16 nt, Mycobacterium bovis subsp bovis AF2122/97
ggcgaguuaggccgcc

SEQ ID NO: 3071946 - RNA, 18 nt, Mycobacterium bovis subsp bovis AF2122/97
ggcgaguuaggccgccag

SEQ ID NO: 3071947 - RNA, 19 nt, Mycobacterium bovis subsp bovis AF2122/97
ggcgaguuaggccgccagc

SEQ ID NO: 3071948 - RNA, 23 nt, Mycobacterium bovis subsp bovis AF2122/97
ggcgaguuaggccgccagccggc

SEQ ID NO: 3071949 - RNA, 16 nt, Mycobacterium bovis subsp bovis AF2122/97
ggcgaguucggcagcg

SEQ ID NO: 3071950 - RNA, 18 nt, Mycobacterium bovis subsp bovis AF2122/97
ggcgauaaagccgcugaa

SEQ ID NO: 3071951 - RNA, 16 nt, Mycobacterium bovis subsp bovis AF2122/97
ggcgauaaaucgccga

SEQ ID NO: 3071952 - RNA, 22 nt, Mycobacterium bovis subsp bovis AF2122/97
ggcgauaaaucgccgaaucuca

SEQ ID NO: 3071953 - RNA, 22 nt, Mycobacterium bovis subsp bovis AF2122/97
ggcgauaaccgacgaucaacgg

SEQ ID NO: 3071954 - RNA, 23 nt, Mycobacterium bovis subsp bovis AF2122/97
ggcgauaaggaccgcgcccagac

SEQ ID NO: 3071955 - RNA, 18 nt, Mycobacterium bovis subsp bovis AF2122/97
ggcgauagucauucgcuc

SEQ ID NO: 3071956 - RNA, 24 nt, Mycobacterium bovis subsp bovis AF2122/97
ggcgauaucgaucggaucgaugcc

SEQ ID NO: 3071957 - RNA, 14 nt, Mycobacterium bovis subsp bovis AF2122/97
ggcgauaucgcaca

SEQ ID NO: 3071958 - RNA, 15 nt, Mycobacterium bovis subsp bovis AF2122/97
ggcgauaucgcccgg

SEQ ID NO: 3071959 - RNA, 20 nt, Mycobacterium bovis subsp bovis AF2122/97
ggcgauauuggacgcgcaug

SEQ ID NO: 3071960 - RNA, 20 nt, Mycobacterium bovis subsp bovis AF2122/97
ggcgaucaauugcccggcac

SEQ ID NO: 3071961 - RNA, 14 nt, Mycobacterium bovis subsp bovis AF2122/97
ggcgaucaccgaga

SEQ ID NO: 3071962 - RNA, 19 nt, Mycobacterium bovis subsp bovis AF2122/97
ggcgaucagcagccgccga

SEQ ID NO: 3071963 - RNA, 23 nt, Mycobacterium bovis subsp bovis AF2122/97
ggcgauccacaggcugaagacga

SEQ ID NO: 3071964 - RNA, 20 nt, Mycobacterium bovis subsp bovis AF2122/97
ggcgauccagaacaacggcg

SEQ ID NO: 3071965 - RNA, 22 nt, Mycobacterium bovis subsp bovis AF2122/97
ggcgauccagaacaacggcgcg

SEQ ID NO: 3071966 - RNA, 15 nt, Mycobacterium bovis subsp bovis AF2122/97
ggcgauccaggccag

SEQ ID NO: 3071967 - RNA, 17 nt, Mycobacterium bovis subsp bovis AF2122/97
ggcgauccggucggcca

SEQ ID NO: 3071968 - RNA, 15 nt, Mycobacterium bovis subsp bovis AF2122/97
ggcgauccggucggg

SEQ ID NO: 3071969 - RNA, 14 nt, Mycobacterium bovis subsp bovis AF2122/97
ggcgaucgcauccg

SEQ ID NO: 3071970 - RNA, 17 nt, Mycobacterium bovis subsp bovis AF2122/97
ggcgaucgcauccgcgg

SEQ ID NO: 3071971 - RNA, 19 nt, Mycobacterium bovis subsp bovis AF2122/97
ggcgaucgcauccgcgguu

SEQ ID NO: 3071972 - RNA, 14 nt, Mycobacterium bovis subsp bovis AF2122/97
ggcgaucgccuggg

SEQ ID NO: 3071973 - RNA, 21 nt, Mycobacterium bovis subsp bovis AF2122/97
ggcgaucgccugggcuuggcg

SEQ ID NO: 3071974 - RNA, 21 nt, Mycobacterium bovis subsp bovis AF2122/97
ggcgaucgggcgggugaacgc

SEQ ID NO: 3071975 - RNA, 14 nt, Mycobacterium bovis subsp bovis AF2122/97
ggcgaucgucuccu

SEQ ID NO: 3071976 - RNA, 23 nt, Mycobacterium bovis subsp bovis AF2122/97
ggcgaucucgaccguauugacca

SEQ ID NO: 3071977 - RNA, 14 nt, Mycobacterium bovis subsp bovis AF2122/97
ggcgaucucgacgg

SEQ ID NO: 3071978 - RNA, 16 nt, Mycobacterium bovis subsp bovis AF2122/97
ggcgaucucuaccagc

SEQ ID NO: 3071979 - RNA, 22 nt, Mycobacterium bovis subsp bovis AF2122/97
ggcgaucugcgacaagaccggc

SEQ ID NO: 3071980 - RNA, 22 nt, Mycobacterium bovis subsp bovis AF2122/97
ggcgaucugcuaccagagccgc

SEQ ID NO: 3071981 - RNA, 23 nt, Mycobacterium bovis subsp bovis AF2122/97
ggcgaucugcuaccagagccgcg

SEQ ID NO: 3071982 - RNA, 13 nt, Mycobacterium bovis subsp bovis AF2122/97
ggcgaucugcucg

SEQ ID NO: 3071983 - RNA, 21 nt, Mycobacterium bovis subsp bovis AF2122/97
ggcgaucugcugcucgaucau

SEQ ID NO: 3071984 - RNA, 17 nt, Mycobacterium bovis subsp bovis AF2122/97
ggcgaucugcugugucg

SEQ ID NO: 3071985 - RNA, 20 nt, Mycobacterium bovis subsp bovis AF2122/97
ggcgaucugggugccggugu

SEQ ID NO: 3071986 - RNA, 17 nt, Mycobacterium bovis subsp bovis AF2122/97
ggcgaucuggucggcgg

SEQ ID NO: 3071987 - RNA, 20 nt, Mycobacterium bovis subsp bovis AF2122/97
ggcgaucuggucggcggccu

SEQ ID NO: 3071988 - RNA, 18 nt, Mycobacterium bovis subsp bovis AF2122/97
ggcgaucuugcgacgccc

SEQ ID NO: 3071989 - RNA, 16 nt, Mycobacterium bovis subsp bovis AF2122/97
ggcgaugaacagcgac

SEQ ID NO: 3071990 - RNA, 16 nt, Mycobacterium bovis subsp bovis AF2122/97
ggcgaugacaaagcac

SEQ ID NO: 3071991 - RNA, 20 nt, Mycobacterium bovis subsp bovis AF2122/97
ggcgaugaccacgccgacga

SEQ ID NO: 3071992 - RNA, 13 nt, Mycobacterium bovis subsp bovis AF2122/97
ggcgaugacgcca

SEQ ID NO: 3071993 - RNA, 14 nt, Mycobacterium bovis subsp bovis AF2122/97
ggcgaugagcgcga

SEQ ID NO: 3071994 - RNA, 20 nt, Mycobacterium bovis subsp bovis AF2122/97
ggcgaugagggcuuguggug

SEQ ID NO: 3071995 - RNA, 19 nt, Mycobacterium bovis subsp bovis AF2122/97
ggcgaugaucaccagucgc

SEQ ID NO: 3071996 - RNA, 23 nt, Mycobacterium bovis subsp bovis AF2122/97
ggcgaugaucaccagucgcugau

SEQ ID NO: 3071997 - RNA, 16 nt, Mycobacterium bovis subsp bovis AF2122/97
ggcgaugaugacggcg

SEQ ID NO: 3071998 - RNA, 24 nt, Mycobacterium bovis subsp bovis AF2122/97
ggcgaugauggcgcgaucggugcc

SEQ ID NO: 3071999 - RNA, 15 nt, Mycobacterium bovis subsp bovis AF2122/97
ggcgaugcagccggg

SEQ ID NO: 3072000 - RNA, 16 nt, Mycobacterium bovis subsp bovis AF2122/97
ggcgaugccgaugucg

SEQ ID NO: 3072001 - RNA, 17 nt, Mycobacterium bovis subsp bovis AF2122/97
ggcgaugcgcaccagca

SEQ ID NO: 3072002 - RNA, 13 nt, Mycobacterium bovis subsp bovis AF2122/97
ggcgaugcgcggg

SEQ ID NO: 3072003 - RNA, 15 nt, Mycobacterium bovis subsp bovis AF2122/97
ggcgaugcggcgucg

SEQ ID NO: 3072004 - RNA, 18 nt, Mycobacterium bovis subsp bovis AF2122/97
ggcgaugcguccgcccag

SEQ ID NO: 3072005 - RNA, 13 nt, Mycobacterium bovis subsp bovis AF2122/97
ggcgaugcugggc

SEQ ID NO: 3072006 - RNA, 17 nt, Mycobacterium bovis subsp bovis AF2122/97
ggcgaugcugggcgaga

SEQ ID NO: 3072007 - RNA, 14 nt, Mycobacterium bovis subsp bovis AF2122/97
ggcgauggcaccgu

SEQ ID NO: 3072008 - RNA, 18 nt, Mycobacterium bovis subsp bovis AF2122/97
ggcgauggcaccguggau

SEQ ID NO: 3072009 - RNA, 14 nt, Mycobacterium bovis subsp bovis AF2122/97
ggcgauggccagca

SEQ ID NO: 3072010 - RNA, 15 nt, Mycobacterium bovis subsp bovis AF2122/97
ggcgauggccagcac

SEQ ID NO: 3072011 - RNA, 17 nt, Mycobacterium bovis subsp bovis AF2122/97
ggcgauggccagcacgg

SEQ ID NO: 3072012 - RNA, 13 nt, Mycobacterium bovis subsp bovis AF2122/97
ggcgauggcgagc

SEQ ID NO: 3072013 - RNA, 12 nt, Mycobacterium bovis subsp bovis AF2122/97
ggcgccaccacc

SEQ ID NO: 3072014 - RNA, 16 nt, Mycobacterium bovis subsp bovis AF2122/97
ggcgccaccacccggc

SEQ ID NO: 3072015 - RNA, 17 nt, Mycobacterium bovis subsp bovis AF2122/97
ggcgccaccacccggcg

SEQ ID NO: 3072016 - RNA, 16 nt, Mycobacterium bovis subsp bovis AF2122/97
ggcgccaccagucacg

SEQ ID NO: 3072017 - RNA, 17 nt, Mycobacterium bovis subsp bovis AF2122/97
ggcgccaccaucgggga

SEQ ID NO: 3072018 - RNA, 19 nt, Mycobacterium bovis subsp bovis AF2122/97
ggcgccacccccaccgucg

SEQ ID NO: 3072019 - RNA, 17 nt, Mycobacterium bovis subsp bovis AF2122/97
ggcgccacccgcgccgc

SEQ ID NO: 3072020 - RNA, 21 nt, Mycobacterium bovis subsp bovis AF2122/97
ggcgccacccgcgccgcccgc

SEQ ID NO: 3072021 - RNA, 22 nt, Mycobacterium bovis subsp bovis AF2122/97
ggcgccacccgcgccgcccgcu

SEQ ID NO: 3072022 - RNA, 23 nt, Mycobacterium bovis subsp bovis AF2122/97
ggcgccacccgcgccgcccgcuc

SEQ ID NO: 3072023 - RNA, 19 nt, Mycobacterium bovis subsp bovis AF2122/97
ggcgccaccgccgcugccg

SEQ ID NO: 3072024 - RNA, 14 nt, Mycobacterium bovis subsp bovis AF2122/97
ggcgccaccggcgc

SEQ ID NO: 3072025 - RNA, 16 nt, Mycobacterium bovis subsp bovis AF2122/97
ggcgccaccggcgccg

SEQ ID NO: 3072026 - RNA, 18 nt, Mycobacterium bovis subsp bovis AF2122/97
ggcgccaccgucaccgcc

SEQ ID NO: 3072027 - RNA, 18 nt, Mycobacterium bovis subsp bovis AF2122/97
ggcgccaccgucgccgua

SEQ ID NO: 3072028 - RNA, 23 nt, Mycobacterium bovis subsp bovis AF2122/97
ggcgccacggcagcgcccagauc

SEQ ID NO: 3072029 - RNA, 20 nt, Mycobacterium bovis subsp bovis AF2122/97
ggcgccacgggugacucggg

SEQ ID NO: 3072030 - RNA, 15 nt, Mycobacterium bovis subsp bovis AF2122/97
ggcgccacugaccgc

SEQ ID NO: 3072031 - RNA, 19 nt, Mycobacterium bovis subsp bovis AF2122/97
ggcgccacugaccgcgauc

SEQ ID NO: 3072032 - RNA, 18 nt, Mycobacterium bovis subsp bovis AF2122/97
ggcgccagaucgacgcca

SEQ ID NO: 3072033 - RNA, 22 nt, Mycobacterium bovis subsp bovis AF2122/97
ggcgccagaugccucggagauc

SEQ ID NO: 3072034 - RNA, 14 nt, Mycobacterium bovis subsp bovis AF2122/97
ggcgccagcagauc

SEQ ID NO: 3072035 - RNA, 14 nt, Mycobacterium bovis subsp bovis AF2122/97
ggcgccagccgacc

SEQ ID NO: 3072036 - RNA, 12 nt, Mycobacterium bovis subsp bovis AF2122/97
ggcgccagcgcc

SEQ ID NO: 3072037 - RNA, 13 nt, Mycobacterium bovis subsp bovis AF2122/97
ggcgccagggccu

SEQ ID NO: 3072038 - RNA, 19 nt, Mycobacterium bovis subsp bovis AF2122/97
ggcgccaguauggccgcca

SEQ ID NO: 3072039 - RNA, 21 nt, Mycobacterium bovis subsp bovis AF2122/97
ggcgccauagccgcgacccgc

SEQ ID NO: 3072040 - RNA, 19 nt, Mycobacterium bovis subsp bovis AF2122/97
ggcgccauccccgccggcg

SEQ ID NO: 3072041 - RNA, 20 nt, Mycobacterium bovis subsp bovis AF2122/97
ggcgccauccccgccggcgc

SEQ ID NO: 3072042 - RNA, 20 nt, Mycobacterium bovis subsp bovis AF2122/97
ggcgccaugaagccgggcgc

SEQ ID NO: 3072043 - RNA, 22 nt, Mycobacterium bovis subsp bovis AF2122/97
ggcgcccagcgacaacaccacg

SEQ ID NO: 3072044 - RNA, 13 nt, Mycobacterium bovis subsp bovis AF2122/97
ggcgcccagcgcu

SEQ ID NO: 3072045 - RNA, 15 nt, Mycobacterium bovis subsp bovis AF2122/97
ggcgcccagcgcuag

SEQ ID NO: 3072046 - RNA, 18 nt, Mycobacterium bovis subsp bovis AF2122/97
ggcgcccagcucgauacc

SEQ ID NO: 3072047 - RNA, 17 nt, Mycobacterium bovis subsp bovis AF2122/97
ggcgcccagcucgucga

SEQ ID NO: 3072048 - RNA, 14 nt, Mycobacterium bovis subsp bovis AF2122/97
ggcgcccaggaacu

SEQ ID NO: 3072049 - RNA, 11 nt, Mycobacterium bovis subsp bovis AF2122/97
ggcgcccaggc

SEQ ID NO: 3072050 - RNA, 14 nt, Mycobacterium bovis subsp bovis AF2122/97
ggcgcccaggccga

SEQ ID NO: 3072051 - RNA, 20 nt, Mycobacterium bovis subsp bovis AF2122/97
ggcgcccauagcaccucgau

SEQ ID NO: 3072052 - RNA, 20 nt, Mycobacterium bovis subsp bovis AF2122/97
ggcgcccaugcugacacgac

SEQ ID NO: 3072053 - RNA, 15 nt, Mycobacterium bovis subsp bovis AF2122/97
ggcgccccaccggcc

SEQ ID NO: 3072054 - RNA, 14 nt, Mycobacterium bovis subsp bovis AF2122/97
ggcgcccccgacga

SEQ ID NO: 3072055 - RNA, 13 nt, Mycobacterium bovis subsp bovis AF2122/97
ggcgcccccgcca

SEQ ID NO: 3072056 - RNA, 15 nt, Mycobacterium bovis subsp bovis AF2122/97
ggcgcccccgccauu

SEQ ID NO: 3072057 - RNA, 22 nt, Mycobacterium bovis subsp bovis AF2122/97
ggcgcccccgccauugccgccg

SEQ ID NO: 3072058 - RNA, 23 nt, Mycobacterium bovis subsp bovis AF2122/97
ggcgcccccgccauugccgccgg

SEQ ID NO: 3072059 - RNA, 21 nt, Mycobacterium bovis subsp bovis AF2122/97
ggcgcccgaagccgggcccca

SEQ ID NO: 3072060 - RNA, 21 nt, Mycobacterium bovis subsp bovis AF2122/97
ggcgcccgagauccccaaauc

SEQ ID NO: 3072061 - RNA, 14 nt, Mycobacterium bovis subsp bovis AF2122/97
ggcgcccgccccgc

SEQ ID NO: 3072062 - RNA, 14 nt, Mycobacterium bovis subsp bovis AF2122/97
ggcgcccgcccgag

SEQ ID NO: 3072063 - RNA, 15 nt, Mycobacterium bovis subsp bovis AF2122/97
ggcgcccgcccgagc

SEQ ID NO: 3072064 - RNA, 20 nt, Mycobacterium bovis subsp bovis AF2122/97
ggcgcccgcccgagccgcug

SEQ ID NO: 3072065 - RNA, 12 nt, Mycobacterium bovis subsp bovis AF2122/97
ggcgcccgccgc

SEQ ID NO: 3072066 - RNA, 16 nt, Mycobacterium bovis subsp bovis AF2122/97
ggcgcccgccggcaac

SEQ ID NO: 3072067 - RNA, 13 nt, Mycobacterium bovis subsp bovis AF2122/97
ggcgcccgcguga

SEQ ID NO: 3072068 - RNA, 21 nt, Mycobacterium bovis subsp bovis AF2122/97
ggcgcccgcucggccgcagcc

SEQ ID NO: 3072069 - RNA, 22 nt, Mycobacterium bovis subsp bovis AF2122/97
ggcgcccgcucggccgcagcca

SEQ ID NO: 3072070 - RNA, 13 nt, Mycobacterium bovis subsp bovis AF2122/97
ggcgcccggcgga

SEQ ID NO: 3072071 - RNA, 14 nt, Mycobacterium bovis subsp bovis AF2122/97
ggcgcccggcggau

SEQ ID NO: 3072072 - RNA, 23 nt, Mycobacterium bovis subsp bovis AF2122/97
ggcgcccggcuuuugcgcccagc

SEQ ID NO: 3072073 - RNA, 12 nt, Mycobacterium bovis subsp bovis AF2122/97
ggcgcccgggau

SEQ ID NO: 3072074 - RNA, 22 nt, Mycobacterium bovis subsp bovis AF2122/97
ggcgcccgggaucggggcaccg

SEQ ID NO: 3072075 - RNA, 14 nt, Mycobacterium bovis subsp bovis AF2122/97
ggcgcccgggccca

SEQ ID NO: 3072076 - RNA, 20 nt, Mycobacterium bovis subsp bovis AF2122/97
ggcgcccggggcggugggcg

SEQ ID NO: 3072077 - RNA, 13 nt, Mycobacterium bovis subsp bovis AF2122/97
ggcgcccggucga

SEQ ID NO: 3072078 - RNA, 16 nt, Mycobacterium bovis subsp bovis AF2122/97
ggcgcccggucgagcc

SEQ ID NO: 3072079 - RNA, 21 nt, Mycobacterium bovis subsp bovis AF2122/97
ggcgcccggucgagccagcgg

SEQ ID NO: 3072080 - RNA, 13 nt, Mycobacterium bovis subsp bovis AF2122/97
ggcgcccgugccg

SEQ ID NO: 3072081 - RNA, 15 nt, Mycobacterium bovis subsp bovis AF2122/97
ggcgcccgugccgcc

SEQ ID NO: 3072082 - RNA, 20 nt, Mycobacterium bovis subsp bovis AF2122/97
ggcgcccgugccgcccgcgc

SEQ ID NO: 3072083 - RNA, 21 nt, Mycobacterium bovis subsp bovis AF2122/97
ggcgcccgugccgcccgcgcc

SEQ ID NO: 3072084 - RNA, 12 nt, Mycobacterium bovis subsp bovis AF2122/97
ggcgcccugcgc

SEQ ID NO: 3072085 - RNA, 14 nt, Mycobacterium bovis subsp bovis AF2122/97
ggcgcccugcgcca

SEQ ID NO: 3072086 - RNA, 19 nt, Mycobacterium bovis subsp bovis AF2122/97
ggcgcccugcgccacaccc

SEQ ID NO: 3072087 - RNA, 16 nt, Mycobacterium bovis subsp bovis AF2122/97
ggcgcccuuaagccgg

SEQ ID NO: 3072088 - RNA, 19 nt, Mycobacterium bovis subsp bovis AF2122/97
ggcgcccuuaagccggcgc

SEQ ID NO: 3072089 - RNA, 22 nt, Mycobacterium bovis subsp bovis AF2122/97
ggcgcccuuaagccggcgcggc

SEQ ID NO: 3072090 - RNA, 23 nt, Mycobacterium bovis subsp bovis AF2122/97
ggcgcccuuaagccggcgcggcg

SEQ ID NO: 3072091 - RNA, 18 nt, Mycobacterium bovis subsp bovis AF2122/97
ggcgcccuugagccgccg

SEQ ID NO: 3072092 - RNA, 17 nt, Mycobacterium bovis subsp bovis AF2122/97
ggcgcccuugccggcga

SEQ ID NO: 3072093 - RNA, 18 nt, Mycobacterium bovis subsp bovis AF2122/97
ggcgcccuugccggcgag

SEQ ID NO: 3072094 - RNA, 15 nt, Mycobacterium bovis subsp bovis AF2122/97
ggcgccgaaccagcg

SEQ ID NO: 3072095 - RNA, 19 nt, Mycobacterium bovis subsp bovis AF2122/97
ggcgccgaagccuugcagc

SEQ ID NO: 3072096 - RNA, 18 nt, Mycobacterium bovis subsp bovis AF2122/97
ggcgccgaaguagccgac

SEQ ID NO: 3072097 - RNA, 19 nt, Mycobacterium bovis subsp bovis AF2122/97
ggcgccgaaguagccgacc

SEQ ID NO: 3072098 - RNA, 22 nt, Mycobacterium bovis subsp bovis AF2122/97
ggcgccgaaguagccgaccggc

SEQ ID NO: 3072099 - RNA, 15 nt, Mycobacterium bovis subsp bovis AF2122/97
ggcgccgacaccggc

SEQ ID NO: 3072100 - RNA, 20 nt, Mycobacterium bovis subsp bovis AF2122/97
ggcgccgucggagccggcca

SEQ ID NO: 3072101 - RNA, 23 nt, Mycobacterium bovis subsp bovis AF2122/97
ggcgccgucggagccggccaccu

SEQ ID NO: 3072102 - RNA, 17 nt, Mycobacterium bovis subsp bovis AF2122/97
ggcgccgucggccgagu

SEQ ID NO: 3072103 - RNA, 19 nt, Mycobacterium bovis subsp bovis AF2122/97
ggcgccgucggccgagucg

SEQ ID NO: 3072104 - RNA, 18 nt, Mycobacterium bovis subsp bovis AF2122/97
ggcgccgucgucagcggg

SEQ ID NO: 3072105 - RNA, 20 nt, Mycobacterium bovis subsp bovis AF2122/97
ggcgccgucguugugccggu

SEQ ID NO: 3072106 - RNA, 23 nt, Mycobacterium bovis subsp bovis AF2122/97
ggcgccgucguugugccggucga

SEQ ID NO: 3072107 - RNA, 24 nt, Mycobacterium bovis subsp bovis AF2122/97
ggcgccgucguugugccggucgau

SEQ ID NO: 3072108 - RNA, 14 nt, Mycobacterium bovis subsp bovis AF2122/97
ggcgccgucucgau

SEQ ID NO: 3072109 - RNA, 17 nt, Mycobacterium bovis subsp bovis AF2122/97
ggcgccgucucgcggug

SEQ ID NO: 3072110 - RNA, 18 nt, Mycobacterium bovis subsp bovis AF2122/97
ggcgccgugccccgggcc

SEQ ID NO: 3072111 - RNA, 22 nt, Mycobacterium bovis subsp bovis AF2122/97
ggcgccguuaccgccguugccg

SEQ ID NO: 3072112 - RNA, 19 nt, Mycobacterium bovis subsp bovis AF2122/97
ggcgccguuagcgucgccu

SEQ ID NO: 3072113 - RNA, 16 nt, Mycobacterium bovis subsp bovis AF2122/97
ggcgccguugccaccg

SEQ ID NO: 3072114 - RNA, 13 nt, Mycobacterium bovis subsp bovis AF2122/97
ggcgccguugccg

SEQ ID NO: 3072115 - RNA, 17 nt, Mycobacterium bovis subsp bovis AF2122/97
ggcgccguugccggcgu

SEQ ID NO: 3072116 - RNA, 18 nt, Mycobacterium bovis subsp bovis AF2122/97
ggcgccguugucggcggu

SEQ ID NO: 3072117 - RNA, 19 nt, Mycobacterium bovis subsp bovis AF2122/97
ggcgccguugucggcggug

SEQ ID NO: 3072118 - RNA, 14 nt, Mycobacterium bovis subsp bovis AF2122/97
ggcgccuacaccgg

SEQ ID NO: 3072119 - RNA, 17 nt, Mycobacterium bovis subsp bovis AF2122/97
ggcgccuacaccggcgc

SEQ ID NO: 3072120 - RNA, 21 nt, Mycobacterium bovis subsp bovis AF2122/97
ggcgccucgugcgugggcgcg

SEQ ID NO: 3072121 - RNA, 13 nt, Mycobacterium bovis subsp bovis AF2122/97
ggcgccucguugc

SEQ ID NO: 3072122 - RNA, 20 nt, Mycobacterium bovis subsp bovis AF2122/97
ggcgccugacucaucaccga

SEQ ID NO: 3072123 - RNA, 18 nt, Mycobacterium bovis subsp bovis AF2122/97
ggcgccugaugcggccgg

SEQ ID NO: 3072124 - RNA, 19 nt, Mycobacterium bovis subsp bovis AF2122/97
ggcgccugaugcggccggc

SEQ ID NO: 3072125 - RNA, 20 nt, Mycobacterium bovis subsp bovis AF2122/97
ggcgccugaugcggccggcg

SEQ ID NO: 3072126 - RNA, 20 nt, Mycobacterium bovis subsp bovis AF2122/97
ggcgccuuccaggcgggcgg

SEQ ID NO: 3072127 - RNA, 22 nt, Mycobacterium bovis subsp bovis AF2122/97
ggcgccuuccaggcgggcggca

SEQ ID NO: 3072128 - RNA, 20 nt, Mycobacterium bovis subsp bovis AF2122/97
ggcgccuugguccguagcgc

SEQ ID NO: 3072129 - RNA, 17 nt, Mycobacterium bovis subsp bovis AF2122/97
ggcgccuuggucgccgc

SEQ ID NO: 3072130 - RNA, 20 nt, Mycobacterium bovis subsp bovis AF2122/97
ggcgcgaagucuugaccgca

SEQ ID NO: 3072131 - RNA, 19 nt, Mycobacterium bovis subsp bovis AF2122/97
ggcgcgaccagaaucgggc

SEQ ID NO: 3072132 - RNA, 12 nt, Mycobacterium bovis subsp bovis AF2122/97
ggcgcgaccgcg

SEQ ID NO: 3072133 - RNA, 13 nt, Mycobacterium bovis subsp bovis AF2122/97
ggcgcgaccgcgg

SEQ ID NO: 3072134 - RNA, 14 nt, Mycobacterium bovis subsp bovis AF2122/97
ggcgcgaccggucu

SEQ ID NO: 3072135 - RNA, 19 nt, Mycobacterium bovis subsp bovis AF2122/97
ggcgcgaccggucugaucg

SEQ ID NO: 3072136 - RNA, 15 nt, Mycobacterium bovis subsp bovis AF2122/97
ggcgcgacgcccgaa

SEQ ID NO: 3072137 - RNA, 13 nt, Mycobacterium bovis subsp bovis AF2122/97
ggcgcgacggcau

SEQ ID NO: 3072138 - RNA, 17 nt, Mycobacterium bovis subsp bovis AF2122/97
ggcgcgacguagacgac

SEQ ID NO: 3072139 - RNA, 15 nt, Mycobacterium bovis subsp bovis AF2122/97
ggcgcgagccggcuc

SEQ ID NO: 3072140 - RNA, 21 nt, Mycobacterium bovis subsp bovis AF2122/97
ggcgcgagccggcucagacga

SEQ ID NO: 3072141 - RNA, 16 nt, Mycobacterium bovis subsp bovis AF2122/97
ggcgcgauccccgcgc

SEQ ID NO: 3072142 - RNA, 20 nt, Mycobacterium bovis subsp bovis AF2122/97
ggcgcgauccccgcgcugag

SEQ ID NO: 3072143 - RNA, 14 nt, Mycobacterium bovis subsp bovis AF2122/97
ggcgcgaucgacgc

SEQ ID NO: 3072144 - RNA, 12 nt, Mycobacterium bovis subsp bovis AF2122/97
ggcgcgauucag

SEQ ID NO: 3072145 - RNA, 22 nt, Mycobacterium bovis subsp bovis AF2122/97
ggcgcgcaacguagccagcagc

SEQ ID NO: 3072146 - RNA, 19 nt, Mycobacterium bovis subsp bovis AF2122/97
ggcgcgcaagugcuggccg

SEQ ID NO: 3072147 - RNA, 20 nt, Mycobacterium bovis subsp bovis AF2122/97
ggcgcgcaccaccgcggcgg

SEQ ID NO: 3072148 - RNA, 14 nt, Mycobacterium bovis subsp bovis AF2122/97
ggcgcgcaccucgg

SEQ ID NO: 3072149 - RNA, 13 nt, Mycobacterium bovis subsp bovis AF2122/97
ggcgcgcagccgg

SEQ ID NO: 3072150 - RNA, 14 nt, Mycobacterium bovis subsp bovis AF2122/97
ggcgcgcagccggg

SEQ ID NO: 3072151 - RNA, 16 nt, Mycobacterium bovis subsp bovis AF2122/97
ggcgcgcagccgggcc

SEQ ID NO: 3072152 - RNA, 18 nt, Mycobacterium bovis subsp bovis AF2122/97
ggcgcgcagccgggccaa

SEQ ID NO: 3072153 - RNA, 17 nt, Mycobacterium bovis subsp bovis AF2122/97
ggcgcgcagcgauucgc

SEQ ID NO: 3072154 - RNA, 16 nt, Mycobacterium bovis subsp bovis AF2122/97
ggcgcgcagcuuggac

SEQ ID NO: 3072155 - RNA, 23 nt, Mycobacterium bovis subsp bovis AF2122/97
ggcgcgcagcuuggacaccagua

SEQ ID NO: 3072156 - RNA, 17 nt, Mycobacterium bovis subsp bovis AF2122/97
ggcgcgcaucugcucgg

SEQ ID NO: 3072157 - RNA, 21 nt, Mycobacterium bovis subsp bovis AF2122/97
ggcgcgcaucugcucggcauc

SEQ ID NO: 3072158 - RNA, 12 nt, Mycobacterium bovis subsp bovis AF2122/97
ggcgcgcccaca

SEQ ID NO: 3072159 - RNA, 15 nt, Mycobacterium bovis subsp bovis AF2122/97
ggcgcgccccaccgc

SEQ ID NO: 3072160 - RNA, 21 nt, Mycobacterium bovis subsp bovis AF2122/97
ggcgcgccccaccgcgccgag

SEQ ID NO: 3072161 - RNA, 23 nt, Mycobacterium bovis subsp bovis AF2122/97
ggcgcgccccaccgcgccgagca

SEQ ID NO: 3072162 - RNA, 19 nt, Mycobacterium bovis subsp bovis AF2122/97
ggcgcgccccgccgcacgc

SEQ ID NO: 3072163 - RNA, 21 nt, Mycobacterium bovis subsp bovis AF2122/97
ggcgcgcccggaucucggcgu

SEQ ID NO: 3072164 - RNA, 12 nt, Mycobacterium bovis subsp bovis AF2122/97
ggcgcgccgacc

SEQ ID NO: 3072165 - RNA, 13 nt, Mycobacterium bovis subsp bovis AF2122/97
ggcgcgccgcacc

SEQ ID NO: 3072166 - RNA, 17 nt, Mycobacterium bovis subsp bovis AF2122/97
ggcgcgccggucgccga

SEQ ID NO: 3072167 - RNA, 18 nt, Mycobacterium bovis subsp bovis AF2122/97
ggcgcgccggucgccgac

SEQ ID NO: 3072168 - RNA, 20 nt, Mycobacterium bovis subsp bovis AF2122/97
ggcgcgccggucgccgacgg

SEQ ID NO: 3072169 - RNA, 21 nt, Mycobacterium bovis subsp bovis AF2122/97
ggcgcgccggucgccgacggc

SEQ ID NO: 3072170 - RNA, 22 nt, Mycobacterium bovis subsp bovis AF2122/97
ggcgcgccguacguucaccacc

SEQ ID NO: 3072171 - RNA, 21 nt, Mycobacterium bovis subsp bovis AF2122/97
ggcgcgccguugccggccacc

SEQ ID NO: 3072172 - RNA, 18 nt, Mycobacterium bovis subsp bovis AF2122/97
ggcgcgcgcaacgcugga

SEQ ID NO: 3072173 - RNA, 20 nt, Mycobacterium bovis subsp bovis AF2122/97
ggcgcgcgcaacgcuggagg

SEQ ID NO: 3072174 - RNA, 14 nt, Mycobacterium bovis subsp bovis AF2122/97
ggcgcgcgcgccgg

SEQ ID NO: 3072175 - RNA, 15 nt, Mycobacterium bovis subsp bovis AF2122/97
ggcgcgcgcgccggc

SEQ ID NO: 3072176 - RNA, 17 nt, Mycobacterium bovis subsp bovis AF2122/97
ggcgcgcgcgccggcug

SEQ ID NO: 3072177 - RNA, 19 nt, Mycobacterium bovis subsp bovis AF2122/97
ggcgcgcgcgccggcugcc

SEQ ID NO: 3072178 - RNA, 13 nt, Mycobacterium bovis subsp bovis AF2122/97
ggcgcgcggcgcc

SEQ ID NO: 3072179 - RNA, 14 nt, Mycobacterium bovis subsp bovis AF2122/97
ggcgcgcggcgccg

SEQ ID NO: 3072180 - RNA, 15 nt, Mycobacterium bovis subsp bovis AF2122/97
ggcgcgcggcgccgc

SEQ ID NO: 3072181 - RNA, 21 nt, Mycobacterium bovis subsp bovis AF2122/97
ggcgcgcggggaugcgaccgc

SEQ ID NO: 3072182 - RNA, 16 nt, Mycobacterium bovis subsp bovis AF2122/97
ggcgcgcggggccucg

SEQ ID NO: 3072183 - RNA, 20 nt, Mycobacterium bovis subsp bovis AF2122/97
ggcgcgcggggccucgcgag

SEQ ID NO: 3072184 - RNA, 21 nt, Mycobacterium bovis subsp bovis AF2122/97
ggcgcgcuaucaugaccaccg

SEQ ID NO: 3072185 - RNA, 13 nt, Mycobacterium bovis subsp bovis AF2122/97
ggcgcgcugcacg

SEQ ID NO: 3072186 - RNA, 11 nt, Mycobacterium bovis subsp bovis AF2122/97
ggcgcugcagc

SEQ ID NO: 3072187 - RNA, 13 nt, Mycobacterium bovis subsp bovis AF2122/97
ggcgcugcagcau

SEQ ID NO: 3072188 - RNA, 17 nt, Mycobacterium bovis subsp bovis AF2122/97
ggcgcugcagcugcucg

SEQ ID NO: 3072189 - RNA, 11 nt, Mycobacterium bovis subsp bovis AF2122/97
ggcgcugccaa

SEQ ID NO: 3072190 - RNA, 16 nt, Mycobacterium bovis subsp bovis AF2122/97
ggcgcugccaggccgc

SEQ ID NO: 3072191 - RNA, 21 nt, Mycobacterium bovis subsp bovis AF2122/97
ggcgcugcccgggcugccgcc

SEQ ID NO: 3072192 - RNA, 14 nt, Mycobacterium bovis subsp bovis AF2122/97
ggcgcugccgggau

SEQ ID NO: 3072193 - RNA, 13 nt, Mycobacterium bovis subsp bovis AF2122/97
ggcgcugcgcacc

SEQ ID NO: 3072194 - RNA, 16 nt, Mycobacterium bovis subsp bovis AF2122/97
ggcgcugcgcaccgcc

SEQ ID NO: 3072195 - RNA, 14 nt, Mycobacterium bovis subsp bovis AF2122/97
ggcgcugcgcgauc

SEQ ID NO: 3072196 - RNA, 19 nt, Mycobacterium bovis subsp bovis AF2122/97
ggcgcugcgcgcgauccac

SEQ ID NO: 3072197 - RNA, 16 nt, Mycobacterium bovis subsp bovis AF2122/97
ggcgcugcggcgugcc

SEQ ID NO: 3072198 - RNA, 14 nt, Mycobacterium bovis subsp bovis AF2122/97
ggcgcugcuggcag

SEQ ID NO: 3072199 - RNA, 15 nt, Mycobacterium bovis subsp bovis AF2122/97
ggcgcugcuggcaga

SEQ ID NO: 3072200 - RNA, 22 nt, Mycobacterium bovis subsp bovis AF2122/97
ggcgcuggaccgggucgggcac

SEQ ID NO: 3072201 - RNA, 14 nt, Mycobacterium bovis subsp bovis AF2122/97
ggcgcuggacggcg

SEQ ID NO: 3072202 - RNA, 17 nt, Mycobacterium bovis subsp bovis AF2122/97
ggcgcuggacggcgggc

SEQ ID NO: 3072203 - RNA, 13 nt, Mycobacterium bovis subsp bovis AF2122/97
ggcgcuggagacg

SEQ ID NO: 3072204 - RNA, 20 nt, Mycobacterium bovis subsp bovis AF2122/97
ggcgcuggaggccaccaccu

SEQ ID NO: 3072205 - RNA, 18 nt, Mycobacterium bovis subsp bovis AF2122/97
ggcgcuggcguggccaac

SEQ ID NO: 3072206 - RNA, 17 nt, Mycobacterium bovis subsp bovis AF2122/97
ggcgcuggucgcggugg

SEQ ID NO: 3072207 - RNA, 22 nt, Mycobacterium bovis subsp bovis AF2122/97
ggcgcuggucgcgguggcggcg

SEQ ID NO: 3072208 - RNA, 15 nt, Mycobacterium bovis subsp bovis AF2122/97
ggcgcuggugcgcca

SEQ ID NO: 3072209 - RNA, 20 nt, Mycobacterium bovis subsp bovis AF2122/97
ggcgcuucugcuacccgagc

SEQ ID NO: 3072210 - RNA, 24 nt, Mycobacterium bovis subsp bovis AF2122/97
ggcgcuucugcuacccgagccggc

SEQ ID NO: 3072211 - RNA, 22 nt, Mycobacterium bovis subsp bovis AF2122/97
ggcgcuugcaccaggggcgcgu

SEQ ID NO: 3072212 - RNA, 13 nt, Mycobacterium bovis subsp bovis AF2122/97
ggcgcuugccggg

SEQ ID NO: 3072213 - RNA, 14 nt, Mycobacterium bovis subsp bovis AF2122/97
ggcgcuugccgggg

SEQ ID NO: 3072214 - RNA, 13 nt, Mycobacterium bovis subsp bovis AF2122/97
ggcgcuuugggcu

SEQ ID NO: 3072215 - RNA, 16 nt, Mycobacterium bovis subsp bovis AF2122/97
ggcgcuuugggcugcc

SEQ ID NO: 3072216 - RNA, 22 nt, Mycobacterium bovis subsp bovis AF2122/97
ggcggaaaaucggcuggcccga

SEQ ID NO: 3072217 - RNA, 22 nt, Mycobacterium bovis subsp bovis AF2122/97
ggcggaacagcuucgcgcagcc

SEQ ID NO: 3072218 - RNA, 23 nt, Mycobacterium bovis subsp bovis AF2122/97
ggcggaacagcuucgcgcagccg

SEQ ID NO: 3072219 - RNA, 24 nt, Mycobacterium bovis subsp bovis AF2122/97
ggcggaacagcuucgcgcagccgg

SEQ ID NO: 3072220 - RNA, 15 nt, Mycobacterium bovis subsp bovis AF2122/97
ggcggaacgaugccg

SEQ ID NO: 3072221 - RNA, 20 nt, Mycobacterium bovis subsp bovis AF2122/97
ggcggaacuguaggucacag

SEQ ID NO: 3072222 - RNA, 14 nt, Mycobacterium bovis subsp bovis AF2122/97
ggcggaacuugccg

SEQ ID NO: 3072223 - RNA, 14 nt, Mycobacterium bovis subsp bovis AF2122/97
ggcggaagaccgga

SEQ ID NO: 3072224 - RNA, 13 nt, Mycobacterium bovis subsp bovis AF2122/97
ggcggaagcggcg

SEQ ID NO: 3072225 - RNA, 21 nt, Mycobacterium bovis subsp bovis AF2122/97
ggcggaaguucuccucgugca

SEQ ID NO: 3072226 - RNA, 16 nt, Mycobacterium bovis subsp bovis AF2122/97
ggcggaauaucggccg

SEQ ID NO: 3072227 - RNA, 17 nt, Mycobacterium bovis subsp bovis AF2122/97
ggcggaauaucggccga

SEQ ID NO: 3072228 - RNA, 22 nt, Mycobacterium bovis subsp bovis AF2122/97
ggcggacaccucgggcgcccgc

SEQ ID NO: 3072229 - RNA, 23 nt, Mycobacterium bovis subsp bovis AF2122/97
ggcggacaccucgggcgcccgcg

SEQ ID NO: 3072230 - RNA, 19 nt, Mycobacterium bovis subsp bovis AF2122/97
ggcggacaggcccgguggc

SEQ ID NO: 3072231 - RNA, 20 nt, Mycobacterium bovis subsp bovis AF2122/97
ggcggacaggcccgguggcg

SEQ ID NO: 3072232 - RNA, 16 nt, Mycobacterium bovis subsp bovis AF2122/97
ggcggacagggcggca

SEQ ID NO: 3072233 - RNA, 18 nt, Mycobacterium bovis subsp bovis AF2122/97
ggcggacagggcggcaac

SEQ ID NO: 3072234 - RNA, 14 nt, Mycobacterium bovis subsp bovis AF2122/97
ggcggacaugcacc

SEQ ID NO: 3072235 - RNA, 19 nt, Mycobacterium bovis subsp bovis AF2122/97
ggcggaccaggccgcgcgc

SEQ ID NO: 3072236 - RNA, 20 nt, Mycobacterium bovis subsp bovis AF2122/97
ggcggaccccucgaccgaua

SEQ ID NO: 3072237 - RNA, 19 nt, Mycobacterium bovis subsp bovis AF2122/97
ggcggacccggugacccgc

SEQ ID NO: 3072238 - RNA, 23 nt, Mycobacterium bovis subsp bovis AF2122/97
ggcggacccggugacccgcuggg

SEQ ID NO: 3072239 - RNA, 21 nt, Mycobacterium bovis subsp bovis AF2122/97
ggcggaccguccgacggcgga

SEQ ID NO: 3072240 - RNA, 12 nt, Mycobacterium bovis subsp bovis AF2122/97
ggcggacgacgu

SEQ ID NO: 3072241 - RNA, 12 nt, Mycobacterium bovis subsp bovis AF2122/97
ggcggacgcccg

SEQ ID NO: 3072242 - RNA, 13 nt, Mycobacterium bovis subsp bovis AF2122/97
ggcggacgcccgg

SEQ ID NO: 3072243 - RNA, 16 nt, Mycobacterium bovis subsp bovis AF2122/97
ggcggacgcccggcgc

SEQ ID NO: 3072244 - RNA, 19 nt, Mycobacterium bovis subsp bovis AF2122/97
ggcggacgccgcgccggcg

SEQ ID NO: 3072245 - RNA, 21 nt, Mycobacterium bovis subsp bovis AF2122/97
ggcggacgccgcgccggcggg

SEQ ID NO: 3072246 - RNA, 17 nt, Mycobacterium bovis subsp bovis AF2122/97
ggcggacgugaccagau

SEQ ID NO: 3072247 - RNA, 16 nt, Mycobacterium bovis subsp bovis AF2122/97
ggcggagagcacuggg

SEQ ID NO: 3072248 - RNA, 20 nt, Mycobacterium bovis subsp bovis AF2122/97
ggcggagagcacugggcugg

SEQ ID NO: 3072249 - RNA, 21 nt, Mycobacterium bovis subsp bovis AF2122/97
ggcggagagcacugggcuggc

SEQ ID NO: 3072250 - RNA, 16 nt, Mycobacterium bovis subsp bovis AF2122/97
ggcggagccgaugacc

SEQ ID NO: 3072251 - RNA, 19 nt, Mycobacterium bovis subsp bovis AF2122/97
ggcggagcgggccagcacc

SEQ ID NO: 3072252 - RNA, 14 nt, Mycobacterium bovis subsp bovis AF2122/97
ggcggaggcugggc

SEQ ID NO: 3072253 - RNA, 17 nt, Mycobacterium bovis subsp bovis AF2122/97
ggcggagucgcgcaggg

SEQ ID NO: 3072254 - RNA, 18 nt, Mycobacterium bovis subsp bovis AF2122/97
ggcggagucgcgcagggc

SEQ ID NO: 3072255 - RNA, 18 nt, Mycobacterium bovis subsp bovis AF2122/97
ggcggauaaccggcaugc

SEQ ID NO: 3072256 - RNA, 23 nt, Mycobacterium bovis subsp bovis AF2122/97
ggcggauacaugguccggccgcg

SEQ ID NO: 3072257 - RNA, 18 nt, Mycobacterium bovis subsp bovis AF2122/97
ggcggauagucgcgggcc

SEQ ID NO: 3072258 - RNA, 15 nt, Mycobacterium bovis subsp bovis AF2122/97
ggcggauaugaugau

SEQ ID NO: 3072259 - RNA, 18 nt, Mycobacterium bovis subsp bovis AF2122/97
ggcggaucccgaggcgcc

SEQ ID NO: 3072260 - RNA, 22 nt, Mycobacterium bovis subsp bovis AF2122/97
ggcggaucccgaggcgcccaac

SEQ ID NO: 3072261 - RNA, 12 nt, Mycobacterium bovis subsp bovis AF2122/97
ggcggaucgccg

SEQ ID NO: 3072262 - RNA, 15 nt, Mycobacterium bovis subsp bovis AF2122/97
ggcggaucgcgagcg

SEQ ID NO: 3072263 - RNA, 16 nt, Mycobacterium bovis subsp bovis AF2122/97
ggcggaucgcgagcgc

SEQ ID NO: 3072264 - RNA, 20 nt, Mycobacterium bovis subsp bovis AF2122/97
ggcggaucgugcccuguccg

SEQ ID NO: 3072265 - RNA, 18 nt, Mycobacterium bovis subsp bovis AF2122/97
ggcggaucugaucggcgc

SEQ ID NO: 3072266 - RNA, 18 nt, Mycobacterium bovis subsp bovis AF2122/97
ggcggaugaugcaacgcc

SEQ ID NO: 3072267 - RNA, 20 nt, Mycobacterium bovis subsp bovis AF2122/97
ggcggaugcuguugacccgu

SEQ ID NO: 3072268 - RNA, 15 nt, Mycobacterium bovis subsp bovis AF2122/97
ggcggauucgcgcug

SEQ ID NO: 3072269 - RNA, 19 nt, Mycobacterium bovis subsp bovis AF2122/97
ggcggcaaagaacagccgg

SEQ ID NO: 3072270 - RNA, 23 nt, Mycobacterium bovis subsp bovis AF2122/97
ggcggcaaagaacagccggccaa

SEQ ID NO: 3072271 - RNA, 16 nt, Mycobacterium bovis subsp bovis AF2122/97
ggcggcaaccccgagc

SEQ ID NO: 3072272 - RNA, 12 nt, Mycobacterium bovis subsp bovis AF2122/97
ggcggccggcgg

SEQ ID NO: 3072273 - RNA, 14 nt, Mycobacterium bovis subsp bovis AF2122/97
ggcggccgggcucc

SEQ ID NO: 3072274 - RNA, 16 nt, Mycobacterium bovis subsp bovis AF2122/97
ggcggccgggcucccc

SEQ ID NO: 3072275 - RNA, 22 nt, Mycobacterium bovis subsp bovis AF2122/97
ggcggccguggcuggacccgca

SEQ ID NO: 3072276 - RNA, 16 nt, Mycobacterium bovis subsp bovis AF2122/97
ggcggccgugucgggc

SEQ ID NO: 3072277 - RNA, 19 nt, Mycobacterium bovis subsp bovis AF2122/97
ggcggccgugucgggcgcg

SEQ ID NO: 3072278 - RNA, 20 nt, Mycobacterium bovis subsp bovis AF2122/97
ggcggccuccaccacgucgg

SEQ ID NO: 3072279 - RNA, 19 nt, Mycobacterium bovis subsp bovis AF2122/97
ggcggccucccgggccgcc

SEQ ID NO: 3072280 - RNA, 20 nt, Mycobacterium bovis subsp bovis AF2122/97
ggcggccucccgggccgccg

SEQ ID NO: 3072281 - RNA, 22 nt, Mycobacterium bovis subsp bovis AF2122/97
ggcggccucccgggccgccgcg

SEQ ID NO: 3072282 - RNA, 13 nt, Mycobacterium bovis subsp bovis AF2122/97
ggcggccuccucc

SEQ ID NO: 3072283 - RNA, 15 nt, Mycobacterium bovis subsp bovis AF2122/97
ggcggccucgccggc

SEQ ID NO: 3072284 - RNA, 16 nt, Mycobacterium bovis subsp bovis AF2122/97
ggcggccucgccggcg

SEQ ID NO: 3072285 - RNA, 15 nt, Mycobacterium bovis subsp bovis AF2122/97
ggcggccucgcugcu

SEQ ID NO: 3072286 - RNA, 18 nt, Mycobacterium bovis subsp bovis AF2122/97
ggcggccuucggccggcg

SEQ ID NO: 3072287 - RNA, 19 nt, Mycobacterium bovis subsp bovis AF2122/97
ggcggccuucggccggcgu

SEQ ID NO: 3072288 - RNA, 13 nt, Mycobacterium bovis subsp bovis AF2122/97
ggcggccuugccg

SEQ ID NO: 3072289 - RNA, 22 nt, Mycobacterium bovis subsp bovis AF2122/97
ggcggccuugccgggccgcgcg

SEQ ID NO: 3072290 - RNA, 22 nt, Mycobacterium bovis subsp bovis AF2122/97
ggcggccuugcucagcacgccg

SEQ ID NO: 3072291 - RNA, 13 nt, Mycobacterium bovis subsp bovis AF2122/97
ggcggcgaccgcc

SEQ ID NO: 3072292 - RNA, 16 nt, Mycobacterium bovis subsp bovis AF2122/97
ggcggcgaccgccagc

SEQ ID NO: 3072293 - RNA, 17 nt, Mycobacterium bovis subsp bovis AF2122/97
ggcggcgaccgccagcg

SEQ ID NO: 3072294 - RNA, 19 nt, Mycobacterium bovis subsp bovis AF2122/97
ggcggcgaccucggcggcg

SEQ ID NO: 3072295 - RNA, 11 nt, Mycobacterium bovis subsp bovis AF2122/97
ggcggcgacgc

SEQ ID NO: 3072296 - RNA, 13 nt, Mycobacterium bovis subsp bovis AF2122/97
ggcggcgacgccg

SEQ ID NO: 3072297 - RNA, 15 nt, Mycobacterium bovis subsp bovis AF2122/97
ggcggcgacggcggc

SEQ ID NO: 3072298 - RNA, 15 nt, Mycobacterium bovis subsp bovis AF2122/97
ggcggcgagcagcag

SEQ ID NO: 3072299 - RNA, 19 nt, Mycobacterium bovis subsp bovis AF2122/97
ggcggcgagcgcgaugcag

SEQ ID NO: 3072300 - RNA, 22 nt, Mycobacterium bovis subsp bovis AF2122/97
ggcggcgagcgcgaugcagugc

SEQ ID NO: 3072301 - RNA, 22 nt, Mycobacterium bovis subsp bovis AF2122/97
ggcggcgaucaacucgggcagc

SEQ ID NO: 3072302 - RNA, 22 nt, Mycobacterium bovis subsp bovis AF2122/97
ggcggcgauccggucgggggcg

SEQ ID NO: 3072303 - RNA, 18 nt, Mycobacterium bovis subsp bovis AF2122/97
ggcggcgaugaccgggcg

SEQ ID NO: 3072304 - RNA, 22 nt, Mycobacterium bovis subsp bovis AF2122/97
ggcggcgcaccuugaccgucgc

SEQ ID NO: 3072305 - RNA, 19 nt, Mycobacterium bovis subsp bovis AF2122/97
ggcggcgcaucaccuccgc

SEQ ID NO: 3072306 - RNA, 12 nt, Mycobacterium bovis subsp bovis AF2122/97
ggcggcgcccgg

SEQ ID NO: 3072307 - RNA, 13 nt, Mycobacterium bovis subsp bovis AF2122/97
ggcggcgccgcag

SEQ ID NO: 3072308 - RNA, 14 nt, Mycobacterium bovis subsp bovis AF2122/97
ggcggcgccgcaga

SEQ ID NO: 3072309 - RNA, 16 nt, Mycobacterium bovis subsp bovis AF2122/97
ggcggcgccggaggcg

SEQ ID NO: 3072310 - RNA, 20 nt, Mycobacterium bovis subsp bovis AF2122/97
ggcggcgccggaggcggcgc

SEQ ID NO: 3072311 - RNA, 21 nt, Mycobacterium bovis subsp bovis AF2122/97
ggcggcgccggaggcggcgcu

SEQ ID NO: 3072312 - RNA, 17 nt, Mycobacterium bovis subsp bovis AF2122/97
ggcggcgccggccucgc

SEQ ID NO: 3072313 - RNA, 15 nt, Mycobacterium bovis subsp bovis AF2122/97
ggcggcgcgcagcuu

SEQ ID NO: 3072314 - RNA, 14 nt, Mycobacterium bovis subsp bovis AF2122/97
ggcggcgcgcccgg

SEQ ID NO: 3072315 - RNA, 12 nt, Mycobacterium bovis subsp bovis AF2122/97
ggcggcgcgccg

SEQ ID NO: 3072316 - RNA, 14 nt, Mycobacterium bovis subsp bovis AF2122/97
ggcggcgcgccgau

SEQ ID NO: 3072317 - RNA, 14 nt, Mycobacterium bovis subsp bovis AF2122/97
ggcggcgcgcgcug

SEQ ID NO: 3072318 - RNA, 17 nt, Mycobacterium bovis subsp bovis AF2122/97
ggcggcgcgggucggcg

SEQ ID NO: 3072319 - RNA, 19 nt, Mycobacterium bovis subsp bovis AF2122/97
ggcggcgcgugcgguggcg

SEQ ID NO: 3072320 - RNA, 12 nt, Mycobacterium bovis subsp bovis AF2122/97
ggcggcgcucgu

SEQ ID NO: 3072321 - RNA, 14 nt, Mycobacterium bovis subsp bovis AF2122/97
ggcggcgcucgucg

SEQ ID NO: 3072322 - RNA, 16 nt, Mycobacterium bovis subsp bovis AF2122/97
ggcggcgcugcagcug

SEQ ID NO: 3072323 - RNA, 17 nt, Mycobacterium bovis subsp bovis AF2122/97
ggcggcgcuggcgucgu

SEQ ID NO: 3072324 - RNA, 15 nt, Mycobacterium bovis subsp bovis AF2122/97
ggcggcgcuggucgc

SEQ ID NO: 3072325 - RNA, 15 nt, Mycobacterium bovis subsp bovis AF2122/97
ggcggcggacccgcu

SEQ ID NO: 3072326 - RNA, 22 nt, Mycobacterium bovis subsp bovis AF2122/97
ggcggcggacccgcucgcggcg

SEQ ID NO: 3072327 - RNA, 14 nt, Mycobacterium bovis subsp bovis AF2122/97
ggcggcggaggcug

SEQ ID NO: 3072328 - RNA, 17 nt, Mycobacterium bovis subsp bovis AF2122/97
ggcggcggcaacggcgg

SEQ ID NO: 3072329 - RNA, 13 nt, Mycobacterium bovis subsp bovis AF2122/97
ggcggcggcaagu

SEQ ID NO: 3072330 - RNA, 13 nt, Mycobacterium bovis subsp bovis AF2122/97
ggcggcggcacgc

SEQ ID NO: 3072331 - RNA, 14 nt, Mycobacterium bovis subsp bovis AF2122/97
ggcggcggcacgcu

SEQ ID NO: 3072332 - RNA, 23 nt, Mycobacterium bovis subsp bovis AF2122/97
ggcggcggccgcagcggccagcc

SEQ ID NO: 3072333 - RNA, 15 nt, Mycobacterium bovis subsp bovis AF2122/97
ggcggcggcgcgauc

SEQ ID NO: 3072334 - RNA, 15 nt, Mycobacterium bovis subsp bovis AF2122/97
ggcggcggcggcaac

SEQ ID NO: 3072335 - RNA, 16 nt, Mycobacterium bovis subsp bovis AF2122/97
ggcggcggcggcaagu

SEQ ID NO: 3072336 - RNA, 14 nt, Mycobacterium bovis subsp bovis AF2122/97
ggcggcggcggccc

SEQ ID NO: 3072337 - RNA, 14 nt, Mycobacterium bovis subsp bovis AF2122/97
ggcggcggcgucgg

SEQ ID NO: 3072338 - RNA, 14 nt, Mycobacterium bovis subsp bovis AF2122/97
ggcggcgggccucg

SEQ ID NO: 3072339 - RNA, 18 nt, Mycobacterium bovis subsp bovis AF2122/97
ggcggcgggccucggcga

SEQ ID NO: 3072340 - RNA, 16 nt, Mycobacterium bovis subsp bovis AF2122/97
ggcggcgggggcggcg

SEQ ID NO: 3072341 - RNA, 17 nt, Mycobacterium bovis subsp bovis AF2122/97
ggcggcgggggcggcgg

SEQ ID NO: 3072342 - RNA, 18 nt, Mycobacterium bovis subsp bovis AF2122/97
ggcggcgggggcggcggc

SEQ ID NO: 3072343 - RNA, 19 nt, Mycobacterium bovis subsp bovis AF2122/97
ggcggcgggggcggcggcu

SEQ ID NO: 3072344 - RNA, 13 nt, Mycobacterium bovis subsp bovis AF2122/97
ggcggcgggguga

SEQ ID NO: 3072345 - RNA, 15 nt, Mycobacterium bovis subsp bovis AF2122/97
ggcggcggucaccac

SEQ ID NO: 3072346 - RNA, 17 nt, Mycobacterium bovis subsp bovis AF2122/97
ggcggcggucaccaccg

SEQ ID NO: 3072347 - RNA, 15 nt, Mycobacterium bovis subsp bovis AF2122/97
ggcggcggugcagca

SEQ ID NO: 3072348 - RNA, 20 nt, Mycobacterium bovis subsp bovis AF2122/97
ggcggcggugguaccggcgc

SEQ ID NO: 3072349 - RNA, 22 nt, Mycobacterium bovis subsp bovis AF2122/97
ggcggcggugguaccggcgcca

SEQ ID NO: 3072350 - RNA, 16 nt, Mycobacterium bovis subsp bovis AF2122/97
ggcggcguccaccugc

SEQ ID NO: 3072351 - RNA, 20 nt, Mycobacterium bovis subsp bovis AF2122/97
ggcggcguccaccugcuccg

SEQ ID NO: 3072352 - RNA, 16 nt, Mycobacterium bovis subsp bovis AF2122/97
ggcggcguccaucgcg

SEQ ID NO: 3072353 - RNA, 18 nt, Mycobacterium bovis subsp bovis AF2122/97
ggcggcgucgacggcucc

SEQ ID NO: 3072354 - RNA, 21 nt, Mycobacterium bovis subsp bovis AF2122/97
ggcggcgucgacggcuccucc

SEQ ID NO: 3072355 - RNA, 22 nt, Mycobacterium bovis subsp bovis AF2122/97
ggcggcgucgacggcuccuccg

SEQ ID NO: 3072356 - RNA, 22 nt, Mycobacterium bovis subsp bovis AF2122/97
ggcggcgucgagggagcgccgc

SEQ ID NO: 3072357 - RNA, 11 nt, Mycobacterium bovis subsp bovis AF2122/97
ggcggcgucgc

SEQ ID NO: 3072358 - RNA, 12 nt, Mycobacterium bovis subsp bovis AF2122/97
ggcggcguggcg

SEQ ID NO: 3072359 - RNA, 19 nt, Mycobacterium bovis subsp bovis AF2122/97
ggcgguaccgccgcugccg

SEQ ID NO: 3072360 - RNA, 16 nt, Mycobacterium bovis subsp bovis AF2122/97
ggcgguaccucgucga

SEQ ID NO: 3072361 - RNA, 17 nt, Mycobacterium bovis subsp bovis AF2122/97
ggcgguaccucgucgag

SEQ ID NO: 3072362 - RNA, 19 nt, Mycobacterium bovis subsp bovis AF2122/97
ggcgguagccgaccagcgc

SEQ ID NO: 3072363 - RNA, 21 nt, Mycobacterium bovis subsp bovis AF2122/97
ggcgguaggcuugcaaggucg

SEQ ID NO: 3072364 - RNA, 20 nt, Mycobacterium bovis subsp bovis AF2122/97
ggcgguagucggccagcucg

SEQ ID NO: 3072365 - RNA, 21 nt, Mycobacterium bovis subsp bovis AF2122/97
ggcgguaugccacaggcugcc

SEQ ID NO: 3072366 - RNA, 16 nt, Mycobacterium bovis subsp bovis AF2122/97
ggcgguaugcucgcug

SEQ ID NO: 3072367 - RNA, 15 nt, Mycobacterium bovis subsp bovis AF2122/97
ggcggucaacggucu

SEQ ID NO: 3072368 - RNA, 15 nt, Mycobacterium bovis subsp bovis AF2122/97
ggcggucaccaccga

SEQ ID NO: 3072369 - RNA, 21 nt, Mycobacterium bovis subsp bovis AF2122/97
ggcggucaccaccgacccgcu

SEQ ID NO: 3072370 - RNA, 15 nt, Mycobacterium bovis subsp bovis AF2122/97
ggcggucaccaccgu

SEQ ID NO: 3072371 - RNA, 19 nt, Mycobacterium bovis subsp bovis AF2122/97
ggcggucaccaccguggcg

SEQ ID NO: 3072372 - RNA, 22 nt, Mycobacterium bovis subsp bovis AF2122/97
ggcggucaccaccguggcgccc

SEQ ID NO: 3072373 - RNA, 17 nt, Mycobacterium bovis subsp bovis AF2122/97
ggcggucaccacgcggc

SEQ ID NO: 3072374 - RNA, 18 nt, Mycobacterium bovis subsp bovis AF2122/97
ggcggucaccacgcggcg

SEQ ID NO: 3072375 - RNA, 21 nt, Mycobacterium bovis subsp bovis AF2122/97
ggcggucaccacgcggcgguc

SEQ ID NO: 3072376 - RNA, 23 nt, Mycobacterium bovis subsp bovis AF2122/97
ggcggucagcagcgccgucagca

SEQ ID NO: 3072377 - RNA, 13 nt, Mycobacterium bovis subsp bovis AF2122/97
ggcggucagcggc

SEQ ID NO: 3072378 - RNA, 20 nt, Mycobacterium bovis subsp bovis AF2122/97
ggcggucagcggccaaccca

SEQ ID NO: 3072379 - RNA, 19 nt, Mycobacterium bovis subsp bovis AF2122/97
ggcggucagcggcucggcg

SEQ ID NO: 3072380 - RNA, 16 nt, Mycobacterium bovis subsp bovis AF2122/97
ggcggucagcggcugg

SEQ ID NO: 3072381 - RNA, 14 nt, Mycobacterium bovis subsp bovis AF2122/97
ggcgguccaccggc

SEQ ID NO: 3072382 - RNA, 21 nt, Mycobacterium bovis subsp bovis AF2122/97
ggcgguccgaugcgcgcggcg

SEQ ID NO: 3072383 - RNA, 13 nt, Mycobacterium bovis subsp bovis AF2122/97
ggcggucgagcga

SEQ ID NO: 3072384 - RNA, 12 nt, Mycobacterium bovis subsp bovis AF2122/97
ggcggucgauca

SEQ ID NO: 3072385 - RNA, 23 nt, Mycobacterium bovis subsp bovis AF2122/97
ggcggucgaucauggcggcagca

SEQ ID NO: 3072386 - RNA, 15 nt, Mycobacterium bovis subsp bovis AF2122/97
ggcggucgccgcgcg

SEQ ID NO: 3072387 - RNA, 16 nt, Mycobacterium bovis subsp bovis AF2122/97
ggcggucgcguaccgg

SEQ ID NO: 3072388 - RNA, 20 nt, Mycobacterium bovis subsp bovis AF2122/97
ggcggucgcuauccggcggc

SEQ ID NO: 3072389 - RNA, 22 nt, Mycobacterium bovis subsp bovis AF2122/97
ggcggucggaaugccgucgccg

SEQ ID NO: 3072390 - RNA, 13 nt, Mycobacterium bovis subsp bovis AF2122/97
ggcggucggcaga

SEQ ID NO: 3072391 - RNA, 21 nt, Mycobacterium bovis subsp bovis AF2122/97
ggcggucggccggcucguccg

SEQ ID NO: 3072392 - RNA, 13 nt, Mycobacterium bovis subsp bovis AF2122/97
ggcggucggcugg

SEQ ID NO: 3072393 - RNA, 20 nt, Mycobacterium bovis subsp bovis AF2122/97
ggcggucgggcccggcgagc

SEQ ID NO: 3072394 - RNA, 23 nt, Mycobacterium bovis subsp bovis AF2122/97
ggcggucguugauuucggcggcg

SEQ ID NO: 3072395 - RNA, 17 nt, Mycobacterium bovis subsp bovis AF2122/97
ggcggucucgucaaccu

SEQ ID NO: 3072396 - RNA, 18 nt, Mycobacterium bovis subsp bovis AF2122/97
ggcggucugcgccaaaau

SEQ ID NO: 3072397 - RNA, 17 nt, Mycobacterium bovis subsp bovis AF2122/97
ggcggucuguaagacag

SEQ ID NO: 3072398 - RNA, 18 nt, Mycobacterium bovis subsp bovis AF2122/97
ggcggucuguaagacagc

SEQ ID NO: 3072399 - RNA, 13 nt, Mycobacterium bovis subsp bovis AF2122/97
ggcggucuugccg

SEQ ID NO: 3072400 - RNA, 19 nt, Mycobacterium bovis subsp bovis AF2122/97
ggcggucuuggcgcgccca

SEQ ID NO: 3072401 - RNA, 23 nt, Mycobacterium bovis subsp bovis AF2122/97
ggcggugaaaucgcacagcgcga

SEQ ID NO: 3072402 - RNA, 13 nt, Mycobacterium bovis subsp bovis AF2122/97
ggcggugaacacc

SEQ ID NO: 3072403 - RNA, 19 nt, Mycobacterium bovis subsp bovis AF2122/97
ggcggugaacugcuggccg

SEQ ID NO: 3072404 - RNA, 14 nt, Mycobacterium bovis subsp bovis AF2122/97
ggcggugaaggccc

SEQ ID NO: 3072405 - RNA, 15 nt, Mycobacterium bovis subsp bovis AF2122/97
ggcggugaagugggc

SEQ ID NO: 3072406 - RNA, 16 nt, Mycobacterium bovis subsp bovis AF2122/97
ggcggugaagugggcg

SEQ ID NO: 3072407 - RNA, 23 nt, Mycobacterium bovis subsp bovis AF2122/97
ggcggugaagugggcguuggcgg

SEQ ID NO: 3072408 - RNA, 13 nt, Mycobacterium bovis subsp bovis AF2122/97
ggcggugacgaag

SEQ ID NO: 3072409 - RNA, 15 nt, Mycobacterium bovis subsp bovis AF2122/97
ggcggugaugguggc

SEQ ID NO: 3072410 - RNA, 14 nt, Mycobacterium bovis subsp bovis AF2122/97
ggcggugcacaccg

SEQ ID NO: 3072411 - RNA, 19 nt, Mycobacterium bovis subsp bovis AF2122/97
ggcggugcacaccgucgca

SEQ ID NO: 3072412 - RNA, 17 nt, Mycobacterium bovis subsp bovis AF2122/97
ggcggugcaguggcuac

SEQ ID NO: 3072413 - RNA, 12 nt, Mycobacterium bovis subsp bovis AF2122/97
ggcggugccacc

SEQ ID NO: 3072414 - RNA, 18 nt, Mycobacterium bovis subsp bovis AF2122/97
ggcggugccacgaucggc

SEQ ID NO: 3072415 - RNA, 21 nt, Mycobacterium bovis subsp bovis AF2122/97
ggcggugccaucgggcgcggu

SEQ ID NO: 3072416 - RNA, 13 nt, Mycobacterium bovis subsp bovis AF2122/97
ggcggugccgaac

SEQ ID NO: 3072417 - RNA, 13 nt, Mycobacterium bovis subsp bovis AF2122/97
ggcggugccgacg

SEQ ID NO: 3072418 - RNA, 12 nt, Mycobacterium bovis subsp bovis AF2122/97
ggcggugccgcc

SEQ ID NO: 3072419 - RNA, 13 nt, Mycobacterium bovis subsp bovis AF2122/97
ggcggugccggcg

SEQ ID NO: 3072420 - RNA, 14 nt, Mycobacterium bovis subsp bovis AF2122/97
ggcggugccggcgg

SEQ ID NO: 3072421 - RNA, 15 nt, Mycobacterium bovis subsp bovis AF2122/97
ggcggugccggcggc

SEQ ID NO: 3072422 - RNA, 16 nt, Mycobacterium bovis subsp bovis AF2122/97
ggcggugccggcggcg

SEQ ID NO: 3072423 - RNA, 18 nt, Mycobacterium bovis subsp bovis AF2122/97
ggcggugccgguggugac

SEQ ID NO: 3072424 - RNA, 16 nt, Mycobacterium bovis subsp bovis AF2122/97
ggcggugccgucagcg

SEQ ID NO: 3072425 - RNA, 16 nt, Mycobacterium bovis subsp bovis AF2122/97
ggcggugccgucgccg

SEQ ID NO: 3072426 - RNA, 22 nt, Mycobacterium bovis subsp bovis AF2122/97
ggcggugcggguggugccggcg

SEQ ID NO: 3072427 - RNA, 21 nt, Mycobacterium bovis subsp bovis AF2122/97
ggcgguggccacccggccgcg

SEQ ID NO: 3072428 - RNA, 13 nt, Mycobacterium bovis subsp bovis AF2122/97
ggcgguggcccga

SEQ ID NO: 3072429 - RNA, 17 nt, Mycobacterium bovis subsp bovis AF2122/97
ggcgguggcgaacagca

SEQ ID NO: 3072430 - RNA, 14 nt, Mycobacterium bovis subsp bovis AF2122/97
ggcgguggcgaggu

SEQ ID NO: 3072431 - RNA, 14 nt, Mycobacterium bovis subsp bovis AF2122/97
ggcggugggcagca

SEQ ID NO: 3072432 - RNA, 17 nt, Mycobacterium bovis subsp bovis AF2122/97
ggcggugggcagcagcu

SEQ ID NO: 3072433 - RNA, 16 nt, Mycobacterium bovis subsp bovis AF2122/97
ggcggugggcgcggac

SEQ ID NO: 3072434 - RNA, 21 nt, Mycobacterium bovis subsp bovis AF2122/97
ggcggugggcuuggcgccgau

SEQ ID NO: 3072435 - RNA, 13 nt, Mycobacterium bovis subsp bovis AF2122/97
ggcgguggggcug

SEQ ID NO: 3072436 - RNA, 21 nt, Mycobacterium bovis subsp bovis AF2122/97
ggcggugguaccggcgccacc

SEQ ID NO: 3072437 - RNA, 14 nt, Mycobacterium bovis subsp bovis AF2122/97
ggcgguggucccga

SEQ ID NO: 3072438 - RNA, 21 nt, Mycobacterium bovis subsp bovis AF2122/97
ggcgguggugccgcggccacc

SEQ ID NO: 3072439 - RNA, 14 nt, Mycobacterium bovis subsp bovis AF2122/97
ggcggugguguagc

SEQ ID NO: 3072440 - RNA, 17 nt, Mycobacterium bovis subsp bovis AF2122/97
ggcgguggugucgcucg

SEQ ID NO: 3072441 - RNA, 22 nt, Mycobacterium bovis subsp bovis AF2122/97
ggcggugucacgacccaagucg

SEQ ID NO: 3072442 - RNA, 14 nt, Mycobacterium bovis subsp bovis AF2122/97
ggcgguguccagaa

SEQ ID NO: 3072443 - RNA, 22 nt, Mycobacterium bovis subsp bovis AF2122/97
ggcgguguccagaacgguggcg

SEQ ID NO: 3072444 - RNA, 16 nt, Mycobacterium bovis subsp bovis AF2122/97
ggcggugucggcgccg

SEQ ID NO: 3072445 - RNA, 14 nt, Mycobacterium bovis subsp bovis AF2122/97
ggcgguguugcccg

SEQ ID NO: 3072446 - RNA, 21 nt, Mycobacterium bovis subsp bovis AF2122/97
ggcgucgccgccauugccgcc

SEQ ID NO: 3072447 - RNA, 23 nt, Mycobacterium bovis subsp bovis AF2122/97
ggcgucgccgccauugccgccgg

SEQ ID NO: 3072448 - RNA, 13 nt, Mycobacterium bovis subsp bovis AF2122/97
ggcgucgccgccg

SEQ ID NO: 3072449 - RNA, 18 nt, Mycobacterium bovis subsp bovis AF2122/97
ggcgucgccgccguugcc

SEQ ID NO: 3072450 - RNA, 21 nt, Mycobacterium bovis subsp bovis AF2122/97
ggcgucgccgccguugccgcc

SEQ ID NO: 3072451 - RNA, 14 nt, Mycobacterium bovis subsp bovis AF2122/97
ggcgucgccggcac

SEQ ID NO: 3072452 - RNA, 15 nt, Mycobacterium bovis subsp bovis AF2122/97
ggcgucgccggcacc

SEQ ID NO: 3072453 - RNA, 23 nt, Mycobacterium bovis subsp bovis AF2122/97
ggcgucgccggccccgccggcgc

SEQ ID NO: 3072454 - RNA, 13 nt, Mycobacterium bovis subsp bovis AF2122/97
ggcgucgcggauc

SEQ ID NO: 3072455 - RNA, 12 nt, Mycobacterium bovis subsp bovis AF2122/97
ggcgucgcggua

SEQ ID NO: 3072456 - RNA, 14 nt, Mycobacterium bovis subsp bovis AF2122/97
ggcgucgcuggugg

SEQ ID NO: 3072457 - RNA, 19 nt, Mycobacterium bovis subsp bovis AF2122/97
ggcgucggccacccggucc

SEQ ID NO: 3072458 - RNA, 14 nt, Mycobacterium bovis subsp bovis AF2122/97
ggcgucggccaccg

SEQ ID NO: 3072459 - RNA, 16 nt, Mycobacterium bovis subsp bovis AF2122/97
ggcgucggccaccgcc

SEQ ID NO: 3072460 - RNA, 22 nt, Mycobacterium bovis subsp bovis AF2122/97
ggcgucggccaccgccugagcg

SEQ ID NO: 3072461 - RNA, 15 nt, Mycobacterium bovis subsp bovis AF2122/97
ggcgucggcgcccag

SEQ ID NO: 3072462 - RNA, 14 nt, Mycobacterium bovis subsp bovis AF2122/97
ggcgucggcgcggc

SEQ ID NO: 3072463 - RNA, 15 nt, Mycobacterium bovis subsp bovis AF2122/97
ggcgucggcgcggcc

SEQ ID NO: 3072464 - RNA, 16 nt, Mycobacterium bovis subsp bovis AF2122/97
ggcgucggcggccgug

SEQ ID NO: 3072465 - RNA, 21 nt, Mycobacterium bovis subsp bovis AF2122/97
ggcgucggugaaugccgucgc

SEQ ID NO: 3072466 - RNA, 22 nt, Mycobacterium bovis subsp bovis AF2122/97
ggcgucggugaaugccgucgcc

SEQ ID NO: 3072467 - RNA, 15 nt, Mycobacterium bovis subsp bovis AF2122/97
ggcgucggugagcgc

SEQ ID NO: 3072468 - RNA, 19 nt, Mycobacterium bovis subsp bovis AF2122/97
ggcgucguaggagccguca

SEQ ID NO: 3072469 - RNA, 23 nt, Mycobacterium bovis subsp bovis AF2122/97
ggcgucguagucgucggccugcg

SEQ ID NO: 3072470 - RNA, 19 nt, Mycobacterium bovis subsp bovis AF2122/97
ggcgucgucgacggcugcg

SEQ ID NO: 3072471 - RNA, 20 nt, Mycobacterium bovis subsp bovis AF2122/97
ggcgucgucgacggcugcgc

SEQ ID NO: 3072472 - RNA, 22 nt, Mycobacterium bovis subsp bovis AF2122/97
ggcgucgucgacggcugcgccg

SEQ ID NO: 3072473 - RNA, 16 nt, Mycobacterium bovis subsp bovis AF2122/97
ggcgucgucggcgggc

SEQ ID NO: 3072474 - RNA, 12 nt, Mycobacterium bovis subsp bovis AF2122/97
ggcgucgucggu

SEQ ID NO: 3072475 - RNA, 15 nt, Mycobacterium bovis subsp bovis AF2122/97
ggcgucgugagaggc

SEQ ID NO: 3072476 - RNA, 16 nt, Mycobacterium bovis subsp bovis AF2122/97
ggcgucgugcgcggcc

SEQ ID NO: 3072477 - RNA, 18 nt, Mycobacterium bovis subsp bovis AF2122/97
ggcgucgugcgcggccgg

SEQ ID NO: 3072478 - RNA, 19 nt, Mycobacterium bovis subsp bovis AF2122/97
ggcgucgugcgcggccggc

SEQ ID NO: 3072479 - RNA, 14 nt, Mycobacterium bovis subsp bovis AF2122/97
ggcgucgugguggc

SEQ ID NO: 3072480 - RNA, 19 nt, Mycobacterium bovis subsp bovis AF2122/97
ggcgucgugguggccacgg

SEQ ID NO: 3072481 - RNA, 23 nt, Mycobacterium bovis subsp bovis AF2122/97
ggcgucucgcagcaacggcggcg

SEQ ID NO: 3072482 - RNA, 17 nt, Mycobacterium bovis subsp bovis AF2122/97
ggcgucugcccgcccag

SEQ ID NO: 3072483 - RNA, 11 nt, Mycobacterium bovis subsp bovis AF2122/97
ggcgucugcgg

SEQ ID NO: 3072484 - RNA, 19 nt, Mycobacterium bovis subsp bovis AF2122/97
ggcgucuuggaaggcgcgc

SEQ ID NO: 3072485 - RNA, 18 nt, Mycobacterium bovis subsp bovis AF2122/97
ggcgugaaaaacgcccgc

SEQ ID NO: 3072486 - RNA, 16 nt, Mycobacterium bovis subsp bovis AF2122/97
ggcgugacagggcggc

SEQ ID NO: 3072487 - RNA, 19 nt, Mycobacterium bovis subsp bovis AF2122/97
ggcgugacagggcggcaac

SEQ ID NO: 3072488 - RNA, 14 nt, Mycobacterium bovis subsp bovis AF2122/97
ggcgugaccacuga

SEQ ID NO: 3072489 - RNA, 15 nt, Mycobacterium bovis subsp bovis AF2122/97
ggcgugacgggcagg

SEQ ID NO: 3072490 - RNA, 20 nt, Mycobacterium bovis subsp bovis AF2122/97
ggcgugagcuaugcuggcag

SEQ ID NO: 3072491 - RNA, 22 nt, Mycobacterium bovis subsp bovis AF2122/97
ggcgugagcuaugcuggcagcu

SEQ ID NO: 3072492 - RNA, 14 nt, Mycobacterium bovis subsp bovis AF2122/97
ggcgugaguggcuc

SEQ ID NO: 3072493 - RNA, 19 nt, Mycobacterium bovis subsp bovis AF2122/97
ggcgugauagcccuugccg

SEQ ID NO: 3072494 - RNA, 18 nt, Mycobacterium bovis subsp bovis AF2122/97
ggcgugaucaccggcauc

SEQ ID NO: 3072495 - RNA, 22 nt, Mycobacterium bovis subsp bovis AF2122/97
ggcgugaucaccggcaucccgg

SEQ ID NO: 3072496 - RNA, 12 nt, Mycobacterium bovis subsp bovis AF2122/97
ggcgugaucccg

SEQ ID NO: 3072497 - RNA, 16 nt, Mycobacterium bovis subsp bovis AF2122/97
ggcgugaucccgccca

SEQ ID NO: 3072498 - RNA, 18 nt, Mycobacterium bovis subsp bovis AF2122/97
ggcgugcacaggucagcg

SEQ ID NO: 3072499 - RNA, 19 nt, Mycobacterium bovis subsp bovis AF2122/97
ggcgugcacaggucagcgc

SEQ ID NO: 3072500 - RNA, 15 nt, Mycobacterium bovis subsp bovis AF2122/97
ggcgugcagacccgg

SEQ ID NO: 3072501 - RNA, 14 nt, Mycobacterium bovis subsp bovis AF2122/97
ggcgugcagcaccc

SEQ ID NO: 3072502 - RNA, 13 nt, Mycobacterium bovis subsp bovis AF2122/97
ggcgugcagcagc

SEQ ID NO: 3072503 - RNA, 14 nt, Mycobacterium bovis subsp bovis AF2122/97
ggcgugcaguacac

SEQ ID NO: 3072504 - RNA, 13 nt, Mycobacterium bovis subsp bovis AF2122/97
ggcgugccgccgc

SEQ ID NO: 3072505 - RNA, 14 nt, Mycobacterium bovis subsp bovis AF2122/97
ggcgugccgucgcc

SEQ ID NO: 3072506 - RNA, 20 nt, Mycobacterium bovis subsp bovis AF2122/97
ggcgugcggacugacgucga

SEQ ID NO: 3072507 - RNA, 14 nt, Mycobacterium bovis subsp bovis AF2122/97
ggcgugcggcggcc

SEQ ID NO: 3072508 - RNA, 15 nt, Mycobacterium bovis subsp bovis AF2122/97
ggcgugcggcggccc

SEQ ID NO: 3072509 - RNA, 14 nt, Mycobacterium bovis subsp bovis AF2122/97
ggcgugcucgccgg

SEQ ID NO: 3072510 - RNA, 21 nt, Mycobacterium bovis subsp bovis AF2122/97
ggcgugcucgccgggucagcc

SEQ ID NO: 3072511 - RNA, 16 nt, Mycobacterium bovis subsp bovis AF2122/97
ggcgugcucggaggcg

SEQ ID NO: 3072512 - RNA, 16 nt, Mycobacterium bovis subsp bovis AF2122/97
ggcgugcugcuagcca

SEQ ID NO: 3072513 - RNA, 22 nt, Mycobacterium bovis subsp bovis AF2122/97
ggcgugcugcuagccagucggc

SEQ ID NO: 3072514 - RNA, 11 nt, Mycobacterium bovis subsp bovis AF2122/97
ggcgugcuggc

SEQ ID NO: 3072515 - RNA, 18 nt, Mycobacterium bovis subsp bovis AF2122/97
ggcgugcugugcucacga

SEQ ID NO: 3072516 - RNA, 17 nt, Mycobacterium bovis subsp bovis AF2122/97
ggcgugcuugacgagga

SEQ ID NO: 3072517 - RNA, 23 nt, Mycobacterium bovis subsp bovis AF2122/97
ggcguggaucuuggccagcagcg

SEQ ID NO: 3072518 - RNA, 14 nt, Mycobacterium bovis subsp bovis AF2122/97
ggcguggcgccggc

SEQ ID NO: 3072519 - RNA, 12 nt, Mycobacterium bovis subsp bovis AF2122/97
ggcguggcuggu

SEQ ID NO: 3072520 - RNA, 14 nt, Mycobacterium bovis subsp bovis AF2122/97
ggcgugggaggugg

SEQ ID NO: 3072521 - RNA, 20 nt, Mycobacterium bovis subsp bovis AF2122/97
ggcgugggugucggcgaagc

SEQ ID NO: 3072522 - RNA, 17 nt, Mycobacterium bovis subsp bovis AF2122/97
ggcgugggugucggcua

SEQ ID NO: 3072523 - RNA, 20 nt, Mycobacterium bovis subsp bovis AF2122/97
ggcgugguagacggccugcg

SEQ ID NO: 3072524 - RNA, 16 nt, Mycobacterium bovis subsp bovis AF2122/97
ggcgugguaucgccgg

SEQ ID NO: 3072525 - RNA, 18 nt, Mycobacterium bovis subsp bovis AF2122/97
ggcguggucggcaaagcg

SEQ ID NO: 3072526 - RNA, 18 nt, Mycobacterium bovis subsp bovis AF2122/97
ggcguggucucggucagc

SEQ ID NO: 3072527 - RNA, 23 nt, Mycobacterium bovis subsp bovis AF2122/97
ggcgugguggaaacugaugucgc

SEQ ID NO: 3072528 - RNA, 17 nt, Mycobacterium bovis subsp bovis AF2122/97
ggcguguaaccccaggc

SEQ ID NO: 3072529 - RNA, 13 nt, Mycobacterium bovis subsp bovis AF2122/97
ggcguguacgucg

SEQ ID NO: 3072530 - RNA, 20 nt, Mycobacterium bovis subsp bovis AF2122/97
ggcguguagccugcggcggu

SEQ ID NO: 3072531 - RNA, 13 nt, Mycobacterium bovis subsp bovis AF2122/97
ggcgugucgccgc

SEQ ID NO: 3072532 - RNA, 16 nt, Mycobacterium bovis subsp bovis AF2122/97
ggcgugucgccgccac

SEQ ID NO: 3072533 - RNA, 22 nt, Mycobacterium bovis subsp bovis AF2122/97
ggcuaguugggugggugcagca

SEQ ID NO: 3072534 - RNA, 16 nt, Mycobacterium bovis subsp bovis AF2122/97
ggcuauaucccgcccc

SEQ ID NO: 3072535 - RNA, 18 nt, Mycobacterium bovis subsp bovis AF2122/97
ggcuaucguggcggcguc

SEQ ID NO: 3072536 - RNA, 14 nt, Mycobacterium bovis subsp bovis AF2122/97
ggcuaugcuggcgc

SEQ ID NO: 3072537 - RNA, 17 nt, Mycobacterium bovis subsp bovis AF2122/97
ggcuaugcuggcgcagc

SEQ ID NO: 3072538 - RNA, 21 nt, Mycobacterium bovis subsp bovis AF2122/97
ggcuaugcuggcgcagcgcca

SEQ ID NO: 3072539 - RNA, 17 nt, Mycobacterium bovis subsp bovis AF2122/97
ggcuauggcgcagcugg

SEQ ID NO: 3072540 - RNA, 14 nt, Mycobacterium bovis subsp bovis AF2122/97
ggcuauggcgccgc

SEQ ID NO: 3072541 - RNA, 22 nt, Mycobacterium bovis subsp bovis AF2122/97
ggcucaacaccgaguuccucug

SEQ ID NO: 3072542 - RNA, 15 nt, Mycobacterium bovis subsp bovis AF2122/97
ggcucaaccucuggc

SEQ ID NO: 3072543 - RNA, 20 nt, Mycobacterium bovis subsp bovis AF2122/97
ggcucaaccucuggcggcgg

SEQ ID NO: 3072544 - RNA, 18 nt, Mycobacterium bovis subsp bovis AF2122/97
ggcucaaucgaugagcgc

SEQ ID NO: 3072545 - RNA, 16 nt, Mycobacterium bovis subsp bovis AF2122/97
ggcucacagcacagcg

SEQ ID NO: 3072546 - RNA, 18 nt, Mycobacterium bovis subsp bovis AF2122/97
ggcucacagcacagcgca

SEQ ID NO: 3072547 - RNA, 21 nt, Mycobacterium bovis subsp bovis AF2122/97
ggcucacagcacagcgcagcc

SEQ ID NO: 3072548 - RNA, 20 nt, Mycobacterium bovis subsp bovis AF2122/97
ggcucacaugcccgcaccgu

SEQ ID NO: 3072549 - RNA, 17 nt, Mycobacterium bovis subsp bovis AF2122/97
ggcucacaugugcgcgu

SEQ ID NO: 3072550 - RNA, 21 nt, Mycobacterium bovis subsp bovis AF2122/97
ggcucacaugugcgcgucgcg

SEQ ID NO: 3072551 - RNA, 13 nt, Mycobacterium bovis subsp bovis AF2122/97
ggcucaccacggu

SEQ ID NO: 3072552 - RNA, 12 nt, Mycobacterium bovis subsp bovis AF2122/97
ggcucaccagcu

SEQ ID NO: 3072553 - RNA, 15 nt, Mycobacterium bovis subsp bovis AF2122/97
ggcucaccagcuccu

SEQ ID NO: 3072554 - RNA, 12 nt, Mycobacterium bovis subsp bovis AF2122/97
ggcucacccagg

SEQ ID NO: 3072555 - RNA, 16 nt, Mycobacterium bovis subsp bovis AF2122/97
ggcucacccaggcgcc

SEQ ID NO: 3072556 - RNA, 19 nt, Mycobacterium bovis subsp bovis AF2122/97
ggcucacccaggcgccgau

SEQ ID NO: 3072557 - RNA, 21 nt, Mycobacterium bovis subsp bovis AF2122/97
ggcucacccaggcgccgaugu

SEQ ID NO: 3072558 - RNA, 23 nt, Mycobacterium bovis subsp bovis AF2122/97
ggcucacccaggcgccgaugucg

SEQ ID NO: 3072559 - RNA, 18 nt, Mycobacterium bovis subsp bovis AF2122/97
ggcucaccccggucgagg

SEQ ID NO: 3072560 - RNA, 21 nt, Mycobacterium bovis subsp bovis AF2122/97
ggcucaccgaacgcgaugcgc

SEQ ID NO: 3072561 - RNA, 14 nt, Mycobacterium bovis subsp bovis AF2122/97
ggcucacgaccggc

SEQ ID NO: 3072562 - RNA, 19 nt, Mycobacterium bovis subsp bovis AF2122/97
ggcucacgucuaacacgcg

SEQ ID NO: 3072563 - RNA, 15 nt, Mycobacterium bovis subsp bovis AF2122/97
ggcucacucgccgaa

SEQ ID NO: 3072564 - RNA, 18 nt, Mycobacterium bovis subsp bovis AF2122/97
ggcucagaacccuccgca

SEQ ID NO: 3072565 - RNA, 16 nt, Mycobacterium bovis subsp bovis AF2122/97
ggcucagacgacgauc

SEQ ID NO: 3072566 - RNA, 12 nt, Mycobacterium bovis subsp bovis AF2122/97
ggcucagcagcg

SEQ ID NO: 3072567 - RNA, 13 nt, Mycobacterium bovis subsp bovis AF2122/97
ggcucagcagcgc

SEQ ID NO: 3072568 - RNA, 16 nt, Mycobacterium bovis subsp bovis AF2122/97
ggcucagcagcgccgc

SEQ ID NO: 3072569 - RNA, 18 nt, Mycobacterium bovis subsp bovis AF2122/97
ggcucagcagcgccgcgc

SEQ ID NO: 3072570 - RNA, 14 nt, Mycobacterium bovis subsp bovis AF2122/97
ggcucagcggcgac

SEQ ID NO: 3072571 - RNA, 15 nt, Mycobacterium bovis subsp bovis AF2122/97
ggcucagcggcgacc

SEQ ID NO: 3072572 - RNA, 17 nt, Mycobacterium bovis subsp bovis AF2122/97
ggcucagcggcgaccgc

SEQ ID NO: 3072573 - RNA, 18 nt, Mycobacterium bovis subsp bovis AF2122/97
ggcucagcggcgaccgca

SEQ ID NO: 3072574 - RNA, 14 nt, Mycobacterium bovis subsp bovis AF2122/97
ggcucagcgguggc

SEQ ID NO: 3072575 - RNA, 22 nt, Mycobacterium bovis subsp bovis AF2122/97
ggcucagcgguggcguggugga

SEQ ID NO: 3072576 - RNA, 21 nt, Mycobacterium bovis subsp bovis AF2122/97
ggcucagcugguggcggcggu

SEQ ID NO: 3072577 - RNA, 16 nt, Mycobacterium bovis subsp bovis AF2122/97
ggcucagucacgcacu

SEQ ID NO: 3072578 - RNA, 13 nt, Mycobacterium bovis subsp bovis AF2122/97
ggcucaucccgac

SEQ ID NO: 3072579 - RNA, 23 nt, Mycobacterium bovis subsp bovis AF2122/97
ggcucaucgaagcuucggccuuc

SEQ ID NO: 3072580 - RNA, 16 nt, Mycobacterium bovis subsp bovis AF2122/97
ggcucauggcauuucc

SEQ ID NO: 3072581 - RNA, 21 nt, Mycobacterium bovis subsp bovis AF2122/97
ggcuccaacuccaagaugccg

SEQ ID NO: 3072582 - RNA, 17 nt, Mycobacterium bovis subsp bovis AF2122/97
ggcuccaauugcggccg

SEQ ID NO: 3072583 - RNA, 17 nt, Mycobacterium bovis subsp bovis AF2122/97
ggcuccaccgggcccgc

SEQ ID NO: 3072584 - RNA, 22 nt, Mycobacterium bovis subsp bovis AF2122/97
ggcuccaccgggcccgccggcc

SEQ ID NO: 3072585 - RNA, 23 nt, Mycobacterium bovis subsp bovis AF2122/97
ggcuccacgucaucuggcgcugc

SEQ ID NO: 3072586 - RNA, 13 nt, Mycobacterium bovis subsp bovis AF2122/97
ggcuccagcgcgc

SEQ ID NO: 3072587 - RNA, 15 nt, Mycobacterium bovis subsp bovis AF2122/97
ggcuccagcgcgcgc

SEQ ID NO: 3072588 - RNA, 17 nt, Mycobacterium bovis subsp bovis AF2122/97
ggcuccagcgcgcgccg

SEQ ID NO: 3072589 - RNA, 19 nt, Mycobacterium bovis subsp bovis AF2122/97
ggcuccagcgcgcgccgca

SEQ ID NO: 3072590 - RNA, 22 nt, Mycobacterium bovis subsp bovis AF2122/97
ggcuccagcgcgcgccgcagcg

SEQ ID NO: 3072591 - RNA, 14 nt, Mycobacterium bovis subsp bovis AF2122/97
ggcuccagguccac

SEQ ID NO: 3072592 - RNA, 21 nt, Mycobacterium bovis subsp bovis AF2122/97
ggcuccccggcaaccgggauc

SEQ ID NO: 3072593 - RNA, 20 nt, Mycobacterium bovis subsp bovis AF2122/97
ggcucccgcaauggggcgca

SEQ ID NO: 3072594 - RNA, 21 nt, Mycobacterium bovis subsp bovis AF2122/97
ggcuccgaacauggccagcau

SEQ ID NO: 3072595 - RNA, 16 nt, Mycobacterium bovis subsp bovis AF2122/97
ggcuccgagggcugcg

SEQ ID NO: 3072596 - RNA, 19 nt, Mycobacterium bovis subsp bovis AF2122/97
ggcuccgagggcugcgugg

SEQ ID NO: 3072597 - RNA, 13 nt, Mycobacterium bovis subsp bovis AF2122/97
ggcuccgcaacca

SEQ ID NO: 3072598 - RNA, 20 nt, Mycobacterium bovis subsp bovis AF2122/97
ggcuccgccacuggcgccgg

SEQ ID NO: 3072599 - RNA, 22 nt, Mycobacterium bovis subsp bovis AF2122/97
ggcuccgccgcgggcuccccgg

SEQ ID NO: 3072600 - RNA, 12 nt, Mycobacterium bovis subsp bovis AF2122/97
ggcuccgccguu

SEQ ID NO: 3072601 - RNA, 16 nt, Mycobacterium bovis subsp bovis AF2122/97
ggcuccgccguugacg

SEQ ID NO: 3072602 - RNA, 19 nt, Mycobacterium bovis subsp bovis AF2122/97
ggcuccgccguugacgccg

SEQ ID NO: 3072603 - RNA, 20 nt, Mycobacterium bovis subsp bovis AF2122/97
ggcuccgccguugccgccgc

SEQ ID NO: 3072604 - RNA, 15 nt, Mycobacterium bovis subsp bovis AF2122/97
ggcuccgcgacgggc

SEQ ID NO: 3072605 - RNA, 14 nt, Mycobacterium bovis subsp bovis AF2122/97
ggcuccggacaccc

SEQ ID NO: 3072606 - RNA, 13 nt, Mycobacterium bovis subsp bovis AF2122/97
ggcuccggccggc

SEQ ID NO: 3072607 - RNA, 14 nt, Mycobacterium bovis subsp bovis AF2122/97
ggcuccggccggcc

SEQ ID NO: 3072608 - RNA, 15 nt, Mycobacterium bovis subsp bovis AF2122/97
ggcuccggccggcca

SEQ ID NO: 3072609 - RNA, 13 nt, Mycobacterium bovis subsp bovis AF2122/97
ggcuccggcggca

SEQ ID NO: 3072610 - RNA, 15 nt, Mycobacterium bovis subsp bovis AF2122/97
ggcuccggcggcagc

SEQ ID NO: 3072611 - RNA, 19 nt, Mycobacterium bovis subsp bovis AF2122/97
ggcuccggcggcagcggcg

SEQ ID NO: 3072612 - RNA, 20 nt, Mycobacterium bovis subsp bovis AF2122/97
ggcuccggcggugccgucgc

SEQ ID NO: 3072613 - RNA, 17 nt, Mycobacterium bovis subsp bovis AF2122/97
ggcuccgguaggcgaga

SEQ ID NO: 3072614 - RNA, 19 nt, Mycobacterium bovis subsp bovis AF2122/97
ggcuccgugguugccgaag

SEQ ID NO: 3072615 - RNA, 21 nt, Mycobacterium bovis subsp bovis AF2122/97
ggcuccgugguugccgaagcc

SEQ ID NO: 3072616 - RNA, 23 nt, Mycobacterium bovis subsp bovis AF2122/97
ggcuccgugguugccgaagccgg

SEQ ID NO: 3072617 - RNA, 19 nt, Mycobacterium bovis subsp bovis AF2122/97
ggcuccguuguccagcgcg

SEQ ID NO: 3072618 - RNA, 18 nt, Mycobacterium bovis subsp bovis AF2122/97
ggcuccuccccggcccgc

SEQ ID NO: 3072619 - RNA, 23 nt, Mycobacterium bovis subsp bovis AF2122/97
ggcugaggcggcgacgaccgucg

SEQ ID NO: 3072620 - RNA, 18 nt, Mycobacterium bovis subsp bovis AF2122/97
ggcugaucccgaugcugg

SEQ ID NO: 3072621 - RNA, 15 nt, Mycobacterium bovis subsp bovis AF2122/97
ggcugaugacgcgga

SEQ ID NO: 3072622 - RNA, 22 nt, Mycobacterium bovis subsp bovis AF2122/97
ggcugauggacggugcgcaggg

SEQ ID NO: 3072623 - RNA, 23 nt, Mycobacterium bovis subsp bovis AF2122/97
ggcugauggacggugcgcagggc

SEQ ID NO: 3072624 - RNA, 19 nt, Mycobacterium bovis subsp bovis AF2122/97
ggcugauggcggcgacccg

SEQ ID NO: 3072625 - RNA, 16 nt, Mycobacterium bovis subsp bovis AF2122/97
ggcugcaaccagcggc

SEQ ID NO: 3072626 - RNA, 17 nt, Mycobacterium bovis subsp bovis AF2122/97
ggcugcaaccagcggca

SEQ ID NO: 3072627 - RNA, 19 nt, Mycobacterium bovis subsp bovis AF2122/97
ggcugcaccggcuugggcc

SEQ ID NO: 3072628 - RNA, 14 nt, Mycobacterium bovis subsp bovis AF2122/97
ggcugcacgcucgu

SEQ ID NO: 3072629 - RNA, 21 nt, Mycobacterium bovis subsp bovis AF2122/97
ggcugcagugacucgaucacc

SEQ ID NO: 3072630 - RNA, 15 nt, Mycobacterium bovis subsp bovis AF2122/97
ggcugcauccuccuc

SEQ ID NO: 3072631 - RNA, 16 nt, Mycobacterium bovis subsp bovis AF2122/97
ggcugcauccuccucg

SEQ ID NO: 3072632 - RNA, 18 nt, Mycobacterium bovis subsp bovis AF2122/97
ggcugcauccuccucguc

SEQ ID NO: 3072633 - RNA, 20 nt, Mycobacterium bovis subsp bovis AF2122/97
ggcugcauccuccucgucga

SEQ ID NO: 3072634 - RNA, 13 nt, Mycobacterium bovis subsp bovis AF2122/97
ggcugccaccgca

SEQ ID NO: 3072635 - RNA, 14 nt, Mycobacterium bovis subsp bovis AF2122/97
ggcugccaccgcag

SEQ ID NO: 3072636 - RNA, 14 nt, Mycobacterium bovis subsp bovis AF2122/97
ggcugccacgaacg

SEQ ID NO: 3072637 - RNA, 13 nt, Mycobacterium bovis subsp bovis AF2122/97
ggcugccagaaug

SEQ ID NO: 3072638 - RNA, 16 nt, Mycobacterium bovis subsp bovis AF2122/97
ggcugccagugccgcc

SEQ ID NO: 3072639 - RNA, 22 nt, Mycobacterium bovis subsp bovis AF2122/97
ggcugccaucccgaucccggcc

SEQ ID NO: 3072640 - RNA, 18 nt, Mycobacterium bovis subsp bovis AF2122/97
ggcugcccaucggugauc

SEQ ID NO: 3072641 - RNA, 20 nt, Mycobacterium bovis subsp bovis AF2122/97
ggcugcccaugguggcgauc

SEQ ID NO: 3072642 - RNA, 16 nt, Mycobacterium bovis subsp bovis AF2122/97
ggcugcccgagaucgc

SEQ ID NO: 3072643 - RNA, 18 nt, Mycobacterium bovis subsp bovis AF2122/97
ggcugcccguucugccca

SEQ ID NO: 3072644 - RNA, 22 nt, Mycobacterium bovis subsp bovis AF2122/97
ggcugccgaacaguucggcgag

SEQ ID NO: 3072645 - RNA, 23 nt, Mycobacterium bovis subsp bovis AF2122/97
ggcugccgaacaguucggcgagc

SEQ ID NO: 3072646 - RNA, 15 nt, Mycobacterium bovis subsp bovis AF2122/97
ggcugccgcaccaag

SEQ ID NO: 3072647 - RNA, 21 nt, Mycobacterium bovis subsp bovis AF2122/97
ggcugccgcaccaaggccgcc

SEQ ID NO: 3072648 - RNA, 16 nt, Mycobacterium bovis subsp bovis AF2122/97
ggcugccgcccaugcc

SEQ ID NO: 3072649 - RNA, 16 nt, Mycobacterium bovis subsp bovis AF2122/97
ggcugccgccguugcc

SEQ ID NO: 3072650 - RNA, 19 nt, Mycobacterium bovis subsp bovis AF2122/97
ggcugccgcgcgcugccgc

SEQ ID NO: 3072651 - RNA, 12 nt, Mycobacterium bovis subsp bovis AF2122/97
ggcugccggcaa

SEQ ID NO: 3072652 - RNA, 22 nt, Mycobacterium bovis subsp bovis AF2122/97
ggcugccggcaacagcucgccu

SEQ ID NO: 3072653 - RNA, 15 nt, Mycobacterium bovis subsp bovis AF2122/97
ggcugccgguucacc

SEQ ID NO: 3072654 - RNA, 19 nt, Mycobacterium bovis subsp bovis AF2122/97
ggcugccgguucaccaugu

SEQ ID NO: 3072655 - RNA, 16 nt, Mycobacterium bovis subsp bovis AF2122/97
ggcugccgucagccgu

SEQ ID NO: 3072656 - RNA, 17 nt, Mycobacterium bovis subsp bovis AF2122/97
ggcugccgucuccuggu

SEQ ID NO: 3072657 - RNA, 20 nt, Mycobacterium bovis subsp bovis AF2122/97
ggcugccuccaucaacugca

SEQ ID NO: 3072658 - RNA, 19 nt, Mycobacterium bovis subsp bovis AF2122/97
ggcugccuucggcgagcgg

SEQ ID NO: 3072659 - RNA, 22 nt, Mycobacterium bovis subsp bovis AF2122/97
ggcugcgaaagccacucgcgca

SEQ ID NO: 3072660 - RNA, 18 nt, Mycobacterium bovis subsp bovis AF2122/97
ggcugcgacaggacgucg

SEQ ID NO: 3072661 - RNA, 16 nt, Mycobacterium bovis subsp bovis AF2122/97
ggcugcgaccggcucc

SEQ ID NO: 3072662 - RNA, 21 nt, Mycobacterium bovis subsp bovis AF2122/97
ggcugcgccgaacaccacacc

SEQ ID NO: 3072663 - RNA, 22 nt, Mycobacterium bovis subsp bovis AF2122/97
ggcugcgccgauacccagcggg

SEQ ID NO: 3072664 - RNA, 20 nt, Mycobacterium bovis subsp bovis AF2122/97
ggcugcgcgcucggccagca

SEQ ID NO: 3072665 - RNA, 22 nt, Mycobacterium bovis subsp bovis AF2122/97
ggcugcgcgcucggccagcauc

SEQ ID NO: 3072666 - RNA, 13 nt, Mycobacterium bovis subsp bovis AF2122/97
ggcugcgcgucga

SEQ ID NO: 3072667 - RNA, 22 nt, Mycobacterium bovis subsp bovis AF2122/97
ggcugcgcucgcccgcggccgu

SEQ ID NO: 3072668 - RNA, 18 nt, Mycobacterium bovis subsp bovis AF2122/97
ggcugcgcuucgaccgag

SEQ ID NO: 3072669 - RNA, 21 nt, Mycobacterium bovis subsp bovis AF2122/97
ggcugcgcuuugcacagcggc

SEQ ID NO: 3072670 - RNA, 24 nt, Mycobacterium bovis subsp bovis AF2122/97
ggcugcgcuuugcacagcggcauc

SEQ ID NO: 3072671 - RNA, 18 nt, Mycobacterium bovis subsp bovis AF2122/97
ggcugcggaggcggguug

SEQ ID NO: 3072672 - RNA, 20 nt, Mycobacterium bovis subsp bovis AF2122/97
ggcugcggcuuggccaucac

SEQ ID NO: 3072673 - RNA, 20 nt, Mycobacterium bovis subsp bovis AF2122/97
ggcugcgggaagacgucggg

SEQ ID NO: 3072674 - RNA, 15 nt, Mycobacterium bovis subsp bovis AF2122/97
ggcugcguucgccgg

SEQ ID NO: 3072675 - RNA, 17 nt, Mycobacterium bovis subsp bovis AF2122/97
ggcugcguucgccggaa

SEQ ID NO: 3072676 - RNA, 16 nt, Mycobacterium bovis subsp bovis AF2122/97
ggcugcguuggcuggu

SEQ ID NO: 3072677 - RNA, 16 nt, Mycobacterium bovis subsp bovis AF2122/97
ggcugcuccgucgccg

SEQ ID NO: 3072678 - RNA, 18 nt, Mycobacterium bovis subsp bovis AF2122/97
ggcugcuccgucgccgaa

SEQ ID NO: 3072679 - RNA, 16 nt, Mycobacterium bovis subsp bovis AF2122/97
ggcugcuugcgcccgg

SEQ ID NO: 3072680 - RNA, 16 nt, Mycobacterium bovis subsp bovis AF2122/97
ggcugcuuggucgccc

SEQ ID NO: 3072681 - RNA, 15 nt, Mycobacterium bovis subsp bovis AF2122/97
ggcuggaccacucgc

SEQ ID NO: 3072682 - RNA, 19 nt, Mycobacterium bovis subsp bovis AF2122/97
ggcuggaccacucgccggc

SEQ ID NO: 3072683 - RNA, 20 nt, Mycobacterium bovis subsp bovis AF2122/97
ggcuggaccacucgccggcg

SEQ ID NO: 3072684 - RNA, 23 nt, Mycobacterium bovis subsp bovis AF2122/97
ggcuggaccacucgccggcggac

SEQ ID NO: 3072685 - RNA, 13 nt, Mycobacterium bovis subsp bovis AF2122/97
ggcuggacccgca

SEQ ID NO: 3072686 - RNA, 22 nt, Mycobacterium bovis subsp bovis AF2122/97
ggcuggacccgcauggcgcggg

SEQ ID NO: 3072687 - RNA, 15 nt, Mycobacterium bovis subsp bovis AF2122/97
ggcuggacggcgccg

SEQ ID NO: 3072688 - RNA, 20 nt, Mycobacterium bovis subsp bovis AF2122/97
ggcuggcaugccggcgugcg

SEQ ID NO: 3072689 - RNA, 22 nt, Mycobacterium bovis subsp bovis AF2122/97
ggcuggcccaccuccucgccgg

SEQ ID NO: 3072690 - RNA, 15 nt, Mycobacterium bovis subsp bovis AF2122/97
ggcuggcccagcgac

SEQ ID NO: 3072691 - RNA, 24 nt, Mycobacterium bovis subsp bovis AF2122/97
ggcuggcccgcaugccggcgcacc

SEQ ID NO: 3072692 - RNA, 12 nt, Mycobacterium bovis subsp bovis AF2122/97
ggcuggccgcca

SEQ ID NO: 3072693 - RNA, 14 nt, Mycobacterium bovis subsp bovis AF2122/97
ggcuggccgccacc

SEQ ID NO: 3072694 - RNA, 17 nt, Mycobacterium bovis subsp bovis AF2122/97
ggcuggccgcgccucgg

SEQ ID NO: 3072695 - RNA, 18 nt, Mycobacterium bovis subsp bovis AF2122/97
ggcuggcgauggccgucc

SEQ ID NO: 3072696 - RNA, 22 nt, Mycobacterium bovis subsp bovis AF2122/97
ggcuggcgauggccguccgacc

SEQ ID NO: 3072697 - RNA, 14 nt, Mycobacterium bovis subsp bovis AF2122/97
ggcuggcggcgacc

SEQ ID NO: 3072698 - RNA, 22 nt, Mycobacterium bovis subsp bovis AF2122/97
ggcuggcggcguggcgccggcc

SEQ ID NO: 3072699 - RNA, 13 nt, Mycobacterium bovis subsp bovis AF2122/97
ggcuggcgucacc

SEQ ID NO: 3072700 - RNA, 14 nt, Mycobacterium bovis subsp bovis AF2122/97
ggcuggcugugccg

SEQ ID NO: 3072701 - RNA, 13 nt, Mycobacterium bovis subsp bovis AF2122/97
ggcugggaaagca

SEQ ID NO: 3072702 - RNA, 21 nt, Mycobacterium bovis subsp bovis AF2122/97
ggcugggcagaccgaucggca

SEQ ID NO: 3072703 - RNA, 16 nt, Mycobacterium bovis subsp bovis AF2122/97
ggcugggcccgccguc

SEQ ID NO: 3072704 - RNA, 19 nt, Mycobacterium bovis subsp bovis AF2122/97
ggcugggcccgccgucacc

SEQ ID NO: 3072705 - RNA, 17 nt, Mycobacterium bovis subsp bovis AF2122/97
ggcuugcgauuggcugg

SEQ ID NO: 3072706 - RNA, 17 nt, Mycobacterium bovis subsp bovis AF2122/97
ggcuugcgcagcagcgu

SEQ ID NO: 3072707 - RNA, 21 nt, Mycobacterium bovis subsp bovis AF2122/97
ggcuugcgccggaugacaccg

SEQ ID NO: 3072708 - RNA, 20 nt, Mycobacterium bovis subsp bovis AF2122/97
ggcuugcgcgacgagacgca

SEQ ID NO: 3072709 - RNA, 14 nt, Mycobacterium bovis subsp bovis AF2122/97
ggcuugcggcaccc

SEQ ID NO: 3072710 - RNA, 12 nt, Mycobacterium bovis subsp bovis AF2122/97
ggcuugcgucgc

SEQ ID NO: 3072711 - RNA, 15 nt, Mycobacterium bovis subsp bovis AF2122/97
ggcuugcucugcgca

SEQ ID NO: 3072712 - RNA, 16 nt, Mycobacterium bovis subsp bovis AF2122/97
ggcuuggaccagcgug

SEQ ID NO: 3072713 - RNA, 22 nt, Mycobacterium bovis subsp bovis AF2122/97
ggcuuggccgggaguguguccg

SEQ ID NO: 3072714 - RNA, 20 nt, Mycobacterium bovis subsp bovis AF2122/97
ggcuuggccguaggcggcga

SEQ ID NO: 3072715 - RNA, 21 nt, Mycobacterium bovis subsp bovis AF2122/97
ggcuuggccuagccgcggcac

SEQ ID NO: 3072716 - RNA, 23 nt, Mycobacterium bovis subsp bovis AF2122/97
ggcuuggccuagccgcggcaccg

SEQ ID NO: 3072717 - RNA, 13 nt, Mycobacterium bovis subsp bovis AF2122/97
ggcuuggcgucga

SEQ ID NO: 3072718 - RNA, 13 nt, Mycobacterium bovis subsp bovis AF2122/97
ggcuuggcgucgg

SEQ ID NO: 3072719 - RNA, 15 nt, Mycobacterium bovis subsp bovis AF2122/97
ggcuuggcgucggcc

SEQ ID NO: 3072720 - RNA, 21 nt, Mycobacterium bovis subsp bovis AF2122/97
ggcuuggcgucggccggcagu

SEQ ID NO: 3072721 - RNA, 19 nt, Mycobacterium bovis subsp bovis AF2122/97
ggcuugggaaacccggcca

SEQ ID NO: 3072722 - RNA, 18 nt, Mycobacterium bovis subsp bovis AF2122/97
ggcuuggggucccgccgg

SEQ ID NO: 3072723 - RNA, 20 nt, Mycobacterium bovis subsp bovis AF2122/97
ggcuuggggucccgccgggu

SEQ ID NO: 3072724 - RNA, 20 nt, Mycobacterium bovis subsp bovis AF2122/97
ggcuugucagccgcgaccgc

SEQ ID NO: 3072725 - RNA, 15 nt, Mycobacterium bovis subsp bovis AF2122/97
ggcuuguccgguggu

SEQ ID NO: 3072726 - RNA, 22 nt, Mycobacterium bovis subsp bovis AF2122/97
ggcuuguccucacaugcccgga

SEQ ID NO: 3072727 - RNA, 15 nt, Mycobacterium bovis subsp bovis AF2122/97
ggcuugucgaccacg

SEQ ID NO: 3072728 - RNA, 16 nt, Mycobacterium bovis subsp bovis AF2122/97
ggcuugucgccggcau

SEQ ID NO: 3072729 - RNA, 15 nt, Mycobacterium bovis subsp bovis AF2122/97
ggcuugucgcggugc

SEQ ID NO: 3072730 - RNA, 23 nt, Mycobacterium bovis subsp bovis AF2122/97
ggcuuucagcaccggaucgacca

SEQ ID NO: 3072731 - RNA, 16 nt, Mycobacterium bovis subsp bovis AF2122/97
ggcuuugccgcuguga

SEQ ID NO: 3072732 - RNA, 17 nt, Mycobacterium bovis subsp bovis AF2122/97
ggcuuuggacaggucaa

SEQ ID NO: 3072733 - RNA, 17 nt, Mycobacterium bovis subsp bovis AF2122/97
ggcuuuuacgucugcuc

SEQ ID NO: 3072734 - RNA, 18 nt, Mycobacterium bovis subsp bovis AF2122/97
ggcuuuuacgucugcucg

SEQ ID NO: 3072735 - RNA, 22 nt, Mycobacterium bovis subsp bovis AF2122/97
gggaaaacgggguggcacgcau

SEQ ID NO: 3072736 - RNA, 22 nt, Mycobacterium bovis subsp bovis AF2122/97
gggaaaaucacaauuccacaaa

SEQ ID NO: 3072737 - RNA, 14 nt, Mycobacterium bovis subsp bovis AF2122/97
gggaaacaccggcu

SEQ ID NO: 3072738 - RNA, 15 nt, Mycobacterium bovis subsp bovis AF2122/97
gggaaacccggccag

SEQ ID NO: 3072739 - RNA, 17 nt, Mycobacterium bovis subsp bovis AF2122/97
gggaaacccggccagcu

SEQ ID NO: 3072740 - RNA, 12 nt, Mycobacterium bovis subsp bovis AF2122/97
gggaaccaccag

SEQ ID NO: 3072741 - RNA, 20 nt, Mycobacterium bovis subsp bovis AF2122/97
gggaaccacggucagcacgc

SEQ ID NO: 3072742 - RNA, 12 nt, Mycobacterium bovis subsp bovis AF2122/97
gggaaccagaug

SEQ ID NO: 3072743 - RNA, 13 nt, Mycobacterium bovis subsp bovis AF2122/97
gggaacccgagcu

SEQ ID NO: 3072744 - RNA, 19 nt, Mycobacterium bovis subsp bovis AF2122/97
gggaaccgacaucccaacc

SEQ ID NO: 3072745 - RNA, 17 nt, Mycobacterium bovis subsp bovis AF2122/97
gggaacgaugccgccgg

SEQ ID NO: 3072746 - RNA, 20 nt, Mycobacterium bovis subsp bovis AF2122/97
gggaacgaugccgccggcgg

SEQ ID NO: 3072747 - RNA, 13 nt, Mycobacterium bovis subsp bovis AF2122/97
gggaacgccgaac

SEQ ID NO: 3072748 - RNA, 14 nt, Mycobacterium bovis subsp bovis AF2122/97
gggaacgcgcccac

SEQ ID NO: 3072749 - RNA, 18 nt, Mycobacterium bovis subsp bovis AF2122/97
gggaacgcggaagccgcc

SEQ ID NO: 3072750 - RNA, 22 nt, Mycobacterium bovis subsp bovis AF2122/97
gggaacguccagccguggcggc

SEQ ID NO: 3072751 - RNA, 20 nt, Mycobacterium bovis subsp bovis AF2122/97
gggaacguccgcgccgagcc

SEQ ID NO: 3072752 - RNA, 20 nt, Mycobacterium bovis subsp bovis AF2122/97
gggaagaaguaugcgggacu

SEQ ID NO: 3072753 - RNA, 14 nt, Mycobacterium bovis subsp bovis AF2122/97
gggaagagccgggc

SEQ ID NO: 3072754 - RNA, 22 nt, Mycobacterium bovis subsp bovis AF2122/97
gggaagcccggcagaugcagcg

SEQ ID NO: 3072755 - RNA, 14 nt, Mycobacterium bovis subsp bovis AF2122/97
gggaagccgccggg

SEQ ID NO: 3072756 - RNA, 16 nt, Mycobacterium bovis subsp bovis AF2122/97
gggaagccgccgggca

SEQ ID NO: 3072757 - RNA, 13 nt, Mycobacterium bovis subsp bovis AF2122/97
gggaagcgccaaa

SEQ ID NO: 3072758 - RNA, 14 nt, Mycobacterium bovis subsp bovis AF2122/97
gggaaggaaccggg

SEQ ID NO: 3072759 - RNA, 16 nt, Mycobacterium bovis subsp bovis AF2122/97
gggaaggaaccgggca

SEQ ID NO: 3072760 - RNA, 23 nt, Mycobacterium bovis subsp bovis AF2122/97
gggaaggaaccgggcaaaucaag

SEQ ID NO: 3072761 - RNA, 12 nt, Mycobacterium bovis subsp bovis AF2122/97
gggaagugcggu

SEQ ID NO: 3072762 - RNA, 18 nt, Mycobacterium bovis subsp bovis AF2122/97
gggaaucagugaagacac

SEQ ID NO: 3072763 - RNA, 14 nt, Mycobacterium bovis subsp bovis AF2122/97
gggaaucgcucgcg

SEQ ID NO: 3072764 - RNA, 15 nt, Mycobacterium bovis subsp bovis AF2122/97
gggaauucccgcagg

SEQ ID NO: 3072765 - RNA, 11 nt, Mycobacterium bovis subsp bovis AF2122/97
gggacaacucg

SEQ ID NO: 3072766 - RNA, 14 nt, Mycobacterium bovis subsp bovis AF2122/97
gggacaacucgcgu

SEQ ID NO: 3072767 - RNA, 15 nt, Mycobacterium bovis subsp bovis AF2122/97
gggacaaucguccac

SEQ ID NO: 3072768 - RNA, 19 nt, Mycobacterium bovis subsp bovis AF2122/97
gggacaaucucggccgcau

SEQ ID NO: 3072769 - RNA, 22 nt, Mycobacterium bovis subsp bovis AF2122/97
gggacacaauccacgucgcggc

SEQ ID NO: 3072770 - RNA, 22 nt, Mycobacterium bovis subsp bovis AF2122/97
gggacacagcguccgucgucgg

SEQ ID NO: 3072771 - RNA, 15 nt, Mycobacterium bovis subsp bovis AF2122/97
gggacaccaaaagga

SEQ ID NO: 3072772 - RNA, 12 nt, Mycobacterium bovis subsp bovis AF2122/97
gggacaccagcu

SEQ ID NO: 3072773 - RNA, 17 nt, Mycobacterium bovis subsp bovis AF2122/97
gggacaccaucuccgcc

SEQ ID NO: 3072774 - RNA, 18 nt, Mycobacterium bovis subsp bovis AF2122/97
gggacacgucgcgccagg

SEQ ID NO: 3072775 - RNA, 19 nt, Mycobacterium bovis subsp bovis AF2122/97
gggacagauggcggccgag

SEQ ID NO: 3072776 - RNA, 20 nt, Mycobacterium bovis subsp bovis AF2122/97
gggacagauggcggccgagg

SEQ ID NO: 3072777 - RNA, 21 nt, Mycobacterium bovis subsp bovis AF2122/97
gggacagauggcggccgaggu

SEQ ID NO: 3072778 - RNA, 20 nt, Mycobacterium bovis subsp bovis AF2122/97
gggacauccagugcgguggc

SEQ ID NO: 3072779 - RNA, 23 nt, Mycobacterium bovis subsp bovis AF2122/97
gggaccaccgggauggcucaccc

SEQ ID NO: 3072780 - RNA, 18 nt, Mycobacterium bovis subsp bovis AF2122/97
gggaccaggccaacggcg

SEQ ID NO: 3072781 - RNA, 21 nt, Mycobacterium bovis subsp bovis AF2122/97
gggaccagugcgguggcaggu

SEQ ID NO: 3072782 - RNA, 14 nt, Mycobacterium bovis subsp bovis AF2122/97
gggacccagcggcg

SEQ ID NO: 3072783 - RNA, 17 nt, Mycobacterium bovis subsp bovis AF2122/97
gggaccccgccagccgg

SEQ ID NO: 3072784 - RNA, 18 nt, Mycobacterium bovis subsp bovis AF2122/97
gggaccccgcugcgacgu

SEQ ID NO: 3072785 - RNA, 14 nt, Mycobacterium bovis subsp bovis AF2122/97
gggacccgagauca

SEQ ID NO: 3072786 - RNA, 17 nt, Mycobacterium bovis subsp bovis AF2122/97
gggacccgcuccaagcg

SEQ ID NO: 3072787 - RNA, 23 nt, Mycobacterium bovis subsp bovis AF2122/97
gggacccggcgccgucgaugacc

SEQ ID NO: 3072788 - RNA, 14 nt, Mycobacterium bovis subsp bovis AF2122/97
gggacccggggccg

SEQ ID NO: 3072789 - RNA, 19 nt, Mycobacterium bovis subsp bovis AF2122/97
gggaccgcaucgguggggc

SEQ ID NO: 3072790 - RNA, 14 nt, Mycobacterium bovis subsp bovis AF2122/97
gggaccgccccggc

SEQ ID NO: 3072791 - RNA, 17 nt, Mycobacterium bovis subsp bovis AF2122/97
gggaccgccccggccag

SEQ ID NO: 3072792 - RNA, 23 nt, Mycobacterium bovis subsp bovis AF2122/97
gggauggacggcagccagccacc

SEQ ID NO: 3072793 - RNA, 13 nt, Mycobacterium bovis subsp bovis AF2122/97
gggauggagccgg

SEQ ID NO: 3072794 - RNA, 15 nt, Mycobacterium bovis subsp bovis AF2122/97
gggauggagccggug

SEQ ID NO: 3072795 - RNA, 13 nt, Mycobacterium bovis subsp bovis AF2122/97
gggauggccgccg

SEQ ID NO: 3072796 - RNA, 18 nt, Mycobacterium bovis subsp bovis AF2122/97
gggaugggggagccggug

SEQ ID NO: 3072797 - RNA, 18 nt, Mycobacterium bovis subsp bovis AF2122/97
gggauggucccgcucugg

SEQ ID NO: 3072798 - RNA, 15 nt, Mycobacterium bovis subsp bovis AF2122/97
gggaugugcggcugc

SEQ ID NO: 3072799 - RNA, 17 nt, Mycobacterium bovis subsp bovis AF2122/97
gggauuaugccggcaac

SEQ ID NO: 3072800 - RNA, 14 nt, Mycobacterium bovis subsp bovis AF2122/97
gggauucggcagcg

SEQ ID NO: 3072801 - RNA, 13 nt, Mycobacterium bovis subsp bovis AF2122/97
gggauucuggaug

SEQ ID NO: 3072802 - RNA, 20 nt, Mycobacterium bovis subsp bovis AF2122/97
gggauugaagcuggccaccg

SEQ ID NO: 3072803 - RNA, 16 nt, Mycobacterium bovis subsp bovis AF2122/97
gggauuuccagcagug

SEQ ID NO: 3072804 - RNA, 19 nt, Mycobacterium bovis subsp bovis AF2122/97
gggauuucgcgucugcucg

SEQ ID NO: 3072805 - RNA, 16 nt, Mycobacterium bovis subsp bovis AF2122/97
gggauuugggcugcgg

SEQ ID NO: 3072806 - RNA, 19 nt, Mycobacterium bovis subsp bovis AF2122/97
gggauuuugcgucugcucg

SEQ ID NO: 3072807 - RNA, 23 nt, Mycobacterium bovis subsp bovis AF2122/97
gggauuuugcgucugcucggcgg

SEQ ID NO: 3072808 - RNA, 17 nt, Mycobacterium bovis subsp bovis AF2122/97
gggcaaacugggcaccg

SEQ ID NO: 3072809 - RNA, 15 nt, Mycobacterium bovis subsp bovis AF2122/97
gggcaaaggagccgu

SEQ ID NO: 3072810 - RNA, 16 nt, Mycobacterium bovis subsp bovis AF2122/97
gggcaaagucgguguc

SEQ ID NO: 3072811 - RNA, 14 nt, Mycobacterium bovis subsp bovis AF2122/97
gggcaaaucaagca

SEQ ID NO: 3072812 - RNA, 17 nt, Mycobacterium bovis subsp bovis AF2122/97
gggcaaaucaagcacag

SEQ ID NO: 3072813 - RNA, 17 nt, Mycobacterium bovis subsp bovis AF2122/97
gggcaaccagcagcagg

SEQ ID NO: 3072814 - RNA, 18 nt, Mycobacterium bovis subsp bovis AF2122/97
gggcaaccagcagcaggu

SEQ ID NO: 3072815 - RNA, 18 nt, Mycobacterium bovis subsp bovis AF2122/97
gggcaaccgccccuuccc

SEQ ID NO: 3072816 - RNA, 15 nt, Mycobacterium bovis subsp bovis AF2122/97
gggcaaccugccggg

SEQ ID NO: 3072817 - RNA, 18 nt, Mycobacterium bovis subsp bovis AF2122/97
gggcaacgaucagguugg

SEQ ID NO: 3072818 - RNA, 13 nt, Mycobacterium bovis subsp bovis AF2122/97
gggcaacgccucg

SEQ ID NO: 3072819 - RNA, 14 nt, Mycobacterium bovis subsp bovis AF2122/97
gggcaacgccucga

SEQ ID NO: 3072820 - RNA, 17 nt, Mycobacterium bovis subsp bovis AF2122/97
gggcaacugcagcaugg

SEQ ID NO: 3072821 - RNA, 18 nt, Mycobacterium bovis subsp bovis AF2122/97
gggcaagaaaguuccacg

SEQ ID NO: 3072822 - RNA, 16 nt, Mycobacterium bovis subsp bovis AF2122/97
gggcaaggacaagccg

SEQ ID NO: 3072823 - RNA, 19 nt, Mycobacterium bovis subsp bovis AF2122/97
gggcaaggacaagccgcug

SEQ ID NO: 3072824 - RNA, 21 nt, Mycobacterium bovis subsp bovis AF2122/97
gggcaaggacaagccgcugau

SEQ ID NO: 3072825 - RNA, 21 nt, Mycobacterium bovis subsp bovis AF2122/97
gggcaaggccaccggcggugc

SEQ ID NO: 3072826 - RNA, 15 nt, Mycobacterium bovis subsp bovis AF2122/97
gggcaaggcggcggc

SEQ ID NO: 3072827 - RNA, 16 nt, Mycobacterium bovis subsp bovis AF2122/97
gggcaaggcggcggcc

SEQ ID NO: 3072828 - RNA, 19 nt, Mycobacterium bovis subsp bovis AF2122/97
gggcaauacguagucgccg

SEQ ID NO: 3072829 - RNA, 20 nt, Mycobacterium bovis subsp bovis AF2122/97
gggcaauuaggucgaccacc

SEQ ID NO: 3072830 - RNA, 16 nt, Mycobacterium bovis subsp bovis AF2122/97
gggcaauuccgccgag

SEQ ID NO: 3072831 - RNA, 19 nt, Mycobacterium bovis subsp bovis AF2122/97
gggcaauuccgccgagcgc

SEQ ID NO: 3072832 - RNA, 14 nt, Mycobacterium bovis subsp bovis AF2122/97
gggcacaccgacgc

SEQ ID NO: 3072833 - RNA, 15 nt, Mycobacterium bovis subsp bovis AF2122/97
gggcacaccgacgcc

SEQ ID NO: 3072834 - RNA, 19 nt, Mycobacterium bovis subsp bovis AF2122/97
gggcacaccgacgccgcca

SEQ ID NO: 3072835 - RNA, 21 nt, Mycobacterium bovis subsp bovis AF2122/97
gggcacaccgacgccgccagg

SEQ ID NO: 3072836 - RNA, 20 nt, Mycobacterium bovis subsp bovis AF2122/97
gggcacaccgguggcgcccu

SEQ ID NO: 3072837 - RNA, 12 nt, Mycobacterium bovis subsp bovis AF2122/97
gggcacagccag

SEQ ID NO: 3072838 - RNA, 15 nt, Mycobacterium bovis subsp bovis AF2122/97
gggcacagccauggu

SEQ ID NO: 3072839 - RNA, 17 nt, Mycobacterium bovis subsp bovis AF2122/97
gggcacaucgggcgugg

SEQ ID NO: 3072840 - RNA, 12 nt, Mycobacterium bovis subsp bovis AF2122/97
gggcaccaccac

SEQ ID NO: 3072841 - RNA, 13 nt, Mycobacterium bovis subsp bovis AF2122/97
gggcaccaccaca

SEQ ID NO: 3072842 - RNA, 14 nt, Mycobacterium bovis subsp bovis AF2122/97
gggcaccacccgau

SEQ ID NO: 3072843 - RNA, 22 nt, Mycobacterium bovis subsp bovis AF2122/97
gggcaccagcgaauccagccgc

SEQ ID NO: 3072844 - RNA, 14 nt, Mycobacterium bovis subsp bovis AF2122/97
gggcaccagucgcc

SEQ ID NO: 3072845 - RNA, 13 nt, Mycobacterium bovis subsp bovis AF2122/97
gggcaccauaucg

SEQ ID NO: 3072846 - RNA, 14 nt, Mycobacterium bovis subsp bovis AF2122/97
gggcaccgagcuga

SEQ ID NO: 3072847 - RNA, 16 nt, Mycobacterium bovis subsp bovis AF2122/97
gggcaccgagcugagc

SEQ ID NO: 3072848 - RNA, 13 nt, Mycobacterium bovis subsp bovis AF2122/97
gggcaccggccgg

SEQ ID NO: 3072849 - RNA, 11 nt, Mycobacterium bovis subsp bovis AF2122/97
gggcaccggcg

SEQ ID NO: 3072850 - RNA, 13 nt, Mycobacterium bovis subsp bovis AF2122/97
gggcaccggcggu

SEQ ID NO: 3072851 - RNA, 17 nt, Mycobacterium bovis subsp bovis AF2122/97
gggcaccgugauggcgu

SEQ ID NO: 3072852 - RNA, 19 nt, Mycobacterium bovis subsp bovis AF2122/97
gggcaccguuaccgccguc

SEQ ID NO: 3072853 - RNA, 13 nt, Mycobacterium bovis subsp bovis AF2122/97
gggcaccuccaau

SEQ ID NO: 3072854 - RNA, 19 nt, Mycobacterium bovis subsp bovis AF2122/97
gggcaccuggucggccgca

SEQ ID NO: 3072855 - RNA, 20 nt, Mycobacterium bovis subsp bovis AF2122/97
gggcaccuggucggccgcaa

SEQ ID NO: 3072856 - RNA, 19 nt, Mycobacterium bovis subsp bovis AF2122/97
gggcaccuuggccaggaag

SEQ ID NO: 3072857 - RNA, 22 nt, Mycobacterium bovis subsp bovis AF2122/97
gggcacgaucgucgcggccaag

SEQ ID NO: 3072858 - RNA, 13 nt, Mycobacterium bovis subsp bovis AF2122/97
gggcacgcccucg

SEQ ID NO: 3072859 - RNA, 17 nt, Mycobacterium bovis subsp bovis AF2122/97
gggcacgccgccgacgu

SEQ ID NO: 3072860 - RNA, 15 nt, Mycobacterium bovis subsp bovis AF2122/97
gggcacggccgucga

SEQ ID NO: 3072861 - RNA, 21 nt, Mycobacterium bovis subsp bovis AF2122/97
gggcacggugaugaggaucgc

SEQ ID NO: 3072862 - RNA, 17 nt, Mycobacterium bovis subsp bovis AF2122/97
gggcacguggcgguaca

SEQ ID NO: 3072863 - RNA, 19 nt, Mycobacterium bovis subsp bovis AF2122/97
gggcacuccgggcucggcg

SEQ ID NO: 3072864 - RNA, 20 nt, Mycobacterium bovis subsp bovis AF2122/97
gggcacuccgggcucggcgu

SEQ ID NO: 3072865 - RNA, 22 nt, Mycobacterium bovis subsp bovis AF2122/97
gggcacucggcccggcccgggu

SEQ ID NO: 3072866 - RNA, 12 nt, Mycobacterium bovis subsp bovis AF2122/97
gggcacuggggu

SEQ ID NO: 3072867 - RNA, 14 nt, Mycobacterium bovis subsp bovis AF2122/97
gggcacugguggcg

SEQ ID NO: 3072868 - RNA, 20 nt, Mycobacterium bovis subsp bovis AF2122/97
gggcacuugcccgucggcgc

SEQ ID NO: 3072869 - RNA, 15 nt, Mycobacterium bovis subsp bovis AF2122/97
gggcagaagaguguc

SEQ ID NO: 3072870 - RNA, 17 nt, Mycobacterium bovis subsp bovis AF2122/97
gggcagaaucggugggc

SEQ ID NO: 3072871 - RNA, 20 nt, Mycobacterium bovis subsp bovis AF2122/97
gggcagaaucggugggcggg

SEQ ID NO: 3072872 - RNA, 18 nt, Mycobacterium bovis subsp bovis AF2122/97
gggcagaccgaucggcag

SEQ ID NO: 3072873 - RNA, 20 nt, Mycobacterium bovis subsp bovis AF2122/97
gggcagaccgaucggcaggc

SEQ ID NO: 3072874 - RNA, 15 nt, Mycobacterium bovis subsp bovis AF2122/97
gggcagauggugaag

SEQ ID NO: 3072875 - RNA, 16 nt, Mycobacterium bovis subsp bovis AF2122/97
gggcagauucuucacc

SEQ ID NO: 3072876 - RNA, 11 nt, Mycobacterium bovis subsp bovis AF2122/97
gggcagcagcc

SEQ ID NO: 3072877 - RNA, 14 nt, Mycobacterium bovis subsp bovis AF2122/97
gggcagcagcuggu

SEQ ID NO: 3072878 - RNA, 19 nt, Mycobacterium bovis subsp bovis AF2122/97
gggcagcaggcccacccgg

SEQ ID NO: 3072879 - RNA, 20 nt, Mycobacterium bovis subsp bovis AF2122/97
gggccagugaaaccaccggc

SEQ ID NO: 3072880 - RNA, 18 nt, Mycobacterium bovis subsp bovis AF2122/97
gggccaucaagcgauccg

SEQ ID NO: 3072881 - RNA, 13 nt, Mycobacterium bovis subsp bovis AF2122/97
gggccaucacggu

SEQ ID NO: 3072882 - RNA, 20 nt, Mycobacterium bovis subsp bovis AF2122/97
gggccaucgcauccccagca

SEQ ID NO: 3072883 - RNA, 22 nt, Mycobacterium bovis subsp bovis AF2122/97
gggccaucgucaggaaccaccc

SEQ ID NO: 3072884 - RNA, 19 nt, Mycobacterium bovis subsp bovis AF2122/97
gggccaugcuaggaccacc

SEQ ID NO: 3072885 - RNA, 16 nt, Mycobacterium bovis subsp bovis AF2122/97
gggccauggguagccg

SEQ ID NO: 3072886 - RNA, 19 nt, Mycobacterium bovis subsp bovis AF2122/97
gggccauggguagccgccc

SEQ ID NO: 3072887 - RNA, 22 nt, Mycobacterium bovis subsp bovis AF2122/97
gggccauggguagccgcccagc

SEQ ID NO: 3072888 - RNA, 13 nt, Mycobacterium bovis subsp bovis AF2122/97
gggcccagcagcg

SEQ ID NO: 3072889 - RNA, 20 nt, Mycobacterium bovis subsp bovis AF2122/97
gggcccagcaggucgucggc

SEQ ID NO: 3072890 - RNA, 14 nt, Mycobacterium bovis subsp bovis AF2122/97
gggcccagcggccg

SEQ ID NO: 3072891 - RNA, 17 nt, Mycobacterium bovis subsp bovis AF2122/97
gggcccagcggccgcga

SEQ ID NO: 3072892 - RNA, 21 nt, Mycobacterium bovis subsp bovis AF2122/97
gggccccacaucgccccccag

SEQ ID NO: 3072893 - RNA, 15 nt, Mycobacterium bovis subsp bovis AF2122/97
gggccccaccgagcg

SEQ ID NO: 3072894 - RNA, 13 nt, Mycobacterium bovis subsp bovis AF2122/97
gggccccacggcg

SEQ ID NO: 3072895 - RNA, 19 nt, Mycobacterium bovis subsp bovis AF2122/97
gggccccaugccgaccggc

SEQ ID NO: 3072896 - RNA, 21 nt, Mycobacterium bovis subsp bovis AF2122/97
gggcccccaaucagugcagcg

SEQ ID NO: 3072897 - RNA, 23 nt, Mycobacterium bovis subsp bovis AF2122/97
gggcccccagguagugcacacuc

SEQ ID NO: 3072898 - RNA, 20 nt, Mycobacterium bovis subsp bovis AF2122/97
gggcccccgccggacacgau

SEQ ID NO: 3072899 - RNA, 20 nt, Mycobacterium bovis subsp bovis AF2122/97
gggcccccuggaucgcgccc

SEQ ID NO: 3072900 - RNA, 16 nt, Mycobacterium bovis subsp bovis AF2122/97
gggccccgccgaugcg

SEQ ID NO: 3072901 - RNA, 17 nt, Mycobacterium bovis subsp bovis AF2122/97
gggccccgcgccggccg

SEQ ID NO: 3072902 - RNA, 22 nt, Mycobacterium bovis subsp bovis AF2122/97
gggccccgcgccggccgcacgc

SEQ ID NO: 3072903 - RNA, 16 nt, Mycobacterium bovis subsp bovis AF2122/97
gggccccgcggcgccg

SEQ ID NO: 3072904 - RNA, 15 nt, Mycobacterium bovis subsp bovis AF2122/97
gggccccuccggcca

SEQ ID NO: 3072905 - RNA, 16 nt, Mycobacterium bovis subsp bovis AF2122/97
gggccccuccggccac

SEQ ID NO: 3072906 - RNA, 19 nt, Mycobacterium bovis subsp bovis AF2122/97
gggccccuucgcagcaugu

SEQ ID NO: 3072907 - RNA, 20 nt, Mycobacterium bovis subsp bovis AF2122/97
gggccccuugaccgcugccc

SEQ ID NO: 3072908 - RNA, 21 nt, Mycobacterium bovis subsp bovis AF2122/97
gggcccgaccuguccacccag

SEQ ID NO: 3072909 - RNA, 17 nt, Mycobacterium bovis subsp bovis AF2122/97
gggcccgacgacgacgu

SEQ ID NO: 3072910 - RNA, 23 nt, Mycobacterium bovis subsp bovis AF2122/97
gggcccgacguugccgaagccgg

SEQ ID NO: 3072911 - RNA, 23 nt, Mycobacterium bovis subsp bovis AF2122/97
gggcccgaugaggacauccggcg

SEQ ID NO: 3072912 - RNA, 13 nt, Mycobacterium bovis subsp bovis AF2122/97
gggcccgaugucg

SEQ ID NO: 3072913 - RNA, 17 nt, Mycobacterium bovis subsp bovis AF2122/97
gggcccgaugucgucga

SEQ ID NO: 3072914 - RNA, 19 nt, Mycobacterium bovis subsp bovis AF2122/97
gggcccgcaggucggccac

SEQ ID NO: 3072915 - RNA, 12 nt, Mycobacterium bovis subsp bovis AF2122/97
gggcccgccagc

SEQ ID NO: 3072916 - RNA, 13 nt, Mycobacterium bovis subsp bovis AF2122/97
gggcccgccagcc

SEQ ID NO: 3072917 - RNA, 14 nt, Mycobacterium bovis subsp bovis AF2122/97
gggcccgccagccc

SEQ ID NO: 3072918 - RNA, 15 nt, Mycobacterium bovis subsp bovis AF2122/97
gggcccgccagccca

SEQ ID NO: 3072919 - RNA, 17 nt, Mycobacterium bovis subsp bovis AF2122/97
gggcccgccagcccagc

SEQ ID NO: 3072920 - RNA, 21 nt, Mycobacterium bovis subsp bovis AF2122/97
gggcccgccagcccagcacgc

SEQ ID NO: 3072921 - RNA, 12 nt, Mycobacterium bovis subsp bovis AF2122/97
gggcccgccggc

SEQ ID NO: 3072922 - RNA, 18 nt, Mycobacterium bovis subsp bovis AF2122/97
gggcccgccgucaccgcc

SEQ ID NO: 3072923 - RNA, 20 nt, Mycobacterium bovis subsp bovis AF2122/97
gggcccgccgucaccgccgu

SEQ ID NO: 3072924 - RNA, 20 nt, Mycobacterium bovis subsp bovis AF2122/97
gggcccgccgucuuggcccg

SEQ ID NO: 3072925 - RNA, 22 nt, Mycobacterium bovis subsp bovis AF2122/97
gggcccgccgucuuggcccggu

SEQ ID NO: 3072926 - RNA, 14 nt, Mycobacterium bovis subsp bovis AF2122/97
gggcccgcgcggcg

SEQ ID NO: 3072927 - RNA, 17 nt, Mycobacterium bovis subsp bovis AF2122/97
gggcccggccggacggg

SEQ ID NO: 3072928 - RNA, 22 nt, Mycobacterium bovis subsp bovis AF2122/97
gggcccggccggacgggugcgg

SEQ ID NO: 3072929 - RNA, 22 nt, Mycobacterium bovis subsp bovis AF2122/97
gggcccggcgaacaggcgaccg

SEQ ID NO: 3072930 - RNA, 13 nt, Mycobacterium bovis subsp bovis AF2122/97
gggcccggcgagc

SEQ ID NO: 3072931 - RNA, 14 nt, Mycobacterium bovis subsp bovis AF2122/97
gggcccggcgagcu

SEQ ID NO: 3072932 - RNA, 12 nt, Mycobacterium bovis subsp bovis AF2122/97
gggcccguccug

SEQ ID NO: 3072933 - RNA, 17 nt, Mycobacterium bovis subsp bovis AF2122/97
gggcccuagccggcgcg

SEQ ID NO: 3072934 - RNA, 20 nt, Mycobacterium bovis subsp bovis AF2122/97
gggcccuagccggcgcgccc

SEQ ID NO: 3072935 - RNA, 20 nt, Mycobacterium bovis subsp bovis AF2122/97
gggcccucuaugcgggcagc

SEQ ID NO: 3072936 - RNA, 21 nt, Mycobacterium bovis subsp bovis AF2122/97
gggcccucuaugcgggcagcg

SEQ ID NO: 3072937 - RNA, 22 nt, Mycobacterium bovis subsp bovis AF2122/97
gggccgaacacaccgggcgggc

SEQ ID NO: 3072938 - RNA, 19 nt, Mycobacterium bovis subsp bovis AF2122/97
gggccgaauaccacaccgu

SEQ ID NO: 3072939 - RNA, 21 nt, Mycobacterium bovis subsp bovis AF2122/97
gggccgaauaccacaccguga

SEQ ID NO: 3072940 - RNA, 15 nt, Mycobacterium bovis subsp bovis AF2122/97
gggccgaccagucga

SEQ ID NO: 3072941 - RNA, 24 nt, Mycobacterium bovis subsp bovis AF2122/97
gggccgaccagucgacgucucugg

SEQ ID NO: 3072942 - RNA, 22 nt, Mycobacterium bovis subsp bovis AF2122/97
gggccgacgcgaacccauacgc

SEQ ID NO: 3072943 - RNA, 17 nt, Mycobacterium bovis subsp bovis AF2122/97
gggccgacgggacaacc

SEQ ID NO: 3072944 - RNA, 23 nt, Mycobacterium bovis subsp bovis AF2122/97
gggccgacugggcgcgaccccag

SEQ ID NO: 3072945 - RNA, 13 nt, Mycobacterium bovis subsp bovis AF2122/97
gggccgagccgac

SEQ ID NO: 3072946 - RNA, 12 nt, Mycobacterium bovis subsp bovis AF2122/97
gggccgagcgca

SEQ ID NO: 3072947 - RNA, 20 nt, Mycobacterium bovis subsp bovis AF2122/97
gggccgagcgcaccacggcg

SEQ ID NO: 3072948 - RNA, 16 nt, Mycobacterium bovis subsp bovis AF2122/97
gggccgaggccgucgc

SEQ ID NO: 3072949 - RNA, 20 nt, Mycobacterium bovis subsp bovis AF2122/97
gggccgaucucuccggcggc

SEQ ID NO: 3072950 - RNA, 22 nt, Mycobacterium bovis subsp bovis AF2122/97
gggccgaucucuccggcggcga

SEQ ID NO: 3072951 - RNA, 20 nt, Mycobacterium bovis subsp bovis AF2122/97
gggccgcaucgucgccgcgc

SEQ ID NO: 3072952 - RNA, 22 nt, Mycobacterium bovis subsp bovis AF2122/97
gggccgccagcugcgcagcgca

SEQ ID NO: 3072953 - RNA, 12 nt, Mycobacterium bovis subsp bovis AF2122/97
gggccgccaggc

SEQ ID NO: 3072954 - RNA, 13 nt, Mycobacterium bovis subsp bovis AF2122/97
gggccgccaggcg

SEQ ID NO: 3072955 - RNA, 18 nt, Mycobacterium bovis subsp bovis AF2122/97
gggccgccaggcggccgg

SEQ ID NO: 3072956 - RNA, 15 nt, Mycobacterium bovis subsp bovis AF2122/97
gggccgccaucucgu

SEQ ID NO: 3072957 - RNA, 23 nt, Mycobacterium bovis subsp bovis AF2122/97
gggccgccgaagcucaucgccgc

SEQ ID NO: 3072958 - RNA, 21 nt, Mycobacterium bovis subsp bovis AF2122/97
gggccgccgagcggaccaccg

SEQ ID NO: 3072959 - RNA, 13 nt, Mycobacterium bovis subsp bovis AF2122/97
gggccgccgagcu

SEQ ID NO: 3072960 - RNA, 13 nt, Mycobacterium bovis subsp bovis AF2122/97
gggccgccgaugc

SEQ ID NO: 3072961 - RNA, 18 nt, Mycobacterium bovis subsp bovis AF2122/97
gggccgccgaugccaccg

SEQ ID NO: 3072962 - RNA, 17 nt, Mycobacterium bovis subsp bovis AF2122/97
gggccgccgcccugguc

SEQ ID NO: 3072963 - RNA, 22 nt, Mycobacterium bovis subsp bovis AF2122/97
gggccgccgcccugguccaggc

SEQ ID NO: 3072964 - RNA, 23 nt, Mycobacterium bovis subsp bovis AF2122/97
gggccgccgcgauggccccuguc

SEQ ID NO: 3072965 - RNA, 13 nt, Mycobacterium bovis subsp bovis AF2122/97
gggcgaucggcgg

SEQ ID NO: 3072966 - RNA, 14 nt, Mycobacterium bovis subsp bovis AF2122/97
gggcgaugcggcgu

SEQ ID NO: 3072967 - RNA, 15 nt, Mycobacterium bovis subsp bovis AF2122/97
gggcgaugcugggcg

SEQ ID NO: 3072968 - RNA, 11 nt, Mycobacterium bovis subsp bovis AF2122/97
gggcgauggca

SEQ ID NO: 3072969 - RNA, 17 nt, Mycobacterium bovis subsp bovis AF2122/97
gggcgauggucgggaug

SEQ ID NO: 3072970 - RNA, 16 nt, Mycobacterium bovis subsp bovis AF2122/97
gggcgauucugcgucu

SEQ ID NO: 3072971 - RNA, 20 nt, Mycobacterium bovis subsp bovis AF2122/97
gggcgauucugcgucugcuc

SEQ ID NO: 3072972 - RNA, 21 nt, Mycobacterium bovis subsp bovis AF2122/97
gggcgauucugcgucugcucg

SEQ ID NO: 3072973 - RNA, 20 nt, Mycobacterium bovis subsp bovis AF2122/97
gggcgauucugugucugcuc

SEQ ID NO: 3072974 - RNA, 20 nt, Mycobacterium bovis subsp bovis AF2122/97
gggcgauuuugcgucugcuc

SEQ ID NO: 3072975 - RNA, 22 nt, Mycobacterium bovis subsp bovis AF2122/97
gggcgauuuugcgucugcucgc

SEQ ID NO: 3072976 - RNA, 15 nt, Mycobacterium bovis subsp bovis AF2122/97
gggcgcaacgccaua

SEQ ID NO: 3072977 - RNA, 16 nt, Mycobacterium bovis subsp bovis AF2122/97
gggcgcaagcagcccg

SEQ ID NO: 3072978 - RNA, 18 nt, Mycobacterium bovis subsp bovis AF2122/97
gggcgcaccaagacgcca

SEQ ID NO: 3072979 - RNA, 15 nt, Mycobacterium bovis subsp bovis AF2122/97
gggcgcaccgagcga

SEQ ID NO: 3072980 - RNA, 14 nt, Mycobacterium bovis subsp bovis AF2122/97
gggcgcagcgcggc

SEQ ID NO: 3072981 - RNA, 14 nt, Mycobacterium bovis subsp bovis AF2122/97
gggcgccaccaccc

SEQ ID NO: 3072982 - RNA, 16 nt, Mycobacterium bovis subsp bovis AF2122/97
gggcgccacgggugac

SEQ ID NO: 3072983 - RNA, 18 nt, Mycobacterium bovis subsp bovis AF2122/97
gggcgccacugaccgcga

SEQ ID NO: 3072984 - RNA, 18 nt, Mycobacterium bovis subsp bovis AF2122/97
gggcgccaucccgccgcc

SEQ ID NO: 3072985 - RNA, 23 nt, Mycobacterium bovis subsp bovis AF2122/97
gggcgccccagggggcgugccgc

SEQ ID NO: 3072986 - RNA, 17 nt, Mycobacterium bovis subsp bovis AF2122/97
gggcgcccuuaagccgg

SEQ ID NO: 3072987 - RNA, 21 nt, Mycobacterium bovis subsp bovis AF2122/97
gggcgccgaauuggcccgggu

SEQ ID NO: 3072988 - RNA, 12 nt, Mycobacterium bovis subsp bovis AF2122/97
gggcgccgcagc

SEQ ID NO: 3072989 - RNA, 17 nt, Mycobacterium bovis subsp bovis AF2122/97
gggcgccgcgcucgacg

SEQ ID NO: 3072990 - RNA, 12 nt, Mycobacterium bovis subsp bovis AF2122/97
gggcgccggcgc

SEQ ID NO: 3072991 - RNA, 12 nt, Mycobacterium bovis subsp bovis AF2122/97
gggcgccggugu

SEQ ID NO: 3072992 - RNA, 19 nt, Mycobacterium bovis subsp bovis AF2122/97
gggcgccuucaccuggugu

SEQ ID NO: 3072993 - RNA, 17 nt, Mycobacterium bovis subsp bovis AF2122/97
gggcgccuuccaggcgg

SEQ ID NO: 3072994 - RNA, 16 nt, Mycobacterium bovis subsp bovis AF2122/97
gggcgcgcaucugcuc

SEQ ID NO: 3072995 - RNA, 18 nt, Mycobacterium bovis subsp bovis AF2122/97
gggcgcgcaucugcucgg

SEQ ID NO: 3072996 - RNA, 13 nt, Mycobacterium bovis subsp bovis AF2122/97
gggcgcggcaggc

SEQ ID NO: 3072997 - RNA, 15 nt, Mycobacterium bovis subsp bovis AF2122/97
gggcgcggcccauga

SEQ ID NO: 3072998 - RNA, 20 nt, Mycobacterium bovis subsp bovis AF2122/97
gggcgcgggugaccaggcgg

SEQ ID NO: 3072999 - RNA, 17 nt, Mycobacterium bovis subsp bovis AF2122/97
gggcgcgguaaccacgc

SEQ ID NO: 3073000 - RNA, 21 nt, Mycobacterium bovis subsp bovis AF2122/97
gggcgcguccucgccgcacgc

SEQ ID NO: 3073001 - RNA, 13 nt, Mycobacterium bovis subsp bovis AF2122/97
gggcgcucgcauc

SEQ ID NO: 3073002 - RNA, 19 nt, Mycobacterium bovis subsp bovis AF2122/97
gggcgcucgcgcgcugggc

SEQ ID NO: 3073003 - RNA, 23 nt, Mycobacterium bovis subsp bovis AF2122/97
gggcgcucgcgcgcugggcgcgc

SEQ ID NO: 3073004 - RNA, 22 nt, Mycobacterium bovis subsp bovis AF2122/97
gggcgcugaugcgcugggccag

SEQ ID NO: 3073005 - RNA, 23 nt, Mycobacterium bovis subsp bovis AF2122/97
gggcgcugccaauccgaucgagg

SEQ ID NO: 3073006 - RNA, 15 nt, Mycobacterium bovis subsp bovis AF2122/97
gggcgcuggacggcg

SEQ ID NO: 3073007 - RNA, 18 nt, Mycobacterium bovis subsp bovis AF2122/97
gggcgcuggaggccacca

SEQ ID NO: 3073008 - RNA, 22 nt, Mycobacterium bovis subsp bovis AF2122/97
gggcgcugucacguagcgagcc

SEQ ID NO: 3073009 - RNA, 22 nt, Mycobacterium bovis subsp bovis AF2122/97
gggcggaaaaucggcuggcccg

SEQ ID NO: 3073010 - RNA, 19 nt, Mycobacterium bovis subsp bovis AF2122/97
gggcggaaagcccgucggg

SEQ ID NO: 3073011 - RNA, 16 nt, Mycobacterium bovis subsp bovis AF2122/97
gggcggaacgccggca

SEQ ID NO: 3073012 - RNA, 23 nt, Mycobacterium bovis subsp bovis AF2122/97
gggcggagccgaugaccugcccg

SEQ ID NO: 3073013 - RNA, 13 nt, Mycobacterium bovis subsp bovis AF2122/97
gggcggaucgccg

SEQ ID NO: 3073014 - RNA, 17 nt, Mycobacterium bovis subsp bovis AF2122/97
gggcggcaacggcggca

SEQ ID NO: 3073015 - RNA, 22 nt, Mycobacterium bovis subsp bovis AF2122/97
gggcggcaccgcuucaggcgcc

SEQ ID NO: 3073016 - RNA, 14 nt, Mycobacterium bovis subsp bovis AF2122/97
gggcggcagcgagg

SEQ ID NO: 3073017 - RNA, 19 nt, Mycobacterium bovis subsp bovis AF2122/97
gggcggcagcgagucgacg

SEQ ID NO: 3073018 - RNA, 11 nt, Mycobacterium bovis subsp bovis AF2122/97
gggcggcagcu

SEQ ID NO: 3073019 - RNA, 13 nt, Mycobacterium bovis subsp bovis AF2122/97
gggcggcagggug

SEQ ID NO: 3073020 - RNA, 14 nt, Mycobacterium bovis subsp bovis AF2122/97
gggcggcaucccca

SEQ ID NO: 3073021 - RNA, 14 nt, Mycobacterium bovis subsp bovis AF2122/97
gggcggcaucgccg

SEQ ID NO: 3073022 - RNA, 21 nt, Mycobacterium bovis subsp bovis AF2122/97
gggcggcaucgccgaggugga

SEQ ID NO: 3073023 - RNA, 18 nt, Mycobacterium bovis subsp bovis AF2122/97
gggcggcauuaccaacgc

SEQ ID NO: 3073024 - RNA, 15 nt, Mycobacterium bovis subsp bovis AF2122/97
gggcggccagcacgu

SEQ ID NO: 3073025 - RNA, 12 nt, Mycobacterium bovis subsp bovis AF2122/97
gggcggccagga

SEQ ID NO: 3073026 - RNA, 14 nt, Mycobacterium bovis subsp bovis AF2122/97
gggcggccaggauc

SEQ ID NO: 3073027 - RNA, 21 nt, Mycobacterium bovis subsp bovis AF2122/97
gggcggccauggcacugccgg

SEQ ID NO: 3073028 - RNA, 22 nt, Mycobacterium bovis subsp bovis AF2122/97
gggcggccauggcacugccggc

SEQ ID NO: 3073029 - RNA, 15 nt, Mycobacterium bovis subsp bovis AF2122/97
gggcggcccaccggc

SEQ ID NO: 3073030 - RNA, 12 nt, Mycobacterium bovis subsp bovis AF2122/97
gggcggccgacc

SEQ ID NO: 3073031 - RNA, 13 nt, Mycobacterium bovis subsp bovis AF2122/97
gggcggccgggcu

SEQ ID NO: 3073032 - RNA, 15 nt, Mycobacterium bovis subsp bovis AF2122/97
gggcggccgggcucc

SEQ ID NO: 3073033 - RNA, 21 nt, Mycobacterium bovis subsp bovis AF2122/97
gggcggccucccgggccgccg

SEQ ID NO: 3073034 - RNA, 22 nt, Mycobacterium bovis subsp bovis AF2122/97
gggcggccucccgggccgccgc

SEQ ID NO: 3073035 - RNA, 14 nt, Mycobacterium bovis subsp bovis AF2122/97
gggcggcgaacucu

SEQ ID NO: 3073036 - RNA, 18 nt, Mycobacterium bovis subsp bovis AF2122/97
gggcggcgcuggcgucgu

SEQ ID NO: 3073037 - RNA, 22 nt, Mycobacterium bovis subsp bovis AF2122/97
gggcggcggccugggccagccg

SEQ ID NO: 3073038 - RNA, 18 nt, Mycobacterium bovis subsp bovis AF2122/97
gggcggcggcgcgaucga

SEQ ID NO: 3073039 - RNA, 12 nt, Mycobacterium bovis subsp bovis AF2122/97
gggcggcggugg

SEQ ID NO: 3073040 - RNA, 12 nt, Mycobacterium bovis subsp bovis AF2122/97
gggcggcgucgg

SEQ ID NO: 3073041 - RNA, 20 nt, Mycobacterium bovis subsp bovis AF2122/97
gggcggcguuguuggccgca

SEQ ID NO: 3073042 - RNA, 12 nt, Mycobacterium bovis subsp bovis AF2122/97
gggcggcuucga

SEQ ID NO: 3073043 - RNA, 23 nt, Mycobacterium bovis subsp bovis AF2122/97
gggcggcuucgaugucguaccgg

SEQ ID NO: 3073044 - RNA, 18 nt, Mycobacterium bovis subsp bovis AF2122/97
gggcgggaaccccggcca

SEQ ID NO: 3073045 - RNA, 17 nt, Mycobacterium bovis subsp bovis AF2122/97
gggcgggauccacccag

SEQ ID NO: 3073046 - RNA, 21 nt, Mycobacterium bovis subsp bovis AF2122/97
gggcgggcaaucaccgccggc

SEQ ID NO: 3073047 - RNA, 13 nt, Mycobacterium bovis subsp bovis AF2122/97
gggcgggcgucga

SEQ ID NO: 3073048 - RNA, 18 nt, Mycobacterium bovis subsp bovis AF2122/97
gggcggggacggcggcaa

SEQ ID NO: 3073049 - RNA, 20 nt, Mycobacterium bovis subsp bovis AF2122/97
gggcgggguggaauucaucc

SEQ ID NO: 3073050 - RNA, 15 nt, Mycobacterium bovis subsp bovis AF2122/97
gggcgggucugggug

SEQ ID NO: 3073051 - RNA, 16 nt, Mycobacterium bovis subsp bovis AF2122/97
gggcgguagccgacga

SEQ ID NO: 3073052 - RNA, 19 nt, Mycobacterium bovis subsp bovis AF2122/97
gggcuuaugcgucugcucg

SEQ ID NO: 3073053 - RNA, 19 nt, Mycobacterium bovis subsp bovis AF2122/97
gggcuuccaacaggccggu

SEQ ID NO: 3073054 - RNA, 19 nt, Mycobacterium bovis subsp bovis AF2122/97
gggcuucugcgucugcucg

SEQ ID NO: 3073055 - RNA, 22 nt, Mycobacterium bovis subsp bovis AF2122/97
gggcuucugcgucugcucgcgg

SEQ ID NO: 3073056 - RNA, 15 nt, Mycobacterium bovis subsp bovis AF2122/97
gggcuugcaccugca

SEQ ID NO: 3073057 - RNA, 14 nt, Mycobacterium bovis subsp bovis AF2122/97
gggcuugcgcagca

SEQ ID NO: 3073058 - RNA, 16 nt, Mycobacterium bovis subsp bovis AF2122/97
gggcuuggccgcgccg

SEQ ID NO: 3073059 - RNA, 20 nt, Mycobacterium bovis subsp bovis AF2122/97
gggcuuggcgacgaugcagg

SEQ ID NO: 3073060 - RNA, 13 nt, Mycobacterium bovis subsp bovis AF2122/97
gggcuuggcugug

SEQ ID NO: 3073061 - RNA, 14 nt, Mycobacterium bovis subsp bovis AF2122/97
gggcuuggcugugg

SEQ ID NO: 3073062 - RNA, 15 nt, Mycobacterium bovis subsp bovis AF2122/97
gggcuugucgccggc

SEQ ID NO: 3073063 - RNA, 16 nt, Mycobacterium bovis subsp bovis AF2122/97
gggcuugucgccggca

SEQ ID NO: 3073064 - RNA, 16 nt, Mycobacterium bovis subsp bovis AF2122/97
gggcuugugggccggu

SEQ ID NO: 3073065 - RNA, 18 nt, Mycobacterium bovis subsp bovis AF2122/97
gggcuuuagugucugcuc

SEQ ID NO: 3073066 - RNA, 16 nt, Mycobacterium bovis subsp bovis AF2122/97
gggcuuucgcgugcgg

SEQ ID NO: 3073067 - RNA, 20 nt, Mycobacterium bovis subsp bovis AF2122/97
gggcuuucgcgugcggcugc

SEQ ID NO: 3073068 - RNA, 16 nt, Mycobacterium bovis subsp bovis AF2122/97
gggcuuucugcacccg

SEQ ID NO: 3073069 - RNA, 23 nt, Mycobacterium bovis subsp bovis AF2122/97
gggcuuucugcacccgccagggc

SEQ ID NO: 3073070 - RNA, 19 nt, Mycobacterium bovis subsp bovis AF2122/97
gggcuuugcagcguugacg

SEQ ID NO: 3073071 - RNA, 23 nt, Mycobacterium bovis subsp bovis AF2122/97
gggcuuugcagcguugacggcgg

SEQ ID NO: 3073072 - RNA, 19 nt, Mycobacterium bovis subsp bovis AF2122/97
gggcuuuuacgucugcucg

SEQ ID NO: 3073073 - RNA, 20 nt, Mycobacterium bovis subsp bovis AF2122/97
gggcuuuuacgucugcucgc

SEQ ID NO: 3073074 - RNA, 22 nt, Mycobacterium bovis subsp bovis AF2122/97
gggcuuuugcgucugcucgcca

SEQ ID NO: 3073075 - RNA, 20 nt, Mycobacterium bovis subsp bovis AF2122/97
gggcuuuugcgucugcugac

SEQ ID NO: 3073076 - RNA, 21 nt, Mycobacterium bovis subsp bovis AF2122/97
ggggaaaccggccagccgacg

SEQ ID NO: 3073077 - RNA, 14 nt, Mycobacterium bovis subsp bovis AF2122/97
ggggaaagccgcag

SEQ ID NO: 3073078 - RNA, 18 nt, Mycobacterium bovis subsp bovis AF2122/97
ggggaaagccgcagccgc

SEQ ID NO: 3073079 - RNA, 14 nt, Mycobacterium bovis subsp bovis AF2122/97
ggggaacaccgcgg

SEQ ID NO: 3073080 - RNA, 20 nt, Mycobacterium bovis subsp bovis AF2122/97
ggggaaccguccaagccggc

SEQ ID NO: 3073081 - RNA, 18 nt, Mycobacterium bovis subsp bovis AF2122/97
ggggaacgcggaagccgc

SEQ ID NO: 3073082 - RNA, 21 nt, Mycobacterium bovis subsp bovis AF2122/97
ggggaacguccgcgccgagcc

SEQ ID NO: 3073083 - RNA, 14 nt, Mycobacterium bovis subsp bovis AF2122/97
ggggaagacgaccg

SEQ ID NO: 3073084 - RNA, 19 nt, Mycobacterium bovis subsp bovis AF2122/97
ggggaagaucucggccagg

SEQ ID NO: 3073085 - RNA, 17 nt, Mycobacterium bovis subsp bovis AF2122/97
ggggaagccugcgggcc

SEQ ID NO: 3073086 - RNA, 20 nt, Mycobacterium bovis subsp bovis AF2122/97
ggggaaggggcucagcggug

SEQ ID NO: 3073087 - RNA, 13 nt, Mycobacterium bovis subsp bovis AF2122/97
ggggacagcccgg

SEQ ID NO: 3073088 - RNA, 16 nt, Mycobacterium bovis subsp bovis AF2122/97
ggggacagcccggcag

SEQ ID NO: 3073089 - RNA, 16 nt, Mycobacterium bovis subsp bovis AF2122/97
ggggaccacgccgacg

SEQ ID NO: 3073090 - RNA, 20 nt, Mycobacterium bovis subsp bovis AF2122/97
ggggaccacgccgacgugga

SEQ ID NO: 3073091 - RNA, 12 nt, Mycobacterium bovis subsp bovis AF2122/97
ggggaccagaua

SEQ ID NO: 3073092 - RNA, 12 nt, Mycobacterium bovis subsp bovis AF2122/97
ggggaccccgcc

SEQ ID NO: 3073093 - RNA, 16 nt, Mycobacterium bovis subsp bovis AF2122/97
ggggaccccgccagcc

SEQ ID NO: 3073094 - RNA, 22 nt, Mycobacterium bovis subsp bovis AF2122/97
ggggaccccgccagccggagcg

SEQ ID NO: 3073095 - RNA, 21 nt, Mycobacterium bovis subsp bovis AF2122/97
ggggacccgcuccaagcgcgg

SEQ ID NO: 3073096 - RNA, 22 nt, Mycobacterium bovis subsp bovis AF2122/97
ggggacccgcuccaagcgcggu

SEQ ID NO: 3073097 - RNA, 13 nt, Mycobacterium bovis subsp bovis AF2122/97
ggggaccggcagg

SEQ ID NO: 3073098 - RNA, 21 nt, Mycobacterium bovis subsp bovis AF2122/97
ggggaccuauuggucgcucgc

SEQ ID NO: 3073099 - RNA, 22 nt, Mycobacterium bovis subsp bovis AF2122/97
ggggaccuauuggucgcucgcg

SEQ ID NO: 3073100 - RNA, 14 nt, Mycobacterium bovis subsp bovis AF2122/97
ggggaccucggcga

SEQ ID NO: 3073101 - RNA, 21 nt, Mycobacterium bovis subsp bovis AF2122/97
ggggacgcccgugcggcucgc

SEQ ID NO: 3073102 - RNA, 23 nt, Mycobacterium bovis subsp bovis AF2122/97
ggggacgcccgugcggcucgccg

SEQ ID NO: 3073103 - RNA, 13 nt, Mycobacterium bovis subsp bovis AF2122/97
ggggacgccgcgg

SEQ ID NO: 3073104 - RNA, 19 nt, Mycobacterium bovis subsp bovis AF2122/97
ggggacgccgcggcgccgg

SEQ ID NO: 3073105 - RNA, 16 nt, Mycobacterium bovis subsp bovis AF2122/97
ggggacggcggcaagg

SEQ ID NO: 3073106 - RNA, 14 nt, Mycobacterium bovis subsp bovis AF2122/97
ggggacgggucggc

SEQ ID NO: 3073107 - RNA, 21 nt, Mycobacterium bovis subsp bovis AF2122/97
ggggacucugccacccagcac

SEQ ID NO: 3073108 - RNA, 11 nt, Mycobacterium bovis subsp bovis AF2122/97
ggggagccggu

SEQ ID NO: 3073109 - RNA, 15 nt, Mycobacterium bovis subsp bovis AF2122/97
ggggagccggugacg

SEQ ID NO: 3073110 - RNA, 18 nt, Mycobacterium bovis subsp bovis AF2122/97
ggggagccggugacggug

SEQ ID NO: 3073111 - RNA, 12 nt, Mycobacterium bovis subsp bovis AF2122/97
ggggagcugcgg

SEQ ID NO: 3073112 - RNA, 15 nt, Mycobacterium bovis subsp bovis AF2122/97
ggggaguaguggugg

SEQ ID NO: 3073113 - RNA, 23 nt, Mycobacterium bovis subsp bovis AF2122/97
ggggaguggaaacccgccgaacg

SEQ ID NO: 3073114 - RNA, 15 nt, Mycobacterium bovis subsp bovis AF2122/97
ggggauaccgcuggg

SEQ ID NO: 3073115 - RNA, 15 nt, Mycobacterium bovis subsp bovis AF2122/97
ggggauccagcaggc

SEQ ID NO: 3073116 - RNA, 19 nt, Mycobacterium bovis subsp bovis AF2122/97
ggggauccagcaggccggg

SEQ ID NO: 3073117 - RNA, 18 nt, Mycobacterium bovis subsp bovis AF2122/97
ggggaucgcuggccgcga

SEQ ID NO: 3073118 - RNA, 12 nt, Mycobacterium bovis subsp bovis AF2122/97
ggggaucggugg

SEQ ID NO: 3073119 - RNA, 17 nt, Mycobacterium bovis subsp bovis AF2122/97
ggggaucucgagccgcg

SEQ ID NO: 3073120 - RNA, 14 nt, Mycobacterium bovis subsp bovis AF2122/97
ggggaucucggucg

SEQ ID NO: 3073121 - RNA, 21 nt, Mycobacterium bovis subsp bovis AF2122/97
ggggaugccgaaccgcugcgg

SEQ ID NO: 3073122 - RNA, 12 nt, Mycobacterium bovis subsp bovis AF2122/97
ggggauggcgcc

SEQ ID NO: 3073123 - RNA, 23 nt, Mycobacterium bovis subsp bovis AF2122/97
ggggauucgucgugcgggcgggc

SEQ ID NO: 3073124 - RNA, 18 nt, Mycobacterium bovis subsp bovis AF2122/97
ggggauuggugcccagcg

SEQ ID NO: 3073125 - RNA, 21 nt, Mycobacterium bovis subsp bovis AF2122/97
ggggauuuauugagucggcug

SEQ ID NO: 3073126 - RNA, 19 nt, Mycobacterium bovis subsp bovis AF2122/97
ggggauuucgcgucugcuc

SEQ ID NO: 3073127 - RNA, 20 nt, Mycobacterium bovis subsp bovis AF2122/97
ggggauuucgcgucugcucg

SEQ ID NO: 3073128 - RNA, 23 nt, Mycobacterium bovis subsp bovis AF2122/97
ggggauuucgcgucugcucgcca

SEQ ID NO: 3073129 - RNA, 17 nt, Mycobacterium bovis subsp bovis AF2122/97
ggggauuuugcgucugc

SEQ ID NO: 3073130 - RNA, 19 nt, Mycobacterium bovis subsp bovis AF2122/97
ggggauuuugcgucugcuc

SEQ ID NO: 3073131 - RNA, 21 nt, Mycobacterium bovis subsp bovis AF2122/97
ggggcaacuacgaaggccuau

SEQ ID NO: 3073132 - RNA, 16 nt, Mycobacterium bovis subsp bovis AF2122/97
ggggcaauugccugcg

SEQ ID NO: 3073133 - RNA, 17 nt, Mycobacterium bovis subsp bovis AF2122/97
ggggcaccacgccagcc

SEQ ID NO: 3073134 - RNA, 19 nt, Mycobacterium bovis subsp bovis AF2122/97
ggggcaccagcgaauccag

SEQ ID NO: 3073135 - RNA, 20 nt, Mycobacterium bovis subsp bovis AF2122/97
ggggcaccagcgaauccagc

SEQ ID NO: 3073136 - RNA, 20 nt, Mycobacterium bovis subsp bovis AF2122/97
ggggcaccguuaccgccguc

SEQ ID NO: 3073137 - RNA, 23 nt, Mycobacterium bovis subsp bovis AF2122/97
ggggcaccguuaccgccgucgcc

SEQ ID NO: 3073138 - RNA, 14 nt, Mycobacterium bovis subsp bovis AF2122/97
gggggcugcugcuc

SEQ ID NO: 3073139 - RNA, 15 nt, Mycobacterium bovis subsp bovis AF2122/97
gggggcugcugcucg

SEQ ID NO: 3073140 - RNA, 19 nt, Mycobacterium bovis subsp bovis AF2122/97
gggggcuuaugcgucugcu

SEQ ID NO: 3073141 - RNA, 20 nt, Mycobacterium bovis subsp bovis AF2122/97
gggggcuuaugcgucugcuc

SEQ ID NO: 3073142 - RNA, 21 nt, Mycobacterium bovis subsp bovis AF2122/97
gggggcuuauguguccgcucg

SEQ ID NO: 3073143 - RNA, 20 nt, Mycobacterium bovis subsp bovis AF2122/97
gggggcuucugcgucugcuc

SEQ ID NO: 3073144 - RNA, 19 nt, Mycobacterium bovis subsp bovis AF2122/97
gggggcuuuuacgucugcu

SEQ ID NO: 3073145 - RNA, 20 nt, Mycobacterium bovis subsp bovis AF2122/97
gggggcuuuuacgucugcuc

SEQ ID NO: 3073146 - RNA, 21 nt, Mycobacterium bovis subsp bovis AF2122/97
gggggcuuuuacgucugcucg

SEQ ID NO: 3073147 - RNA, 15 nt, Mycobacterium bovis subsp bovis AF2122/97
ggggguagccgccgg

SEQ ID NO: 3073148 - RNA, 16 nt, Mycobacterium bovis subsp bovis AF2122/97
ggggguagccgccggc

SEQ ID NO: 3073149 - RNA, 17 nt, Mycobacterium bovis subsp bovis AF2122/97
ggggguagccgccggcg

SEQ ID NO: 3073150 - RNA, 15 nt, Mycobacterium bovis subsp bovis AF2122/97
ggggguccggcggcc

SEQ ID NO: 3073151 - RNA, 17 nt, Mycobacterium bovis subsp bovis AF2122/97
ggggguccggcggccgc

SEQ ID NO: 3073152 - RNA, 18 nt, Mycobacterium bovis subsp bovis AF2122/97
ggggguccggcggccgcc

SEQ ID NO: 3073153 - RNA, 12 nt, Mycobacterium bovis subsp bovis AF2122/97
ggggguggcagc

SEQ ID NO: 3073154 - RNA, 16 nt, Mycobacterium bovis subsp bovis AF2122/97
ggggguggcagcgcgg

SEQ ID NO: 3073155 - RNA, 17 nt, Mycobacterium bovis subsp bovis AF2122/97
ggggguucuggccguag

SEQ ID NO: 3073156 - RNA, 19 nt, Mycobacterium bovis subsp bovis AF2122/97
ggggguugcggcagcuggc

SEQ ID NO: 3073157 - RNA, 23 nt, Mycobacterium bovis subsp bovis AF2122/97
gggguaauacgcggggccggccg

SEQ ID NO: 3073158 - RNA, 20 nt, Mycobacterium bovis subsp bovis AF2122/97
gggguaccucccgcuugcgg

SEQ ID NO: 3073159 - RNA, 19 nt, Mycobacterium bovis subsp bovis AF2122/97
gggguacugcggcucgcug

SEQ ID NO: 3073160 - RNA, 21 nt, Mycobacterium bovis subsp bovis AF2122/97
gggguagaccuucucgccgcc

SEQ ID NO: 3073161 - RNA, 13 nt, Mycobacterium bovis subsp bovis AF2122/97
gggguagccgccg

SEQ ID NO: 3073162 - RNA, 14 nt, Mycobacterium bovis subsp bovis AF2122/97
gggguagccgccgg

SEQ ID NO: 3073163 - RNA, 16 nt, Mycobacterium bovis subsp bovis AF2122/97
gggguagccgccggcg

SEQ ID NO: 3073164 - RNA, 22 nt, Mycobacterium bovis subsp bovis AF2122/97
gggguaucgacccuccagcacg

SEQ ID NO: 3073165 - RNA, 18 nt, Mycobacterium bovis subsp bovis AF2122/97
ggggucacccaucucgaa

SEQ ID NO: 3073166 - RNA, 15 nt, Mycobacterium bovis subsp bovis AF2122/97
ggggucaggcaggag

SEQ ID NO: 3073167 - RNA, 17 nt, Mycobacterium bovis subsp bovis AF2122/97
ggggucagugcgggcgg

SEQ ID NO: 3073168 - RNA, 23 nt, Mycobacterium bovis subsp bovis AF2122/97
ggggucagugcgggcggcgucug

SEQ ID NO: 3073169 - RNA, 16 nt, Mycobacterium bovis subsp bovis AF2122/97
ggggucccgccgggug

SEQ ID NO: 3073170 - RNA, 16 nt, Mycobacterium bovis subsp bovis AF2122/97
ggggucgaacagcucg

SEQ ID NO: 3073171 - RNA, 18 nt, Mycobacterium bovis subsp bovis AF2122/97
ggggucgcugugcagcgg

SEQ ID NO: 3073172 - RNA, 14 nt, Mycobacterium bovis subsp bovis AF2122/97
ggggucguucgccg

SEQ ID NO: 3073173 - RNA, 17 nt, Mycobacterium bovis subsp bovis AF2122/97
ggggucugauggcggcu

SEQ ID NO: 3073174 - RNA, 19 nt, Mycobacterium bovis subsp bovis AF2122/97
ggggucuugacggcgccag

SEQ ID NO: 3073175 - RNA, 20 nt, Mycobacterium bovis subsp bovis AF2122/97
ggggugaacgcggacaccgc

SEQ ID NO: 3073176 - RNA, 22 nt, Mycobacterium bovis subsp bovis AF2122/97
ggggugcacgccuugagccgag

SEQ ID NO: 3073177 - RNA, 17 nt, Mycobacterium bovis subsp bovis AF2122/97
ggggugcccggccgcca

SEQ ID NO: 3073178 - RNA, 20 nt, Mycobacterium bovis subsp bovis AF2122/97
ggggugcccggccgccagcg

SEQ ID NO: 3073179 - RNA, 11 nt, Mycobacterium bovis subsp bovis AF2122/97
ggggugccgau

SEQ ID NO: 3073180 - RNA, 14 nt, Mycobacterium bovis subsp bovis AF2122/97
ggggugcucggucg

SEQ ID NO: 3073181 - RNA, 13 nt, Mycobacterium bovis subsp bovis AF2122/97
ggggugcuuucgc

SEQ ID NO: 3073182 - RNA, 14 nt, Mycobacterium bovis subsp bovis AF2122/97
gggguggccaccag

SEQ ID NO: 3073183 - RNA, 13 nt, Mycobacterium bovis subsp bovis AF2122/97
gggguggcgcggg

SEQ ID NO: 3073184 - RNA, 22 nt, Mycobacterium bovis subsp bovis AF2122/97
ggggugguaccggcggcgccgg

SEQ ID NO: 3073185 - RNA, 14 nt, Mycobacterium bovis subsp bovis AF2122/97
ggggugugcggggu

SEQ ID NO: 3073186 - RNA, 23 nt, Mycobacterium bovis subsp bovis AF2122/97
ggggugugcgggguugggcggag

SEQ ID NO: 3073187 - RNA, 16 nt, Mycobacterium bovis subsp bovis AF2122/97
gggguguugaggccgg

SEQ ID NO: 3073188 - RNA, 18 nt, Mycobacterium bovis subsp bovis AF2122/97
gggguguugaggccggug

SEQ ID NO: 3073189 - RNA, 17 nt, Mycobacterium bovis subsp bovis AF2122/97
gggguugacuggccgcc

SEQ ID NO: 3073190 - RNA, 17 nt, Mycobacterium bovis subsp bovis AF2122/97
gggguugaucaccgaca

SEQ ID NO: 3073191 - RNA, 15 nt, Mycobacterium bovis subsp bovis AF2122/97
gggguugcggcagcu

SEQ ID NO: 3073192 - RNA, 17 nt, Mycobacterium bovis subsp bovis AF2122/97
gggguuggcucggcgca

SEQ ID NO: 3073193 - RNA, 12 nt, Mycobacterium bovis subsp bovis AF2122/97
ggguaacguguu

SEQ ID NO: 3073194 - RNA, 16 nt, Mycobacterium bovis subsp bovis AF2122/97
ggguaacguguucacg

SEQ ID NO: 3073195 - RNA, 21 nt, Mycobacterium bovis subsp bovis AF2122/97
ggguaagaguucgcgcgccgc

SEQ ID NO: 3073196 - RNA, 16 nt, Mycobacterium bovis subsp bovis AF2122/97
ggguacacccgcucgc

SEQ ID NO: 3073197 - RNA, 16 nt, Mycobacterium bovis subsp bovis AF2122/97
ggguacaggcugcugc

SEQ ID NO: 3073198 - RNA, 17 nt, Mycobacterium bovis subsp bovis AF2122/97
ggguaccacgcuggcgc

SEQ ID NO: 3073199 - RNA, 11 nt, Mycobacterium bovis subsp bovis AF2122/97
ggguaccuccc

SEQ ID NO: 3073200 - RNA, 18 nt, Mycobacterium bovis subsp bovis AF2122/97
ggguacgacaccgcagcg

SEQ ID NO: 3073201 - RNA, 24 nt, Mycobacterium bovis subsp bovis AF2122/97
ggguacgacaccgcagcgggcggu

SEQ ID NO: 3073202 - RNA, 16 nt, Mycobacterium bovis subsp bovis AF2122/97
ggguacgcaucucgag

SEQ ID NO: 3073203 - RNA, 14 nt, Mycobacterium bovis subsp bovis AF2122/97
ggguacgccgggca

SEQ ID NO: 3073204 - RNA, 24 nt, Mycobacterium bovis subsp bovis AF2122/97
ggguacgucaccggguccggugaa

SEQ ID NO: 3073205 - RNA, 16 nt, Mycobacterium bovis subsp bovis AF2122/97
ggguagaccuucucgc

SEQ ID NO: 3073206 - RNA, 22 nt, Mycobacterium bovis subsp bovis AF2122/97
ggguagaccuucucgccgccgc

SEQ ID NO: 3073207 - RNA, 14 nt, Mycobacterium bovis subsp bovis AF2122/97
ggguagauccgccg

SEQ ID NO: 3073208 - RNA, 20 nt, Mycobacterium bovis subsp bovis AF2122/97
ggguagauguucacgccgcc

SEQ ID NO: 3073209 - RNA, 21 nt, Mycobacterium bovis subsp bovis AF2122/97
ggguagauguucacgccgccg

SEQ ID NO: 3073210 - RNA, 23 nt, Mycobacterium bovis subsp bovis AF2122/97
ggguagccaucggcuaggccggc

SEQ ID NO: 3073211 - RNA, 16 nt, Mycobacterium bovis subsp bovis AF2122/97
ggguagccgcccagcg

SEQ ID NO: 3073212 - RNA, 17 nt, Mycobacterium bovis subsp bovis AF2122/97
ggguagccgccggcgcc

SEQ ID NO: 3073213 - RNA, 19 nt, Mycobacterium bovis subsp bovis AF2122/97
ggguagccgccggcgccga

SEQ ID NO: 3073214 - RNA, 15 nt, Mycobacterium bovis subsp bovis AF2122/97
ggguagcggaucaag

SEQ ID NO: 3073215 - RNA, 12 nt, Mycobacterium bovis subsp bovis AF2122/97
ggguagcggcgc

SEQ ID NO: 3073216 - RNA, 13 nt, Mycobacterium bovis subsp bovis AF2122/97
ggguagcggcgcc

SEQ ID NO: 3073217 - RNA, 16 nt, Mycobacterium bovis subsp bovis AF2122/97
ggguagcggcgccgcc

SEQ ID NO: 3073218 - RNA, 21 nt, Mycobacterium bovis subsp bovis AF2122/97
ggguagcugccgcggccggcg

SEQ ID NO: 3073219 - RNA, 19 nt, Mycobacterium bovis subsp bovis AF2122/97
ggguaggcaauggcgugcg

SEQ ID NO: 3073220 - RNA, 13 nt, Mycobacterium bovis subsp bovis AF2122/97
ggguaggcuccca

SEQ ID NO: 3073221 - RNA, 14 nt, Mycobacterium bovis subsp bovis AF2122/97
ggguaucgccagcc

SEQ ID NO: 3073222 - RNA, 14 nt, Mycobacterium bovis subsp bovis AF2122/97
ggguauggcggcga

SEQ ID NO: 3073223 - RNA, 12 nt, Mycobacterium bovis subsp bovis AF2122/97
gggucaaccggu

SEQ ID NO: 3073224 - RNA, 20 nt, Mycobacterium bovis subsp bovis AF2122/97
gggucaaucccacgcccggc

SEQ ID NO: 3073225 - RNA, 19 nt, Mycobacterium bovis subsp bovis AF2122/97
gggucacaaacccagcauc

SEQ ID NO: 3073226 - RNA, 21 nt, Mycobacterium bovis subsp bovis AF2122/97
gggucacaaacccagcaucgg

SEQ ID NO: 3073227 - RNA, 20 nt, Mycobacterium bovis subsp bovis AF2122/97
gggucaccagcgcaucggcc

SEQ ID NO: 3073228 - RNA, 19 nt, Mycobacterium bovis subsp bovis AF2122/97
gggucaccgauucggccag

SEQ ID NO: 3073229 - RNA, 15 nt, Mycobacterium bovis subsp bovis AF2122/97
gggucacgaccugcu

SEQ ID NO: 3073230 - RNA, 22 nt, Mycobacterium bovis subsp bovis AF2122/97
gggucagacaacaacacggggc

SEQ ID NO: 3073231 - RNA, 16 nt, Mycobacterium bovis subsp bovis AF2122/97
gggucagcccagccaa

SEQ ID NO: 3073232 - RNA, 12 nt, Mycobacterium bovis subsp bovis AF2122/97
gggucagcgccg

SEQ ID NO: 3073233 - RNA, 16 nt, Mycobacterium bovis subsp bovis AF2122/97
gggucagcgccgcgcc

SEQ ID NO: 3073234 - RNA, 23 nt, Mycobacterium bovis subsp bovis AF2122/97
gggucagcgcguauggcucaccc

SEQ ID NO: 3073235 - RNA, 15 nt, Mycobacterium bovis subsp bovis AF2122/97
gggucagcucgguga

SEQ ID NO: 3073236 - RNA, 15 nt, Mycobacterium bovis subsp bovis AF2122/97
gggucaggaucgcaa

SEQ ID NO: 3073237 - RNA, 13 nt, Mycobacterium bovis subsp bovis AF2122/97
gggucaggccagg

SEQ ID NO: 3073238 - RNA, 15 nt, Mycobacterium bovis subsp bovis AF2122/97
gggucaggccagggu

SEQ ID NO: 3073239 - RNA, 14 nt, Mycobacterium bovis subsp bovis AF2122/97
gggucaggccgacg

SEQ ID NO: 3073240 - RNA, 15 nt, Mycobacterium bovis subsp bovis AF2122/97
gggucaggccgacgu

SEQ ID NO: 3073241 - RNA, 20 nt, Mycobacterium bovis subsp bovis AF2122/97
gggucagguugucggcgauc

SEQ ID NO: 3073242 - RNA, 17 nt, Mycobacterium bovis subsp bovis AF2122/97
gggucaguaggcggauc

SEQ ID NO: 3073243 - RNA, 19 nt, Mycobacterium bovis subsp bovis AF2122/97
gggucagugcgaugcggug

SEQ ID NO: 3073244 - RNA, 16 nt, Mycobacterium bovis subsp bovis AF2122/97
gggucaucgccagcgg

SEQ ID NO: 3073245 - RNA, 18 nt, Mycobacterium bovis subsp bovis AF2122/97
gggucaucgccagcggca

SEQ ID NO: 3073246 - RNA, 12 nt, Mycobacterium bovis subsp bovis AF2122/97
gggucaugccgu

SEQ ID NO: 3073247 - RNA, 22 nt, Mycobacterium bovis subsp bovis AF2122/97
gggucaugucgaucagcgcgac

SEQ ID NO: 3073248 - RNA, 18 nt, Mycobacterium bovis subsp bovis AF2122/97
ggguccaacccgcgauuc

SEQ ID NO: 3073249 - RNA, 20 nt, Mycobacterium bovis subsp bovis AF2122/97
ggguccacaacgcccgcauc

SEQ ID NO: 3073250 - RNA, 19 nt, Mycobacterium bovis subsp bovis AF2122/97
ggguccagcccggaacccg

SEQ ID NO: 3073251 - RNA, 22 nt, Mycobacterium bovis subsp bovis AF2122/97
ggguccagcccggaacccgagc

SEQ ID NO: 3073252 - RNA, 14 nt, Mycobacterium bovis subsp bovis AF2122/97
ggguccagcgagga

SEQ ID NO: 3073253 - RNA, 16 nt, Mycobacterium bovis subsp bovis AF2122/97
ggguccaucggggccg

SEQ ID NO: 3073254 - RNA, 22 nt, Mycobacterium bovis subsp bovis AF2122/97
gggucccaaucgucggccagca

SEQ ID NO: 3073255 - RNA, 20 nt, Mycobacterium bovis subsp bovis AF2122/97
ggguccccguaaauaucggg

SEQ ID NO: 3073256 - RNA, 12 nt, Mycobacterium bovis subsp bovis AF2122/97
gggucccgccgc

SEQ ID NO: 3073257 - RNA, 17 nt, Mycobacterium bovis subsp bovis AF2122/97
ggguccgacgggccacg

SEQ ID NO: 3073258 - RNA, 17 nt, Mycobacterium bovis subsp bovis AF2122/97
ggguccgccgggccccg

SEQ ID NO: 3073259 - RNA, 13 nt, Mycobacterium bovis subsp bovis AF2122/97
ggguccgcggaga

SEQ ID NO: 3073260 - RNA, 16 nt, Mycobacterium bovis subsp bovis AF2122/97
ggguccggcggccgcc

SEQ ID NO: 3073261 - RNA, 17 nt, Mycobacterium bovis subsp bovis AF2122/97
ggguccggcggccgcca

SEQ ID NO: 3073262 - RNA, 13 nt, Mycobacterium bovis subsp bovis AF2122/97
ggguccgggccaa

SEQ ID NO: 3073263 - RNA, 16 nt, Mycobacterium bovis subsp bovis AF2122/97
ggguccgggcggccgc

SEQ ID NO: 3073264 - RNA, 21 nt, Mycobacterium bovis subsp bovis AF2122/97
ggguccgucgagucgccgagg

SEQ ID NO: 3073265 - RNA, 23 nt, Mycobacterium bovis subsp bovis AF2122/97
ggguccguuuuaccucggccgcc

SEQ ID NO: 3073266 - RNA, 19 nt, Mycobacterium bovis subsp bovis AF2122/97
ggguccucgagcggcagau

SEQ ID NO: 3073267 - RNA, 18 nt, Mycobacterium bovis subsp bovis AF2122/97
gggucgaacaggccggcc

SEQ ID NO: 3073268 - RNA, 22 nt, Mycobacterium bovis subsp bovis AF2122/97
gggucgaacaggccggccgcga

SEQ ID NO: 3073269 - RNA, 18 nt, Mycobacterium bovis subsp bovis AF2122/97
gggucgaacaugauccgc

SEQ ID NO: 3073270 - RNA, 16 nt, Mycobacterium bovis subsp bovis AF2122/97
gggucgaagcgauccg

SEQ ID NO: 3073271 - RNA, 16 nt, Mycobacterium bovis subsp bovis AF2122/97
gggucgaccccggcca

SEQ ID NO: 3073272 - RNA, 17 nt, Mycobacterium bovis subsp bovis AF2122/97
gggucgaccccggccag

SEQ ID NO: 3073273 - RNA, 22 nt, Mycobacterium bovis subsp bovis AF2122/97
gggucgacguaggacugccagc

SEQ ID NO: 3073274 - RNA, 18 nt, Mycobacterium bovis subsp bovis AF2122/97
gggucgaucaccgacacc

SEQ ID NO: 3073275 - RNA, 12 nt, Mycobacterium bovis subsp bovis AF2122/97
gggucgcaaccg

SEQ ID NO: 3073276 - RNA, 18 nt, Mycobacterium bovis subsp bovis AF2122/97
gggucgcaaccgccgcca

SEQ ID NO: 3073277 - RNA, 20 nt, Mycobacterium bovis subsp bovis AF2122/97
gggucgcaaccgccgccauu

SEQ ID NO: 3073278 - RNA, 19 nt, Mycobacterium bovis subsp bovis AF2122/97
gggucgcaccccggcggcg

SEQ ID NO: 3073279 - RNA, 14 nt, Mycobacterium bovis subsp bovis AF2122/97
gggucgccgccauc

SEQ ID NO: 3073280 - RNA, 22 nt, Mycobacterium bovis subsp bovis AF2122/97
gggucgccgccaucagcccuuc

SEQ ID NO: 3073281 - RNA, 14 nt, Mycobacterium bovis subsp bovis AF2122/97
gggucgccggcacc

SEQ ID NO: 3073282 - RNA, 13 nt, Mycobacterium bovis subsp bovis AF2122/97
gggucgccgucga

SEQ ID NO: 3073283 - RNA, 19 nt, Mycobacterium bovis subsp bovis AF2122/97
gggucgccuccugccgccg

SEQ ID NO: 3073284 - RNA, 21 nt, Mycobacterium bovis subsp bovis AF2122/97
gggucgccuccugccgccgcu

SEQ ID NO: 3073285 - RNA, 12 nt, Mycobacterium bovis subsp bovis AF2122/97
gggucgcgcugg

SEQ ID NO: 3073286 - RNA, 18 nt, Mycobacterium bovis subsp bovis AF2122/97
gggucgcgcuggcgccgg

SEQ ID NO: 3073287 - RNA, 18 nt, Mycobacterium bovis subsp bovis AF2122/97
gggucgcggcuauggcgc

SEQ ID NO: 3073288 - RNA, 21 nt, Mycobacterium bovis subsp bovis AF2122/97
gggucgcgggguaggcccagc

SEQ ID NO: 3073289 - RNA, 12 nt, Mycobacterium bovis subsp bovis AF2122/97
gggucgcggugu

SEQ ID NO: 3073290 - RNA, 14 nt, Mycobacterium bovis subsp bovis AF2122/97
gggucgcugccgcc

SEQ ID NO: 3073291 - RNA, 15 nt, Mycobacterium bovis subsp bovis AF2122/97
gggucgcugccgccg

SEQ ID NO: 3073292 - RNA, 13 nt, Mycobacterium bovis subsp bovis AF2122/97
gggucgcugccgg

SEQ ID NO: 3073293 - RNA, 14 nt, Mycobacterium bovis subsp bovis AF2122/97
gggucgcugccggc

SEQ ID NO: 3073294 - RNA, 16 nt, Mycobacterium bovis subsp bovis AF2122/97
gggucggcacgacccg

SEQ ID NO: 3073295 - RNA, 20 nt, Mycobacterium bovis subsp bovis AF2122/97
gggucggcauugaucggugc

SEQ ID NO: 3073296 - RNA, 15 nt, Mycobacterium bovis subsp bovis AF2122/97
gggucggcccgccaa

SEQ ID NO: 3073297 - RNA, 23 nt, Mycobacterium bovis subsp bovis AF2122/97
gggucggccggguugcccuggug

SEQ ID NO: 3073298 - RNA, 18 nt, Mycobacterium bovis subsp bovis AF2122/97
gggucggccugcggcacc

SEQ ID NO: 3073299 - RNA, 19 nt, Mycobacterium bovis subsp bovis AF2122/97
gggucggccugcggcaccg

SEQ ID NO: 3073300 - RNA, 12 nt, Mycobacterium bovis subsp bovis AF2122/97
gggucggcgaug

SEQ ID NO: 3073301 - RNA, 16 nt, Mycobacterium bovis subsp bovis AF2122/97
gggucggcgauggcgg

SEQ ID NO: 3073302 - RNA, 12 nt, Mycobacterium bovis subsp bovis AF2122/97
gggucggcgccg

SEQ ID NO: 3073303 - RNA, 17 nt, Mycobacterium bovis subsp bovis AF2122/97
gggucggcuuccggugc

SEQ ID NO: 3073304 - RNA, 20 nt, Mycobacterium bovis subsp bovis AF2122/97
gggucggcuuccggugccgg

SEQ ID NO: 3073305 - RNA, 18 nt, Mycobacterium bovis subsp bovis AF2122/97
gggucgggacgcugccgg

SEQ ID NO: 3073306 - RNA, 22 nt, Mycobacterium bovis subsp bovis AF2122/97
gggucgggcaaccugccgggcc

SEQ ID NO: 3073307 - RNA, 20 nt, Mycobacterium bovis subsp bovis AF2122/97
gggucggggaagacgaccgu

SEQ ID NO: 3073308 - RNA, 17 nt, Mycobacterium bovis subsp bovis AF2122/97
gggucgggguccgcggc

SEQ ID NO: 3073309 - RNA, 21 nt, Mycobacterium bovis subsp bovis AF2122/97
gggucggucacgacggcacgc

SEQ ID NO: 3073310 - RNA, 21 nt, Mycobacterium bovis subsp bovis AF2122/97
gggucggucgguaacggcggu

SEQ ID NO: 3073311 - RNA, 17 nt, Mycobacterium bovis subsp bovis AF2122/97
gggucgguugcuccugg

SEQ ID NO: 3073312 - RNA, 14 nt, Mycobacterium bovis subsp bovis AF2122/97
ggguggcgcgggcc

SEQ ID NO: 3073313 - RNA, 15 nt, Mycobacterium bovis subsp bovis AF2122/97
ggguggcgcgguacc

SEQ ID NO: 3073314 - RNA, 11 nt, Mycobacterium bovis subsp bovis AF2122/97
ggguggcggcg

SEQ ID NO: 3073315 - RNA, 12 nt, Mycobacterium bovis subsp bovis AF2122/97
ggguggcggcgc

SEQ ID NO: 3073316 - RNA, 17 nt, Mycobacterium bovis subsp bovis AF2122/97
ggguggcggcgcugcgc

SEQ ID NO: 3073317 - RNA, 14 nt, Mycobacterium bovis subsp bovis AF2122/97
ggguggcgguccgg

SEQ ID NO: 3073318 - RNA, 19 nt, Mycobacterium bovis subsp bovis AF2122/97
ggguggcgucaccgccggu

SEQ ID NO: 3073319 - RNA, 12 nt, Mycobacterium bovis subsp bovis AF2122/97
ggguggcgucgc

SEQ ID NO: 3073320 - RNA, 14 nt, Mycobacterium bovis subsp bovis AF2122/97
ggguggcgucgcgg

SEQ ID NO: 3073321 - RNA, 14 nt, Mycobacterium bovis subsp bovis AF2122/97
ggguggcugcuggc

SEQ ID NO: 3073322 - RNA, 22 nt, Mycobacterium bovis subsp bovis AF2122/97
gggugggcaagcugaccgccag

SEQ ID NO: 3073323 - RNA, 17 nt, Mycobacterium bovis subsp bovis AF2122/97
gggugggccagugaaac

SEQ ID NO: 3073324 - RNA, 20 nt, Mycobacterium bovis subsp bovis AF2122/97
gggugggucggcuuccggug

SEQ ID NO: 3073325 - RNA, 11 nt, Mycobacterium bovis subsp bovis AF2122/97
gggugggugca

SEQ ID NO: 3073326 - RNA, 13 nt, Mycobacterium bovis subsp bovis AF2122/97
gggugguccagcc

SEQ ID NO: 3073327 - RNA, 18 nt, Mycobacterium bovis subsp bovis AF2122/97
ggguggugucgcggccgc

SEQ ID NO: 3073328 - RNA, 19 nt, Mycobacterium bovis subsp bovis AF2122/97
gggugguuguucggccauc

SEQ ID NO: 3073329 - RNA, 20 nt, Mycobacterium bovis subsp bovis AF2122/97
ggguguagcaagucgccgag

SEQ ID NO: 3073330 - RNA, 13 nt, Mycobacterium bovis subsp bovis AF2122/97
ggguguccgucga

SEQ ID NO: 3073331 - RNA, 16 nt, Mycobacterium bovis subsp bovis AF2122/97
gggugucgaagagcag

SEQ ID NO: 3073332 - RNA, 17 nt, Mycobacterium bovis subsp bovis AF2122/97
gggugucggcgaagcgg

SEQ ID NO: 3073333 - RNA, 23 nt, Mycobacterium bovis subsp bovis AF2122/97
gggugugcgggcggugcacaccg

SEQ ID NO: 3073334 - RNA, 16 nt, Mycobacterium bovis subsp bovis AF2122/97
gggugugugcugccgc

SEQ ID NO: 3073335 - RNA, 18 nt, Mycobacterium bovis subsp bovis AF2122/97
ggguguucgcgcgcgacu

SEQ ID NO: 3073336 - RNA, 16 nt, Mycobacterium bovis subsp bovis AF2122/97
ggguguugaggccggu

SEQ ID NO: 3073337 - RNA, 20 nt, Mycobacterium bovis subsp bovis AF2122/97
ggguguugaugggcagccgc

SEQ ID NO: 3073338 - RNA, 18 nt, Mycobacterium bovis subsp bovis AF2122/97
ggguguugcuggccgcga

SEQ ID NO: 3073339 - RNA, 20 nt, Mycobacterium bovis subsp bovis AF2122/97
ggguguugucgucgagcgcg

SEQ ID NO: 3073340 - RNA, 21 nt, Mycobacterium bovis subsp bovis AF2122/97
ggguguugucgucgagcgcgc

SEQ ID NO: 3073341 - RNA, 18 nt, Mycobacterium bovis subsp bovis AF2122/97
ggguguuugucgcggugg

SEQ ID NO: 3073342 - RNA, 16 nt, Mycobacterium bovis subsp bovis AF2122/97
ggguuaucggcagcag

SEQ ID NO: 3073343 - RNA, 18 nt, Mycobacterium bovis subsp bovis AF2122/97
ggguucacguucggugga

SEQ ID NO: 3073344 - RNA, 13 nt, Mycobacterium bovis subsp bovis AF2122/97
ggguuccacaccc

SEQ ID NO: 3073345 - RNA, 18 nt, Mycobacterium bovis subsp bovis AF2122/97
ggguuccacuccccagcc

SEQ ID NO: 3073346 - RNA, 19 nt, Mycobacterium bovis subsp bovis AF2122/97
ggguucgccgaagccggac

SEQ ID NO: 3073347 - RNA, 14 nt, Mycobacterium bovis subsp bovis AF2122/97
ggguucgcgucuga

SEQ ID NO: 3073348 - RNA, 13 nt, Mycobacterium bovis subsp bovis AF2122/97
ggguucgcucugg

SEQ ID NO: 3073349 - RNA, 19 nt, Mycobacterium bovis subsp bovis AF2122/97
ggguucuuccacagcgcgu

SEQ ID NO: 3073350 - RNA, 20 nt, Mycobacterium bovis subsp bovis AF2122/97
ggguucuucgacgcggcgga

SEQ ID NO: 3073351 - RNA, 19 nt, Mycobacterium bovis subsp bovis AF2122/97
ggguucuuuaccgaugugg

SEQ ID NO: 3073352 - RNA, 14 nt, Mycobacterium bovis subsp bovis AF2122/97
ggguugaccgccac

SEQ ID NO: 3073353 - RNA, 18 nt, Mycobacterium bovis subsp bovis AF2122/97
ggguugaccgccaccccg

SEQ ID NO: 3073354 - RNA, 19 nt, Mycobacterium bovis subsp bovis AF2122/97
ggguugacguaggcggcgg

SEQ ID NO: 3073355 - RNA, 14 nt, Mycobacterium bovis subsp bovis AF2122/97
ggguugacuggccg

SEQ ID NO: 3073356 - RNA, 24 nt, Mycobacterium bovis subsp bovis AF2122/97
ggguugaggaucccggccgggucg

SEQ ID NO: 3073357 - RNA, 16 nt, Mycobacterium bovis subsp bovis AF2122/97
ggguugaucgcgcuga

SEQ ID NO: 3073358 - RNA, 21 nt, Mycobacterium bovis subsp bovis AF2122/97
ggguugccaucaaggccaccu

SEQ ID NO: 3073359 - RNA, 16 nt, Mycobacterium bovis subsp bovis AF2122/97
ggguugcggucaccgg

SEQ ID NO: 3073360 - RNA, 15 nt, Mycobacterium bovis subsp bovis AF2122/97
ggguuggccggcgcu

SEQ ID NO: 3073361 - RNA, 12 nt, Mycobacterium bovis subsp bovis AF2122/97
ggguuggucccg

SEQ ID NO: 3073362 - RNA, 17 nt, Mycobacterium bovis subsp bovis AF2122/97
ggguuucgaucuucucg

SEQ ID NO: 3073363 - RNA, 21 nt, Mycobacterium bovis subsp bovis AF2122/97
ggguuuugauagacgacccgg

SEQ ID NO: 3073364 - RNA, 14 nt, Mycobacterium bovis subsp bovis AF2122/97
gguaaagcgauggg

SEQ ID NO: 3073365 - RNA, 14 nt, Mycobacterium bovis subsp bovis AF2122/97
gguaacaccggcga

SEQ ID NO: 3073366 - RNA, 21 nt, Mycobacterium bovis subsp bovis AF2122/97
gguaacacucgaagucgccca

SEQ ID NO: 3073367 - RNA, 19 nt, Mycobacterium bovis subsp bovis AF2122/97
gguaaccagggcagccggg

SEQ ID NO: 3073368 - RNA, 20 nt, Mycobacterium bovis subsp bovis AF2122/97
gguaaccauauggcccgcga

SEQ ID NO: 3073369 - RNA, 20 nt, Mycobacterium bovis subsp bovis AF2122/97
gguaaccggcccgaugaccg

SEQ ID NO: 3073370 - RNA, 15 nt, Mycobacterium bovis subsp bovis AF2122/97
gguaaccggcggauu

SEQ ID NO: 3073371 - RNA, 14 nt, Mycobacterium bovis subsp bovis AF2122/97
gguaacgccaacac

SEQ ID NO: 3073372 - RNA, 15 nt, Mycobacterium bovis subsp bovis AF2122/97
gguaacgccaacacc

SEQ ID NO: 3073373 - RNA, 19 nt, Mycobacterium bovis subsp bovis AF2122/97
gguaacgccaacaccggca

SEQ ID NO: 3073374 - RNA, 20 nt, Mycobacterium bovis subsp bovis AF2122/97
gguaacgguccucgaaacgc

SEQ ID NO: 3073375 - RNA, 22 nt, Mycobacterium bovis subsp bovis AF2122/97
gguaacucgaguagucgcuggc

SEQ ID NO: 3073376 - RNA, 11 nt, Mycobacterium bovis subsp bovis AF2122/97
gguaacugucc

SEQ ID NO: 3073377 - RNA, 15 nt, Mycobacterium bovis subsp bovis AF2122/97
gguaagaaucgaagc

SEQ ID NO: 3073378 - RNA, 17 nt, Mycobacterium bovis subsp bovis AF2122/97
gguaagaguucgcgcgc

SEQ ID NO: 3073379 - RNA, 22 nt, Mycobacterium bovis subsp bovis AF2122/97
gguaagaguucgcgcgccgcga

SEQ ID NO: 3073380 - RNA, 16 nt, Mycobacterium bovis subsp bovis AF2122/97
gguaagcgagucgacg

SEQ ID NO: 3073381 - RNA, 20 nt, Mycobacterium bovis subsp bovis AF2122/97
gguaaguacuagccggucgg

SEQ ID NO: 3073382 - RNA, 17 nt, Mycobacterium bovis subsp bovis AF2122/97
gguaauacgcggggccg

SEQ ID NO: 3073383 - RNA, 20 nt, Mycobacterium bovis subsp bovis AF2122/97
gguaauacgcggggccggcc

SEQ ID NO: 3073384 - RNA, 14 nt, Mycobacterium bovis subsp bovis AF2122/97
gguaaucaccuggc

SEQ ID NO: 3073385 - RNA, 16 nt, Mycobacterium bovis subsp bovis AF2122/97
gguaauccggcugccg

SEQ ID NO: 3073386 - RNA, 13 nt, Mycobacterium bovis subsp bovis AF2122/97
gguaauccgggca

SEQ ID NO: 3073387 - RNA, 14 nt, Mycobacterium bovis subsp bovis AF2122/97
gguaaugccagcgg

SEQ ID NO: 3073388 - RNA, 16 nt, Mycobacterium bovis subsp bovis AF2122/97
gguaaugguggcgucc

SEQ ID NO: 3073389 - RNA, 13 nt, Mycobacterium bovis subsp bovis AF2122/97
gguacacccgcuc

SEQ ID NO: 3073390 - RNA, 17 nt, Mycobacterium bovis subsp bovis AF2122/97
gguacacccgcucgccc

SEQ ID NO: 3073391 - RNA, 20 nt, Mycobacterium bovis subsp bovis AF2122/97
gguacacccgcucgcccgcc

SEQ ID NO: 3073392 - RNA, 13 nt, Mycobacterium bovis subsp bovis AF2122/97
gguacacguccag

SEQ ID NO: 3073393 - RNA, 15 nt, Mycobacterium bovis subsp bovis AF2122/97
gguacauccagagac

SEQ ID NO: 3073394 - RNA, 22 nt, Mycobacterium bovis subsp bovis AF2122/97
gguacaucccggugucgaugcg

SEQ ID NO: 3073395 - RNA, 15 nt, Mycobacterium bovis subsp bovis AF2122/97
gguaccaaccugcgc

SEQ ID NO: 3073396 - RNA, 16 nt, Mycobacterium bovis subsp bovis AF2122/97
gguaccaaccugcgcg

SEQ ID NO: 3073397 - RNA, 17 nt, Mycobacterium bovis subsp bovis AF2122/97
gguaccaaccugcgcgg

SEQ ID NO: 3073398 - RNA, 20 nt, Mycobacterium bovis subsp bovis AF2122/97
gguaccaaccugcgcggcga

SEQ ID NO: 3073399 - RNA, 15 nt, Mycobacterium bovis subsp bovis AF2122/97
ggucaccccuucgcc

SEQ ID NO: 3073400 - RNA, 17 nt, Mycobacterium bovis subsp bovis AF2122/97
ggucacccgcaggucga

SEQ ID NO: 3073401 - RNA, 17 nt, Mycobacterium bovis subsp bovis AF2122/97
ggucacccgguagacgu

SEQ ID NO: 3073402 - RNA, 18 nt, Mycobacterium bovis subsp bovis AF2122/97
ggucaccgaacgacccug

SEQ ID NO: 3073403 - RNA, 23 nt, Mycobacterium bovis subsp bovis AF2122/97
ggucaccgaagaacaguugcccg

SEQ ID NO: 3073404 - RNA, 14 nt, Mycobacterium bovis subsp bovis AF2122/97
ggucaccgacacgg

SEQ ID NO: 3073405 - RNA, 20 nt, Mycobacterium bovis subsp bovis AF2122/97
ggucaccgauucggccagcg

SEQ ID NO: 3073406 - RNA, 21 nt, Mycobacterium bovis subsp bovis AF2122/97
ggucaccgauucggccagcgc

SEQ ID NO: 3073407 - RNA, 12 nt, Mycobacterium bovis subsp bovis AF2122/97
ggucaccgcgca

SEQ ID NO: 3073408 - RNA, 17 nt, Mycobacterium bovis subsp bovis AF2122/97
ggucaccggagagccgg

SEQ ID NO: 3073409 - RNA, 21 nt, Mycobacterium bovis subsp bovis AF2122/97
ggucaccggcacgucgccccc

SEQ ID NO: 3073410 - RNA, 14 nt, Mycobacterium bovis subsp bovis AF2122/97
ggucaccggccgcc

SEQ ID NO: 3073411 - RNA, 16 nt, Mycobacterium bovis subsp bovis AF2122/97
ggucaccggccgccga

SEQ ID NO: 3073412 - RNA, 20 nt, Mycobacterium bovis subsp bovis AF2122/97
ggucaccggcgaccggugcc

SEQ ID NO: 3073413 - RNA, 16 nt, Mycobacterium bovis subsp bovis AF2122/97
ggucaccggucaccgc

SEQ ID NO: 3073414 - RNA, 18 nt, Mycobacterium bovis subsp bovis AF2122/97
ggucaccgucugcaccgg

SEQ ID NO: 3073415 - RNA, 17 nt, Mycobacterium bovis subsp bovis AF2122/97
ggucaccucgucgccua

SEQ ID NO: 3073416 - RNA, 13 nt, Mycobacterium bovis subsp bovis AF2122/97
ggucaccugcugc

SEQ ID NO: 3073417 - RNA, 12 nt, Mycobacterium bovis subsp bovis AF2122/97
ggucaccuucuu

SEQ ID NO: 3073418 - RNA, 23 nt, Mycobacterium bovis subsp bovis AF2122/97
ggucaccuucuuggcgggugacu

SEQ ID NO: 3073419 - RNA, 15 nt, Mycobacterium bovis subsp bovis AF2122/97
ggucaccuuggccgg

SEQ ID NO: 3073420 - RNA, 20 nt, Mycobacterium bovis subsp bovis AF2122/97
ggucacgaagaccaggccgg

SEQ ID NO: 3073421 - RNA, 18 nt, Mycobacterium bovis subsp bovis AF2122/97
ggucacgacggcacgcca

SEQ ID NO: 3073422 - RNA, 16 nt, Mycobacterium bovis subsp bovis AF2122/97
ggucacgcagcacccu

SEQ ID NO: 3073423 - RNA, 17 nt, Mycobacterium bovis subsp bovis AF2122/97
ggucacgcagucgggca

SEQ ID NO: 3073424 - RNA, 19 nt, Mycobacterium bovis subsp bovis AF2122/97
ggucacgcagucgggcagc

SEQ ID NO: 3073425 - RNA, 15 nt, Mycobacterium bovis subsp bovis AF2122/97
ggucacgcgaggcga

SEQ ID NO: 3073426 - RNA, 21 nt, Mycobacterium bovis subsp bovis AF2122/97
ggucacgguucgcccgucgcc

SEQ ID NO: 3073427 - RNA, 14 nt, Mycobacterium bovis subsp bovis AF2122/97
ggucacguccgcgg

SEQ ID NO: 3073428 - RNA, 19 nt, Mycobacterium bovis subsp bovis AF2122/97
ggucacgucgaugagucgg

SEQ ID NO: 3073429 - RNA, 20 nt, Mycobacterium bovis subsp bovis AF2122/97
ggucacuacuccggucccgc

SEQ ID NO: 3073430 - RNA, 16 nt, Mycobacterium bovis subsp bovis AF2122/97
ggucacuccggcggcu

SEQ ID NO: 3073431 - RNA, 13 nt, Mycobacterium bovis subsp bovis AF2122/97
ggucacucuggcg

SEQ ID NO: 3073432 - RNA, 17 nt, Mycobacterium bovis subsp bovis AF2122/97
ggucacugugacgccgg

SEQ ID NO: 3073433 - RNA, 12 nt, Mycobacterium bovis subsp bovis AF2122/97
ggucagcaccac

SEQ ID NO: 3073434 - RNA, 18 nt, Mycobacterium bovis subsp bovis AF2122/97
ggucagcacccaacccgg

SEQ ID NO: 3073435 - RNA, 22 nt, Mycobacterium bovis subsp bovis AF2122/97
ggucagcacccaacccggcggc

SEQ ID NO: 3073436 - RNA, 16 nt, Mycobacterium bovis subsp bovis AF2122/97
ggucagcaccggcgcg

SEQ ID NO: 3073437 - RNA, 21 nt, Mycobacterium bovis subsp bovis AF2122/97
ggucagcacgcugaccacaac

SEQ ID NO: 3073438 - RNA, 18 nt, Mycobacterium bovis subsp bovis AF2122/97
ggucagcagauccgcgau

SEQ ID NO: 3073439 - RNA, 11 nt, Mycobacterium bovis subsp bovis AF2122/97
ggucagcagcg

SEQ ID NO: 3073440 - RNA, 14 nt, Mycobacterium bovis subsp bovis AF2122/97
ggucagcagcgccg

SEQ ID NO: 3073441 - RNA, 12 nt, Mycobacterium bovis subsp bovis AF2122/97
ggucagcagcuc

SEQ ID NO: 3073442 - RNA, 20 nt, Mycobacterium bovis subsp bovis AF2122/97
ggucagcagcuccacuggcg

SEQ ID NO: 3073443 - RNA, 14 nt, Mycobacterium bovis subsp bovis AF2122/97
ggucagccgauggg

SEQ ID NO: 3073444 - RNA, 15 nt, Mycobacterium bovis subsp bovis AF2122/97
ggucagccgcggcgg

SEQ ID NO: 3073445 - RNA, 16 nt, Mycobacterium bovis subsp bovis AF2122/97
ggucagccgcggcggc

SEQ ID NO: 3073446 - RNA, 15 nt, Mycobacterium bovis subsp bovis AF2122/97
ggucagccgcggggc

SEQ ID NO: 3073447 - RNA, 22 nt, Mycobacterium bovis subsp bovis AF2122/97
ggucagcgaccucacugcggcg

SEQ ID NO: 3073448 - RNA, 21 nt, Mycobacterium bovis subsp bovis AF2122/97
ggucagcgaguuucugcucga

SEQ ID NO: 3073449 - RNA, 12 nt, Mycobacterium bovis subsp bovis AF2122/97
ggucagcgccga

SEQ ID NO: 3073450 - RNA, 23 nt, Mycobacterium bovis subsp bovis AF2122/97
ggucagcgccgacuccaguucgg

SEQ ID NO: 3073451 - RNA, 23 nt, Mycobacterium bovis subsp bovis AF2122/97
ggucagcgccgcgccccagacgc

SEQ ID NO: 3073452 - RNA, 11 nt, Mycobacterium bovis subsp bovis AF2122/97
ggucagcgccu

SEQ ID NO: 3073453 - RNA, 21 nt, Mycobacterium bovis subsp bovis AF2122/97
ggucagcgcguauggcucacc

SEQ ID NO: 3073454 - RNA, 22 nt, Mycobacterium bovis subsp bovis AF2122/97
ggucagcgcgucguccagggcg

SEQ ID NO: 3073455 - RNA, 19 nt, Mycobacterium bovis subsp bovis AF2122/97
ggucagcgcugccaccgcg

SEQ ID NO: 3073456 - RNA, 11 nt, Mycobacterium bovis subsp bovis AF2122/97
ggucagcggcc

SEQ ID NO: 3073457 - RNA, 19 nt, Mycobacterium bovis subsp bovis AF2122/97
ggucagcggcucggcgggg

SEQ ID NO: 3073458 - RNA, 20 nt, Mycobacterium bovis subsp bovis AF2122/97
ggucagcgggcacgccgccg

SEQ ID NO: 3073459 - RNA, 17 nt, Mycobacterium bovis subsp bovis AF2122/97
ggucagcggggugcugc

SEQ ID NO: 3073460 - RNA, 17 nt, Mycobacterium bovis subsp bovis AF2122/97
ggucagcgggucgaccc

SEQ ID NO: 3073461 - RNA, 20 nt, Mycobacterium bovis subsp bovis AF2122/97
ggucagcgggucgaccccgg

SEQ ID NO: 3073462 - RNA, 14 nt, Mycobacterium bovis subsp bovis AF2122/97
ggucagcgugcagg

SEQ ID NO: 3073463 - RNA, 23 nt, Mycobacterium bovis subsp bovis AF2122/97
ggucagcuagguauugccgcaga

SEQ ID NO: 3073464 - RNA, 17 nt, Mycobacterium bovis subsp bovis AF2122/97
ggucagcucggcagcau

SEQ ID NO: 3073465 - RNA, 15 nt, Mycobacterium bovis subsp bovis AF2122/97
ggucagcucgucggc

SEQ ID NO: 3073466 - RNA, 18 nt, Mycobacterium bovis subsp bovis AF2122/97
ggucagcucgucggcgau

SEQ ID NO: 3073467 - RNA, 19 nt, Mycobacterium bovis subsp bovis AF2122/97
ggucagcugacgggccgcu

SEQ ID NO: 3073468 - RNA, 21 nt, Mycobacterium bovis subsp bovis AF2122/97
ggucagcugacgggccgcugu

SEQ ID NO: 3073469 - RNA, 18 nt, Mycobacterium bovis subsp bovis AF2122/97
ggucagcuggccgcggcg

SEQ ID NO: 3073470 - RNA, 15 nt, Mycobacterium bovis subsp bovis AF2122/97
ggucaggaacacucg

SEQ ID NO: 3073471 - RNA, 15 nt, Mycobacterium bovis subsp bovis AF2122/97
ggucaggaucgcacc

SEQ ID NO: 3073472 - RNA, 14 nt, Mycobacterium bovis subsp bovis AF2122/97
ggucaggaugggga

SEQ ID NO: 3073473 - RNA, 23 nt, Mycobacterium bovis subsp bovis AF2122/97
ggucaggcaguccaccgcgcggc

SEQ ID NO: 3073474 - RNA, 16 nt, Mycobacterium bovis subsp bovis AF2122/97
ggucaggccaggguga

SEQ ID NO: 3073475 - RNA, 13 nt, Mycobacterium bovis subsp bovis AF2122/97
ggucaggccgacg

SEQ ID NO: 3073476 - RNA, 14 nt, Mycobacterium bovis subsp bovis AF2122/97
ggucaggccgacgu

SEQ ID NO: 3073477 - RNA, 13 nt, Mycobacterium bovis subsp bovis AF2122/97
ggucaggccgccg

SEQ ID NO: 3073478 - RNA, 14 nt, Mycobacterium bovis subsp bovis AF2122/97
ggucaggccgccgc

SEQ ID NO: 3073479 - RNA, 13 nt, Mycobacterium bovis subsp bovis AF2122/97
ggucaggcggccg

SEQ ID NO: 3073480 - RNA, 14 nt, Mycobacterium bovis subsp bovis AF2122/97
ggucaggcggccgu

SEQ ID NO: 3073481 - RNA, 16 nt, Mycobacterium bovis subsp bovis AF2122/97
ggucaggcggcuggcc

SEQ ID NO: 3073482 - RNA, 17 nt, Mycobacterium bovis subsp bovis AF2122/97
ggucagguccugggugu

SEQ ID NO: 3073483 - RNA, 14 nt, Mycobacterium bovis subsp bovis AF2122/97
ggucaggucgaggu

SEQ ID NO: 3073484 - RNA, 20 nt, Mycobacterium bovis subsp bovis AF2122/97
ggucaggucgagguccucgg

SEQ ID NO: 3073485 - RNA, 23 nt, Mycobacterium bovis subsp bovis AF2122/97
ggucaggucugacagaccgggca

SEQ ID NO: 3073486 - RNA, 22 nt, Mycobacterium bovis subsp bovis AF2122/97
ggucccuuguggucugccagca

SEQ ID NO: 3073487 - RNA, 16 nt, Mycobacterium bovis subsp bovis AF2122/97
gguccgaccagcggcc

SEQ ID NO: 3073488 - RNA, 18 nt, Mycobacterium bovis subsp bovis AF2122/97
gguccgacgguguagccg

SEQ ID NO: 3073489 - RNA, 23 nt, Mycobacterium bovis subsp bovis AF2122/97
gguccgacgguguagccgccggc

SEQ ID NO: 3073490 - RNA, 19 nt, Mycobacterium bovis subsp bovis AF2122/97
gguccgagcggcaucgguc

SEQ ID NO: 3073491 - RNA, 21 nt, Mycobacterium bovis subsp bovis AF2122/97
gguccgaucaugucggccggg

SEQ ID NO: 3073492 - RNA, 18 nt, Mycobacterium bovis subsp bovis AF2122/97
gguccgcacgaucugcag

SEQ ID NO: 3073493 - RNA, 20 nt, Mycobacterium bovis subsp bovis AF2122/97
gguccgcacgaucugcaggc

SEQ ID NO: 3073494 - RNA, 17 nt, Mycobacterium bovis subsp bovis AF2122/97
gguccgcacugugcccu

SEQ ID NO: 3073495 - RNA, 17 nt, Mycobacterium bovis subsp bovis AF2122/97
gguccgccacggcgggc

SEQ ID NO: 3073496 - RNA, 13 nt, Mycobacterium bovis subsp bovis AF2122/97
gguccgccagcgc

SEQ ID NO: 3073497 - RNA, 14 nt, Mycobacterium bovis subsp bovis AF2122/97
gguccgccagcgcg

SEQ ID NO: 3073498 - RNA, 16 nt, Mycobacterium bovis subsp bovis AF2122/97
gguccgccgggccccg

SEQ ID NO: 3073499 - RNA, 15 nt, Mycobacterium bovis subsp bovis AF2122/97
gguccgccguugccg

SEQ ID NO: 3073500 - RNA, 19 nt, Mycobacterium bovis subsp bovis AF2122/97
gguccgccguugccgaucc

SEQ ID NO: 3073501 - RNA, 13 nt, Mycobacterium bovis subsp bovis AF2122/97
gguccgcggccgc

SEQ ID NO: 3073502 - RNA, 16 nt, Mycobacterium bovis subsp bovis AF2122/97
gguccgcgucggcggc

SEQ ID NO: 3073503 - RNA, 18 nt, Mycobacterium bovis subsp bovis AF2122/97
gguccgcgucggcggcga

SEQ ID NO: 3073504 - RNA, 18 nt, Mycobacterium bovis subsp bovis AF2122/97
gguccgcgugcugccgua

SEQ ID NO: 3073505 - RNA, 14 nt, Mycobacterium bovis subsp bovis AF2122/97
gguccgcugcagca

SEQ ID NO: 3073506 - RNA, 19 nt, Mycobacterium bovis subsp bovis AF2122/97
gguccgcugccaucggcac

SEQ ID NO: 3073507 - RNA, 21 nt, Mycobacterium bovis subsp bovis AF2122/97
gguccggaaauuccggcgcgg

SEQ ID NO: 3073508 - RNA, 22 nt, Mycobacterium bovis subsp bovis AF2122/97
gguccggaugcgcaaccgcggc

SEQ ID NO: 3073509 - RNA, 17 nt, Mycobacterium bovis subsp bovis AF2122/97
gguccggcccaccagcg

SEQ ID NO: 3073510 - RNA, 18 nt, Mycobacterium bovis subsp bovis AF2122/97
gguccggcccaccagcgc

SEQ ID NO: 3073511 - RNA, 15 nt, Mycobacterium bovis subsp bovis AF2122/97
gguccggcccgggga

SEQ ID NO: 3073512 - RNA, 17 nt, Mycobacterium bovis subsp bovis AF2122/97
gguccgggugccggugc

SEQ ID NO: 3073513 - RNA, 22 nt, Mycobacterium bovis subsp bovis AF2122/97
gguccggucuuuguccgucgcg

SEQ ID NO: 3073514 - RNA, 15 nt, Mycobacterium bovis subsp bovis AF2122/97
gguccggugaacccg

SEQ ID NO: 3073515 - RNA, 19 nt, Mycobacterium bovis subsp bovis AF2122/97
gguccgucaccaccgccgc

SEQ ID NO: 3073516 - RNA, 17 nt, Mycobacterium bovis subsp bovis AF2122/97
gguccgucgagucgccg

SEQ ID NO: 3073517 - RNA, 19 nt, Mycobacterium bovis subsp bovis AF2122/97
gguccgucgagucgccgag

SEQ ID NO: 3073518 - RNA, 13 nt, Mycobacterium bovis subsp bovis AF2122/97
gguccgugccgau

SEQ ID NO: 3073519 - RNA, 23 nt, Mycobacterium bovis subsp bovis AF2122/97
gguccguuuuaccucggccgcca

SEQ ID NO: 3073520 - RNA, 19 nt, Mycobacterium bovis subsp bovis AF2122/97
gguccuccuucgguggugg

SEQ ID NO: 3073521 - RNA, 13 nt, Mycobacterium bovis subsp bovis AF2122/97
gguccucgagccg

SEQ ID NO: 3073522 - RNA, 15 nt, Mycobacterium bovis subsp bovis AF2122/97
gguccucgagcggca

SEQ ID NO: 3073523 - RNA, 21 nt, Mycobacterium bovis subsp bovis AF2122/97
gguccucgagguccucgucgg

SEQ ID NO: 3073524 - RNA, 21 nt, Mycobacterium bovis subsp bovis AF2122/97
gguccucgaucagacgcucga

SEQ ID NO: 3073525 - RNA, 15 nt, Mycobacterium bovis subsp bovis AF2122/97
gguccucgucggcga

SEQ ID NO: 3073526 - RNA, 15 nt, Mycobacterium bovis subsp bovis AF2122/97
gguccucgucggcgu

SEQ ID NO: 3073527 - RNA, 15 nt, Mycobacterium bovis subsp bovis AF2122/97
gguccucgucgucga

SEQ ID NO: 3073528 - RNA, 17 nt, Mycobacterium bovis subsp bovis AF2122/97
gguccugcggucgcgga

SEQ ID NO: 3073529 - RNA, 21 nt, Mycobacterium bovis subsp bovis AF2122/97
gguccugcucgcacagcacca

SEQ ID NO: 3073530 - RNA, 16 nt, Mycobacterium bovis subsp bovis AF2122/97
gguccuucugccggga

SEQ ID NO: 3073531 - RNA, 21 nt, Mycobacterium bovis subsp bovis AF2122/97
gguccuugaggauccgcacca

SEQ ID NO: 3073532 - RNA, 20 nt, Mycobacterium bovis subsp bovis AF2122/97
gguccuugccguagaagcgc

SEQ ID NO: 3073533 - RNA, 15 nt, Mycobacterium bovis subsp bovis AF2122/97
ggucgaaccgccggc

SEQ ID NO: 3073534 - RNA, 19 nt, Mycobacterium bovis subsp bovis AF2122/97
ggucgaacuugaucaccgc

SEQ ID NO: 3073535 - RNA, 20 nt, Mycobacterium bovis subsp bovis AF2122/97
ggucgaacuugaucaccgcg

SEQ ID NO: 3073536 - RNA, 22 nt, Mycobacterium bovis subsp bovis AF2122/97
ggucgaacuugaucaccgcgua

SEQ ID NO: 3073537 - RNA, 23 nt, Mycobacterium bovis subsp bovis AF2122/97
ggucgaagaccaagagcgcgcag

SEQ ID NO: 3073538 - RNA, 23 nt, Mycobacterium bovis subsp bovis AF2122/97
ggucgaagagguggggcaggauc

SEQ ID NO: 3073539 - RNA, 12 nt, Mycobacterium bovis subsp bovis AF2122/97
ggucgaagcugg

SEQ ID NO: 3073540 - RNA, 16 nt, Mycobacterium bovis subsp bovis AF2122/97
ggucgaaucgcugccg

SEQ ID NO: 3073541 - RNA, 17 nt, Mycobacterium bovis subsp bovis AF2122/97
ggucgaaucgcugccgc

SEQ ID NO: 3073542 - RNA, 20 nt, Mycobacterium bovis subsp bovis AF2122/97
ggucgaaucgcugccgccga

SEQ ID NO: 3073543 - RNA, 21 nt, Mycobacterium bovis subsp bovis AF2122/97
ggucgaaugggggcuggucgc

SEQ ID NO: 3073544 - RNA, 13 nt, Mycobacterium bovis subsp bovis AF2122/97
ggucgacaccgcg

SEQ ID NO: 3073545 - RNA, 14 nt, Mycobacterium bovis subsp bovis AF2122/97
ggucgacaccgcgg

SEQ ID NO: 3073546 - RNA, 12 nt, Mycobacterium bovis subsp bovis AF2122/97
ggucgacagcgc

SEQ ID NO: 3073547 - RNA, 19 nt, Mycobacterium bovis subsp bovis AF2122/97
ggucgacaggugccagacc

SEQ ID NO: 3073548 - RNA, 20 nt, Mycobacterium bovis subsp bovis AF2122/97
ggucgacaugggucggcugu

SEQ ID NO: 3073549 - RNA, 13 nt, Mycobacterium bovis subsp bovis AF2122/97
ggucgaccaucgg

SEQ ID NO: 3073550 - RNA, 15 nt, Mycobacterium bovis subsp bovis AF2122/97
ggucgaccaucgguu

SEQ ID NO: 3073551 - RNA, 14 nt, Mycobacterium bovis subsp bovis AF2122/97
ggucgacccggcca

SEQ ID NO: 3073552 - RNA, 13 nt, Mycobacterium bovis subsp bovis AF2122/97
ggucgaccgugcg

SEQ ID NO: 3073553 - RNA, 22 nt, Mycobacterium bovis subsp bovis AF2122/97
ggucgaccgugcgucgauggcg

SEQ ID NO: 3073554 - RNA, 18 nt, Mycobacterium bovis subsp bovis AF2122/97
ggucgacgaacaccccgg

SEQ ID NO: 3073555 - RNA, 19 nt, Mycobacterium bovis subsp bovis AF2122/97
ggucgacgaacaccccggg

SEQ ID NO: 3073556 - RNA, 18 nt, Mycobacterium bovis subsp bovis AF2122/97
ggucgacgaugacggugg

SEQ ID NO: 3073557 - RNA, 18 nt, Mycobacterium bovis subsp bovis AF2122/97
ggucgacgccgaccaccc

SEQ ID NO: 3073558 - RNA, 22 nt, Mycobacterium bovis subsp bovis AF2122/97
ggucgacgccgaccacccggau

SEQ ID NO: 3073559 - RNA, 15 nt, Mycobacterium bovis subsp bovis AF2122/97
ggucgacgggcucgu

SEQ ID NO: 3073560 - RNA, 18 nt, Mycobacterium bovis subsp bovis AF2122/97
ggucgacggggcggucgg

SEQ ID NO: 3073561 - RNA, 16 nt, Mycobacterium bovis subsp bovis AF2122/97
ggucgacgggucggcg

SEQ ID NO: 3073562 - RNA, 18 nt, Mycobacterium bovis subsp bovis AF2122/97
ggucgacgggucggcgcc

SEQ ID NO: 3073563 - RNA, 20 nt, Mycobacterium bovis subsp bovis AF2122/97
ggucgacgggucggcgccga

SEQ ID NO: 3073564 - RNA, 14 nt, Mycobacterium bovis subsp bovis AF2122/97
ggucgacggguucu

SEQ ID NO: 3073565 - RNA, 15 nt, Mycobacterium bovis subsp bovis AF2122/97
ggucgacgucggugu

SEQ ID NO: 3073566 - RNA, 14 nt, Mycobacterium bovis subsp bovis AF2122/97
ggucgacgugaucg

SEQ ID NO: 3073567 - RNA, 15 nt, Mycobacterium bovis subsp bovis AF2122/97
ggucgacguguugga

SEQ ID NO: 3073568 - RNA, 16 nt, Mycobacterium bovis subsp bovis AF2122/97
ggucgacuccagcacc

SEQ ID NO: 3073569 - RNA, 18 nt, Mycobacterium bovis subsp bovis AF2122/97
ggucgacuccagcaccag

SEQ ID NO: 3073570 - RNA, 17 nt, Mycobacterium bovis subsp bovis AF2122/97
ggucgacugggacgacg

SEQ ID NO: 3073571 - RNA, 18 nt, Mycobacterium bovis subsp bovis AF2122/97
ggucgacugggacgacgc

SEQ ID NO: 3073572 - RNA, 21 nt, Mycobacterium bovis subsp bovis AF2122/97
ggucgcguuucgcagccgcac

SEQ ID NO: 3073573 - RNA, 11 nt, Mycobacterium bovis subsp bovis AF2122/97
ggucgcucgcg

SEQ ID NO: 3073574 - RNA, 15 nt, Mycobacterium bovis subsp bovis AF2122/97
ggucgcucgcgguca

SEQ ID NO: 3073575 - RNA, 21 nt, Mycobacterium bovis subsp bovis AF2122/97
ggucgcugauccgggcgccga

SEQ ID NO: 3073576 - RNA, 15 nt, Mycobacterium bovis subsp bovis AF2122/97
ggucgcugccgccgu

SEQ ID NO: 3073577 - RNA, 18 nt, Mycobacterium bovis subsp bovis AF2122/97
ggucgcugccgccgucgc

SEQ ID NO: 3073578 - RNA, 18 nt, Mycobacterium bovis subsp bovis AF2122/97
ggucgcugccggcugacg

SEQ ID NO: 3073579 - RNA, 18 nt, Mycobacterium bovis subsp bovis AF2122/97
ggucgcugcgacuggugc

SEQ ID NO: 3073580 - RNA, 16 nt, Mycobacterium bovis subsp bovis AF2122/97
ggucgcugcugccgca

SEQ ID NO: 3073581 - RNA, 22 nt, Mycobacterium bovis subsp bovis AF2122/97
ggucgcugcugcgaucgccgcg

SEQ ID NO: 3073582 - RNA, 21 nt, Mycobacterium bovis subsp bovis AF2122/97
ggucgcugcuugcgggcucgu

SEQ ID NO: 3073583 - RNA, 15 nt, Mycobacterium bovis subsp bovis AF2122/97
ggucgcuggugcacg

SEQ ID NO: 3073584 - RNA, 13 nt, Mycobacterium bovis subsp bovis AF2122/97
ggucgcuguccac

SEQ ID NO: 3073585 - RNA, 17 nt, Mycobacterium bovis subsp bovis AF2122/97
ggucgcugugcagcggg

SEQ ID NO: 3073586 - RNA, 15 nt, Mycobacterium bovis subsp bovis AF2122/97
ggucgcuucagcgcc

SEQ ID NO: 3073587 - RNA, 16 nt, Mycobacterium bovis subsp bovis AF2122/97
ggucgcuugcugucgu

SEQ ID NO: 3073588 - RNA, 17 nt, Mycobacterium bovis subsp bovis AF2122/97
ggucggaacuagccagu

SEQ ID NO: 3073589 - RNA, 15 nt, Mycobacterium bovis subsp bovis AF2122/97
ggucggacagcgucu

SEQ ID NO: 3073590 - RNA, 22 nt, Mycobacterium bovis subsp bovis AF2122/97
ggucggacggccaucgccagcc

SEQ ID NO: 3073591 - RNA, 14 nt, Mycobacterium bovis subsp bovis AF2122/97
ggucggaucggcgc

SEQ ID NO: 3073592 - RNA, 22 nt, Mycobacterium bovis subsp bovis AF2122/97
ggucggcaaugucuucgauacc

SEQ ID NO: 3073593 - RNA, 22 nt, Mycobacterium bovis subsp bovis AF2122/97
ggucggcaccaccacgccgacc

SEQ ID NO: 3073594 - RNA, 21 nt, Mycobacterium bovis subsp bovis AF2122/97
ggucggcaccagguugccgag

SEQ ID NO: 3073595 - RNA, 16 nt, Mycobacterium bovis subsp bovis AF2122/97
ggucggcacgacccgg

SEQ ID NO: 3073596 - RNA, 14 nt, Mycobacterium bovis subsp bovis AF2122/97
ggucggcagcgacg

SEQ ID NO: 3073597 - RNA, 17 nt, Mycobacterium bovis subsp bovis AF2122/97
ggucggcagcuccagca

SEQ ID NO: 3073598 - RNA, 13 nt, Mycobacterium bovis subsp bovis AF2122/97
ggucggcagcuuc

SEQ ID NO: 3073599 - RNA, 21 nt, Mycobacterium bovis subsp bovis AF2122/97
ggucggcagcuucucgccgac

SEQ ID NO: 3073600 - RNA, 23 nt, Mycobacterium bovis subsp bovis AF2122/97
ggucggcagcuucucgccgacga

SEQ ID NO: 3073601 - RNA, 18 nt, Mycobacterium bovis subsp bovis AF2122/97
ggucggcauugaucggug

SEQ ID NO: 3073602 - RNA, 13 nt, Mycobacterium bovis subsp bovis AF2122/97
ggucggccaccaa

SEQ ID NO: 3073603 - RNA, 23 nt, Mycobacterium bovis subsp bovis AF2122/97
ggucggccacgcgcacucgacgc

SEQ ID NO: 3073604 - RNA, 18 nt, Mycobacterium bovis subsp bovis AF2122/97
ggucggccaggccgucgg

SEQ ID NO: 3073605 - RNA, 20 nt, Mycobacterium bovis subsp bovis AF2122/97
ggucggcccuccaccggugu

SEQ ID NO: 3073606 - RNA, 13 nt, Mycobacterium bovis subsp bovis AF2122/97
ggucggccgccuc

SEQ ID NO: 3073607 - RNA, 21 nt, Mycobacterium bovis subsp bovis AF2122/97
ggucggccucgagacggucga

SEQ ID NO: 3073608 - RNA, 13 nt, Mycobacterium bovis subsp bovis AF2122/97
ggucggccugcga

SEQ ID NO: 3073609 - RNA, 13 nt, Mycobacterium bovis subsp bovis AF2122/97
ggucggccugcgg

SEQ ID NO: 3073610 - RNA, 16 nt, Mycobacterium bovis subsp bovis AF2122/97
ggucggccugcggcac

SEQ ID NO: 3073611 - RNA, 21 nt, Mycobacterium bovis subsp bovis AF2122/97
ggucggccugcggcaccggcu

SEQ ID NO: 3073612 - RNA, 12 nt, Mycobacterium bovis subsp bovis AF2122/97
ggucggcgacca

SEQ ID NO: 3073613 - RNA, 14 nt, Mycobacterium bovis subsp bovis AF2122/97
ggucggcgaccacc

SEQ ID NO: 3073614 - RNA, 15 nt, Mycobacterium bovis subsp bovis AF2122/97
ggucggcgaccaccc

SEQ ID NO: 3073615 - RNA, 22 nt, Mycobacterium bovis subsp bovis AF2122/97
ggucggcgaccaccccguagcg

SEQ ID NO: 3073616 - RNA, 15 nt, Mycobacterium bovis subsp bovis AF2122/97
ggucggcgaccccga

SEQ ID NO: 3073617 - RNA, 15 nt, Mycobacterium bovis subsp bovis AF2122/97
ggucggcgaccgcgc

SEQ ID NO: 3073618 - RNA, 13 nt, Mycobacterium bovis subsp bovis AF2122/97
ggucggcgacguc

SEQ ID NO: 3073619 - RNA, 16 nt, Mycobacterium bovis subsp bovis AF2122/97
ggucggcgaucugcgc

SEQ ID NO: 3073620 - RNA, 20 nt, Mycobacterium bovis subsp bovis AF2122/97
ggucggcgaugaugacggcg

SEQ ID NO: 3073621 - RNA, 22 nt, Mycobacterium bovis subsp bovis AF2122/97
ggucggcgaugaugacggcggc

SEQ ID NO: 3073622 - RNA, 14 nt, Mycobacterium bovis subsp bovis AF2122/97
ggucggcgauggcg

SEQ ID NO: 3073623 - RNA, 12 nt, Mycobacterium bovis subsp bovis AF2122/97
ggucggcgccga

SEQ ID NO: 3073624 - RNA, 14 nt, Mycobacterium bovis subsp bovis AF2122/97
ggucggcgcgccgu

SEQ ID NO: 3073625 - RNA, 15 nt, Mycobacterium bovis subsp bovis AF2122/97
ggucggcggccgcca

SEQ ID NO: 3073626 - RNA, 13 nt, Mycobacterium bovis subsp bovis AF2122/97
ggucggcgguagc

SEQ ID NO: 3073627 - RNA, 14 nt, Mycobacterium bovis subsp bovis AF2122/97
ggucggcggugccg

SEQ ID NO: 3073628 - RNA, 15 nt, Mycobacterium bovis subsp bovis AF2122/97
ggucggcuccgcgac

SEQ ID NO: 3073629 - RNA, 22 nt, Mycobacterium bovis subsp bovis AF2122/97
ggucggcugauuggcccaccgc

SEQ ID NO: 3073630 - RNA, 22 nt, Mycobacterium bovis subsp bovis AF2122/97
ggucggcuuccggugccgggau

SEQ ID NO: 3073631 - RNA, 17 nt, Mycobacterium bovis subsp bovis AF2122/97
ggucggcuucgacaacc

SEQ ID NO: 3073632 - RNA, 21 nt, Mycobacterium bovis subsp bovis AF2122/97
ggucggcuucgacaaccucga

SEQ ID NO: 3073633 - RNA, 17 nt, Mycobacterium bovis subsp bovis AF2122/97
ggucgggcaaccugccg

SEQ ID NO: 3073634 - RNA, 14 nt, Mycobacterium bovis subsp bovis AF2122/97
ggucgggcagcacu

SEQ ID NO: 3073635 - RNA, 23 nt, Mycobacterium bovis subsp bovis AF2122/97
ggucgggcagcacuuggacccgg

SEQ ID NO: 3073636 - RNA, 17 nt, Mycobacterium bovis subsp bovis AF2122/97
ggucgggcauuccggug

SEQ ID NO: 3073637 - RNA, 15 nt, Mycobacterium bovis subsp bovis AF2122/97
ggucgggcccccggc

SEQ ID NO: 3073638 - RNA, 15 nt, Mycobacterium bovis subsp bovis AF2122/97
ggucgggcccggcga

SEQ ID NO: 3073639 - RNA, 16 nt, Mycobacterium bovis subsp bovis AF2122/97
ggucgggcggcgucga

SEQ ID NO: 3073640 - RNA, 17 nt, Mycobacterium bovis subsp bovis AF2122/97
ggucggggaacgcggcg

SEQ ID NO: 3073641 - RNA, 16 nt, Mycobacterium bovis subsp bovis AF2122/97
ggucggggagcugcgg

SEQ ID NO: 3073642 - RNA, 18 nt, Mycobacterium bovis subsp bovis AF2122/97
ggucggggagcugcggcg

SEQ ID NO: 3073643 - RNA, 20 nt, Mycobacterium bovis subsp bovis AF2122/97
ggucggggagcugcggcggc

SEQ ID NO: 3073644 - RNA, 15 nt, Mycobacterium bovis subsp bovis AF2122/97
ggucgggggcagcgc

SEQ ID NO: 3073645 - RNA, 14 nt, Mycobacterium bovis subsp bovis AF2122/97
ggucgggggcgucc

SEQ ID NO: 3073646 - RNA, 23 nt, Mycobacterium bovis subsp bovis AF2122/97
ggucggguaaauauugcgcccgg

SEQ ID NO: 3073647 - RNA, 21 nt, Mycobacterium bovis subsp bovis AF2122/97
ggucgggucgaucaccgacac

SEQ ID NO: 3073648 - RNA, 22 nt, Mycobacterium bovis subsp bovis AF2122/97
ggucgggucgaucaccgacacc

SEQ ID NO: 3073649 - RNA, 16 nt, Mycobacterium bovis subsp bovis AF2122/97
ggucgguaacggcggu

SEQ ID NO: 3073650 - RNA, 23 nt, Mycobacterium bovis subsp bovis AF2122/97
ggucgguaccccagcgcugucgu

SEQ ID NO: 3073651 - RNA, 23 nt, Mycobacterium bovis subsp bovis AF2122/97
ggucgguacccgcacccguugcg

SEQ ID NO: 3073652 - RNA, 13 nt, Mycobacterium bovis subsp bovis AF2122/97
ggucggucacgac

SEQ ID NO: 3073653 - RNA, 16 nt, Mycobacterium bovis subsp bovis AF2122/97
ggucggucacgacggc

SEQ ID NO: 3073654 - RNA, 12 nt, Mycobacterium bovis subsp bovis AF2122/97
ggucggucaggu

SEQ ID NO: 3073655 - RNA, 18 nt, Mycobacterium bovis subsp bovis AF2122/97
ggucggucgcgcgacggc

SEQ ID NO: 3073656 - RNA, 19 nt, Mycobacterium bovis subsp bovis AF2122/97
ggucggugaacccgccggc

SEQ ID NO: 3073657 - RNA, 15 nt, Mycobacterium bovis subsp bovis AF2122/97
ggucggugacugugc

SEQ ID NO: 3073658 - RNA, 14 nt, Mycobacterium bovis subsp bovis AF2122/97
ggucggugagccgu

SEQ ID NO: 3073659 - RNA, 22 nt, Mycobacterium bovis subsp bovis AF2122/97
ggugaaaccggccuucucgccg

SEQ ID NO: 3073660 - RNA, 13 nt, Mycobacterium bovis subsp bovis AF2122/97
ggugaaacgaugg

SEQ ID NO: 3073661 - RNA, 15 nt, Mycobacterium bovis subsp bovis AF2122/97
ggugaaacgauggcg

SEQ ID NO: 3073662 - RNA, 19 nt, Mycobacterium bovis subsp bovis AF2122/97
ggugaacaccgccucugca

SEQ ID NO: 3073663 - RNA, 21 nt, Mycobacterium bovis subsp bovis AF2122/97
ggugaacaugugaccggcgau

SEQ ID NO: 3073664 - RNA, 13 nt, Mycobacterium bovis subsp bovis AF2122/97
ggugaaccaccac

SEQ ID NO: 3073665 - RNA, 21 nt, Mycobacterium bovis subsp bovis AF2122/97
ggugaaccaccacuucggcgc

SEQ ID NO: 3073666 - RNA, 23 nt, Mycobacterium bovis subsp bovis AF2122/97
ggugaaccaccacuucggcgccg

SEQ ID NO: 3073667 - RNA, 15 nt, Mycobacterium bovis subsp bovis AF2122/97
ggugaaccccgccgg

SEQ ID NO: 3073668 - RNA, 16 nt, Mycobacterium bovis subsp bovis AF2122/97
ggugaaccccgccggc

SEQ ID NO: 3073669 - RNA, 19 nt, Mycobacterium bovis subsp bovis AF2122/97
ggugaacccgauuggggug

SEQ ID NO: 3073670 - RNA, 13 nt, Mycobacterium bovis subsp bovis AF2122/97
ggugaacccgccg

SEQ ID NO: 3073671 - RNA, 23 nt, Mycobacterium bovis subsp bovis AF2122/97
ggugaacgacaugggcaggccgc

SEQ ID NO: 3073672 - RNA, 15 nt, Mycobacterium bovis subsp bovis AF2122/97
ggugaacgccugcgg

SEQ ID NO: 3073673 - RNA, 22 nt, Mycobacterium bovis subsp bovis AF2122/97
ggugaacgcgucguugucgucg

SEQ ID NO: 3073674 - RNA, 21 nt, Mycobacterium bovis subsp bovis AF2122/97
ggugaacggcagcacggucug

SEQ ID NO: 3073675 - RNA, 15 nt, Mycobacterium bovis subsp bovis AF2122/97
ggugaacgguagcac

SEQ ID NO: 3073676 - RNA, 16 nt, Mycobacterium bovis subsp bovis AF2122/97
ggugaacugcuggccg

SEQ ID NO: 3073677 - RNA, 17 nt, Mycobacterium bovis subsp bovis AF2122/97
ggugaacugguugacgu

SEQ ID NO: 3073678 - RNA, 19 nt, Mycobacterium bovis subsp bovis AF2122/97
ggugaacuucuccaccagc

SEQ ID NO: 3073679 - RNA, 20 nt, Mycobacterium bovis subsp bovis AF2122/97
ggugaacuucuccaccagcg

SEQ ID NO: 3073680 - RNA, 16 nt, Mycobacterium bovis subsp bovis AF2122/97
ggugaagacaccggcg

SEQ ID NO: 3073681 - RNA, 20 nt, Mycobacterium bovis subsp bovis AF2122/97
ggugaagacaccggcgucga

SEQ ID NO: 3073682 - RNA, 16 nt, Mycobacterium bovis subsp bovis AF2122/97
ggugaagccgagcgcc

SEQ ID NO: 3073683 - RNA, 17 nt, Mycobacterium bovis subsp bovis AF2122/97
ggugaaggugccccaag

SEQ ID NO: 3073684 - RNA, 19 nt, Mycobacterium bovis subsp bovis AF2122/97
ggugaaguagucggcgccg

SEQ ID NO: 3073685 - RNA, 22 nt, Mycobacterium bovis subsp bovis AF2122/97
ggugaaguagucggcgccgaga

SEQ ID NO: 3073686 - RNA, 19 nt, Mycobacterium bovis subsp bovis AF2122/97
ggugaaguagugcucgcag

SEQ ID NO: 3073687 - RNA, 18 nt, Mycobacterium bovis subsp bovis AF2122/97
ggugaaguggcgcaccac

SEQ ID NO: 3073688 - RNA, 22 nt, Mycobacterium bovis subsp bovis AF2122/97
ggugaaguugccggucaggcag

SEQ ID NO: 3073689 - RNA, 16 nt, Mycobacterium bovis subsp bovis AF2122/97
ggugaaguuggcgugg

SEQ ID NO: 3073690 - RNA, 16 nt, Mycobacterium bovis subsp bovis AF2122/97
ggugaauaucucgccg

SEQ ID NO: 3073691 - RNA, 16 nt, Mycobacterium bovis subsp bovis AF2122/97
ggugaaucgaagcccg

SEQ ID NO: 3073692 - RNA, 16 nt, Mycobacterium bovis subsp bovis AF2122/97
ggugaaucgacaccgc

SEQ ID NO: 3073693 - RNA, 18 nt, Mycobacterium bovis subsp bovis AF2122/97
ggugaaucgacugaucgc

SEQ ID NO: 3073694 - RNA, 19 nt, Mycobacterium bovis subsp bovis AF2122/97
ggugaaucgucugacgaaa

SEQ ID NO: 3073695 - RNA, 16 nt, Mycobacterium bovis subsp bovis AF2122/97
ggugacaaauggggug

SEQ ID NO: 3073696 - RNA, 22 nt, Mycobacterium bovis subsp bovis AF2122/97
ggugacaagcgauuuggcgucg

SEQ ID NO: 3073697 - RNA, 16 nt, Mycobacterium bovis subsp bovis AF2122/97
ggugacaagcggcccg

SEQ ID NO: 3073698 - RNA, 19 nt, Mycobacterium bovis subsp bovis AF2122/97
ggugacaccaacaccggug

SEQ ID NO: 3073699 - RNA, 13 nt, Mycobacterium bovis subsp bovis AF2122/97
ggugacacgacgu

SEQ ID NO: 3073700 - RNA, 22 nt, Mycobacterium bovis subsp bovis AF2122/97
ggugacagagcggguucgacgu

SEQ ID NO: 3073701 - RNA, 19 nt, Mycobacterium bovis subsp bovis AF2122/97
ggugacauagacguugccg

SEQ ID NO: 3073702 - RNA, 18 nt, Mycobacterium bovis subsp bovis AF2122/97
ggugaccaacaccccccc

SEQ ID NO: 3073703 - RNA, 17 nt, Mycobacterium bovis subsp bovis AF2122/97
ggugaccaacgucgacu

SEQ ID NO: 3073704 - RNA, 11 nt, Mycobacterium bovis subsp bovis AF2122/97
ggugaccacgc

SEQ ID NO: 3073705 - RNA, 13 nt, Mycobacterium bovis subsp bovis AF2122/97
ggugaccacgccg

SEQ ID NO: 3073706 - RNA, 20 nt, Mycobacterium bovis subsp bovis AF2122/97
ggugaccacgccguggcccg

SEQ ID NO: 3073707 - RNA, 21 nt, Mycobacterium bovis subsp bovis AF2122/97
ggugaccacgccguggcccgc

SEQ ID NO: 3073708 - RNA, 14 nt, Mycobacterium bovis subsp bovis AF2122/97
ggugaccagcaacc

SEQ ID NO: 3073709 - RNA, 17 nt, Mycobacterium bovis subsp bovis AF2122/97
ggugaccaggccgagcu

SEQ ID NO: 3073710 - RNA, 14 nt, Mycobacterium bovis subsp bovis AF2122/97
ggugaccaggccgg

SEQ ID NO: 3073711 - RNA, 22 nt, Mycobacterium bovis subsp bovis AF2122/97
ggugaccaggccggcccgcaac

SEQ ID NO: 3073712 - RNA, 23 nt, Mycobacterium bovis subsp bovis AF2122/97
ggugacccacucggggacggcga

SEQ ID NO: 3073713 - RNA, 13 nt, Mycobacterium bovis subsp bovis AF2122/97
ggugacccccaau

SEQ ID NO: 3073714 - RNA, 17 nt, Mycobacterium bovis subsp bovis AF2122/97
ggugacccccgagaucc

SEQ ID NO: 3073715 - RNA, 16 nt, Mycobacterium bovis subsp bovis AF2122/97
ggugacccgcuauucg

SEQ ID NO: 3073716 - RNA, 16 nt, Mycobacterium bovis subsp bovis AF2122/97
ggugacccgcugggcc

SEQ ID NO: 3073717 - RNA, 14 nt, Mycobacterium bovis subsp bovis AF2122/97
ggugaccgagaucg

SEQ ID NO: 3073718 - RNA, 14 nt, Mycobacterium bovis subsp bovis AF2122/97
ggugaccgcgggcg

SEQ ID NO: 3073719 - RNA, 14 nt, Mycobacterium bovis subsp bovis AF2122/97
ggugaccgggucga

SEQ ID NO: 3073720 - RNA, 21 nt, Mycobacterium bovis subsp bovis AF2122/97
ggugaccgguguuccgcccag

SEQ ID NO: 3073721 - RNA, 22 nt, Mycobacterium bovis subsp bovis AF2122/97
ggugaccgguguuccgcccagc

SEQ ID NO: 3073722 - RNA, 14 nt, Mycobacterium bovis subsp bovis AF2122/97
ggugaccguucggc

SEQ ID NO: 3073723 - RNA, 14 nt, Mycobacterium bovis subsp bovis AF2122/97
ggugaccucgucga

SEQ ID NO: 3073724 - RNA, 20 nt, Mycobacterium bovis subsp bovis AF2122/97
ggugaccucgucgaccggga

SEQ ID NO: 3073725 - RNA, 23 nt, Mycobacterium bovis subsp bovis AF2122/97
ggugaccucgugguucugcaggu

SEQ ID NO: 3073726 - RNA, 22 nt, Mycobacterium bovis subsp bovis AF2122/97
ggugaccuucgcuauggcggcu

SEQ ID NO: 3073727 - RNA, 16 nt, Mycobacterium bovis subsp bovis AF2122/97
ggugacgaaagcgccc

SEQ ID NO: 3073728 - RNA, 16 nt, Mycobacterium bovis subsp bovis AF2122/97
ggugacgaccacgucg

SEQ ID NO: 3073729 - RNA, 22 nt, Mycobacterium bovis subsp bovis AF2122/97
ggugacgagcacaugcucgacg

SEQ ID NO: 3073730 - RNA, 18 nt, Mycobacterium bovis subsp bovis AF2122/97
ggugacgagccaccaccg

SEQ ID NO: 3073731 - RNA, 13 nt, Mycobacterium bovis subsp bovis AF2122/97
ggugacgaucagg

SEQ ID NO: 3073732 - RNA, 22 nt, Mycobacterium bovis subsp bovis AF2122/97
ggugacgaucaggccgucgccg

SEQ ID NO: 3073733 - RNA, 14 nt, Mycobacterium bovis subsp bovis AF2122/97
ggugacgaucgaca

SEQ ID NO: 3073734 - RNA, 17 nt, Mycobacterium bovis subsp bovis AF2122/97
ggugacgaucgacagcc

SEQ ID NO: 3073735 - RNA, 12 nt, Mycobacterium bovis subsp bovis AF2122/97
ggugacgaugaa

SEQ ID NO: 3073736 - RNA, 18 nt, Mycobacterium bovis subsp bovis AF2122/97
ggugacgaugaccgcgcg

SEQ ID NO: 3073737 - RNA, 18 nt, Mycobacterium bovis subsp bovis AF2122/97
ggugacgcacagcagcac

SEQ ID NO: 3073738 - RNA, 20 nt, Mycobacterium bovis subsp bovis AF2122/97
ggugacgcacagcagcaccg

SEQ ID NO: 3073739 - RNA, 22 nt, Mycobacterium bovis subsp bovis AF2122/97
ggugacgcacagcagcaccgcg

SEQ ID NO: 3073740 - RNA, 14 nt, Mycobacterium bovis subsp bovis AF2122/97
ggugacgcccgcuc

SEQ ID NO: 3073741 - RNA, 19 nt, Mycobacterium bovis subsp bovis AF2122/97
ggugacgcccgcuccgcgg

SEQ ID NO: 3073742 - RNA, 13 nt, Mycobacterium bovis subsp bovis AF2122/97
ggugacgccgcca

SEQ ID NO: 3073743 - RNA, 15 nt, Mycobacterium bovis subsp bovis AF2122/97
ggugacgccgccagc

SEQ ID NO: 3073744 - RNA, 12 nt, Mycobacterium bovis subsp bovis AF2122/97
ggugacgcgccg

SEQ ID NO: 3073745 - RNA, 15 nt, Mycobacterium bovis subsp bovis AF2122/97
ggugauggccgacgu

SEQ ID NO: 3073746 - RNA, 17 nt, Mycobacterium bovis subsp bovis AF2122/97
ggugauggccgcgcccg

SEQ ID NO: 3073747 - RNA, 19 nt, Mycobacterium bovis subsp bovis AF2122/97
ggugauggccgcgcccgcc

SEQ ID NO: 3073748 - RNA, 17 nt, Mycobacterium bovis subsp bovis AF2122/97
ggugauggcuuggacca

SEQ ID NO: 3073749 - RNA, 19 nt, Mycobacterium bovis subsp bovis AF2122/97
ggugaugggcaugguggug

SEQ ID NO: 3073750 - RNA, 20 nt, Mycobacterium bovis subsp bovis AF2122/97
ggugaugggcaugguggugg

SEQ ID NO: 3073751 - RNA, 18 nt, Mycobacterium bovis subsp bovis AF2122/97
ggugaugggggagccggu

SEQ ID NO: 3073752 - RNA, 18 nt, Mycobacterium bovis subsp bovis AF2122/97
ggugaugguaccgccacu

SEQ ID NO: 3073753 - RNA, 22 nt, Mycobacterium bovis subsp bovis AF2122/97
ggugaugguaccgccacuggcg

SEQ ID NO: 3073754 - RNA, 11 nt, Mycobacterium bovis subsp bovis AF2122/97
ggugaugguga

SEQ ID NO: 3073755 - RNA, 11 nt, Mycobacterium bovis subsp bovis AF2122/97
ggugauggugc

SEQ ID NO: 3073756 - RNA, 13 nt, Mycobacterium bovis subsp bovis AF2122/97
ggugaugguggcg

SEQ ID NO: 3073757 - RNA, 18 nt, Mycobacterium bovis subsp bovis AF2122/97
ggugauguagggcugcuc

SEQ ID NO: 3073758 - RNA, 22 nt, Mycobacterium bovis subsp bovis AF2122/97
ggugauguagggcugcuccugg

SEQ ID NO: 3073759 - RNA, 18 nt, Mycobacterium bovis subsp bovis AF2122/97
ggugauguuggccgccac

SEQ ID NO: 3073760 - RNA, 19 nt, Mycobacterium bovis subsp bovis AF2122/97
ggugauguuggccgccaca

SEQ ID NO: 3073761 - RNA, 21 nt, Mycobacterium bovis subsp bovis AF2122/97
ggugauguuggccgccacacc

SEQ ID NO: 3073762 - RNA, 22 nt, Mycobacterium bovis subsp bovis AF2122/97
ggugauguuggccgccacaccg

SEQ ID NO: 3073763 - RNA, 15 nt, Mycobacterium bovis subsp bovis AF2122/97
ggugcaacaggcgcg

SEQ ID NO: 3073764 - RNA, 16 nt, Mycobacterium bovis subsp bovis AF2122/97
ggugcaacggcguugg

SEQ ID NO: 3073765 - RNA, 15 nt, Mycobacterium bovis subsp bovis AF2122/97
ggugcacaacccgug

SEQ ID NO: 3073766 - RNA, 20 nt, Mycobacterium bovis subsp bovis AF2122/97
ggugcacaacgcccaccacg

SEQ ID NO: 3073767 - RNA, 12 nt, Mycobacterium bovis subsp bovis AF2122/97
ggugcacaccgu

SEQ ID NO: 3073768 - RNA, 13 nt, Mycobacterium bovis subsp bovis AF2122/97
ggugcacaccguc

SEQ ID NO: 3073769 - RNA, 24 nt, Mycobacterium bovis subsp bovis AF2122/97
ggugcacaccgucgcgcucgcacc

SEQ ID NO: 3073770 - RNA, 14 nt, Mycobacterium bovis subsp bovis AF2122/97
ggugcacagcagug

SEQ ID NO: 3073771 - RNA, 20 nt, Mycobacterium bovis subsp bovis AF2122/97
ggugcacaggauuggccgcu

SEQ ID NO: 3073772 - RNA, 23 nt, Mycobacterium bovis subsp bovis AF2122/97
ggugcaccauuguuccguccccg

SEQ ID NO: 3073773 - RNA, 20 nt, Mycobacterium bovis subsp bovis AF2122/97
ggugcaccgaagauggccag

SEQ ID NO: 3073774 - RNA, 14 nt, Mycobacterium bovis subsp bovis AF2122/97
ggugcaccgauucc

SEQ ID NO: 3073775 - RNA, 21 nt, Mycobacterium bovis subsp bovis AF2122/97
ggugcacgccuugagccgagg

SEQ ID NO: 3073776 - RNA, 12 nt, Mycobacterium bovis subsp bovis AF2122/97
ggugcacggcgc

SEQ ID NO: 3073777 - RNA, 13 nt, Mycobacterium bovis subsp bovis AF2122/97
ggugcacggcgcu

SEQ ID NO: 3073778 - RNA, 18 nt, Mycobacterium bovis subsp bovis AF2122/97
ggugcagaauucggcgcg

SEQ ID NO: 3073779 - RNA, 14 nt, Mycobacterium bovis subsp bovis AF2122/97
ggugcagaccaccg

SEQ ID NO: 3073780 - RNA, 15 nt, Mycobacterium bovis subsp bovis AF2122/97
ggugcagcaccagcc

SEQ ID NO: 3073781 - RNA, 14 nt, Mycobacterium bovis subsp bovis AF2122/97
ggugcagcccgccg

SEQ ID NO: 3073782 - RNA, 13 nt, Mycobacterium bovis subsp bovis AF2122/97
ggugcagcgacuc

SEQ ID NO: 3073783 - RNA, 15 nt, Mycobacterium bovis subsp bovis AF2122/97
ggugcagcgacuccg

SEQ ID NO: 3073784 - RNA, 15 nt, Mycobacterium bovis subsp bovis AF2122/97
ggugcagcgccgaca

SEQ ID NO: 3073785 - RNA, 17 nt, Mycobacterium bovis subsp bovis AF2122/97
ggugcagcgccgacagc

SEQ ID NO: 3073786 - RNA, 19 nt, Mycobacterium bovis subsp bovis AF2122/97
ggugcagcgugcagcggcg

SEQ ID NO: 3073787 - RNA, 22 nt, Mycobacterium bovis subsp bovis AF2122/97
ggugcagcuccccgccggaacu

SEQ ID NO: 3073788 - RNA, 20 nt, Mycobacterium bovis subsp bovis AF2122/97
ggugcaggauucggcggucg

SEQ ID NO: 3073789 - RNA, 21 nt, Mycobacterium bovis subsp bovis AF2122/97
ggugcaggauucggcggucgc

SEQ ID NO: 3073790 - RNA, 11 nt, Mycobacterium bovis subsp bovis AF2122/97
ggugcagguga

SEQ ID NO: 3073791 - RNA, 12 nt, Mycobacterium bovis subsp bovis AF2122/97
ggugcaggugag

SEQ ID NO: 3073792 - RNA, 18 nt, Mycobacterium bovis subsp bovis AF2122/97
ggugcaggugagugcggc

SEQ ID NO: 3073793 - RNA, 22 nt, Mycobacterium bovis subsp bovis AF2122/97
ggugcagugaccucgucggcga

SEQ ID NO: 3073794 - RNA, 22 nt, Mycobacterium bovis subsp bovis AF2122/97
ggugcaucgccacagucgucga

SEQ ID NO: 3073795 - RNA, 13 nt, Mycobacterium bovis subsp bovis AF2122/97
ggugcaugucgau

SEQ ID NO: 3073796 - RNA, 17 nt, Mycobacterium bovis subsp bovis AF2122/97
ggugccaaccgcggcga

SEQ ID NO: 3073797 - RNA, 13 nt, Mycobacterium bovis subsp bovis AF2122/97
ggugccaacugcg

SEQ ID NO: 3073798 - RNA, 16 nt, Mycobacterium bovis subsp bovis AF2122/97
ggugccacccuugccg

SEQ ID NO: 3073799 - RNA, 16 nt, Mycobacterium bovis subsp bovis AF2122/97
ggugccaccgcgacgg

SEQ ID NO: 3073800 - RNA, 17 nt, Mycobacterium bovis subsp bovis AF2122/97
ggugccacgaucggcgg

SEQ ID NO: 3073801 - RNA, 18 nt, Mycobacterium bovis subsp bovis AF2122/97
ggugccacgaucggcggg

SEQ ID NO: 3073802 - RNA, 15 nt, Mycobacterium bovis subsp bovis AF2122/97
ggugccacguucgcg

SEQ ID NO: 3073803 - RNA, 19 nt, Mycobacterium bovis subsp bovis AF2122/97
ggugccacguucgcgggcg

SEQ ID NO: 3073804 - RNA, 19 nt, Mycobacterium bovis subsp bovis AF2122/97
ggugccacugccguugccg

SEQ ID NO: 3073805 - RNA, 21 nt, Mycobacterium bovis subsp bovis AF2122/97
ggugccagaccagggcagcgg

SEQ ID NO: 3073806 - RNA, 22 nt, Mycobacterium bovis subsp bovis AF2122/97
ggugccagaccagggcagcggc

SEQ ID NO: 3073807 - RNA, 19 nt, Mycobacterium bovis subsp bovis AF2122/97
ggugccagcaccacgucga

SEQ ID NO: 3073808 - RNA, 16 nt, Mycobacterium bovis subsp bovis AF2122/97
ggugccagcaggccga

SEQ ID NO: 3073809 - RNA, 11 nt, Mycobacterium bovis subsp bovis AF2122/97
ggugccagccg

SEQ ID NO: 3073810 - RNA, 21 nt, Mycobacterium bovis subsp bovis AF2122/97
ggugccagccggauguugguc

SEQ ID NO: 3073811 - RNA, 16 nt, Mycobacterium bovis subsp bovis AF2122/97
ggugccagccggucga

SEQ ID NO: 3073812 - RNA, 17 nt, Mycobacterium bovis subsp bovis AF2122/97
ggugccagccggucgau

SEQ ID NO: 3073813 - RNA, 16 nt, Mycobacterium bovis subsp bovis AF2122/97
ggugccaguccaaaac

SEQ ID NO: 3073814 - RNA, 17 nt, Mycobacterium bovis subsp bovis AF2122/97
ggugccaucgguggugg

SEQ ID NO: 3073815 - RNA, 19 nt, Mycobacterium bovis subsp bovis AF2122/97
ggugccaucggugguggcg

SEQ ID NO: 3073816 - RNA, 21 nt, Mycobacterium bovis subsp bovis AF2122/97
ggugcccaacccacucgcagc

SEQ ID NO: 3073817 - RNA, 23 nt, Mycobacterium bovis subsp bovis AF2122/97
ggugcccaaggcagacccccagc

SEQ ID NO: 3073818 - RNA, 14 nt, Mycobacterium bovis subsp bovis AF2122/97
ggugcccaccaccg

SEQ ID NO: 3073819 - RNA, 15 nt, Mycobacterium bovis subsp bovis AF2122/97
ggugcccagcagcgc

SEQ ID NO: 3073820 - RNA, 13 nt, Mycobacterium bovis subsp bovis AF2122/97
ggugcccagcgcu

SEQ ID NO: 3073821 - RNA, 23 nt, Mycobacterium bovis subsp bovis AF2122/97
ggugcccagcguggcuggcaccu

SEQ ID NO: 3073822 - RNA, 16 nt, Mycobacterium bovis subsp bovis AF2122/97
ggugcccaugaugguc

SEQ ID NO: 3073823 - RNA, 16 nt, Mycobacterium bovis subsp bovis AF2122/97
ggugcccccggugccg

SEQ ID NO: 3073824 - RNA, 16 nt, Mycobacterium bovis subsp bovis AF2122/97
ggugcccgaguucgca

SEQ ID NO: 3073825 - RNA, 15 nt, Mycobacterium bovis subsp bovis AF2122/97
ggugcccgcaccaca

SEQ ID NO: 3073826 - RNA, 16 nt, Mycobacterium bovis subsp bovis AF2122/97
ggugcccgcaccacac

SEQ ID NO: 3073827 - RNA, 13 nt, Mycobacterium bovis subsp bovis AF2122/97
ggugcccggccgc

SEQ ID NO: 3073828 - RNA, 15 nt, Mycobacterium bovis subsp bovis AF2122/97
ggugcccggccgcca

SEQ ID NO: 3073829 - RNA, 14 nt, Mycobacterium bovis subsp bovis AF2122/97
ggugcccggcggcc

SEQ ID NO: 3073830 - RNA, 15 nt, Mycobacterium bovis subsp bovis AF2122/97
ggugcccucggccgc

SEQ ID NO: 3073831 - RNA, 18 nt, Mycobacterium bovis subsp bovis AF2122/97
ggugcccucggccgccug

SEQ ID NO: 3073832 - RNA, 17 nt, Mycobacterium bovis subsp bovis AF2122/97
ggugccgugaucggcgc

SEQ ID NO: 3073833 - RNA, 15 nt, Mycobacterium bovis subsp bovis AF2122/97
ggugccgugcucacg

SEQ ID NO: 3073834 - RNA, 20 nt, Mycobacterium bovis subsp bovis AF2122/97
ggugccgugcucacggcagg

SEQ ID NO: 3073835 - RNA, 23 nt, Mycobacterium bovis subsp bovis AF2122/97
ggugccgugcucacggcaggcgg

SEQ ID NO: 3073836 - RNA, 24 nt, Mycobacterium bovis subsp bovis AF2122/97
ggugccgugcucacggcaggcggu

SEQ ID NO: 3073837 - RNA, 19 nt, Mycobacterium bovis subsp bovis AF2122/97
ggugccguugcgucugcuc

SEQ ID NO: 3073838 - RNA, 23 nt, Mycobacterium bovis subsp bovis AF2122/97
ggugccguugcgucugcucggcg

SEQ ID NO: 3073839 - RNA, 18 nt, Mycobacterium bovis subsp bovis AF2122/97
ggugccguuggagccgcc

SEQ ID NO: 3073840 - RNA, 20 nt, Mycobacterium bovis subsp bovis AF2122/97
ggugccguuggagccgccac

SEQ ID NO: 3073841 - RNA, 16 nt, Mycobacterium bovis subsp bovis AF2122/97
ggugccuacaccggca

SEQ ID NO: 3073842 - RNA, 19 nt, Mycobacterium bovis subsp bovis AF2122/97
ggugccucgcagccaacgc

SEQ ID NO: 3073843 - RNA, 15 nt, Mycobacterium bovis subsp bovis AF2122/97
ggugccugcagcuug

SEQ ID NO: 3073844 - RNA, 13 nt, Mycobacterium bovis subsp bovis AF2122/97
ggugccugucaga

SEQ ID NO: 3073845 - RNA, 17 nt, Mycobacterium bovis subsp bovis AF2122/97
ggugccugucagaagga

SEQ ID NO: 3073846 - RNA, 21 nt, Mycobacterium bovis subsp bovis AF2122/97
ggugccuguugcgaccauccg

SEQ ID NO: 3073847 - RNA, 17 nt, Mycobacterium bovis subsp bovis AF2122/97
ggugcgacgcgaccgcg

SEQ ID NO: 3073848 - RNA, 19 nt, Mycobacterium bovis subsp bovis AF2122/97
ggugcgacgcgaccgcgau

SEQ ID NO: 3073849 - RNA, 18 nt, Mycobacterium bovis subsp bovis AF2122/97
ggugcgaucccacccucg

SEQ ID NO: 3073850 - RNA, 19 nt, Mycobacterium bovis subsp bovis AF2122/97
ggugcgaucccacccucgg

SEQ ID NO: 3073851 - RNA, 21 nt, Mycobacterium bovis subsp bovis AF2122/97
ggugcgaucgcaacaccggug

SEQ ID NO: 3073852 - RNA, 17 nt, Mycobacterium bovis subsp bovis AF2122/97
ggugcgauuccgcgucu

SEQ ID NO: 3073853 - RNA, 21 nt, Mycobacterium bovis subsp bovis AF2122/97
ggugcgcaaucgacaccagcg

SEQ ID NO: 3073854 - RNA, 16 nt, Mycobacterium bovis subsp bovis AF2122/97
ggugcgcagggccugg

SEQ ID NO: 3073855 - RNA, 17 nt, Mycobacterium bovis subsp bovis AF2122/97
ggugcgcagguacgccu

SEQ ID NO: 3073856 - RNA, 23 nt, Mycobacterium bovis subsp bovis AF2122/97
ggugcgcauggacaacagcuugg

SEQ ID NO: 3073857 - RNA, 20 nt, Mycobacterium bovis subsp bovis AF2122/97
ggugcgccagaucaccgucg

SEQ ID NO: 3073858 - RNA, 16 nt, Mycobacterium bovis subsp bovis AF2122/97
ggugcgccauucccgg

SEQ ID NO: 3073859 - RNA, 19 nt, Mycobacterium bovis subsp bovis AF2122/97
ggugcgccauugcgggaac

SEQ ID NO: 3073860 - RNA, 16 nt, Mycobacterium bovis subsp bovis AF2122/97
ggugcgcccgccggcg

SEQ ID NO: 3073861 - RNA, 17 nt, Mycobacterium bovis subsp bovis AF2122/97
ggugcgcccgccggcgc

SEQ ID NO: 3073862 - RNA, 15 nt, Mycobacterium bovis subsp bovis AF2122/97
ggugcgccgaucccg

SEQ ID NO: 3073863 - RNA, 16 nt, Mycobacterium bovis subsp bovis AF2122/97
ggugcgccgcagcagg

SEQ ID NO: 3073864 - RNA, 23 nt, Mycobacterium bovis subsp bovis AF2122/97
ggugcgccgggcguccgccggcg

SEQ ID NO: 3073865 - RNA, 14 nt, Mycobacterium bovis subsp bovis AF2122/97
ggugcgccgucagc

SEQ ID NO: 3073866 - RNA, 22 nt, Mycobacterium bovis subsp bovis AF2122/97
ggugcgccguugccgccgucgc

SEQ ID NO: 3073867 - RNA, 23 nt, Mycobacterium bovis subsp bovis AF2122/97
ggugcgccguugccgccgucgcc

SEQ ID NO: 3073868 - RNA, 15 nt, Mycobacterium bovis subsp bovis AF2122/97
ggugcgcgaggucgg

SEQ ID NO: 3073869 - RNA, 13 nt, Mycobacterium bovis subsp bovis AF2122/97
ggugcgcgcggcg

SEQ ID NO: 3073870 - RNA, 15 nt, Mycobacterium bovis subsp bovis AF2122/97
ggugcgcgcggucga

SEQ ID NO: 3073871 - RNA, 20 nt, Mycobacterium bovis subsp bovis AF2122/97
ggugcgcugcgaucaccccc

SEQ ID NO: 3073872 - RNA, 18 nt, Mycobacterium bovis subsp bovis AF2122/97
ggugcgcuggaggcuccu

SEQ ID NO: 3073873 - RNA, 24 nt, Mycobacterium bovis subsp bovis AF2122/97
ggugcgcuggaugugggcgcucgc

SEQ ID NO: 3073874 - RNA, 12 nt, Mycobacterium bovis subsp bovis AF2122/97
ggugcgcuggcg

SEQ ID NO: 3073875 - RNA, 16 nt, Mycobacterium bovis subsp bovis AF2122/97
ggugcgcuggcggcgc

SEQ ID NO: 3073876 - RNA, 19 nt, Mycobacterium bovis subsp bovis AF2122/97
ggugcgcuugcggccgcgc

SEQ ID NO: 3073877 - RNA, 23 nt, Mycobacterium bovis subsp bovis AF2122/97
ggugcgcuugcggccgcgcgccg

SEQ ID NO: 3073878 - RNA, 14 nt, Mycobacterium bovis subsp bovis AF2122/97
ggugcggacuucga

SEQ ID NO: 3073879 - RNA, 17 nt, Mycobacterium bovis subsp bovis AF2122/97
ggugcggauuuguguac

SEQ ID NO: 3073880 - RNA, 23 nt, Mycobacterium bovis subsp bovis AF2122/97
ggugcggcccugcuugcaggcga

SEQ ID NO: 3073881 - RNA, 16 nt, Mycobacterium bovis subsp bovis AF2122/97
ggugcggccgcggcga

SEQ ID NO: 3073882 - RNA, 17 nt, Mycobacterium bovis subsp bovis AF2122/97
ggugcggccgcggcgau

SEQ ID NO: 3073883 - RNA, 15 nt, Mycobacterium bovis subsp bovis AF2122/97
ggugcggccgggucg

SEQ ID NO: 3073884 - RNA, 16 nt, Mycobacterium bovis subsp bovis AF2122/97
ggugcggccgggucgc

SEQ ID NO: 3073885 - RNA, 14 nt, Mycobacterium bovis subsp bovis AF2122/97
ggugcggcggcauc

SEQ ID NO: 3073886 - RNA, 15 nt, Mycobacterium bovis subsp bovis AF2122/97
ggugcgggccggugg

SEQ ID NO: 3073887 - RNA, 16 nt, Mycobacterium bovis subsp bovis AF2122/97
ggugcgggcuaggcgg

SEQ ID NO: 3073888 - RNA, 18 nt, Mycobacterium bovis subsp bovis AF2122/97
ggugcgggcuaggcggcg

SEQ ID NO: 3073889 - RNA, 19 nt, Mycobacterium bovis subsp bovis AF2122/97
ggugcgggguuggccgugg

SEQ ID NO: 3073890 - RNA, 19 nt, Mycobacterium bovis subsp bovis AF2122/97
ggugcggguggugccggcg

SEQ ID NO: 3073891 - RNA, 20 nt, Mycobacterium bovis subsp bovis AF2122/97
ggugcggguggugccggcgg

SEQ ID NO: 3073892 - RNA, 18 nt, Mycobacterium bovis subsp bovis AF2122/97
ggugcggucagauucggc

SEQ ID NO: 3073893 - RNA, 16 nt, Mycobacterium bovis subsp bovis AF2122/97
ggugcgguucgcugcg

SEQ ID NO: 3073894 - RNA, 21 nt, Mycobacterium bovis subsp bovis AF2122/97
ggugcgguucgcugcggcggu

SEQ ID NO: 3073895 - RNA, 16 nt, Mycobacterium bovis subsp bovis AF2122/97
ggugcgucacagccgg

SEQ ID NO: 3073896 - RNA, 18 nt, Mycobacterium bovis subsp bovis AF2122/97
ggugcgucacagccgggu

SEQ ID NO: 3073897 - RNA, 20 nt, Mycobacterium bovis subsp bovis AF2122/97
ggugcgucacagccggguuu

SEQ ID NO: 3073898 - RNA, 22 nt, Mycobacterium bovis subsp bovis AF2122/97
ggugcguccaggccagggcggu

SEQ ID NO: 3073899 - RNA, 14 nt, Mycobacterium bovis subsp bovis AF2122/97
ggugcgucgaugag

SEQ ID NO: 3073900 - RNA, 14 nt, Mycobacterium bovis subsp bovis AF2122/97
ggugcgucugggca

SEQ ID NO: 3073901 - RNA, 16 nt, Mycobacterium bovis subsp bovis AF2122/97
ggugcgugcgcgucgg

SEQ ID NO: 3073902 - RNA, 17 nt, Mycobacterium bovis subsp bovis AF2122/97
ggugcguggaauggcgc

SEQ ID NO: 3073903 - RNA, 21 nt, Mycobacterium bovis subsp bovis AF2122/97
ggugcguggaauggcgccggc

SEQ ID NO: 3073904 - RNA, 17 nt, Mycobacterium bovis subsp bovis AF2122/97
ggugcuaaccgacgcug

SEQ ID NO: 3073905 - RNA, 21 nt, Mycobacterium bovis subsp bovis AF2122/97
ggugcuaccggcuuggcggga

SEQ ID NO: 3073906 - RNA, 15 nt, Mycobacterium bovis subsp bovis AF2122/97
ggugcuacuggugug

SEQ ID NO: 3073907 - RNA, 22 nt, Mycobacterium bovis subsp bovis AF2122/97
ggugcuagcgccgccagucguc

SEQ ID NO: 3073908 - RNA, 20 nt, Mycobacterium bovis subsp bovis AF2122/97
ggugcucaacggcgacaucg

SEQ ID NO: 3073909 - RNA, 21 nt, Mycobacterium bovis subsp bovis AF2122/97
ggugcucaacggcgacaucgg

SEQ ID NO: 3073910 - RNA, 16 nt, Mycobacterium bovis subsp bovis AF2122/97
ggugcucaagcgcguc

SEQ ID NO: 3073911 - RNA, 17 nt, Mycobacterium bovis subsp bovis AF2122/97
ggugcucaaggcuucgg

SEQ ID NO: 3073912 - RNA, 15 nt, Mycobacterium bovis subsp bovis AF2122/97
ggugcucagcggcuc

SEQ ID NO: 3073913 - RNA, 17 nt, Mycobacterium bovis subsp bovis AF2122/97
ggugcucagcggcucgc

SEQ ID NO: 3073914 - RNA, 17 nt, Mycobacterium bovis subsp bovis AF2122/97
ggugcucggucgaugcu

SEQ ID NO: 3073915 - RNA, 22 nt, Mycobacterium bovis subsp bovis AF2122/97
ggugcucgucaccaaacccgau

SEQ ID NO: 3073916 - RNA, 24 nt, Mycobacterium bovis subsp bovis AF2122/97
ggugcucgucaccaaacccgaugg

SEQ ID NO: 3073917 - RNA, 22 nt, Mycobacterium bovis subsp bovis AF2122/97
ggugcucuucggcaccaccgcg

SEQ ID NO: 3073918 - RNA, 20 nt, Mycobacterium bovis subsp bovis AF2122/97
gguggcgccgaacgcaacgc

SEQ ID NO: 3073919 - RNA, 17 nt, Mycobacterium bovis subsp bovis AF2122/97
gguggcgccgaccugga

SEQ ID NO: 3073920 - RNA, 14 nt, Mycobacterium bovis subsp bovis AF2122/97
gguggcgccgacgu

SEQ ID NO: 3073921 - RNA, 11 nt, Mycobacterium bovis subsp bovis AF2122/97
gguggcgccgu

SEQ ID NO: 3073922 - RNA, 14 nt, Mycobacterium bovis subsp bovis AF2122/97
gguggcgccgucgg

SEQ ID NO: 3073923 - RNA, 15 nt, Mycobacterium bovis subsp bovis AF2122/97
gguggcgccgucggc

SEQ ID NO: 3073924 - RNA, 21 nt, Mycobacterium bovis subsp bovis AF2122/97
gguggcgccguugucggcggu

SEQ ID NO: 3073925 - RNA, 15 nt, Mycobacterium bovis subsp bovis AF2122/97
gguggcgcgcagcgc

SEQ ID NO: 3073926 - RNA, 18 nt, Mycobacterium bovis subsp bovis AF2122/97
gguggcgcgggccggcga

SEQ ID NO: 3073927 - RNA, 13 nt, Mycobacterium bovis subsp bovis AF2122/97
gguggcgcggugc

SEQ ID NO: 3073928 - RNA, 10 nt, Mycobacterium bovis subsp bovis AF2122/97
gguggcggca

SEQ ID NO: 3073929 - RNA, 11 nt, Mycobacterium bovis subsp bovis AF2122/97
gguggcggcag

SEQ ID NO: 3073930 - RNA, 13 nt, Mycobacterium bovis subsp bovis AF2122/97
gguggcggccucc

SEQ ID NO: 3073931 - RNA, 17 nt, Mycobacterium bovis subsp bovis AF2122/97
gguggcggcgagcagca

SEQ ID NO: 3073932 - RNA, 22 nt, Mycobacterium bovis subsp bovis AF2122/97
gguggcggcggcggcaacggcg

SEQ ID NO: 3073933 - RNA, 16 nt, Mycobacterium bovis subsp bovis AF2122/97
gguggcgggcgaugcg

SEQ ID NO: 3073934 - RNA, 14 nt, Mycobacterium bovis subsp bovis AF2122/97
gguggcgggcuugc

SEQ ID NO: 3073935 - RNA, 16 nt, Mycobacterium bovis subsp bovis AF2122/97
gguggcgggcuugccg

SEQ ID NO: 3073936 - RNA, 18 nt, Mycobacterium bovis subsp bovis AF2122/97
gguggcggggugggugac

SEQ ID NO: 3073937 - RNA, 16 nt, Mycobacterium bovis subsp bovis AF2122/97
gguggcggugcggcga

SEQ ID NO: 3073938 - RNA, 15 nt, Mycobacterium bovis subsp bovis AF2122/97
gguggcguaucgggc

SEQ ID NO: 3073939 - RNA, 18 nt, Mycobacterium bovis subsp bovis AF2122/97
gguggcguccagggcgcc

SEQ ID NO: 3073940 - RNA, 13 nt, Mycobacterium bovis subsp bovis AF2122/97
gguggcgucgcgg

SEQ ID NO: 3073941 - RNA, 14 nt, Mycobacterium bovis subsp bovis AF2122/97
gguggcgugcgcgu

SEQ ID NO: 3073942 - RNA, 20 nt, Mycobacterium bovis subsp bovis AF2122/97
gguggcguggcccucggcga

SEQ ID NO: 3073943 - RNA, 15 nt, Mycobacterium bovis subsp bovis AF2122/97
gguggcucggguggu

SEQ ID NO: 3073944 - RNA, 20 nt, Mycobacterium bovis subsp bovis AF2122/97
gguggcucgggugguuugcg

SEQ ID NO: 3073945 - RNA, 19 nt, Mycobacterium bovis subsp bovis AF2122/97
gguggcucuguagcgucgc

SEQ ID NO: 3073946 - RNA, 20 nt, Mycobacterium bovis subsp bovis AF2122/97
gguggcugaucaccguugcg

SEQ ID NO: 3073947 - RNA, 23 nt, Mycobacterium bovis subsp bovis AF2122/97
gguggcugcgccggaaccccucg

SEQ ID NO: 3073948 - RNA, 24 nt, Mycobacterium bovis subsp bovis AF2122/97
gguggcuggccgccaccgcacgca

SEQ ID NO: 3073949 - RNA, 18 nt, Mycobacterium bovis subsp bovis AF2122/97
gguggcuucgacggcggc

SEQ ID NO: 3073950 - RNA, 16 nt, Mycobacterium bovis subsp bovis AF2122/97
gguggcuugccccgcc

SEQ ID NO: 3073951 - RNA, 20 nt, Mycobacterium bovis subsp bovis AF2122/97
gguggcuuuugcgucugcuc

SEQ ID NO: 3073952 - RNA, 13 nt, Mycobacterium bovis subsp bovis AF2122/97
ggugggagcagcc

SEQ ID NO: 3073953 - RNA, 18 nt, Mycobacterium bovis subsp bovis AF2122/97
ggugggaucgcagcgcca

SEQ ID NO: 3073954 - RNA, 16 nt, Mycobacterium bovis subsp bovis AF2122/97
ggugggcacaccggug

SEQ ID NO: 3073955 - RNA, 22 nt, Mycobacterium bovis subsp bovis AF2122/97
ggugggcagcagcuggucgugg

SEQ ID NO: 3073956 - RNA, 16 nt, Mycobacterium bovis subsp bovis AF2122/97
ggugggccagcagcaa

SEQ ID NO: 3073957 - RNA, 20 nt, Mycobacterium bovis subsp bovis AF2122/97
ggugggcgcagagucaacgu

SEQ ID NO: 3073958 - RNA, 12 nt, Mycobacterium bovis subsp bovis AF2122/97
ggugggcgccgc

SEQ ID NO: 3073959 - RNA, 22 nt, Mycobacterium bovis subsp bovis AF2122/97
ggugggcgccgcaaccgccgcg

SEQ ID NO: 3073960 - RNA, 13 nt, Mycobacterium bovis subsp bovis AF2122/97
ggugggcgcuggg

SEQ ID NO: 3073961 - RNA, 16 nt, Mycobacterium bovis subsp bovis AF2122/97
ggugggcggcucgucg

SEQ ID NO: 3073962 - RNA, 15 nt, Mycobacterium bovis subsp bovis AF2122/97
ggugggcgggugcgc

SEQ ID NO: 3073963 - RNA, 21 nt, Mycobacterium bovis subsp bovis AF2122/97
ggugggcgugacgggcaggag

SEQ ID NO: 3073964 - RNA, 13 nt, Mycobacterium bovis subsp bovis AF2122/97
ggugggcuugccg

SEQ ID NO: 3073965 - RNA, 16 nt, Mycobacterium bovis subsp bovis AF2122/97
ggugggcuugccgcgc

SEQ ID NO: 3073966 - RNA, 21 nt, Mycobacterium bovis subsp bovis AF2122/97
gguggggauagccgcgucgcg

SEQ ID NO: 3073967 - RNA, 13 nt, Mycobacterium bovis subsp bovis AF2122/97
gguggggccggcg

SEQ ID NO: 3073968 - RNA, 14 nt, Mycobacterium bovis subsp bovis AF2122/97
gguggggccggcgg

SEQ ID NO: 3073969 - RNA, 17 nt, Mycobacterium bovis subsp bovis AF2122/97
gguggggccggcggugu

SEQ ID NO: 3073970 - RNA, 14 nt, Mycobacterium bovis subsp bovis AF2122/97
gguggggcgcgccg

SEQ ID NO: 3073971 - RNA, 15 nt, Mycobacterium bovis subsp bovis AF2122/97
ggugggggcaucagg

SEQ ID NO: 3073972 - RNA, 14 nt, Mycobacterium bovis subsp bovis AF2122/97
gguggggucgacgc

SEQ ID NO: 3073973 - RNA, 23 nt, Mycobacterium bovis subsp bovis AF2122/97
gguggggucgcugccgccgucgc

SEQ ID NO: 3073974 - RNA, 13 nt, Mycobacterium bovis subsp bovis AF2122/97
ggugggguggugg

SEQ ID NO: 3073975 - RNA, 14 nt, Mycobacterium bovis subsp bovis AF2122/97
gguggguagccagc

SEQ ID NO: 3073976 - RNA, 13 nt, Mycobacterium bovis subsp bovis AF2122/97
ggugggucggcuu

SEQ ID NO: 3073977 - RNA, 14 nt, Mycobacterium bovis subsp bovis AF2122/97
ggugggucggggcg

SEQ ID NO: 3073978 - RNA, 22 nt, Mycobacterium bovis subsp bovis AF2122/97
ggugggugaacgccugcgggaa

SEQ ID NO: 3073979 - RNA, 17 nt, Mycobacterium bovis subsp bovis AF2122/97
ggugggugccggcgucg

SEQ ID NO: 3073980 - RNA, 18 nt, Mycobacterium bovis subsp bovis AF2122/97
ggugggugccggcgucgc

SEQ ID NO: 3073981 - RNA, 22 nt, Mycobacterium bovis subsp bovis AF2122/97
ggugggugccggcgucgcuggc

SEQ ID NO: 3073982 - RNA, 15 nt, Mycobacterium bovis subsp bovis AF2122/97
ggugguaacggcggc

SEQ ID NO: 3073983 - RNA, 17 nt, Mycobacterium bovis subsp bovis AF2122/97
ggugguacagggugugc

SEQ ID NO: 3073984 - RNA, 18 nt, Mycobacterium bovis subsp bovis AF2122/97
ggugguaccggcgccacc

SEQ ID NO: 3073985 - RNA, 15 nt, Mycobacterium bovis subsp bovis AF2122/97
ggugguaccggcggc

SEQ ID NO: 3073986 - RNA, 21 nt, Mycobacterium bovis subsp bovis AF2122/97
ggugguagcggacagcucgcg

SEQ ID NO: 3073987 - RNA, 18 nt, Mycobacterium bovis subsp bovis AF2122/97
ggugguagcugacgcugc

SEQ ID NO: 3073988 - RNA, 14 nt, Mycobacterium bovis subsp bovis AF2122/97
ggugguaggccggg

SEQ ID NO: 3073989 - RNA, 19 nt, Mycobacterium bovis subsp bovis AF2122/97
gguggucaccaccaucacg

SEQ ID NO: 3073990 - RNA, 23 nt, Mycobacterium bovis subsp bovis AF2122/97
gguggucacgcagucgggcagcg

SEQ ID NO: 3073991 - RNA, 18 nt, Mycobacterium bovis subsp bovis AF2122/97
gguggucagcaccggcgc

SEQ ID NO: 3073992 - RNA, 20 nt, Mycobacterium bovis subsp bovis AF2122/97
gguggucagguuggcacgcu

SEQ ID NO: 3073993 - RNA, 17 nt, Mycobacterium bovis subsp bovis AF2122/97
gguggucaguccgucgg

SEQ ID NO: 3073994 - RNA, 20 nt, Mycobacterium bovis subsp bovis AF2122/97
gguggucccccgcagccaga

SEQ ID NO: 3073995 - RNA, 21 nt, Mycobacterium bovis subsp bovis AF2122/97
gguggucgacccggccaggag

SEQ ID NO: 3073996 - RNA, 16 nt, Mycobacterium bovis subsp bovis AF2122/97
gguggucgcaccgccg

SEQ ID NO: 3073997 - RNA, 15 nt, Mycobacterium bovis subsp bovis AF2122/97
gguggucgggcgcaa

SEQ ID NO: 3073998 - RNA, 21 nt, Mycobacterium bovis subsp bovis AF2122/97
gguggucgggucgaucaccga

SEQ ID NO: 3073999 - RNA, 16 nt, Mycobacterium bovis subsp bovis AF2122/97
gguggucgucccgaug

SEQ ID NO: 3074000 - RNA, 17 nt, Mycobacterium bovis subsp bovis AF2122/97
gguggucucgguaggcg

SEQ ID NO: 3074001 - RNA, 16 nt, Mycobacterium bovis subsp bovis AF2122/97
gguggucuuggcggug

SEQ ID NO: 3074002 - RNA, 13 nt, Mycobacterium bovis subsp bovis AF2122/97
gguggugacacga

SEQ ID NO: 3074003 - RNA, 21 nt, Mycobacterium bovis subsp bovis AF2122/97
gguggugacacgacgugcagg

SEQ ID NO: 3074004 - RNA, 13 nt, Mycobacterium bovis subsp bovis AF2122/97
gguggugagcuga

SEQ ID NO: 3074005 - RNA, 17 nt, Mycobacterium bovis subsp bovis AF2122/97
gguguggccucgucccg

SEQ ID NO: 3074006 - RNA, 21 nt, Mycobacterium bovis subsp bovis AF2122/97
gguguggccuugcgucaucgg

SEQ ID NO: 3074007 - RNA, 15 nt, Mycobacterium bovis subsp bovis AF2122/97
gguguggucgagcgg

SEQ ID NO: 3074008 - RNA, 17 nt, Mycobacterium bovis subsp bovis AF2122/97
gguguggucggcugugg

SEQ ID NO: 3074009 - RNA, 19 nt, Mycobacterium bovis subsp bovis AF2122/97
gguguguauucgccgacgu

SEQ ID NO: 3074010 - RNA, 13 nt, Mycobacterium bovis subsp bovis AF2122/97
ggugugucggguu

SEQ ID NO: 3074011 - RNA, 20 nt, Mycobacterium bovis subsp bovis AF2122/97
gguguguucggagcugggcu

SEQ ID NO: 3074012 - RNA, 16 nt, Mycobacterium bovis subsp bovis AF2122/97
gguguuaaugaccgcg

SEQ ID NO: 3074013 - RNA, 20 nt, Mycobacterium bovis subsp bovis AF2122/97
gguguuauugaugcccgacu

SEQ ID NO: 3074014 - RNA, 19 nt, Mycobacterium bovis subsp bovis AF2122/97
gguguuccggucgcccgag

SEQ ID NO: 3074015 - RNA, 20 nt, Mycobacterium bovis subsp bovis AF2122/97
gguguuccggucgcccgagu

SEQ ID NO: 3074016 - RNA, 17 nt, Mycobacterium bovis subsp bovis AF2122/97
gguguucgggcagcugg

SEQ ID NO: 3074017 - RNA, 17 nt, Mycobacterium bovis subsp bovis AF2122/97
gguguucgggucgauca

SEQ ID NO: 3074018 - RNA, 21 nt, Mycobacterium bovis subsp bovis AF2122/97
gguguucgggucgaucaccga

SEQ ID NO: 3074019 - RNA, 17 nt, Mycobacterium bovis subsp bovis AF2122/97
gguguugagaucgcccg

SEQ ID NO: 3074020 - RNA, 20 nt, Mycobacterium bovis subsp bovis AF2122/97
gguguugagaucgcccgagu

SEQ ID NO: 3074021 - RNA, 18 nt, Mycobacterium bovis subsp bovis AF2122/97
gguguugaggccggugaa

SEQ ID NO: 3074022 - RNA, 20 nt, Mycobacterium bovis subsp bovis AF2122/97
gguguuggaagucccgccgu

SEQ ID NO: 3074023 - RNA, 19 nt, Mycobacterium bovis subsp bovis AF2122/97
gguguuggacacucccggg

SEQ ID NO: 3074024 - RNA, 18 nt, Mycobacterium bovis subsp bovis AF2122/97
gguguuguaggccgggcc

SEQ ID NO: 3074025 - RNA, 18 nt, Mycobacterium bovis subsp bovis AF2122/97
gguguugucgucgagcgc

SEQ ID NO: 3074026 - RNA, 19 nt, Mycobacterium bovis subsp bovis AF2122/97
gguguugucgucgagcgcg

SEQ ID NO: 3074027 - RNA, 19 nt, Mycobacterium bovis subsp bovis AF2122/97
gguguugugugcucgucgc

SEQ ID NO: 3074028 - RNA, 18 nt, Mycobacterium bovis subsp bovis AF2122/97
gguguuuauggcccuggg

SEQ ID NO: 3074029 - RNA, 17 nt, Mycobacterium bovis subsp bovis AF2122/97
gguguuuaugguugugc

SEQ ID NO: 3074030 - RNA, 16 nt, Mycobacterium bovis subsp bovis AF2122/97
gguguuuccgaaaccc

SEQ ID NO: 3074031 - RNA, 21 nt, Mycobacterium bovis subsp bovis AF2122/97
gguguuuccgaaacccgccgc

SEQ ID NO: 3074032 - RNA, 17 nt, Mycobacterium bovis subsp bovis AF2122/97
gguguuugucgcggugg

SEQ ID NO: 3074033 - RNA, 14 nt, Mycobacterium bovis subsp bovis AF2122/97
gguuacccgcagcg

SEQ ID NO: 3074034 - RNA, 17 nt, Mycobacterium bovis subsp bovis AF2122/97
gguuacucgcagcgccg

SEQ ID NO: 3074035 - RNA, 14 nt, Mycobacterium bovis subsp bovis AF2122/97
gguuagccgcggcc

SEQ ID NO: 3074036 - RNA, 15 nt, Mycobacterium bovis subsp bovis AF2122/97
gguuagccgcggccc

SEQ ID NO: 3074037 - RNA, 21 nt, Mycobacterium bovis subsp bovis AF2122/97
gguuagggacuuuccggcgca

SEQ ID NO: 3074038 - RNA, 16 nt, Mycobacterium bovis subsp bovis AF2122/97
gguuagggcgugucuu

SEQ ID NO: 3074039 - RNA, 21 nt, Mycobacterium bovis subsp bovis AF2122/97
gguuaucgccgagauccgcgc

SEQ ID NO: 3074040 - RNA, 17 nt, Mycobacterium bovis subsp bovis AF2122/97
gguuaucgucgggucac

SEQ ID NO: 3074041 - RNA, 15 nt, Mycobacterium bovis subsp bovis AF2122/97
gguucaaagcagcgc

SEQ ID NO: 3074042 - RNA, 20 nt, Mycobacterium bovis subsp bovis AF2122/97
gguucaaccggacgaccgga

SEQ ID NO: 3074043 - RNA, 14 nt, Mycobacterium bovis subsp bovis AF2122/97
gguucaacgcgcgc

SEQ ID NO: 3074044 - RNA, 16 nt, Mycobacterium bovis subsp bovis AF2122/97
gguucaccucggcgac

SEQ ID NO: 3074045 - RNA, 18 nt, Mycobacterium bovis subsp bovis AF2122/97
gguucacggggaccagau

SEQ ID NO: 3074046 - RNA, 16 nt, Mycobacterium bovis subsp bovis AF2122/97
gguucacucucggcgc

SEQ ID NO: 3074047 - RNA, 19 nt, Mycobacterium bovis subsp bovis AF2122/97
gguucacuuccgggcagcu

SEQ ID NO: 3074048 - RNA, 18 nt, Mycobacterium bovis subsp bovis AF2122/97
gguucagccacgcagcac

SEQ ID NO: 3074049 - RNA, 20 nt, Mycobacterium bovis subsp bovis AF2122/97
gguucagccacgcagcacgg

SEQ ID NO: 3074050 - RNA, 22 nt, Mycobacterium bovis subsp bovis AF2122/97
gguucagccacgcagcacggca

SEQ ID NO: 3074051 - RNA, 21 nt, Mycobacterium bovis subsp bovis AF2122/97
gguucagccugagcacguuca

SEQ ID NO: 3074052 - RNA, 20 nt, Mycobacterium bovis subsp bovis AF2122/97
gguucagcgcuggcaggccg

SEQ ID NO: 3074053 - RNA, 16 nt, Mycobacterium bovis subsp bovis AF2122/97
gguucagguugagugu

SEQ ID NO: 3074054 - RNA, 20 nt, Mycobacterium bovis subsp bovis AF2122/97
gguucaucgccggcgcgccg

SEQ ID NO: 3074055 - RNA, 18 nt, Mycobacterium bovis subsp bovis AF2122/97
gguucaugaacaucggcc

SEQ ID NO: 3074056 - RNA, 23 nt, Mycobacterium bovis subsp bovis AF2122/97
gguuccaagggaauucccgcagg

SEQ ID NO: 3074057 - RNA, 17 nt, Mycobacterium bovis subsp bovis AF2122/97
gguuccagcggcaccgc

SEQ ID NO: 3074058 - RNA, 18 nt, Mycobacterium bovis subsp bovis AF2122/97
gguuccagcggcaccgcg

SEQ ID NO: 3074059 - RNA, 19 nt, Mycobacterium bovis subsp bovis AF2122/97
gguuccagcggcaccgcgg

SEQ ID NO: 3074060 - RNA, 14 nt, Mycobacterium bovis subsp bovis AF2122/97
gguucccgggcagc

SEQ ID NO: 3074061 - RNA, 19 nt, Mycobacterium bovis subsp bovis AF2122/97
gguucccgggcagccgcac

SEQ ID NO: 3074062 - RNA, 19 nt, Mycobacterium bovis subsp bovis AF2122/97
gguucccuuguucccgaaa

SEQ ID NO: 3074063 - RNA, 18 nt, Mycobacterium bovis subsp bovis AF2122/97
gguuccgaucucaagggc

SEQ ID NO: 3074064 - RNA, 14 nt, Mycobacterium bovis subsp bovis AF2122/97
gguuccgcugucga

SEQ ID NO: 3074065 - RNA, 18 nt, Mycobacterium bovis subsp bovis AF2122/97
gguuccggcgugcagcac

SEQ ID NO: 3074066 - RNA, 18 nt, Mycobacterium bovis subsp bovis AF2122/97
gguuccggcuucguccac

SEQ ID NO: 3074067 - RNA, 20 nt, Mycobacterium bovis subsp bovis AF2122/97
gguuccggcuucguccaccg

SEQ ID NO: 3074068 - RNA, 22 nt, Mycobacterium bovis subsp bovis AF2122/97
gguuccgguguaggccugcccc

SEQ ID NO: 3074069 - RNA, 17 nt, Mycobacterium bovis subsp bovis AF2122/97
gguucgaaucccaucgg

SEQ ID NO: 3074070 - RNA, 22 nt, Mycobacterium bovis subsp bovis AF2122/97
gguucgacccccgcaucggcgc

SEQ ID NO: 3074071 - RNA, 21 nt, Mycobacterium bovis subsp bovis AF2122/97
gguucgacucaugccgagcga

SEQ ID NO: 3074072 - RNA, 13 nt, Mycobacterium bovis subsp bovis AF2122/97
gguucgaggguga

SEQ ID NO: 3074073 - RNA, 20 nt, Mycobacterium bovis subsp bovis AF2122/97
gguucgagucccgucacuca

SEQ ID NO: 3074074 - RNA, 14 nt, Mycobacterium bovis subsp bovis AF2122/97
gguucgaguccugg

SEQ ID NO: 3074075 - RNA, 17 nt, Mycobacterium bovis subsp bovis AF2122/97
gguucgcacaccuccuc

SEQ ID NO: 3074076 - RNA, 19 nt, Mycobacterium bovis subsp bovis AF2122/97
gguucgcacaccuccucga

SEQ ID NO: 3074077 - RNA, 13 nt, Mycobacterium bovis subsp bovis AF2122/97
gguucgcccagcc

SEQ ID NO: 3074078 - RNA, 24 nt, Mycobacterium bovis subsp bovis AF2122/97
gguucgccccugcacagcaggcuc

SEQ ID NO: 3074079 - RNA, 22 nt, Mycobacterium bovis subsp bovis AF2122/97
gguucgccgaagccggaccgca

SEQ ID NO: 3074080 - RNA, 15 nt, Mycobacterium bovis subsp bovis AF2122/97
gguucgcucggggac

SEQ ID NO: 3074081 - RNA, 19 nt, Mycobacterium bovis subsp bovis AF2122/97
gguucggacacacaggcgg

SEQ ID NO: 3074082 - RNA, 21 nt, Mycobacterium bovis subsp bovis AF2122/97
gguucggacacacaggcggcg

SEQ ID NO: 3074083 - RNA, 20 nt, Mycobacterium bovis subsp bovis AF2122/97
gguucggagucacgcagccg

SEQ ID NO: 3074084 - RNA, 20 nt, Mycobacterium bovis subsp bovis AF2122/97
gguucggaugucucggcacc

SEQ ID NO: 3074085 - RNA, 17 nt, Mycobacterium bovis subsp bovis AF2122/97
gguucggccggagccgc

SEQ ID NO: 3074086 - RNA, 13 nt, Mycobacterium bovis subsp bovis AF2122/97
gguucggcgucga

SEQ ID NO: 3074087 - RNA, 19 nt, Mycobacterium bovis subsp bovis AF2122/97
gguucggcgucgacccaga

SEQ ID NO: 3074088 - RNA, 19 nt, Mycobacterium bovis subsp bovis AF2122/97
gguucgggcagcacccgcg

SEQ ID NO: 3074089 - RNA, 16 nt, Mycobacterium bovis subsp bovis AF2122/97
gguucggugaucgggc

SEQ ID NO: 3074090 - RNA, 23 nt, Mycobacterium bovis subsp bovis AF2122/97
gguucgucgaacggaucucggug

SEQ ID NO: 3074091 - RNA, 16 nt, Mycobacterium bovis subsp bovis AF2122/97
gguucgucgucgucgg

SEQ ID NO: 3074092 - RNA, 15 nt, Mycobacterium bovis subsp bovis AF2122/97
gguucgugcacggcg

SEQ ID NO: 3074093 - RNA, 17 nt, Mycobacterium bovis subsp bovis AF2122/97
gguucuccccgcuagcc

SEQ ID NO: 3074094 - RNA, 15 nt, Mycobacterium bovis subsp bovis AF2122/97
gguucugggccugcg

SEQ ID NO: 3074095 - RNA, 23 nt, Mycobacterium bovis subsp bovis AF2122/97
gguucuguuccagaaggccgcac

SEQ ID NO: 3074096 - RNA, 21 nt, Mycobacterium bovis subsp bovis AF2122/97
gguucuucaacuccgggaccg

SEQ ID NO: 3074097 - RNA, 18 nt, Mycobacterium bovis subsp bovis AF2122/97
gguucuucuccaccaccg

SEQ ID NO: 3074098 - RNA, 19 nt, Mycobacterium bovis subsp bovis AF2122/97
gguucuucuccaccaccgu

SEQ ID NO: 3074099 - RNA, 17 nt, Mycobacterium bovis subsp bovis AF2122/97
gguucuugaccagcagc

SEQ ID NO: 3074100 - RNA, 17 nt, Mycobacterium bovis subsp bovis AF2122/97
gguugaaaacgcccggc

SEQ ID NO: 3074101 - RNA, 23 nt, Mycobacterium bovis subsp bovis AF2122/97
gguugaaaacgcccggcacacgg

SEQ ID NO: 3074102 - RNA, 17 nt, Mycobacterium bovis subsp bovis AF2122/97
gguugaacauguccagu

SEQ ID NO: 3074103 - RNA, 17 nt, Mycobacterium bovis subsp bovis AF2122/97
gguugaaccgguacaac

SEQ ID NO: 3074104 - RNA, 14 nt, Mycobacterium bovis subsp bovis AF2122/97
gguugaacgaccuc

SEQ ID NO: 3074105 - RNA, 17 nt, Mycobacterium bovis subsp bovis AF2122/97
gguugaacuggcggugc

SEQ ID NO: 3074106 - RNA, 20 nt, Mycobacterium bovis subsp bovis AF2122/97
gguugacccccggguagacc

SEQ ID NO: 3074107 - RNA, 15 nt, Mycobacterium bovis subsp bovis AF2122/97
gguugaccgaguuga

SEQ ID NO: 3074108 - RNA, 24 nt, Mycobacterium bovis subsp bovis AF2122/97
gguugacggcgaagucgagugccg

SEQ ID NO: 3074109 - RNA, 16 nt, Mycobacterium bovis subsp bovis AF2122/97
gguugacgggcucggc

SEQ ID NO: 3074110 - RNA, 18 nt, Mycobacterium bovis subsp bovis AF2122/97
gguugacguaggcggcgg

SEQ ID NO: 3074111 - RNA, 13 nt, Mycobacterium bovis subsp bovis AF2122/97
gguugagccgccg

SEQ ID NO: 3074112 - RNA, 18 nt, Mycobacterium bovis subsp bovis AF2122/97
gguugaggaucccggccg

SEQ ID NO: 3074113 - RNA, 20 nt, Mycobacterium bovis subsp bovis AF2122/97
gguugaggaucccggccggg

SEQ ID NO: 3074114 - RNA, 18 nt, Mycobacterium bovis subsp bovis AF2122/97
gguugaggucacccggua

SEQ ID NO: 3074115 - RNA, 21 nt, Mycobacterium bovis subsp bovis AF2122/97
gguugaguugcagaccgggug

SEQ ID NO: 3074116 - RNA, 17 nt, Mycobacterium bovis subsp bovis AF2122/97
gguugaucaccgacacc

SEQ ID NO: 3074117 - RNA, 12 nt, Mycobacterium bovis subsp bovis AF2122/97
gguugaucagcc

SEQ ID NO: 3074118 - RNA, 22 nt, Mycobacterium bovis subsp bovis AF2122/97
gguugaucagccagaccaacau

SEQ ID NO: 3074119 - RNA, 12 nt, Mycobacterium bovis subsp bovis AF2122/97
gguugaucgcgc

SEQ ID NO: 3074120 - RNA, 14 nt, Mycobacterium bovis subsp bovis AF2122/97
gguugaucgcgcug

SEQ ID NO: 3074121 - RNA, 17 nt, Mycobacterium bovis subsp bovis AF2122/97
gguugaucugucagcgc

SEQ ID NO: 3074122 - RNA, 16 nt, Mycobacterium bovis subsp bovis AF2122/97
gguugaugaguuccuu

SEQ ID NO: 3074123 - RNA, 15 nt, Mycobacterium bovis subsp bovis AF2122/97
gguugcaucaugccg

SEQ ID NO: 3074124 - RNA, 11 nt, Mycobacterium bovis subsp bovis AF2122/97
gguugccaacc

SEQ ID NO: 3074125 - RNA, 18 nt, Mycobacterium bovis subsp bovis AF2122/97
gguugccaacgaaccgcu

SEQ ID NO: 3074126 - RNA, 13 nt, Mycobacterium bovis subsp bovis AF2122/97
gguugccagcgac

SEQ ID NO: 3074127 - RNA, 14 nt, Mycobacterium bovis subsp bovis AF2122/97
gguugccagcgacg

SEQ ID NO: 3074128 - RNA, 18 nt, Mycobacterium bovis subsp bovis AF2122/97
gguugcccgcauugccaa

SEQ ID NO: 3074129 - RNA, 21 nt, Mycobacterium bovis subsp bovis AF2122/97
gguugccgaucucgcccagcg

SEQ ID NO: 3074130 - RNA, 14 nt, Mycobacterium bovis subsp bovis AF2122/97
gguugccgccgacu

SEQ ID NO: 3074131 - RNA, 12 nt, Mycobacterium bovis subsp bovis AF2122/97
gguugccggcgg

SEQ ID NO: 3074132 - RNA, 14 nt, Mycobacterium bovis subsp bovis AF2122/97
gguugcgacggcgu

SEQ ID NO: 3074133 - RNA, 21 nt, Mycobacterium bovis subsp bovis AF2122/97
gguugcgcgguagcucgucga

SEQ ID NO: 3074134 - RNA, 15 nt, Mycobacterium bovis subsp bovis AF2122/97
gguugcgcucacccg

SEQ ID NO: 3074135 - RNA, 17 nt, Mycobacterium bovis subsp bovis AF2122/97
gguugcggcagcuggcg

SEQ ID NO: 3074136 - RNA, 15 nt, Mycobacterium bovis subsp bovis AF2122/97
gguugcggccgucga

SEQ ID NO: 3074137 - RNA, 17 nt, Mycobacterium bovis subsp bovis AF2122/97
gguugcggucaucggcg

SEQ ID NO: 3074138 - RNA, 18 nt, Mycobacterium bovis subsp bovis AF2122/97
gguugcucgagcgguggc

SEQ ID NO: 3074139 - RNA, 13 nt, Mycobacterium bovis subsp bovis AF2122/97
gguuggccaccag

SEQ ID NO: 3074140 - RNA, 15 nt, Mycobacterium bovis subsp bovis AF2122/97
gguuggccaccagcu

SEQ ID NO: 3074141 - RNA, 11 nt, Mycobacterium bovis subsp bovis AF2122/97
gguuggccagu

SEQ ID NO: 3074142 - RNA, 14 nt, Mycobacterium bovis subsp bovis AF2122/97
gguuggccggcgcu

SEQ ID NO: 3074143 - RNA, 23 nt, Mycobacterium bovis subsp bovis AF2122/97
gguuggccggguuggccggcgcu

SEQ ID NO: 3074144 - RNA, 20 nt, Mycobacterium bovis subsp bovis AF2122/97
gguuggccguggucgaggug

SEQ ID NO: 3074145 - RNA, 12 nt, Mycobacterium bovis subsp bovis AF2122/97
gguuggcgccgg

SEQ ID NO: 3074146 - RNA, 22 nt, Mycobacterium bovis subsp bovis AF2122/97
gguuggcggcugcacgcugcgg

SEQ ID NO: 3074147 - RNA, 12 nt, Mycobacterium bovis subsp bovis AF2122/97
gguuggcgucgc

SEQ ID NO: 3074148 - RNA, 16 nt, Mycobacterium bovis subsp bovis AF2122/97
gguuggcguugguggu

SEQ ID NO: 3074149 - RNA, 21 nt, Mycobacterium bovis subsp bovis AF2122/97
gguuggcucggcgcagcacau

SEQ ID NO: 3074150 - RNA, 16 nt, Mycobacterium bovis subsp bovis AF2122/97
gguuggcugaugacgc

SEQ ID NO: 3074151 - RNA, 15 nt, Mycobacterium bovis subsp bovis AF2122/97
gguugggguggcggu

SEQ ID NO: 3074152 - RNA, 19 nt, Mycobacterium bovis subsp bovis AF2122/97
gguugggguggcggugccg

SEQ ID NO: 3074153 - RNA, 13 nt, Mycobacterium bovis subsp bovis AF2122/97
gguugguccucgg

SEQ ID NO: 3074154 - RNA, 21 nt, Mycobacterium bovis subsp bovis AF2122/97
gguuggugacguagauguugc

SEQ ID NO: 3074155 - RNA, 19 nt, Mycobacterium bovis subsp bovis AF2122/97
gguuggugauugcggccgc

SEQ ID NO: 3074156 - RNA, 20 nt, Mycobacterium bovis subsp bovis AF2122/97
gguuggugauugcggccgcc

SEQ ID NO: 3074157 - RNA, 16 nt, Mycobacterium bovis subsp bovis AF2122/97
gguuggugcucagcgg

SEQ ID NO: 3074158 - RNA, 16 nt, Mycobacterium bovis subsp bovis AF2122/97
gguugguuggcucgcu

SEQ ID NO: 3074159 - RNA, 15 nt, Mycobacterium bovis subsp bovis AF2122/97
gguuguccucggcga

SEQ ID NO: 3074160 - RNA, 17 nt, Mycobacterium bovis subsp bovis AF2122/97
gguuguccucggcgauc

SEQ ID NO: 3074161 - RNA, 15 nt, Mycobacterium bovis subsp bovis AF2122/97
gguugucggggucgc

SEQ ID NO: 3074162 - RNA, 16 nt, Mycobacterium bovis subsp bovis AF2122/97
gguugucgucgguggg

SEQ ID NO: 3074163 - RNA, 18 nt, Mycobacterium bovis subsp bovis AF2122/97
gguuguggcugaucccgg

SEQ ID NO: 3074164 - RNA, 21 nt, Mycobacterium bovis subsp bovis AF2122/97
gguuguucaacucgggcagcu

SEQ ID NO: 3074165 - RNA, 23 nt, Mycobacterium bovis subsp bovis AF2122/97
gguuguucaacucgggcagcuuc

SEQ ID NO: 3074166 - RNA, 15 nt, Mycobacterium bovis subsp bovis AF2122/97
gguuguugccgacga

SEQ ID NO: 3074167 - RNA, 21 nt, Mycobacterium bovis subsp bovis AF2122/97
gguuguuggagaugucgauca

SEQ ID NO: 3074168 - RNA, 21 nt, Mycobacterium bovis subsp bovis AF2122/97
gguuucaaagcgacagcgcgg

SEQ ID NO: 3074169 - RNA, 21 nt, Mycobacterium bovis subsp bovis AF2122/97
gguuuccggccugcacggcgc

SEQ ID NO: 3074170 - RNA, 21 nt, Mycobacterium bovis subsp bovis AF2122/97
gguuucgaggcgaagcgguga

SEQ ID NO: 3074171 - RNA, 16 nt, Mycobacterium bovis subsp bovis AF2122/97
gguuugcacggcgcgc

SEQ ID NO: 3074172 - RNA, 17 nt, Mycobacterium bovis subsp bovis AF2122/97
gguuugcagcgggauca

SEQ ID NO: 3074173 - RNA, 13 nt, Mycobacterium bovis subsp bovis AF2122/97
gguuugccggcgg

SEQ ID NO: 3074174 - RNA, 16 nt, Mycobacterium bovis subsp bovis AF2122/97
gguuugccggcggugg

SEQ ID NO: 3074175 - RNA, 17 nt, Mycobacterium bovis subsp bovis AF2122/97
gguuugccgggcgcugg

SEQ ID NO: 3074176 - RNA, 17 nt, Mycobacterium bovis subsp bovis AF2122/97
gguuugccggugcggug

SEQ ID NO: 3074177 - RNA, 18 nt, Mycobacterium bovis subsp bovis AF2122/97
gguuugccggugcggugg

SEQ ID NO: 3074178 - RNA, 13 nt, Mycobacterium bovis subsp bovis AF2122/97
guaccagcuggcc

SEQ ID NO: 3074179 - RNA, 22 nt, Mycobacterium bovis subsp bovis AF2122/97
guaccagggugucgucuugcgu

SEQ ID NO: 3074180 - RNA, 15 nt, Mycobacterium bovis subsp bovis AF2122/97
guaccaucaccgcgc

SEQ ID NO: 3074181 - RNA, 12 nt, Mycobacterium bovis subsp bovis AF2122/97
guacccaccucc

SEQ ID NO: 3074182 - RNA, 13 nt, Mycobacterium bovis subsp bovis AF2122/97
guacccaccuccc

SEQ ID NO: 3074183 - RNA, 14 nt, Mycobacterium bovis subsp bovis AF2122/97
guacccaucugcuc

SEQ ID NO: 3074184 - RNA, 23 nt, Mycobacterium bovis subsp bovis AF2122/97
guaccccagcgcugucguaccgc

SEQ ID NO: 3074185 - RNA, 15 nt, Mycobacterium bovis subsp bovis AF2122/97
guacccgaccagcac

SEQ ID NO: 3074186 - RNA, 16 nt, Mycobacterium bovis subsp bovis AF2122/97
guacccgaccagcacc

SEQ ID NO: 3074187 - RNA, 17 nt, Mycobacterium bovis subsp bovis AF2122/97
guacccgaccagcacca

SEQ ID NO: 3074188 - RNA, 17 nt, Mycobacterium bovis subsp bovis AF2122/97
guacccgaucagcgacg

SEQ ID NO: 3074189 - RNA, 21 nt, Mycobacterium bovis subsp bovis AF2122/97
guacccgccucgggccggcgu

SEQ ID NO: 3074190 - RNA, 20 nt, Mycobacterium bovis subsp bovis AF2122/97
guacccggcgacguuccgcu

SEQ ID NO: 3074191 - RNA, 18 nt, Mycobacterium bovis subsp bovis AF2122/97
guacccguuaugcgccgc

SEQ ID NO: 3074192 - RNA, 20 nt, Mycobacterium bovis subsp bovis AF2122/97
guaccgaaaagccguucgcg

SEQ ID NO: 3074193 - RNA, 23 nt, Mycobacterium bovis subsp bovis AF2122/97
guaccgacgaagaucgcugcgaa

SEQ ID NO: 3074194 - RNA, 15 nt, Mycobacterium bovis subsp bovis AF2122/97
guaccgagcagcaga

SEQ ID NO: 3074195 - RNA, 22 nt, Mycobacterium bovis subsp bovis AF2122/97
guaccgauagccugcggcggcg

SEQ ID NO: 3074196 - RNA, 23 nt, Mycobacterium bovis subsp bovis AF2122/97
guaccgcaaucauccgaucgccg

SEQ ID NO: 3074197 - RNA, 14 nt, Mycobacterium bovis subsp bovis AF2122/97
guaccgccacggcg

SEQ ID NO: 3074198 - RNA, 18 nt, Mycobacterium bovis subsp bovis AF2122/97
guaccgccacuggcgcug

SEQ ID NO: 3074199 - RNA, 19 nt, Mycobacterium bovis subsp bovis AF2122/97
guaccgccacuggcgcuga

SEQ ID NO: 3074200 - RNA, 14 nt, Mycobacterium bovis subsp bovis AF2122/97
guaccgcccaguug

SEQ ID NO: 3074201 - RNA, 14 nt, Mycobacterium bovis subsp bovis AF2122/97
guaccgccgcugcc

SEQ ID NO: 3074202 - RNA, 13 nt, Mycobacterium bovis subsp bovis AF2122/97
guaccgcgacgua

SEQ ID NO: 3074203 - RNA, 14 nt, Mycobacterium bovis subsp bovis AF2122/97
guaccgcuggacag

SEQ ID NO: 3074204 - RNA, 15 nt, Mycobacterium bovis subsp bovis AF2122/97
guaccggaaucggcg

SEQ ID NO: 3074205 - RNA, 17 nt, Mycobacterium bovis subsp bovis AF2122/97
guaccggaaucggcggc

SEQ ID NO: 3074206 - RNA, 19 nt, Mycobacterium bovis subsp bovis AF2122/97
guaccggaaucggcggcgg

SEQ ID NO: 3074207 - RNA, 16 nt, Mycobacterium bovis subsp bovis AF2122/97
guaccggagcagcuca

SEQ ID NO: 3074208 - RNA, 14 nt, Mycobacterium bovis subsp bovis AF2122/97
guaccggccagccg

SEQ ID NO: 3074209 - RNA, 15 nt, Mycobacterium bovis subsp bovis AF2122/97
guaccggcgccaccg

SEQ ID NO: 3074210 - RNA, 20 nt, Mycobacterium bovis subsp bovis AF2122/97
guaccggcgccaccguggug

SEQ ID NO: 3074211 - RNA, 15 nt, Mycobacterium bovis subsp bovis AF2122/97
guaccggcggcgccg

SEQ ID NO: 3074212 - RNA, 22 nt, Mycobacterium bovis subsp bovis AF2122/97
guaccggcggcgccggaggcgg

SEQ ID NO: 3074213 - RNA, 18 nt, Mycobacterium bovis subsp bovis AF2122/97
guaccggcggcgccggcc

SEQ ID NO: 3074214 - RNA, 21 nt, Mycobacterium bovis subsp bovis AF2122/97
guaccggcugguugaccgagu

SEQ ID NO: 3074215 - RNA, 18 nt, Mycobacterium bovis subsp bovis AF2122/97
guaccggcuucgucggcc

SEQ ID NO: 3074216 - RNA, 13 nt, Mycobacterium bovis subsp bovis AF2122/97
guaccgggacgaa

SEQ ID NO: 3074217 - RNA, 21 nt, Mycobacterium bovis subsp bovis AF2122/97
guaccgggcgagucccggcgg

SEQ ID NO: 3074218 - RNA, 19 nt, Mycobacterium bovis subsp bovis AF2122/97
guaccgguugacgggcucg

SEQ ID NO: 3074219 - RNA, 22 nt, Mycobacterium bovis subsp bovis AF2122/97
guaccgucaucgcggugugccg

SEQ ID NO: 3074220 - RNA, 18 nt, Mycobacterium bovis subsp bovis AF2122/97
guaccucaacaccaggcc

SEQ ID NO: 3074221 - RNA, 22 nt, Mycobacterium bovis subsp bovis AF2122/97
guaccucaacaccaggccgucc

SEQ ID NO: 3074222 - RNA, 16 nt, Mycobacterium bovis subsp bovis AF2122/97
guaccucaucgcagac

SEQ ID NO: 3074223 - RNA, 12 nt, Mycobacterium bovis subsp bovis AF2122/97
guaccucgucga

SEQ ID NO: 3074224 - RNA, 16 nt, Mycobacterium bovis subsp bovis AF2122/97
guacgacaccgcagcg

SEQ ID NO: 3074225 - RNA, 19 nt, Mycobacterium bovis subsp bovis AF2122/97
guacgacagucgcagucgc

SEQ ID NO: 3074226 - RNA, 18 nt, Mycobacterium bovis subsp bovis AF2122/97
guacgacccccgaucagg

SEQ ID NO: 3074227 - RNA, 18 nt, Mycobacterium bovis subsp bovis AF2122/97
guacgaucgugagacgcc

SEQ ID NO: 3074228 - RNA, 18 nt, Mycobacterium bovis subsp bovis AF2122/97
guacgcaagcucaaggga

SEQ ID NO: 3074229 - RNA, 14 nt, Mycobacterium bovis subsp bovis AF2122/97
guacgcaucgccgu

SEQ ID NO: 3074230 - RNA, 20 nt, Mycobacterium bovis subsp bovis AF2122/97
guacgccaggugcagcacca

SEQ ID NO: 3074231 - RNA, 19 nt, Mycobacterium bovis subsp bovis AF2122/97
guacgcccuggaaugccgc

SEQ ID NO: 3074232 - RNA, 13 nt, Mycobacterium bovis subsp bovis AF2122/97
guacgccgccgau

SEQ ID NO: 3074233 - RNA, 14 nt, Mycobacterium bovis subsp bovis AF2122/97
guacgccgccgcga

SEQ ID NO: 3074234 - RNA, 15 nt, Mycobacterium bovis subsp bovis AF2122/97
guacgccgcgccgaa

SEQ ID NO: 3074235 - RNA, 19 nt, Mycobacterium bovis subsp bovis AF2122/97
guacgccgcgccgaaucgc

SEQ ID NO: 3074236 - RNA, 20 nt, Mycobacterium bovis subsp bovis AF2122/97
guacgccgcgccgaaucgcg

SEQ ID NO: 3074237 - RNA, 20 nt, Mycobacterium bovis subsp bovis AF2122/97
guacgccguaucggggcacc

SEQ ID NO: 3074238 - RNA, 21 nt, Mycobacterium bovis subsp bovis AF2122/97
guacgccucgacagcggcaau

SEQ ID NO: 3074239 - RNA, 17 nt, Mycobacterium bovis subsp bovis AF2122/97
guacgcgacgggccgcg

SEQ ID NO: 3074240 - RNA, 19 nt, Mycobacterium bovis subsp bovis AF2122/97
guacgcgaucagcgcgcac

SEQ ID NO: 3074241 - RNA, 12 nt, Mycobacterium bovis subsp bovis AF2122/97
guacgcggcugc

SEQ ID NO: 3074242 - RNA, 14 nt, Mycobacterium bovis subsp bovis AF2122/97
guacggaccgucgc

SEQ ID NO: 3074243 - RNA, 22 nt, Mycobacterium bovis subsp bovis AF2122/97
guacggaccguggcagcugcuc

SEQ ID NO: 3074244 - RNA, 17 nt, Mycobacterium bovis subsp bovis AF2122/97
guacggcguacgccgga

SEQ ID NO: 3074245 - RNA, 14 nt, Mycobacterium bovis subsp bovis AF2122/97
guacggcucggcgc

SEQ ID NO: 3074246 - RNA, 16 nt, Mycobacterium bovis subsp bovis AF2122/97
guacggcucggcgcug

SEQ ID NO: 3074247 - RNA, 13 nt, Mycobacterium bovis subsp bovis AF2122/97
guacgggcaggcc

SEQ ID NO: 3074248 - RNA, 14 nt, Mycobacterium bovis subsp bovis AF2122/97
guacgggcaggccg

SEQ ID NO: 3074249 - RNA, 17 nt, Mycobacterium bovis subsp bovis AF2122/97
guacgggcaggccgcug

SEQ ID NO: 3074250 - RNA, 13 nt, Mycobacterium bovis subsp bovis AF2122/97
guacggguaacgc

SEQ ID NO: 3074251 - RNA, 12 nt, Mycobacterium bovis subsp bovis AF2122/97
guacgggugauc

SEQ ID NO: 3074252 - RNA, 15 nt, Mycobacterium bovis subsp bovis AF2122/97
guacgguacggaccg

SEQ ID NO: 3074253 - RNA, 17 nt, Mycobacterium bovis subsp bovis AF2122/97
guacggucucacggcgc

SEQ ID NO: 3074254 - RNA, 23 nt, Mycobacterium bovis subsp bovis AF2122/97
guacggugggugguuguccacgg

SEQ ID NO: 3074255 - RNA, 17 nt, Mycobacterium bovis subsp bovis AF2122/97
guacggugguaagacgc

SEQ ID NO: 3074256 - RNA, 21 nt, Mycobacterium bovis subsp bovis AF2122/97
guacucagguggaagugcacc

SEQ ID NO: 3074257 - RNA, 15 nt, Mycobacterium bovis subsp bovis AF2122/97
guacuccaccgcgcc

SEQ ID NO: 3074258 - RNA, 15 nt, Mycobacterium bovis subsp bovis AF2122/97
guacuccagccgcaa

SEQ ID NO: 3074259 - RNA, 13 nt, Mycobacterium bovis subsp bovis AF2122/97
guacuccauggca

SEQ ID NO: 3074260 - RNA, 16 nt, Mycobacterium bovis subsp bovis AF2122/97
guacucccaggccgcc

SEQ ID NO: 3074261 - RNA, 21 nt, Mycobacterium bovis subsp bovis AF2122/97
guacucccccgaaccugcggc

SEQ ID NO: 3074262 - RNA, 15 nt, Mycobacterium bovis subsp bovis AF2122/97
guacucccgcgaucg

SEQ ID NO: 3074263 - RNA, 22 nt, Mycobacterium bovis subsp bovis AF2122/97
guacucgcggcgcggccgcagc

SEQ ID NO: 3074264 - RNA, 17 nt, Mycobacterium bovis subsp bovis AF2122/97
guacucggcggccacca

SEQ ID NO: 3074265 - RNA, 18 nt, Mycobacterium bovis subsp bovis AF2122/97
guagccgcggccacaaug

SEQ ID NO: 3074266 - RNA, 19 nt, Mycobacterium bovis subsp bovis AF2122/97
guagccgcugcacguggcc

SEQ ID NO: 3074267 - RNA, 14 nt, Mycobacterium bovis subsp bovis AF2122/97
guagccggcggugg

SEQ ID NO: 3074268 - RNA, 22 nt, Mycobacterium bovis subsp bovis AF2122/97
guagccgggaacgcugacgccc

SEQ ID NO: 3074269 - RNA, 15 nt, Mycobacterium bovis subsp bovis AF2122/97
guagccgucgucguc

SEQ ID NO: 3074270 - RNA, 16 nt, Mycobacterium bovis subsp bovis AF2122/97
guagccgucgucgucg

SEQ ID NO: 3074271 - RNA, 17 nt, Mycobacterium bovis subsp bovis AF2122/97
guagccgucgucgucga

SEQ ID NO: 3074272 - RNA, 17 nt, Mycobacterium bovis subsp bovis AF2122/97
guagccugcggcgguca

SEQ ID NO: 3074273 - RNA, 17 nt, Mycobacterium bovis subsp bovis AF2122/97
guagcgaccucgccgcg

SEQ ID NO: 3074274 - RNA, 18 nt, Mycobacterium bovis subsp bovis AF2122/97
guagcgagcccacguggg

SEQ ID NO: 3074275 - RNA, 16 nt, Mycobacterium bovis subsp bovis AF2122/97
guagcgaugcacccca

SEQ ID NO: 3074276 - RNA, 19 nt, Mycobacterium bovis subsp bovis AF2122/97
guagcgaugcaccccauga

SEQ ID NO: 3074277 - RNA, 15 nt, Mycobacterium bovis subsp bovis AF2122/97
guagcgcaaccgcgc

SEQ ID NO: 3074278 - RNA, 19 nt, Mycobacterium bovis subsp bovis AF2122/97
guagcgcaaugcggcccgg

SEQ ID NO: 3074279 - RNA, 22 nt, Mycobacterium bovis subsp bovis AF2122/97
guagcgcaaugcggcccgggug

SEQ ID NO: 3074280 - RNA, 13 nt, Mycobacterium bovis subsp bovis AF2122/97
guagcgcaccaca

SEQ ID NO: 3074281 - RNA, 14 nt, Mycobacterium bovis subsp bovis AF2122/97
guagcgcagcgccu

SEQ ID NO: 3074282 - RNA, 11 nt, Mycobacterium bovis subsp bovis AF2122/97
guagcgcccac

SEQ ID NO: 3074283 - RNA, 17 nt, Mycobacterium bovis subsp bovis AF2122/97
guagcgccgcacuucuu

SEQ ID NO: 3074284 - RNA, 21 nt, Mycobacterium bovis subsp bovis AF2122/97
guagcggacagcucgcgguag

SEQ ID NO: 3074285 - RNA, 17 nt, Mycobacterium bovis subsp bovis AF2122/97
guagcggaucgcgguca

SEQ ID NO: 3074286 - RNA, 22 nt, Mycobacterium bovis subsp bovis AF2122/97
guagcggaucgcggucagcggg

SEQ ID NO: 3074287 - RNA, 18 nt, Mycobacterium bovis subsp bovis AF2122/97
guagcggcccuucgacga

SEQ ID NO: 3074288 - RNA, 21 nt, Mycobacterium bovis subsp bovis AF2122/97
guagcggcccuucgacgagga

SEQ ID NO: 3074289 - RNA, 20 nt, Mycobacterium bovis subsp bovis AF2122/97
guagcggccgcaggcgaaca

SEQ ID NO: 3074290 - RNA, 12 nt, Mycobacterium bovis subsp bovis AF2122/97
guagcggccggg

SEQ ID NO: 3074291 - RNA, 13 nt, Mycobacterium bovis subsp bovis AF2122/97
guagcggccggga

SEQ ID NO: 3074292 - RNA, 14 nt, Mycobacterium bovis subsp bovis AF2122/97
guagcggcgauacc

SEQ ID NO: 3074293 - RNA, 15 nt, Mycobacterium bovis subsp bovis AF2122/97
guagcggcgccgccc

SEQ ID NO: 3074294 - RNA, 16 nt, Mycobacterium bovis subsp bovis AF2122/97
guagcggcgccgcccu

SEQ ID NO: 3074295 - RNA, 22 nt, Mycobacterium bovis subsp bovis AF2122/97
guagcgggggagcgaacggcgc

SEQ ID NO: 3074296 - RNA, 21 nt, Mycobacterium bovis subsp bovis AF2122/97
guagcggguugggaccgaaca

SEQ ID NO: 3074297 - RNA, 18 nt, Mycobacterium bovis subsp bovis AF2122/97
guagcgguccagcgucgc

SEQ ID NO: 3074298 - RNA, 19 nt, Mycobacterium bovis subsp bovis AF2122/97
guagcgucgcacccagggc

SEQ ID NO: 3074299 - RNA, 12 nt, Mycobacterium bovis subsp bovis AF2122/97
guagcgugcgac

SEQ ID NO: 3074300 - RNA, 15 nt, Mycobacterium bovis subsp bovis AF2122/97
guagcguucccacac

SEQ ID NO: 3074301 - RNA, 23 nt, Mycobacterium bovis subsp bovis AF2122/97
guagcguucgucguaguccaggc

SEQ ID NO: 3074302 - RNA, 15 nt, Mycobacterium bovis subsp bovis AF2122/97
guagcucauugccga

SEQ ID NO: 3074303 - RNA, 19 nt, Mycobacterium bovis subsp bovis AF2122/97
guagcucgguaggccggca

SEQ ID NO: 3074304 - RNA, 20 nt, Mycobacterium bovis subsp bovis AF2122/97
guagcucgucgaggaagauc

SEQ ID NO: 3074305 - RNA, 19 nt, Mycobacterium bovis subsp bovis AF2122/97
guagcugacggccugcaac

SEQ ID NO: 3074306 - RNA, 19 nt, Mycobacterium bovis subsp bovis AF2122/97
guagcugccgcggccggcg

SEQ ID NO: 3074307 - RNA, 16 nt, Mycobacterium bovis subsp bovis AF2122/97
guagcugcgcagcgca

SEQ ID NO: 3074308 - RNA, 13 nt, Mycobacterium bovis subsp bovis AF2122/97
guagcugcgcggg

SEQ ID NO: 3074309 - RNA, 20 nt, Mycobacterium bovis subsp bovis AF2122/97
guagcugcgggucucgccga

SEQ ID NO: 3074310 - RNA, 19 nt, Mycobacterium bovis subsp bovis AF2122/97
guagcuggcgaucuggucg

SEQ ID NO: 3074311 - RNA, 19 nt, Mycobacterium bovis subsp bovis AF2122/97
guagcuggucccacaccuc

SEQ ID NO: 3074312 - RNA, 18 nt, Mycobacterium bovis subsp bovis AF2122/97
guagcuuccgguccagcg

SEQ ID NO: 3074313 - RNA, 16 nt, Mycobacterium bovis subsp bovis AF2122/97
guaggacacguggugg

SEQ ID NO: 3074314 - RNA, 19 nt, Mycobacterium bovis subsp bovis AF2122/97
guaggacugccagcguugc

SEQ ID NO: 3074315 - RNA, 19 nt, Mycobacterium bovis subsp bovis AF2122/97
guaggagaacgucaaaccc

SEQ ID NO: 3074316 - RNA, 16 nt, Mycobacterium bovis subsp bovis AF2122/97
guaggagccgucacgc

SEQ ID NO: 3074317 - RNA, 19 nt, Mycobacterium bovis subsp bovis AF2122/97
guaggcaaccuuuggccgc

SEQ ID NO: 3074318 - RNA, 13 nt, Mycobacterium bovis subsp bovis AF2122/97
guaggcaccccgg

SEQ ID NO: 3074319 - RNA, 12 nt, Mycobacterium bovis subsp bovis AF2122/97
guaggcaccgau

SEQ ID NO: 3074320 - RNA, 15 nt, Mycobacterium bovis subsp bovis AF2122/97
guaggcaggccggcu

SEQ ID NO: 3074321 - RNA, 20 nt, Mycobacterium bovis subsp bovis AF2122/97
guaggccagcccggcgugca

SEQ ID NO: 3074322 - RNA, 22 nt, Mycobacterium bovis subsp bovis AF2122/97
guaggcccagcaaccgcucggc

SEQ ID NO: 3074323 - RNA, 15 nt, Mycobacterium bovis subsp bovis AF2122/97
guaggccgccguggu

SEQ ID NO: 3074324 - RNA, 13 nt, Mycobacterium bovis subsp bovis AF2122/97
guaggccgggccg

SEQ ID NO: 3074325 - RNA, 16 nt, Mycobacterium bovis subsp bovis AF2122/97
guaggccggggcgucg

SEQ ID NO: 3074326 - RNA, 16 nt, Mycobacterium bovis subsp bovis AF2122/97
guaggccucggcagca

SEQ ID NO: 3074327 - RNA, 14 nt, Mycobacterium bovis subsp bovis AF2122/97
guaggcgaccgcca

SEQ ID NO: 3074328 - RNA, 20 nt, Mycobacterium bovis subsp bovis AF2122/97
guaggcgccgcgacaaaucg

SEQ ID NO: 3074329 - RNA, 13 nt, Mycobacterium bovis subsp bovis AF2122/97
guaggcggcggcc

SEQ ID NO: 3074330 - RNA, 13 nt, Mycobacterium bovis subsp bovis AF2122/97
guaggcggugacc

SEQ ID NO: 3074331 - RNA, 17 nt, Mycobacterium bovis subsp bovis AF2122/97
guaggcgguguccagaa

SEQ ID NO: 3074332 - RNA, 15 nt, Mycobacterium bovis subsp bovis AF2122/97
guaggcuggccgccu

SEQ ID NO: 3074333 - RNA, 15 nt, Mycobacterium bovis subsp bovis AF2122/97
guaggcuuccagcuc

SEQ ID NO: 3074334 - RNA, 22 nt, Mycobacterium bovis subsp bovis AF2122/97
guaggcuucgaccguggugguc

SEQ ID NO: 3074335 - RNA, 11 nt, Mycobacterium bovis subsp bovis AF2122/97
guagggacgcc

SEQ ID NO: 3074336 - RNA, 15 nt, Mycobacterium bovis subsp bovis AF2122/97
guagggauagcagug

SEQ ID NO: 3074337 - RNA, 17 nt, Mycobacterium bovis subsp bovis AF2122/97
guagggauagcagugca

SEQ ID NO: 3074338 - RNA, 19 nt, Mycobacterium bovis subsp bovis AF2122/97
guagggauagcagugcagc

SEQ ID NO: 3074339 - RNA, 12 nt, Mycobacterium bovis subsp bovis AF2122/97
guagggcaucgu

SEQ ID NO: 3074340 - RNA, 21 nt, Mycobacterium bovis subsp bovis AF2122/97
guagggcuguccgaccucgcc

SEQ ID NO: 3074341 - RNA, 23 nt, Mycobacterium bovis subsp bovis AF2122/97
guagggcuguccgaccucgccgc

SEQ ID NO: 3074342 - RNA, 11 nt, Mycobacterium bovis subsp bovis AF2122/97
guaggggucug

SEQ ID NO: 3074343 - RNA, 14 nt, Mycobacterium bovis subsp bovis AF2122/97
guaggggugauccc

SEQ ID NO: 3074344 - RNA, 13 nt, Mycobacterium bovis subsp bovis AF2122/97
guaggucagcgcg

SEQ ID NO: 3074345 - RNA, 21 nt, Mycobacterium bovis subsp bovis AF2122/97
guagguccuugucggccccgg

SEQ ID NO: 3074346 - RNA, 17 nt, Mycobacterium bovis subsp bovis AF2122/97
guaggucgccgccgcca

SEQ ID NO: 3074347 - RNA, 18 nt, Mycobacterium bovis subsp bovis AF2122/97
guaggugcaugucgauga

SEQ ID NO: 3074348 - RNA, 13 nt, Mycobacterium bovis subsp bovis AF2122/97
guagguggccggc

SEQ ID NO: 3074349 - RNA, 22 nt, Mycobacterium bovis subsp bovis AF2122/97
guagguggccggcuugcaguga

SEQ ID NO: 3074350 - RNA, 18 nt, Mycobacterium bovis subsp bovis AF2122/97
guagguggggcacuucca

SEQ ID NO: 3074351 - RNA, 17 nt, Mycobacterium bovis subsp bovis AF2122/97
guagguuuucggcggcu

SEQ ID NO: 3074352 - RNA, 21 nt, Mycobacterium bovis subsp bovis AF2122/97
guauuugccgugcucaccggc

SEQ ID NO: 3074353 - RNA, 13 nt, Mycobacterium bovis subsp bovis AF2122/97
gucaaaauccgcg

SEQ ID NO: 3074354 - RNA, 12 nt, Mycobacterium bovis subsp bovis AF2122/97
gucaaacgacag

SEQ ID NO: 3074355 - RNA, 18 nt, Mycobacterium bovis subsp bovis AF2122/97
gucaaacgccgucacggc

SEQ ID NO: 3074356 - RNA, 23 nt, Mycobacterium bovis subsp bovis AF2122/97
gucaaagaauucguucagcgcca

SEQ ID NO: 3074357 - RNA, 14 nt, Mycobacterium bovis subsp bovis AF2122/97
gucaaagcccgacg

SEQ ID NO: 3074358 - RNA, 15 nt, Mycobacterium bovis subsp bovis AF2122/97
gucaaauccagcagc

SEQ ID NO: 3074359 - RNA, 22 nt, Mycobacterium bovis subsp bovis AF2122/97
gucaacaagacgaugcuggcgg

SEQ ID NO: 3074360 - RNA, 18 nt, Mycobacterium bovis subsp bovis AF2122/97
gucaacaccaugguggug

SEQ ID NO: 3074361 - RNA, 15 nt, Mycobacterium bovis subsp bovis AF2122/97
gucaacacccgcccg

SEQ ID NO: 3074362 - RNA, 18 nt, Mycobacterium bovis subsp bovis AF2122/97
gucaacacccgcccgggc

SEQ ID NO: 3074363 - RNA, 20 nt, Mycobacterium bovis subsp bovis AF2122/97
gucaacacccgcccgggcgu

SEQ ID NO: 3074364 - RNA, 12 nt, Mycobacterium bovis subsp bovis AF2122/97
gucaacaccgcg

SEQ ID NO: 3074365 - RNA, 14 nt, Mycobacterium bovis subsp bovis AF2122/97
gucaacaccgcggc

SEQ ID NO: 3074366 - RNA, 18 nt, Mycobacterium bovis subsp bovis AF2122/97
gucaacaccgcggccgag

SEQ ID NO: 3074367 - RNA, 17 nt, Mycobacterium bovis subsp bovis AF2122/97
gucaacagauaaggauc

SEQ ID NO: 3074368 - RNA, 18 nt, Mycobacterium bovis subsp bovis AF2122/97
gucaacagcggcaagaag

SEQ ID NO: 3074369 - RNA, 12 nt, Mycobacterium bovis subsp bovis AF2122/97
gucaacaggacc

SEQ ID NO: 3074370 - RNA, 13 nt, Mycobacterium bovis subsp bovis AF2122/97
gucaacaggccgu

SEQ ID NO: 3074371 - RNA, 20 nt, Mycobacterium bovis subsp bovis AF2122/97
gucaacagggccaggacaac

SEQ ID NO: 3074372 - RNA, 18 nt, Mycobacterium bovis subsp bovis AF2122/97
gucaaccaagcgugccug

SEQ ID NO: 3074373 - RNA, 17 nt, Mycobacterium bovis subsp bovis AF2122/97
gucaaccaagugaccgg

SEQ ID NO: 3074374 - RNA, 13 nt, Mycobacterium bovis subsp bovis AF2122/97
gucaaccaccagg

SEQ ID NO: 3074375 - RNA, 17 nt, Mycobacterium bovis subsp bovis AF2122/97
gucaaccacggccgccg

SEQ ID NO: 3074376 - RNA, 19 nt, Mycobacterium bovis subsp bovis AF2122/97
gucaaccacggccgccgcg

SEQ ID NO: 3074377 - RNA, 19 nt, Mycobacterium bovis subsp bovis AF2122/97
gucaaccagggugccggcg

SEQ ID NO: 3074378 - RNA, 18 nt, Mycobacterium bovis subsp bovis AF2122/97
gucaacccgcaccccggc

SEQ ID NO: 3074379 - RNA, 23 nt, Mycobacterium bovis subsp bovis AF2122/97
gucaacccgcaccccggccgcgc

SEQ ID NO: 3074380 - RNA, 18 nt, Mycobacterium bovis subsp bovis AF2122/97
gucaaccgaucggucguc

SEQ ID NO: 3074381 - RNA, 11 nt, Mycobacterium bovis subsp bovis AF2122/97
gucaaccugcg

SEQ ID NO: 3074382 - RNA, 20 nt, Mycobacterium bovis subsp bovis AF2122/97
gucaacgacauugccacggc

SEQ ID NO: 3074383 - RNA, 23 nt, Mycobacterium bovis subsp bovis AF2122/97
gucaacgacauugccacggcgcc

SEQ ID NO: 3074384 - RNA, 16 nt, Mycobacterium bovis subsp bovis AF2122/97
gucaacgacgacgaca

SEQ ID NO: 3074385 - RNA, 21 nt, Mycobacterium bovis subsp bovis AF2122/97
gucaacgacgacgacaagugc

SEQ ID NO: 3074386 - RNA, 16 nt, Mycobacterium bovis subsp bovis AF2122/97
gucaacgccacgccga

SEQ ID NO: 3074387 - RNA, 17 nt, Mycobacterium bovis subsp bovis AF2122/97
gucaacgccacgccgau

SEQ ID NO: 3074388 - RNA, 18 nt, Mycobacterium bovis subsp bovis AF2122/97
gucaacgccacgccgaug

SEQ ID NO: 3074389 - RNA, 15 nt, Mycobacterium bovis subsp bovis AF2122/97
gucaacgcgcggcuc

SEQ ID NO: 3074390 - RNA, 14 nt, Mycobacterium bovis subsp bovis AF2122/97
gucaacgcugacgu

SEQ ID NO: 3074391 - RNA, 17 nt, Mycobacterium bovis subsp bovis AF2122/97
gucaacgcuucggcacg

SEQ ID NO: 3074392 - RNA, 13 nt, Mycobacterium bovis subsp bovis AF2122/97
gucaacggccgac

SEQ ID NO: 3074393 - RNA, 19 nt, Mycobacterium bovis subsp bovis AF2122/97
gucaacgggaugccggcga

SEQ ID NO: 3074394 - RNA, 14 nt, Mycobacterium bovis subsp bovis AF2122/97
gucaacgugaacug

SEQ ID NO: 3074395 - RNA, 21 nt, Mycobacterium bovis subsp bovis AF2122/97
gucaacgugaugcguucggcc

SEQ ID NO: 3074396 - RNA, 15 nt, Mycobacterium bovis subsp bovis AF2122/97
gucaacguggauguc

SEQ ID NO: 3074397 - RNA, 22 nt, Mycobacterium bovis subsp bovis AF2122/97
gucaacguggaugucucgauca

SEQ ID NO: 3074398 - RNA, 14 nt, Mycobacterium bovis subsp bovis AF2122/97
gucaacuccacgcg

SEQ ID NO: 3074399 - RNA, 22 nt, Mycobacterium bovis subsp bovis AF2122/97
gucaacuccacgcggaccucga

SEQ ID NO: 3074400 - RNA, 20 nt, Mycobacterium bovis subsp bovis AF2122/97
gucaagaucggugccagcac

SEQ ID NO: 3074401 - RNA, 23 nt, Mycobacterium bovis subsp bovis AF2122/97
gucaagauugaacgaguagccgg

SEQ ID NO: 3074402 - RNA, 18 nt, Mycobacterium bovis subsp bovis AF2122/97
gucaagauugaccgcggc

SEQ ID NO: 3074403 - RNA, 20 nt, Mycobacterium bovis subsp bovis AF2122/97
gucaagauugaccgcggccg

SEQ ID NO: 3074404 - RNA, 22 nt, Mycobacterium bovis subsp bovis AF2122/97
gucaagcaaguccaccggaucg

SEQ ID NO: 3074405 - RNA, 14 nt, Mycobacterium bovis subsp bovis AF2122/97
gucaagcacacugg

SEQ ID NO: 3074406 - RNA, 13 nt, Mycobacterium bovis subsp bovis AF2122/97
gucaagccggcgc

SEQ ID NO: 3074407 - RNA, 16 nt, Mycobacterium bovis subsp bovis AF2122/97
gucaagccggcgcccg

SEQ ID NO: 3074408 - RNA, 16 nt, Mycobacterium bovis subsp bovis AF2122/97
gucaaggugcgccgcc

SEQ ID NO: 3074409 - RNA, 20 nt, Mycobacterium bovis subsp bovis AF2122/97
gucaaguccuucacugcgac

SEQ ID NO: 3074410 - RNA, 20 nt, Mycobacterium bovis subsp bovis AF2122/97
gucaagucugucuggcccca

SEQ ID NO: 3074411 - RNA, 20 nt, Mycobacterium bovis subsp bovis AF2122/97
gucaagucugugcucacggc

SEQ ID NO: 3074412 - RNA, 19 nt, Mycobacterium bovis subsp bovis AF2122/97
gucaaguggcaaccgcacc

SEQ ID NO: 3074413 - RNA, 18 nt, Mycobacterium bovis subsp bovis AF2122/97
gucaaguucgccagcaac

SEQ ID NO: 3074414 - RNA, 18 nt, Mycobacterium bovis subsp bovis AF2122/97
gucaaucccacgcccggc

SEQ ID NO: 3074415 - RNA, 19 nt, Mycobacterium bovis subsp bovis AF2122/97
gucaaucgcaaugaccugc

SEQ ID NO: 3074416 - RNA, 16 nt, Mycobacterium bovis subsp bovis AF2122/97
gucaaucgcgucauca

SEQ ID NO: 3074417 - RNA, 14 nt, Mycobacterium bovis subsp bovis AF2122/97
gucaaugacaccgg

SEQ ID NO: 3074418 - RNA, 16 nt, Mycobacterium bovis subsp bovis AF2122/97
gucaaugacaccgggg

SEQ ID NO: 3074419 - RNA, 17 nt, Mycobacterium bovis subsp bovis AF2122/97
gucaaugacaccggggc

SEQ ID NO: 3074420 - RNA, 16 nt, Mycobacterium bovis subsp bovis AF2122/97
gucaaugccggccgcg

SEQ ID NO: 3074421 - RNA, 15 nt, Mycobacterium bovis subsp bovis AF2122/97
gucaaugcgcuggcg

SEQ ID NO: 3074422 - RNA, 18 nt, Mycobacterium bovis subsp bovis AF2122/97
gucaaugcuggcagcggc

SEQ ID NO: 3074423 - RNA, 13 nt, Mycobacterium bovis subsp bovis AF2122/97
gucaauucggugc

SEQ ID NO: 3074424 - RNA, 13 nt, Mycobacterium bovis subsp bovis AF2122/97
gucacaaacccag

SEQ ID NO: 3074425 - RNA, 14 nt, Mycobacterium bovis subsp bovis AF2122/97
gucacaaacccagc

SEQ ID NO: 3074426 - RNA, 16 nt, Mycobacterium bovis subsp bovis AF2122/97
gucacaacgcgugacc

SEQ ID NO: 3074427 - RNA, 18 nt, Mycobacterium bovis subsp bovis AF2122/97
gucacaacgcgugaccag

SEQ ID NO: 3074428 - RNA, 19 nt, Mycobacterium bovis subsp bovis AF2122/97
gucacaacgcgugaccagg

SEQ ID NO: 3074429 - RNA, 23 nt, Mycobacterium bovis subsp bovis AF2122/97
gucacaacgcgugaccagggccu

SEQ ID NO: 3074430 - RNA, 17 nt, Mycobacterium bovis subsp bovis AF2122/97
gucacaagccugccggc

SEQ ID NO: 3074431 - RNA, 17 nt, Mycobacterium bovis subsp bovis AF2122/97
gucacaagcugacacga

SEQ ID NO: 3074432 - RNA, 18 nt, Mycobacterium bovis subsp bovis AF2122/97
gucacaccagcgggcauc

SEQ ID NO: 3074433 - RNA, 19 nt, Mycobacterium bovis subsp bovis AF2122/97
gucacaccagcgggcaucg

SEQ ID NO: 3074434 - RNA, 14 nt, Mycobacterium bovis subsp bovis AF2122/97
gucacacccacacc

SEQ ID NO: 3074435 - RNA, 19 nt, Mycobacterium bovis subsp bovis AF2122/97
gucacacccacacccagcg

SEQ ID NO: 3074436 - RNA, 16 nt, Mycobacterium bovis subsp bovis AF2122/97
gucacacgccagccgg

SEQ ID NO: 3074437 - RNA, 13 nt, Mycobacterium bovis subsp bovis AF2122/97
gucacagcucacc

SEQ ID NO: 3074438 - RNA, 15 nt, Mycobacterium bovis subsp bovis AF2122/97
gucacaggccgccug

SEQ ID NO: 3074439 - RNA, 12 nt, Mycobacterium bovis subsp bovis AF2122/97
gucacgccaccg

SEQ ID NO: 3074440 - RNA, 15 nt, Mycobacterium bovis subsp bovis AF2122/97
gucacgccaccgcaa

SEQ ID NO: 3074441 - RNA, 21 nt, Mycobacterium bovis subsp bovis AF2122/97
gucacgcccaugaccggccgc

SEQ ID NO: 3074442 - RNA, 19 nt, Mycobacterium bovis subsp bovis AF2122/97
gucacgccccucacgugga

SEQ ID NO: 3074443 - RNA, 13 nt, Mycobacterium bovis subsp bovis AF2122/97
gucacgcccgcga

SEQ ID NO: 3074444 - RNA, 16 nt, Mycobacterium bovis subsp bovis AF2122/97
gucacgccggaugguc

SEQ ID NO: 3074445 - RNA, 16 nt, Mycobacterium bovis subsp bovis AF2122/97
gucacgccugccaccg

SEQ ID NO: 3074446 - RNA, 19 nt, Mycobacterium bovis subsp bovis AF2122/97
gucacgccugccaccggcg

SEQ ID NO: 3074447 - RNA, 19 nt, Mycobacterium bovis subsp bovis AF2122/97
gucacgcgaccaccgccga

SEQ ID NO: 3074448 - RNA, 20 nt, Mycobacterium bovis subsp bovis AF2122/97
gucacgcgaccaccgccgag

SEQ ID NO: 3074449 - RNA, 22 nt, Mycobacterium bovis subsp bovis AF2122/97
gucacgcgaccaccgccgagcc

SEQ ID NO: 3074450 - RNA, 13 nt, Mycobacterium bovis subsp bovis AF2122/97
gucacgcgaggcg

SEQ ID NO: 3074451 - RNA, 13 nt, Mycobacterium bovis subsp bovis AF2122/97
gucacgcgcggcg

SEQ ID NO: 3074452 - RNA, 16 nt, Mycobacterium bovis subsp bovis AF2122/97
gucacgcgcggcggcg

SEQ ID NO: 3074453 - RNA, 21 nt, Mycobacterium bovis subsp bovis AF2122/97
gucacgcgcggcggcguccac

SEQ ID NO: 3074454 - RNA, 20 nt, Mycobacterium bovis subsp bovis AF2122/97
gucacgcggguugcgcggcu

SEQ ID NO: 3074455 - RNA, 21 nt, Mycobacterium bovis subsp bovis AF2122/97
gucacgcguuccauggcccgc

SEQ ID NO: 3074456 - RNA, 20 nt, Mycobacterium bovis subsp bovis AF2122/97
gucacgcugugcgguaucgg

SEQ ID NO: 3074457 - RNA, 22 nt, Mycobacterium bovis subsp bovis AF2122/97
gucacggacccuuccgccgccg

SEQ ID NO: 3074458 - RNA, 19 nt, Mycobacterium bovis subsp bovis AF2122/97
gucacggaccgccaccuug

SEQ ID NO: 3074459 - RNA, 14 nt, Mycobacterium bovis subsp bovis AF2122/97
gucacggaccugga

SEQ ID NO: 3074460 - RNA, 18 nt, Mycobacterium bovis subsp bovis AF2122/97
gucacggcgugaccacug

SEQ ID NO: 3074461 - RNA, 17 nt, Mycobacterium bovis subsp bovis AF2122/97
gucacgguggugucagc

SEQ ID NO: 3074462 - RNA, 20 nt, Mycobacterium bovis subsp bovis AF2122/97
gucacgguucgcccgucgcc

SEQ ID NO: 3074463 - RNA, 14 nt, Mycobacterium bovis subsp bovis AF2122/97
gucacgucgacggc

SEQ ID NO: 3074464 - RNA, 15 nt, Mycobacterium bovis subsp bovis AF2122/97
gucacgucgacggcg

SEQ ID NO: 3074465 - RNA, 13 nt, Mycobacterium bovis subsp bovis AF2122/97
gucacgucgaucu

SEQ ID NO: 3074466 - RNA, 14 nt, Mycobacterium bovis subsp bovis AF2122/97
gucacgucgaugag

SEQ ID NO: 3074467 - RNA, 14 nt, Mycobacterium bovis subsp bovis AF2122/97
gucacgucgcagua

SEQ ID NO: 3074468 - RNA, 15 nt, Mycobacterium bovis subsp bovis AF2122/97
gucacguggucggcc

SEQ ID NO: 3074469 - RNA, 19 nt, Mycobacterium bovis subsp bovis AF2122/97
gucacguggucggccaccc

SEQ ID NO: 3074470 - RNA, 20 nt, Mycobacterium bovis subsp bovis AF2122/97
gucacguggucggccacccc

SEQ ID NO: 3074471 - RNA, 15 nt, Mycobacterium bovis subsp bovis AF2122/97
gucacucaccccaac

SEQ ID NO: 3074472 - RNA, 12 nt, Mycobacterium bovis subsp bovis AF2122/97
gucacuccggcg

SEQ ID NO: 3074473 - RNA, 14 nt, Mycobacterium bovis subsp bovis AF2122/97
gucacuccggcggc

SEQ ID NO: 3074474 - RNA, 21 nt, Mycobacterium bovis subsp bovis AF2122/97
gucacucgcaagaaccggcau

SEQ ID NO: 3074475 - RNA, 13 nt, Mycobacterium bovis subsp bovis AF2122/97
gucacugccaccu

SEQ ID NO: 3074476 - RNA, 11 nt, Mycobacterium bovis subsp bovis AF2122/97
gucacugcccu

SEQ ID NO: 3074477 - RNA, 23 nt, Mycobacterium bovis subsp bovis AF2122/97
gucacugcccugauugaagcccc

SEQ ID NO: 3074478 - RNA, 15 nt, Mycobacterium bovis subsp bovis AF2122/97
gucagaacaccggcc

SEQ ID NO: 3074479 - RNA, 20 nt, Mycobacterium bovis subsp bovis AF2122/97
gucagaacaccggccaggcc

SEQ ID NO: 3074480 - RNA, 17 nt, Mycobacterium bovis subsp bovis AF2122/97
gucagaacggcggcagc

SEQ ID NO: 3074481 - RNA, 18 nt, Mycobacterium bovis subsp bovis AF2122/97
gucagaacggcggcagcg

SEQ ID NO: 3074482 - RNA, 19 nt, Mycobacterium bovis subsp bovis AF2122/97
gucagaacggcggcagcgg

SEQ ID NO: 3074483 - RNA, 22 nt, Mycobacterium bovis subsp bovis AF2122/97
gucagaauugugugcagcagca

SEQ ID NO: 3074484 - RNA, 16 nt, Mycobacterium bovis subsp bovis AF2122/97
gucagacgacgaugau

SEQ ID NO: 3074485 - RNA, 19 nt, Mycobacterium bovis subsp bovis AF2122/97
gucagacgacgaugaugcc

SEQ ID NO: 3074486 - RNA, 14 nt, Mycobacterium bovis subsp bovis AF2122/97
gucagauagugcau

SEQ ID NO: 3074487 - RNA, 19 nt, Mycobacterium bovis subsp bovis AF2122/97
gucagcaagaucggcagcg

SEQ ID NO: 3074488 - RNA, 16 nt, Mycobacterium bovis subsp bovis AF2122/97
gucagcaccaccagca

SEQ ID NO: 3074489 - RNA, 17 nt, Mycobacterium bovis subsp bovis AF2122/97
gucagcacccaacccgg

SEQ ID NO: 3074490 - RNA, 17 nt, Mycobacterium bovis subsp bovis AF2122/97
gucagcaccggcgcggg

SEQ ID NO: 3074491 - RNA, 15 nt, Mycobacterium bovis subsp bovis AF2122/97
gucagcacgcugacc

SEQ ID NO: 3074492 - RNA, 16 nt, Mycobacterium bovis subsp bovis AF2122/97
gucagcagacugccga

SEQ ID NO: 3074493 - RNA, 19 nt, Mycobacterium bovis subsp bovis AF2122/97
gucagcagaugggcgucgg

SEQ ID NO: 3074494 - RNA, 13 nt, Mycobacterium bovis subsp bovis AF2122/97
gucagcagcgccg

SEQ ID NO: 3074495 - RNA, 17 nt, Mycobacterium bovis subsp bovis AF2122/97
gucagcaguucggcgau

SEQ ID NO: 3074496 - RNA, 23 nt, Mycobacterium bovis subsp bovis AF2122/97
gucagcaguucggcgaugcgcgg

SEQ ID NO: 3074497 - RNA, 23 nt, Mycobacterium bovis subsp bovis AF2122/97
gucagcauaucgauucgggcguc

SEQ ID NO: 3074498 - RNA, 17 nt, Mycobacterium bovis subsp bovis AF2122/97
gucagccaccggugagc

SEQ ID NO: 3074499 - RNA, 13 nt, Mycobacterium bovis subsp bovis AF2122/97
gucagccaccuga

SEQ ID NO: 3074500 - RNA, 19 nt, Mycobacterium bovis subsp bovis AF2122/97
gucagccaggugcccaagc

SEQ ID NO: 3074501 - RNA, 18 nt, Mycobacterium bovis subsp bovis AF2122/97
gucagccccgacugcgcc

SEQ ID NO: 3074502 - RNA, 21 nt, Mycobacterium bovis subsp bovis AF2122/97
gucagcccgauacgggugugg

SEQ ID NO: 3074503 - RNA, 12 nt, Mycobacterium bovis subsp bovis AF2122/97
gucagccgcacc

SEQ ID NO: 3074504 - RNA, 17 nt, Mycobacterium bovis subsp bovis AF2122/97
gucagccgcaccccgcc

SEQ ID NO: 3074505 - RNA, 21 nt, Mycobacterium bovis subsp bovis AF2122/97
gucagccgcaccccgcccgac

SEQ ID NO: 3074506 - RNA, 13 nt, Mycobacterium bovis subsp bovis AF2122/97
gucagccgcggcg

SEQ ID NO: 3074507 - RNA, 15 nt, Mycobacterium bovis subsp bovis AF2122/97
gucagccgcggcggc

SEQ ID NO: 3074508 - RNA, 13 nt, Mycobacterium bovis subsp bovis AF2122/97
gucagccggugac

SEQ ID NO: 3074509 - RNA, 15 nt, Mycobacterium bovis subsp bovis AF2122/97
gucagccugccaggu

SEQ ID NO: 3074510 - RNA, 17 nt, Mycobacterium bovis subsp bovis AF2122/97
gucagcgaccucacugc

SEQ ID NO: 3074511 - RNA, 20 nt, Mycobacterium bovis subsp bovis AF2122/97
gucagcgacuugcggugcuc

SEQ ID NO: 3074512 - RNA, 19 nt, Mycobacterium bovis subsp bovis AF2122/97
gucagcgaguuucugcucg

SEQ ID NO: 3074513 - RNA, 14 nt, Mycobacterium bovis subsp bovis AF2122/97
gucagcgccgccgg

SEQ ID NO: 3074514 - RNA, 13 nt, Mycobacterium bovis subsp bovis AF2122/97
gucagcgccgcgc

SEQ ID NO: 3074515 - RNA, 20 nt, Mycobacterium bovis subsp bovis AF2122/97
gucagcgcgccgucggguuc

SEQ ID NO: 3074516 - RNA, 15 nt, Mycobacterium bovis subsp bovis AF2122/97
gucagcgcggcgacc

SEQ ID NO: 3074517 - RNA, 16 nt, Mycobacterium bovis subsp bovis AF2122/97
gucagcgcggcgcaca

SEQ ID NO: 3074518 - RNA, 14 nt, Mycobacterium bovis subsp bovis AF2122/97
gucagcgcggcgcg

SEQ ID NO: 3074519 - RNA, 17 nt, Mycobacterium bovis subsp bovis AF2122/97
gucagcgcgucguccag

SEQ ID NO: 3074520 - RNA, 18 nt, Mycobacterium bovis subsp bovis AF2122/97
gucagcgcugagccgcuc

SEQ ID NO: 3074521 - RNA, 12 nt, Mycobacterium bovis subsp bovis AF2122/97
gucagcggcgcg

SEQ ID NO: 3074522 - RNA, 12 nt, Mycobacterium bovis subsp bovis AF2122/97
gucagcggcggc

SEQ ID NO: 3074523 - RNA, 17 nt, Mycobacterium bovis subsp bovis AF2122/97
gucagcggcucggcggg

SEQ ID NO: 3074524 - RNA, 22 nt, Mycobacterium bovis subsp bovis AF2122/97
gucagcggcucggcgggggacc

SEQ ID NO: 3074525 - RNA, 14 nt, Mycobacterium bovis subsp bovis AF2122/97
gucagcggcugggc

SEQ ID NO: 3074526 - RNA, 17 nt, Mycobacterium bovis subsp bovis AF2122/97
gucaucggaucaaagcc

SEQ ID NO: 3074527 - RNA, 19 nt, Mycobacterium bovis subsp bovis AF2122/97
gucaucggcuggccgcgcc

SEQ ID NO: 3074528 - RNA, 23 nt, Mycobacterium bovis subsp bovis AF2122/97
gucaucggcuggccgcgccucgg

SEQ ID NO: 3074529 - RNA, 17 nt, Mycobacterium bovis subsp bovis AF2122/97
gucaucgggcagcggca

SEQ ID NO: 3074530 - RNA, 20 nt, Mycobacterium bovis subsp bovis AF2122/97
gucaucgggcagcggcaucg

SEQ ID NO: 3074531 - RNA, 20 nt, Mycobacterium bovis subsp bovis AF2122/97
gucaucgguugaccggucga

SEQ ID NO: 3074532 - RNA, 13 nt, Mycobacterium bovis subsp bovis AF2122/97
gucaucgugcccg

SEQ ID NO: 3074533 - RNA, 13 nt, Mycobacterium bovis subsp bovis AF2122/97
gucaucuggaagu

SEQ ID NO: 3074534 - RNA, 18 nt, Mycobacterium bovis subsp bovis AF2122/97
gucaucuggcgcugcugg

SEQ ID NO: 3074535 - RNA, 16 nt, Mycobacterium bovis subsp bovis AF2122/97
gucaucuugccaccgc

SEQ ID NO: 3074536 - RNA, 15 nt, Mycobacterium bovis subsp bovis AF2122/97
gucaugaacgaccgg

SEQ ID NO: 3074537 - RNA, 17 nt, Mycobacterium bovis subsp bovis AF2122/97
gucaugaacgaucggac

SEQ ID NO: 3074538 - RNA, 16 nt, Mycobacterium bovis subsp bovis AF2122/97
gucaugaagccguugc

SEQ ID NO: 3074539 - RNA, 13 nt, Mycobacterium bovis subsp bovis AF2122/97
gucaugcaagcgc

SEQ ID NO: 3074540 - RNA, 14 nt, Mycobacterium bovis subsp bovis AF2122/97
gucaugcccaggug

SEQ ID NO: 3074541 - RNA, 15 nt, Mycobacterium bovis subsp bovis AF2122/97
gucauggcccgaucg

SEQ ID NO: 3074542 - RNA, 21 nt, Mycobacterium bovis subsp bovis AF2122/97
gucauggcccgaucgaccgcu

SEQ ID NO: 3074543 - RNA, 17 nt, Mycobacterium bovis subsp bovis AF2122/97
gucauggccggccaucg

SEQ ID NO: 3074544 - RNA, 22 nt, Mycobacterium bovis subsp bovis AF2122/97
gucauggccggccaucgcccga

SEQ ID NO: 3074545 - RNA, 20 nt, Mycobacterium bovis subsp bovis AF2122/97
gucauggcgaaccgucagcg

SEQ ID NO: 3074546 - RNA, 13 nt, Mycobacterium bovis subsp bovis AF2122/97
gucauguccgucc

SEQ ID NO: 3074547 - RNA, 16 nt, Mycobacterium bovis subsp bovis AF2122/97
gucaugucggccaccg

SEQ ID NO: 3074548 - RNA, 13 nt, Mycobacterium bovis subsp bovis AF2122/97
gucauucaccgcg

SEQ ID NO: 3074549 - RNA, 17 nt, Mycobacterium bovis subsp bovis AF2122/97
guccaaaacaccgccag

SEQ ID NO: 3074550 - RNA, 13 nt, Mycobacterium bovis subsp bovis AF2122/97
guccaacagcgcu

SEQ ID NO: 3074551 - RNA, 21 nt, Mycobacterium bovis subsp bovis AF2122/97
guccaacgacuguggcgccgc

SEQ ID NO: 3074552 - RNA, 13 nt, Mycobacterium bovis subsp bovis AF2122/97
guccaacucggcc

SEQ ID NO: 3074553 - RNA, 18 nt, Mycobacterium bovis subsp bovis AF2122/97
guccaagaaccacgacgu

SEQ ID NO: 3074554 - RNA, 23 nt, Mycobacterium bovis subsp bovis AF2122/97
guccaagccggccacgcauucca

SEQ ID NO: 3074555 - RNA, 21 nt, Mycobacterium bovis subsp bovis AF2122/97
guccaagcugucaagcgggcu

SEQ ID NO: 3074556 - RNA, 15 nt, Mycobacterium bovis subsp bovis AF2122/97
guccaaucgccgggu

SEQ ID NO: 3074557 - RNA, 13 nt, Mycobacterium bovis subsp bovis AF2122/97
guccaaucuucuc

SEQ ID NO: 3074558 - RNA, 19 nt, Mycobacterium bovis subsp bovis AF2122/97
guccaauuccgcagagacc

SEQ ID NO: 3074559 - RNA, 16 nt, Mycobacterium bovis subsp bovis AF2122/97
guccaauuggcgucgu

SEQ ID NO: 3074560 - RNA, 21 nt, Mycobacterium bovis subsp bovis AF2122/97
guccaauuggcgucgucggcg

SEQ ID NO: 3074561 - RNA, 19 nt, Mycobacterium bovis subsp bovis AF2122/97
guccacaaguaccgcaucg

SEQ ID NO: 3074562 - RNA, 14 nt, Mycobacterium bovis subsp bovis AF2122/97
guccacaccauggu

SEQ ID NO: 3074563 - RNA, 17 nt, Mycobacterium bovis subsp bovis AF2122/97
guccacagccggcggcu

SEQ ID NO: 3074564 - RNA, 20 nt, Mycobacterium bovis subsp bovis AF2122/97
guccacauccagggugccgg

SEQ ID NO: 3074565 - RNA, 21 nt, Mycobacterium bovis subsp bovis AF2122/97
guccaccacaccugcggcugc

SEQ ID NO: 3074566 - RNA, 23 nt, Mycobacterium bovis subsp bovis AF2122/97
guccaccacccugcacugcgcgu

SEQ ID NO: 3074567 - RNA, 15 nt, Mycobacterium bovis subsp bovis AF2122/97
guccaccaccggcac

SEQ ID NO: 3074568 - RNA, 19 nt, Mycobacterium bovis subsp bovis AF2122/97
guccaccaccggcacccgc

SEQ ID NO: 3074569 - RNA, 13 nt, Mycobacterium bovis subsp bovis AF2122/97
guccaccaccugg

SEQ ID NO: 3074570 - RNA, 14 nt, Mycobacterium bovis subsp bovis AF2122/97
guccaccaccuggc

SEQ ID NO: 3074571 - RNA, 23 nt, Mycobacterium bovis subsp bovis AF2122/97
guccacccaagcucggucaacgc

SEQ ID NO: 3074572 - RNA, 21 nt, Mycobacterium bovis subsp bovis AF2122/97
guccacccacgaucagcagcg

SEQ ID NO: 3074573 - RNA, 11 nt, Mycobacterium bovis subsp bovis AF2122/97
guccaccccgc

SEQ ID NO: 3074574 - RNA, 22 nt, Mycobacterium bovis subsp bovis AF2122/97
guccaccgaccuaccgucgacc

SEQ ID NO: 3074575 - RNA, 14 nt, Mycobacterium bovis subsp bovis AF2122/97
guccaccgccacca

SEQ ID NO: 3074576 - RNA, 16 nt, Mycobacterium bovis subsp bovis AF2122/97
guccaccgcgaugccc

SEQ ID NO: 3074577 - RNA, 18 nt, Mycobacterium bovis subsp bovis AF2122/97
guccaccgcgaugcccca

SEQ ID NO: 3074578 - RNA, 22 nt, Mycobacterium bovis subsp bovis AF2122/97
guccaccggaccgaccaccgcg

SEQ ID NO: 3074579 - RNA, 17 nt, Mycobacterium bovis subsp bovis AF2122/97
guccaccggaucgucga

SEQ ID NO: 3074580 - RNA, 14 nt, Mycobacterium bovis subsp bovis AF2122/97
guccacgacagcag

SEQ ID NO: 3074581 - RNA, 17 nt, Mycobacterium bovis subsp bovis AF2122/97
guccacgaccccggcgg

SEQ ID NO: 3074582 - RNA, 17 nt, Mycobacterium bovis subsp bovis AF2122/97
guccacgaugacgucga

SEQ ID NO: 3074583 - RNA, 21 nt, Mycobacterium bovis subsp bovis AF2122/97
guccacgcaccacgagcagcc

SEQ ID NO: 3074584 - RNA, 23 nt, Mycobacterium bovis subsp bovis AF2122/97
guccacgcagaggcggcuggcgg

SEQ ID NO: 3074585 - RNA, 16 nt, Mycobacterium bovis subsp bovis AF2122/97
guccacgccgugcuug

SEQ ID NO: 3074586 - RNA, 22 nt, Mycobacterium bovis subsp bovis AF2122/97
guccacgcgcucggugccgccc

SEQ ID NO: 3074587 - RNA, 22 nt, Mycobacterium bovis subsp bovis AF2122/97
guccacggcguuacguggugga

SEQ ID NO: 3074588 - RNA, 15 nt, Mycobacterium bovis subsp bovis AF2122/97
guccacgggaucugc

SEQ ID NO: 3074589 - RNA, 14 nt, Mycobacterium bovis subsp bovis AF2122/97
guccacguucggcu

SEQ ID NO: 3074590 - RNA, 16 nt, Mycobacterium bovis subsp bovis AF2122/97
guccacugaucaggcc

SEQ ID NO: 3074591 - RNA, 14 nt, Mycobacterium bovis subsp bovis AF2122/97
guccacugccaccg

SEQ ID NO: 3074592 - RNA, 18 nt, Mycobacterium bovis subsp bovis AF2122/97
guccacuucagaucggcg

SEQ ID NO: 3074593 - RNA, 17 nt, Mycobacterium bovis subsp bovis AF2122/97
guccagaacggcgauca

SEQ ID NO: 3074594 - RNA, 21 nt, Mycobacterium bovis subsp bovis AF2122/97
guccagaacggcgaucaccga

SEQ ID NO: 3074595 - RNA, 19 nt, Mycobacterium bovis subsp bovis AF2122/97
guccagaacgguggcgcgg

SEQ ID NO: 3074596 - RNA, 16 nt, Mycobacterium bovis subsp bovis AF2122/97
guccagaaugucgcgg

SEQ ID NO: 3074597 - RNA, 10 nt, Mycobacterium bovis subsp bovis AF2122/97
guccagaccg

SEQ ID NO: 3074598 - RNA, 18 nt, Mycobacterium bovis subsp bovis AF2122/97
guccagaccguagcggcc

SEQ ID NO: 3074599 - RNA, 20 nt, Mycobacterium bovis subsp bovis AF2122/97
guccagauaggccaaccggu

SEQ ID NO: 3074600 - RNA, 21 nt, Mycobacterium bovis subsp bovis AF2122/97
guccagauaucgaagcgucgg

SEQ ID NO: 3074601 - RNA, 20 nt, Mycobacterium bovis subsp bovis AF2122/97
guccagcaaaugcggcgcgu

SEQ ID NO: 3074602 - RNA, 19 nt, Mycobacterium bovis subsp bovis AF2122/97
guccagcaacagcgagcgg

SEQ ID NO: 3074603 - RNA, 22 nt, Mycobacterium bovis subsp bovis AF2122/97
guccagcaauaccugagcgcgc

SEQ ID NO: 3074604 - RNA, 13 nt, Mycobacterium bovis subsp bovis AF2122/97
guccagcacaucg

SEQ ID NO: 3074605 - RNA, 18 nt, Mycobacterium bovis subsp bovis AF2122/97
guccagcacaucggcgag

SEQ ID NO: 3074606 - RNA, 13 nt, Mycobacterium bovis subsp bovis AF2122/97
guccagcaccggg

SEQ ID NO: 3074607 - RNA, 14 nt, Mycobacterium bovis subsp bovis AF2122/97
guccagcaccugcc

SEQ ID NO: 3074608 - RNA, 19 nt, Mycobacterium bovis subsp bovis AF2122/97
guccagcagcgacgcugcc

SEQ ID NO: 3074609 - RNA, 20 nt, Mycobacterium bovis subsp bovis AF2122/97
guccagcagcgacgcugccg

SEQ ID NO: 3074610 - RNA, 16 nt, Mycobacterium bovis subsp bovis AF2122/97
guccagcagcucggcc

SEQ ID NO: 3074611 - RNA, 17 nt, Mycobacterium bovis subsp bovis AF2122/97
guccagcagcucggccg

SEQ ID NO: 3074612 - RNA, 19 nt, Mycobacterium bovis subsp bovis AF2122/97
guccagcagcucggccgag

SEQ ID NO: 3074613 - RNA, 17 nt, Mycobacterium bovis subsp bovis AF2122/97
gucccauggugagcugu

SEQ ID NO: 3074614 - RNA, 18 nt, Mycobacterium bovis subsp bovis AF2122/97
gucccauuugccuugagc

SEQ ID NO: 3074615 - RNA, 21 nt, Mycobacterium bovis subsp bovis AF2122/97
guccccagaccggcggcuacg

SEQ ID NO: 3074616 - RNA, 14 nt, Mycobacterium bovis subsp bovis AF2122/97
guccccaggugggc

SEQ ID NO: 3074617 - RNA, 21 nt, Mycobacterium bovis subsp bovis AF2122/97
guccccaggugggcagcaggc

SEQ ID NO: 3074618 - RNA, 21 nt, Mycobacterium bovis subsp bovis AF2122/97
guccccaugcagcgcgucgcc

SEQ ID NO: 3074619 - RNA, 21 nt, Mycobacterium bovis subsp bovis AF2122/97
gucccccuguggacacggcgc

SEQ ID NO: 3074620 - RNA, 20 nt, Mycobacterium bovis subsp bovis AF2122/97
guccccgacgucaggcagcu

SEQ ID NO: 3074621 - RNA, 14 nt, Mycobacterium bovis subsp bovis AF2122/97
guccccgcagcgcc

SEQ ID NO: 3074622 - RNA, 12 nt, Mycobacterium bovis subsp bovis AF2122/97
guccccgccgac

SEQ ID NO: 3074623 - RNA, 16 nt, Mycobacterium bovis subsp bovis AF2122/97
guccccgccgacgccg

SEQ ID NO: 3074624 - RNA, 13 nt, Mycobacterium bovis subsp bovis AF2122/97
guccccgccggcc

SEQ ID NO: 3074625 - RNA, 15 nt, Mycobacterium bovis subsp bovis AF2122/97
guccccgccggcggg

SEQ ID NO: 3074626 - RNA, 16 nt, Mycobacterium bovis subsp bovis AF2122/97
guccccgccgucgcca

SEQ ID NO: 3074627 - RNA, 23 nt, Mycobacterium bovis subsp bovis AF2122/97
guccccgcuuggcgagccacggc

SEQ ID NO: 3074628 - RNA, 21 nt, Mycobacterium bovis subsp bovis AF2122/97
guccccggcugccagcgccgc

SEQ ID NO: 3074629 - RNA, 22 nt, Mycobacterium bovis subsp bovis AF2122/97
guccccggucaggacggcaccc

SEQ ID NO: 3074630 - RNA, 23 nt, Mycobacterium bovis subsp bovis AF2122/97
guccccgucgcuggccggcaccg

SEQ ID NO: 3074631 - RNA, 17 nt, Mycobacterium bovis subsp bovis AF2122/97
guccccucccaccagcg

SEQ ID NO: 3074632 - RNA, 18 nt, Mycobacterium bovis subsp bovis AF2122/97
gucccgaguggccggugg

SEQ ID NO: 3074633 - RNA, 17 nt, Mycobacterium bovis subsp bovis AF2122/97
gucccgauacggccggc

SEQ ID NO: 3074634 - RNA, 18 nt, Mycobacterium bovis subsp bovis AF2122/97
gucccgauacggccggcc

SEQ ID NO: 3074635 - RNA, 12 nt, Mycobacterium bovis subsp bovis AF2122/97
gucccgaucacc

SEQ ID NO: 3074636 - RNA, 13 nt, Mycobacterium bovis subsp bovis AF2122/97
gucccgauggcga

SEQ ID NO: 3074637 - RNA, 22 nt, Mycobacterium bovis subsp bovis AF2122/97
gucccgcaaaaucgucagcgcc

SEQ ID NO: 3074638 - RNA, 22 nt, Mycobacterium bovis subsp bovis AF2122/97
gucccgccgaccgacaccacca

SEQ ID NO: 3074639 - RNA, 12 nt, Mycobacterium bovis subsp bovis AF2122/97
gucccgccgcgc

SEQ ID NO: 3074640 - RNA, 17 nt, Mycobacterium bovis subsp bovis AF2122/97
gucccgccgcgcgucgc

SEQ ID NO: 3074641 - RNA, 17 nt, Mycobacterium bovis subsp bovis AF2122/97
gucccgccggucacgac

SEQ ID NO: 3074642 - RNA, 17 nt, Mycobacterium bovis subsp bovis AF2122/97
gucccgccgugccgcgg

SEQ ID NO: 3074643 - RNA, 18 nt, Mycobacterium bovis subsp bovis AF2122/97
gucccgcgagcagcccgg

SEQ ID NO: 3074644 - RNA, 22 nt, Mycobacterium bovis subsp bovis AF2122/97
gucccgcgaggcaagaacccga

SEQ ID NO: 3074645 - RNA, 17 nt, Mycobacterium bovis subsp bovis AF2122/97
gucccgcggaccgcaac

SEQ ID NO: 3074646 - RNA, 18 nt, Mycobacterium bovis subsp bovis AF2122/97
gucccgcgggccagcacc

SEQ ID NO: 3074647 - RNA, 15 nt, Mycobacterium bovis subsp bovis AF2122/97
gucccgcucuggucg

SEQ ID NO: 3074648 - RNA, 17 nt, Mycobacterium bovis subsp bovis AF2122/97
gucccgcucuggucguc

SEQ ID NO: 3074649 - RNA, 18 nt, Mycobacterium bovis subsp bovis AF2122/97
gucccgcucuggucgucg

SEQ ID NO: 3074650 - RNA, 21 nt, Mycobacterium bovis subsp bovis AF2122/97
gucccgcucuggucgucgaac

SEQ ID NO: 3074651 - RNA, 23 nt, Mycobacterium bovis subsp bovis AF2122/97
gucccggcagcuggucggugggc

SEQ ID NO: 3074652 - RNA, 19 nt, Mycobacterium bovis subsp bovis AF2122/97
gucccggccgagcguggcc

SEQ ID NO: 3074653 - RNA, 12 nt, Mycobacterium bovis subsp bovis AF2122/97
gucccggcgacc

SEQ ID NO: 3074654 - RNA, 17 nt, Mycobacterium bovis subsp bovis AF2122/97
gucccggcgaccggguc

SEQ ID NO: 3074655 - RNA, 22 nt, Mycobacterium bovis subsp bovis AF2122/97
gucccggcggucagcggcucgg

SEQ ID NO: 3074656 - RNA, 20 nt, Mycobacterium bovis subsp bovis AF2122/97
gucccggcgguuggugcagc

SEQ ID NO: 3074657 - RNA, 12 nt, Mycobacterium bovis subsp bovis AF2122/97
gucccggcuggg

SEQ ID NO: 3074658 - RNA, 18 nt, Mycobacterium bovis subsp bovis AF2122/97
gucccggucgccaaaucc

SEQ ID NO: 3074659 - RNA, 21 nt, Mycobacterium bovis subsp bovis AF2122/97
gucccggugggcggcucgucg

SEQ ID NO: 3074660 - RNA, 22 nt, Mycobacterium bovis subsp bovis AF2122/97
gucccggugggcggcucgucga

SEQ ID NO: 3074661 - RNA, 17 nt, Mycobacterium bovis subsp bovis AF2122/97
gucccgguguccagcca

SEQ ID NO: 3074662 - RNA, 19 nt, Mycobacterium bovis subsp bovis AF2122/97
gucccguucgcccgcccgu

SEQ ID NO: 3074663 - RNA, 15 nt, Mycobacterium bovis subsp bovis AF2122/97
gucccguugccgccc

SEQ ID NO: 3074664 - RNA, 22 nt, Mycobacterium bovis subsp bovis AF2122/97
gucccuauugaucuggcaacgc

SEQ ID NO: 3074665 - RNA, 15 nt, Mycobacterium bovis subsp bovis AF2122/97
gucccucaucaccuc

SEQ ID NO: 3074666 - RNA, 21 nt, Mycobacterium bovis subsp bovis AF2122/97
gucccucgccaaccagucgca

SEQ ID NO: 3074667 - RNA, 16 nt, Mycobacterium bovis subsp bovis AF2122/97
gucccugaagccagcg

SEQ ID NO: 3074668 - RNA, 18 nt, Mycobacterium bovis subsp bovis AF2122/97
gucccugaagccagcgca

SEQ ID NO: 3074669 - RNA, 18 nt, Mycobacterium bovis subsp bovis AF2122/97
gucccugugucgccgucg

SEQ ID NO: 3074670 - RNA, 19 nt, Mycobacterium bovis subsp bovis AF2122/97
gucccugugucgccgucgc

SEQ ID NO: 3074671 - RNA, 23 nt, Mycobacterium bovis subsp bovis AF2122/97
gucccuuguggucugccagcacc

SEQ ID NO: 3074672 - RNA, 15 nt, Mycobacterium bovis subsp bovis AF2122/97
guccgaaccaccugu

SEQ ID NO: 3074673 - RNA, 19 nt, Mycobacterium bovis subsp bovis AF2122/97
guccgaaccaccuguccgg

SEQ ID NO: 3074674 - RNA, 19 nt, Mycobacterium bovis subsp bovis AF2122/97
guccgaacuugacgaacuc

SEQ ID NO: 3074675 - RNA, 16 nt, Mycobacterium bovis subsp bovis AF2122/97
guccgaaguacuggcc

SEQ ID NO: 3074676 - RNA, 21 nt, Mycobacterium bovis subsp bovis AF2122/97
guccgacaccacggaccagcg

SEQ ID NO: 3074677 - RNA, 22 nt, Mycobacterium bovis subsp bovis AF2122/97
guccgacaccacggaccagcgc

SEQ ID NO: 3074678 - RNA, 14 nt, Mycobacterium bovis subsp bovis AF2122/97
guccgaccagcggc

SEQ ID NO: 3074679 - RNA, 17 nt, Mycobacterium bovis subsp bovis AF2122/97
guccgaccagcggccga

SEQ ID NO: 3074680 - RNA, 15 nt, Mycobacterium bovis subsp bovis AF2122/97
guccgacgccaccgc

SEQ ID NO: 3074681 - RNA, 13 nt, Mycobacterium bovis subsp bovis AF2122/97
guccgacgcgugu

SEQ ID NO: 3074682 - RNA, 18 nt, Mycobacterium bovis subsp bovis AF2122/97
guccgacgggccgucgcc

SEQ ID NO: 3074683 - RNA, 16 nt, Mycobacterium bovis subsp bovis AF2122/97
guccgagacgucggcg

SEQ ID NO: 3074684 - RNA, 19 nt, Mycobacterium bovis subsp bovis AF2122/97
guccgagacgucggcguag

SEQ ID NO: 3074685 - RNA, 20 nt, Mycobacterium bovis subsp bovis AF2122/97
guccgagcguaaugcugcug

SEQ ID NO: 3074686 - RNA, 22 nt, Mycobacterium bovis subsp bovis AF2122/97
guccgagcguaaugcugcugca

SEQ ID NO: 3074687 - RNA, 15 nt, Mycobacterium bovis subsp bovis AF2122/97
guccgagggcgucgc

SEQ ID NO: 3074688 - RNA, 18 nt, Mycobacterium bovis subsp bovis AF2122/97
guccgagggcgucgccgc

SEQ ID NO: 3074689 - RNA, 13 nt, Mycobacterium bovis subsp bovis AF2122/97
guccgaucgccga

SEQ ID NO: 3074690 - RNA, 15 nt, Mycobacterium bovis subsp bovis AF2122/97
guccgaucggcgcgc

SEQ ID NO: 3074691 - RNA, 17 nt, Mycobacterium bovis subsp bovis AF2122/97
guccgaucggcgcgccg

SEQ ID NO: 3074692 - RNA, 20 nt, Mycobacterium bovis subsp bovis AF2122/97
guccgaucggcgcgccgauc

SEQ ID NO: 3074693 - RNA, 21 nt, Mycobacterium bovis subsp bovis AF2122/97
guccgaucguuucagcuagac

SEQ ID NO: 3074694 - RNA, 16 nt, Mycobacterium bovis subsp bovis AF2122/97
guccgaugcgcgcggc

SEQ ID NO: 3074695 - RNA, 22 nt, Mycobacterium bovis subsp bovis AF2122/97
guccgaugcgcgcggcgcgauc

SEQ ID NO: 3074696 - RNA, 13 nt, Mycobacterium bovis subsp bovis AF2122/97
guccgauuggugu

SEQ ID NO: 3074697 - RNA, 15 nt, Mycobacterium bovis subsp bovis AF2122/97
guccgcaaccucgcc

SEQ ID NO: 3074698 - RNA, 18 nt, Mycobacterium bovis subsp bovis AF2122/97
guccgcaaccucgccguc

SEQ ID NO: 3074699 - RNA, 13 nt, Mycobacterium bovis subsp bovis AF2122/97
guccggguagcgg

SEQ ID NO: 3074700 - RNA, 16 nt, Mycobacterium bovis subsp bovis AF2122/97
guccggguagcggcgc

SEQ ID NO: 3074701 - RNA, 16 nt, Mycobacterium bovis subsp bovis AF2122/97
guccgggucaccagcg

SEQ ID NO: 3074702 - RNA, 23 nt, Mycobacterium bovis subsp bovis AF2122/97
guccggguguagagggagcggcg

SEQ ID NO: 3074703 - RNA, 15 nt, Mycobacterium bovis subsp bovis AF2122/97
guccgguagcagcgc

SEQ ID NO: 3074704 - RNA, 21 nt, Mycobacterium bovis subsp bovis AF2122/97
guccgguagcuguggugguga

SEQ ID NO: 3074705 - RNA, 15 nt, Mycobacterium bovis subsp bovis AF2122/97
guccgguccgccagc

SEQ ID NO: 3074706 - RNA, 22 nt, Mycobacterium bovis subsp bovis AF2122/97
guccggucgccucaccggcgcg

SEQ ID NO: 3074707 - RNA, 14 nt, Mycobacterium bovis subsp bovis AF2122/97
guccggucgcggcg

SEQ ID NO: 3074708 - RNA, 17 nt, Mycobacterium bovis subsp bovis AF2122/97
guccggucgcggcgguc

SEQ ID NO: 3074709 - RNA, 22 nt, Mycobacterium bovis subsp bovis AF2122/97
guccggucggcgguagccgacc

SEQ ID NO: 3074710 - RNA, 15 nt, Mycobacterium bovis subsp bovis AF2122/97
guccggugauccaac

SEQ ID NO: 3074711 - RNA, 13 nt, Mycobacterium bovis subsp bovis AF2122/97
guccggugauggu

SEQ ID NO: 3074712 - RNA, 13 nt, Mycobacterium bovis subsp bovis AF2122/97
guccggugcuggu

SEQ ID NO: 3074713 - RNA, 19 nt, Mycobacterium bovis subsp bovis AF2122/97
guccggugcugguccagcc

SEQ ID NO: 3074714 - RNA, 19 nt, Mycobacterium bovis subsp bovis AF2122/97
guccgguggaauccaccag

SEQ ID NO: 3074715 - RNA, 21 nt, Mycobacterium bovis subsp bovis AF2122/97
guccgguggaauccaccagcc

SEQ ID NO: 3074716 - RNA, 23 nt, Mycobacterium bovis subsp bovis AF2122/97
guccgguggaccgccgaucggcc

SEQ ID NO: 3074717 - RNA, 16 nt, Mycobacterium bovis subsp bovis AF2122/97
guccgguggacgcaga

SEQ ID NO: 3074718 - RNA, 23 nt, Mycobacterium bovis subsp bovis AF2122/97
guccgguguggcgcugaucggca

SEQ ID NO: 3074719 - RNA, 21 nt, Mycobacterium bovis subsp bovis AF2122/97
guccgguuacuuuucgagugu

SEQ ID NO: 3074720 - RNA, 21 nt, Mycobacterium bovis subsp bovis AF2122/97
guccgguuagcggcgcgagca

SEQ ID NO: 3074721 - RNA, 17 nt, Mycobacterium bovis subsp bovis AF2122/97
guccguacuugccaccc

SEQ ID NO: 3074722 - RNA, 15 nt, Mycobacterium bovis subsp bovis AF2122/97
guccguagcgcggcc

SEQ ID NO: 3074723 - RNA, 18 nt, Mycobacterium bovis subsp bovis AF2122/97
guccguagcgcggccgau

SEQ ID NO: 3074724 - RNA, 23 nt, Mycobacterium bovis subsp bovis AF2122/97
guccguagugaucgcaaaggccc

SEQ ID NO: 3074725 - RNA, 23 nt, Mycobacterium bovis subsp bovis AF2122/97
guccgucaccaccgccgccacca

SEQ ID NO: 3074726 - RNA, 20 nt, Mycobacterium bovis subsp bovis AF2122/97
guccgucgcgcgggcgagcg

SEQ ID NO: 3074727 - RNA, 14 nt, Mycobacterium bovis subsp bovis AF2122/97
guccgucggggaca

SEQ ID NO: 3074728 - RNA, 17 nt, Mycobacterium bovis subsp bovis AF2122/97
guccgugaguacggugu

SEQ ID NO: 3074729 - RNA, 14 nt, Mycobacterium bovis subsp bovis AF2122/97
guccguggacaagc

SEQ ID NO: 3074730 - RNA, 15 nt, Mycobacterium bovis subsp bovis AF2122/97
guccguggacaagca

SEQ ID NO: 3074731 - RNA, 19 nt, Mycobacterium bovis subsp bovis AF2122/97
guccguggacaagcacagc

SEQ ID NO: 3074732 - RNA, 19 nt, Mycobacterium bovis subsp bovis AF2122/97
guccguucaccgucugcgg

SEQ ID NO: 3074733 - RNA, 16 nt, Mycobacterium bovis subsp bovis AF2122/97
guccguucgaugccag

SEQ ID NO: 3074734 - RNA, 18 nt, Mycobacterium bovis subsp bovis AF2122/97
guccuaucagugagccgc

SEQ ID NO: 3074735 - RNA, 20 nt, Mycobacterium bovis subsp bovis AF2122/97
guccuauccgggccccugau

SEQ ID NO: 3074736 - RNA, 18 nt, Mycobacterium bovis subsp bovis AF2122/97
guccuauuugcagccuuc

SEQ ID NO: 3074737 - RNA, 19 nt, Mycobacterium bovis subsp bovis AF2122/97
guccucacaugcccggacg

SEQ ID NO: 3074738 - RNA, 18 nt, Mycobacterium bovis subsp bovis AF2122/97
guccucacgggucagcau

SEQ ID NO: 3074739 - RNA, 14 nt, Mycobacterium bovis subsp bovis AF2122/97
guccucaucgagcg

SEQ ID NO: 3074740 - RNA, 18 nt, Mycobacterium bovis subsp bovis AF2122/97
guccucaucgagcgcgcg

SEQ ID NO: 3074741 - RNA, 19 nt, Mycobacterium bovis subsp bovis AF2122/97
guccucaucgagcgcgcga

SEQ ID NO: 3074742 - RNA, 17 nt, Mycobacterium bovis subsp bovis AF2122/97
guccucaucguuccacg

SEQ ID NO: 3074743 - RNA, 20 nt, Mycobacterium bovis subsp bovis AF2122/97
guccuccaaggcggucacca

SEQ ID NO: 3074744 - RNA, 18 nt, Mycobacterium bovis subsp bovis AF2122/97
guccuccacggcgggaac

SEQ ID NO: 3074745 - RNA, 20 nt, Mycobacterium bovis subsp bovis AF2122/97
guccuccacuuuuccgccgg

SEQ ID NO: 3074746 - RNA, 22 nt, Mycobacterium bovis subsp bovis AF2122/97
guccuccacuuuuccgccggcc

SEQ ID NO: 3074747 - RNA, 18 nt, Mycobacterium bovis subsp bovis AF2122/97
guccuccagcugcgcggg

SEQ ID NO: 3074748 - RNA, 22 nt, Mycobacterium bovis subsp bovis AF2122/97
guccucccaucccaugucgagg

SEQ ID NO: 3074749 - RNA, 22 nt, Mycobacterium bovis subsp bovis AF2122/97
guccucgaaacgcuuacccagc

SEQ ID NO: 3074750 - RNA, 15 nt, Mycobacterium bovis subsp bovis AF2122/97
guccucgaagaacug

SEQ ID NO: 3074751 - RNA, 22 nt, Mycobacterium bovis subsp bovis AF2122/97
guccucgaagaacuggugcuuc

SEQ ID NO: 3074752 - RNA, 21 nt, Mycobacterium bovis subsp bovis AF2122/97
guccucgagguccucgucggc

SEQ ID NO: 3074753 - RNA, 18 nt, Mycobacterium bovis subsp bovis AF2122/97
guccucgagugccgccgu

SEQ ID NO: 3074754 - RNA, 21 nt, Mycobacterium bovis subsp bovis AF2122/97
guccucgagugccgccgucgc

SEQ ID NO: 3074755 - RNA, 21 nt, Mycobacterium bovis subsp bovis AF2122/97
guccucgaucagacgcucgac

SEQ ID NO: 3074756 - RNA, 16 nt, Mycobacterium bovis subsp bovis AF2122/97
guccucgauccgggcg

SEQ ID NO: 3074757 - RNA, 17 nt, Mycobacterium bovis subsp bovis AF2122/97
guccucgaucgcgcaga

SEQ ID NO: 3074758 - RNA, 20 nt, Mycobacterium bovis subsp bovis AF2122/97
guccucgcggagccgucgca

SEQ ID NO: 3074759 - RNA, 11 nt, Mycobacterium bovis subsp bovis AF2122/97
guccucggcga

SEQ ID NO: 3074760 - RNA, 21 nt, Mycobacterium bovis subsp bovis AF2122/97
guccucgggcaggcggccagc

SEQ ID NO: 3074761 - RNA, 22 nt, Mycobacterium bovis subsp bovis AF2122/97
guccucgggcaggcggccagcg

SEQ ID NO: 3074762 - RNA, 15 nt, Mycobacterium bovis subsp bovis AF2122/97
guccucgucggcguc

SEQ ID NO: 3074763 - RNA, 14 nt, Mycobacterium bovis subsp bovis AF2122/97
guccucgucggugu

SEQ ID NO: 3074764 - RNA, 18 nt, Mycobacterium bovis subsp bovis AF2122/97
guccugaaucgguucggc

SEQ ID NO: 3074765 - RNA, 21 nt, Mycobacterium bovis subsp bovis AF2122/97
guccugaaucgguucggccag

SEQ ID NO: 3074766 - RNA, 22 nt, Mycobacterium bovis subsp bovis AF2122/97
guccugaaucgguucggccaga

SEQ ID NO: 3074767 - RNA, 19 nt, Mycobacterium bovis subsp bovis AF2122/97
guccugacgguacagcucc

SEQ ID NO: 3074768 - RNA, 11 nt, Mycobacterium bovis subsp bovis AF2122/97
guccugcagga

SEQ ID NO: 3074769 - RNA, 19 nt, Mycobacterium bovis subsp bovis AF2122/97
guccugccaguccgcagcg

SEQ ID NO: 3074770 - RNA, 19 nt, Mycobacterium bovis subsp bovis AF2122/97
guccugcgagaggugcugc

SEQ ID NO: 3074771 - RNA, 19 nt, Mycobacterium bovis subsp bovis AF2122/97
guccugcggauagugguug

SEQ ID NO: 3074772 - RNA, 17 nt, Mycobacterium bovis subsp bovis AF2122/97
guccugcggguagguga

SEQ ID NO: 3074773 - RNA, 16 nt, Mycobacterium bovis subsp bovis AF2122/97
guccugcucgcacagc

SEQ ID NO: 3074774 - RNA, 14 nt, Mycobacterium bovis subsp bovis AF2122/97
guccuggcucggca

SEQ ID NO: 3074775 - RNA, 15 nt, Mycobacterium bovis subsp bovis AF2122/97
guccugggccgccgc

SEQ ID NO: 3074776 - RNA, 17 nt, Mycobacterium bovis subsp bovis AF2122/97
guccugggccgccgccc

SEQ ID NO: 3074777 - RNA, 14 nt, Mycobacterium bovis subsp bovis AF2122/97
guccugguggcggg

SEQ ID NO: 3074778 - RNA, 20 nt, Mycobacterium bovis subsp bovis AF2122/97
guccuucagccaguccagcg

SEQ ID NO: 3074779 - RNA, 14 nt, Mycobacterium bovis subsp bovis AF2122/97
guccuucgcuggua

SEQ ID NO: 3074780 - RNA, 20 nt, Mycobacterium bovis subsp bovis AF2122/97
guccuucuuguuggucccga

SEQ ID NO: 3074781 - RNA, 23 nt, Mycobacterium bovis subsp bovis AF2122/97
guccuugaggauccgcaccacgc

SEQ ID NO: 3074782 - RNA, 14 nt, Mycobacterium bovis subsp bovis AF2122/97
guccuugcgcagca

SEQ ID NO: 3074783 - RNA, 16 nt, Mycobacterium bovis subsp bovis AF2122/97
guccuuggccgccacu

SEQ ID NO: 3074784 - RNA, 14 nt, Mycobacterium bovis subsp bovis AF2122/97
guccuugggcgucg

SEQ ID NO: 3074785 - RNA, 20 nt, Mycobacterium bovis subsp bovis AF2122/97
gucgacccccugccacagcg

SEQ ID NO: 3074786 - RNA, 23 nt, Mycobacterium bovis subsp bovis AF2122/97
gucgacccccugccacagcgaca

SEQ ID NO: 3074787 - RNA, 15 nt, Mycobacterium bovis subsp bovis AF2122/97
gucgaccccggccag

SEQ ID NO: 3074788 - RNA, 22 nt, Mycobacterium bovis subsp bovis AF2122/97
gucgaccccugaaucaccggag

SEQ ID NO: 3074789 - RNA, 15 nt, Mycobacterium bovis subsp bovis AF2122/97
gucgacccggccagg

SEQ ID NO: 3074790 - RNA, 16 nt, Mycobacterium bovis subsp bovis AF2122/97
gucgacccugcccagc

SEQ ID NO: 3074791 - RNA, 21 nt, Mycobacterium bovis subsp bovis AF2122/97
gucgaccgaaacggggcgacg

SEQ ID NO: 3074792 - RNA, 17 nt, Mycobacterium bovis subsp bovis AF2122/97
gucgaccgaacccgacg

SEQ ID NO: 3074793 - RNA, 13 nt, Mycobacterium bovis subsp bovis AF2122/97
gucgaccgccgag

SEQ ID NO: 3074794 - RNA, 21 nt, Mycobacterium bovis subsp bovis AF2122/97
gucgaccggacaaagcugcuc

SEQ ID NO: 3074795 - RNA, 22 nt, Mycobacterium bovis subsp bovis AF2122/97
gucgaccggacaaagcugcucg

SEQ ID NO: 3074796 - RNA, 20 nt, Mycobacterium bovis subsp bovis AF2122/97
gucgaccggcccccggucga

SEQ ID NO: 3074797 - RNA, 13 nt, Mycobacterium bovis subsp bovis AF2122/97
gucgaccggcggg

SEQ ID NO: 3074798 - RNA, 20 nt, Mycobacterium bovis subsp bovis AF2122/97
gucgaccgugucaccgccgg

SEQ ID NO: 3074799 - RNA, 14 nt, Mycobacterium bovis subsp bovis AF2122/97
gucgaccuccucga

SEQ ID NO: 3074800 - RNA, 21 nt, Mycobacterium bovis subsp bovis AF2122/97
gucgaccucggcaaccaccuc

SEQ ID NO: 3074801 - RNA, 21 nt, Mycobacterium bovis subsp bovis AF2122/97
gucgaccuucucgaugcugac

SEQ ID NO: 3074802 - RNA, 21 nt, Mycobacterium bovis subsp bovis AF2122/97
gucgacgaacaccccgggcgc

SEQ ID NO: 3074803 - RNA, 16 nt, Mycobacterium bovis subsp bovis AF2122/97
gucgacgacgucgcgc

SEQ ID NO: 3074804 - RNA, 17 nt, Mycobacterium bovis subsp bovis AF2122/97
gucgacgacgucgcgca

SEQ ID NO: 3074805 - RNA, 13 nt, Mycobacterium bovis subsp bovis AF2122/97
gucgacgacgugg

SEQ ID NO: 3074806 - RNA, 16 nt, Mycobacterium bovis subsp bovis AF2122/97
gucgacgacguggcug

SEQ ID NO: 3074807 - RNA, 17 nt, Mycobacterium bovis subsp bovis AF2122/97
gucgacgagauccagcg

SEQ ID NO: 3074808 - RNA, 15 nt, Mycobacterium bovis subsp bovis AF2122/97
gucgacgagcaccgc

SEQ ID NO: 3074809 - RNA, 16 nt, Mycobacterium bovis subsp bovis AF2122/97
gucgacgagcaccgcg

SEQ ID NO: 3074810 - RNA, 17 nt, Mycobacterium bovis subsp bovis AF2122/97
gucgacgagcaccgcgc

SEQ ID NO: 3074811 - RNA, 21 nt, Mycobacterium bovis subsp bovis AF2122/97
gucgacgagcaccgcgccgcg

SEQ ID NO: 3074812 - RNA, 18 nt, Mycobacterium bovis subsp bovis AF2122/97
gucgacgagcgccucaag

SEQ ID NO: 3074813 - RNA, 15 nt, Mycobacterium bovis subsp bovis AF2122/97
gucgacgaucagcga

SEQ ID NO: 3074814 - RNA, 18 nt, Mycobacterium bovis subsp bovis AF2122/97
gucgacgaucucgccggc

SEQ ID NO: 3074815 - RNA, 23 nt, Mycobacterium bovis subsp bovis AF2122/97
gucgacgaugacgguggggucgc

SEQ ID NO: 3074816 - RNA, 19 nt, Mycobacterium bovis subsp bovis AF2122/97
gucgacgaugucggcacca

SEQ ID NO: 3074817 - RNA, 20 nt, Mycobacterium bovis subsp bovis AF2122/97
gucgacgcagugcccgaucg

SEQ ID NO: 3074818 - RNA, 14 nt, Mycobacterium bovis subsp bovis AF2122/97
gucgacgcaugggu

SEQ ID NO: 3074819 - RNA, 20 nt, Mycobacterium bovis subsp bovis AF2122/97
gucgacgcccauggcgucga

SEQ ID NO: 3074820 - RNA, 17 nt, Mycobacterium bovis subsp bovis AF2122/97
gucgacgcccgauacgc

SEQ ID NO: 3074821 - RNA, 12 nt, Mycobacterium bovis subsp bovis AF2122/97
gucgacgccgac

SEQ ID NO: 3074822 - RNA, 17 nt, Mycobacterium bovis subsp bovis AF2122/97
gucgacgccgagaccgc

SEQ ID NO: 3074823 - RNA, 14 nt, Mycobacterium bovis subsp bovis AF2122/97
gucgacgccgcagc

SEQ ID NO: 3074824 - RNA, 15 nt, Mycobacterium bovis subsp bovis AF2122/97
gucgacgccgcagcg

SEQ ID NO: 3074825 - RNA, 18 nt, Mycobacterium bovis subsp bovis AF2122/97
gucgacgccgcagcgucc

SEQ ID NO: 3074826 - RNA, 16 nt, Mycobacterium bovis subsp bovis AF2122/97
gucgacgccggccagc

SEQ ID NO: 3074827 - RNA, 13 nt, Mycobacterium bovis subsp bovis AF2122/97
gucgacgcggccg

SEQ ID NO: 3074828 - RNA, 15 nt, Mycobacterium bovis subsp bovis AF2122/97
gucgacgcggccggc

SEQ ID NO: 3074829 - RNA, 19 nt, Mycobacterium bovis subsp bovis AF2122/97
gucgacggaaucgucggcg

SEQ ID NO: 3074830 - RNA, 22 nt, Mycobacterium bovis subsp bovis AF2122/97
gucgacggccuggggcagccgg

SEQ ID NO: 3074831 - RNA, 12 nt, Mycobacterium bovis subsp bovis AF2122/97
gucgacggcggc

SEQ ID NO: 3074832 - RNA, 13 nt, Mycobacterium bovis subsp bovis AF2122/97
gucgacggcggcc

SEQ ID NO: 3074833 - RNA, 18 nt, Mycobacterium bovis subsp bovis AF2122/97
gucgacggcggccgccac

SEQ ID NO: 3074834 - RNA, 16 nt, Mycobacterium bovis subsp bovis AF2122/97
gucgacggcuccuccg

SEQ ID NO: 3074835 - RNA, 18 nt, Mycobacterium bovis subsp bovis AF2122/97
gucgacgggcacgcggcg

SEQ ID NO: 3074836 - RNA, 19 nt, Mycobacterium bovis subsp bovis AF2122/97
gucgacgggcacgcggcga

SEQ ID NO: 3074837 - RNA, 18 nt, Mycobacterium bovis subsp bovis AF2122/97
gucgacggggcggucggc

SEQ ID NO: 3074838 - RNA, 21 nt, Mycobacterium bovis subsp bovis AF2122/97
gucgacggggcggucggccgg

SEQ ID NO: 3074839 - RNA, 14 nt, Mycobacterium bovis subsp bovis AF2122/97
gucgacggucaccg

SEQ ID NO: 3074840 - RNA, 21 nt, Mycobacterium bovis subsp bovis AF2122/97
gucgacggucaccggcgcacc

SEQ ID NO: 3074841 - RNA, 21 nt, Mycobacterium bovis subsp bovis AF2122/97
gucgacggucuggcccgcgac

SEQ ID NO: 3074842 - RNA, 17 nt, Mycobacterium bovis subsp bovis AF2122/97
gucgacggugccgucgg

SEQ ID NO: 3074843 - RNA, 13 nt, Mycobacterium bovis subsp bovis AF2122/97
gucgacgguggcg

SEQ ID NO: 3074844 - RNA, 17 nt, Mycobacterium bovis subsp bovis AF2122/97
gucgacgguggcgccgu

SEQ ID NO: 3074845 - RNA, 20 nt, Mycobacterium bovis subsp bovis AF2122/97
gucgacgguggcgccgucgg

SEQ ID NO: 3074846 - RNA, 22 nt, Mycobacterium bovis subsp bovis AF2122/97
gucgacgguggcgccgucggcc

SEQ ID NO: 3074847 - RNA, 19 nt, Mycobacterium bovis subsp bovis AF2122/97
gucgacggugucuugggcg

SEQ ID NO: 3074848 - RNA, 14 nt, Mycobacterium bovis subsp bovis AF2122/97
gucgacgucgauca

SEQ ID NO: 3074849 - RNA, 22 nt, Mycobacterium bovis subsp bovis AF2122/97
gucgacgucgauuucggcgacc

SEQ ID NO: 3074850 - RNA, 16 nt, Mycobacterium bovis subsp bovis AF2122/97
gucgacgucggcgagc

SEQ ID NO: 3074851 - RNA, 23 nt, Mycobacterium bovis subsp bovis AF2122/97
gucgacgucucuggugcagguga

SEQ ID NO: 3074852 - RNA, 22 nt, Mycobacterium bovis subsp bovis AF2122/97
gucgacgugaucgcgguccaac

SEQ ID NO: 3074853 - RNA, 22 nt, Mycobacterium bovis subsp bovis AF2122/97
gucgacguucgguggcgaugcg

SEQ ID NO: 3074854 - RNA, 22 nt, Mycobacterium bovis subsp bovis AF2122/97
gucgacguugaugaccuguccg

SEQ ID NO: 3074855 - RNA, 15 nt, Mycobacterium bovis subsp bovis AF2122/97
gucgacuccagcacc

SEQ ID NO: 3074856 - RNA, 19 nt, Mycobacterium bovis subsp bovis AF2122/97
gucgacuccagcaccagca

SEQ ID NO: 3074857 - RNA, 21 nt, Mycobacterium bovis subsp bovis AF2122/97
gucgacuccagcaccagcacg

SEQ ID NO: 3074858 - RNA, 13 nt, Mycobacterium bovis subsp bovis AF2122/97
gucgacuccgauc

SEQ ID NO: 3074859 - RNA, 18 nt, Mycobacterium bovis subsp bovis AF2122/97
gucgacuccgaucgggcc

SEQ ID NO: 3074860 - RNA, 15 nt, Mycobacterium bovis subsp bovis AF2122/97
gucgacucggcggcg

SEQ ID NO: 3074861 - RNA, 16 nt, Mycobacterium bovis subsp bovis AF2122/97
gucgacucggcggcgc

SEQ ID NO: 3074862 - RNA, 17 nt, Mycobacterium bovis subsp bovis AF2122/97
gucgacucggcggcgcg

SEQ ID NO: 3074863 - RNA, 17 nt, Mycobacterium bovis subsp bovis AF2122/97
gucgacucguggcgcca

SEQ ID NO: 3074864 - RNA, 21 nt, Mycobacterium bovis subsp bovis AF2122/97
gucgacucguggcgccacggc

SEQ ID NO: 3074865 - RNA, 15 nt, Mycobacterium bovis subsp bovis AF2122/97
gucgacugcgugccg

SEQ ID NO: 3074866 - RNA, 21 nt, Mycobacterium bovis subsp bovis AF2122/97
gucgacugcgugccgcaccgc

SEQ ID NO: 3074867 - RNA, 17 nt, Mycobacterium bovis subsp bovis AF2122/97
gucgacugggacgacgc

SEQ ID NO: 3074868 - RNA, 16 nt, Mycobacterium bovis subsp bovis AF2122/97
gucgacuucagcggcc

SEQ ID NO: 3074869 - RNA, 17 nt, Mycobacterium bovis subsp bovis AF2122/97
gucgacuucagcggccg

SEQ ID NO: 3074870 - RNA, 18 nt, Mycobacterium bovis subsp bovis AF2122/97
gucgacuucagcggccgg

SEQ ID NO: 3074871 - RNA, 19 nt, Mycobacterium bovis subsp bovis AF2122/97
gucgaucaacaccaacgac

SEQ ID NO: 3074872 - RNA, 21 nt, Mycobacterium bovis subsp bovis AF2122/97
gucgaucaacaccaacgacag

SEQ ID NO: 3074873 - RNA, 12 nt, Mycobacterium bovis subsp bovis AF2122/97
gucgaucaccga

SEQ ID NO: 3074874 - RNA, 14 nt, Mycobacterium bovis subsp bovis AF2122/97
gucgaucaccugca

SEQ ID NO: 3074875 - RNA, 18 nt, Mycobacterium bovis subsp bovis AF2122/97
gucgaucaccugcagcac

SEQ ID NO: 3074876 - RNA, 18 nt, Mycobacterium bovis subsp bovis AF2122/97
gucgaucacggccgucga

SEQ ID NO: 3074877 - RNA, 20 nt, Mycobacterium bovis subsp bovis AF2122/97
gucgaucacguacgccgccg

SEQ ID NO: 3074878 - RNA, 14 nt, Mycobacterium bovis subsp bovis AF2122/97
gucgaucacgucgu

SEQ ID NO: 3074879 - RNA, 21 nt, Mycobacterium bovis subsp bovis AF2122/97
gucgaucacgucgucagccac

SEQ ID NO: 3074880 - RNA, 22 nt, Mycobacterium bovis subsp bovis AF2122/97
gucgaucacguggugcggccgg

SEQ ID NO: 3074881 - RNA, 16 nt, Mycobacterium bovis subsp bovis AF2122/97
gucgaucagcggcagc

SEQ ID NO: 3074882 - RNA, 19 nt, Mycobacterium bovis subsp bovis AF2122/97
gucgaucagcggcagcacc

SEQ ID NO: 3074883 - RNA, 14 nt, Mycobacterium bovis subsp bovis AF2122/97
gucgaucaggccgu

SEQ ID NO: 3074884 - RNA, 15 nt, Mycobacterium bovis subsp bovis AF2122/97
gucgaucaggccgug

SEQ ID NO: 3074885 - RNA, 21 nt, Mycobacterium bovis subsp bovis AF2122/97
gucgaucaugacgagccgagc

SEQ ID NO: 3074886 - RNA, 16 nt, Mycobacterium bovis subsp bovis AF2122/97
gucgaucauggcggca

SEQ ID NO: 3074887 - RNA, 18 nt, Mycobacterium bovis subsp bovis AF2122/97
gucgaucauggcggcagc

SEQ ID NO: 3074888 - RNA, 22 nt, Mycobacterium bovis subsp bovis AF2122/97
gucgauccccgcaauucccauc

SEQ ID NO: 3074889 - RNA, 15 nt, Mycobacterium bovis subsp bovis AF2122/97
gucgauccgucggcg

SEQ ID NO: 3074890 - RNA, 14 nt, Mycobacterium bovis subsp bovis AF2122/97
gucgaucgcggccc

SEQ ID NO: 3074891 - RNA, 13 nt, Mycobacterium bovis subsp bovis AF2122/97
gucgaucucccag

SEQ ID NO: 3074892 - RNA, 20 nt, Mycobacterium bovis subsp bovis AF2122/97
gucgaucucgaucgacccgg

SEQ ID NO: 3074893 - RNA, 16 nt, Mycobacterium bovis subsp bovis AF2122/97
gucgaucucggcagag

SEQ ID NO: 3074894 - RNA, 21 nt, Mycobacterium bovis subsp bovis AF2122/97
gucgaucucggcgcagggacu

SEQ ID NO: 3074895 - RNA, 13 nt, Mycobacterium bovis subsp bovis AF2122/97
gucgaucugcccc

SEQ ID NO: 3074896 - RNA, 21 nt, Mycobacterium bovis subsp bovis AF2122/97
gucgaugaagcgucguugcuc

SEQ ID NO: 3074897 - RNA, 20 nt, Mycobacterium bovis subsp bovis AF2122/97
gucgaugaccagcacaccgc

SEQ ID NO: 3074898 - RNA, 18 nt, Mycobacterium bovis subsp bovis AF2122/97
gucgaugacgccgucagc

SEQ ID NO: 3074899 - RNA, 18 nt, Mycobacterium bovis subsp bovis AF2122/97
gucgaugaggaucaucga

SEQ ID NO: 3074900 - RNA, 22 nt, Mycobacterium bovis subsp bovis AF2122/97
gucgaugagguucaucgccggc

SEQ ID NO: 3074901 - RNA, 18 nt, Mycobacterium bovis subsp bovis AF2122/97
gucgaugagugacggucc

SEQ ID NO: 3074902 - RNA, 17 nt, Mycobacterium bovis subsp bovis AF2122/97
gucgaugccgcgcagcg

SEQ ID NO: 3074903 - RNA, 13 nt, Mycobacterium bovis subsp bovis AF2122/97
gucgaugccggcu

SEQ ID NO: 3074904 - RNA, 17 nt, Mycobacterium bovis subsp bovis AF2122/97
gucgaugccggcugccg

SEQ ID NO: 3074905 - RNA, 13 nt, Mycobacterium bovis subsp bovis AF2122/97
gucgaugcgcagc

SEQ ID NO: 3074906 - RNA, 16 nt, Mycobacterium bovis subsp bovis AF2122/97
gucgaugcgcagcccg

SEQ ID NO: 3074907 - RNA, 13 nt, Mycobacterium bovis subsp bovis AF2122/97
gucgaugcgcgcc

SEQ ID NO: 3074908 - RNA, 14 nt, Mycobacterium bovis subsp bovis AF2122/97
gucgaugcgcgccg

SEQ ID NO: 3074909 - RNA, 16 nt, Mycobacterium bovis subsp bovis AF2122/97
gucgaugcgcgccggc

SEQ ID NO: 3074910 - RNA, 14 nt, Mycobacterium bovis subsp bovis AF2122/97
gucgaugcgcugcu

SEQ ID NO: 3074911 - RNA, 20 nt, Mycobacterium bovis subsp bovis AF2122/97
gucgaugcgcugcucacgca

SEQ ID NO: 3074912 - RNA, 17 nt, Mycobacterium bovis subsp bovis AF2122/97
gucgaugcgggcgacga

SEQ ID NO: 3074913 - RNA, 23 nt, Mycobacterium bovis subsp bovis AF2122/97
gucgaugcgggcugugaacagcg

SEQ ID NO: 3074914 - RNA, 21 nt, Mycobacterium bovis subsp bovis AF2122/97
gucgaugcugaacacgcagcc

SEQ ID NO: 3074915 - RNA, 22 nt, Mycobacterium bovis subsp bovis AF2122/97
gucgaugcugaacacgcagccg

SEQ ID NO: 3074916 - RNA, 18 nt, Mycobacterium bovis subsp bovis AF2122/97
gucgaugcugacgguggg

SEQ ID NO: 3074917 - RNA, 15 nt, Mycobacterium bovis subsp bovis AF2122/97
gucgauggcguacag

SEQ ID NO: 3074918 - RNA, 17 nt, Mycobacterium bovis subsp bovis AF2122/97
gucgauggggacggcgg

SEQ ID NO: 3074919 - RNA, 20 nt, Mycobacterium bovis subsp bovis AF2122/97
gucgauggggacggcggcga

SEQ ID NO: 3074920 - RNA, 23 nt, Mycobacterium bovis subsp bovis AF2122/97
gucgauggucuccggacgcacga

SEQ ID NO: 3074921 - RNA, 22 nt, Mycobacterium bovis subsp bovis AF2122/97
gucgauguacaccgugcgccga

SEQ ID NO: 3074922 - RNA, 19 nt, Mycobacterium bovis subsp bovis AF2122/97
gucgauguccgcagcaccg

SEQ ID NO: 3074923 - RNA, 18 nt, Mycobacterium bovis subsp bovis AF2122/97
gucgaugucguuggccac

SEQ ID NO: 3074924 - RNA, 19 nt, Mycobacterium bovis subsp bovis AF2122/97
gucgauguugcccagcaug

SEQ ID NO: 3074925 - RNA, 17 nt, Mycobacterium bovis subsp bovis AF2122/97
gucgauucgucgaaggg

SEQ ID NO: 3074926 - RNA, 18 nt, Mycobacterium bovis subsp bovis AF2122/97
gucgauucgucgaaggga

SEQ ID NO: 3074927 - RNA, 20 nt, Mycobacterium bovis subsp bovis AF2122/97
gucgauugccaccgagauca

SEQ ID NO: 3074928 - RNA, 18 nt, Mycobacterium bovis subsp bovis AF2122/97
gucgauuggcugcgccga

SEQ ID NO: 3074929 - RNA, 19 nt, Mycobacterium bovis subsp bovis AF2122/97
gucgauuggcugcgccgau

SEQ ID NO: 3074930 - RNA, 15 nt, Mycobacterium bovis subsp bovis AF2122/97
gucgauuucgacgac

SEQ ID NO: 3074931 - RNA, 17 nt, Mycobacterium bovis subsp bovis AF2122/97
gucgauuucgaugacga

SEQ ID NO: 3074932 - RNA, 15 nt, Mycobacterium bovis subsp bovis AF2122/97
gucgauuucgccguc

SEQ ID NO: 3074933 - RNA, 16 nt, Mycobacterium bovis subsp bovis AF2122/97
gucgauuucgccgucg

SEQ ID NO: 3074934 - RNA, 17 nt, Mycobacterium bovis subsp bovis AF2122/97
gucgauuucgccgucgc

SEQ ID NO: 3074935 - RNA, 18 nt, Mycobacterium bovis subsp bovis AF2122/97
gucgauuucgccgucgcu

SEQ ID NO: 3074936 - RNA, 22 nt, Mycobacterium bovis subsp bovis AF2122/97
gucgauuucggcgaccggccgg

SEQ ID NO: 3074937 - RNA, 15 nt, Mycobacterium bovis subsp bovis AF2122/97
gucgauuucggcggc

SEQ ID NO: 3074938 - RNA, 16 nt, Mycobacterium bovis subsp bovis AF2122/97
gucgauuucggcggcg

SEQ ID NO: 3074939 - RNA, 15 nt, Mycobacterium bovis subsp bovis AF2122/97
gucgcaaccgccgcc

SEQ ID NO: 3074940 - RNA, 16 nt, Mycobacterium bovis subsp bovis AF2122/97
gucgcaaccgccgcca

SEQ ID NO: 3074941 - RNA, 19 nt, Mycobacterium bovis subsp bovis AF2122/97
gucgcaacgcaucgaugcg

SEQ ID NO: 3074942 - RNA, 14 nt, Mycobacterium bovis subsp bovis AF2122/97
gucgcaacgcgauc

SEQ ID NO: 3074943 - RNA, 17 nt, Mycobacterium bovis subsp bovis AF2122/97
gucgcaaggcccgcacc

SEQ ID NO: 3074944 - RNA, 22 nt, Mycobacterium bovis subsp bovis AF2122/97
gucgcaaggcccgcaccgcuga

SEQ ID NO: 3074945 - RNA, 21 nt, Mycobacterium bovis subsp bovis AF2122/97
gucgcaauauccggccgagcc

SEQ ID NO: 3074946 - RNA, 18 nt, Mycobacterium bovis subsp bovis AF2122/97
gucgcaauggucguaggg

SEQ ID NO: 3074947 - RNA, 19 nt, Mycobacterium bovis subsp bovis AF2122/97
gucgcaccacagugccaau

SEQ ID NO: 3074948 - RNA, 16 nt, Mycobacterium bovis subsp bovis AF2122/97
gucgcaccccggcggc

SEQ ID NO: 3074949 - RNA, 20 nt, Mycobacterium bovis subsp bovis AF2122/97
gucgcacgcgcgcaggccgc

SEQ ID NO: 3074950 - RNA, 12 nt, Mycobacterium bovis subsp bovis AF2122/97
gucgcacggugc

SEQ ID NO: 3074951 - RNA, 17 nt, Mycobacterium bovis subsp bovis AF2122/97
gucgcacggugccgccg

SEQ ID NO: 3074952 - RNA, 22 nt, Mycobacterium bovis subsp bovis AF2122/97
gucgcacucauagaacucgccg

SEQ ID NO: 3074953 - RNA, 17 nt, Mycobacterium bovis subsp bovis AF2122/97
gucgcacugcgccggcc

SEQ ID NO: 3074954 - RNA, 14 nt, Mycobacterium bovis subsp bovis AF2122/97
gucgcacuuggccc

SEQ ID NO: 3074955 - RNA, 20 nt, Mycobacterium bovis subsp bovis AF2122/97
gucgcacuuggcccccgacg

SEQ ID NO: 3074956 - RNA, 19 nt, Mycobacterium bovis subsp bovis AF2122/97
gucgcagaucaggacgcga

SEQ ID NO: 3074957 - RNA, 16 nt, Mycobacterium bovis subsp bovis AF2122/97
gucgcggccggcggcc

SEQ ID NO: 3074958 - RNA, 16 nt, Mycobacterium bovis subsp bovis AF2122/97
gucgcggccgucgcgg

SEQ ID NO: 3074959 - RNA, 17 nt, Mycobacterium bovis subsp bovis AF2122/97
gucgcggcgcuggcugc

SEQ ID NO: 3074960 - RNA, 13 nt, Mycobacterium bovis subsp bovis AF2122/97
gucgcggcggcac

SEQ ID NO: 3074961 - RNA, 15 nt, Mycobacterium bovis subsp bovis AF2122/97
gucgcggcggcacua

SEQ ID NO: 3074962 - RNA, 13 nt, Mycobacterium bovis subsp bovis AF2122/97
gucgcggcguucg

SEQ ID NO: 3074963 - RNA, 15 nt, Mycobacterium bovis subsp bovis AF2122/97
gucgcggcguucggc

SEQ ID NO: 3074964 - RNA, 16 nt, Mycobacterium bovis subsp bovis AF2122/97
gucgcggcguucggcu

SEQ ID NO: 3074965 - RNA, 19 nt, Mycobacterium bovis subsp bovis AF2122/97
gucgcggcuauggcgccgc

SEQ ID NO: 3074966 - RNA, 21 nt, Mycobacterium bovis subsp bovis AF2122/97
gucgcgggagaaaacggcggc

SEQ ID NO: 3074967 - RNA, 22 nt, Mycobacterium bovis subsp bovis AF2122/97
gucgcgggagaaaacggcggcg

SEQ ID NO: 3074968 - RNA, 22 nt, Mycobacterium bovis subsp bovis AF2122/97
gucgcgggccaagccggagccc

SEQ ID NO: 3074969 - RNA, 15 nt, Mycobacterium bovis subsp bovis AF2122/97
gucgcgggccaccac

SEQ ID NO: 3074970 - RNA, 17 nt, Mycobacterium bovis subsp bovis AF2122/97
gucgcgggccaccaccg

SEQ ID NO: 3074971 - RNA, 18 nt, Mycobacterium bovis subsp bovis AF2122/97
gucgcgggccaccaccga

SEQ ID NO: 3074972 - RNA, 15 nt, Mycobacterium bovis subsp bovis AF2122/97
gucgcgggccaccgc

SEQ ID NO: 3074973 - RNA, 21 nt, Mycobacterium bovis subsp bovis AF2122/97
gucgcgggcgauggcgagcug

SEQ ID NO: 3074974 - RNA, 16 nt, Mycobacterium bovis subsp bovis AF2122/97
gucgcggggccggaug

SEQ ID NO: 3074975 - RNA, 20 nt, Mycobacterium bovis subsp bovis AF2122/97
gucgcgggucacaaaaccug

SEQ ID NO: 3074976 - RNA, 15 nt, Mycobacterium bovis subsp bovis AF2122/97
gucgcggguccaggc

SEQ ID NO: 3074977 - RNA, 22 nt, Mycobacterium bovis subsp bovis AF2122/97
gucgcggguguuccacaccagg

SEQ ID NO: 3074978 - RNA, 20 nt, Mycobacterium bovis subsp bovis AF2122/97
gucgcgguaccaucaccgcg

SEQ ID NO: 3074979 - RNA, 16 nt, Mycobacterium bovis subsp bovis AF2122/97
gucgcgguaggcggga

SEQ ID NO: 3074980 - RNA, 15 nt, Mycobacterium bovis subsp bovis AF2122/97
gucgcggucgcccgc

SEQ ID NO: 3074981 - RNA, 22 nt, Mycobacterium bovis subsp bovis AF2122/97
gucgcggucuuugagccgguag

SEQ ID NO: 3074982 - RNA, 16 nt, Mycobacterium bovis subsp bovis AF2122/97
gucgcggugcggcaga

SEQ ID NO: 3074983 - RNA, 16 nt, Mycobacterium bovis subsp bovis AF2122/97
gucgcgguggcggcgg

SEQ ID NO: 3074984 - RNA, 18 nt, Mycobacterium bovis subsp bovis AF2122/97
gucgcgguggcggcggug

SEQ ID NO: 3074985 - RNA, 20 nt, Mycobacterium bovis subsp bovis AF2122/97
gucgcgguggcggcggugcc

SEQ ID NO: 3074986 - RNA, 17 nt, Mycobacterium bovis subsp bovis AF2122/97
gucgcguccacccacga

SEQ ID NO: 3074987 - RNA, 23 nt, Mycobacterium bovis subsp bovis AF2122/97
gucgcguccgcgaucugcagcgc

SEQ ID NO: 3074988 - RNA, 15 nt, Mycobacterium bovis subsp bovis AF2122/97
gucgcgucgaccgga

SEQ ID NO: 3074989 - RNA, 16 nt, Mycobacterium bovis subsp bovis AF2122/97
gucgcgucgccaggcc

SEQ ID NO: 3074990 - RNA, 13 nt, Mycobacterium bovis subsp bovis AF2122/97
gucgcguucggcc

SEQ ID NO: 3074991 - RNA, 18 nt, Mycobacterium bovis subsp bovis AF2122/97
gucgcguucuccggcacc

SEQ ID NO: 3074992 - RNA, 17 nt, Mycobacterium bovis subsp bovis AF2122/97
gucgcguugagcgcagc

SEQ ID NO: 3074993 - RNA, 19 nt, Mycobacterium bovis subsp bovis AF2122/97
gucgcguugagcgcagcua

SEQ ID NO: 3074994 - RNA, 21 nt, Mycobacterium bovis subsp bovis AF2122/97
gucgcguuucgcagccgcacc

SEQ ID NO: 3074995 - RNA, 15 nt, Mycobacterium bovis subsp bovis AF2122/97
gucgcuaucgugcgc

SEQ ID NO: 3074996 - RNA, 17 nt, Mycobacterium bovis subsp bovis AF2122/97
gucgcuaucgugcgccg

SEQ ID NO: 3074997 - RNA, 23 nt, Mycobacterium bovis subsp bovis AF2122/97
gucgcucccgguugggguggcgg

SEQ ID NO: 3074998 - RNA, 14 nt, Mycobacterium bovis subsp bovis AF2122/97
gucgcucgcgguca

SEQ ID NO: 3074999 - RNA, 14 nt, Mycobacterium bovis subsp bovis AF2122/97
gucgcugaaaucgg

SEQ ID NO: 3075000 - RNA, 16 nt, Mycobacterium bovis subsp bovis AF2122/97
gucgcugaacagacgg

SEQ ID NO: 3075001 - RNA, 17 nt, Mycobacterium bovis subsp bovis AF2122/97
gucgcugaagccgucgu

SEQ ID NO: 3075002 - RNA, 15 nt, Mycobacterium bovis subsp bovis AF2122/97
gucgcugagcagcgc

SEQ ID NO: 3075003 - RNA, 18 nt, Mycobacterium bovis subsp bovis AF2122/97
gucgcugagcagcgccgc

SEQ ID NO: 3075004 - RNA, 17 nt, Mycobacterium bovis subsp bovis AF2122/97
gucgcugcaaccgccgg

SEQ ID NO: 3075005 - RNA, 21 nt, Mycobacterium bovis subsp bovis AF2122/97
gucgcugccccuugggcucga

SEQ ID NO: 3075006 - RNA, 11 nt, Mycobacterium bovis subsp bovis AF2122/97
gucgcugcccg

SEQ ID NO: 3075007 - RNA, 19 nt, Mycobacterium bovis subsp bovis AF2122/97
gucgcugcccgcgcggcca

SEQ ID NO: 3075008 - RNA, 14 nt, Mycobacterium bovis subsp bovis AF2122/97
gucgcugccgccgc

SEQ ID NO: 3075009 - RNA, 17 nt, Mycobacterium bovis subsp bovis AF2122/97
gucgcugccgccgccgg

SEQ ID NO: 3075010 - RNA, 19 nt, Mycobacterium bovis subsp bovis AF2122/97
gucgcugccgccgccggcg

SEQ ID NO: 3075011 - RNA, 14 nt, Mycobacterium bovis subsp bovis AF2122/97
gucgcugccgccgu

SEQ ID NO: 3075012 - RNA, 17 nt, Mycobacterium bovis subsp bovis AF2122/97
gucgcugccgccgucgc

SEQ ID NO: 3075013 - RNA, 19 nt, Mycobacterium bovis subsp bovis AF2122/97
gucgcugccgccgucgccg

SEQ ID NO: 3075014 - RNA, 18 nt, Mycobacterium bovis subsp bovis AF2122/97
gucgcugccggcugacga

SEQ ID NO: 3075015 - RNA, 15 nt, Mycobacterium bovis subsp bovis AF2122/97
gucgcugcgcuggua

SEQ ID NO: 3075016 - RNA, 20 nt, Mycobacterium bovis subsp bovis AF2122/97
gucgcugcggcgcuggccag

SEQ ID NO: 3075017 - RNA, 17 nt, Mycobacterium bovis subsp bovis AF2122/97
gucgcugcugccgcacc

SEQ ID NO: 3075018 - RNA, 21 nt, Mycobacterium bovis subsp bovis AF2122/97
gucgcugcugccgcaccggug

SEQ ID NO: 3075019 - RNA, 20 nt, Mycobacterium bovis subsp bovis AF2122/97
gucgcugcuugcgggcucgu

SEQ ID NO: 3075020 - RNA, 19 nt, Mycobacterium bovis subsp bovis AF2122/97
gucgcuggccaggccggca

SEQ ID NO: 3075021 - RNA, 14 nt, Mycobacterium bovis subsp bovis AF2122/97
gucgcuggccggca

SEQ ID NO: 3075022 - RNA, 16 nt, Mycobacterium bovis subsp bovis AF2122/97
gucgcuggccggcacc

SEQ ID NO: 3075023 - RNA, 14 nt, Mycobacterium bovis subsp bovis AF2122/97
gucgcuggccguag

SEQ ID NO: 3075024 - RNA, 15 nt, Mycobacterium bovis subsp bovis AF2122/97
gucgcugggaggcgc

SEQ ID NO: 3075025 - RNA, 22 nt, Mycobacterium bovis subsp bovis AF2122/97
gucgcugggaggcgcggucgac

SEQ ID NO: 3075026 - RNA, 23 nt, Mycobacterium bovis subsp bovis AF2122/97
gucgcugggaggcgcggucgacc

SEQ ID NO: 3075027 - RNA, 16 nt, Mycobacterium bovis subsp bovis AF2122/97
gucgcugggugcgcga

SEQ ID NO: 3075028 - RNA, 17 nt, Mycobacterium bovis subsp bovis AF2122/97
gucgcugggugcgcgaa

SEQ ID NO: 3075029 - RNA, 15 nt, Mycobacterium bovis subsp bovis AF2122/97
gucgcuguaggcgau

SEQ ID NO: 3075030 - RNA, 15 nt, Mycobacterium bovis subsp bovis AF2122/97
gucgcuguccacugc

SEQ ID NO: 3075031 - RNA, 17 nt, Mycobacterium bovis subsp bovis AF2122/97
gucgcugucggcaguag

SEQ ID NO: 3075032 - RNA, 19 nt, Mycobacterium bovis subsp bovis AF2122/97
gucgcugugcagcggguug

SEQ ID NO: 3075033 - RNA, 18 nt, Mycobacterium bovis subsp bovis AF2122/97
gucggaauacaacagcug

SEQ ID NO: 3075034 - RNA, 21 nt, Mycobacterium bovis subsp bovis AF2122/97
gucggaauacaacagcugggu

SEQ ID NO: 3075035 - RNA, 19 nt, Mycobacterium bovis subsp bovis AF2122/97
gucggaaugccgucgccgg

SEQ ID NO: 3075036 - RNA, 14 nt, Mycobacterium bovis subsp bovis AF2122/97
gucggaaugggcgc

SEQ ID NO: 3075037 - RNA, 14 nt, Mycobacterium bovis subsp bovis AF2122/97
gucggacagcgagu

SEQ ID NO: 3075038 - RNA, 16 nt, Mycobacterium bovis subsp bovis AF2122/97
gucggacauaccgcga

SEQ ID NO: 3075039 - RNA, 17 nt, Mycobacterium bovis subsp bovis AF2122/97
gucggacauaccgcgaa

SEQ ID NO: 3075040 - RNA, 22 nt, Mycobacterium bovis subsp bovis AF2122/97
gucggacaugccgagguaacgc

SEQ ID NO: 3075041 - RNA, 20 nt, Mycobacterium bovis subsp bovis AF2122/97
gucggaccagcugccggcga

SEQ ID NO: 3075042 - RNA, 19 nt, Mycobacterium bovis subsp bovis AF2122/97
gucggaccguuucgucggc

SEQ ID NO: 3075043 - RNA, 20 nt, Mycobacterium bovis subsp bovis AF2122/97
gucggaccguuucgucggcc

SEQ ID NO: 3075044 - RNA, 20 nt, Mycobacterium bovis subsp bovis AF2122/97
gucggccugcgccggcgcug

SEQ ID NO: 3075045 - RNA, 17 nt, Mycobacterium bovis subsp bovis AF2122/97
gucggccugcggcaacg

SEQ ID NO: 3075046 - RNA, 16 nt, Mycobacterium bovis subsp bovis AF2122/97
gucggccugcggcacc

SEQ ID NO: 3075047 - RNA, 19 nt, Mycobacterium bovis subsp bovis AF2122/97
gucggccuggaucgugccg

SEQ ID NO: 3075048 - RNA, 21 nt, Mycobacterium bovis subsp bovis AF2122/97
gucggccuggcaggguggggc

SEQ ID NO: 3075049 - RNA, 14 nt, Mycobacterium bovis subsp bovis AF2122/97
gucggcgaaccacg

SEQ ID NO: 3075050 - RNA, 20 nt, Mycobacterium bovis subsp bovis AF2122/97
gucggcgaaccacggcagcc

SEQ ID NO: 3075051 - RNA, 21 nt, Mycobacterium bovis subsp bovis AF2122/97
gucggcgaaccacggcagcca

SEQ ID NO: 3075052 - RNA, 19 nt, Mycobacterium bovis subsp bovis AF2122/97
gucggcgaacgcguccagc

SEQ ID NO: 3075053 - RNA, 21 nt, Mycobacterium bovis subsp bovis AF2122/97
gucggcgaacgcguccagcgc

SEQ ID NO: 3075054 - RNA, 17 nt, Mycobacterium bovis subsp bovis AF2122/97
gucggcgaauccgccgc

SEQ ID NO: 3075055 - RNA, 20 nt, Mycobacterium bovis subsp bovis AF2122/97
gucggcgaauccgccgccua

SEQ ID NO: 3075056 - RNA, 16 nt, Mycobacterium bovis subsp bovis AF2122/97
gucggcgaauuccucg

SEQ ID NO: 3075057 - RNA, 19 nt, Mycobacterium bovis subsp bovis AF2122/97
gucggcgaccaccagcgcc

SEQ ID NO: 3075058 - RNA, 21 nt, Mycobacterium bovis subsp bovis AF2122/97
gucggcgaccaccagcgccga

SEQ ID NO: 3075059 - RNA, 17 nt, Mycobacterium bovis subsp bovis AF2122/97
gucggcgaccaccccgu

SEQ ID NO: 3075060 - RNA, 14 nt, Mycobacterium bovis subsp bovis AF2122/97
gucggcgaccaggu

SEQ ID NO: 3075061 - RNA, 13 nt, Mycobacterium bovis subsp bovis AF2122/97
gucggcgaccgcg

SEQ ID NO: 3075062 - RNA, 16 nt, Mycobacterium bovis subsp bovis AF2122/97
gucggcgacggccagc

SEQ ID NO: 3075063 - RNA, 15 nt, Mycobacterium bovis subsp bovis AF2122/97
gucggcgacuccucu

SEQ ID NO: 3075064 - RNA, 16 nt, Mycobacterium bovis subsp bovis AF2122/97
gucggcgagcucggcc

SEQ ID NO: 3075065 - RNA, 20 nt, Mycobacterium bovis subsp bovis AF2122/97
gucggcgagcucggccccgc

SEQ ID NO: 3075066 - RNA, 17 nt, Mycobacterium bovis subsp bovis AF2122/97
gucggcgagggcgcgcc

SEQ ID NO: 3075067 - RNA, 15 nt, Mycobacterium bovis subsp bovis AF2122/97
gucggcgaucaacgc

SEQ ID NO: 3075068 - RNA, 16 nt, Mycobacterium bovis subsp bovis AF2122/97
gucggcgaucaacgcg

SEQ ID NO: 3075069 - RNA, 22 nt, Mycobacterium bovis subsp bovis AF2122/97
gucggcgaucaacgcgcacgcg

SEQ ID NO: 3075070 - RNA, 16 nt, Mycobacterium bovis subsp bovis AF2122/97
gucggcgaucugcgca

SEQ ID NO: 3075071 - RNA, 23 nt, Mycobacterium bovis subsp bovis AF2122/97
gucggcgaugaacagcgacgcca

SEQ ID NO: 3075072 - RNA, 16 nt, Mycobacterium bovis subsp bovis AF2122/97
gucggcgcaggcgugc

SEQ ID NO: 3075073 - RNA, 12 nt, Mycobacterium bovis subsp bovis AF2122/97
gucggcgcccag

SEQ ID NO: 3075074 - RNA, 16 nt, Mycobacterium bovis subsp bovis AF2122/97
gucggcgcccagcucg

SEQ ID NO: 3075075 - RNA, 14 nt, Mycobacterium bovis subsp bovis AF2122/97
gucggcgccgaagc

SEQ ID NO: 3075076 - RNA, 13 nt, Mycobacterium bovis subsp bovis AF2122/97
gucggcgccgagc

SEQ ID NO: 3075077 - RNA, 14 nt, Mycobacterium bovis subsp bovis AF2122/97
gucggcgccgagca

SEQ ID NO: 3075078 - RNA, 13 nt, Mycobacterium bovis subsp bovis AF2122/97
gucggcgccgccg

SEQ ID NO: 3075079 - RNA, 19 nt, Mycobacterium bovis subsp bovis AF2122/97
gucggcgccgccguccagc

SEQ ID NO: 3075080 - RNA, 14 nt, Mycobacterium bovis subsp bovis AF2122/97
gucggcgccggcgg

SEQ ID NO: 3075081 - RNA, 16 nt, Mycobacterium bovis subsp bovis AF2122/97
gucggcgccggcggcc

SEQ ID NO: 3075082 - RNA, 18 nt, Mycobacterium bovis subsp bovis AF2122/97
gucggcgccggcggccgc

SEQ ID NO: 3075083 - RNA, 17 nt, Mycobacterium bovis subsp bovis AF2122/97
gucggcgccucggacca

SEQ ID NO: 3075084 - RNA, 15 nt, Mycobacterium bovis subsp bovis AF2122/97
gucggcgcgccgcac

SEQ ID NO: 3075085 - RNA, 12 nt, Mycobacterium bovis subsp bovis AF2122/97
gucggcgcggcc

SEQ ID NO: 3075086 - RNA, 13 nt, Mycobacterium bovis subsp bovis AF2122/97
gucggcgcggccg

SEQ ID NO: 3075087 - RNA, 15 nt, Mycobacterium bovis subsp bovis AF2122/97
gucggcgcggcuguc

SEQ ID NO: 3075088 - RNA, 19 nt, Mycobacterium bovis subsp bovis AF2122/97
gucggcgcugcgcgcgauc

SEQ ID NO: 3075089 - RNA, 14 nt, Mycobacterium bovis subsp bovis AF2122/97
gucggcggccgcca

SEQ ID NO: 3075090 - RNA, 22 nt, Mycobacterium bovis subsp bovis AF2122/97
gucggcggccuucuccccgauc

SEQ ID NO: 3075091 - RNA, 14 nt, Mycobacterium bovis subsp bovis AF2122/97
gucggcggcgaccg

SEQ ID NO: 3075092 - RNA, 15 nt, Mycobacterium bovis subsp bovis AF2122/97
gucggcggcgaccgc

SEQ ID NO: 3075093 - RNA, 17 nt, Mycobacterium bovis subsp bovis AF2122/97
gucggcggcgaccgcca

SEQ ID NO: 3075094 - RNA, 14 nt, Mycobacterium bovis subsp bovis AF2122/97
gucggcggcgacgu

SEQ ID NO: 3075095 - RNA, 11 nt, Mycobacterium bovis subsp bovis AF2122/97
gucggcggcgu

SEQ ID NO: 3075096 - RNA, 16 nt, Mycobacterium bovis subsp bovis AF2122/97
gucggcgggcggcagc

SEQ ID NO: 3075097 - RNA, 15 nt, Mycobacterium bovis subsp bovis AF2122/97
gucggcgggcgugug

SEQ ID NO: 3075098 - RNA, 13 nt, Mycobacterium bovis subsp bovis AF2122/97
gucggcggggcgc

SEQ ID NO: 3075099 - RNA, 17 nt, Mycobacterium bovis subsp bovis AF2122/97
gucggcggggcgccgga

SEQ ID NO: 3075100 - RNA, 12 nt, Mycobacterium bovis subsp bovis AF2122/97
gucggcggugac

SEQ ID NO: 3075101 - RNA, 15 nt, Mycobacterium bovis subsp bovis AF2122/97
gucggcggugccgug

SEQ ID NO: 3075102 - RNA, 22 nt, Mycobacterium bovis subsp bovis AF2122/97
gucggcgucgaauucagcugca

SEQ ID NO: 3075103 - RNA, 16 nt, Mycobacterium bovis subsp bovis AF2122/97
gucggcgucgagcucg

SEQ ID NO: 3075104 - RNA, 20 nt, Mycobacterium bovis subsp bovis AF2122/97
gucggcgucgagcucguccu

SEQ ID NO: 3075105 - RNA, 17 nt, Mycobacterium bovis subsp bovis AF2122/97
gucggcgugacgucguc

SEQ ID NO: 3075106 - RNA, 14 nt, Mycobacterium bovis subsp bovis AF2122/97
gucggcgugcaggg

SEQ ID NO: 3075107 - RNA, 13 nt, Mycobacterium bovis subsp bovis AF2122/97
gucggcguggcug

SEQ ID NO: 3075108 - RNA, 20 nt, Mycobacterium bovis subsp bovis AF2122/97
gucggcguggucgcgcggca

SEQ ID NO: 3075109 - RNA, 14 nt, Mycobacterium bovis subsp bovis AF2122/97
gucggcgugucgcg

SEQ ID NO: 3075110 - RNA, 15 nt, Mycobacterium bovis subsp bovis AF2122/97
gucggcguuggggcu

SEQ ID NO: 3075111 - RNA, 18 nt, Mycobacterium bovis subsp bovis AF2122/97
gucggcuaccgccgaccg

SEQ ID NO: 3075112 - RNA, 18 nt, Mycobacterium bovis subsp bovis AF2122/97
gucggcucggcccccgag

SEQ ID NO: 3075113 - RNA, 19 nt, Mycobacterium bovis subsp bovis AF2122/97
gucggcucggcccccgaga

SEQ ID NO: 3075114 - RNA, 21 nt, Mycobacterium bovis subsp bovis AF2122/97
gucggcugauuggcccaccgc

SEQ ID NO: 3075115 - RNA, 23 nt, Mycobacterium bovis subsp bovis AF2122/97
gucggcugauuggcccaccgccg

SEQ ID NO: 3075116 - RNA, 21 nt, Mycobacterium bovis subsp bovis AF2122/97
gucggcugccgcaaacgcggc

SEQ ID NO: 3075117 - RNA, 14 nt, Mycobacterium bovis subsp bovis AF2122/97
gucggcugccgcgg

SEQ ID NO: 3075118 - RNA, 15 nt, Mycobacterium bovis subsp bovis AF2122/97
gucggcugccgcggc

SEQ ID NO: 3075119 - RNA, 16 nt, Mycobacterium bovis subsp bovis AF2122/97
gucggcuggacggcgc

SEQ ID NO: 3075120 - RNA, 17 nt, Mycobacterium bovis subsp bovis AF2122/97
gucggcuggacggcgcc

SEQ ID NO: 3075121 - RNA, 19 nt, Mycobacterium bovis subsp bovis AF2122/97
gucggcuggacggcgccgg

SEQ ID NO: 3075122 - RNA, 13 nt, Mycobacterium bovis subsp bovis AF2122/97
gucggcugucgug

SEQ ID NO: 3075123 - RNA, 16 nt, Mycobacterium bovis subsp bovis AF2122/97
gucggcuuccggugcc

SEQ ID NO: 3075124 - RNA, 19 nt, Mycobacterium bovis subsp bovis AF2122/97
gucggcuuccggugccggg

SEQ ID NO: 3075125 - RNA, 21 nt, Mycobacterium bovis subsp bovis AF2122/97
gucggcuuccuccucggcgcg

SEQ ID NO: 3075126 - RNA, 19 nt, Mycobacterium bovis subsp bovis AF2122/97
gucggcuucgacaaccucg

SEQ ID NO: 3075127 - RNA, 20 nt, Mycobacterium bovis subsp bovis AF2122/97
gucggcuucgacaaccucga

SEQ ID NO: 3075128 - RNA, 14 nt, Mycobacterium bovis subsp bovis AF2122/97
gucgggacgccgcc

SEQ ID NO: 3075129 - RNA, 18 nt, Mycobacterium bovis subsp bovis AF2122/97
gucgggacgccgcccccg

SEQ ID NO: 3075130 - RNA, 15 nt, Mycobacterium bovis subsp bovis AF2122/97
gucgggacgcugccg

SEQ ID NO: 3075131 - RNA, 23 nt, Mycobacterium bovis subsp bovis AF2122/97
gucggucuuuggcauugccgcca

SEQ ID NO: 3075132 - RNA, 22 nt, Mycobacterium bovis subsp bovis AF2122/97
gucggugaaaugacggcugaac

SEQ ID NO: 3075133 - RNA, 21 nt, Mycobacterium bovis subsp bovis AF2122/97
gucggugaaauucgcggcggu

SEQ ID NO: 3075134 - RNA, 17 nt, Mycobacterium bovis subsp bovis AF2122/97
gucggugaacccgccgg

SEQ ID NO: 3075135 - RNA, 15 nt, Mycobacterium bovis subsp bovis AF2122/97
gucggugaaguccuc

SEQ ID NO: 3075136 - RNA, 22 nt, Mycobacterium bovis subsp bovis AF2122/97
gucggugaccguucggcggucg

SEQ ID NO: 3075137 - RNA, 11 nt, Mycobacterium bovis subsp bovis AF2122/97
gucggugaccu

SEQ ID NO: 3075138 - RNA, 18 nt, Mycobacterium bovis subsp bovis AF2122/97
gucggugaucacggucgg

SEQ ID NO: 3075139 - RNA, 22 nt, Mycobacterium bovis subsp bovis AF2122/97
gucggugauggucagcuggccg

SEQ ID NO: 3075140 - RNA, 22 nt, Mycobacterium bovis subsp bovis AF2122/97
gucggugaugguuucggcggga

SEQ ID NO: 3075141 - RNA, 13 nt, Mycobacterium bovis subsp bovis AF2122/97
gucggugcagcgc

SEQ ID NO: 3075142 - RNA, 16 nt, Mycobacterium bovis subsp bovis AF2122/97
gucggugccaccacgc

SEQ ID NO: 3075143 - RNA, 15 nt, Mycobacterium bovis subsp bovis AF2122/97
gucggugccgagcgc

SEQ ID NO: 3075144 - RNA, 16 nt, Mycobacterium bovis subsp bovis AF2122/97
gucggugccgccgccg

SEQ ID NO: 3075145 - RNA, 17 nt, Mycobacterium bovis subsp bovis AF2122/97
gucggugccgccgccgg

SEQ ID NO: 3075146 - RNA, 14 nt, Mycobacterium bovis subsp bovis AF2122/97
gucggugccgcgga

SEQ ID NO: 3075147 - RNA, 16 nt, Mycobacterium bovis subsp bovis AF2122/97
gucggugccgcggacg

SEQ ID NO: 3075148 - RNA, 14 nt, Mycobacterium bovis subsp bovis AF2122/97
gucggugccgucga

SEQ ID NO: 3075149 - RNA, 15 nt, Mycobacterium bovis subsp bovis AF2122/97
gucggugccgucgag

SEQ ID NO: 3075150 - RNA, 12 nt, Mycobacterium bovis subsp bovis AF2122/97
gucggugcgcgc

SEQ ID NO: 3075151 - RNA, 16 nt, Mycobacterium bovis subsp bovis AF2122/97
gucggugcgcgcggcg

SEQ ID NO: 3075152 - RNA, 10 nt, Mycobacterium bovis subsp bovis AF2122/97
gucggugcgg

SEQ ID NO: 3075153 - RNA, 12 nt, Mycobacterium bovis subsp bovis AF2122/97
gucggugcggaa

SEQ ID NO: 3075154 - RNA, 20 nt, Mycobacterium bovis subsp bovis AF2122/97
gucggugcggaacacgaugc

SEQ ID NO: 3075155 - RNA, 23 nt, Mycobacterium bovis subsp bovis AF2122/97
gucgguggcaacgggucggcauu

SEQ ID NO: 3075156 - RNA, 14 nt, Mycobacterium bovis subsp bovis AF2122/97
gucgguggccgcgg

SEQ ID NO: 3075157 - RNA, 16 nt, Mycobacterium bovis subsp bovis AF2122/97
gucgguggccgcggcg

SEQ ID NO: 3075158 - RNA, 15 nt, Mycobacterium bovis subsp bovis AF2122/97
gucgguggcggggaa

SEQ ID NO: 3075159 - RNA, 15 nt, Mycobacterium bovis subsp bovis AF2122/97
gucggugggcggcga

SEQ ID NO: 3075160 - RNA, 18 nt, Mycobacterium bovis subsp bovis AF2122/97
gucggugggcggcgagcg

SEQ ID NO: 3075161 - RNA, 20 nt, Mycobacterium bovis subsp bovis AF2122/97
gucggugggcggcgagcgcg

SEQ ID NO: 3075162 - RNA, 22 nt, Mycobacterium bovis subsp bovis AF2122/97
gucggugggcuugccgcgcacc

SEQ ID NO: 3075163 - RNA, 23 nt, Mycobacterium bovis subsp bovis AF2122/97
gucgguggucucgacggcgccgc

SEQ ID NO: 3075164 - RNA, 19 nt, Mycobacterium bovis subsp bovis AF2122/97
gucgguguaacccuggcgg

SEQ ID NO: 3075165 - RNA, 21 nt, Mycobacterium bovis subsp bovis AF2122/97
gucgguguagcaacgguagcg

SEQ ID NO: 3075166 - RNA, 15 nt, Mycobacterium bovis subsp bovis AF2122/97
gucggugucggugac

SEQ ID NO: 3075167 - RNA, 18 nt, Mycobacterium bovis subsp bovis AF2122/97
gucggugugcaucgccgg

SEQ ID NO: 3075168 - RNA, 16 nt, Mycobacterium bovis subsp bovis AF2122/97
gucgguguuccgccgc

SEQ ID NO: 3075169 - RNA, 18 nt, Mycobacterium bovis subsp bovis AF2122/97
gucgguguuuggccgccg

SEQ ID NO: 3075170 - RNA, 20 nt, Mycobacterium bovis subsp bovis AF2122/97
gucgguucagccacgcagca

SEQ ID NO: 3075171 - RNA, 22 nt, Mycobacterium bovis subsp bovis AF2122/97
gucgguucagccacgcagcacg

SEQ ID NO: 3075172 - RNA, 17 nt, Mycobacterium bovis subsp bovis AF2122/97
gucgguucaucaaggug

SEQ ID NO: 3075173 - RNA, 20 nt, Mycobacterium bovis subsp bovis AF2122/97
gucgguucggccggagccgc

SEQ ID NO: 3075174 - RNA, 23 nt, Mycobacterium bovis subsp bovis AF2122/97
gucgguucggccggagccgccgg

SEQ ID NO: 3075175 - RNA, 20 nt, Mycobacterium bovis subsp bovis AF2122/97
gucgguugccacgccgccgg

SEQ ID NO: 3075176 - RNA, 14 nt, Mycobacterium bovis subsp bovis AF2122/97
gucgguuggcagcc

SEQ ID NO: 3075177 - RNA, 14 nt, Mycobacterium bovis subsp bovis AF2122/97
gucguaaucggcaa

SEQ ID NO: 3075178 - RNA, 14 nt, Mycobacterium bovis subsp bovis AF2122/97
gucguacaacacgg

SEQ ID NO: 3075179 - RNA, 15 nt, Mycobacterium bovis subsp bovis AF2122/97
gucguacaacacggg

SEQ ID NO: 3075180 - RNA, 22 nt, Mycobacterium bovis subsp bovis AF2122/97
gucguacaacacgggcagcuuc

SEQ ID NO: 3075181 - RNA, 20 nt, Mycobacterium bovis subsp bovis AF2122/97
gucguacaccucgagcgcgg

SEQ ID NO: 3075182 - RNA, 17 nt, Mycobacterium bovis subsp bovis AF2122/97
gucguacaugggcagau

SEQ ID NO: 3075183 - RNA, 16 nt, Mycobacterium bovis subsp bovis AF2122/97
gucguacccggcaacg

SEQ ID NO: 3075184 - RNA, 22 nt, Mycobacterium bovis subsp bovis AF2122/97
gucguacccggcaacgggaucu

SEQ ID NO: 3075185 - RNA, 18 nt, Mycobacterium bovis subsp bovis AF2122/97
gucguaccgcucggcggc

SEQ ID NO: 3075186 - RNA, 19 nt, Mycobacterium bovis subsp bovis AF2122/97
gucguaccgcucggcggca

SEQ ID NO: 3075187 - RNA, 15 nt, Mycobacterium bovis subsp bovis AF2122/97
gucguaccggccuuc

SEQ ID NO: 3075188 - RNA, 20 nt, Mycobacterium bovis subsp bovis AF2122/97
gucguacucccaggccgccg

SEQ ID NO: 3075189 - RNA, 21 nt, Mycobacterium bovis subsp bovis AF2122/97
gucguacucccaggccgccgc

SEQ ID NO: 3075190 - RNA, 14 nt, Mycobacterium bovis subsp bovis AF2122/97
gucguacucgaccg

SEQ ID NO: 3075191 - RNA, 18 nt, Mycobacterium bovis subsp bovis AF2122/97
gucguacucggcggccac

SEQ ID NO: 3075192 - RNA, 16 nt, Mycobacterium bovis subsp bovis AF2122/97
gucguagacgguuacc

SEQ ID NO: 3075193 - RNA, 14 nt, Mycobacterium bovis subsp bovis AF2122/97
gucguagagauacg

SEQ ID NO: 3075194 - RNA, 19 nt, Mycobacterium bovis subsp bovis AF2122/97
gucguagagauacgggaac

SEQ ID NO: 3075195 - RNA, 23 nt, Mycobacterium bovis subsp bovis AF2122/97
gucguagccacgcaugggccagg

SEQ ID NO: 3075196 - RNA, 17 nt, Mycobacterium bovis subsp bovis AF2122/97
gucguagcgacgccauc

SEQ ID NO: 3075197 - RNA, 19 nt, Mycobacterium bovis subsp bovis AF2122/97
gucguagcucgguaggccg

SEQ ID NO: 3075198 - RNA, 22 nt, Mycobacterium bovis subsp bovis AF2122/97
gucguagcucgguaggccggca

SEQ ID NO: 3075199 - RNA, 14 nt, Mycobacterium bovis subsp bovis AF2122/97
gucguagcuuccgg

SEQ ID NO: 3075200 - RNA, 18 nt, Mycobacterium bovis subsp bovis AF2122/97
gucguaggacaccaccgu

SEQ ID NO: 3075201 - RNA, 19 nt, Mycobacterium bovis subsp bovis AF2122/97
gucguaggacaccaccgug

SEQ ID NO: 3075202 - RNA, 17 nt, Mycobacterium bovis subsp bovis AF2122/97
gucguaguaggcgccgc

SEQ ID NO: 3075203 - RNA, 19 nt, Mycobacterium bovis subsp bovis AF2122/97
gucguaguccaggccguag

SEQ ID NO: 3075204 - RNA, 21 nt, Mycobacterium bovis subsp bovis AF2122/97
gucguaugauucacgcucggc

SEQ ID NO: 3075205 - RNA, 22 nt, Mycobacterium bovis subsp bovis AF2122/97
gucguaugauucacgcucggcg

SEQ ID NO: 3075206 - RNA, 21 nt, Mycobacterium bovis subsp bovis AF2122/97
gucgucaaacacucugaucug

SEQ ID NO: 3075207 - RNA, 15 nt, Mycobacterium bovis subsp bovis AF2122/97
gucgucaccgaugcg

SEQ ID NO: 3075208 - RNA, 19 nt, Mycobacterium bovis subsp bovis AF2122/97
gucgucaccgaugcgccgg

SEQ ID NO: 3075209 - RNA, 20 nt, Mycobacterium bovis subsp bovis AF2122/97
gucgucaccgaugcgccgga

SEQ ID NO: 3075210 - RNA, 19 nt, Mycobacterium bovis subsp bovis AF2122/97
gucgucaccgugggccugc

SEQ ID NO: 3075211 - RNA, 19 nt, Mycobacterium bovis subsp bovis AF2122/97
gucgucaucgagcgggauc

SEQ ID NO: 3075212 - RNA, 20 nt, Mycobacterium bovis subsp bovis AF2122/97
gucgucaucgagcgggaucg

SEQ ID NO: 3075213 - RNA, 22 nt, Mycobacterium bovis subsp bovis AF2122/97
gucgucaucgaguugcucggcc

SEQ ID NO: 3075214 - RNA, 18 nt, Mycobacterium bovis subsp bovis AF2122/97
gucgucaugccagucgcc

SEQ ID NO: 3075215 - RNA, 21 nt, Mycobacterium bovis subsp bovis AF2122/97
gucgucaugccagucgccgaa

SEQ ID NO: 3075216 - RNA, 18 nt, Mycobacterium bovis subsp bovis AF2122/97
gucgucauugcccuugac

SEQ ID NO: 3075217 - RNA, 18 nt, Mycobacterium bovis subsp bovis AF2122/97
gucguuggcggcggucgg

SEQ ID NO: 3075218 - RNA, 20 nt, Mycobacterium bovis subsp bovis AF2122/97
gucguugggcaugucgccga

SEQ ID NO: 3075219 - RNA, 20 nt, Mycobacterium bovis subsp bovis AF2122/97
gucguuggugcagaccaccg

SEQ ID NO: 3075220 - RNA, 17 nt, Mycobacterium bovis subsp bovis AF2122/97
gucguugucgucgccgg

SEQ ID NO: 3075221 - RNA, 22 nt, Mycobacterium bovis subsp bovis AF2122/97
gucguugucgucgccggcggcg

SEQ ID NO: 3075222 - RNA, 13 nt, Mycobacterium bovis subsp bovis AF2122/97
gucguugucugcc

SEQ ID NO: 3075223 - RNA, 23 nt, Mycobacterium bovis subsp bovis AF2122/97
gucguugucuugggucaggaucg

SEQ ID NO: 3075224 - RNA, 17 nt, Mycobacterium bovis subsp bovis AF2122/97
gucguuucgccagccgg

SEQ ID NO: 3075225 - RNA, 13 nt, Mycobacterium bovis subsp bovis AF2122/97
gucuaaugagguc

SEQ ID NO: 3075226 - RNA, 24 nt, Mycobacterium bovis subsp bovis AF2122/97
gucuaccccgagccuugagcgcgg

SEQ ID NO: 3075227 - RNA, 23 nt, Mycobacterium bovis subsp bovis AF2122/97
gucuaucggcgaacccgcagucg

SEQ ID NO: 3075228 - RNA, 15 nt, Mycobacterium bovis subsp bovis AF2122/97
gucuaucuggucggg

SEQ ID NO: 3075229 - RNA, 23 nt, Mycobacterium bovis subsp bovis AF2122/97
gucuaugaucuggucccguggcg

SEQ ID NO: 3075230 - RNA, 21 nt, Mycobacterium bovis subsp bovis AF2122/97
gucuauuugccugccgcgcaa

SEQ ID NO: 3075231 - RNA, 17 nt, Mycobacterium bovis subsp bovis AF2122/97
gucucacucaucggugu

SEQ ID NO: 3075232 - RNA, 22 nt, Mycobacterium bovis subsp bovis AF2122/97
gucuccagcaccaaaaggauca

SEQ ID NO: 3075233 - RNA, 14 nt, Mycobacterium bovis subsp bovis AF2122/97
gucuccagcugggu

SEQ ID NO: 3075234 - RNA, 16 nt, Mycobacterium bovis subsp bovis AF2122/97
gucuccagcuggguga

SEQ ID NO: 3075235 - RNA, 14 nt, Mycobacterium bovis subsp bovis AF2122/97
gucuccaguagccg

SEQ ID NO: 3075236 - RNA, 13 nt, Mycobacterium bovis subsp bovis AF2122/97
gucucccggccgc

SEQ ID NO: 3075237 - RNA, 20 nt, Mycobacterium bovis subsp bovis AF2122/97
gucucccuugccgccauucc

SEQ ID NO: 3075238 - RNA, 20 nt, Mycobacterium bovis subsp bovis AF2122/97
gucuccgacauuggccguca

SEQ ID NO: 3075239 - RNA, 19 nt, Mycobacterium bovis subsp bovis AF2122/97
gucuccgcugaugagccgc

SEQ ID NO: 3075240 - RNA, 22 nt, Mycobacterium bovis subsp bovis AF2122/97
gucuccgcugaugagccgcaga

SEQ ID NO: 3075241 - RNA, 17 nt, Mycobacterium bovis subsp bovis AF2122/97
gucuccggacgcacgau

SEQ ID NO: 3075242 - RNA, 13 nt, Mycobacterium bovis subsp bovis AF2122/97
gucuccggcaagc

SEQ ID NO: 3075243 - RNA, 14 nt, Mycobacterium bovis subsp bovis AF2122/97
gucuccggcgccac

SEQ ID NO: 3075244 - RNA, 15 nt, Mycobacterium bovis subsp bovis AF2122/97
gucuccucggucacc

SEQ ID NO: 3075245 - RNA, 18 nt, Mycobacterium bovis subsp bovis AF2122/97
gucuccucggucaccgag

SEQ ID NO: 3075246 - RNA, 16 nt, Mycobacterium bovis subsp bovis AF2122/97
gucuccuucggcgacu

SEQ ID NO: 3075247 - RNA, 22 nt, Mycobacterium bovis subsp bovis AF2122/97
gucuccuugagcuucucgucgg

SEQ ID NO: 3075248 - RNA, 23 nt, Mycobacterium bovis subsp bovis AF2122/97
gucucgaaagccgcggccgaaac

SEQ ID NO: 3075249 - RNA, 16 nt, Mycobacterium bovis subsp bovis AF2122/97
gucucgacacugcagu

SEQ ID NO: 3075250 - RNA, 15 nt, Mycobacterium bovis subsp bovis AF2122/97
gucucgacggcggcc

SEQ ID NO: 3075251 - RNA, 14 nt, Mycobacterium bovis subsp bovis AF2122/97
gucucgcggugcgg

SEQ ID NO: 3075252 - RNA, 17 nt, Mycobacterium bovis subsp bovis AF2122/97
gucucggaggcgaccac

SEQ ID NO: 3075253 - RNA, 23 nt, Mycobacterium bovis subsp bovis AF2122/97
gucucggaggcgaccacgucggc

SEQ ID NO: 3075254 - RNA, 13 nt, Mycobacterium bovis subsp bovis AF2122/97
gucucggccacga

SEQ ID NO: 3075255 - RNA, 17 nt, Mycobacterium bovis subsp bovis AF2122/97
gucucggcgaccgacgc

SEQ ID NO: 3075256 - RNA, 19 nt, Mycobacterium bovis subsp bovis AF2122/97
gucucggcgucgaccaguu

SEQ ID NO: 3075257 - RNA, 15 nt, Mycobacterium bovis subsp bovis AF2122/97
gucucggcguuccgg

SEQ ID NO: 3075258 - RNA, 21 nt, Mycobacterium bovis subsp bovis AF2122/97
gucucggcguuccggacggga

SEQ ID NO: 3075259 - RNA, 21 nt, Mycobacterium bovis subsp bovis AF2122/97
gucucgggcgcgggugaccag

SEQ ID NO: 3075260 - RNA, 19 nt, Mycobacterium bovis subsp bovis AF2122/97
gucucgggguuguucggca

SEQ ID NO: 3075261 - RNA, 16 nt, Mycobacterium bovis subsp bovis AF2122/97
gucucggugcagcagc

SEQ ID NO: 3075262 - RNA, 20 nt, Mycobacterium bovis subsp bovis AF2122/97
gucucgguggcugcgccgga

SEQ ID NO: 3075263 - RNA, 15 nt, Mycobacterium bovis subsp bovis AF2122/97
gucucgucaaccugc

SEQ ID NO: 3075264 - RNA, 16 nt, Mycobacterium bovis subsp bovis AF2122/97
gucucgucgccccguu

SEQ ID NO: 3075265 - RNA, 22 nt, Mycobacterium bovis subsp bovis AF2122/97
gucucuagauauggaccgccgc

SEQ ID NO: 3075266 - RNA, 14 nt, Mycobacterium bovis subsp bovis AF2122/97
gucucucgcagcuc

SEQ ID NO: 3075267 - RNA, 13 nt, Mycobacterium bovis subsp bovis AF2122/97
gucucugacgaau

SEQ ID NO: 3075268 - RNA, 17 nt, Mycobacterium bovis subsp bovis AF2122/97
gucugacagaccgggca

SEQ ID NO: 3075269 - RNA, 18 nt, Mycobacterium bovis subsp bovis AF2122/97
gucugacaucgucgacga

SEQ ID NO: 3075270 - RNA, 15 nt, Mycobacterium bovis subsp bovis AF2122/97
gucugacccaccgcc

SEQ ID NO: 3075271 - RNA, 19 nt, Mycobacterium bovis subsp bovis AF2122/97
gucugaccgguucccgggc

SEQ ID NO: 3075272 - RNA, 13 nt, Mycobacterium bovis subsp bovis AF2122/97
gucugacgaaucg

SEQ ID NO: 3075273 - RNA, 15 nt, Mycobacterium bovis subsp bovis AF2122/97
gucugagcgccggca

SEQ ID NO: 3075274 - RNA, 14 nt, Mycobacterium bovis subsp bovis AF2122/97
gucugaucggcuuc

SEQ ID NO: 3075275 - RNA, 14 nt, Mycobacterium bovis subsp bovis AF2122/97
gucugauggccucg

SEQ ID NO: 3075276 - RNA, 17 nt, Mycobacterium bovis subsp bovis AF2122/97
gucugauggcggcucgu

SEQ ID NO: 3075277 - RNA, 16 nt, Mycobacterium bovis subsp bovis AF2122/97
gucugcaccggcaggc

SEQ ID NO: 3075278 - RNA, 15 nt, Mycobacterium bovis subsp bovis AF2122/97
gucugcagacggucc

SEQ ID NO: 3075279 - RNA, 24 nt, Mycobacterium bovis subsp bovis AF2122/97
gucugcagacgguccgcuacggcg

SEQ ID NO: 3075280 - RNA, 19 nt, Mycobacterium bovis subsp bovis AF2122/97
gucugcagggucgaguucg

SEQ ID NO: 3075281 - RNA, 15 nt, Mycobacterium bovis subsp bovis AF2122/97
gucugcagugcagcg

SEQ ID NO: 3075282 - RNA, 12 nt, Mycobacterium bovis subsp bovis AF2122/97
gucugccagcac

SEQ ID NO: 3075283 - RNA, 14 nt, Mycobacterium bovis subsp bovis AF2122/97
gucugccagcaccc

SEQ ID NO: 3075284 - RNA, 12 nt, Mycobacterium bovis subsp bovis AF2122/97
gucugccaggcg

SEQ ID NO: 3075285 - RNA, 16 nt, Mycobacterium bovis subsp bovis AF2122/97
gucugccaggcgcagc

SEQ ID NO: 3075286 - RNA, 21 nt, Mycobacterium bovis subsp bovis AF2122/97
gucugcccgacugccguucag

SEQ ID NO: 3075287 - RNA, 16 nt, Mycobacterium bovis subsp bovis AF2122/97
gucugcccgcccagcc

SEQ ID NO: 3075288 - RNA, 15 nt, Mycobacterium bovis subsp bovis AF2122/97
gucugcgacuggauc

SEQ ID NO: 3075289 - RNA, 20 nt, Mycobacterium bovis subsp bovis AF2122/97
gucugcgccaaaauccgccc

SEQ ID NO: 3075290 - RNA, 14 nt, Mycobacterium bovis subsp bovis AF2122/97
gucugcgccgccgg

SEQ ID NO: 3075291 - RNA, 18 nt, Mycobacterium bovis subsp bovis AF2122/97
gucugcgccgccggcggc

SEQ ID NO: 3075292 - RNA, 18 nt, Mycobacterium bovis subsp bovis AF2122/97
gucugcgccuucgccagc

SEQ ID NO: 3075293 - RNA, 23 nt, Mycobacterium bovis subsp bovis AF2122/97
gucugcgccuucgccagcggcgc

SEQ ID NO: 3075294 - RNA, 16 nt, Mycobacterium bovis subsp bovis AF2122/97
gucugcgcggugcccg

SEQ ID NO: 3075295 - RNA, 15 nt, Mycobacterium bovis subsp bovis AF2122/97
gucugcggaccggcg

SEQ ID NO: 3075296 - RNA, 20 nt, Mycobacterium bovis subsp bovis AF2122/97
gucugcggucaucgccucgg

SEQ ID NO: 3075297 - RNA, 13 nt, Mycobacterium bovis subsp bovis AF2122/97
gucugcucaccag

SEQ ID NO: 3075298 - RNA, 15 nt, Mycobacterium bovis subsp bovis AF2122/97
gucugcucaccagcg

SEQ ID NO: 3075299 - RNA, 22 nt, Mycobacterium bovis subsp bovis AF2122/97
gucugcuccaggcgcgccgcac

SEQ ID NO: 3075300 - RNA, 20 nt, Mycobacterium bovis subsp bovis AF2122/97
gucugcuccuuggcccagcg

SEQ ID NO: 3075301 - RNA, 13 nt, Mycobacterium bovis subsp bovis AF2122/97
gucugcucgccag

SEQ ID NO: 3075302 - RNA, 15 nt, Mycobacterium bovis subsp bovis AF2122/97
gucugcucgccagcg

SEQ ID NO: 3075303 - RNA, 15 nt, Mycobacterium bovis subsp bovis AF2122/97
gucugcucgccaggc

SEQ ID NO: 3075304 - RNA, 14 nt, Mycobacterium bovis subsp bovis AF2122/97
gugaagacaccagg

SEQ ID NO: 3075305 - RNA, 17 nt, Mycobacterium bovis subsp bovis AF2122/97
gugaagacaccaggccc

SEQ ID NO: 3075306 - RNA, 16 nt, Mycobacterium bovis subsp bovis AF2122/97
gugaagaucgacaccc

SEQ ID NO: 3075307 - RNA, 22 nt, Mycobacterium bovis subsp bovis AF2122/97
gugaagccaagcgacucgccgg

SEQ ID NO: 3075308 - RNA, 17 nt, Mycobacterium bovis subsp bovis AF2122/97
gugaagcccuggccagc

SEQ ID NO: 3075309 - RNA, 19 nt, Mycobacterium bovis subsp bovis AF2122/97
gugaaggcaaacaccagcc

SEQ ID NO: 3075310 - RNA, 20 nt, Mycobacterium bovis subsp bovis AF2122/97
gugaaggcaaacaccagccc

SEQ ID NO: 3075311 - RNA, 17 nt, Mycobacterium bovis subsp bovis AF2122/97
gugaaguagucggcgcc

SEQ ID NO: 3075312 - RNA, 16 nt, Mycobacterium bovis subsp bovis AF2122/97
gugaagucacggcggc

SEQ ID NO: 3075313 - RNA, 22 nt, Mycobacterium bovis subsp bovis AF2122/97
gugaaguccgagacgucggcgu

SEQ ID NO: 3075314 - RNA, 19 nt, Mycobacterium bovis subsp bovis AF2122/97
gugaagugagcucggcugc

SEQ ID NO: 3075315 - RNA, 20 nt, Mycobacterium bovis subsp bovis AF2122/97
gugaaguggcgcaccaccuc

SEQ ID NO: 3075316 - RNA, 15 nt, Mycobacterium bovis subsp bovis AF2122/97
gugaaguggcgcagc

SEQ ID NO: 3075317 - RNA, 20 nt, Mycobacterium bovis subsp bovis AF2122/97
gugaaguuguuggccagacc

SEQ ID NO: 3075318 - RNA, 18 nt, Mycobacterium bovis subsp bovis AF2122/97
gugaaucgaagcccggcg

SEQ ID NO: 3075319 - RNA, 13 nt, Mycobacterium bovis subsp bovis AF2122/97
gugaaucgcacga

SEQ ID NO: 3075320 - RNA, 13 nt, Mycobacterium bovis subsp bovis AF2122/97
gugaaucggaccg

SEQ ID NO: 3075321 - RNA, 20 nt, Mycobacterium bovis subsp bovis AF2122/97
gugaaucugacgacgcgaca

SEQ ID NO: 3075322 - RNA, 18 nt, Mycobacterium bovis subsp bovis AF2122/97
gugaaugcaacuccucga

SEQ ID NO: 3075323 - RNA, 16 nt, Mycobacterium bovis subsp bovis AF2122/97
gugaauggcagcacga

SEQ ID NO: 3075324 - RNA, 13 nt, Mycobacterium bovis subsp bovis AF2122/97
gugaauucgccga

SEQ ID NO: 3075325 - RNA, 20 nt, Mycobacterium bovis subsp bovis AF2122/97
gugacaacugcgccggugcc

SEQ ID NO: 3075326 - RNA, 23 nt, Mycobacterium bovis subsp bovis AF2122/97
gugacaaggauggucgccugcgg

SEQ ID NO: 3075327 - RNA, 14 nt, Mycobacterium bovis subsp bovis AF2122/97
gugacaccaacacc

SEQ ID NO: 3075328 - RNA, 15 nt, Mycobacterium bovis subsp bovis AF2122/97
gugacaccacaucgg

SEQ ID NO: 3075329 - RNA, 20 nt, Mycobacterium bovis subsp bovis AF2122/97
gugacagagcggguucgacg

SEQ ID NO: 3075330 - RNA, 13 nt, Mycobacterium bovis subsp bovis AF2122/97
gugacagcggcau

SEQ ID NO: 3075331 - RNA, 20 nt, Mycobacterium bovis subsp bovis AF2122/97
gugacagugcgucgagcauc

SEQ ID NO: 3075332 - RNA, 22 nt, Mycobacterium bovis subsp bovis AF2122/97
gugacauaccaagggauccgaa

SEQ ID NO: 3075333 - RNA, 22 nt, Mycobacterium bovis subsp bovis AF2122/97
gugacauagaccucgccgguga

SEQ ID NO: 3075334 - RNA, 23 nt, Mycobacterium bovis subsp bovis AF2122/97
gugacauagaccucgccggugac

SEQ ID NO: 3075335 - RNA, 17 nt, Mycobacterium bovis subsp bovis AF2122/97
gugacaucgcgaggcgu

SEQ ID NO: 3075336 - RNA, 22 nt, Mycobacterium bovis subsp bovis AF2122/97
gugacaucgggccgccgagcuc

SEQ ID NO: 3075337 - RNA, 14 nt, Mycobacterium bovis subsp bovis AF2122/97
gugaccaacggugc

SEQ ID NO: 3075338 - RNA, 15 nt, Mycobacterium bovis subsp bovis AF2122/97
gugaccaccgccgac

SEQ ID NO: 3075339 - RNA, 15 nt, Mycobacterium bovis subsp bovis AF2122/97
gugaccagaucgacg

SEQ ID NO: 3075340 - RNA, 12 nt, Mycobacterium bovis subsp bovis AF2122/97
gugaccagcagg

SEQ ID NO: 3075341 - RNA, 18 nt, Mycobacterium bovis subsp bovis AF2122/97
gugaccagcaggccgggc

SEQ ID NO: 3075342 - RNA, 17 nt, Mycobacterium bovis subsp bovis AF2122/97
gugaccaggaucgacag

SEQ ID NO: 3075343 - RNA, 16 nt, Mycobacterium bovis subsp bovis AF2122/97
gugaccaggccgagcu

SEQ ID NO: 3075344 - RNA, 13 nt, Mycobacterium bovis subsp bovis AF2122/97
gugaccaggccgg

SEQ ID NO: 3075345 - RNA, 16 nt, Mycobacterium bovis subsp bovis AF2122/97
gugaccaggccggccc

SEQ ID NO: 3075346 - RNA, 21 nt, Mycobacterium bovis subsp bovis AF2122/97
gugaccaggcggacgccgcgc

SEQ ID NO: 3075347 - RNA, 16 nt, Mycobacterium bovis subsp bovis AF2122/97
gugaccaggcggcgcg

SEQ ID NO: 3075348 - RNA, 13 nt, Mycobacterium bovis subsp bovis AF2122/97
gugaccaggugcc

SEQ ID NO: 3075349 - RNA, 17 nt, Mycobacterium bovis subsp bovis AF2122/97
gugacccacucggggac

SEQ ID NO: 3075350 - RNA, 23 nt, Mycobacterium bovis subsp bovis AF2122/97
gugacccauucucggccggcggc

SEQ ID NO: 3075351 - RNA, 17 nt, Mycobacterium bovis subsp bovis AF2122/97
gugacccgccggcgacu

SEQ ID NO: 3075352 - RNA, 15 nt, Mycobacterium bovis subsp bovis AF2122/97
gugacccgcugggcc

SEQ ID NO: 3075353 - RNA, 20 nt, Mycobacterium bovis subsp bovis AF2122/97
gugacccggauaucgaccac

SEQ ID NO: 3075354 - RNA, 22 nt, Mycobacterium bovis subsp bovis AF2122/97
gugacccggauaucgaccaccg

SEQ ID NO: 3075355 - RNA, 15 nt, Mycobacterium bovis subsp bovis AF2122/97
gugacccucagcacc

SEQ ID NO: 3075356 - RNA, 22 nt, Mycobacterium bovis subsp bovis AF2122/97
gugacccucagcaccgcuggca

SEQ ID NO: 3075357 - RNA, 17 nt, Mycobacterium bovis subsp bovis AF2122/97
gugaccgacgccgucga

SEQ ID NO: 3075358 - RNA, 19 nt, Mycobacterium bovis subsp bovis AF2122/97
gugaccgagaagcccaccg

SEQ ID NO: 3075359 - RNA, 17 nt, Mycobacterium bovis subsp bovis AF2122/97
gugaccgcagucccagc

SEQ ID NO: 3075360 - RNA, 16 nt, Mycobacterium bovis subsp bovis AF2122/97
gugaccgccgaugccc

SEQ ID NO: 3075361 - RNA, 13 nt, Mycobacterium bovis subsp bovis AF2122/97
gugaccgccgcgc

SEQ ID NO: 3075362 - RNA, 20 nt, Mycobacterium bovis subsp bovis AF2122/97
gugaccgccgcgccggcacg

SEQ ID NO: 3075363 - RNA, 22 nt, Mycobacterium bovis subsp bovis AF2122/97
gugaccgccguugucgaccucc

SEQ ID NO: 3075364 - RNA, 13 nt, Mycobacterium bovis subsp bovis AF2122/97
gugaccgcuggug

SEQ ID NO: 3075365 - RNA, 14 nt, Mycobacterium bovis subsp bovis AF2122/97
gugaccgcuggugu

SEQ ID NO: 3075366 - RNA, 19 nt, Mycobacterium bovis subsp bovis AF2122/97
gugaccggcaaugccacgg

SEQ ID NO: 3075367 - RNA, 18 nt, Mycobacterium bovis subsp bovis AF2122/97
gugaccggccugcgacga

SEQ ID NO: 3075368 - RNA, 13 nt, Mycobacterium bovis subsp bovis AF2122/97
gugaccggcggga

SEQ ID NO: 3075369 - RNA, 16 nt, Mycobacterium bovis subsp bovis AF2122/97
gugaccgggucgauca

SEQ ID NO: 3075370 - RNA, 18 nt, Mycobacterium bovis subsp bovis AF2122/97
gugaccgggucgaucacc

SEQ ID NO: 3075371 - RNA, 19 nt, Mycobacterium bovis subsp bovis AF2122/97
gugaccgggucgaucaccg

SEQ ID NO: 3075372 - RNA, 16 nt, Mycobacterium bovis subsp bovis AF2122/97
gugaccgugccgucgg

SEQ ID NO: 3075373 - RNA, 14 nt, Mycobacterium bovis subsp bovis AF2122/97
gugaccguggcggg

SEQ ID NO: 3075374 - RNA, 15 nt, Mycobacterium bovis subsp bovis AF2122/97
gugaccucggcgacc

SEQ ID NO: 3075375 - RNA, 17 nt, Mycobacterium bovis subsp bovis AF2122/97
gugaccucggcgaccag

SEQ ID NO: 3075376 - RNA, 13 nt, Mycobacterium bovis subsp bovis AF2122/97
gugaccucgucga

SEQ ID NO: 3075377 - RNA, 16 nt, Mycobacterium bovis subsp bovis AF2122/97
gugaccucgucgaccg

SEQ ID NO: 3075378 - RNA, 13 nt, Mycobacterium bovis subsp bovis AF2122/97
gugaccucgucgg

SEQ ID NO: 3075379 - RNA, 24 nt, Mycobacterium bovis subsp bovis AF2122/97
gugaccucgucggcgacggccagc

SEQ ID NO: 3075380 - RNA, 17 nt, Mycobacterium bovis subsp bovis AF2122/97
gugaccugacgcucggu

SEQ ID NO: 3075381 - RNA, 20 nt, Mycobacterium bovis subsp bovis AF2122/97
gugaccuguuuggggcugug

SEQ ID NO: 3075382 - RNA, 20 nt, Mycobacterium bovis subsp bovis AF2122/97
gugacgaaggcugucaguuc

SEQ ID NO: 3075383 - RNA, 21 nt, Mycobacterium bovis subsp bovis AF2122/97
gugacgaccacgucgaggucc

SEQ ID NO: 3075384 - RNA, 14 nt, Mycobacterium bovis subsp bovis AF2122/97
gugacgaccagccc

SEQ ID NO: 3075385 - RNA, 18 nt, Mycobacterium bovis subsp bovis AF2122/97
gugacgacgucgccgccg

SEQ ID NO: 3075386 - RNA, 19 nt, Mycobacterium bovis subsp bovis AF2122/97
gugacgacgucgccgccgc

SEQ ID NO: 3075387 - RNA, 17 nt, Mycobacterium bovis subsp bovis AF2122/97
gugacgagccaccaccg

SEQ ID NO: 3075388 - RNA, 23 nt, Mycobacterium bovis subsp bovis AF2122/97
gugacgagccaccaccgccgacc

SEQ ID NO: 3075389 - RNA, 20 nt, Mycobacterium bovis subsp bovis AF2122/97
gugacgaucaggccgucgcc

SEQ ID NO: 3075390 - RNA, 23 nt, Mycobacterium bovis subsp bovis AF2122/97
gugauauccgugaauggcagcac

SEQ ID NO: 3075391 - RNA, 19 nt, Mycobacterium bovis subsp bovis AF2122/97
gugauauccuuugccgccg

SEQ ID NO: 3075392 - RNA, 18 nt, Mycobacterium bovis subsp bovis AF2122/97
gugaucaaaccggccuua

SEQ ID NO: 3075393 - RNA, 19 nt, Mycobacterium bovis subsp bovis AF2122/97
gugaucaaaccggcggcga

SEQ ID NO: 3075394 - RNA, 16 nt, Mycobacterium bovis subsp bovis AF2122/97
gugaucaccacgaaug

SEQ ID NO: 3075395 - RNA, 16 nt, Mycobacterium bovis subsp bovis AF2122/97
gugaucaccgcggcgg

SEQ ID NO: 3075396 - RNA, 14 nt, Mycobacterium bovis subsp bovis AF2122/97
gugaucacggucgg

SEQ ID NO: 3075397 - RNA, 16 nt, Mycobacterium bovis subsp bovis AF2122/97
gugaucacgucggcgu

SEQ ID NO: 3075398 - RNA, 13 nt, Mycobacterium bovis subsp bovis AF2122/97
gugaucagcagca

SEQ ID NO: 3075399 - RNA, 19 nt, Mycobacterium bovis subsp bovis AF2122/97
gugaucagcaggacgauga

SEQ ID NO: 3075400 - RNA, 21 nt, Mycobacterium bovis subsp bovis AF2122/97
gugaucagcaggaucggcagc

SEQ ID NO: 3075401 - RNA, 18 nt, Mycobacterium bovis subsp bovis AF2122/97
gugaucagccaccgggug

SEQ ID NO: 3075402 - RNA, 18 nt, Mycobacterium bovis subsp bovis AF2122/97
gugaucagcgcaucgccg

SEQ ID NO: 3075403 - RNA, 20 nt, Mycobacterium bovis subsp bovis AF2122/97
gugaucagguaagcgaacgg

SEQ ID NO: 3075404 - RNA, 13 nt, Mycobacterium bovis subsp bovis AF2122/97
gugaucaggucac

SEQ ID NO: 3075405 - RNA, 21 nt, Mycobacterium bovis subsp bovis AF2122/97
gugauccaacuggccgcgucg

SEQ ID NO: 3075406 - RNA, 22 nt, Mycobacterium bovis subsp bovis AF2122/97
gugauccaacuggccgcgucgc

SEQ ID NO: 3075407 - RNA, 12 nt, Mycobacterium bovis subsp bovis AF2122/97
gugauccacgcu

SEQ ID NO: 3075408 - RNA, 14 nt, Mycobacterium bovis subsp bovis AF2122/97
gugauccacgcucg

SEQ ID NO: 3075409 - RNA, 16 nt, Mycobacterium bovis subsp bovis AF2122/97
gugauccagccgucgg

SEQ ID NO: 3075410 - RNA, 15 nt, Mycobacterium bovis subsp bovis AF2122/97
gugaucccgcccaag

SEQ ID NO: 3075411 - RNA, 13 nt, Mycobacterium bovis subsp bovis AF2122/97
gugauccgacagu

SEQ ID NO: 3075412 - RNA, 16 nt, Mycobacterium bovis subsp bovis AF2122/97
gugauccgagaccaug

SEQ ID NO: 3075413 - RNA, 16 nt, Mycobacterium bovis subsp bovis AF2122/97
gugaucgaggcggcgg

SEQ ID NO: 3075414 - RNA, 15 nt, Mycobacterium bovis subsp bovis AF2122/97
gugaucgagucgcga

SEQ ID NO: 3075415 - RNA, 15 nt, Mycobacterium bovis subsp bovis AF2122/97
gugaucgaucgcggc

SEQ ID NO: 3075416 - RNA, 20 nt, Mycobacterium bovis subsp bovis AF2122/97
gugaucgccaccgguaccgg

SEQ ID NO: 3075417 - RNA, 23 nt, Mycobacterium bovis subsp bovis AF2122/97
gugaucgcgguccaacagcgcca

SEQ ID NO: 3075418 - RNA, 17 nt, Mycobacterium bovis subsp bovis AF2122/97
gugaucggcgauccgac

SEQ ID NO: 3075419 - RNA, 14 nt, Mycobacterium bovis subsp bovis AF2122/97
gugaucggcgcccg

SEQ ID NO: 3075420 - RNA, 17 nt, Mycobacterium bovis subsp bovis AF2122/97
gugaucggcgucaggca

SEQ ID NO: 3075421 - RNA, 19 nt, Mycobacterium bovis subsp bovis AF2122/97
gugaucgggcagcacgcca

SEQ ID NO: 3075422 - RNA, 20 nt, Mycobacterium bovis subsp bovis AF2122/97
gugaucgggcagcacgccag

SEQ ID NO: 3075423 - RNA, 21 nt, Mycobacterium bovis subsp bovis AF2122/97
gugaucgggcagcacgccagc

SEQ ID NO: 3075424 - RNA, 15 nt, Mycobacterium bovis subsp bovis AF2122/97
gugaugaagcgcggu

SEQ ID NO: 3075425 - RNA, 20 nt, Mycobacterium bovis subsp bovis AF2122/97
gugaugaauucgcuugcagc

SEQ ID NO: 3075426 - RNA, 21 nt, Mycobacterium bovis subsp bovis AF2122/97
gugaugaccgcguagagcagc

SEQ ID NO: 3075427 - RNA, 19 nt, Mycobacterium bovis subsp bovis AF2122/97
gugaugacgccgucggcgc

SEQ ID NO: 3075428 - RNA, 17 nt, Mycobacterium bovis subsp bovis AF2122/97
gugaugcaugcuaggca

SEQ ID NO: 3075429 - RNA, 13 nt, Mycobacterium bovis subsp bovis AF2122/97
gugaugcccuggg

SEQ ID NO: 3075430 - RNA, 13 nt, Mycobacterium bovis subsp bovis AF2122/97
gugaugccgauga

SEQ ID NO: 3075431 - RNA, 13 nt, Mycobacterium bovis subsp bovis AF2122/97
gugaugccgccgu

SEQ ID NO: 3075432 - RNA, 14 nt, Mycobacterium bovis subsp bovis AF2122/97
gugaugcgggcucg

SEQ ID NO: 3075433 - RNA, 18 nt, Mycobacterium bovis subsp bovis AF2122/97
gugaugcguucggccggg

SEQ ID NO: 3075434 - RNA, 16 nt, Mycobacterium bovis subsp bovis AF2122/97
gugauggagccgguga

SEQ ID NO: 3075435 - RNA, 17 nt, Mycobacterium bovis subsp bovis AF2122/97
gugauggcggcgcaccu

SEQ ID NO: 3075436 - RNA, 18 nt, Mycobacterium bovis subsp bovis AF2122/97
gugauggcuuggaccagc

SEQ ID NO: 3075437 - RNA, 16 nt, Mycobacterium bovis subsp bovis AF2122/97
gugaugggcauggugg

SEQ ID NO: 3075438 - RNA, 20 nt, Mycobacterium bovis subsp bovis AF2122/97
gugauggucagcuggccgcg

SEQ ID NO: 3075439 - RNA, 21 nt, Mycobacterium bovis subsp bovis AF2122/97
gugauggucagcuggccgcgg

SEQ ID NO: 3075440 - RNA, 21 nt, Mycobacterium bovis subsp bovis AF2122/97
gugauggugaauaucucgccg

SEQ ID NO: 3075441 - RNA, 17 nt, Mycobacterium bovis subsp bovis AF2122/97
gugauggugaccagcag

SEQ ID NO: 3075442 - RNA, 15 nt, Mycobacterium bovis subsp bovis AF2122/97
gugauggugugcagc

SEQ ID NO: 3075443 - RNA, 17 nt, Mycobacterium bovis subsp bovis AF2122/97
gugauggugugcagcag

SEQ ID NO: 3075444 - RNA, 19 nt, Mycobacterium bovis subsp bovis AF2122/97
gugauggugugcagcagca

SEQ ID NO: 3075445 - RNA, 21 nt, Mycobacterium bovis subsp bovis AF2122/97
gugaugguucaaugccauguu

SEQ ID NO: 3075446 - RNA, 18 nt, Mycobacterium bovis subsp bovis AF2122/97
gugauguagggcugcucc

SEQ ID NO: 3075447 - RNA, 16 nt, Mycobacterium bovis subsp bovis AF2122/97
gugauguuggccgcca

SEQ ID NO: 3075448 - RNA, 19 nt, Mycobacterium bovis subsp bovis AF2122/97
gugauuaccugguucgacu

SEQ ID NO: 3075449 - RNA, 19 nt, Mycobacterium bovis subsp bovis AF2122/97
gugauuccgggucggcgaa

SEQ ID NO: 3075450 - RNA, 15 nt, Mycobacterium bovis subsp bovis AF2122/97
gugauucgcgcagcg

SEQ ID NO: 3075451 - RNA, 15 nt, Mycobacterium bovis subsp bovis AF2122/97
gugauucggccugag

SEQ ID NO: 3075452 - RNA, 15 nt, Mycobacterium bovis subsp bovis AF2122/97
gugauugagcucagg

SEQ ID NO: 3075453 - RNA, 12 nt, Mycobacterium bovis subsp bovis AF2122/97
gugauugcgcgg

SEQ ID NO: 3075454 - RNA, 19 nt, Mycobacterium bovis subsp bovis AF2122/97
gugauugcgcgggcaucgu

SEQ ID NO: 3075455 - RNA, 17 nt, Mycobacterium bovis subsp bovis AF2122/97
gugcaaccacggcggca

SEQ ID NO: 3075456 - RNA, 18 nt, Mycobacterium bovis subsp bovis AF2122/97
gugcaaccacggcggcau

SEQ ID NO: 3075457 - RNA, 17 nt, Mycobacterium bovis subsp bovis AF2122/97
gugcaaccauggcggcu

SEQ ID NO: 3075458 - RNA, 22 nt, Mycobacterium bovis subsp bovis AF2122/97
gugcaaccccaaguccagcagc

SEQ ID NO: 3075459 - RNA, 13 nt, Mycobacterium bovis subsp bovis AF2122/97
gugcaaccgugcc

SEQ ID NO: 3075460 - RNA, 14 nt, Mycobacterium bovis subsp bovis AF2122/97
gugcaacggcguug

SEQ ID NO: 3075461 - RNA, 20 nt, Mycobacterium bovis subsp bovis AF2122/97
gugcaagcccuuucgacuuc

SEQ ID NO: 3075462 - RNA, 18 nt, Mycobacterium bovis subsp bovis AF2122/97
gugcaagccgaacaccgu

SEQ ID NO: 3075463 - RNA, 20 nt, Mycobacterium bovis subsp bovis AF2122/97
gugcaaugcuuccagcauca

SEQ ID NO: 3075464 - RNA, 21 nt, Mycobacterium bovis subsp bovis AF2122/97
gugcacaaaauacuccgcgag

SEQ ID NO: 3075465 - RNA, 21 nt, Mycobacterium bovis subsp bovis AF2122/97
gugcacacaauucgggcguga

SEQ ID NO: 3075466 - RNA, 22 nt, Mycobacterium bovis subsp bovis AF2122/97
gugcacagacacggcagcugca

SEQ ID NO: 3075467 - RNA, 14 nt, Mycobacterium bovis subsp bovis AF2122/97
gugcacagcaguga

SEQ ID NO: 3075468 - RNA, 19 nt, Mycobacterium bovis subsp bovis AF2122/97
gugcacaggcaucguccgc

SEQ ID NO: 3075469 - RNA, 23 nt, Mycobacterium bovis subsp bovis AF2122/97
gugcaccagcgaccaggucgcca

SEQ ID NO: 3075470 - RNA, 12 nt, Mycobacterium bovis subsp bovis AF2122/97
gugcaccaggua

SEQ ID NO: 3075471 - RNA, 14 nt, Mycobacterium bovis subsp bovis AF2122/97
gugcaccaucauca

SEQ ID NO: 3075472 - RNA, 20 nt, Mycobacterium bovis subsp bovis AF2122/97
gugcaccaucaucaccucuc

SEQ ID NO: 3075473 - RNA, 23 nt, Mycobacterium bovis subsp bovis AF2122/97
gugcaccauuguuccguccccga

SEQ ID NO: 3075474 - RNA, 20 nt, Mycobacterium bovis subsp bovis AF2122/97
gugcacccgggccgccucga

SEQ ID NO: 3075475 - RNA, 24 nt, Mycobacterium bovis subsp bovis AF2122/97
gugcacccgggccgccucgaucga

SEQ ID NO: 3075476 - RNA, 22 nt, Mycobacterium bovis subsp bovis AF2122/97
gugccacugccguugccgccgg

SEQ ID NO: 3075477 - RNA, 23 nt, Mycobacterium bovis subsp bovis AF2122/97
gugccacugccguugccgccggu

SEQ ID NO: 3075478 - RNA, 13 nt, Mycobacterium bovis subsp bovis AF2122/97
gugccacuuccac

SEQ ID NO: 3075479 - RNA, 23 nt, Mycobacterium bovis subsp bovis AF2122/97
gugccagaccagggcagcggcca

SEQ ID NO: 3075480 - RNA, 20 nt, Mycobacterium bovis subsp bovis AF2122/97
gugccagcaccacgucgacg

SEQ ID NO: 3075481 - RNA, 15 nt, Mycobacterium bovis subsp bovis AF2122/97
gugccagcagcagcg

SEQ ID NO: 3075482 - RNA, 17 nt, Mycobacterium bovis subsp bovis AF2122/97
gugccagcagcagcgcc

SEQ ID NO: 3075483 - RNA, 20 nt, Mycobacterium bovis subsp bovis AF2122/97
gugccagcaggccgaagaaa

SEQ ID NO: 3075484 - RNA, 14 nt, Mycobacterium bovis subsp bovis AF2122/97
gugccagcagggga

SEQ ID NO: 3075485 - RNA, 16 nt, Mycobacterium bovis subsp bovis AF2122/97
gugccagcaggggacg

SEQ ID NO: 3075486 - RNA, 14 nt, Mycobacterium bovis subsp bovis AF2122/97
gugccagcgccccg

SEQ ID NO: 3075487 - RNA, 14 nt, Mycobacterium bovis subsp bovis AF2122/97
gugccaggaucgcg

SEQ ID NO: 3075488 - RNA, 14 nt, Mycobacterium bovis subsp bovis AF2122/97
gugccaguccgaug

SEQ ID NO: 3075489 - RNA, 18 nt, Mycobacterium bovis subsp bovis AF2122/97
gugccagugccagcgucc

SEQ ID NO: 3075490 - RNA, 18 nt, Mycobacterium bovis subsp bovis AF2122/97
gugccagugcgcagcccg

SEQ ID NO: 3075491 - RNA, 12 nt, Mycobacterium bovis subsp bovis AF2122/97
gugccaucgcca

SEQ ID NO: 3075492 - RNA, 15 nt, Mycobacterium bovis subsp bovis AF2122/97
gugccaucgggcgcg

SEQ ID NO: 3075493 - RNA, 14 nt, Mycobacterium bovis subsp bovis AF2122/97
gugccaucgguggu

SEQ ID NO: 3075494 - RNA, 15 nt, Mycobacterium bovis subsp bovis AF2122/97
gugccaucgguggug

SEQ ID NO: 3075495 - RNA, 17 nt, Mycobacterium bovis subsp bovis AF2122/97
gugccaucggugguggc

SEQ ID NO: 3075496 - RNA, 17 nt, Mycobacterium bovis subsp bovis AF2122/97
gugccaucuacaucguc

SEQ ID NO: 3075497 - RNA, 17 nt, Mycobacterium bovis subsp bovis AF2122/97
gugcccaacccacucgc

SEQ ID NO: 3075498 - RNA, 24 nt, Mycobacterium bovis subsp bovis AF2122/97
gugcccaacccacucgcagcagca

SEQ ID NO: 3075499 - RNA, 21 nt, Mycobacterium bovis subsp bovis AF2122/97
gugcccaauauugcguucggg

SEQ ID NO: 3075500 - RNA, 18 nt, Mycobacterium bovis subsp bovis AF2122/97
gugcccagcagcgcgacg

SEQ ID NO: 3075501 - RNA, 15 nt, Mycobacterium bovis subsp bovis AF2122/97
gugcccagcgaugcg

SEQ ID NO: 3075502 - RNA, 20 nt, Mycobacterium bovis subsp bovis AF2122/97
gugcccagcgcuuugaugcc

SEQ ID NO: 3075503 - RNA, 15 nt, Mycobacterium bovis subsp bovis AF2122/97
gugcccaggaaggcg

SEQ ID NO: 3075504 - RNA, 18 nt, Mycobacterium bovis subsp bovis AF2122/97
gugcccaggaaggcgacg

SEQ ID NO: 3075505 - RNA, 18 nt, Mycobacterium bovis subsp bovis AF2122/97
gugcccaggccaccggcu

SEQ ID NO: 3075506 - RNA, 24 nt, Mycobacterium bovis subsp bovis AF2122/97
gugcccagggcgaucugcgcgaug

SEQ ID NO: 3075507 - RNA, 15 nt, Mycobacterium bovis subsp bovis AF2122/97
gugcccaugaugcuc

SEQ ID NO: 3075508 - RNA, 15 nt, Mycobacterium bovis subsp bovis AF2122/97
gugccccgagcugcc

SEQ ID NO: 3075509 - RNA, 14 nt, Mycobacterium bovis subsp bovis AF2122/97
gugccccgcccggc

SEQ ID NO: 3075510 - RNA, 11 nt, Mycobacterium bovis subsp bovis AF2122/97
gugccccgccg

SEQ ID NO: 3075511 - RNA, 14 nt, Mycobacterium bovis subsp bovis AF2122/97
gugccccgccgagc

SEQ ID NO: 3075512 - RNA, 15 nt, Mycobacterium bovis subsp bovis AF2122/97
gugccccgccgagcg

SEQ ID NO: 3075513 - RNA, 13 nt, Mycobacterium bovis subsp bovis AF2122/97
gugccccggcgcg

SEQ ID NO: 3075514 - RNA, 20 nt, Mycobacterium bovis subsp bovis AF2122/97
gugccccggcgguaccggag

SEQ ID NO: 3075515 - RNA, 11 nt, Mycobacterium bovis subsp bovis AF2122/97
gugccccgggc

SEQ ID NO: 3075516 - RNA, 15 nt, Mycobacterium bovis subsp bovis AF2122/97
gugcccgaaggaaaa

SEQ ID NO: 3075517 - RNA, 17 nt, Mycobacterium bovis subsp bovis AF2122/97
gugcccgcacugccgcc

SEQ ID NO: 3075518 - RNA, 21 nt, Mycobacterium bovis subsp bovis AF2122/97
gugcccgcacugccgccgguu

SEQ ID NO: 3075519 - RNA, 13 nt, Mycobacterium bovis subsp bovis AF2122/97
gugcccgccaccg

SEQ ID NO: 3075520 - RNA, 16 nt, Mycobacterium bovis subsp bovis AF2122/97
gugcccgccaccggcg

SEQ ID NO: 3075521 - RNA, 18 nt, Mycobacterium bovis subsp bovis AF2122/97
gugcccgccaccggcgcg

SEQ ID NO: 3075522 - RNA, 20 nt, Mycobacterium bovis subsp bovis AF2122/97
gugcccgccagucccccgcu

SEQ ID NO: 3075523 - RNA, 23 nt, Mycobacterium bovis subsp bovis AF2122/97
gugcccgcgaacgaucccgccga

SEQ ID NO: 3075524 - RNA, 13 nt, Mycobacterium bovis subsp bovis AF2122/97
gugcccgcgcggc

SEQ ID NO: 3075525 - RNA, 21 nt, Mycobacterium bovis subsp bovis AF2122/97
gugcccgcgcggcgcauuccg

SEQ ID NO: 3075526 - RNA, 16 nt, Mycobacterium bovis subsp bovis AF2122/97
gugcccgcguugccaa

SEQ ID NO: 3075527 - RNA, 16 nt, Mycobacterium bovis subsp bovis AF2122/97
gugcccggccaaaaug

SEQ ID NO: 3075528 - RNA, 17 nt, Mycobacterium bovis subsp bovis AF2122/97
gugcccggccaaccacc

SEQ ID NO: 3075529 - RNA, 14 nt, Mycobacterium bovis subsp bovis AF2122/97
gugcccggccgcca

SEQ ID NO: 3075530 - RNA, 21 nt, Mycobacterium bovis subsp bovis AF2122/97
gugcccggccgccagcgcgcc

SEQ ID NO: 3075531 - RNA, 13 nt, Mycobacterium bovis subsp bovis AF2122/97
gugcccggcgccc

SEQ ID NO: 3075532 - RNA, 13 nt, Mycobacterium bovis subsp bovis AF2122/97
gugcccggcgcga

SEQ ID NO: 3075533 - RNA, 14 nt, Mycobacterium bovis subsp bovis AF2122/97
gugcccggcggcca

SEQ ID NO: 3075534 - RNA, 20 nt, Mycobacterium bovis subsp bovis AF2122/97
gugcccggcuccuccccggc

SEQ ID NO: 3075535 - RNA, 13 nt, Mycobacterium bovis subsp bovis AF2122/97
gugcccgggcguc

SEQ ID NO: 3075536 - RNA, 14 nt, Mycobacterium bovis subsp bovis AF2122/97
gugcccugccggca

SEQ ID NO: 3075537 - RNA, 19 nt, Mycobacterium bovis subsp bovis AF2122/97
gugcccugccggcagcggc

SEQ ID NO: 3075538 - RNA, 15 nt, Mycobacterium bovis subsp bovis AF2122/97
gugccgaaaugggcg

SEQ ID NO: 3075539 - RNA, 14 nt, Mycobacterium bovis subsp bovis AF2122/97
gugccgaacaggga

SEQ ID NO: 3075540 - RNA, 21 nt, Mycobacterium bovis subsp bovis AF2122/97
gugccgacccuacuuccucga

SEQ ID NO: 3075541 - RNA, 13 nt, Mycobacterium bovis subsp bovis AF2122/97
gugccgacggcgc

SEQ ID NO: 3075542 - RNA, 14 nt, Mycobacterium bovis subsp bovis AF2122/97
gugccgacggcgcc

SEQ ID NO: 3075543 - RNA, 14 nt, Mycobacterium bovis subsp bovis AF2122/97
gugccgacggugau

SEQ ID NO: 3075544 - RNA, 14 nt, Mycobacterium bovis subsp bovis AF2122/97
gugccgagaugccg

SEQ ID NO: 3075545 - RNA, 19 nt, Mycobacterium bovis subsp bovis AF2122/97
gugccgagaugccggcgag

SEQ ID NO: 3075546 - RNA, 20 nt, Mycobacterium bovis subsp bovis AF2122/97
gugccgagcacucggccacg

SEQ ID NO: 3075547 - RNA, 16 nt, Mycobacterium bovis subsp bovis AF2122/97
gugccgagcgugcgcu

SEQ ID NO: 3075548 - RNA, 13 nt, Mycobacterium bovis subsp bovis AF2122/97
gugccgagcuggc

SEQ ID NO: 3075549 - RNA, 14 nt, Mycobacterium bovis subsp bovis AF2122/97
gugccgagcuggcg

SEQ ID NO: 3075550 - RNA, 16 nt, Mycobacterium bovis subsp bovis AF2122/97
gugccgagcuggcgac

SEQ ID NO: 3075551 - RNA, 20 nt, Mycobacterium bovis subsp bovis AF2122/97
gugccgagcuugucgagcag

SEQ ID NO: 3075552 - RNA, 22 nt, Mycobacterium bovis subsp bovis AF2122/97
gugccgaguuccugcacgguca

SEQ ID NO: 3075553 - RNA, 14 nt, Mycobacterium bovis subsp bovis AF2122/97
gugccgaucgaugc

SEQ ID NO: 3075554 - RNA, 14 nt, Mycobacterium bovis subsp bovis AF2122/97
gugccgaugaccga

SEQ ID NO: 3075555 - RNA, 18 nt, Mycobacterium bovis subsp bovis AF2122/97
gugccgauuggccugcca

SEQ ID NO: 3075556 - RNA, 16 nt, Mycobacterium bovis subsp bovis AF2122/97
gugccgcaaccggcga

SEQ ID NO: 3075557 - RNA, 13 nt, Mycobacterium bovis subsp bovis AF2122/97
gugccgcaccgcc

SEQ ID NO: 3075558 - RNA, 17 nt, Mycobacterium bovis subsp bovis AF2122/97
gugccgcacgauggccg

SEQ ID NO: 3075559 - RNA, 20 nt, Mycobacterium bovis subsp bovis AF2122/97
gugccgcacgauggccgucg

SEQ ID NO: 3075560 - RNA, 21 nt, Mycobacterium bovis subsp bovis AF2122/97
gugccgcacgauggccgucga

SEQ ID NO: 3075561 - RNA, 12 nt, Mycobacterium bovis subsp bovis AF2122/97
gugccgcagcag

SEQ ID NO: 3075562 - RNA, 15 nt, Mycobacterium bovis subsp bovis AF2122/97
gugccgcagcagggg

SEQ ID NO: 3075563 - RNA, 18 nt, Mycobacterium bovis subsp bovis AF2122/97
gugccgguggugacggcg

SEQ ID NO: 3075564 - RNA, 13 nt, Mycobacterium bovis subsp bovis AF2122/97
gugccguacgccc

SEQ ID NO: 3075565 - RNA, 21 nt, Mycobacterium bovis subsp bovis AF2122/97
gugccgucggcgugcagcagc

SEQ ID NO: 3075566 - RNA, 22 nt, Mycobacterium bovis subsp bovis AF2122/97
gugccgucggcgugcagcagcu

SEQ ID NO: 3075567 - RNA, 17 nt, Mycobacterium bovis subsp bovis AF2122/97
gugccgugaucggcgcc

SEQ ID NO: 3075568 - RNA, 13 nt, Mycobacterium bovis subsp bovis AF2122/97
gugccguggauug

SEQ ID NO: 3075569 - RNA, 15 nt, Mycobacterium bovis subsp bovis AF2122/97
gugccguggcuaccg

SEQ ID NO: 3075570 - RNA, 16 nt, Mycobacterium bovis subsp bovis AF2122/97
gugccguguccagcau

SEQ ID NO: 3075571 - RNA, 18 nt, Mycobacterium bovis subsp bovis AF2122/97
gugccguguccagcaugc

SEQ ID NO: 3075572 - RNA, 21 nt, Mycobacterium bovis subsp bovis AF2122/97
gugccgugugcuucgagcacc

SEQ ID NO: 3075573 - RNA, 21 nt, Mycobacterium bovis subsp bovis AF2122/97
gugccguugaagcccaacagc

SEQ ID NO: 3075574 - RNA, 22 nt, Mycobacterium bovis subsp bovis AF2122/97
gugccguugcgucugcucggcg

SEQ ID NO: 3075575 - RNA, 14 nt, Mycobacterium bovis subsp bovis AF2122/97
gugccguuggagcc

SEQ ID NO: 3075576 - RNA, 19 nt, Mycobacterium bovis subsp bovis AF2122/97
gugccuacaccggcaagcc

SEQ ID NO: 3075577 - RNA, 19 nt, Mycobacterium bovis subsp bovis AF2122/97
gugccucgauuguggccag

SEQ ID NO: 3075578 - RNA, 19 nt, Mycobacterium bovis subsp bovis AF2122/97
gugccugaguuuaugcccg

SEQ ID NO: 3075579 - RNA, 17 nt, Mycobacterium bovis subsp bovis AF2122/97
gugccugcaguucggcg

SEQ ID NO: 3075580 - RNA, 20 nt, Mycobacterium bovis subsp bovis AF2122/97
gugccugccgcacguucggc

SEQ ID NO: 3075581 - RNA, 21 nt, Mycobacterium bovis subsp bovis AF2122/97
gugccugccgcacguucggcg

SEQ ID NO: 3075582 - RNA, 22 nt, Mycobacterium bovis subsp bovis AF2122/97
gugccugccgcacguucggcga

SEQ ID NO: 3075583 - RNA, 16 nt, Mycobacterium bovis subsp bovis AF2122/97
gugccugcggguggau

SEQ ID NO: 3075584 - RNA, 13 nt, Mycobacterium bovis subsp bovis AF2122/97
gugccugcgucuc

SEQ ID NO: 3075585 - RNA, 13 nt, Mycobacterium bovis subsp bovis AF2122/97
gugccuggccggu

SEQ ID NO: 3075586 - RNA, 22 nt, Mycobacterium bovis subsp bovis AF2122/97
gugccuggccggugcgcaggua

SEQ ID NO: 3075587 - RNA, 21 nt, Mycobacterium bovis subsp bovis AF2122/97
gugccugucagaaggaucagc

SEQ ID NO: 3075588 - RNA, 18 nt, Mycobacterium bovis subsp bovis AF2122/97
gugccuuccucggcaagu

SEQ ID NO: 3075589 - RNA, 22 nt, Mycobacterium bovis subsp bovis AF2122/97
gugccuucuucgcuaccuucuu

SEQ ID NO: 3075590 - RNA, 21 nt, Mycobacterium bovis subsp bovis AF2122/97
gugccuugaucugagcgcggg

SEQ ID NO: 3075591 - RNA, 19 nt, Mycobacterium bovis subsp bovis AF2122/97
gugcgaacaaguggccagc

SEQ ID NO: 3075592 - RNA, 20 nt, Mycobacterium bovis subsp bovis AF2122/97
gugcgacaacacgaccucuu

SEQ ID NO: 3075593 - RNA, 16 nt, Mycobacterium bovis subsp bovis AF2122/97
gugcgacccgggcguc

SEQ ID NO: 3075594 - RNA, 13 nt, Mycobacterium bovis subsp bovis AF2122/97
gugcgacgacggc

SEQ ID NO: 3075595 - RNA, 15 nt, Mycobacterium bovis subsp bovis AF2122/97
gugcgacgacggcgc

SEQ ID NO: 3075596 - RNA, 20 nt, Mycobacterium bovis subsp bovis AF2122/97
gugcgacgacggcgccgucg

SEQ ID NO: 3075597 - RNA, 14 nt, Mycobacterium bovis subsp bovis AF2122/97
gugcgacgcgaccg

SEQ ID NO: 3075598 - RNA, 20 nt, Mycobacterium bovis subsp bovis AF2122/97
gugcgacucugcgucugcuc

SEQ ID NO: 3075599 - RNA, 15 nt, Mycobacterium bovis subsp bovis AF2122/97
gugcgagcgacaccg

SEQ ID NO: 3075600 - RNA, 15 nt, Mycobacterium bovis subsp bovis AF2122/97
gugcgagggcacggc

SEQ ID NO: 3075601 - RNA, 23 nt, Mycobacterium bovis subsp bovis AF2122/97
gugcgaguaacccguccggugga

SEQ ID NO: 3075602 - RNA, 19 nt, Mycobacterium bovis subsp bovis AF2122/97
gugcgauccagggccgacg

SEQ ID NO: 3075603 - RNA, 22 nt, Mycobacterium bovis subsp bovis AF2122/97
gugcgauccagggccgacgcga

SEQ ID NO: 3075604 - RNA, 22 nt, Mycobacterium bovis subsp bovis AF2122/97
gugcgaucgcaacaccgguguc

SEQ ID NO: 3075605 - RNA, 19 nt, Mycobacterium bovis subsp bovis AF2122/97
gugcgauuccgcgucugcu

SEQ ID NO: 3075606 - RNA, 19 nt, Mycobacterium bovis subsp bovis AF2122/97
gugcgauucugcgucugcu

SEQ ID NO: 3075607 - RNA, 20 nt, Mycobacterium bovis subsp bovis AF2122/97
gugcgauucugcgucugcuc

SEQ ID NO: 3075608 - RNA, 20 nt, Mycobacterium bovis subsp bovis AF2122/97
gugcgauuuugugucugcuc

SEQ ID NO: 3075609 - RNA, 15 nt, Mycobacterium bovis subsp bovis AF2122/97
gugcgcaacccagcc

SEQ ID NO: 3075610 - RNA, 19 nt, Mycobacterium bovis subsp bovis AF2122/97
gugcgcaacccagccgcgc

SEQ ID NO: 3075611 - RNA, 13 nt, Mycobacterium bovis subsp bovis AF2122/97
gugcgcaccaccg

SEQ ID NO: 3075612 - RNA, 16 nt, Mycobacterium bovis subsp bovis AF2122/97
gugcgcaccaccgagc

SEQ ID NO: 3075613 - RNA, 15 nt, Mycobacterium bovis subsp bovis AF2122/97
gugcgcaccagagug

SEQ ID NO: 3075614 - RNA, 13 nt, Mycobacterium bovis subsp bovis AF2122/97
gugcgcaccagca

SEQ ID NO: 3075615 - RNA, 20 nt, Mycobacterium bovis subsp bovis AF2122/97
gugcgcaccagcacacccgu

SEQ ID NO: 3075616 - RNA, 13 nt, Mycobacterium bovis subsp bovis AF2122/97
gugcgcaccccgc

SEQ ID NO: 3075617 - RNA, 22 nt, Mycobacterium bovis subsp bovis AF2122/97
gugcgcaccccgcuugcgcggc

SEQ ID NO: 3075618 - RNA, 23 nt, Mycobacterium bovis subsp bovis AF2122/97
gugcgcacugaggcucaggugcu

SEQ ID NO: 3075619 - RNA, 14 nt, Mycobacterium bovis subsp bovis AF2122/97
gugcgcagaacacc

SEQ ID NO: 3075620 - RNA, 20 nt, Mycobacterium bovis subsp bovis AF2122/97
gugcgcagaacaccaccgcc

SEQ ID NO: 3075621 - RNA, 21 nt, Mycobacterium bovis subsp bovis AF2122/97
gugcgcagaacaccaccgcca

SEQ ID NO: 3075622 - RNA, 22 nt, Mycobacterium bovis subsp bovis AF2122/97
gugcgcagaacaccaccgccag

SEQ ID NO: 3075623 - RNA, 22 nt, Mycobacterium bovis subsp bovis AF2122/97
gugcgcagacaucggagaucau

SEQ ID NO: 3075624 - RNA, 14 nt, Mycobacterium bovis subsp bovis AF2122/97
gugcgcagggccug

SEQ ID NO: 3075625 - RNA, 12 nt, Mycobacterium bovis subsp bovis AF2122/97
gugcgcagguac

SEQ ID NO: 3075626 - RNA, 21 nt, Mycobacterium bovis subsp bovis AF2122/97
gugcgcauccgucguacacgc

SEQ ID NO: 3075627 - RNA, 16 nt, Mycobacterium bovis subsp bovis AF2122/97
gugcgccacgccaccg

SEQ ID NO: 3075628 - RNA, 21 nt, Mycobacterium bovis subsp bovis AF2122/97
gugcgccagcgauaucggcgg

SEQ ID NO: 3075629 - RNA, 23 nt, Mycobacterium bovis subsp bovis AF2122/97
gugcgccagcgauaucggcggcu

SEQ ID NO: 3075630 - RNA, 21 nt, Mycobacterium bovis subsp bovis AF2122/97
gugcgccauucccgguggcug

SEQ ID NO: 3075631 - RNA, 17 nt, Mycobacterium bovis subsp bovis AF2122/97
gugcgcccaggugaucg

SEQ ID NO: 3075632 - RNA, 14 nt, Mycobacterium bovis subsp bovis AF2122/97
gugcgcccgccggc

SEQ ID NO: 3075633 - RNA, 19 nt, Mycobacterium bovis subsp bovis AF2122/97
gugcgcccggccaagccgg

SEQ ID NO: 3075634 - RNA, 23 nt, Mycobacterium bovis subsp bovis AF2122/97
gugcgcccggccaagccggcgag

SEQ ID NO: 3075635 - RNA, 13 nt, Mycobacterium bovis subsp bovis AF2122/97
gugcgccgcagcc

SEQ ID NO: 3075636 - RNA, 19 nt, Mycobacterium bovis subsp bovis AF2122/97
gugcgccggcuggcggccu

SEQ ID NO: 3075637 - RNA, 13 nt, Mycobacterium bovis subsp bovis AF2122/97
gugcgccgguccu

SEQ ID NO: 3075638 - RNA, 14 nt, Mycobacterium bovis subsp bovis AF2122/97
gugcgccgguccuc

SEQ ID NO: 3075639 - RNA, 16 nt, Mycobacterium bovis subsp bovis AF2122/97
gugcgccgucagccca

SEQ ID NO: 3075640 - RNA, 17 nt, Mycobacterium bovis subsp bovis AF2122/97
gugcgcgaccacccgcc

SEQ ID NO: 3075641 - RNA, 16 nt, Mycobacterium bovis subsp bovis AF2122/97
gugcgcgaggucggcg

SEQ ID NO: 3075642 - RNA, 22 nt, Mycobacterium bovis subsp bovis AF2122/97
gugcgcgcgaccauacccgcgc

SEQ ID NO: 3075643 - RNA, 12 nt, Mycobacterium bovis subsp bovis AF2122/97
gugcgcgcggcg

SEQ ID NO: 3075644 - RNA, 15 nt, Mycobacterium bovis subsp bovis AF2122/97
gugcgcgcggcgacc

SEQ ID NO: 3075645 - RNA, 23 nt, Mycobacterium bovis subsp bovis AF2122/97
gugcgcggcaauugcgguucgaa

SEQ ID NO: 3075646 - RNA, 14 nt, Mycobacterium bovis subsp bovis AF2122/97
gugcgcggccggca

SEQ ID NO: 3075647 - RNA, 13 nt, Mycobacterium bovis subsp bovis AF2122/97
gugcgcgucgcgc

SEQ ID NO: 3075648 - RNA, 21 nt, Mycobacterium bovis subsp bovis AF2122/97
gugcgcucgcgguagcgccgu

SEQ ID NO: 3075649 - RNA, 20 nt, Mycobacterium bovis subsp bovis AF2122/97
gugcgcugggugaugagcgc

SEQ ID NO: 3075650 - RNA, 22 nt, Mycobacterium bovis subsp bovis AF2122/97
gugcgcuuggucgaccgccgag

SEQ ID NO: 3075651 - RNA, 19 nt, Mycobacterium bovis subsp bovis AF2122/97
gugcggaaaccgcuggggg

SEQ ID NO: 3075652 - RNA, 14 nt, Mycobacterium bovis subsp bovis AF2122/97
gugcggaacaccgc

SEQ ID NO: 3075653 - RNA, 15 nt, Mycobacterium bovis subsp bovis AF2122/97
gugcggaacaccgcc

SEQ ID NO: 3075654 - RNA, 18 nt, Mycobacterium bovis subsp bovis AF2122/97
gugcggaacaccgcccgg

SEQ ID NO: 3075655 - RNA, 19 nt, Mycobacterium bovis subsp bovis AF2122/97
gugcggaacaccgcccggc

SEQ ID NO: 3075656 - RNA, 20 nt, Mycobacterium bovis subsp bovis AF2122/97
gugcggaacaccgcccggcc

SEQ ID NO: 3075657 - RNA, 17 nt, Mycobacterium bovis subsp bovis AF2122/97
gugcggaaccugcucgg

SEQ ID NO: 3075658 - RNA, 22 nt, Mycobacterium bovis subsp bovis AF2122/97
gugcggaacgauggacgcccag

SEQ ID NO: 3075659 - RNA, 16 nt, Mycobacterium bovis subsp bovis AF2122/97
gugcggaacggccagg

SEQ ID NO: 3075660 - RNA, 20 nt, Mycobacterium bovis subsp bovis AF2122/97
gugcggaagcaucggcugcg

SEQ ID NO: 3075661 - RNA, 19 nt, Mycobacterium bovis subsp bovis AF2122/97
gugcggaauggucagguuc

SEQ ID NO: 3075662 - RNA, 22 nt, Mycobacterium bovis subsp bovis AF2122/97
gugcggaucacucccccacaca

SEQ ID NO: 3075663 - RNA, 18 nt, Mycobacterium bovis subsp bovis AF2122/97
gugcggaucagaggaccc

SEQ ID NO: 3075664 - RNA, 16 nt, Mycobacterium bovis subsp bovis AF2122/97
gugcggcaacagcgcc

SEQ ID NO: 3075665 - RNA, 13 nt, Mycobacterium bovis subsp bovis AF2122/97
gugcggcagcccg

SEQ ID NO: 3075666 - RNA, 14 nt, Mycobacterium bovis subsp bovis AF2122/97
gugcggcagcccgc

SEQ ID NO: 3075667 - RNA, 17 nt, Mycobacterium bovis subsp bovis AF2122/97
gugcggcauugguaccg

SEQ ID NO: 3075668 - RNA, 20 nt, Mycobacterium bovis subsp bovis AF2122/97
gugcggccaaugacgucgga

SEQ ID NO: 3075669 - RNA, 17 nt, Mycobacterium bovis subsp bovis AF2122/97
gugcggccacucgcccg

SEQ ID NO: 3075670 - RNA, 14 nt, Mycobacterium bovis subsp bovis AF2122/97
gugcggccaggcgg

SEQ ID NO: 3075671 - RNA, 14 nt, Mycobacterium bovis subsp bovis AF2122/97
gugcggcccaaccg

SEQ ID NO: 3075672 - RNA, 12 nt, Mycobacterium bovis subsp bovis AF2122/97
gugcggccgggg

SEQ ID NO: 3075673 - RNA, 20 nt, Mycobacterium bovis subsp bovis AF2122/97
gugcggccgggucgcgcugg

SEQ ID NO: 3075674 - RNA, 21 nt, Mycobacterium bovis subsp bovis AF2122/97
gugcggccguggcguggcuug

SEQ ID NO: 3075675 - RNA, 21 nt, Mycobacterium bovis subsp bovis AF2122/97
gugcggccuuggcgacgucgc

SEQ ID NO: 3075676 - RNA, 17 nt, Mycobacterium bovis subsp bovis AF2122/97
gugcggcgaagguagua

SEQ ID NO: 3075677 - RNA, 15 nt, Mycobacterium bovis subsp bovis AF2122/97
gugcggcgcaugcaa

SEQ ID NO: 3075678 - RNA, 11 nt, Mycobacterium bovis subsp bovis AF2122/97
gugcggcggca

SEQ ID NO: 3075679 - RNA, 16 nt, Mycobacterium bovis subsp bovis AF2122/97
gugcggcggcguccgg

SEQ ID NO: 3075680 - RNA, 12 nt, Mycobacterium bovis subsp bovis AF2122/97
gugcggcggcug

SEQ ID NO: 3075681 - RNA, 13 nt, Mycobacterium bovis subsp bovis AF2122/97
gugcggcggcugc

SEQ ID NO: 3075682 - RNA, 14 nt, Mycobacterium bovis subsp bovis AF2122/97
gugcggcggcugcc

SEQ ID NO: 3075683 - RNA, 18 nt, Mycobacterium bovis subsp bovis AF2122/97
gugcggcguuguggcgug

SEQ ID NO: 3075684 - RNA, 18 nt, Mycobacterium bovis subsp bovis AF2122/97
gugcggcucgccggcggc

SEQ ID NO: 3075685 - RNA, 22 nt, Mycobacterium bovis subsp bovis AF2122/97
gugcgggaagaacaucaccucg

SEQ ID NO: 3075686 - RNA, 15 nt, Mycobacterium bovis subsp bovis AF2122/97
gugcgggacgccgaa

SEQ ID NO: 3075687 - RNA, 23 nt, Mycobacterium bovis subsp bovis AF2122/97
gugcgggagacguaaccgcuggc

SEQ ID NO: 3075688 - RNA, 18 nt, Mycobacterium bovis subsp bovis AF2122/97
gugcgggcaugccggcga

SEQ ID NO: 3075689 - RNA, 14 nt, Mycobacterium bovis subsp bovis AF2122/97
gugcgggcggcguc

SEQ ID NO: 3075690 - RNA, 12 nt, Mycobacterium bovis subsp bovis AF2122/97
gugcgggcggug

SEQ ID NO: 3075691 - RNA, 15 nt, Mycobacterium bovis subsp bovis AF2122/97
gugcggggccggucg

SEQ ID NO: 3075692 - RNA, 17 nt, Mycobacterium bovis subsp bovis AF2122/97
gugcggggccggucggg

SEQ ID NO: 3075693 - RNA, 16 nt, Mycobacterium bovis subsp bovis AF2122/97
gugcgggggcgaccug

SEQ ID NO: 3075694 - RNA, 19 nt, Mycobacterium bovis subsp bovis AF2122/97
gugcgggggcgaccuggug

SEQ ID NO: 3075695 - RNA, 15 nt, Mycobacterium bovis subsp bovis AF2122/97
gugcgggguugggcg

SEQ ID NO: 3075696 - RNA, 18 nt, Mycobacterium bovis subsp bovis AF2122/97
gugcggguaauacggcgc

SEQ ID NO: 3075697 - RNA, 21 nt, Mycobacterium bovis subsp bovis AF2122/97
gugcgggugggcacaccggug

SEQ ID NO: 3075698 - RNA, 18 nt, Mycobacterium bovis subsp bovis AF2122/97
gugcggguucacugccgg

SEQ ID NO: 3075699 - RNA, 18 nt, Mycobacterium bovis subsp bovis AF2122/97
gugcgguaucggucagcc

SEQ ID NO: 3075700 - RNA, 19 nt, Mycobacterium bovis subsp bovis AF2122/97
gugcgguaucggucagcca

SEQ ID NO: 3075701 - RNA, 20 nt, Mycobacterium bovis subsp bovis AF2122/97
gugcgguauuugaacgcccg

SEQ ID NO: 3075702 - RNA, 14 nt, Mycobacterium bovis subsp bovis AF2122/97
gugcggucaaagga

SEQ ID NO: 3075703 - RNA, 23 nt, Mycobacterium bovis subsp bovis AF2122/97
gugcggucauauaggagcgggug

SEQ ID NO: 3075704 - RNA, 18 nt, Mycobacterium bovis subsp bovis AF2122/97
gugcggucucacucaucg

SEQ ID NO: 3075705 - RNA, 14 nt, Mycobacterium bovis subsp bovis AF2122/97
gugcggucuccgcc

SEQ ID NO: 3075706 - RNA, 16 nt, Mycobacterium bovis subsp bovis AF2122/97
gugcggugaccgugaa

SEQ ID NO: 3075707 - RNA, 16 nt, Mycobacterium bovis subsp bovis AF2122/97
gugcggugagauggcg

SEQ ID NO: 3075708 - RNA, 18 nt, Mycobacterium bovis subsp bovis AF2122/97
gugcggugccguggugga

SEQ ID NO: 3075709 - RNA, 13 nt, Mycobacterium bovis subsp bovis AF2122/97
gugcgguggcagg

SEQ ID NO: 3075710 - RNA, 14 nt, Mycobacterium bovis subsp bovis AF2122/97
gugcggugucacaa

SEQ ID NO: 3075711 - RNA, 17 nt, Mycobacterium bovis subsp bovis AF2122/97
gugcggugucacaacgc

SEQ ID NO: 3075712 - RNA, 22 nt, Mycobacterium bovis subsp bovis AF2122/97
gugcgguucucguagucaacca

SEQ ID NO: 3075713 - RNA, 15 nt, Mycobacterium bovis subsp bovis AF2122/97
gugcgguugcgcgga

SEQ ID NO: 3075714 - RNA, 17 nt, Mycobacterium bovis subsp bovis AF2122/97
gugcgguuggaucggcg

SEQ ID NO: 3075715 - RNA, 22 nt, Mycobacterium bovis subsp bovis AF2122/97
gugcguacugguccgcacgguu

SEQ ID NO: 3075716 - RNA, 13 nt, Mycobacterium bovis subsp bovis AF2122/97
gugcgucacagcc

SEQ ID NO: 3075717 - RNA, 15 nt, Mycobacterium bovis subsp bovis AF2122/97
gugcguccaggccag

SEQ ID NO: 3075718 - RNA, 13 nt, Mycobacterium bovis subsp bovis AF2122/97
gugcguccgcaac

SEQ ID NO: 3075719 - RNA, 15 nt, Mycobacterium bovis subsp bovis AF2122/97
gugcguccgcaacag

SEQ ID NO: 3075720 - RNA, 14 nt, Mycobacterium bovis subsp bovis AF2122/97
gugcguccggugcu

SEQ ID NO: 3075721 - RNA, 14 nt, Mycobacterium bovis subsp bovis AF2122/97
gugcgucgaugagc

SEQ ID NO: 3075722 - RNA, 13 nt, Mycobacterium bovis subsp bovis AF2122/97
gugcgucgcggaa

SEQ ID NO: 3075723 - RNA, 22 nt, Mycobacterium bovis subsp bovis AF2122/97
gugcgucugggcaucaucgacg

SEQ ID NO: 3075724 - RNA, 23 nt, Mycobacterium bovis subsp bovis AF2122/97
gugcgugcggucgauccggccag

SEQ ID NO: 3075725 - RNA, 14 nt, Mycobacterium bovis subsp bovis AF2122/97
gugcguuggaugaa

SEQ ID NO: 3075726 - RNA, 17 nt, Mycobacterium bovis subsp bovis AF2122/97
gugcguuggaugaaguc

SEQ ID NO: 3075727 - RNA, 14 nt, Mycobacterium bovis subsp bovis AF2122/97
gugcguugucggcu

SEQ ID NO: 3075728 - RNA, 15 nt, Mycobacterium bovis subsp bovis AF2122/97
gugcguugucggcug

SEQ ID NO: 3075729 - RNA, 21 nt, Mycobacterium bovis subsp bovis AF2122/97
gugcuacccauucggcggcgg

SEQ ID NO: 3075730 - RNA, 20 nt, Mycobacterium bovis subsp bovis AF2122/97
gugcuaccggcuuggcggga

SEQ ID NO: 3075731 - RNA, 15 nt, Mycobacterium bovis subsp bovis AF2122/97
gugcuagcgccgcca

SEQ ID NO: 3075732 - RNA, 22 nt, Mycobacterium bovis subsp bovis AF2122/97
gugcuaugcaacaccgcaccgg

SEQ ID NO: 3075733 - RNA, 19 nt, Mycobacterium bovis subsp bovis AF2122/97
gugcuaugcguccaggcga

SEQ ID NO: 3075734 - RNA, 16 nt, Mycobacterium bovis subsp bovis AF2122/97
gugcucaaggcuucgg

SEQ ID NO: 3075735 - RNA, 13 nt, Mycobacterium bovis subsp bovis AF2122/97
gugcucaccggcg

SEQ ID NO: 3075736 - RNA, 14 nt, Mycobacterium bovis subsp bovis AF2122/97
guggaccgccgauc

SEQ ID NO: 3075737 - RNA, 14 nt, Mycobacterium bovis subsp bovis AF2122/97
guggaccggccugg

SEQ ID NO: 3075738 - RNA, 16 nt, Mycobacterium bovis subsp bovis AF2122/97
guggaccggcuccggu

SEQ ID NO: 3075739 - RNA, 21 nt, Mycobacterium bovis subsp bovis AF2122/97
guggaccggcuccgguaggcg

SEQ ID NO: 3075740 - RNA, 22 nt, Mycobacterium bovis subsp bovis AF2122/97
guggaccggcuccgguaggcga

SEQ ID NO: 3075741 - RNA, 16 nt, Mycobacterium bovis subsp bovis AF2122/97
guggacgaucaacccg

SEQ ID NO: 3075742 - RNA, 15 nt, Mycobacterium bovis subsp bovis AF2122/97
guggacgaucuggca

SEQ ID NO: 3075743 - RNA, 20 nt, Mycobacterium bovis subsp bovis AF2122/97
guggacgaucuggcagccga

SEQ ID NO: 3075744 - RNA, 20 nt, Mycobacterium bovis subsp bovis AF2122/97
guggacgcagagucaacaga

SEQ ID NO: 3075745 - RNA, 22 nt, Mycobacterium bovis subsp bovis AF2122/97
guggacggcauagcagccagcg

SEQ ID NO: 3075746 - RNA, 19 nt, Mycobacterium bovis subsp bovis AF2122/97
guggacguacugucgucgc

SEQ ID NO: 3075747 - RNA, 17 nt, Mycobacterium bovis subsp bovis AF2122/97
guggacgugucaucacg

SEQ ID NO: 3075748 - RNA, 16 nt, Mycobacterium bovis subsp bovis AF2122/97
guggacucgggcgcug

SEQ ID NO: 3075749 - RNA, 19 nt, Mycobacterium bovis subsp bovis AF2122/97
guggacucgggcgcugaug

SEQ ID NO: 3075750 - RNA, 22 nt, Mycobacterium bovis subsp bovis AF2122/97
guggacucgggcgcugaugcgc

SEQ ID NO: 3075751 - RNA, 22 nt, Mycobacterium bovis subsp bovis AF2122/97
guggacuucagcaggcccagcg

SEQ ID NO: 3075752 - RNA, 16 nt, Mycobacterium bovis subsp bovis AF2122/97
guggagccggccguga

SEQ ID NO: 3075753 - RNA, 16 nt, Mycobacterium bovis subsp bovis AF2122/97
guggagcgcgccucgc

SEQ ID NO: 3075754 - RNA, 18 nt, Mycobacterium bovis subsp bovis AF2122/97
guggaggaaucguucggg

SEQ ID NO: 3075755 - RNA, 18 nt, Mycobacterium bovis subsp bovis AF2122/97
guggaguacggcgaugcg

SEQ ID NO: 3075756 - RNA, 20 nt, Mycobacterium bovis subsp bovis AF2122/97
guggaguuuccgaagcccgg

SEQ ID NO: 3075757 - RNA, 21 nt, Mycobacterium bovis subsp bovis AF2122/97
guggaguuuccgaagcccggg

SEQ ID NO: 3075758 - RNA, 22 nt, Mycobacterium bovis subsp bovis AF2122/97
guggaucaucccgaccagcaga

SEQ ID NO: 3075759 - RNA, 18 nt, Mycobacterium bovis subsp bovis AF2122/97
guggaucauguucggcca

SEQ ID NO: 3075760 - RNA, 23 nt, Mycobacterium bovis subsp bovis AF2122/97
guggaucauguucggccaccaga

SEQ ID NO: 3075761 - RNA, 18 nt, Mycobacterium bovis subsp bovis AF2122/97
guggauccggcagcagcc

SEQ ID NO: 3075762 - RNA, 18 nt, Mycobacterium bovis subsp bovis AF2122/97
guggaucuggcgcagcau

SEQ ID NO: 3075763 - RNA, 16 nt, Mycobacterium bovis subsp bovis AF2122/97
guggaugaacaccuca

SEQ ID NO: 3075764 - RNA, 15 nt, Mycobacterium bovis subsp bovis AF2122/97
guggaugagccgguc

SEQ ID NO: 3075765 - RNA, 17 nt, Mycobacterium bovis subsp bovis AF2122/97
guggaugcccgguuucu

SEQ ID NO: 3075766 - RNA, 19 nt, Mycobacterium bovis subsp bovis AF2122/97
guggaugccgacggcgggc

SEQ ID NO: 3075767 - RNA, 23 nt, Mycobacterium bovis subsp bovis AF2122/97
guggaugcgccgcacggcgacgc

SEQ ID NO: 3075768 - RNA, 15 nt, Mycobacterium bovis subsp bovis AF2122/97
guggaugucgcgguc

SEQ ID NO: 3075769 - RNA, 15 nt, Mycobacterium bovis subsp bovis AF2122/97
guggaugugugaguc

SEQ ID NO: 3075770 - RNA, 21 nt, Mycobacterium bovis subsp bovis AF2122/97
guggauucgaucaggccuugg

SEQ ID NO: 3075771 - RNA, 15 nt, Mycobacterium bovis subsp bovis AF2122/97
guggcaaccgcaccg

SEQ ID NO: 3075772 - RNA, 23 nt, Mycobacterium bovis subsp bovis AF2122/97
guggcaacggaggugccggcgcc

SEQ ID NO: 3075773 - RNA, 15 nt, Mycobacterium bovis subsp bovis AF2122/97
guggcaaucccgcca

SEQ ID NO: 3075774 - RNA, 14 nt, Mycobacterium bovis subsp bovis AF2122/97
guggcaaucgagga

SEQ ID NO: 3075775 - RNA, 14 nt, Mycobacterium bovis subsp bovis AF2122/97
guggcacaagcugg

SEQ ID NO: 3075776 - RNA, 18 nt, Mycobacterium bovis subsp bovis AF2122/97
guggcacccgcgucgagu

SEQ ID NO: 3075777 - RNA, 22 nt, Mycobacterium bovis subsp bovis AF2122/97
guggcacccggcugaaacgucc

SEQ ID NO: 3075778 - RNA, 16 nt, Mycobacterium bovis subsp bovis AF2122/97
guggcaccggcggcga

SEQ ID NO: 3075779 - RNA, 19 nt, Mycobacterium bovis subsp bovis AF2122/97
guggcaccggcggcgacgg

SEQ ID NO: 3075780 - RNA, 12 nt, Mycobacterium bovis subsp bovis AF2122/97
guggcagccagc

SEQ ID NO: 3075781 - RNA, 16 nt, Mycobacterium bovis subsp bovis AF2122/97
guggcagccagcggcg

SEQ ID NO: 3075782 - RNA, 17 nt, Mycobacterium bovis subsp bovis AF2122/97
guggcagcccgucggac

SEQ ID NO: 3075783 - RNA, 14 nt, Mycobacterium bovis subsp bovis AF2122/97
guggcagccugcug

SEQ ID NO: 3075784 - RNA, 15 nt, Mycobacterium bovis subsp bovis AF2122/97
guggcagccugcugc

SEQ ID NO: 3075785 - RNA, 18 nt, Mycobacterium bovis subsp bovis AF2122/97
guggcagccugcugcaca

SEQ ID NO: 3075786 - RNA, 21 nt, Mycobacterium bovis subsp bovis AF2122/97
guggcagccugcugcacaucg

SEQ ID NO: 3075787 - RNA, 15 nt, Mycobacterium bovis subsp bovis AF2122/97
guggcagcgcacccg

SEQ ID NO: 3075788 - RNA, 17 nt, Mycobacterium bovis subsp bovis AF2122/97
guggcagcgcacccggu

SEQ ID NO: 3075789 - RNA, 18 nt, Mycobacterium bovis subsp bovis AF2122/97
guggcaggugaucccgau

SEQ ID NO: 3075790 - RNA, 17 nt, Mycobacterium bovis subsp bovis AF2122/97
guggcaguacaccggcg

SEQ ID NO: 3075791 - RNA, 19 nt, Mycobacterium bovis subsp bovis AF2122/97
guggcaguacaccggcgug

SEQ ID NO: 3075792 - RNA, 16 nt, Mycobacterium bovis subsp bovis AF2122/97
guggcauaaccgcuga

SEQ ID NO: 3075793 - RNA, 16 nt, Mycobacterium bovis subsp bovis AF2122/97
guggcauccagcagcg

SEQ ID NO: 3075794 - RNA, 13 nt, Mycobacterium bovis subsp bovis AF2122/97
guggcaugcgaca

SEQ ID NO: 3075795 - RNA, 20 nt, Mycobacterium bovis subsp bovis AF2122/97
guggccaacaccgccagcau

SEQ ID NO: 3075796 - RNA, 16 nt, Mycobacterium bovis subsp bovis AF2122/97
guggccaaccaaccgg

SEQ ID NO: 3075797 - RNA, 19 nt, Mycobacterium bovis subsp bovis AF2122/97
guggccaauccggcggcga

SEQ ID NO: 3075798 - RNA, 21 nt, Mycobacterium bovis subsp bovis AF2122/97
guggccaauccggcggcgacg

SEQ ID NO: 3075799 - RNA, 22 nt, Mycobacterium bovis subsp bovis AF2122/97
guggccaauccggcggcgacgu

SEQ ID NO: 3075800 - RNA, 23 nt, Mycobacterium bovis subsp bovis AF2122/97
guggccaccaccgugaagcccug

SEQ ID NO: 3075801 - RNA, 22 nt, Mycobacterium bovis subsp bovis AF2122/97
guggccagaucgaacgcagcca

SEQ ID NO: 3075802 - RNA, 12 nt, Mycobacterium bovis subsp bovis AF2122/97
guggccagcacg

SEQ ID NO: 3075803 - RNA, 18 nt, Mycobacterium bovis subsp bovis AF2122/97
guggccagcaggcggcug

SEQ ID NO: 3075804 - RNA, 20 nt, Mycobacterium bovis subsp bovis AF2122/97
guggccagcaggcggcugaa

SEQ ID NO: 3075805 - RNA, 15 nt, Mycobacterium bovis subsp bovis AF2122/97
guggccagcccgccc

SEQ ID NO: 3075806 - RNA, 18 nt, Mycobacterium bovis subsp bovis AF2122/97
guggccagcgcggcgagg

SEQ ID NO: 3075807 - RNA, 14 nt, Mycobacterium bovis subsp bovis AF2122/97
guggccagcgcuug

SEQ ID NO: 3075808 - RNA, 16 nt, Mycobacterium bovis subsp bovis AF2122/97
guggccagcgcuugug

SEQ ID NO: 3075809 - RNA, 17 nt, Mycobacterium bovis subsp bovis AF2122/97
guggccagcgucgcgau

SEQ ID NO: 3075810 - RNA, 20 nt, Mycobacterium bovis subsp bovis AF2122/97
guggccaucgaucccuuguc

SEQ ID NO: 3075811 - RNA, 17 nt, Mycobacterium bovis subsp bovis AF2122/97
guggcccaacaccgcca

SEQ ID NO: 3075812 - RNA, 22 nt, Mycobacterium bovis subsp bovis AF2122/97
guggcccaacccgguucggaug

SEQ ID NO: 3075813 - RNA, 22 nt, Mycobacterium bovis subsp bovis AF2122/97
guggcccacauguccagcgucc

SEQ ID NO: 3075814 - RNA, 14 nt, Mycobacterium bovis subsp bovis AF2122/97
guggcccccgccgg

SEQ ID NO: 3075815 - RNA, 19 nt, Mycobacterium bovis subsp bovis AF2122/97
guggcccgaccgggaacca

SEQ ID NO: 3075816 - RNA, 14 nt, Mycobacterium bovis subsp bovis AF2122/97
guggcccgcgggca

SEQ ID NO: 3075817 - RNA, 13 nt, Mycobacterium bovis subsp bovis AF2122/97
guggcccgcggug

SEQ ID NO: 3075818 - RNA, 14 nt, Mycobacterium bovis subsp bovis AF2122/97
guggcccgcgguga

SEQ ID NO: 3075819 - RNA, 18 nt, Mycobacterium bovis subsp bovis AF2122/97
guggcccgcucccugcac

SEQ ID NO: 3075820 - RNA, 16 nt, Mycobacterium bovis subsp bovis AF2122/97
guggcccgggccaccg

SEQ ID NO: 3075821 - RNA, 17 nt, Mycobacterium bovis subsp bovis AF2122/97
guggcccguagcgucga

SEQ ID NO: 3075822 - RNA, 18 nt, Mycobacterium bovis subsp bovis AF2122/97
guggcgguggccgucggg

SEQ ID NO: 3075823 - RNA, 15 nt, Mycobacterium bovis subsp bovis AF2122/97
guggcguaucgggcc

SEQ ID NO: 3075824 - RNA, 14 nt, Mycobacterium bovis subsp bovis AF2122/97
guggcgucaccgcc

SEQ ID NO: 3075825 - RNA, 13 nt, Mycobacterium bovis subsp bovis AF2122/97
guggcgucgcucg

SEQ ID NO: 3075826 - RNA, 19 nt, Mycobacterium bovis subsp bovis AF2122/97
guggcgugcgcguccagau

SEQ ID NO: 3075827 - RNA, 21 nt, Mycobacterium bovis subsp bovis AF2122/97
guggcguuacgcucggcgaac

SEQ ID NO: 3075828 - RNA, 18 nt, Mycobacterium bovis subsp bovis AF2122/97
guggcuacgcgaucagcu

SEQ ID NO: 3075829 - RNA, 18 nt, Mycobacterium bovis subsp bovis AF2122/97
guggcuauuccgacucga

SEQ ID NO: 3075830 - RNA, 20 nt, Mycobacterium bovis subsp bovis AF2122/97
guggcuauuccgacucgagu

SEQ ID NO: 3075831 - RNA, 14 nt, Mycobacterium bovis subsp bovis AF2122/97
guggcucggguggu

SEQ ID NO: 3075832 - RNA, 20 nt, Mycobacterium bovis subsp bovis AF2122/97
guggcugaacaccgcgggca

SEQ ID NO: 3075833 - RNA, 13 nt, Mycobacterium bovis subsp bovis AF2122/97
guggcugaucccg

SEQ ID NO: 3075834 - RNA, 16 nt, Mycobacterium bovis subsp bovis AF2122/97
guggcugcgcucgccc

SEQ ID NO: 3075835 - RNA, 14 nt, Mycobacterium bovis subsp bovis AF2122/97
guggcugcuggcgc

SEQ ID NO: 3075836 - RNA, 21 nt, Mycobacterium bovis subsp bovis AF2122/97
guggcuggacccgcauggcgc

SEQ ID NO: 3075837 - RNA, 16 nt, Mycobacterium bovis subsp bovis AF2122/97
guggcuggcaugccgg

SEQ ID NO: 3075838 - RNA, 14 nt, Mycobacterium bovis subsp bovis AF2122/97
guggcuggcggcga

SEQ ID NO: 3075839 - RNA, 20 nt, Mycobacterium bovis subsp bovis AF2122/97
guggcuuaagucuggaguga

SEQ ID NO: 3075840 - RNA, 14 nt, Mycobacterium bovis subsp bovis AF2122/97
guggcuucaacccg

SEQ ID NO: 3075841 - RNA, 22 nt, Mycobacterium bovis subsp bovis AF2122/97
guggcuucaacccgggcagcau

SEQ ID NO: 3075842 - RNA, 15 nt, Mycobacterium bovis subsp bovis AF2122/97
guggcuucacccaac

SEQ ID NO: 3075843 - RNA, 18 nt, Mycobacterium bovis subsp bovis AF2122/97
guggcuugccccgccgua

SEQ ID NO: 3075844 - RNA, 18 nt, Mycobacterium bovis subsp bovis AF2122/97
guggcuugcgucgcggac

SEQ ID NO: 3075845 - RNA, 23 nt, Mycobacterium bovis subsp bovis AF2122/97
guggcuugcgucgcggacggugc

SEQ ID NO: 3075846 - RNA, 21 nt, Mycobacterium bovis subsp bovis AF2122/97
guggcuugguggucgccaccc

SEQ ID NO: 3075847 - RNA, 19 nt, Mycobacterium bovis subsp bovis AF2122/97
guggcuuuugcgucugcuc

SEQ ID NO: 3075848 - RNA, 20 nt, Mycobacterium bovis subsp bovis AF2122/97
guggcuuuugcgucugcucg

SEQ ID NO: 3075849 - RNA, 22 nt, Mycobacterium bovis subsp bovis AF2122/97
guggcuuuugcgucugcucgcg

SEQ ID NO: 3075850 - RNA, 22 nt, Mycobacterium bovis subsp bovis AF2122/97
gugggaacuggaccacagccgc

SEQ ID NO: 3075851 - RNA, 18 nt, Mycobacterium bovis subsp bovis AF2122/97
gugggacaaagacgccgu

SEQ ID NO: 3075852 - RNA, 23 nt, Mycobacterium bovis subsp bovis AF2122/97
gugggacaaagacgccgucggcg

SEQ ID NO: 3075853 - RNA, 22 nt, Mycobacterium bovis subsp bovis AF2122/97
gugggacaccaucuccgccguc

SEQ ID NO: 3075854 - RNA, 16 nt, Mycobacterium bovis subsp bovis AF2122/97
gugggacgcggccgag

SEQ ID NO: 3075855 - RNA, 18 nt, Mycobacterium bovis subsp bovis AF2122/97
gugggacuggcgugaacg

SEQ ID NO: 3075856 - RNA, 21 nt, Mycobacterium bovis subsp bovis AF2122/97
gugggagcuacccgggccagg

SEQ ID NO: 3075857 - RNA, 14 nt, Mycobacterium bovis subsp bovis AF2122/97
gugggagguggcgc

SEQ ID NO: 3075858 - RNA, 18 nt, Mycobacterium bovis subsp bovis AF2122/97
gugggauucugacgaccg

SEQ ID NO: 3075859 - RNA, 13 nt, Mycobacterium bovis subsp bovis AF2122/97
gugggcaccccgc

SEQ ID NO: 3075860 - RNA, 18 nt, Mycobacterium bovis subsp bovis AF2122/97
gugggcaccuuggccggc

SEQ ID NO: 3075861 - RNA, 22 nt, Mycobacterium bovis subsp bovis AF2122/97
gugggcacuugcccgucggcgc

SEQ ID NO: 3075862 - RNA, 11 nt, Mycobacterium bovis subsp bovis AF2122/97
gugggcagcag

SEQ ID NO: 3075863 - RNA, 18 nt, Mycobacterium bovis subsp bovis AF2122/97
gugggcagcagcuggucg

SEQ ID NO: 3075864 - RNA, 16 nt, Mycobacterium bovis subsp bovis AF2122/97
gugggcauugcggcgc

SEQ ID NO: 3075865 - RNA, 21 nt, Mycobacterium bovis subsp bovis AF2122/97
gugggcauugcggcgcgggug

SEQ ID NO: 3075866 - RNA, 14 nt, Mycobacterium bovis subsp bovis AF2122/97
gugggccacgauga

SEQ ID NO: 3075867 - RNA, 14 nt, Mycobacterium bovis subsp bovis AF2122/97
gugggccagcagca

SEQ ID NO: 3075868 - RNA, 19 nt, Mycobacterium bovis subsp bovis AF2122/97
gugggccgacgugaccagc

SEQ ID NO: 3075869 - RNA, 14 nt, Mycobacterium bovis subsp bovis AF2122/97
gugggccggcggua

SEQ ID NO: 3075870 - RNA, 16 nt, Mycobacterium bovis subsp bovis AF2122/97
gugggccguggguguc

SEQ ID NO: 3075871 - RNA, 19 nt, Mycobacterium bovis subsp bovis AF2122/97
gugggccucgaucagcgcc

SEQ ID NO: 3075872 - RNA, 14 nt, Mycobacterium bovis subsp bovis AF2122/97
gugggccugcccgg

SEQ ID NO: 3075873 - RNA, 16 nt, Mycobacterium bovis subsp bovis AF2122/97
gugggccugcccggcg

SEQ ID NO: 3075874 - RNA, 23 nt, Mycobacterium bovis subsp bovis AF2122/97
gugggccuguugcugcccgacac

SEQ ID NO: 3075875 - RNA, 19 nt, Mycobacterium bovis subsp bovis AF2122/97
gugggcgacggccaagauc

SEQ ID NO: 3075876 - RNA, 23 nt, Mycobacterium bovis subsp bovis AF2122/97
gugggcgacggcggcgucgauga

SEQ ID NO: 3075877 - RNA, 14 nt, Mycobacterium bovis subsp bovis AF2122/97
gugggcgauggcac

SEQ ID NO: 3075878 - RNA, 15 nt, Mycobacterium bovis subsp bovis AF2122/97
gugggcgccgacacc

SEQ ID NO: 3075879 - RNA, 16 nt, Mycobacterium bovis subsp bovis AF2122/97
gugggcgccgacaccg

SEQ ID NO: 3075880 - RNA, 13 nt, Mycobacterium bovis subsp bovis AF2122/97
gugggcgccgcaa

SEQ ID NO: 3075881 - RNA, 16 nt, Mycobacterium bovis subsp bovis AF2122/97
gugggcgccgcaaccg

SEQ ID NO: 3075882 - RNA, 13 nt, Mycobacterium bovis subsp bovis AF2122/97
gugggcgccgucg

SEQ ID NO: 3075883 - RNA, 13 nt, Mycobacterium bovis subsp bovis AF2122/97
gugggcgcuguca

SEQ ID NO: 3075884 - RNA, 23 nt, Mycobacterium bovis subsp bovis AF2122/97
gugggcggagccgaugaccugcc

SEQ ID NO: 3075885 - RNA, 14 nt, Mycobacterium bovis subsp bovis AF2122/97
gugggcgugacggg

SEQ ID NO: 3075886 - RNA, 18 nt, Mycobacterium bovis subsp bovis AF2122/97
gugggcgugacgggcagg

SEQ ID NO: 3075887 - RNA, 13 nt, Mycobacterium bovis subsp bovis AF2122/97
gugggcgugcagg

SEQ ID NO: 3075888 - RNA, 19 nt, Mycobacterium bovis subsp bovis AF2122/97
gugggcguggcuggucaug

SEQ ID NO: 3075889 - RNA, 21 nt, Mycobacterium bovis subsp bovis AF2122/97
gugggcguucccccggcaccg

SEQ ID NO: 3075890 - RNA, 17 nt, Mycobacterium bovis subsp bovis AF2122/97
gugggcucguagcgcgc

SEQ ID NO: 3075891 - RNA, 17 nt, Mycobacterium bovis subsp bovis AF2122/97
gugggcuuggcuguggu

SEQ ID NO: 3075892 - RNA, 13 nt, Mycobacterium bovis subsp bovis AF2122/97
guggggacccgcu

SEQ ID NO: 3075893 - RNA, 19 nt, Mycobacterium bovis subsp bovis AF2122/97
guggggauagccgcgucgc

SEQ ID NO: 3075894 - RNA, 21 nt, Mycobacterium bovis subsp bovis AF2122/97
guggggaucacgaucacacca

SEQ ID NO: 3075895 - RNA, 13 nt, Mycobacterium bovis subsp bovis AF2122/97
guggggaucgacc

SEQ ID NO: 3075896 - RNA, 19 nt, Mycobacterium bovis subsp bovis AF2122/97
guggggccggcgucgauga

SEQ ID NO: 3075897 - RNA, 17 nt, Mycobacterium bovis subsp bovis AF2122/97
guggggccggggucggc

SEQ ID NO: 3075898 - RNA, 22 nt, Mycobacterium bovis subsp bovis AF2122/97
guggggccguguucuaccugca

SEQ ID NO: 3075899 - RNA, 14 nt, Mycobacterium bovis subsp bovis AF2122/97
guggggcgccgggg

SEQ ID NO: 3075900 - RNA, 15 nt, Mycobacterium bovis subsp bovis AF2122/97
guggggcgcgccggc

SEQ ID NO: 3075901 - RNA, 14 nt, Mycobacterium bovis subsp bovis AF2122/97
gugggggcgcaccg

SEQ ID NO: 3075902 - RNA, 17 nt, Mycobacterium bovis subsp bovis AF2122/97
guggggguccggcggcc

SEQ ID NO: 3075903 - RNA, 15 nt, Mycobacterium bovis subsp bovis AF2122/97
gugggguaucgccag

SEQ ID NO: 3075904 - RNA, 16 nt, Mycobacterium bovis subsp bovis AF2122/97
gugggguaucgccagc

SEQ ID NO: 3075905 - RNA, 22 nt, Mycobacterium bovis subsp bovis AF2122/97
gugggguaucgccagccaaccg

SEQ ID NO: 3075906 - RNA, 15 nt, Mycobacterium bovis subsp bovis AF2122/97
gugggguugcgcggu

SEQ ID NO: 3075907 - RNA, 20 nt, Mycobacterium bovis subsp bovis AF2122/97
gugggucaacgucaggcccu

SEQ ID NO: 3075908 - RNA, 19 nt, Mycobacterium bovis subsp bovis AF2122/97
gugggucaagaucggugcc

SEQ ID NO: 3075909 - RNA, 16 nt, Mycobacterium bovis subsp bovis AF2122/97
gugucgugguagcggu

SEQ ID NO: 3075910 - RNA, 20 nt, Mycobacterium bovis subsp bovis AF2122/97
gugucucccuugccgccauu

SEQ ID NO: 3075911 - RNA, 22 nt, Mycobacterium bovis subsp bovis AF2122/97
gugucugcccgagguccgcccu

SEQ ID NO: 3075912 - RNA, 15 nt, Mycobacterium bovis subsp bovis AF2122/97
gugucugcucgccga

SEQ ID NO: 3075913 - RNA, 21 nt, Mycobacterium bovis subsp bovis AF2122/97
gugucugggaccccgcugcga

SEQ ID NO: 3075914 - RNA, 19 nt, Mycobacterium bovis subsp bovis AF2122/97
gugucugugauugcgcggg

SEQ ID NO: 3075915 - RNA, 15 nt, Mycobacterium bovis subsp bovis AF2122/97
gugugaagaccaccg

SEQ ID NO: 3075916 - RNA, 13 nt, Mycobacterium bovis subsp bovis AF2122/97
gugugacggcggc

SEQ ID NO: 3075917 - RNA, 14 nt, Mycobacterium bovis subsp bovis AF2122/97
gugugacggcggcc

SEQ ID NO: 3075918 - RNA, 23 nt, Mycobacterium bovis subsp bovis AF2122/97
gugugagaucguagggacgccga

SEQ ID NO: 3075919 - RNA, 21 nt, Mycobacterium bovis subsp bovis AF2122/97
gugugcacggcuucggcgagc

SEQ ID NO: 3075920 - RNA, 12 nt, Mycobacterium bovis subsp bovis AF2122/97
gugugcagcagc

SEQ ID NO: 3075921 - RNA, 13 nt, Mycobacterium bovis subsp bovis AF2122/97
gugugcagcagca

SEQ ID NO: 3075922 - RNA, 19 nt, Mycobacterium bovis subsp bovis AF2122/97
gugugcaggaucacgccgc

SEQ ID NO: 3075923 - RNA, 14 nt, Mycobacterium bovis subsp bovis AF2122/97
gugugcaggccgcg

SEQ ID NO: 3075924 - RNA, 22 nt, Mycobacterium bovis subsp bovis AF2122/97
gugugcgaacaaguggccagcg

SEQ ID NO: 3075925 - RNA, 14 nt, Mycobacterium bovis subsp bovis AF2122/97
gugugcgacgacgg

SEQ ID NO: 3075926 - RNA, 16 nt, Mycobacterium bovis subsp bovis AF2122/97
gugugcgcaugguggg

SEQ ID NO: 3075927 - RNA, 19 nt, Mycobacterium bovis subsp bovis AF2122/97
gugugcggaagcaucggcu

SEQ ID NO: 3075928 - RNA, 23 nt, Mycobacterium bovis subsp bovis AF2122/97
gugugcggcauugguaccggcuu

SEQ ID NO: 3075929 - RNA, 14 nt, Mycobacterium bovis subsp bovis AF2122/97
gugugcgucgaggu

SEQ ID NO: 3075930 - RNA, 15 nt, Mycobacterium bovis subsp bovis AF2122/97
gugugcgucuccagc

SEQ ID NO: 3075931 - RNA, 12 nt, Mycobacterium bovis subsp bovis AF2122/97
gugugcgugcgg

SEQ ID NO: 3075932 - RNA, 13 nt, Mycobacterium bovis subsp bovis AF2122/97
gugugcgugcggu

SEQ ID NO: 3075933 - RNA, 15 nt, Mycobacterium bovis subsp bovis AF2122/97
gugugcgugucaccc

SEQ ID NO: 3075934 - RNA, 19 nt, Mycobacterium bovis subsp bovis AF2122/97
gugugcucgccgaccagcu

SEQ ID NO: 3075935 - RNA, 19 nt, Mycobacterium bovis subsp bovis AF2122/97
gugugcucgucgccugcga

SEQ ID NO: 3075936 - RNA, 10 nt, Mycobacterium bovis subsp bovis AF2122/97
gugugcugca

SEQ ID NO: 3075937 - RNA, 14 nt, Mycobacterium bovis subsp bovis AF2122/97
gugugcugccaccg

SEQ ID NO: 3075938 - RNA, 16 nt, Mycobacterium bovis subsp bovis AF2122/97
gugugcugccaccggc

SEQ ID NO: 3075939 - RNA, 13 nt, Mycobacterium bovis subsp bovis AF2122/97
gugugcugccgca

SEQ ID NO: 3075940 - RNA, 15 nt, Mycobacterium bovis subsp bovis AF2122/97
gugugcugccgcaca

SEQ ID NO: 3075941 - RNA, 22 nt, Mycobacterium bovis subsp bovis AF2122/97
gugugcuucgagcaccgacacc

SEQ ID NO: 3075942 - RNA, 17 nt, Mycobacterium bovis subsp bovis AF2122/97
guguggaacauccgcac

SEQ ID NO: 3075943 - RNA, 20 nt, Mycobacterium bovis subsp bovis AF2122/97
guguggaauacgcugcuggu

SEQ ID NO: 3075944 - RNA, 19 nt, Mycobacterium bovis subsp bovis AF2122/97
guguggaauggaccagcgc

SEQ ID NO: 3075945 - RNA, 15 nt, Mycobacterium bovis subsp bovis AF2122/97
guguggacgcacggc

SEQ ID NO: 3075946 - RNA, 22 nt, Mycobacterium bovis subsp bovis AF2122/97
guguggacuucagcaggcccag

SEQ ID NO: 3075947 - RNA, 14 nt, Mycobacterium bovis subsp bovis AF2122/97
guguggcagcccca

SEQ ID NO: 3075948 - RNA, 14 nt, Mycobacterium bovis subsp bovis AF2122/97
guguggcccaacac

SEQ ID NO: 3075949 - RNA, 18 nt, Mycobacterium bovis subsp bovis AF2122/97
guguggccuugcgucauc

SEQ ID NO: 3075950 - RNA, 13 nt, Mycobacterium bovis subsp bovis AF2122/97
guguggcgccggg

SEQ ID NO: 3075951 - RNA, 14 nt, Mycobacterium bovis subsp bovis AF2122/97
guguggcgccgggg

SEQ ID NO: 3075952 - RNA, 20 nt, Mycobacterium bovis subsp bovis AF2122/97
guguggcgccggggaccacg

SEQ ID NO: 3075953 - RNA, 21 nt, Mycobacterium bovis subsp bovis AF2122/97
guguggcuuugacugcugggg

SEQ ID NO: 3075954 - RNA, 16 nt, Mycobacterium bovis subsp bovis AF2122/97
gugugggggucagggg

SEQ ID NO: 3075955 - RNA, 21 nt, Mycobacterium bovis subsp bovis AF2122/97
gugugguaggaacuacccgcc

SEQ ID NO: 3075956 - RNA, 17 nt, Mycobacterium bovis subsp bovis AF2122/97
guguggucggcuguggu

SEQ ID NO: 3075957 - RNA, 16 nt, Mycobacterium bovis subsp bovis AF2122/97
guguggucgguggcgg

SEQ ID NO: 3075958 - RNA, 17 nt, Mycobacterium bovis subsp bovis AF2122/97
guguggucgguggcggg

SEQ ID NO: 3075959 - RNA, 17 nt, Mycobacterium bovis subsp bovis AF2122/97
guguguucggagcuggg

SEQ ID NO: 3075960 - RNA, 23 nt, Mycobacterium bovis subsp bovis AF2122/97
guguucagcuucgccagguggcc

SEQ ID NO: 3075961 - RNA, 20 nt, Mycobacterium bovis subsp bovis AF2122/97
guguucaucacgccgccgga

SEQ ID NO: 3075962 - RNA, 22 nt, Mycobacterium bovis subsp bovis AF2122/97
guguuccaacuccugcagcccg

SEQ ID NO: 3075963 - RNA, 18 nt, Mycobacterium bovis subsp bovis AF2122/97
guguuccacaccaggccg

SEQ ID NO: 3075964 - RNA, 14 nt, Mycobacterium bovis subsp bovis AF2122/97
guguuccgccgcgc

SEQ ID NO: 3075965 - RNA, 15 nt, Mycobacterium bovis subsp bovis AF2122/97
guguuccggucgccc

SEQ ID NO: 3075966 - RNA, 17 nt, Mycobacterium bovis subsp bovis AF2122/97
guguuccggucgcccga

SEQ ID NO: 3075967 - RNA, 22 nt, Mycobacterium bovis subsp bovis AF2122/97
guguucgacgagguugccgcac

SEQ ID NO: 3075968 - RNA, 13 nt, Mycobacterium bovis subsp bovis AF2122/97
guguucgccacac

SEQ ID NO: 3075969 - RNA, 15 nt, Mycobacterium bovis subsp bovis AF2122/97
guguucggagcuggg

SEQ ID NO: 3075970 - RNA, 16 nt, Mycobacterium bovis subsp bovis AF2122/97
guguucggcagcgcgg

SEQ ID NO: 3075971 - RNA, 15 nt, Mycobacterium bovis subsp bovis AF2122/97
guguucggcccgcac

SEQ ID NO: 3075972 - RNA, 21 nt, Mycobacterium bovis subsp bovis AF2122/97
guguucggugguccuggcgaa

SEQ ID NO: 3075973 - RNA, 13 nt, Mycobacterium bovis subsp bovis AF2122/97
guguucuccugcc

SEQ ID NO: 3075974 - RNA, 19 nt, Mycobacterium bovis subsp bovis AF2122/97
guguugacgauccggucgg

SEQ ID NO: 3075975 - RNA, 16 nt, Mycobacterium bovis subsp bovis AF2122/97
guguugagaucgcccg

SEQ ID NO: 3075976 - RNA, 22 nt, Mycobacterium bovis subsp bovis AF2122/97
guguugagaucgcccgaguuga

SEQ ID NO: 3075977 - RNA, 14 nt, Mycobacterium bovis subsp bovis AF2122/97
guguugagggugcc

SEQ ID NO: 3075978 - RNA, 17 nt, Mycobacterium bovis subsp bovis AF2122/97
guguugagggugcccga

SEQ ID NO: 3075979 - RNA, 19 nt, Mycobacterium bovis subsp bovis AF2122/97
guguugaugggcagccgcc

SEQ ID NO: 3075980 - RNA, 22 nt, Mycobacterium bovis subsp bovis AF2122/97
guguugauguugccggaguuga

SEQ ID NO: 3075981 - RNA, 24 nt, Mycobacterium bovis subsp bovis AF2122/97
guguugcccgaccacaccgggaug

SEQ ID NO: 3075982 - RNA, 15 nt, Mycobacterium bovis subsp bovis AF2122/97
guguugccgacgaga

SEQ ID NO: 3075983 - RNA, 13 nt, Mycobacterium bovis subsp bovis AF2122/97
guguugccgccgg

SEQ ID NO: 3075984 - RNA, 19 nt, Mycobacterium bovis subsp bovis AF2122/97
guguugccggagacgucgc

SEQ ID NO: 3075985 - RNA, 19 nt, Mycobacterium bovis subsp bovis AF2122/97
guguugccguuaccgccaa

SEQ ID NO: 3075986 - RNA, 21 nt, Mycobacterium bovis subsp bovis AF2122/97
guguugcgcugcggccagcgc

SEQ ID NO: 3075987 - RNA, 14 nt, Mycobacterium bovis subsp bovis AF2122/97
guguugcucccggc

SEQ ID NO: 3075988 - RNA, 19 nt, Mycobacterium bovis subsp bovis AF2122/97
guguugcucccggccgccg

SEQ ID NO: 3075989 - RNA, 16 nt, Mycobacterium bovis subsp bovis AF2122/97
guguuggccgggucgu

SEQ ID NO: 3075990 - RNA, 22 nt, Mycobacterium bovis subsp bovis AF2122/97
guguugggagccaccggcgucg

SEQ ID NO: 3075991 - RNA, 23 nt, Mycobacterium bovis subsp bovis AF2122/97
guguugggagccaccggcgucga

SEQ ID NO: 3075992 - RNA, 23 nt, Mycobacterium bovis subsp bovis AF2122/97
guguugguggauucgaucaggcc

SEQ ID NO: 3075993 - RNA, 19 nt, Mycobacterium bovis subsp bovis AF2122/97
guguugguggccgggucga

SEQ ID NO: 3075994 - RNA, 19 nt, Mycobacterium bovis subsp bovis AF2122/97
guguugguguucgggucga

SEQ ID NO: 3075995 - RNA, 15 nt, Mycobacterium bovis subsp bovis AF2122/97
guguuguuagccccg

SEQ ID NO: 3075996 - RNA, 20 nt, Mycobacterium bovis subsp bovis AF2122/97
guuccacuccccagccccac

SEQ ID NO: 3075997 - RNA, 17 nt, Mycobacterium bovis subsp bovis AF2122/97
guuccagcaucgagcag

SEQ ID NO: 3075998 - RNA, 15 nt, Mycobacterium bovis subsp bovis AF2122/97
guuccagcgcaucga

SEQ ID NO: 3075999 - RNA, 18 nt, Mycobacterium bovis subsp bovis AF2122/97
guuccagcggcaccgcgg

SEQ ID NO: 3076000 - RNA, 22 nt, Mycobacterium bovis subsp bovis AF2122/97
guuccaggucauauugcggugc

SEQ ID NO: 3076001 - RNA, 17 nt, Mycobacterium bovis subsp bovis AF2122/97
guuccaguccccgccgg

SEQ ID NO: 3076002 - RNA, 16 nt, Mycobacterium bovis subsp bovis AF2122/97
guuccaucacggacca

SEQ ID NO: 3076003 - RNA, 19 nt, Mycobacterium bovis subsp bovis AF2122/97
guuccaucacggaccaggc

SEQ ID NO: 3076004 - RNA, 18 nt, Mycobacterium bovis subsp bovis AF2122/97
guucccaccaccaccgcc

SEQ ID NO: 3076005 - RNA, 16 nt, Mycobacterium bovis subsp bovis AF2122/97
guucccccggcaccgc

SEQ ID NO: 3076006 - RNA, 19 nt, Mycobacterium bovis subsp bovis AF2122/97
guucccccggcaccgccgg

SEQ ID NO: 3076007 - RNA, 21 nt, Mycobacterium bovis subsp bovis AF2122/97
guuccccgagaacggcgggcg

SEQ ID NO: 3076008 - RNA, 21 nt, Mycobacterium bovis subsp bovis AF2122/97
guuccccgggcucggugaccc

SEQ ID NO: 3076009 - RNA, 19 nt, Mycobacterium bovis subsp bovis AF2122/97
guucccgaauggcaucagu

SEQ ID NO: 3076010 - RNA, 14 nt, Mycobacterium bovis subsp bovis AF2122/97
guucccgacgucgg

SEQ ID NO: 3076011 - RNA, 15 nt, Mycobacterium bovis subsp bovis AF2122/97
guucccgccggcacg

SEQ ID NO: 3076012 - RNA, 16 nt, Mycobacterium bovis subsp bovis AF2122/97
guucccgccggcgccg

SEQ ID NO: 3076013 - RNA, 17 nt, Mycobacterium bovis subsp bovis AF2122/97
guucccgcucgggcaac

SEQ ID NO: 3076014 - RNA, 14 nt, Mycobacterium bovis subsp bovis AF2122/97
guucccucggcacg

SEQ ID NO: 3076015 - RNA, 21 nt, Mycobacterium bovis subsp bovis AF2122/97
guucccucggcacggucgccc

SEQ ID NO: 3076016 - RNA, 23 nt, Mycobacterium bovis subsp bovis AF2122/97
guucccucggcacggucgcccga

SEQ ID NO: 3076017 - RNA, 20 nt, Mycobacterium bovis subsp bovis AF2122/97
guucccuuguucccgaaacc

SEQ ID NO: 3076018 - RNA, 13 nt, Mycobacterium bovis subsp bovis AF2122/97
guuccgcaaugac

SEQ ID NO: 3076019 - RNA, 23 nt, Mycobacterium bovis subsp bovis AF2122/97
guuccgcaaugaccuggccgccc

SEQ ID NO: 3076020 - RNA, 14 nt, Mycobacterium bovis subsp bovis AF2122/97
guuccgcaucggcc

SEQ ID NO: 3076021 - RNA, 21 nt, Mycobacterium bovis subsp bovis AF2122/97
guuccgccaggccgaccgcgc

SEQ ID NO: 3076022 - RNA, 22 nt, Mycobacterium bovis subsp bovis AF2122/97
guuccgccaggccgaccgcgca

SEQ ID NO: 3076023 - RNA, 11 nt, Mycobacterium bovis subsp bovis AF2122/97
guuccgccauu

SEQ ID NO: 3076024 - RNA, 16 nt, Mycobacterium bovis subsp bovis AF2122/97
guuccgcccagcgagg

SEQ ID NO: 3076025 - RNA, 15 nt, Mycobacterium bovis subsp bovis AF2122/97
guuccgccggcccca

SEQ ID NO: 3076026 - RNA, 18 nt, Mycobacterium bovis subsp bovis AF2122/97
guuccgcgacaaccacga

SEQ ID NO: 3076027 - RNA, 22 nt, Mycobacterium bovis subsp bovis AF2122/97
guuccgcgacaaccacgaaagc

SEQ ID NO: 3076028 - RNA, 14 nt, Mycobacterium bovis subsp bovis AF2122/97
guuccgcgcggcag

SEQ ID NO: 3076029 - RNA, 19 nt, Mycobacterium bovis subsp bovis AF2122/97
guuccgcggggccgaaucc

SEQ ID NO: 3076030 - RNA, 15 nt, Mycobacterium bovis subsp bovis AF2122/97
guuccgcucgccguu

SEQ ID NO: 3076031 - RNA, 13 nt, Mycobacterium bovis subsp bovis AF2122/97
guuccggccggcu

SEQ ID NO: 3076032 - RNA, 16 nt, Mycobacterium bovis subsp bovis AF2122/97
guuccggcggucaaga

SEQ ID NO: 3076033 - RNA, 15 nt, Mycobacterium bovis subsp bovis AF2122/97
guuccggcugguggg

SEQ ID NO: 3076034 - RNA, 20 nt, Mycobacterium bovis subsp bovis AF2122/97
guuccggcuucguccaccgc

SEQ ID NO: 3076035 - RNA, 17 nt, Mycobacterium bovis subsp bovis AF2122/97
guuccgggccgaucacc

SEQ ID NO: 3076036 - RNA, 16 nt, Mycobacterium bovis subsp bovis AF2122/97
guuccgggcgcgugga

SEQ ID NO: 3076037 - RNA, 16 nt, Mycobacterium bovis subsp bovis AF2122/97
guuccguccccgacgu

SEQ ID NO: 3076038 - RNA, 19 nt, Mycobacterium bovis subsp bovis AF2122/97
guuccguugaugccgccgg

SEQ ID NO: 3076039 - RNA, 20 nt, Mycobacterium bovis subsp bovis AF2122/97
guuccguugaugccgccgga

SEQ ID NO: 3076040 - RNA, 18 nt, Mycobacterium bovis subsp bovis AF2122/97
guuccucgaucgucgacg

SEQ ID NO: 3076041 - RNA, 23 nt, Mycobacterium bovis subsp bovis AF2122/97
guuccucggugacuucacucguu

SEQ ID NO: 3076042 - RNA, 16 nt, Mycobacterium bovis subsp bovis AF2122/97
guuccugcaagaacca

SEQ ID NO: 3076043 - RNA, 19 nt, Mycobacterium bovis subsp bovis AF2122/97
guuccuugaugcggccgcg

SEQ ID NO: 3076044 - RNA, 16 nt, Mycobacterium bovis subsp bovis AF2122/97
guuccuugcggccgcu

SEQ ID NO: 3076045 - RNA, 17 nt, Mycobacterium bovis subsp bovis AF2122/97
guuccuugugaccccgg

SEQ ID NO: 3076046 - RNA, 23 nt, Mycobacterium bovis subsp bovis AF2122/97
guucgaacuggcugguggcgugc

SEQ ID NO: 3076047 - RNA, 15 nt, Mycobacterium bovis subsp bovis AF2122/97
guucgaaggccaccc

SEQ ID NO: 3076048 - RNA, 20 nt, Mycobacterium bovis subsp bovis AF2122/97
guucgacccccgcaucggcg

SEQ ID NO: 3076049 - RNA, 13 nt, Mycobacterium bovis subsp bovis AF2122/97
guucgacggcguc

SEQ ID NO: 3076050 - RNA, 14 nt, Mycobacterium bovis subsp bovis AF2122/97
guucgacgggccgg

SEQ ID NO: 3076051 - RNA, 21 nt, Mycobacterium bovis subsp bovis AF2122/97
guucgacgucuuugacgaacu

SEQ ID NO: 3076052 - RNA, 15 nt, Mycobacterium bovis subsp bovis AF2122/97
guucgacucaugccg

SEQ ID NO: 3076053 - RNA, 17 nt, Mycobacterium bovis subsp bovis AF2122/97
guucgauagcggcggcg

SEQ ID NO: 3076054 - RNA, 16 nt, Mycobacterium bovis subsp bovis AF2122/97
guucgaucccguccgc

SEQ ID NO: 3076055 - RNA, 23 nt, Mycobacterium bovis subsp bovis AF2122/97
guucgauggcaucggccaucucg

SEQ ID NO: 3076056 - RNA, 21 nt, Mycobacterium bovis subsp bovis AF2122/97
guucgaugggugcaccgaaga

SEQ ID NO: 3076057 - RNA, 12 nt, Mycobacterium bovis subsp bovis AF2122/97
guucgcacaccu

SEQ ID NO: 3076058 - RNA, 18 nt, Mycobacterium bovis subsp bovis AF2122/97
guucgccacgcccgacgc

SEQ ID NO: 3076059 - RNA, 19 nt, Mycobacterium bovis subsp bovis AF2122/97
guucgcccacagcuugccc

SEQ ID NO: 3076060 - RNA, 16 nt, Mycobacterium bovis subsp bovis AF2122/97
guucgcccacaugccg

SEQ ID NO: 3076061 - RNA, 18 nt, Mycobacterium bovis subsp bovis AF2122/97
guucgcccacaugccggu

SEQ ID NO: 3076062 - RNA, 14 nt, Mycobacterium bovis subsp bovis AF2122/97
guucgcccgucgcc

SEQ ID NO: 3076063 - RNA, 17 nt, Mycobacterium bovis subsp bovis AF2122/97
guucgccgaagccggac

SEQ ID NO: 3076064 - RNA, 15 nt, Mycobacterium bovis subsp bovis AF2122/97
guucgccgcccggcg

SEQ ID NO: 3076065 - RNA, 23 nt, Mycobacterium bovis subsp bovis AF2122/97
guucgccgcgaaugucgccgccu

SEQ ID NO: 3076066 - RNA, 19 nt, Mycobacterium bovis subsp bovis AF2122/97
guucgccgcgcagcgugcg

SEQ ID NO: 3076067 - RNA, 18 nt, Mycobacterium bovis subsp bovis AF2122/97
guucgccggagacccggg

SEQ ID NO: 3076068 - RNA, 14 nt, Mycobacterium bovis subsp bovis AF2122/97
guucgccuggucac

SEQ ID NO: 3076069 - RNA, 20 nt, Mycobacterium bovis subsp bovis AF2122/97
guucgcgaagcugugcccgg

SEQ ID NO: 3076070 - RNA, 23 nt, Mycobacterium bovis subsp bovis AF2122/97
guucgcgaagcugugcccggcgc

SEQ ID NO: 3076071 - RNA, 15 nt, Mycobacterium bovis subsp bovis AF2122/97
guucgcgcaaaugcc

SEQ ID NO: 3076072 - RNA, 22 nt, Mycobacterium bovis subsp bovis AF2122/97
guucgcgccacgcacccggcaa

SEQ ID NO: 3076073 - RNA, 15 nt, Mycobacterium bovis subsp bovis AF2122/97
guucgcgcgccgcga

SEQ ID NO: 3076074 - RNA, 17 nt, Mycobacterium bovis subsp bovis AF2122/97
guucgcgcgccgcgacg

SEQ ID NO: 3076075 - RNA, 18 nt, Mycobacterium bovis subsp bovis AF2122/97
guucgcggccaucgccga

SEQ ID NO: 3076076 - RNA, 21 nt, Mycobacterium bovis subsp bovis AF2122/97
guucgcggccaucgccgacac

SEQ ID NO: 3076077 - RNA, 22 nt, Mycobacterium bovis subsp bovis AF2122/97
guucgcgggcgucccgcauacc

SEQ ID NO: 3076078 - RNA, 19 nt, Mycobacterium bovis subsp bovis AF2122/97
guucgcgggugcgcugcag

SEQ ID NO: 3076079 - RNA, 17 nt, Mycobacterium bovis subsp bovis AF2122/97
guucgcgucacaccagc

SEQ ID NO: 3076080 - RNA, 15 nt, Mycobacterium bovis subsp bovis AF2122/97
guucgcgucgccgau

SEQ ID NO: 3076081 - RNA, 16 nt, Mycobacterium bovis subsp bovis AF2122/97
guucgcgucgccgaug

SEQ ID NO: 3076082 - RNA, 18 nt, Mycobacterium bovis subsp bovis AF2122/97
guugaagacggccaccgg

SEQ ID NO: 3076083 - RNA, 21 nt, Mycobacterium bovis subsp bovis AF2122/97
guugaagacggccaccggggu

SEQ ID NO: 3076084 - RNA, 14 nt, Mycobacterium bovis subsp bovis AF2122/97
guugaagccgcccg

SEQ ID NO: 3076085 - RNA, 14 nt, Mycobacterium bovis subsp bovis AF2122/97
guugaaggcgccgg

SEQ ID NO: 3076086 - RNA, 16 nt, Mycobacterium bovis subsp bovis AF2122/97
guugaaggugccggcg

SEQ ID NO: 3076087 - RNA, 14 nt, Mycobacterium bovis subsp bovis AF2122/97
guugaagucgccgg

SEQ ID NO: 3076088 - RNA, 21 nt, Mycobacterium bovis subsp bovis AF2122/97
guugaaucccagauaugcagg

SEQ ID NO: 3076089 - RNA, 22 nt, Mycobacterium bovis subsp bovis AF2122/97
guugaaucccagauaugcagga

SEQ ID NO: 3076090 - RNA, 12 nt, Mycobacterium bovis subsp bovis AF2122/97
guugacacccgg

SEQ ID NO: 3076091 - RNA, 23 nt, Mycobacterium bovis subsp bovis AF2122/97
guugacacccgggccaccccgag

SEQ ID NO: 3076092 - RNA, 20 nt, Mycobacterium bovis subsp bovis AF2122/97
guugaccaaugucagugccc

SEQ ID NO: 3076093 - RNA, 22 nt, Mycobacterium bovis subsp bovis AF2122/97
guugaccaccaccgagccgucc

SEQ ID NO: 3076094 - RNA, 14 nt, Mycobacterium bovis subsp bovis AF2122/97
guugaccaccagcg

SEQ ID NO: 3076095 - RNA, 15 nt, Mycobacterium bovis subsp bovis AF2122/97
guugaccaggccgac

SEQ ID NO: 3076096 - RNA, 21 nt, Mycobacterium bovis subsp bovis AF2122/97
guugacccagaccggcucguc

SEQ ID NO: 3076097 - RNA, 22 nt, Mycobacterium bovis subsp bovis AF2122/97
guugacccaucucgucgucggg

SEQ ID NO: 3076098 - RNA, 15 nt, Mycobacterium bovis subsp bovis AF2122/97
guugacccggcgaug

SEQ ID NO: 3076099 - RNA, 20 nt, Mycobacterium bovis subsp bovis AF2122/97
guugacccguacccacgacg

SEQ ID NO: 3076100 - RNA, 18 nt, Mycobacterium bovis subsp bovis AF2122/97
guugaccgcggucugcgc

SEQ ID NO: 3076101 - RNA, 23 nt, Mycobacterium bovis subsp bovis AF2122/97
guugaccgcggucugcgcgucgc

SEQ ID NO: 3076102 - RNA, 20 nt, Mycobacterium bovis subsp bovis AF2122/97
guugaccgggucgccgauga

SEQ ID NO: 3076103 - RNA, 15 nt, Mycobacterium bovis subsp bovis AF2122/97
guugaccgggucguc

SEQ ID NO: 3076104 - RNA, 17 nt, Mycobacterium bovis subsp bovis AF2122/97
guugaccuccuccuccg

SEQ ID NO: 3076105 - RNA, 14 nt, Mycobacterium bovis subsp bovis AF2122/97
guugaccucgcgca

SEQ ID NO: 3076106 - RNA, 15 nt, Mycobacterium bovis subsp bovis AF2122/97
guugacgaucacccc

SEQ ID NO: 3076107 - RNA, 15 nt, Mycobacterium bovis subsp bovis AF2122/97
guugacgccacgacg

SEQ ID NO: 3076108 - RNA, 13 nt, Mycobacterium bovis subsp bovis AF2122/97
guugacgccgguc

SEQ ID NO: 3076109 - RNA, 18 nt, Mycobacterium bovis subsp bovis AF2122/97
guugacggugguccugau

SEQ ID NO: 3076110 - RNA, 18 nt, Mycobacterium bovis subsp bovis AF2122/97
guugacggugucuugcca

SEQ ID NO: 3076111 - RNA, 21 nt, Mycobacterium bovis subsp bovis AF2122/97
guugacguccaacagcgcucg

SEQ ID NO: 3076112 - RNA, 16 nt, Mycobacterium bovis subsp bovis AF2122/97
guugacuaccaccgcg

SEQ ID NO: 3076113 - RNA, 23 nt, Mycobacterium bovis subsp bovis AF2122/97
guugacucugcguccaccggacg

SEQ ID NO: 3076114 - RNA, 13 nt, Mycobacterium bovis subsp bovis AF2122/97
guugacuggccgc

SEQ ID NO: 3076115 - RNA, 16 nt, Mycobacterium bovis subsp bovis AF2122/97
guugacuggccgcccg

SEQ ID NO: 3076116 - RNA, 21 nt, Mycobacterium bovis subsp bovis AF2122/97
guugacuggccgcccggcgag

SEQ ID NO: 3076117 - RNA, 14 nt, Mycobacterium bovis subsp bovis AF2122/97
guugagaucgcccg

SEQ ID NO: 3076118 - RNA, 16 nt, Mycobacterium bovis subsp bovis AF2122/97
guugagaucgcccgag

SEQ ID NO: 3076119 - RNA, 19 nt, Mycobacterium bovis subsp bovis AF2122/97
guugagcagcuugguggcg

SEQ ID NO: 3076120 - RNA, 15 nt, Mycobacterium bovis subsp bovis AF2122/97
guugagcauaugacg

SEQ ID NO: 3076121 - RNA, 20 nt, Mycobacterium bovis subsp bovis AF2122/97
guugagcaucgauucgaugu

SEQ ID NO: 3076122 - RNA, 14 nt, Mycobacterium bovis subsp bovis AF2122/97
guugagcuggaccu

SEQ ID NO: 3076123 - RNA, 17 nt, Mycobacterium bovis subsp bovis AF2122/97
guugaggacguggacuu

SEQ ID NO: 3076124 - RNA, 22 nt, Mycobacterium bovis subsp bovis AF2122/97
guugaggaugacgacggugacc

SEQ ID NO: 3076125 - RNA, 19 nt, Mycobacterium bovis subsp bovis AF2122/97
guugaggaugccggagagu

SEQ ID NO: 3076126 - RNA, 16 nt, Mycobacterium bovis subsp bovis AF2122/97
guugaggccggugaac

SEQ ID NO: 3076127 - RNA, 20 nt, Mycobacterium bovis subsp bovis AF2122/97
guugaggccggugaacggua

SEQ ID NO: 3076128 - RNA, 20 nt, Mycobacterium bovis subsp bovis AF2122/97
guugaggccgucgaacggua

SEQ ID NO: 3076129 - RNA, 22 nt, Mycobacterium bovis subsp bovis AF2122/97
guugagguucuucugcgccacg

SEQ ID NO: 3076130 - RNA, 21 nt, Mycobacterium bovis subsp bovis AF2122/97
guugaucaagaaggccagcgc

SEQ ID NO: 3076131 - RNA, 14 nt, Mycobacterium bovis subsp bovis AF2122/97
guugauccugcagu

SEQ ID NO: 3076132 - RNA, 19 nt, Mycobacterium bovis subsp bovis AF2122/97
guugaucgacaucaccacc

SEQ ID NO: 3076133 - RNA, 23 nt, Mycobacterium bovis subsp bovis AF2122/97
guugaucgacaucaccaccgccg

SEQ ID NO: 3076134 - RNA, 15 nt, Mycobacterium bovis subsp bovis AF2122/97
guugaucgcggacac

SEQ ID NO: 3076135 - RNA, 21 nt, Mycobacterium bovis subsp bovis AF2122/97
guugaucgcguagcuggccag

SEQ ID NO: 3076136 - RNA, 16 nt, Mycobacterium bovis subsp bovis AF2122/97
guugaucucgccggug

SEQ ID NO: 3076137 - RNA, 16 nt, Mycobacterium bovis subsp bovis AF2122/97
guugaucuggcguuca

SEQ ID NO: 3076138 - RNA, 22 nt, Mycobacterium bovis subsp bovis AF2122/97
guugaucuggcguucagcggcc

SEQ ID NO: 3076139 - RNA, 13 nt, Mycobacterium bovis subsp bovis AF2122/97
guugaugaccagg

SEQ ID NO: 3076140 - RNA, 14 nt, Mycobacterium bovis subsp bovis AF2122/97
guugaugacggcgu

SEQ ID NO: 3076141 - RNA, 13 nt, Mycobacterium bovis subsp bovis AF2122/97
guugaugccgccg

SEQ ID NO: 3076142 - RNA, 14 nt, Mycobacterium bovis subsp bovis AF2122/97
guugaugccgccgg

SEQ ID NO: 3076143 - RNA, 20 nt, Mycobacterium bovis subsp bovis AF2122/97
guugaugccgccggagucga

SEQ ID NO: 3076144 - RNA, 19 nt, Mycobacterium bovis subsp bovis AF2122/97
guugaugcggaugucgucg

SEQ ID NO: 3076145 - RNA, 16 nt, Mycobacterium bovis subsp bovis AF2122/97
guugaugcggccgcgg

SEQ ID NO: 3076146 - RNA, 17 nt, Mycobacterium bovis subsp bovis AF2122/97
guugauuucggcggcga

SEQ ID NO: 3076147 - RNA, 20 nt, Mycobacterium bovis subsp bovis AF2122/97
guugcaacggguacacccgc

SEQ ID NO: 3076148 - RNA, 14 nt, Mycobacterium bovis subsp bovis AF2122/97
guugcacagcagcg

SEQ ID NO: 3076149 - RNA, 14 nt, Mycobacterium bovis subsp bovis AF2122/97
guugcacgcgggug

SEQ ID NO: 3076150 - RNA, 21 nt, Mycobacterium bovis subsp bovis AF2122/97
guugcacugcucguugaugaa

SEQ ID NO: 3076151 - RNA, 15 nt, Mycobacterium bovis subsp bovis AF2122/97
guugcaggcgcagcu

SEQ ID NO: 3076152 - RNA, 15 nt, Mycobacterium bovis subsp bovis AF2122/97
guugcaguggcgacg

SEQ ID NO: 3076153 - RNA, 14 nt, Mycobacterium bovis subsp bovis AF2122/97
guugccaacaacau

SEQ ID NO: 3076154 - RNA, 15 nt, Mycobacterium bovis subsp bovis AF2122/97
guugccaacaccggc

SEQ ID NO: 3076155 - RNA, 17 nt, Mycobacterium bovis subsp bovis AF2122/97
guugccaacaccggcga

SEQ ID NO: 3076156 - RNA, 15 nt, Mycobacterium bovis subsp bovis AF2122/97
guugccaacgaaccg

SEQ ID NO: 3076157 - RNA, 22 nt, Mycobacterium bovis subsp bovis AF2122/97
guugccaacgaaccgcucagcg

SEQ ID NO: 3076158 - RNA, 18 nt, Mycobacterium bovis subsp bovis AF2122/97
guugccaagcagcugggc

SEQ ID NO: 3076159 - RNA, 18 nt, Mycobacterium bovis subsp bovis AF2122/97
guugccaaugacgucgcg

SEQ ID NO: 3076160 - RNA, 13 nt, Mycobacterium bovis subsp bovis AF2122/97
guugccaccggug

SEQ ID NO: 3076161 - RNA, 14 nt, Mycobacterium bovis subsp bovis AF2122/97
guugccaccuuggu

SEQ ID NO: 3076162 - RNA, 14 nt, Mycobacterium bovis subsp bovis AF2122/97
guugccacgccgcc

SEQ ID NO: 3076163 - RNA, 23 nt, Mycobacterium bovis subsp bovis AF2122/97
guugccagcgacgcggucaucga

SEQ ID NO: 3076164 - RNA, 18 nt, Mycobacterium bovis subsp bovis AF2122/97
guugccagggcgggcguc

SEQ ID NO: 3076165 - RNA, 15 nt, Mycobacterium bovis subsp bovis AF2122/97
guugccagucgaucg

SEQ ID NO: 3076166 - RNA, 16 nt, Mycobacterium bovis subsp bovis AF2122/97
guugccaucaaggcca

SEQ ID NO: 3076167 - RNA, 19 nt, Mycobacterium bovis subsp bovis AF2122/97
guugccaucaaggccaccu

SEQ ID NO: 3076168 - RNA, 16 nt, Mycobacterium bovis subsp bovis AF2122/97
guugcccccguugccg

SEQ ID NO: 3076169 - RNA, 19 nt, Mycobacterium bovis subsp bovis AF2122/97
guugcugagcaaguccugc

SEQ ID NO: 3076170 - RNA, 21 nt, Mycobacterium bovis subsp bovis AF2122/97
guugcugagcguaggccagcg

SEQ ID NO: 3076171 - RNA, 15 nt, Mycobacterium bovis subsp bovis AF2122/97
guugcugauggugcc

SEQ ID NO: 3076172 - RNA, 19 nt, Mycobacterium bovis subsp bovis AF2122/97
guugcugcccugguuggug

SEQ ID NO: 3076173 - RNA, 13 nt, Mycobacterium bovis subsp bovis AF2122/97
guugcuggccgcg

SEQ ID NO: 3076174 - RNA, 15 nt, Mycobacterium bovis subsp bovis AF2122/97
guugcuggcgccccc

SEQ ID NO: 3076175 - RNA, 17 nt, Mycobacterium bovis subsp bovis AF2122/97
guugcuggucgccgucg

SEQ ID NO: 3076176 - RNA, 17 nt, Mycobacterium bovis subsp bovis AF2122/97
guuggaagucccgccgu

SEQ ID NO: 3076177 - RNA, 23 nt, Mycobacterium bovis subsp bovis AF2122/97
guuggaccacgugaucgacgacc

SEQ ID NO: 3076178 - RNA, 15 nt, Mycobacterium bovis subsp bovis AF2122/97
guuggauacggugcg

SEQ ID NO: 3076179 - RNA, 16 nt, Mycobacterium bovis subsp bovis AF2122/97
guuggaucccagcccg

SEQ ID NO: 3076180 - RNA, 15 nt, Mycobacterium bovis subsp bovis AF2122/97
guuggaucgccaccg

SEQ ID NO: 3076181 - RNA, 21 nt, Mycobacterium bovis subsp bovis AF2122/97
guuggcaaagacgcuggccac

SEQ ID NO: 3076182 - RNA, 18 nt, Mycobacterium bovis subsp bovis AF2122/97
guuggcaagcacggcguc

SEQ ID NO: 3076183 - RNA, 14 nt, Mycobacterium bovis subsp bovis AF2122/97
guuggcaccagccg

SEQ ID NO: 3076184 - RNA, 18 nt, Mycobacterium bovis subsp bovis AF2122/97
guuggcaccgucagacca

SEQ ID NO: 3076185 - RNA, 17 nt, Mycobacterium bovis subsp bovis AF2122/97
guuggcacgcaacaccg

SEQ ID NO: 3076186 - RNA, 14 nt, Mycobacterium bovis subsp bovis AF2122/97
guuggcagcccucu

SEQ ID NO: 3076187 - RNA, 19 nt, Mycobacterium bovis subsp bovis AF2122/97
guuggcagcgcuggcuacg

SEQ ID NO: 3076188 - RNA, 13 nt, Mycobacterium bovis subsp bovis AF2122/97
guuggcagggcca

SEQ ID NO: 3076189 - RNA, 18 nt, Mycobacterium bovis subsp bovis AF2122/97
guuggcagggccagcggc

SEQ ID NO: 3076190 - RNA, 13 nt, Mycobacterium bovis subsp bovis AF2122/97
guuggcaguggcg

SEQ ID NO: 3076191 - RNA, 16 nt, Mycobacterium bovis subsp bovis AF2122/97
guuggcaguggcgcgg

SEQ ID NO: 3076192 - RNA, 15 nt, Mycobacterium bovis subsp bovis AF2122/97
guuggccaccgccca

SEQ ID NO: 3076193 - RNA, 19 nt, Mycobacterium bovis subsp bovis AF2122/97
guuggccagccacagccga

SEQ ID NO: 3076194 - RNA, 17 nt, Mycobacterium bovis subsp bovis AF2122/97
guuggccaggcccgagu

SEQ ID NO: 3076195 - RNA, 18 nt, Mycobacterium bovis subsp bovis AF2122/97
guuggccaguaugcggug

SEQ ID NO: 3076196 - RNA, 21 nt, Mycobacterium bovis subsp bovis AF2122/97
guuggccaugcaccgaugccg

SEQ ID NO: 3076197 - RNA, 16 nt, Mycobacterium bovis subsp bovis AF2122/97
guuggccauggccagu

SEQ ID NO: 3076198 - RNA, 18 nt, Mycobacterium bovis subsp bovis AF2122/97
guuggccgaacagcugcc

SEQ ID NO: 3076199 - RNA, 20 nt, Mycobacterium bovis subsp bovis AF2122/97
guuggccgaacagcugcccg

SEQ ID NO: 3076200 - RNA, 17 nt, Mycobacterium bovis subsp bovis AF2122/97
guuggccgcgcucaucg

SEQ ID NO: 3076201 - RNA, 17 nt, Mycobacterium bovis subsp bovis AF2122/97
guuggccggcgcugccc

SEQ ID NO: 3076202 - RNA, 18 nt, Mycobacterium bovis subsp bovis AF2122/97
guuggccggcgcugcccg

SEQ ID NO: 3076203 - RNA, 14 nt, Mycobacterium bovis subsp bovis AF2122/97
guuggccugcaacg

SEQ ID NO: 3076204 - RNA, 18 nt, Mycobacterium bovis subsp bovis AF2122/97
guuggcgaacugguagcc

SEQ ID NO: 3076205 - RNA, 16 nt, Mycobacterium bovis subsp bovis AF2122/97
guuggcgaagcccgag

SEQ ID NO: 3076206 - RNA, 22 nt, Mycobacterium bovis subsp bovis AF2122/97
guuggcgaagucgucgagguca

SEQ ID NO: 3076207 - RNA, 23 nt, Mycobacterium bovis subsp bovis AF2122/97
guuggcgaaugcggccccgacac

SEQ ID NO: 3076208 - RNA, 17 nt, Mycobacterium bovis subsp bovis AF2122/97
guuggcgaccaccgcgu

SEQ ID NO: 3076209 - RNA, 11 nt, Mycobacterium bovis subsp bovis AF2122/97
guuggcgacga

SEQ ID NO: 3076210 - RNA, 18 nt, Mycobacterium bovis subsp bovis AF2122/97
guuggcgauccgcggcgu

SEQ ID NO: 3076211 - RNA, 20 nt, Mycobacterium bovis subsp bovis AF2122/97
guuggcgccaccagucacgc

SEQ ID NO: 3076212 - RNA, 20 nt, Mycobacterium bovis subsp bovis AF2122/97
guuggcgccguuaccgccgu

SEQ ID NO: 3076213 - RNA, 15 nt, Mycobacterium bovis subsp bovis AF2122/97
guuggcggcaagggu

SEQ ID NO: 3076214 - RNA, 19 nt, Mycobacterium bovis subsp bovis AF2122/97
guuggcggccagcgcaccg

SEQ ID NO: 3076215 - RNA, 12 nt, Mycobacterium bovis subsp bovis AF2122/97
guuggcggccuc

SEQ ID NO: 3076216 - RNA, 21 nt, Mycobacterium bovis subsp bovis AF2122/97
guuggcggcgauccagaacaa

SEQ ID NO: 3076217 - RNA, 16 nt, Mycobacterium bovis subsp bovis AF2122/97
guuggcggcggucggc

SEQ ID NO: 3076218 - RNA, 21 nt, Mycobacterium bovis subsp bovis AF2122/97
guuggcggcggucggcugggc

SEQ ID NO: 3076219 - RNA, 13 nt, Mycobacterium bovis subsp bovis AF2122/97
guuggcggcucgc

SEQ ID NO: 3076220 - RNA, 12 nt, Mycobacterium bovis subsp bovis AF2122/97
guuggcggcugc

SEQ ID NO: 3076221 - RNA, 18 nt, Mycobacterium bovis subsp bovis AF2122/97
guuggcgguggucccgau

SEQ ID NO: 3076222 - RNA, 16 nt, Mycobacterium bovis subsp bovis AF2122/97
guuggcgugcaccgca

SEQ ID NO: 3076223 - RNA, 23 nt, Mycobacterium bovis subsp bovis AF2122/97
guuggcguggaucuuggccagca

SEQ ID NO: 3076224 - RNA, 14 nt, Mycobacterium bovis subsp bovis AF2122/97
guuggcucgcuggg

SEQ ID NO: 3076225 - RNA, 14 nt, Mycobacterium bovis subsp bovis AF2122/97
guuggcucggcgca

SEQ ID NO: 3076226 - RNA, 17 nt, Mycobacterium bovis subsp bovis AF2122/97
guuggcucggcgcagca

SEQ ID NO: 3076227 - RNA, 14 nt, Mycobacterium bovis subsp bovis AF2122/97
guuggcugccggca

SEQ ID NO: 3076228 - RNA, 14 nt, Mycobacterium bovis subsp bovis AF2122/97
guugggagccaccg

SEQ ID NO: 3076229 - RNA, 23 nt, Mycobacterium bovis subsp bovis AF2122/97
guugggcgagaccgcgagcagca

SEQ ID NO: 3076230 - RNA, 21 nt, Mycobacterium bovis subsp bovis AF2122/97
guugggcgcgaaacgccgcaa

SEQ ID NO: 3076231 - RNA, 23 nt, Mycobacterium bovis subsp bovis AF2122/97
guugggugccggacuuggccugc

SEQ ID NO: 3076232 - RNA, 20 nt, Mycobacterium bovis subsp bovis AF2122/97
guugggugggugcagcacgu

SEQ ID NO: 3076233 - RNA, 23 nt, Mycobacterium bovis subsp bovis AF2122/97
guuggguugaaaacgcccggcac

SEQ ID NO: 3076234 - RNA, 19 nt, Mycobacterium bovis subsp bovis AF2122/97
guugguagagcaccagguu

SEQ ID NO: 3076235 - RNA, 17 nt, Mycobacterium bovis subsp bovis AF2122/97
guugguauuagggccgg

SEQ ID NO: 3076236 - RNA, 18 nt, Mycobacterium bovis subsp bovis AF2122/97
guugguauuagggccggc

SEQ ID NO: 3076237 - RNA, 22 nt, Mycobacterium bovis subsp bovis AF2122/97
guugguauuagggccggcguug

SEQ ID NO: 3076238 - RNA, 18 nt, Mycobacterium bovis subsp bovis AF2122/97
guuggucaccaccuggug

SEQ ID NO: 3076239 - RNA, 20 nt, Mycobacterium bovis subsp bovis AF2122/97
guuggucagcguggacgccc

SEQ ID NO: 3076240 - RNA, 22 nt, Mycobacterium bovis subsp bovis AF2122/97
guuggucaucaacgccacgaug

SEQ ID NO: 3076241 - RNA, 15 nt, Mycobacterium bovis subsp bovis AF2122/97
guugguccucggcgg

SEQ ID NO: 3076242 - RNA, 19 nt, Mycobacterium bovis subsp bovis AF2122/97
guuggucggcugauuggcc

SEQ ID NO: 3076243 - RNA, 19 nt, Mycobacterium bovis subsp bovis AF2122/97
guuggucgucgcgugcauc

SEQ ID NO: 3076244 - RNA, 19 nt, Mycobacterium bovis subsp bovis AF2122/97
guuggugcagaccaccgcc

SEQ ID NO: 3076245 - RNA, 20 nt, Mycobacterium bovis subsp bovis AF2122/97
guuggugcccgugugcagcc

SEQ ID NO: 3076246 - RNA, 14 nt, Mycobacterium bovis subsp bovis AF2122/97
guuggugucguacu

SEQ ID NO: 3076247 - RNA, 20 nt, Mycobacterium bovis subsp bovis AF2122/97
guugguguucgggucgauca

SEQ ID NO: 3076248 - RNA, 16 nt, Mycobacterium bovis subsp bovis AF2122/97
guugguguugcggacg

SEQ ID NO: 3076249 - RNA, 18 nt, Mycobacterium bovis subsp bovis AF2122/97
guuguaaaucuccucgga

SEQ ID NO: 3076250 - RNA, 16 nt, Mycobacterium bovis subsp bovis AF2122/97
guuguaccccagcauc

SEQ ID NO: 3076251 - RNA, 16 nt, Mycobacterium bovis subsp bovis AF2122/97
guuguagacggcaccc

SEQ ID NO: 3076252 - RNA, 13 nt, Mycobacterium bovis subsp bovis AF2122/97
guuguagacggcg

SEQ ID NO: 3076253 - RNA, 14 nt, Mycobacterium bovis subsp bovis AF2122/97
guuguagacggcgg

SEQ ID NO: 3076254 - RNA, 17 nt, Mycobacterium bovis subsp bovis AF2122/97
guuguagacggcggcau

SEQ ID NO: 3076255 - RNA, 16 nt, Mycobacterium bovis subsp bovis AF2122/97
guuugggauccuggcc

SEQ ID NO: 3076256 - RNA, 15 nt, Mycobacterium bovis subsp bovis AF2122/97
guuuggguuuuguuu

SEQ ID NO: 3076257 - RNA, 19 nt, Mycobacterium bovis subsp bovis AF2122/97
guuuggugucgaucagcuc

SEQ ID NO: 3076258 - RNA, 20 nt, Mycobacterium bovis subsp bovis AF2122/97
guuuggugucgaucagcucc

SEQ ID NO: 3076259 - RNA, 17 nt, Mycobacterium bovis subsp bovis AF2122/97
guuugguuuucccggcg

SEQ ID NO: 3076260 - RNA, 15 nt, Mycobacterium bovis subsp bovis AF2122/97
guuuguagucacggu

SEQ ID NO: 3076261 - RNA, 19 nt, Mycobacterium bovis subsp bovis AF2122/97
guuugucgugucaugcuca

SEQ ID NO: 3076262 - RNA, 20 nt, Mycobacterium bovis subsp bovis AF2122/97
guuuucagagccgggcuggc

SEQ ID NO: 3076263 - RNA, 14 nt, Mycobacterium bovis subsp bovis AF2122/97
guuuuccaccagcg

SEQ ID NO: 3076264 - RNA, 15 nt, Mycobacterium bovis subsp bovis AF2122/97
guuuucgaucuggcu

SEQ ID NO: 3076265 - RNA, 16 nt, Mycobacterium bovis subsp bovis AF2122/97
guuuucggccgccagu

SEQ ID NO: 3076266 - RNA, 18 nt, Mycobacterium bovis subsp bovis AF2122/97
guuuucggccgccaguac

SEQ ID NO: 3076267 - RNA, 18 nt, Mycobacterium bovis subsp bovis AF2122/97
guuuuugcagacucggcg

SEQ ID NO: 3076268 - RNA, 18 nt, Mycobacterium bovis subsp bovis AF2122/97
guuuuuguauguucggcg

SEQ ID NO: 3076269 - RNA, 14 nt, Mycobacterium bovis subsp bovis AF2122/97
uaaaaaccaccccc

SEQ ID NO: 3076270 - RNA, 15 nt, Mycobacterium bovis subsp bovis AF2122/97
uaaaaagcccagcga

SEQ ID NO: 3076271 - RNA, 20 nt, Mycobacterium bovis subsp bovis AF2122/97
uaaaaaggcaggacugaaca

SEQ ID NO: 3076272 - RNA, 23 nt, Mycobacterium bovis subsp bovis AF2122/97
uaaaacucgggggcugcacgcuc

SEQ ID NO: 3076273 - RNA, 21 nt, Mycobacterium bovis subsp bovis AF2122/97
uaaacaccgcgaacuugcuga

SEQ ID NO: 3076274 - RNA, 20 nt, Mycobacterium bovis subsp bovis AF2122/97
uaaacauacaaaaacaccac

SEQ ID NO: 3076275 - RNA, 19 nt, Mycobacterium bovis subsp bovis AF2122/97
uaaaccagccaccaccagg

SEQ ID NO: 3076276 - RNA, 22 nt, Mycobacterium bovis subsp bovis AF2122/97
uaaacccggcgagggcaacgag

SEQ ID NO: 3076277 - RNA, 21 nt, Mycobacterium bovis subsp bovis AF2122/97
uaaaccgcugcuugucgaggc

SEQ ID NO: 3076278 - RNA, 17 nt, Mycobacterium bovis subsp bovis AF2122/97
uaaaccguggccgcgau

SEQ ID NO: 3076279 - RNA, 20 nt, Mycobacterium bovis subsp bovis AF2122/97
uaaaccuggcuaucgcagaa

SEQ ID NO: 3076280 - RNA, 13 nt, Mycobacterium bovis subsp bovis AF2122/97
uaaacgcggcgcg

SEQ ID NO: 3076281 - RNA, 22 nt, Mycobacterium bovis subsp bovis AF2122/97
uaaacggcacacgaguacagau

SEQ ID NO: 3076282 - RNA, 21 nt, Mycobacterium bovis subsp bovis AF2122/97
uaaacgggccggugcgcacca

SEQ ID NO: 3076283 - RNA, 20 nt, Mycobacterium bovis subsp bovis AF2122/97
uaaagccaacuggucgccaa

SEQ ID NO: 3076284 - RNA, 15 nt, Mycobacterium bovis subsp bovis AF2122/97
uaaagcccggcggca

SEQ ID NO: 3076285 - RNA, 18 nt, Mycobacterium bovis subsp bovis AF2122/97
uaaaggccuugggcggca

SEQ ID NO: 3076286 - RNA, 19 nt, Mycobacterium bovis subsp bovis AF2122/97
uaaauaucggggccacuga

SEQ ID NO: 3076287 - RNA, 21 nt, Mycobacterium bovis subsp bovis AF2122/97
uaaauggccgaugagcccagc

SEQ ID NO: 3076288 - RNA, 21 nt, Mycobacterium bovis subsp bovis AF2122/97
uaaaugggugugcugccaccg

SEQ ID NO: 3076289 - RNA, 17 nt, Mycobacterium bovis subsp bovis AF2122/97
uaacaacaccaccagca

SEQ ID NO: 3076290 - RNA, 19 nt, Mycobacterium bovis subsp bovis AF2122/97
uaacagauuguccggccgg

SEQ ID NO: 3076291 - RNA, 16 nt, Mycobacterium bovis subsp bovis AF2122/97
uaaccacggugugcua

SEQ ID NO: 3076292 - RNA, 16 nt, Mycobacterium bovis subsp bovis AF2122/97
uaacccaaccgcgcca

SEQ ID NO: 3076293 - RNA, 13 nt, Mycobacterium bovis subsp bovis AF2122/97
uaacccagcacca

SEQ ID NO: 3076294 - RNA, 15 nt, Mycobacterium bovis subsp bovis AF2122/97
uaacccagcggcgcc

SEQ ID NO: 3076295 - RNA, 19 nt, Mycobacterium bovis subsp bovis AF2122/97
uaacccggcuccagcaccg

SEQ ID NO: 3076296 - RNA, 20 nt, Mycobacterium bovis subsp bovis AF2122/97
uaacccggcuccagcaccgu

SEQ ID NO: 3076297 - RNA, 17 nt, Mycobacterium bovis subsp bovis AF2122/97
uaaccgagccgaccggc

SEQ ID NO: 3076298 - RNA, 21 nt, Mycobacterium bovis subsp bovis AF2122/97
uaaccgagccgaccggcggca

SEQ ID NO: 3076299 - RNA, 22 nt, Mycobacterium bovis subsp bovis AF2122/97
uaaccgcgaccagcuggccgua

SEQ ID NO: 3076300 - RNA, 17 nt, Mycobacterium bovis subsp bovis AF2122/97
uaaccggcaugccgcca

SEQ ID NO: 3076301 - RNA, 21 nt, Mycobacterium bovis subsp bovis AF2122/97
uaaccggcggauucggcgcug

SEQ ID NO: 3076302 - RNA, 19 nt, Mycobacterium bovis subsp bovis AF2122/97
uaaccgucgccugccgacg

SEQ ID NO: 3076303 - RNA, 21 nt, Mycobacterium bovis subsp bovis AF2122/97
uaacgacgguuccgccaccgg

SEQ ID NO: 3076304 - RNA, 14 nt, Mycobacterium bovis subsp bovis AF2122/97
uaacgacgucggcg

SEQ ID NO: 3076305 - RNA, 14 nt, Mycobacterium bovis subsp bovis AF2122/97
uaacgacugacaac

SEQ ID NO: 3076306 - RNA, 18 nt, Mycobacterium bovis subsp bovis AF2122/97
uaacgacugacaacggcc

SEQ ID NO: 3076307 - RNA, 14 nt, Mycobacterium bovis subsp bovis AF2122/97
uaacgagccgucca

SEQ ID NO: 3076308 - RNA, 23 nt, Mycobacterium bovis subsp bovis AF2122/97
uaacgcacccaccgaaccgaggg

SEQ ID NO: 3076309 - RNA, 22 nt, Mycobacterium bovis subsp bovis AF2122/97
uaacgcaccugcgcgcggccgc

SEQ ID NO: 3076310 - RNA, 14 nt, Mycobacterium bovis subsp bovis AF2122/97
uaacgcaggcagug

SEQ ID NO: 3076311 - RNA, 19 nt, Mycobacterium bovis subsp bovis AF2122/97
uaacgccaagcucggccca

SEQ ID NO: 3076312 - RNA, 13 nt, Mycobacterium bovis subsp bovis AF2122/97
uaacgcgcguccg

SEQ ID NO: 3076313 - RNA, 23 nt, Mycobacterium bovis subsp bovis AF2122/97
uaacgcugcucguaggugccgaa

SEQ ID NO: 3076314 - RNA, 16 nt, Mycobacterium bovis subsp bovis AF2122/97
uaacggcgaccgccau

SEQ ID NO: 3076315 - RNA, 17 nt, Mycobacterium bovis subsp bovis AF2122/97
uaacgguaaccggcccg

SEQ ID NO: 3076316 - RNA, 18 nt, Mycobacterium bovis subsp bovis AF2122/97
uaacggucgcugucggca

SEQ ID NO: 3076317 - RNA, 21 nt, Mycobacterium bovis subsp bovis AF2122/97
uaacucgccugcacccggcga

SEQ ID NO: 3076318 - RNA, 15 nt, Mycobacterium bovis subsp bovis AF2122/97
uaacuguccgcccgg

SEQ ID NO: 3076319 - RNA, 15 nt, Mycobacterium bovis subsp bovis AF2122/97
uaagacggcgacgac

SEQ ID NO: 3076320 - RNA, 14 nt, Mycobacterium bovis subsp bovis AF2122/97
uaagacgucggacg

SEQ ID NO: 3076321 - RNA, 12 nt, Mycobacterium bovis subsp bovis AF2122/97
uaagcaccagcc

SEQ ID NO: 3076322 - RNA, 21 nt, Mycobacterium bovis subsp bovis AF2122/97
uaagcagccagcaacaccaga

SEQ ID NO: 3076323 - RNA, 17 nt, Mycobacterium bovis subsp bovis AF2122/97
uaagcauucagcgcgcc

SEQ ID NO: 3076324 - RNA, 18 nt, Mycobacterium bovis subsp bovis AF2122/97
uaagcccccgcacgcacg

SEQ ID NO: 3076325 - RNA, 21 nt, Mycobacterium bovis subsp bovis AF2122/97
uaagccuucggugucgccgaa

SEQ ID NO: 3076326 - RNA, 22 nt, Mycobacterium bovis subsp bovis AF2122/97
uaagccuucggugucgccgaac

SEQ ID NO: 3076327 - RNA, 16 nt, Mycobacterium bovis subsp bovis AF2122/97
uaagcgaacagcggca

SEQ ID NO: 3076328 - RNA, 23 nt, Mycobacterium bovis subsp bovis AF2122/97
uaaggagccgggccguccgggua

SEQ ID NO: 3076329 - RNA, 20 nt, Mycobacterium bovis subsp bovis AF2122/97
uaaggcacguucagccaggc

SEQ ID NO: 3076330 - RNA, 15 nt, Mycobacterium bovis subsp bovis AF2122/97
uaaggcccuggccgc

SEQ ID NO: 3076331 - RNA, 19 nt, Mycobacterium bovis subsp bovis AF2122/97
uaaggcccuggccgcgccg

SEQ ID NO: 3076332 - RNA, 14 nt, Mycobacterium bovis subsp bovis AF2122/97
uaagggcacuccac

SEQ ID NO: 3076333 - RNA, 21 nt, Mycobacterium bovis subsp bovis AF2122/97
uaagggucaucgccagcggca

SEQ ID NO: 3076334 - RNA, 20 nt, Mycobacterium bovis subsp bovis AF2122/97
uaagguguggucggcugugg

SEQ ID NO: 3076335 - RNA, 13 nt, Mycobacterium bovis subsp bovis AF2122/97
uaaucaagcagcg

SEQ ID NO: 3076336 - RNA, 17 nt, Mycobacterium bovis subsp bovis AF2122/97
uaauccagcgccgaccu

SEQ ID NO: 3076337 - RNA, 18 nt, Mycobacterium bovis subsp bovis AF2122/97
uaauccagcgccgaccuc

SEQ ID NO: 3076338 - RNA, 15 nt, Mycobacterium bovis subsp bovis AF2122/97
uaauccccgacaucg

SEQ ID NO: 3076339 - RNA, 11 nt, Mycobacterium bovis subsp bovis AF2122/97
uaaucgccacc

SEQ ID NO: 3076340 - RNA, 24 nt, Mycobacterium bovis subsp bovis AF2122/97
uaaucgcgagaccaacauacagca

SEQ ID NO: 3076341 - RNA, 20 nt, Mycobacterium bovis subsp bovis AF2122/97
uacccgcaugacgccggcgg

SEQ ID NO: 3076342 - RNA, 23 nt, Mycobacterium bovis subsp bovis AF2122/97
uacccgcccacggcaccaccaag

SEQ ID NO: 3076343 - RNA, 21 nt, Mycobacterium bovis subsp bovis AF2122/97
uacccgccgcgaugccaccca

SEQ ID NO: 3076344 - RNA, 14 nt, Mycobacterium bovis subsp bovis AF2122/97
uacccgcgcgcacc

SEQ ID NO: 3076345 - RNA, 11 nt, Mycobacterium bovis subsp bovis AF2122/97
uacccgcggcg

SEQ ID NO: 3076346 - RNA, 15 nt, Mycobacterium bovis subsp bovis AF2122/97
uacccgcggggaauc

SEQ ID NO: 3076347 - RNA, 22 nt, Mycobacterium bovis subsp bovis AF2122/97
uacccgcggggaaucacccacu

SEQ ID NO: 3076348 - RNA, 16 nt, Mycobacterium bovis subsp bovis AF2122/97
uacccggaccgucgug

SEQ ID NO: 3076349 - RNA, 12 nt, Mycobacterium bovis subsp bovis AF2122/97
uacccggcgacg

SEQ ID NO: 3076350 - RNA, 20 nt, Mycobacterium bovis subsp bovis AF2122/97
uacccguagcaccacaucgg

SEQ ID NO: 3076351 - RNA, 18 nt, Mycobacterium bovis subsp bovis AF2122/97
uacccguuaugcgccgcc

SEQ ID NO: 3076352 - RNA, 11 nt, Mycobacterium bovis subsp bovis AF2122/97
uacccuuugca

SEQ ID NO: 3076353 - RNA, 13 nt, Mycobacterium bovis subsp bovis AF2122/97
uaccgaacagugg

SEQ ID NO: 3076354 - RNA, 14 nt, Mycobacterium bovis subsp bovis AF2122/97
uaccgacaccgugu

SEQ ID NO: 3076355 - RNA, 14 nt, Mycobacterium bovis subsp bovis AF2122/97
uaccgacgccggug

SEQ ID NO: 3076356 - RNA, 23 nt, Mycobacterium bovis subsp bovis AF2122/97
uaccgacggggauggagccggug

SEQ ID NO: 3076357 - RNA, 16 nt, Mycobacterium bovis subsp bovis AF2122/97
uaccgagaucaccgcc

SEQ ID NO: 3076358 - RNA, 17 nt, Mycobacterium bovis subsp bovis AF2122/97
uaccgagaucaccgcca

SEQ ID NO: 3076359 - RNA, 13 nt, Mycobacterium bovis subsp bovis AF2122/97
uaccgagcagcag

SEQ ID NO: 3076360 - RNA, 18 nt, Mycobacterium bovis subsp bovis AF2122/97
uaccgaggccaugcucgc

SEQ ID NO: 3076361 - RNA, 14 nt, Mycobacterium bovis subsp bovis AF2122/97
uaccgaucgccaag

SEQ ID NO: 3076362 - RNA, 14 nt, Mycobacterium bovis subsp bovis AF2122/97
uaccgauuggcccg

SEQ ID NO: 3076363 - RNA, 18 nt, Mycobacterium bovis subsp bovis AF2122/97
uaccgcaauggcggccuu

SEQ ID NO: 3076364 - RNA, 16 nt, Mycobacterium bovis subsp bovis AF2122/97
uaccgcaggugccacc

SEQ ID NO: 3076365 - RNA, 14 nt, Mycobacterium bovis subsp bovis AF2122/97
uaccgccagcgcca

SEQ ID NO: 3076366 - RNA, 18 nt, Mycobacterium bovis subsp bovis AF2122/97
uaccgcccgcgccaccgg

SEQ ID NO: 3076367 - RNA, 20 nt, Mycobacterium bovis subsp bovis AF2122/97
uaccgcccgcgccaccggca

SEQ ID NO: 3076368 - RNA, 18 nt, Mycobacterium bovis subsp bovis AF2122/97
uaccgccgcgaccgcgag

SEQ ID NO: 3076369 - RNA, 15 nt, Mycobacterium bovis subsp bovis AF2122/97
uaccgccgcugccga

SEQ ID NO: 3076370 - RNA, 15 nt, Mycobacterium bovis subsp bovis AF2122/97
uaccgccggccccac

SEQ ID NO: 3076371 - RNA, 20 nt, Mycobacterium bovis subsp bovis AF2122/97
uaccgccggccccaccggug

SEQ ID NO: 3076372 - RNA, 21 nt, Mycobacterium bovis subsp bovis AF2122/97
uaccgccggcgccggugccgc

SEQ ID NO: 3076373 - RNA, 16 nt, Mycobacterium bovis subsp bovis AF2122/97
uaccgccggcggcggc

SEQ ID NO: 3076374 - RNA, 20 nt, Mycobacterium bovis subsp bovis AF2122/97
uaccgccggcggcggccgca

SEQ ID NO: 3076375 - RNA, 17 nt, Mycobacterium bovis subsp bovis AF2122/97
uaccgccguuaccgacg

SEQ ID NO: 3076376 - RNA, 19 nt, Mycobacterium bovis subsp bovis AF2122/97
uaccgccguuugcgccguu

SEQ ID NO: 3076377 - RNA, 20 nt, Mycobacterium bovis subsp bovis AF2122/97
uaccgccuuugcccgccgcg

SEQ ID NO: 3076378 - RNA, 16 nt, Mycobacterium bovis subsp bovis AF2122/97
uaccgcgcguugaagu

SEQ ID NO: 3076379 - RNA, 20 nt, Mycobacterium bovis subsp bovis AF2122/97
uaccgcgugcgccggggaca

SEQ ID NO: 3076380 - RNA, 18 nt, Mycobacterium bovis subsp bovis AF2122/97
uaccgcuggaaaaucggg

SEQ ID NO: 3076381 - RNA, 22 nt, Mycobacterium bovis subsp bovis AF2122/97
uaccgcuggggcuguagucgau

SEQ ID NO: 3076382 - RNA, 14 nt, Mycobacterium bovis subsp bovis AF2122/97
uaccggaccccaac

SEQ ID NO: 3076383 - RNA, 16 nt, Mycobacterium bovis subsp bovis AF2122/97
uaccggcacgccggcg

SEQ ID NO: 3076384 - RNA, 15 nt, Mycobacterium bovis subsp bovis AF2122/97
uaccggcagcugcuc

SEQ ID NO: 3076385 - RNA, 14 nt, Mycobacterium bovis subsp bovis AF2122/97
uaccggcccggguu

SEQ ID NO: 3076386 - RNA, 17 nt, Mycobacterium bovis subsp bovis AF2122/97
uaccggccuuuccagca

SEQ ID NO: 3076387 - RNA, 18 nt, Mycobacterium bovis subsp bovis AF2122/97
uaccggccuuuccagcac

SEQ ID NO: 3076388 - RNA, 18 nt, Mycobacterium bovis subsp bovis AF2122/97
uaccggcgaucugcugug

SEQ ID NO: 3076389 - RNA, 21 nt, Mycobacterium bovis subsp bovis AF2122/97
uaccggcgaucugcugugucg

SEQ ID NO: 3076390 - RNA, 17 nt, Mycobacterium bovis subsp bovis AF2122/97
uaccggcggcgccggag

SEQ ID NO: 3076391 - RNA, 17 nt, Mycobacterium bovis subsp bovis AF2122/97
uaccggcggcgccgggg

SEQ ID NO: 3076392 - RNA, 13 nt, Mycobacterium bovis subsp bovis AF2122/97
uaccggcgggcga

SEQ ID NO: 3076393 - RNA, 14 nt, Mycobacterium bovis subsp bovis AF2122/97
uaccggcgugcagu

SEQ ID NO: 3076394 - RNA, 23 nt, Mycobacterium bovis subsp bovis AF2122/97
uaccggcgugcaguacaccccau

SEQ ID NO: 3076395 - RNA, 17 nt, Mycobacterium bovis subsp bovis AF2122/97
uaccggcuacggcgaca

SEQ ID NO: 3076396 - RNA, 21 nt, Mycobacterium bovis subsp bovis AF2122/97
uaccggcuacggcgacacgcc

SEQ ID NO: 3076397 - RNA, 22 nt, Mycobacterium bovis subsp bovis AF2122/97
uaccggcuucgucggccagcag

SEQ ID NO: 3076398 - RNA, 15 nt, Mycobacterium bovis subsp bovis AF2122/97
uaccgggaucccacg

SEQ ID NO: 3076399 - RNA, 23 nt, Mycobacterium bovis subsp bovis AF2122/97
uaccgggaucccacggcgggcga

SEQ ID NO: 3076400 - RNA, 19 nt, Mycobacterium bovis subsp bovis AF2122/97
uaccgggcccgcguucucg

SEQ ID NO: 3076401 - RNA, 15 nt, Mycobacterium bovis subsp bovis AF2122/97
uaccggucagcaccu

SEQ ID NO: 3076402 - RNA, 16 nt, Mycobacterium bovis subsp bovis AF2122/97
uaccgguccagugugu

SEQ ID NO: 3076403 - RNA, 19 nt, Mycobacterium bovis subsp bovis AF2122/97
uaccggugguagcggcggu

SEQ ID NO: 3076404 - RNA, 22 nt, Mycobacterium bovis subsp bovis AF2122/97
uaccgguugcggucaucggcgc

SEQ ID NO: 3076405 - RNA, 14 nt, Mycobacterium bovis subsp bovis AF2122/97
uaccgucagcgccg

SEQ ID NO: 3076406 - RNA, 16 nt, Mycobacterium bovis subsp bovis AF2122/97
uaccgucaugggcggc

SEQ ID NO: 3076407 - RNA, 21 nt, Mycobacterium bovis subsp bovis AF2122/97
uaccgucgugcgugcggcgaa

SEQ ID NO: 3076408 - RNA, 23 nt, Mycobacterium bovis subsp bovis AF2122/97
uaccguucgggccguccucccac

SEQ ID NO: 3076409 - RNA, 16 nt, Mycobacterium bovis subsp bovis AF2122/97
uaccguuguugaggau

SEQ ID NO: 3076410 - RNA, 17 nt, Mycobacterium bovis subsp bovis AF2122/97
uaccuaacccgcgccgg

SEQ ID NO: 3076411 - RNA, 23 nt, Mycobacterium bovis subsp bovis AF2122/97
uaccuaggagugguacggcucgg

SEQ ID NO: 3076412 - RNA, 15 nt, Mycobacterium bovis subsp bovis AF2122/97
uaccucaucgcagac

SEQ ID NO: 3076413 - RNA, 18 nt, Mycobacterium bovis subsp bovis AF2122/97
uaccucccgcgugcgggg

SEQ ID NO: 3076414 - RNA, 12 nt, Mycobacterium bovis subsp bovis AF2122/97
uaccuccucgag

SEQ ID NO: 3076415 - RNA, 16 nt, Mycobacterium bovis subsp bovis AF2122/97
uaccucggccgccagc

SEQ ID NO: 3076416 - RNA, 15 nt, Mycobacterium bovis subsp bovis AF2122/97
uaccugguucgacuc

SEQ ID NO: 3076417 - RNA, 20 nt, Mycobacterium bovis subsp bovis AF2122/97
uaccugguugcugacgacug

SEQ ID NO: 3076418 - RNA, 16 nt, Mycobacterium bovis subsp bovis AF2122/97
uacgaacucaccgcca

SEQ ID NO: 3076419 - RNA, 18 nt, Mycobacterium bovis subsp bovis AF2122/97
uacgaacucaccgccaug

SEQ ID NO: 3076420 - RNA, 19 nt, Mycobacterium bovis subsp bovis AF2122/97
uacgaagccgccgcgacca

SEQ ID NO: 3076421 - RNA, 15 nt, Mycobacterium bovis subsp bovis AF2122/97
uacgacgacccgacg

SEQ ID NO: 3076422 - RNA, 22 nt, Mycobacterium bovis subsp bovis AF2122/97
uacgacgguccguucgcgccgu

SEQ ID NO: 3076423 - RNA, 15 nt, Mycobacterium bovis subsp bovis AF2122/97
uacgaugcucagcug

SEQ ID NO: 3076424 - RNA, 18 nt, Mycobacterium bovis subsp bovis AF2122/97
uacgaugcucagcugguc

SEQ ID NO: 3076425 - RNA, 15 nt, Mycobacterium bovis subsp bovis AF2122/97
uacgcaacgggucgg

SEQ ID NO: 3076426 - RNA, 16 nt, Mycobacterium bovis subsp bovis AF2122/97
uacgcaccgaggccgc

SEQ ID NO: 3076427 - RNA, 12 nt, Mycobacterium bovis subsp bovis AF2122/97
uacgcaccggua

SEQ ID NO: 3076428 - RNA, 19 nt, Mycobacterium bovis subsp bovis AF2122/97
uagaggauggucagcagcu

SEQ ID NO: 3076429 - RNA, 22 nt, Mycobacterium bovis subsp bovis AF2122/97
uagaggauggucagcagcucca

SEQ ID NO: 3076430 - RNA, 16 nt, Mycobacterium bovis subsp bovis AF2122/97
uagauaugcacccgca

SEQ ID NO: 3076431 - RNA, 15 nt, Mycobacterium bovis subsp bovis AF2122/97
uagaucacccgcagc

SEQ ID NO: 3076432 - RNA, 17 nt, Mycobacterium bovis subsp bovis AF2122/97
uagaucacccgcagccg

SEQ ID NO: 3076433 - RNA, 16 nt, Mycobacterium bovis subsp bovis AF2122/97
uagaucaucuggcugg

SEQ ID NO: 3076434 - RNA, 23 nt, Mycobacterium bovis subsp bovis AF2122/97
uagaucauuucgguaauggccgc

SEQ ID NO: 3076435 - RNA, 15 nt, Mycobacterium bovis subsp bovis AF2122/97
uagauccaaacaccc

SEQ ID NO: 3076436 - RNA, 11 nt, Mycobacterium bovis subsp bovis AF2122/97
uagaucgccuc

SEQ ID NO: 3076437 - RNA, 19 nt, Mycobacterium bovis subsp bovis AF2122/97
uagaucgcguggaucgcgc

SEQ ID NO: 3076438 - RNA, 14 nt, Mycobacterium bovis subsp bovis AF2122/97
uagaucugggcugg

SEQ ID NO: 3076439 - RNA, 16 nt, Mycobacterium bovis subsp bovis AF2122/97
uagaugacgggcucgu

SEQ ID NO: 3076440 - RNA, 15 nt, Mycobacterium bovis subsp bovis AF2122/97
uagaugcgugcggca

SEQ ID NO: 3076441 - RNA, 15 nt, Mycobacterium bovis subsp bovis AF2122/97
uagcaauccgcacag

SEQ ID NO: 3076442 - RNA, 20 nt, Mycobacterium bovis subsp bovis AF2122/97
uagcaaucggcaggauuccc

SEQ ID NO: 3076443 - RNA, 21 nt, Mycobacterium bovis subsp bovis AF2122/97
uagcacagcagcaacgcggug

SEQ ID NO: 3076444 - RNA, 16 nt, Mycobacterium bovis subsp bovis AF2122/97
uagcacaucaugaaga

SEQ ID NO: 3076445 - RNA, 12 nt, Mycobacterium bovis subsp bovis AF2122/97
uagcaccacauc

SEQ ID NO: 3076446 - RNA, 23 nt, Mycobacterium bovis subsp bovis AF2122/97
uagcaccaguuugugccgccgcg

SEQ ID NO: 3076447 - RNA, 11 nt, Mycobacterium bovis subsp bovis AF2122/97
uagcacccacg

SEQ ID NO: 3076448 - RNA, 13 nt, Mycobacterium bovis subsp bovis AF2122/97
uagcaccgcgccg

SEQ ID NO: 3076449 - RNA, 21 nt, Mycobacterium bovis subsp bovis AF2122/97
uagcaccgcgccgaacacgca

SEQ ID NO: 3076450 - RNA, 17 nt, Mycobacterium bovis subsp bovis AF2122/97
uagcacgggcacgaucg

SEQ ID NO: 3076451 - RNA, 21 nt, Mycobacterium bovis subsp bovis AF2122/97
uagcacgggcacgaucgucgc

SEQ ID NO: 3076452 - RNA, 22 nt, Mycobacterium bovis subsp bovis AF2122/97
uagcacguugacguccaacagc

SEQ ID NO: 3076453 - RNA, 14 nt, Mycobacterium bovis subsp bovis AF2122/97
uagcagaaggccgc

SEQ ID NO: 3076454 - RNA, 13 nt, Mycobacterium bovis subsp bovis AF2122/97
uagcagccgcuga

SEQ ID NO: 3076455 - RNA, 14 nt, Mycobacterium bovis subsp bovis AF2122/97
uagcaggucgacgg

SEQ ID NO: 3076456 - RNA, 19 nt, Mycobacterium bovis subsp bovis AF2122/97
uagcaggucgacggccacg

SEQ ID NO: 3076457 - RNA, 13 nt, Mycobacterium bovis subsp bovis AF2122/97
uagcagugcagca

SEQ ID NO: 3076458 - RNA, 14 nt, Mycobacterium bovis subsp bovis AF2122/97
uagcagugcagcaa

SEQ ID NO: 3076459 - RNA, 17 nt, Mycobacterium bovis subsp bovis AF2122/97
uagcauugucgccggau

SEQ ID NO: 3076460 - RNA, 22 nt, Mycobacterium bovis subsp bovis AF2122/97
uagccaagcgagcggucgacgu

SEQ ID NO: 3076461 - RNA, 22 nt, Mycobacterium bovis subsp bovis AF2122/97
uagccaaugcccuuggccagca

SEQ ID NO: 3076462 - RNA, 16 nt, Mycobacterium bovis subsp bovis AF2122/97
uagccaccaagcacaa

SEQ ID NO: 3076463 - RNA, 16 nt, Mycobacterium bovis subsp bovis AF2122/97
uagccacgcaagcaaa

SEQ ID NO: 3076464 - RNA, 19 nt, Mycobacterium bovis subsp bovis AF2122/97
uagccagcgucucaaggcc

SEQ ID NO: 3076465 - RNA, 20 nt, Mycobacterium bovis subsp bovis AF2122/97
uagccagcgucucaaggccu

SEQ ID NO: 3076466 - RNA, 17 nt, Mycobacterium bovis subsp bovis AF2122/97
uagccaggcaaccgguc

SEQ ID NO: 3076467 - RNA, 15 nt, Mycobacterium bovis subsp bovis AF2122/97
uagccaggucgauac

SEQ ID NO: 3076468 - RNA, 23 nt, Mycobacterium bovis subsp bovis AF2122/97
uagccaggucgauaccggcgugc

SEQ ID NO: 3076469 - RNA, 15 nt, Mycobacterium bovis subsp bovis AF2122/97
uagccagucggccac

SEQ ID NO: 3076470 - RNA, 21 nt, Mycobacterium bovis subsp bovis AF2122/97
uagccagucggccaccugguc

SEQ ID NO: 3076471 - RNA, 22 nt, Mycobacterium bovis subsp bovis AF2122/97
uagccaugggauucggccagac

SEQ ID NO: 3076472 - RNA, 20 nt, Mycobacterium bovis subsp bovis AF2122/97
uagccauucgguguggccgu

SEQ ID NO: 3076473 - RNA, 16 nt, Mycobacterium bovis subsp bovis AF2122/97
uagccauuuccuuggc

SEQ ID NO: 3076474 - RNA, 22 nt, Mycobacterium bovis subsp bovis AF2122/97
uagcccccgcgggggcggccgg

SEQ ID NO: 3076475 - RNA, 18 nt, Mycobacterium bovis subsp bovis AF2122/97
uagcccgaccgguccagc

SEQ ID NO: 3076476 - RNA, 19 nt, Mycobacterium bovis subsp bovis AF2122/97
uagcccgaucgaagaaacg

SEQ ID NO: 3076477 - RNA, 21 nt, Mycobacterium bovis subsp bovis AF2122/97
uagcccgccacccuuggcccg

SEQ ID NO: 3076478 - RNA, 15 nt, Mycobacterium bovis subsp bovis AF2122/97
uagcccggcagcacg

SEQ ID NO: 3076479 - RNA, 13 nt, Mycobacterium bovis subsp bovis AF2122/97
uagcccggccgcg

SEQ ID NO: 3076480 - RNA, 16 nt, Mycobacterium bovis subsp bovis AF2122/97
uagcccuccgagcaca

SEQ ID NO: 3076481 - RNA, 15 nt, Mycobacterium bovis subsp bovis AF2122/97
uagccgaaaaagacc

SEQ ID NO: 3076482 - RNA, 19 nt, Mycobacterium bovis subsp bovis AF2122/97
uagccgaagcgcccggaga

SEQ ID NO: 3076483 - RNA, 14 nt, Mycobacterium bovis subsp bovis AF2122/97
uagccgaccaggac

SEQ ID NO: 3076484 - RNA, 18 nt, Mycobacterium bovis subsp bovis AF2122/97
uagccgaccaggaccacc

SEQ ID NO: 3076485 - RNA, 17 nt, Mycobacterium bovis subsp bovis AF2122/97
uagccgacuaucggccg

SEQ ID NO: 3076486 - RNA, 19 nt, Mycobacterium bovis subsp bovis AF2122/97
uagccgacuaucggccgcc

SEQ ID NO: 3076487 - RNA, 22 nt, Mycobacterium bovis subsp bovis AF2122/97
uagccgacuaucggccgccgga

SEQ ID NO: 3076488 - RNA, 13 nt, Mycobacterium bovis subsp bovis AF2122/97
uagccgagccagu

SEQ ID NO: 3076489 - RNA, 15 nt, Mycobacterium bovis subsp bovis AF2122/97
uagccgauccagcag

SEQ ID NO: 3076490 - RNA, 18 nt, Mycobacterium bovis subsp bovis AF2122/97
uagccgcagaugcaguuc

SEQ ID NO: 3076491 - RNA, 19 nt, Mycobacterium bovis subsp bovis AF2122/97
uagccgcagcuuggccuca

SEQ ID NO: 3076492 - RNA, 19 nt, Mycobacterium bovis subsp bovis AF2122/97
uagccgccgcuucacccca

SEQ ID NO: 3076493 - RNA, 15 nt, Mycobacterium bovis subsp bovis AF2122/97
uagccgccggugccg

SEQ ID NO: 3076494 - RNA, 18 nt, Mycobacterium bovis subsp bovis AF2122/97
uagccgccggugccgccg

SEQ ID NO: 3076495 - RNA, 21 nt, Mycobacterium bovis subsp bovis AF2122/97
uagccgccguggauacgcacg

SEQ ID NO: 3076496 - RNA, 12 nt, Mycobacterium bovis subsp bovis AF2122/97
uagccgcgcucg

SEQ ID NO: 3076497 - RNA, 18 nt, Mycobacterium bovis subsp bovis AF2122/97
uagccgcgcucgaacucc

SEQ ID NO: 3076498 - RNA, 21 nt, Mycobacterium bovis subsp bovis AF2122/97
uagccgcggcccgcgugcgca

SEQ ID NO: 3076499 - RNA, 19 nt, Mycobacterium bovis subsp bovis AF2122/97
uagccgcugcacguggcca

SEQ ID NO: 3076500 - RNA, 17 nt, Mycobacterium bovis subsp bovis AF2122/97
uagccgcugccuggccg

SEQ ID NO: 3076501 - RNA, 21 nt, Mycobacterium bovis subsp bovis AF2122/97
uagccgcuugggccugggccg

SEQ ID NO: 3076502 - RNA, 20 nt, Mycobacterium bovis subsp bovis AF2122/97
uagccggacuauacgcgucg

SEQ ID NO: 3076503 - RNA, 14 nt, Mycobacterium bovis subsp bovis AF2122/97
uagccggcgccgcc

SEQ ID NO: 3076504 - RNA, 17 nt, Mycobacterium bovis subsp bovis AF2122/97
uagccggcgccgccguc

SEQ ID NO: 3076505 - RNA, 18 nt, Mycobacterium bovis subsp bovis AF2122/97
uagccgggaacgcugacg

SEQ ID NO: 3076506 - RNA, 19 nt, Mycobacterium bovis subsp bovis AF2122/97
uagccgguugucgcagcgc

SEQ ID NO: 3076507 - RNA, 12 nt, Mycobacterium bovis subsp bovis AF2122/97
uagccgucgauc

SEQ ID NO: 3076508 - RNA, 18 nt, Mycobacterium bovis subsp bovis AF2122/97
uagccgucgucgucgaga

SEQ ID NO: 3076509 - RNA, 19 nt, Mycobacterium bovis subsp bovis AF2122/97
uagccgugacaaggugcgc

SEQ ID NO: 3076510 - RNA, 21 nt, Mycobacterium bovis subsp bovis AF2122/97
uagccgugggccacgaugauc

SEQ ID NO: 3076511 - RNA, 15 nt, Mycobacterium bovis subsp bovis AF2122/97
uagccguugccgccg

SEQ ID NO: 3076512 - RNA, 12 nt, Mycobacterium bovis subsp bovis AF2122/97
uagccugcggcg

SEQ ID NO: 3076513 - RNA, 15 nt, Mycobacterium bovis subsp bovis AF2122/97
uagccugcggcggcg

SEQ ID NO: 3076514 - RNA, 15 nt, Mycobacterium bovis subsp bovis AF2122/97
uagcgaagaacuggg

SEQ ID NO: 3076515 - RNA, 21 nt, Mycobacterium bovis subsp bovis AF2122/97
uaggccugagcgugucuggcg

SEQ ID NO: 3076516 - RNA, 13 nt, Mycobacterium bovis subsp bovis AF2122/97
uaggcgaccagau

SEQ ID NO: 3076517 - RNA, 14 nt, Mycobacterium bovis subsp bovis AF2122/97
uaggcgaccgccau

SEQ ID NO: 3076518 - RNA, 15 nt, Mycobacterium bovis subsp bovis AF2122/97
uaggcgauaucgccc

SEQ ID NO: 3076519 - RNA, 20 nt, Mycobacterium bovis subsp bovis AF2122/97
uaggcgauaucgcccggaac

SEQ ID NO: 3076520 - RNA, 16 nt, Mycobacterium bovis subsp bovis AF2122/97
uaggcgaucucacgca

SEQ ID NO: 3076521 - RNA, 20 nt, Mycobacterium bovis subsp bovis AF2122/97
uaggcgauucugcgucugcu

SEQ ID NO: 3076522 - RNA, 19 nt, Mycobacterium bovis subsp bovis AF2122/97
uaggcgcuccuucagggcg

SEQ ID NO: 3076523 - RNA, 21 nt, Mycobacterium bovis subsp bovis AF2122/97
uaggcggccaugucagcggcc

SEQ ID NO: 3076524 - RNA, 16 nt, Mycobacterium bovis subsp bovis AF2122/97
uaggcggcggcccgca

SEQ ID NO: 3076525 - RNA, 20 nt, Mycobacterium bovis subsp bovis AF2122/97
uaggcggcguuugaggcagc

SEQ ID NO: 3076526 - RNA, 13 nt, Mycobacterium bovis subsp bovis AF2122/97
uaggcuccaagca

SEQ ID NO: 3076527 - RNA, 17 nt, Mycobacterium bovis subsp bovis AF2122/97
uaggcuugcaaggucgc

SEQ ID NO: 3076528 - RNA, 22 nt, Mycobacterium bovis subsp bovis AF2122/97
uagggauaacgacgucggcgcg

SEQ ID NO: 3076529 - RNA, 12 nt, Mycobacterium bovis subsp bovis AF2122/97
uagggcagcgcc

SEQ ID NO: 3076530 - RNA, 16 nt, Mycobacterium bovis subsp bovis AF2122/97
uagggccgccaucccc

SEQ ID NO: 3076531 - RNA, 11 nt, Mycobacterium bovis subsp bovis AF2122/97
uagggccgcgu

SEQ ID NO: 3076532 - RNA, 13 nt, Mycobacterium bovis subsp bovis AF2122/97
uagggccggugac

SEQ ID NO: 3076533 - RNA, 16 nt, Mycobacterium bovis subsp bovis AF2122/97
uagggcggcggcgcga

SEQ ID NO: 3076534 - RNA, 21 nt, Mycobacterium bovis subsp bovis AF2122/97
uagggcugaccgaagaagccc

SEQ ID NO: 3076535 - RNA, 20 nt, Mycobacterium bovis subsp bovis AF2122/97
uagggcuguccgaccucgcc

SEQ ID NO: 3076536 - RNA, 20 nt, Mycobacterium bovis subsp bovis AF2122/97
uaggggcuuuugcgucugcu

SEQ ID NO: 3076537 - RNA, 17 nt, Mycobacterium bovis subsp bovis AF2122/97
uaggggucgaggucuuu

SEQ ID NO: 3076538 - RNA, 14 nt, Mycobacterium bovis subsp bovis AF2122/97
uaggguggccgacg

SEQ ID NO: 3076539 - RNA, 22 nt, Mycobacterium bovis subsp bovis AF2122/97
uaggguggcgauccacaggcug

SEQ ID NO: 3076540 - RNA, 18 nt, Mycobacterium bovis subsp bovis AF2122/97
uaggucagcgggcuugcc

SEQ ID NO: 3076541 - RNA, 22 nt, Mycobacterium bovis subsp bovis AF2122/97
uaggucgaccacccgcagggca

SEQ ID NO: 3076542 - RNA, 17 nt, Mycobacterium bovis subsp bovis AF2122/97
uaggugcaugucgauga

SEQ ID NO: 3076543 - RNA, 14 nt, Mycobacterium bovis subsp bovis AF2122/97
uaggugcggggccg

SEQ ID NO: 3076544 - RNA, 23 nt, Mycobacterium bovis subsp bovis AF2122/97
uaggugcucgcgaucugcucgua

SEQ ID NO: 3076545 - RNA, 13 nt, Mycobacterium bovis subsp bovis AF2122/97
uaggugggcucgu

SEQ ID NO: 3076546 - RNA, 21 nt, Mycobacterium bovis subsp bovis AF2122/97
uaggugggcucguagcgcgca

SEQ ID NO: 3076547 - RNA, 17 nt, Mycobacterium bovis subsp bovis AF2122/97
uaggugucgggcucgca

SEQ ID NO: 3076548 - RNA, 18 nt, Mycobacterium bovis subsp bovis AF2122/97
uagguucaguuccaccgc

SEQ ID NO: 3076549 - RNA, 22 nt, Mycobacterium bovis subsp bovis AF2122/97
uagguucgguagucgaugcuga

SEQ ID NO: 3076550 - RNA, 16 nt, Mycobacterium bovis subsp bovis AF2122/97
uagguugccaugccaa

SEQ ID NO: 3076551 - RNA, 15 nt, Mycobacterium bovis subsp bovis AF2122/97
uagguuuucggcggc

SEQ ID NO: 3076552 - RNA, 16 nt, Mycobacterium bovis subsp bovis AF2122/97
uagguuuucggcggcu

SEQ ID NO: 3076553 - RNA, 17 nt, Mycobacterium bovis subsp bovis AF2122/97
uagucagaaccgacggc

SEQ ID NO: 3076554 - RNA, 23 nt, Mycobacterium bovis subsp bovis AF2122/97
uagucagaugguuggaucgccac

SEQ ID NO: 3076555 - RNA, 18 nt, Mycobacterium bovis subsp bovis AF2122/97
uagucgaauggcaacaca

SEQ ID NO: 3076556 - RNA, 13 nt, Mycobacterium bovis subsp bovis AF2122/97
uagucgacgucga

SEQ ID NO: 3076557 - RNA, 22 nt, Mycobacterium bovis subsp bovis AF2122/97
uagucgaucacguacgccgccg

SEQ ID NO: 3076558 - RNA, 13 nt, Mycobacterium bovis subsp bovis AF2122/97
uagucggccagcu

SEQ ID NO: 3076559 - RNA, 22 nt, Mycobacterium bovis subsp bovis AF2122/97
uagucggccgaugaaggccggc

SEQ ID NO: 3076560 - RNA, 17 nt, Mycobacterium bovis subsp bovis AF2122/97
uagucggccuccucguc

SEQ ID NO: 3076561 - RNA, 21 nt, Mycobacterium bovis subsp bovis AF2122/97
uagucggcggugcagaucggc

SEQ ID NO: 3076562 - RNA, 14 nt, Mycobacterium bovis subsp bovis AF2122/97
uagucgggcaaggc

SEQ ID NO: 3076563 - RNA, 15 nt, Mycobacterium bovis subsp bovis AF2122/97
uagucgucggcgcug

SEQ ID NO: 3076564 - RNA, 19 nt, Mycobacterium bovis subsp bovis AF2122/97
uagucucgacaaagcggcu

SEQ ID NO: 3076565 - RNA, 23 nt, Mycobacterium bovis subsp bovis AF2122/97
uagucucgacaaagcggcugccc

SEQ ID NO: 3076566 - RNA, 21 nt, Mycobacterium bovis subsp bovis AF2122/97
uagugaacggcucgggcagcg

SEQ ID NO: 3076567 - RNA, 18 nt, Mycobacterium bovis subsp bovis AF2122/97
uagugacugguauuuccc

SEQ ID NO: 3076568 - RNA, 17 nt, Mycobacterium bovis subsp bovis AF2122/97
uagugaucgaucgcggc

SEQ ID NO: 3076569 - RNA, 21 nt, Mycobacterium bovis subsp bovis AF2122/97
uagugaugguucaugaacauc

SEQ ID NO: 3076570 - RNA, 20 nt, Mycobacterium bovis subsp bovis AF2122/97
uagugcaaugguucgugcac

SEQ ID NO: 3076571 - RNA, 22 nt, Mycobacterium bovis subsp bovis AF2122/97
uagugcgacugcgaaugcuggg

SEQ ID NO: 3076572 - RNA, 14 nt, Mycobacterium bovis subsp bovis AF2122/97
uagugcuccacguc

SEQ ID NO: 3076573 - RNA, 18 nt, Mycobacterium bovis subsp bovis AF2122/97
uaguggaacagucgaggu

SEQ ID NO: 3076574 - RNA, 16 nt, Mycobacterium bovis subsp bovis AF2122/97
uaguggaagccgacca

SEQ ID NO: 3076575 - RNA, 14 nt, Mycobacterium bovis subsp bovis AF2122/97
uaguuaacccaggg

SEQ ID NO: 3076576 - RNA, 16 nt, Mycobacterium bovis subsp bovis AF2122/97
uaguucaccaacgcgg

SEQ ID NO: 3076577 - RNA, 21 nt, Mycobacterium bovis subsp bovis AF2122/97
uaguucaccaacgcgggaacg

SEQ ID NO: 3076578 - RNA, 22 nt, Mycobacterium bovis subsp bovis AF2122/97
uaguugaggccgucgaacggua

SEQ ID NO: 3076579 - RNA, 17 nt, Mycobacterium bovis subsp bovis AF2122/97
uaguugauggccccggg

SEQ ID NO: 3076580 - RNA, 19 nt, Mycobacterium bovis subsp bovis AF2122/97
uaguugcgcggcaucccgc

SEQ ID NO: 3076581 - RNA, 11 nt, Mycobacterium bovis subsp bovis AF2122/97
uauagaagccg

SEQ ID NO: 3076582 - RNA, 17 nt, Mycobacterium bovis subsp bovis AF2122/97
uauagccgacgccggug

SEQ ID NO: 3076583 - RNA, 23 nt, Mycobacterium bovis subsp bovis AF2122/97
uauagccgguugucgcagcgcac

SEQ ID NO: 3076584 - RNA, 17 nt, Mycobacterium bovis subsp bovis AF2122/97
uauagcucacgguggcc

SEQ ID NO: 3076585 - RNA, 15 nt, Mycobacterium bovis subsp bovis AF2122/97
uauaggccgcaugcc

SEQ ID NO: 3076586 - RNA, 20 nt, Mycobacterium bovis subsp bovis AF2122/97
uauccacggucgaccaggac

SEQ ID NO: 3076587 - RNA, 18 nt, Mycobacterium bovis subsp bovis AF2122/97
uauccagucgauccuuga

SEQ ID NO: 3076588 - RNA, 17 nt, Mycobacterium bovis subsp bovis AF2122/97
uauccaugucgcgccag

SEQ ID NO: 3076589 - RNA, 19 nt, Mycobacterium bovis subsp bovis AF2122/97
uaucccgaaucucacccac

SEQ ID NO: 3076590 - RNA, 12 nt, Mycobacterium bovis subsp bovis AF2122/97
uauccgaugcga

SEQ ID NO: 3076591 - RNA, 17 nt, Mycobacterium bovis subsp bovis AF2122/97
uauccgcaggcccgcca

SEQ ID NO: 3076592 - RNA, 17 nt, Mycobacterium bovis subsp bovis AF2122/97
uauccggacuugaccag

SEQ ID NO: 3076593 - RNA, 12 nt, Mycobacterium bovis subsp bovis AF2122/97
uauccggccgag

SEQ ID NO: 3076594 - RNA, 18 nt, Mycobacterium bovis subsp bovis AF2122/97
uauccguacaguccacgc

SEQ ID NO: 3076595 - RNA, 21 nt, Mycobacterium bovis subsp bovis AF2122/97
uauccuuugccgccgaacgcc

SEQ ID NO: 3076596 - RNA, 23 nt, Mycobacterium bovis subsp bovis AF2122/97
uaucgaaagccaacucgaccgac

SEQ ID NO: 3076597 - RNA, 14 nt, Mycobacterium bovis subsp bovis AF2122/97
uaucgacaccacca

SEQ ID NO: 3076598 - RNA, 16 nt, Mycobacterium bovis subsp bovis AF2122/97
uaucgacaccaccauu

SEQ ID NO: 3076599 - RNA, 13 nt, Mycobacterium bovis subsp bovis AF2122/97
uaucgaccgccgc

SEQ ID NO: 3076600 - RNA, 16 nt, Mycobacterium bovis subsp bovis AF2122/97
uaucgaugcggcgacc

SEQ ID NO: 3076601 - RNA, 14 nt, Mycobacterium bovis subsp bovis AF2122/97
ucaacgacaccaga

SEQ ID NO: 3076602 - RNA, 20 nt, Mycobacterium bovis subsp bovis AF2122/97
ucaacgacauugccacggcg

SEQ ID NO: 3076603 - RNA, 19 nt, Mycobacterium bovis subsp bovis AF2122/97
ucaacgacgacgacaagug

SEQ ID NO: 3076604 - RNA, 22 nt, Mycobacterium bovis subsp bovis AF2122/97
ucaacgacgacgacaagugccc

SEQ ID NO: 3076605 - RNA, 16 nt, Mycobacterium bovis subsp bovis AF2122/97
ucaacgaucgcgccgu

SEQ ID NO: 3076606 - RNA, 19 nt, Mycobacterium bovis subsp bovis AF2122/97
ucaacgcaaucgacugauc

SEQ ID NO: 3076607 - RNA, 21 nt, Mycobacterium bovis subsp bovis AF2122/97
ucaacgcacggcagacacgcu

SEQ ID NO: 3076608 - RNA, 16 nt, Mycobacterium bovis subsp bovis AF2122/97
ucaacgccacgccgau

SEQ ID NO: 3076609 - RNA, 18 nt, Mycobacterium bovis subsp bovis AF2122/97
ucaacgccucugcucagc

SEQ ID NO: 3076610 - RNA, 21 nt, Mycobacterium bovis subsp bovis AF2122/97
ucaacgccucugcucagccgu

SEQ ID NO: 3076611 - RNA, 18 nt, Mycobacterium bovis subsp bovis AF2122/97
ucaacgcguugcacagca

SEQ ID NO: 3076612 - RNA, 21 nt, Mycobacterium bovis subsp bovis AF2122/97
ucaacggaagaagcaguagcu

SEQ ID NO: 3076613 - RNA, 22 nt, Mycobacterium bovis subsp bovis AF2122/97
ucaacggcagaucccacgccag

SEQ ID NO: 3076614 - RNA, 17 nt, Mycobacterium bovis subsp bovis AF2122/97
ucaacggcgacaucggc

SEQ ID NO: 3076615 - RNA, 17 nt, Mycobacterium bovis subsp bovis AF2122/97
ucaacggcggcaacggc

SEQ ID NO: 3076616 - RNA, 18 nt, Mycobacterium bovis subsp bovis AF2122/97
ucaacgggaugccggcga

SEQ ID NO: 3076617 - RNA, 13 nt, Mycobacterium bovis subsp bovis AF2122/97
ucaacgggccgca

SEQ ID NO: 3076618 - RNA, 21 nt, Mycobacterium bovis subsp bovis AF2122/97
ucaacgggccgcaucgucgcc

SEQ ID NO: 3076619 - RNA, 20 nt, Mycobacterium bovis subsp bovis AF2122/97
ucaacggucucaacgcaucg

SEQ ID NO: 3076620 - RNA, 21 nt, Mycobacterium bovis subsp bovis AF2122/97
ucaacggucucaacgcaucgg

SEQ ID NO: 3076621 - RNA, 15 nt, Mycobacterium bovis subsp bovis AF2122/97
ucaacguggaaaccg

SEQ ID NO: 3076622 - RNA, 23 nt, Mycobacterium bovis subsp bovis AF2122/97
ucaacucccgaacacuuugcgca

SEQ ID NO: 3076623 - RNA, 13 nt, Mycobacterium bovis subsp bovis AF2122/97
ucaacuccggcac

SEQ ID NO: 3076624 - RNA, 15 nt, Mycobacterium bovis subsp bovis AF2122/97
ucaacucgggcagcg

SEQ ID NO: 3076625 - RNA, 16 nt, Mycobacterium bovis subsp bovis AF2122/97
ucaagaaaggcaaccg

SEQ ID NO: 3076626 - RNA, 15 nt, Mycobacterium bovis subsp bovis AF2122/97
ucaagaaggccagcg

SEQ ID NO: 3076627 - RNA, 19 nt, Mycobacterium bovis subsp bovis AF2122/97
ucaagaaggccagcgcgcc

SEQ ID NO: 3076628 - RNA, 19 nt, Mycobacterium bovis subsp bovis AF2122/97
ucaagagugcucagcgcgc

SEQ ID NO: 3076629 - RNA, 20 nt, Mycobacterium bovis subsp bovis AF2122/97
ucaagaucggugccagcacu

SEQ ID NO: 3076630 - RNA, 18 nt, Mycobacterium bovis subsp bovis AF2122/97
ucaagcacacuggccaca

SEQ ID NO: 3076631 - RNA, 21 nt, Mycobacterium bovis subsp bovis AF2122/97
ucaagcacacuggccacaauc

SEQ ID NO: 3076632 - RNA, 12 nt, Mycobacterium bovis subsp bovis AF2122/97
ucaagcacagcc

SEQ ID NO: 3076633 - RNA, 13 nt, Mycobacterium bovis subsp bovis AF2122/97
ucaagcacagccc

SEQ ID NO: 3076634 - RNA, 14 nt, Mycobacterium bovis subsp bovis AF2122/97
ucaagcacagcccg

SEQ ID NO: 3076635 - RNA, 22 nt, Mycobacterium bovis subsp bovis AF2122/97
ucaagcacagcccggcgacgac

SEQ ID NO: 3076636 - RNA, 13 nt, Mycobacterium bovis subsp bovis AF2122/97
ucaagcagcgugg

SEQ ID NO: 3076637 - RNA, 17 nt, Mycobacterium bovis subsp bovis AF2122/97
ucaagccggcgcccgcc

SEQ ID NO: 3076638 - RNA, 22 nt, Mycobacterium bovis subsp bovis AF2122/97
ucaagccggcgcccgccgcgaa

SEQ ID NO: 3076639 - RNA, 15 nt, Mycobacterium bovis subsp bovis AF2122/97
ucaagccgugcugcc

SEQ ID NO: 3076640 - RNA, 21 nt, Mycobacterium bovis subsp bovis AF2122/97
ucaagcgaugucccaucgcgu

SEQ ID NO: 3076641 - RNA, 16 nt, Mycobacterium bovis subsp bovis AF2122/97
ucaagcgggcuggcgu

SEQ ID NO: 3076642 - RNA, 20 nt, Mycobacterium bovis subsp bovis AF2122/97
ucaagcuggcccgcucauac

SEQ ID NO: 3076643 - RNA, 14 nt, Mycobacterium bovis subsp bovis AF2122/97
ucaaggaagccgcg

SEQ ID NO: 3076644 - RNA, 20 nt, Mycobacterium bovis subsp bovis AF2122/97
ucaaggaagccgcggccacg

SEQ ID NO: 3076645 - RNA, 19 nt, Mycobacterium bovis subsp bovis AF2122/97
ucaaggaccgcucugcggc

SEQ ID NO: 3076646 - RNA, 23 nt, Mycobacterium bovis subsp bovis AF2122/97
ucaaggaccgcucugcggccacg

SEQ ID NO: 3076647 - RNA, 18 nt, Mycobacterium bovis subsp bovis AF2122/97
ucaaggacgcaccgccag

SEQ ID NO: 3076648 - RNA, 16 nt, Mycobacterium bovis subsp bovis AF2122/97
ucaaggccuuucaaca

SEQ ID NO: 3076649 - RNA, 16 nt, Mycobacterium bovis subsp bovis AF2122/97
ucaaggcuucggcggc

SEQ ID NO: 3076650 - RNA, 18 nt, Mycobacterium bovis subsp bovis AF2122/97
ucaagggggucgagcgcu

SEQ ID NO: 3076651 - RNA, 20 nt, Mycobacterium bovis subsp bovis AF2122/97
ucaaggucuuuagccgccgc

SEQ ID NO: 3076652 - RNA, 14 nt, Mycobacterium bovis subsp bovis AF2122/97
ucaaggugaucagc

SEQ ID NO: 3076653 - RNA, 20 nt, Mycobacterium bovis subsp bovis AF2122/97
ucaaggugucaacgcgcggc

SEQ ID NO: 3076654 - RNA, 14 nt, Mycobacterium bovis subsp bovis AF2122/97
ucaaggugucgacg

SEQ ID NO: 3076655 - RNA, 22 nt, Mycobacterium bovis subsp bovis AF2122/97
ucaagucugugcucacggcggc

SEQ ID NO: 3076656 - RNA, 17 nt, Mycobacterium bovis subsp bovis AF2122/97
ucaaguucgccagcaac

SEQ ID NO: 3076657 - RNA, 22 nt, Mycobacterium bovis subsp bovis AF2122/97
ucaauaauggcaaccagcuucu

SEQ ID NO: 3076658 - RNA, 16 nt, Mycobacterium bovis subsp bovis AF2122/97
ucaauaguguguuugg

SEQ ID NO: 3076659 - RNA, 16 nt, Mycobacterium bovis subsp bovis AF2122/97
ucaaucgcgucaucaa

SEQ ID NO: 3076660 - RNA, 21 nt, Mycobacterium bovis subsp bovis AF2122/97
ucaaucgucaagaacgccacg

SEQ ID NO: 3076661 - RNA, 18 nt, Mycobacterium bovis subsp bovis AF2122/97
ucaaucuucccaccuuua

SEQ ID NO: 3076662 - RNA, 18 nt, Mycobacterium bovis subsp bovis AF2122/97
ucaaugaccaccgggcgc

SEQ ID NO: 3076663 - RNA, 14 nt, Mycobacterium bovis subsp bovis AF2122/97
ucaaugcuggcagc

SEQ ID NO: 3076664 - RNA, 23 nt, Mycobacterium bovis subsp bovis AF2122/97
ucaaugcuggcagcggccuccgg

SEQ ID NO: 3076665 - RNA, 23 nt, Mycobacterium bovis subsp bovis AF2122/97
ucaauuccgcgaguagaucaucg

SEQ ID NO: 3076666 - RNA, 16 nt, Mycobacterium bovis subsp bovis AF2122/97
ucaauuggaagacacg

SEQ ID NO: 3076667 - RNA, 13 nt, Mycobacterium bovis subsp bovis AF2122/97
ucacaaacccagc

SEQ ID NO: 3076668 - RNA, 18 nt, Mycobacterium bovis subsp bovis AF2122/97
ucacaacgcgugaccagg

SEQ ID NO: 3076669 - RNA, 23 nt, Mycobacterium bovis subsp bovis AF2122/97
ucacaacugcccgacgaccauuc

SEQ ID NO: 3076670 - RNA, 18 nt, Mycobacterium bovis subsp bovis AF2122/97
ucacaagccccgcgcguu

SEQ ID NO: 3076671 - RNA, 13 nt, Mycobacterium bovis subsp bovis AF2122/97
ucacaagccugcc

SEQ ID NO: 3076672 - RNA, 19 nt, Mycobacterium bovis subsp bovis AF2122/97
ucacacauuucgaggcgcu

SEQ ID NO: 3076673 - RNA, 22 nt, Mycobacterium bovis subsp bovis AF2122/97
ucacaccagcgggcaucgcgaa

SEQ ID NO: 3076674 - RNA, 22 nt, Mycobacterium bovis subsp bovis AF2122/97
ucacacccacacccagcgugcc

SEQ ID NO: 3076675 - RNA, 16 nt, Mycobacterium bovis subsp bovis AF2122/97
ucacacccacgucgag

SEQ ID NO: 3076676 - RNA, 15 nt, Mycobacterium bovis subsp bovis AF2122/97
ucacaccccaggcac

SEQ ID NO: 3076677 - RNA, 16 nt, Mycobacterium bovis subsp bovis AF2122/97
ucacaccccaggcacc

SEQ ID NO: 3076678 - RNA, 23 nt, Mycobacterium bovis subsp bovis AF2122/97
ucacacguuggcagcccucuggu

SEQ ID NO: 3076679 - RNA, 14 nt, Mycobacterium bovis subsp bovis AF2122/97
ucacacucccaucc

SEQ ID NO: 3076680 - RNA, 12 nt, Mycobacterium bovis subsp bovis AF2122/97
ucacacuggcuu

SEQ ID NO: 3076681 - RNA, 13 nt, Mycobacterium bovis subsp bovis AF2122/97
ucacagcacagcg

SEQ ID NO: 3076682 - RNA, 14 nt, Mycobacterium bovis subsp bovis AF2122/97
ucacagccaccagc

SEQ ID NO: 3076683 - RNA, 15 nt, Mycobacterium bovis subsp bovis AF2122/97
ucacagccaccagcc

SEQ ID NO: 3076684 - RNA, 20 nt, Mycobacterium bovis subsp bovis AF2122/97
ucacagccaccagccgggca

SEQ ID NO: 3076685 - RNA, 21 nt, Mycobacterium bovis subsp bovis AF2122/97
ucacagccggguuuggugcag

SEQ ID NO: 3076686 - RNA, 17 nt, Mycobacterium bovis subsp bovis AF2122/97
ucacagcuugagcacac

SEQ ID NO: 3076687 - RNA, 19 nt, Mycobacterium bovis subsp bovis AF2122/97
ucaccgacaugacgcggcc

SEQ ID NO: 3076688 - RNA, 20 nt, Mycobacterium bovis subsp bovis AF2122/97
ucaccgacgcacaggcgacg

SEQ ID NO: 3076689 - RNA, 23 nt, Mycobacterium bovis subsp bovis AF2122/97
ucaccgacgcacaggcgacggcc

SEQ ID NO: 3076690 - RNA, 16 nt, Mycobacterium bovis subsp bovis AF2122/97
ucaccgacggagaucg

SEQ ID NO: 3076691 - RNA, 17 nt, Mycobacterium bovis subsp bovis AF2122/97
ucaccgacgucgccaag

SEQ ID NO: 3076692 - RNA, 19 nt, Mycobacterium bovis subsp bovis AF2122/97
ucaccgagucgacggccag

SEQ ID NO: 3076693 - RNA, 17 nt, Mycobacterium bovis subsp bovis AF2122/97
ucaccgaucccgcggcc

SEQ ID NO: 3076694 - RNA, 18 nt, Mycobacterium bovis subsp bovis AF2122/97
ucaccgaucccgcggccg

SEQ ID NO: 3076695 - RNA, 22 nt, Mycobacterium bovis subsp bovis AF2122/97
ucaccgaucccgcggccgggcc

SEQ ID NO: 3076696 - RNA, 18 nt, Mycobacterium bovis subsp bovis AF2122/97
ucaccgaucgaacagugc

SEQ ID NO: 3076697 - RNA, 17 nt, Mycobacterium bovis subsp bovis AF2122/97
ucaccgaucucgaccag

SEQ ID NO: 3076698 - RNA, 15 nt, Mycobacterium bovis subsp bovis AF2122/97
ucaccgaugcgccgg

SEQ ID NO: 3076699 - RNA, 16 nt, Mycobacterium bovis subsp bovis AF2122/97
ucaccgauucggccag

SEQ ID NO: 3076700 - RNA, 21 nt, Mycobacterium bovis subsp bovis AF2122/97
ucaccgcacaccugcgcggcg

SEQ ID NO: 3076701 - RNA, 22 nt, Mycobacterium bovis subsp bovis AF2122/97
ucaccgcacaccugcgcggcgu

SEQ ID NO: 3076702 - RNA, 15 nt, Mycobacterium bovis subsp bovis AF2122/97
ucaccgcagccaacg

SEQ ID NO: 3076703 - RNA, 13 nt, Mycobacterium bovis subsp bovis AF2122/97
ucaccgccagccc

SEQ ID NO: 3076704 - RNA, 18 nt, Mycobacterium bovis subsp bovis AF2122/97
ucaccgccagcugggcag

SEQ ID NO: 3076705 - RNA, 21 nt, Mycobacterium bovis subsp bovis AF2122/97
ucaccgccagcugggcagcca

SEQ ID NO: 3076706 - RNA, 14 nt, Mycobacterium bovis subsp bovis AF2122/97
ucaccgcccuugcc

SEQ ID NO: 3076707 - RNA, 17 nt, Mycobacterium bovis subsp bovis AF2122/97
ucaccgcccuugccgcc

SEQ ID NO: 3076708 - RNA, 18 nt, Mycobacterium bovis subsp bovis AF2122/97
ucaccgcccuugccgccg

SEQ ID NO: 3076709 - RNA, 22 nt, Mycobacterium bovis subsp bovis AF2122/97
ucaccgcccuugccgccggccc

SEQ ID NO: 3076710 - RNA, 14 nt, Mycobacterium bovis subsp bovis AF2122/97
ucaccgccgcgacc

SEQ ID NO: 3076711 - RNA, 15 nt, Mycobacterium bovis subsp bovis AF2122/97
ucaccgccgcgaccg

SEQ ID NO: 3076712 - RNA, 15 nt, Mycobacterium bovis subsp bovis AF2122/97
ucaccgccgcggccg

SEQ ID NO: 3076713 - RNA, 16 nt, Mycobacterium bovis subsp bovis AF2122/97
ucaccgccgcggccgc

SEQ ID NO: 3076714 - RNA, 17 nt, Mycobacterium bovis subsp bovis AF2122/97
ucaccgccgcuaccgcc

SEQ ID NO: 3076715 - RNA, 22 nt, Mycobacterium bovis subsp bovis AF2122/97
ucaccgccgcuaccgcccgcgc

SEQ ID NO: 3076716 - RNA, 13 nt, Mycobacterium bovis subsp bovis AF2122/97
ucaccgccggcac

SEQ ID NO: 3076717 - RNA, 15 nt, Mycobacterium bovis subsp bovis AF2122/97
ucaccgccggcggcg

SEQ ID NO: 3076718 - RNA, 15 nt, Mycobacterium bovis subsp bovis AF2122/97
ucaccgccgucaccg

SEQ ID NO: 3076719 - RNA, 24 nt, Mycobacterium bovis subsp bovis AF2122/97
ucaccgccgucggguugcgacgaa

SEQ ID NO: 3076720 - RNA, 18 nt, Mycobacterium bovis subsp bovis AF2122/97
ucaccgccguuaccgccg

SEQ ID NO: 3076721 - RNA, 19 nt, Mycobacterium bovis subsp bovis AF2122/97
ucaccgccguugccgaucg

SEQ ID NO: 3076722 - RNA, 21 nt, Mycobacterium bovis subsp bovis AF2122/97
ucaccgccugugccgccggcg

SEQ ID NO: 3076723 - RNA, 22 nt, Mycobacterium bovis subsp bovis AF2122/97
ucaccgccugugccgccggcgc

SEQ ID NO: 3076724 - RNA, 22 nt, Mycobacterium bovis subsp bovis AF2122/97
ucaccgccuuugccgccggcac

SEQ ID NO: 3076725 - RNA, 12 nt, Mycobacterium bovis subsp bovis AF2122/97
ucaccgcgaccc

SEQ ID NO: 3076726 - RNA, 15 nt, Mycobacterium bovis subsp bovis AF2122/97
ucaccgcgcccgccg

SEQ ID NO: 3076727 - RNA, 21 nt, Mycobacterium bovis subsp bovis AF2122/97
ucaccgcggagauaccggacc

SEQ ID NO: 3076728 - RNA, 18 nt, Mycobacterium bovis subsp bovis AF2122/97
ucaccgcguagaccccaa

SEQ ID NO: 3076729 - RNA, 19 nt, Mycobacterium bovis subsp bovis AF2122/97
ucaccgcguaguccaggcc

SEQ ID NO: 3076730 - RNA, 16 nt, Mycobacterium bovis subsp bovis AF2122/97
ucaccggagcgccgag

SEQ ID NO: 3076731 - RNA, 16 nt, Mycobacterium bovis subsp bovis AF2122/97
ucaccggauucuucgg

SEQ ID NO: 3076732 - RNA, 18 nt, Mycobacterium bovis subsp bovis AF2122/97
ucaccggcauacagccgg

SEQ ID NO: 3076733 - RNA, 19 nt, Mycobacterium bovis subsp bovis AF2122/97
ucaccggcgcccagcgccu

SEQ ID NO: 3076734 - RNA, 18 nt, Mycobacterium bovis subsp bovis AF2122/97
ucaccggcuggugccaac

SEQ ID NO: 3076735 - RNA, 20 nt, Mycobacterium bovis subsp bovis AF2122/97
ucaccggcuucggccagcag

SEQ ID NO: 3076736 - RNA, 17 nt, Mycobacterium bovis subsp bovis AF2122/97
ucaccgggcccgacgac

SEQ ID NO: 3076737 - RNA, 18 nt, Mycobacterium bovis subsp bovis AF2122/97
ucaccgggcccgacgacg

SEQ ID NO: 3076738 - RNA, 18 nt, Mycobacterium bovis subsp bovis AF2122/97
ucaccggggccgucggca

SEQ ID NO: 3076739 - RNA, 23 nt, Mycobacterium bovis subsp bovis AF2122/97
ucaccggguuggaagccgcaccg

SEQ ID NO: 3076740 - RNA, 18 nt, Mycobacterium bovis subsp bovis AF2122/97
ucaccggucaccgcgcag

SEQ ID NO: 3076741 - RNA, 21 nt, Mycobacterium bovis subsp bovis AF2122/97
ucaccggucaccgcgcagcga

SEQ ID NO: 3076742 - RNA, 19 nt, Mycobacterium bovis subsp bovis AF2122/97
ucaccggugcgcuggaggc

SEQ ID NO: 3076743 - RNA, 22 nt, Mycobacterium bovis subsp bovis AF2122/97
ucaccgucaacgccugcgagga

SEQ ID NO: 3076744 - RNA, 17 nt, Mycobacterium bovis subsp bovis AF2122/97
ucaccgucauugccacc

SEQ ID NO: 3076745 - RNA, 21 nt, Mycobacterium bovis subsp bovis AF2122/97
ucaccgucugcggaccggcgc

SEQ ID NO: 3076746 - RNA, 16 nt, Mycobacterium bovis subsp bovis AF2122/97
ucaccgugaaccgccc

SEQ ID NO: 3076747 - RNA, 20 nt, Mycobacterium bovis subsp bovis AF2122/97
ucaccgugggccugcccggc

SEQ ID NO: 3076748 - RNA, 16 nt, Mycobacterium bovis subsp bovis AF2122/97
ucaccgugguggcgua

SEQ ID NO: 3076749 - RNA, 21 nt, Mycobacterium bovis subsp bovis AF2122/97
ucaccguucuugucgaaguaa

SEQ ID NO: 3076750 - RNA, 22 nt, Mycobacterium bovis subsp bovis AF2122/97
ucaccguugcguuggcgccacc

SEQ ID NO: 3076751 - RNA, 17 nt, Mycobacterium bovis subsp bovis AF2122/97
ucaccguuggccgcgcu

SEQ ID NO: 3076752 - RNA, 23 nt, Mycobacterium bovis subsp bovis AF2122/97
ucaccguuguucccauagccagc

SEQ ID NO: 3076753 - RNA, 14 nt, Mycobacterium bovis subsp bovis AF2122/97
ucaccucgaugccg

SEQ ID NO: 3076754 - RNA, 13 nt, Mycobacterium bovis subsp bovis AF2122/97
ucaccucgcacga

SEQ ID NO: 3076755 - RNA, 15 nt, Mycobacterium bovis subsp bovis AF2122/97
ucaccucgccggcgg

SEQ ID NO: 3076756 - RNA, 16 nt, Mycobacterium bovis subsp bovis AF2122/97
ucaccucggugccggc

SEQ ID NO: 3076757 - RNA, 22 nt, Mycobacterium bovis subsp bovis AF2122/97
ucaccucggugccggccgcaca

SEQ ID NO: 3076758 - RNA, 14 nt, Mycobacterium bovis subsp bovis AF2122/97
ucaccucuuggugc

SEQ ID NO: 3076759 - RNA, 21 nt, Mycobacterium bovis subsp bovis AF2122/97
ucaccugacacgcccgcgagc

SEQ ID NO: 3076760 - RNA, 17 nt, Mycobacterium bovis subsp bovis AF2122/97
ucaccugcgggugcguc

SEQ ID NO: 3076761 - RNA, 15 nt, Mycobacterium bovis subsp bovis AF2122/97
ucaccugcugcaacc

SEQ ID NO: 3076762 - RNA, 22 nt, Mycobacterium bovis subsp bovis AF2122/97
ucaccugcugcaaccgacuucg

SEQ ID NO: 3076763 - RNA, 18 nt, Mycobacterium bovis subsp bovis AF2122/97
ucaccuggcgugucgccg

SEQ ID NO: 3076764 - RNA, 21 nt, Mycobacterium bovis subsp bovis AF2122/97
ucaccuggcgugucgccgcca

SEQ ID NO: 3076765 - RNA, 23 nt, Mycobacterium bovis subsp bovis AF2122/97
ucaccuggcgugucgccgccacc

SEQ ID NO: 3076766 - RNA, 18 nt, Mycobacterium bovis subsp bovis AF2122/97
ucaccugggccagcagcc

SEQ ID NO: 3076767 - RNA, 20 nt, Mycobacterium bovis subsp bovis AF2122/97
ucaccuggugugcgggagac

SEQ ID NO: 3076768 - RNA, 19 nt, Mycobacterium bovis subsp bovis AF2122/97
ucaccuuccucgaaaucgu

SEQ ID NO: 3076769 - RNA, 15 nt, Mycobacterium bovis subsp bovis AF2122/97
ucaccuucggccgac

SEQ ID NO: 3076770 - RNA, 18 nt, Mycobacterium bovis subsp bovis AF2122/97
ucaccuucgucgcggccg

SEQ ID NO: 3076771 - RNA, 23 nt, Mycobacterium bovis subsp bovis AF2122/97
ucaccuucgucgcggccgcggcc

SEQ ID NO: 3076772 - RNA, 14 nt, Mycobacterium bovis subsp bovis AF2122/97
ucaccuugcgcacc

SEQ ID NO: 3076773 - RNA, 13 nt, Mycobacterium bovis subsp bovis AF2122/97
ucacuccaugauc

SEQ ID NO: 3076774 - RNA, 16 nt, Mycobacterium bovis subsp bovis AF2122/97
ucacuccaugauccag

SEQ ID NO: 3076775 - RNA, 12 nt, Mycobacterium bovis subsp bovis AF2122/97
ucacucgccgaa

SEQ ID NO: 3076776 - RNA, 15 nt, Mycobacterium bovis subsp bovis AF2122/97
ucacucgccgaaucg

SEQ ID NO: 3076777 - RNA, 17 nt, Mycobacterium bovis subsp bovis AF2122/97
ucacucguugaccggcc

SEQ ID NO: 3076778 - RNA, 18 nt, Mycobacterium bovis subsp bovis AF2122/97
ucacucguugaccggccg

SEQ ID NO: 3076779 - RNA, 14 nt, Mycobacterium bovis subsp bovis AF2122/97
ucacugcgagcgca

SEQ ID NO: 3076780 - RNA, 14 nt, Mycobacterium bovis subsp bovis AF2122/97
ucacugcggcgcca

SEQ ID NO: 3076781 - RNA, 20 nt, Mycobacterium bovis subsp bovis AF2122/97
ucacugguccaacgaucagu

SEQ ID NO: 3076782 - RNA, 16 nt, Mycobacterium bovis subsp bovis AF2122/97
ucacugugccgcugca

SEQ ID NO: 3076783 - RNA, 21 nt, Mycobacterium bovis subsp bovis AF2122/97
ucacuguugcccuugggacug

SEQ ID NO: 3076784 - RNA, 16 nt, Mycobacterium bovis subsp bovis AF2122/97
ucacuucacgccgccc

SEQ ID NO: 3076785 - RNA, 22 nt, Mycobacterium bovis subsp bovis AF2122/97
ucacuucccggauagacggcga

SEQ ID NO: 3076786 - RNA, 17 nt, Mycobacterium bovis subsp bovis AF2122/97
ucagaacaccggccagg

SEQ ID NO: 3076787 - RNA, 19 nt, Mycobacterium bovis subsp bovis AF2122/97
ucagaaccgacggccagca

SEQ ID NO: 3076788 - RNA, 14 nt, Mycobacterium bovis subsp bovis AF2122/97
ucagaacgcggccu

SEQ ID NO: 3076789 - RNA, 13 nt, Mycobacterium bovis subsp bovis AF2122/97
ucagaacggcggc

SEQ ID NO: 3076790 - RNA, 21 nt, Mycobacterium bovis subsp bovis AF2122/97
ucagaacggcggcagcggcgu

SEQ ID NO: 3076791 - RNA, 16 nt, Mycobacterium bovis subsp bovis AF2122/97
ucagaacgucggugug

SEQ ID NO: 3076792 - RNA, 17 nt, Mycobacterium bovis subsp bovis AF2122/97
ucagaacgugacggucc

SEQ ID NO: 3076793 - RNA, 23 nt, Mycobacterium bovis subsp bovis AF2122/97
ucagaacuuguuugucaccgcag

SEQ ID NO: 3076794 - RNA, 22 nt, Mycobacterium bovis subsp bovis AF2122/97
ucagaaggaucagcgcacuggc

SEQ ID NO: 3076795 - RNA, 22 nt, Mycobacterium bovis subsp bovis AF2122/97
ucagaaucaggcucgccgaugc

SEQ ID NO: 3076796 - RNA, 13 nt, Mycobacterium bovis subsp bovis AF2122/97
ucagaaucugccu

SEQ ID NO: 3076797 - RNA, 17 nt, Mycobacterium bovis subsp bovis AF2122/97
ucagaaugccuggcccg

SEQ ID NO: 3076798 - RNA, 18 nt, Mycobacterium bovis subsp bovis AF2122/97
ucagaauugugugcagca

SEQ ID NO: 3076799 - RNA, 19 nt, Mycobacterium bovis subsp bovis AF2122/97
ucagaauugugugcagcag

SEQ ID NO: 3076800 - RNA, 14 nt, Mycobacterium bovis subsp bovis AF2122/97
ucagacaacaacac

SEQ ID NO: 3076801 - RNA, 19 nt, Mycobacterium bovis subsp bovis AF2122/97
ucagaccaaugaccgccag

SEQ ID NO: 3076802 - RNA, 19 nt, Mycobacterium bovis subsp bovis AF2122/97
ucagacccagcgcggcaac

SEQ ID NO: 3076803 - RNA, 15 nt, Mycobacterium bovis subsp bovis AF2122/97
ucagacgacgaucgc

SEQ ID NO: 3076804 - RNA, 21 nt, Mycobacterium bovis subsp bovis AF2122/97
ucagacgacgaugaugccguc

SEQ ID NO: 3076805 - RNA, 22 nt, Mycobacterium bovis subsp bovis AF2122/97
ucagacgacgaugaugccgucg

SEQ ID NO: 3076806 - RNA, 18 nt, Mycobacterium bovis subsp bovis AF2122/97
ucagacgauucggcggcc

SEQ ID NO: 3076807 - RNA, 16 nt, Mycobacterium bovis subsp bovis AF2122/97
ucagacgcucgaccug

SEQ ID NO: 3076808 - RNA, 18 nt, Mycobacterium bovis subsp bovis AF2122/97
ucagacgcucgaccugcc

SEQ ID NO: 3076809 - RNA, 20 nt, Mycobacterium bovis subsp bovis AF2122/97
ucagacgcucgaccugccuu

SEQ ID NO: 3076810 - RNA, 18 nt, Mycobacterium bovis subsp bovis AF2122/97
ucagacggcgaguaggcg

SEQ ID NO: 3076811 - RNA, 18 nt, Mycobacterium bovis subsp bovis AF2122/97
ucagacggugaagccgag

SEQ ID NO: 3076812 - RNA, 21 nt, Mycobacterium bovis subsp bovis AF2122/97
ucagacggugaagccgagcgc

SEQ ID NO: 3076813 - RNA, 21 nt, Mycobacterium bovis subsp bovis AF2122/97
ucagauagauagcggugccgu

SEQ ID NO: 3076814 - RNA, 22 nt, Mycobacterium bovis subsp bovis AF2122/97
ucagaucuccaagcucgacaac

SEQ ID NO: 3076815 - RNA, 23 nt, Mycobacterium bovis subsp bovis AF2122/97
ucagaugcggcccgggcucggcg

SEQ ID NO: 3076816 - RNA, 18 nt, Mycobacterium bovis subsp bovis AF2122/97
ucagcaacaacgucugca

SEQ ID NO: 3076817 - RNA, 21 nt, Mycobacterium bovis subsp bovis AF2122/97
ucagcaacaacgucugcagcc

SEQ ID NO: 3076818 - RNA, 14 nt, Mycobacterium bovis subsp bovis AF2122/97
ucagcaacagcagg

SEQ ID NO: 3076819 - RNA, 21 nt, Mycobacterium bovis subsp bovis AF2122/97
ucagcaacgcauuguccugaa

SEQ ID NO: 3076820 - RNA, 18 nt, Mycobacterium bovis subsp bovis AF2122/97
ucagcaacgucacgucga

SEQ ID NO: 3076821 - RNA, 16 nt, Mycobacterium bovis subsp bovis AF2122/97
ucagcaacucggccac

SEQ ID NO: 3076822 - RNA, 17 nt, Mycobacterium bovis subsp bovis AF2122/97
ucagcaacucggccacg

SEQ ID NO: 3076823 - RNA, 20 nt, Mycobacterium bovis subsp bovis AF2122/97
ucagcaagaucggcagcgug

SEQ ID NO: 3076824 - RNA, 21 nt, Mycobacterium bovis subsp bovis AF2122/97
ucagcaagaucggcagcgugg

SEQ ID NO: 3076825 - RNA, 22 nt, Mycobacterium bovis subsp bovis AF2122/97
ucagcaauacggcggcgccgcc

SEQ ID NO: 3076826 - RNA, 16 nt, Mycobacterium bovis subsp bovis AF2122/97
ucagcaccaccagcag

SEQ ID NO: 3076827 - RNA, 17 nt, Mycobacterium bovis subsp bovis AF2122/97
ucagcacccaacccggc

SEQ ID NO: 3076828 - RNA, 19 nt, Mycobacterium bovis subsp bovis AF2122/97
ucagcaccccauggccacc

SEQ ID NO: 3076829 - RNA, 16 nt, Mycobacterium bovis subsp bovis AF2122/97
ucagcaccgacagccc

SEQ ID NO: 3076830 - RNA, 22 nt, Mycobacterium bovis subsp bovis AF2122/97
ucagcaccgcuacgaccaauag

SEQ ID NO: 3076831 - RNA, 20 nt, Mycobacterium bovis subsp bovis AF2122/97
ucagcaccgugacagcggca

SEQ ID NO: 3076832 - RNA, 15 nt, Mycobacterium bovis subsp bovis AF2122/97
ucagcacgacgacaa

SEQ ID NO: 3076833 - RNA, 17 nt, Mycobacterium bovis subsp bovis AF2122/97
ucagcacgccgggugcc

SEQ ID NO: 3076834 - RNA, 15 nt, Mycobacterium bovis subsp bovis AF2122/97
ucagcacgcugacca

SEQ ID NO: 3076835 - RNA, 17 nt, Mycobacterium bovis subsp bovis AF2122/97
ucagcacggugaucagc

SEQ ID NO: 3076836 - RNA, 20 nt, Mycobacterium bovis subsp bovis AF2122/97
ucagcacggugggcgcuggg

SEQ ID NO: 3076837 - RNA, 19 nt, Mycobacterium bovis subsp bovis AF2122/97
ucagcacgguguacgcccg

SEQ ID NO: 3076838 - RNA, 23 nt, Mycobacterium bovis subsp bovis AF2122/97
ucagcacguaacgccgcucaucc

SEQ ID NO: 3076839 - RNA, 12 nt, Mycobacterium bovis subsp bovis AF2122/97
ucagcacguggg

SEQ ID NO: 3076840 - RNA, 14 nt, Mycobacterium bovis subsp bovis AF2122/97
ucagcagaugggcg

SEQ ID NO: 3076841 - RNA, 12 nt, Mycobacterium bovis subsp bovis AF2122/97
ucagcagcgccg

SEQ ID NO: 3076842 - RNA, 14 nt, Mycobacterium bovis subsp bovis AF2122/97
ucagcagcgccguc

SEQ ID NO: 3076843 - RNA, 12 nt, Mycobacterium bovis subsp bovis AF2122/97
ucagcagcucca

SEQ ID NO: 3076844 - RNA, 18 nt, Mycobacterium bovis subsp bovis AF2122/97
ucagcagcuccacuggcg

SEQ ID NO: 3076845 - RNA, 22 nt, Mycobacterium bovis subsp bovis AF2122/97
ucagcaggagaucaacauccug

SEQ ID NO: 3076846 - RNA, 18 nt, Mycobacterium bovis subsp bovis AF2122/97
ucagcaggaucggcagca

SEQ ID NO: 3076847 - RNA, 21 nt, Mycobacterium bovis subsp bovis AF2122/97
ucagcaggcccuucaguucga

SEQ ID NO: 3076848 - RNA, 22 nt, Mycobacterium bovis subsp bovis AF2122/97
ucagcauaucgauucgggcguc

SEQ ID NO: 3076849 - RNA, 21 nt, Mycobacterium bovis subsp bovis AF2122/97
ucagcaugggaauccgcuguu

SEQ ID NO: 3076850 - RNA, 18 nt, Mycobacterium bovis subsp bovis AF2122/97
ucagcaugguccacagcc

SEQ ID NO: 3076851 - RNA, 12 nt, Mycobacterium bovis subsp bovis AF2122/97
ucagccaccauc

SEQ ID NO: 3076852 - RNA, 19 nt, Mycobacterium bovis subsp bovis AF2122/97
ucagccaccaucuggaugg

SEQ ID NO: 3076853 - RNA, 14 nt, Mycobacterium bovis subsp bovis AF2122/97
ucagccaccgcaug

SEQ ID NO: 3076854 - RNA, 19 nt, Mycobacterium bovis subsp bovis AF2122/97
ucagccacgcagcacggca

SEQ ID NO: 3076855 - RNA, 16 nt, Mycobacterium bovis subsp bovis AF2122/97
ucagccacucgccacu

SEQ ID NO: 3076856 - RNA, 21 nt, Mycobacterium bovis subsp bovis AF2122/97
ucagccaggccagugccaccu

SEQ ID NO: 3076857 - RNA, 14 nt, Mycobacterium bovis subsp bovis AF2122/97
ucagccaggccgca

SEQ ID NO: 3076858 - RNA, 19 nt, Mycobacterium bovis subsp bovis AF2122/97
ucagccagggucccgccgc

SEQ ID NO: 3076859 - RNA, 14 nt, Mycobacterium bovis subsp bovis AF2122/97
ucagcgucgacguc

SEQ ID NO: 3076860 - RNA, 15 nt, Mycobacterium bovis subsp bovis AF2122/97
ucagcgucugagcgc

SEQ ID NO: 3076861 - RNA, 21 nt, Mycobacterium bovis subsp bovis AF2122/97
ucagcgugaucugcagggcca

SEQ ID NO: 3076862 - RNA, 15 nt, Mycobacterium bovis subsp bovis AF2122/97
ucagcgugcgcuggc

SEQ ID NO: 3076863 - RNA, 19 nt, Mycobacterium bovis subsp bovis AF2122/97
ucagcguggacgcccgccc

SEQ ID NO: 3076864 - RNA, 21 nt, Mycobacterium bovis subsp bovis AF2122/97
ucagcguggacgcccgcccgc

SEQ ID NO: 3076865 - RNA, 13 nt, Mycobacterium bovis subsp bovis AF2122/97
ucagcgugucgcc

SEQ ID NO: 3076866 - RNA, 16 nt, Mycobacterium bovis subsp bovis AF2122/97
ucagcguugaccgcau

SEQ ID NO: 3076867 - RNA, 22 nt, Mycobacterium bovis subsp bovis AF2122/97
ucagcguugaccgcaucgucga

SEQ ID NO: 3076868 - RNA, 15 nt, Mycobacterium bovis subsp bovis AF2122/97
ucagcuaccuccgcc

SEQ ID NO: 3076869 - RNA, 16 nt, Mycobacterium bovis subsp bovis AF2122/97
ucagcuaccuccgcca

SEQ ID NO: 3076870 - RNA, 14 nt, Mycobacterium bovis subsp bovis AF2122/97
ucagcuagguauug

SEQ ID NO: 3076871 - RNA, 18 nt, Mycobacterium bovis subsp bovis AF2122/97
ucagcucaccacccagau

SEQ ID NO: 3076872 - RNA, 21 nt, Mycobacterium bovis subsp bovis AF2122/97
ucagcuccuccgacagggccu

SEQ ID NO: 3076873 - RNA, 19 nt, Mycobacterium bovis subsp bovis AF2122/97
ucagcucgaggaccaccug

SEQ ID NO: 3076874 - RNA, 17 nt, Mycobacterium bovis subsp bovis AF2122/97
ucagcucgaucacgccg

SEQ ID NO: 3076875 - RNA, 19 nt, Mycobacterium bovis subsp bovis AF2122/97
ucagcucgcgcacgucgac

SEQ ID NO: 3076876 - RNA, 15 nt, Mycobacterium bovis subsp bovis AF2122/97
ucagcucggcagcau

SEQ ID NO: 3076877 - RNA, 19 nt, Mycobacterium bovis subsp bovis AF2122/97
ucagcucggguugcgcgau

SEQ ID NO: 3076878 - RNA, 18 nt, Mycobacterium bovis subsp bovis AF2122/97
ucagcugcaccuccgacg

SEQ ID NO: 3076879 - RNA, 15 nt, Mycobacterium bovis subsp bovis AF2122/97
ucagcugcggauaca

SEQ ID NO: 3076880 - RNA, 20 nt, Mycobacterium bovis subsp bovis AF2122/97
ucagcugcucgucuuggcgg

SEQ ID NO: 3076881 - RNA, 18 nt, Mycobacterium bovis subsp bovis AF2122/97
ucagcugggcaucaucag

SEQ ID NO: 3076882 - RNA, 17 nt, Mycobacterium bovis subsp bovis AF2122/97
ucagcugugcgacccgc

SEQ ID NO: 3076883 - RNA, 18 nt, Mycobacterium bovis subsp bovis AF2122/97
ucagcugugcgacccgca

SEQ ID NO: 3076884 - RNA, 22 nt, Mycobacterium bovis subsp bovis AF2122/97
ucagcuucuuaccgcgggccgc

SEQ ID NO: 3076885 - RNA, 16 nt, Mycobacterium bovis subsp bovis AF2122/97
ucagcuuuaucggccc

SEQ ID NO: 3076886 - RNA, 17 nt, Mycobacterium bovis subsp bovis AF2122/97
ucagcuuuaucggcccu

SEQ ID NO: 3076887 - RNA, 20 nt, Mycobacterium bovis subsp bovis AF2122/97
ucaggaaaccggcgcggaac

SEQ ID NO: 3076888 - RNA, 20 nt, Mycobacterium bovis subsp bovis AF2122/97
ucaggaacaaguagccgucg

SEQ ID NO: 3076889 - RNA, 20 nt, Mycobacterium bovis subsp bovis AF2122/97
ucaggaaccacccaccggcc

SEQ ID NO: 3076890 - RNA, 16 nt, Mycobacterium bovis subsp bovis AF2122/97
ucaggaagcgugcggu

SEQ ID NO: 3076891 - RNA, 20 nt, Mycobacterium bovis subsp bovis AF2122/97
ucaggaagcgugcggucguu

SEQ ID NO: 3076892 - RNA, 14 nt, Mycobacterium bovis subsp bovis AF2122/97
ucaggacaugcagg

SEQ ID NO: 3076893 - RNA, 14 nt, Mycobacterium bovis subsp bovis AF2122/97
ucaggaucccggug

SEQ ID NO: 3076894 - RNA, 17 nt, Mycobacterium bovis subsp bovis AF2122/97
ucaggaucccgguggca

SEQ ID NO: 3076895 - RNA, 20 nt, Mycobacterium bovis subsp bovis AF2122/97
ucaggaucccgguggcagca

SEQ ID NO: 3076896 - RNA, 21 nt, Mycobacterium bovis subsp bovis AF2122/97
ucaggcaacgaagagggcgcc

SEQ ID NO: 3076897 - RNA, 17 nt, Mycobacterium bovis subsp bovis AF2122/97
ucaggcagcuccgccgc

SEQ ID NO: 3076898 - RNA, 18 nt, Mycobacterium bovis subsp bovis AF2122/97
ucaggcaguccaccgcgc

SEQ ID NO: 3076899 - RNA, 21 nt, Mycobacterium bovis subsp bovis AF2122/97
ucaggccagagucgcccgcac

SEQ ID NO: 3076900 - RNA, 13 nt, Mycobacterium bovis subsp bovis AF2122/97
ucaggccagggug

SEQ ID NO: 3076901 - RNA, 22 nt, Mycobacterium bovis subsp bovis AF2122/97
ucaggccagggugaccaggccg

SEQ ID NO: 3076902 - RNA, 14 nt, Mycobacterium bovis subsp bovis AF2122/97
ucaggcccgggcgg

SEQ ID NO: 3076903 - RNA, 16 nt, Mycobacterium bovis subsp bovis AF2122/97
ucaggcccugccgacg

SEQ ID NO: 3076904 - RNA, 21 nt, Mycobacterium bovis subsp bovis AF2122/97
ucaggcccugccgacgcucca

SEQ ID NO: 3076905 - RNA, 19 nt, Mycobacterium bovis subsp bovis AF2122/97
ucaggccgacgucgaccac

SEQ ID NO: 3076906 - RNA, 21 nt, Mycobacterium bovis subsp bovis AF2122/97
ucaggccgacgucuaggccaa

SEQ ID NO: 3076907 - RNA, 22 nt, Mycobacterium bovis subsp bovis AF2122/97
ucaggccgacgucuaggccaaa

SEQ ID NO: 3076908 - RNA, 20 nt, Mycobacterium bovis subsp bovis AF2122/97
ucaggccgacuaaccacugu

SEQ ID NO: 3076909 - RNA, 21 nt, Mycobacterium bovis subsp bovis AF2122/97
ucaggccgaugcgggucucga

SEQ ID NO: 3076910 - RNA, 13 nt, Mycobacterium bovis subsp bovis AF2122/97
ucaggcgggagcg

SEQ ID NO: 3076911 - RNA, 18 nt, Mycobacterium bovis subsp bovis AF2122/97
ucaggcucacacucggcc

SEQ ID NO: 3076912 - RNA, 15 nt, Mycobacterium bovis subsp bovis AF2122/97
ucaggcucauccgcc

SEQ ID NO: 3076913 - RNA, 21 nt, Mycobacterium bovis subsp bovis AF2122/97
ucaggcugaaggacggcagcu

SEQ ID NO: 3076914 - RNA, 18 nt, Mycobacterium bovis subsp bovis AF2122/97
ucagggacgaacugcuga

SEQ ID NO: 3076915 - RNA, 23 nt, Mycobacterium bovis subsp bovis AF2122/97
ucagggcacgcuggaacuuggcg

SEQ ID NO: 3076916 - RNA, 21 nt, Mycobacterium bovis subsp bovis AF2122/97
ucagggcgcaaaccacccgca

SEQ ID NO: 3076917 - RNA, 16 nt, Mycobacterium bovis subsp bovis AF2122/97
ucagggcucgcucgcc

SEQ ID NO: 3076918 - RNA, 15 nt, Mycobacterium bovis subsp bovis AF2122/97
ucagggcuuagcgcg

SEQ ID NO: 3076919 - RNA, 22 nt, Mycobacterium bovis subsp bovis AF2122/97
ucaggggcgccuuaggcguccg

SEQ ID NO: 3076920 - RNA, 22 nt, Mycobacterium bovis subsp bovis AF2122/97
ucaggggcuacuaggcccagca

SEQ ID NO: 3076921 - RNA, 22 nt, Mycobacterium bovis subsp bovis AF2122/97
ucagggguggcgcgggccggcg

SEQ ID NO: 3076922 - RNA, 13 nt, Mycobacterium bovis subsp bovis AF2122/97
ucagggucagcgc

SEQ ID NO: 3076923 - RNA, 17 nt, Mycobacterium bovis subsp bovis AF2122/97
ucagggucagcgccgcg

SEQ ID NO: 3076924 - RNA, 18 nt, Mycobacterium bovis subsp bovis AF2122/97
ucagggucugcgccgccg

SEQ ID NO: 3076925 - RNA, 14 nt, Mycobacterium bovis subsp bovis AF2122/97
ucagggugccgucg

SEQ ID NO: 3076926 - RNA, 14 nt, Mycobacterium bovis subsp bovis AF2122/97
ucagggugcgccgc

SEQ ID NO: 3076927 - RNA, 24 nt, Mycobacterium bovis subsp bovis AF2122/97
ucagggugggcgacgucaucgccg

SEQ ID NO: 3076928 - RNA, 16 nt, Mycobacterium bovis subsp bovis AF2122/97
ucagggugucgacaac

SEQ ID NO: 3076929 - RNA, 18 nt, Mycobacterium bovis subsp bovis AF2122/97
ucaggguguucacguuca

SEQ ID NO: 3076930 - RNA, 18 nt, Mycobacterium bovis subsp bovis AF2122/97
ucagguacggcgggcggc

SEQ ID NO: 3076931 - RNA, 17 nt, Mycobacterium bovis subsp bovis AF2122/97
ucagguagcggcccuuc

SEQ ID NO: 3076932 - RNA, 15 nt, Mycobacterium bovis subsp bovis AF2122/97
ucaggucaccggccg

SEQ ID NO: 3076933 - RNA, 17 nt, Mycobacterium bovis subsp bovis AF2122/97
ucaggucaccggccgcc

SEQ ID NO: 3076934 - RNA, 17 nt, Mycobacterium bovis subsp bovis AF2122/97
ucaggucaucggcggcg

SEQ ID NO: 3076935 - RNA, 14 nt, Mycobacterium bovis subsp bovis AF2122/97
ucagguccggggaa

SEQ ID NO: 3076936 - RNA, 19 nt, Mycobacterium bovis subsp bovis AF2122/97
ucagguccuggguguagca

SEQ ID NO: 3076937 - RNA, 13 nt, Mycobacterium bovis subsp bovis AF2122/97
ucaggucgccgag

SEQ ID NO: 3076938 - RNA, 16 nt, Mycobacterium bovis subsp bovis AF2122/97
ucaggucggggucaga

SEQ ID NO: 3076939 - RNA, 20 nt, Mycobacterium bovis subsp bovis AF2122/97
ucaggucgguggucucgacg

SEQ ID NO: 3076940 - RNA, 20 nt, Mycobacterium bovis subsp bovis AF2122/97
ucaggucgucacgccccuca

SEQ ID NO: 3076941 - RNA, 20 nt, Mycobacterium bovis subsp bovis AF2122/97
ucaggucguuugugaacacc

SEQ ID NO: 3076942 - RNA, 15 nt, Mycobacterium bovis subsp bovis AF2122/97
ucaggucuggcgcgg

SEQ ID NO: 3076943 - RNA, 15 nt, Mycobacterium bovis subsp bovis AF2122/97
ucaggugcgcgacca

SEQ ID NO: 3076944 - RNA, 16 nt, Mycobacterium bovis subsp bovis AF2122/97
ucaggugcgcgaccag

SEQ ID NO: 3076945 - RNA, 16 nt, Mycobacterium bovis subsp bovis AF2122/97
ucaugaacaucggccg

SEQ ID NO: 3076946 - RNA, 18 nt, Mycobacterium bovis subsp bovis AF2122/97
ucaugacgagccgagccu

SEQ ID NO: 3076947 - RNA, 12 nt, Mycobacterium bovis subsp bovis AF2122/97
ucaugagccgcu

SEQ ID NO: 3076948 - RNA, 17 nt, Mycobacterium bovis subsp bovis AF2122/97
ucaugagccgcugcgcc

SEQ ID NO: 3076949 - RNA, 17 nt, Mycobacterium bovis subsp bovis AF2122/97
ucaugcaaaagccgcga

SEQ ID NO: 3076950 - RNA, 22 nt, Mycobacterium bovis subsp bovis AF2122/97
ucaugcagggaauagcggcgcc

SEQ ID NO: 3076951 - RNA, 19 nt, Mycobacterium bovis subsp bovis AF2122/97
ucaugccauagaugcccgc

SEQ ID NO: 3076952 - RNA, 14 nt, Mycobacterium bovis subsp bovis AF2122/97
ucaugcccaccgcc

SEQ ID NO: 3076953 - RNA, 23 nt, Mycobacterium bovis subsp bovis AF2122/97
ucaugcccgacgagucgccgcgg

SEQ ID NO: 3076954 - RNA, 18 nt, Mycobacterium bovis subsp bovis AF2122/97
ucaugccggcgaacucgc

SEQ ID NO: 3076955 - RNA, 19 nt, Mycobacterium bovis subsp bovis AF2122/97
ucaugcgagucgucccagu

SEQ ID NO: 3076956 - RNA, 20 nt, Mycobacterium bovis subsp bovis AF2122/97
ucaugcgagucgucccaguc

SEQ ID NO: 3076957 - RNA, 16 nt, Mycobacterium bovis subsp bovis AF2122/97
ucaugcgauucugcgu

SEQ ID NO: 3076958 - RNA, 13 nt, Mycobacterium bovis subsp bovis AF2122/97
ucaugcuggaagu

SEQ ID NO: 3076959 - RNA, 21 nt, Mycobacterium bovis subsp bovis AF2122/97
ucaugcuggaaguugugcgca

SEQ ID NO: 3076960 - RNA, 18 nt, Mycobacterium bovis subsp bovis AF2122/97
ucauggauaauccaugac

SEQ ID NO: 3076961 - RNA, 20 nt, Mycobacterium bovis subsp bovis AF2122/97
ucauggcgaaccgucagcgc

SEQ ID NO: 3076962 - RNA, 16 nt, Mycobacterium bovis subsp bovis AF2122/97
ucauggcgggugcggc

SEQ ID NO: 3076963 - RNA, 12 nt, Mycobacterium bovis subsp bovis AF2122/97
ucaugggaucag

SEQ ID NO: 3076964 - RNA, 14 nt, Mycobacterium bovis subsp bovis AF2122/97
ucaugggaucaggc

SEQ ID NO: 3076965 - RNA, 22 nt, Mycobacterium bovis subsp bovis AF2122/97
ucaugggaucaggcugggcaga

SEQ ID NO: 3076966 - RNA, 12 nt, Mycobacterium bovis subsp bovis AF2122/97
ucaugggcgcgu

SEQ ID NO: 3076967 - RNA, 20 nt, Mycobacterium bovis subsp bovis AF2122/97
ucauggggcuauggcgcagc

SEQ ID NO: 3076968 - RNA, 21 nt, Mycobacterium bovis subsp bovis AF2122/97
ucauguagcgguuguagaccu

SEQ ID NO: 3076969 - RNA, 13 nt, Mycobacterium bovis subsp bovis AF2122/97
ucaugucggccac

SEQ ID NO: 3076970 - RNA, 14 nt, Mycobacterium bovis subsp bovis AF2122/97
ucaugucggcgcag

SEQ ID NO: 3076971 - RNA, 17 nt, Mycobacterium bovis subsp bovis AF2122/97
ucauguucucgaccgcg

SEQ ID NO: 3076972 - RNA, 12 nt, Mycobacterium bovis subsp bovis AF2122/97
ucauugcccuug

SEQ ID NO: 3076973 - RNA, 14 nt, Mycobacterium bovis subsp bovis AF2122/97
ucauugcccuugac

SEQ ID NO: 3076974 - RNA, 17 nt, Mycobacterium bovis subsp bovis AF2122/97
ucauuggcuagguaccg

SEQ ID NO: 3076975 - RNA, 17 nt, Mycobacterium bovis subsp bovis AF2122/97
ucauuuucuguaaccac

SEQ ID NO: 3076976 - RNA, 14 nt, Mycobacterium bovis subsp bovis AF2122/97
uccaaaacaccgcc

SEQ ID NO: 3076977 - RNA, 17 nt, Mycobacterium bovis subsp bovis AF2122/97
uccaaaagccucagccg

SEQ ID NO: 3076978 - RNA, 14 nt, Mycobacterium bovis subsp bovis AF2122/97
uccaaaaucgcggc

SEQ ID NO: 3076979 - RNA, 17 nt, Mycobacterium bovis subsp bovis AF2122/97
uccaaagaccccuaccg

SEQ ID NO: 3076980 - RNA, 18 nt, Mycobacterium bovis subsp bovis AF2122/97
uccaaagggaguguuugg

SEQ ID NO: 3076981 - RNA, 19 nt, Mycobacterium bovis subsp bovis AF2122/97
uccaaauccuucggcgugg

SEQ ID NO: 3076982 - RNA, 23 nt, Mycobacterium bovis subsp bovis AF2122/97
uccaaauggugagcucgcgcaga

SEQ ID NO: 3076983 - RNA, 18 nt, Mycobacterium bovis subsp bovis AF2122/97
uccaacaacuccagcagg

SEQ ID NO: 3076984 - RNA, 19 nt, Mycobacterium bovis subsp bovis AF2122/97
uccaacaggaacaggcaaa

SEQ ID NO: 3076985 - RNA, 17 nt, Mycobacterium bovis subsp bovis AF2122/97
uccaacaggccggugug

SEQ ID NO: 3076986 - RNA, 19 nt, Mycobacterium bovis subsp bovis AF2122/97
uccaacaguucucgcgcuu

SEQ ID NO: 3076987 - RNA, 18 nt, Mycobacterium bovis subsp bovis AF2122/97
uccaacccaggguggcga

SEQ ID NO: 3076988 - RNA, 21 nt, Mycobacterium bovis subsp bovis AF2122/97
uccaacccaggguggcgacgu

SEQ ID NO: 3076989 - RNA, 15 nt, Mycobacterium bovis subsp bovis AF2122/97
uccaaccgggccggc

SEQ ID NO: 3076990 - RNA, 22 nt, Mycobacterium bovis subsp bovis AF2122/97
uccaacgacuguggcgccgccg

SEQ ID NO: 3076991 - RNA, 18 nt, Mycobacterium bovis subsp bovis AF2122/97
uccaacuacgccagccgc

SEQ ID NO: 3076992 - RNA, 13 nt, Mycobacterium bovis subsp bovis AF2122/97
uccaacucggcca

SEQ ID NO: 3076993 - RNA, 18 nt, Mycobacterium bovis subsp bovis AF2122/97
uccaacucggcggccagc

SEQ ID NO: 3076994 - RNA, 19 nt, Mycobacterium bovis subsp bovis AF2122/97
uccaacuggccgcgucgcu

SEQ ID NO: 3076995 - RNA, 16 nt, Mycobacterium bovis subsp bovis AF2122/97
uccaagcaauuccacc

SEQ ID NO: 3076996 - RNA, 20 nt, Mycobacterium bovis subsp bovis AF2122/97
uccaagcaauuccaccgccg

SEQ ID NO: 3076997 - RNA, 23 nt, Mycobacterium bovis subsp bovis AF2122/97
uccaagccgggugggagcagccg

SEQ ID NO: 3076998 - RNA, 14 nt, Mycobacterium bovis subsp bovis AF2122/97
uccaagcguacucg

SEQ ID NO: 3076999 - RNA, 22 nt, Mycobacterium bovis subsp bovis AF2122/97
uccaaggcgcgcugggcgccgu

SEQ ID NO: 3077000 - RNA, 17 nt, Mycobacterium bovis subsp bovis AF2122/97
uccaaggcucagcagcg

SEQ ID NO: 3077001 - RNA, 20 nt, Mycobacterium bovis subsp bovis AF2122/97
uccaaggcucagcagcgccg

SEQ ID NO: 3077002 - RNA, 17 nt, Mycobacterium bovis subsp bovis AF2122/97
uccaagucacagcucac

SEQ ID NO: 3077003 - RNA, 23 nt, Mycobacterium bovis subsp bovis AF2122/97
uccaauccacgguugccggcggc

SEQ ID NO: 3077004 - RNA, 14 nt, Mycobacterium bovis subsp bovis AF2122/97
uccaaucgccgggu

SEQ ID NO: 3077005 - RNA, 17 nt, Mycobacterium bovis subsp bovis AF2122/97
uccaaugcuguggcccg

SEQ ID NO: 3077006 - RNA, 19 nt, Mycobacterium bovis subsp bovis AF2122/97
uccaauugcgaaccggccg

SEQ ID NO: 3077007 - RNA, 23 nt, Mycobacterium bovis subsp bovis AF2122/97
uccaauugcgcugaagcccaugg

SEQ ID NO: 3077008 - RNA, 17 nt, Mycobacterium bovis subsp bovis AF2122/97
uccaauugcggccgcgc

SEQ ID NO: 3077009 - RNA, 24 nt, Mycobacterium bovis subsp bovis AF2122/97
uccaauugcggccgcgcgcucgag

SEQ ID NO: 3077010 - RNA, 17 nt, Mycobacterium bovis subsp bovis AF2122/97
uccacaaauccaaaccu

SEQ ID NO: 3077011 - RNA, 14 nt, Mycobacterium bovis subsp bovis AF2122/97
uccacaaguaccgc

SEQ ID NO: 3077012 - RNA, 17 nt, Mycobacterium bovis subsp bovis AF2122/97
uccacaaguaccgcauc

SEQ ID NO: 3077013 - RNA, 12 nt, Mycobacterium bovis subsp bovis AF2122/97
uccacaccagcu

SEQ ID NO: 3077014 - RNA, 20 nt, Mycobacterium bovis subsp bovis AF2122/97
uccacaccaggccgagccgc

SEQ ID NO: 3077015 - RNA, 12 nt, Mycobacterium bovis subsp bovis AF2122/97
uccacacccaca

SEQ ID NO: 3077016 - RNA, 16 nt, Mycobacterium bovis subsp bovis AF2122/97
uccacagccggcggcu

SEQ ID NO: 3077017 - RNA, 12 nt, Mycobacterium bovis subsp bovis AF2122/97
uccacagcggcc

SEQ ID NO: 3077018 - RNA, 18 nt, Mycobacterium bovis subsp bovis AF2122/97
uccacauaguccgaaccg

SEQ ID NO: 3077019 - RNA, 19 nt, Mycobacterium bovis subsp bovis AF2122/97
uccacauaguccgaaccga

SEQ ID NO: 3077020 - RNA, 16 nt, Mycobacterium bovis subsp bovis AF2122/97
uccacauaugucccau

SEQ ID NO: 3077021 - RNA, 16 nt, Mycobacterium bovis subsp bovis AF2122/97
uccacaucggcucuga

SEQ ID NO: 3077022 - RNA, 14 nt, Mycobacterium bovis subsp bovis AF2122/97
uccaccaccggcac

SEQ ID NO: 3077023 - RNA, 15 nt, Mycobacterium bovis subsp bovis AF2122/97
uccaccaccgucgag

SEQ ID NO: 3077024 - RNA, 16 nt, Mycobacterium bovis subsp bovis AF2122/97
uccaccacgacgucgg

SEQ ID NO: 3077025 - RNA, 19 nt, Mycobacterium bovis subsp bovis AF2122/97
uccaccacgucgggaugcc

SEQ ID NO: 3077026 - RNA, 13 nt, Mycobacterium bovis subsp bovis AF2122/97
uccaccagccggu

SEQ ID NO: 3077027 - RNA, 14 nt, Mycobacterium bovis subsp bovis AF2122/97
uccacccaagcucg

SEQ ID NO: 3077028 - RNA, 19 nt, Mycobacterium bovis subsp bovis AF2122/97
uccacccacgaucagcagc

SEQ ID NO: 3077029 - RNA, 18 nt, Mycobacterium bovis subsp bovis AF2122/97
uccacccagugccacgcc

SEQ ID NO: 3077030 - RNA, 19 nt, Mycobacterium bovis subsp bovis AF2122/97
uccacccauagacccggcu

SEQ ID NO: 3077031 - RNA, 14 nt, Mycobacterium bovis subsp bovis AF2122/97
uccaccccgauccg

SEQ ID NO: 3077032 - RNA, 16 nt, Mycobacterium bovis subsp bovis AF2122/97
uccagccccccggcga

SEQ ID NO: 3077033 - RNA, 20 nt, Mycobacterium bovis subsp bovis AF2122/97
uccagcccgacgcccgacug

SEQ ID NO: 3077034 - RNA, 11 nt, Mycobacterium bovis subsp bovis AF2122/97
uccagccgacg

SEQ ID NO: 3077035 - RNA, 22 nt, Mycobacterium bovis subsp bovis AF2122/97
uccagccgacggcagugcugca

SEQ ID NO: 3077036 - RNA, 22 nt, Mycobacterium bovis subsp bovis AF2122/97
uccagccgacguaccagggugu

SEQ ID NO: 3077037 - RNA, 16 nt, Mycobacterium bovis subsp bovis AF2122/97
uccagccgcgcguccg

SEQ ID NO: 3077038 - RNA, 21 nt, Mycobacterium bovis subsp bovis AF2122/97
uccagccgguccagacccagc

SEQ ID NO: 3077039 - RNA, 17 nt, Mycobacterium bovis subsp bovis AF2122/97
uccagccggugccgccg

SEQ ID NO: 3077040 - RNA, 19 nt, Mycobacterium bovis subsp bovis AF2122/97
uccagccggugccgccguu

SEQ ID NO: 3077041 - RNA, 21 nt, Mycobacterium bovis subsp bovis AF2122/97
uccagccgugcggcggcugcc

SEQ ID NO: 3077042 - RNA, 18 nt, Mycobacterium bovis subsp bovis AF2122/97
uccagcgaaccgacccgg

SEQ ID NO: 3077043 - RNA, 22 nt, Mycobacterium bovis subsp bovis AF2122/97
uccagcgaaccgacccggccgc

SEQ ID NO: 3077044 - RNA, 12 nt, Mycobacterium bovis subsp bovis AF2122/97
uccagcgcaccg

SEQ ID NO: 3077045 - RNA, 13 nt, Mycobacterium bovis subsp bovis AF2122/97
uccagcgcaccgg

SEQ ID NO: 3077046 - RNA, 13 nt, Mycobacterium bovis subsp bovis AF2122/97
uccagcgcaucga

SEQ ID NO: 3077047 - RNA, 23 nt, Mycobacterium bovis subsp bovis AF2122/97
uccagcgcaucgagcccggacga

SEQ ID NO: 3077048 - RNA, 20 nt, Mycobacterium bovis subsp bovis AF2122/97
uccagcgccgcggcccgcuc

SEQ ID NO: 3077049 - RNA, 12 nt, Mycobacterium bovis subsp bovis AF2122/97
uccagcgccgga

SEQ ID NO: 3077050 - RNA, 21 nt, Mycobacterium bovis subsp bovis AF2122/97
uccagcgccugcgcccagccg

SEQ ID NO: 3077051 - RNA, 23 nt, Mycobacterium bovis subsp bovis AF2122/97
uccagcgcgacguccaccagccg

SEQ ID NO: 3077052 - RNA, 21 nt, Mycobacterium bovis subsp bovis AF2122/97
uccagcgcgccacccagcacc

SEQ ID NO: 3077053 - RNA, 17 nt, Mycobacterium bovis subsp bovis AF2122/97
uccagcgcgcgccgcag

SEQ ID NO: 3077054 - RNA, 22 nt, Mycobacterium bovis subsp bovis AF2122/97
uccagcgcgcgccgcagcgcgu

SEQ ID NO: 3077055 - RNA, 13 nt, Mycobacterium bovis subsp bovis AF2122/97
uccagcgcggccu

SEQ ID NO: 3077056 - RNA, 14 nt, Mycobacterium bovis subsp bovis AF2122/97
uccagcgcggccuu

SEQ ID NO: 3077057 - RNA, 13 nt, Mycobacterium bovis subsp bovis AF2122/97
uccagcggcaccg

SEQ ID NO: 3077058 - RNA, 13 nt, Mycobacterium bovis subsp bovis AF2122/97
uccagcggccgcc

SEQ ID NO: 3077059 - RNA, 14 nt, Mycobacterium bovis subsp bovis AF2122/97
uccagcggccgccg

SEQ ID NO: 3077060 - RNA, 13 nt, Mycobacterium bovis subsp bovis AF2122/97
uccagcgugucgu

SEQ ID NO: 3077061 - RNA, 18 nt, Mycobacterium bovis subsp bovis AF2122/97
uccagcucgcugcgcgcc

SEQ ID NO: 3077062 - RNA, 14 nt, Mycobacterium bovis subsp bovis AF2122/97
uccagcucggccag

SEQ ID NO: 3077063 - RNA, 17 nt, Mycobacterium bovis subsp bovis AF2122/97
uccagcucggccagugc

SEQ ID NO: 3077064 - RNA, 21 nt, Mycobacterium bovis subsp bovis AF2122/97
uccagcucgggggcgccggcg

SEQ ID NO: 3077065 - RNA, 15 nt, Mycobacterium bovis subsp bovis AF2122/97
uccagcugcugccga

SEQ ID NO: 3077066 - RNA, 16 nt, Mycobacterium bovis subsp bovis AF2122/97
uccagcuugccgaccu

SEQ ID NO: 3077067 - RNA, 15 nt, Mycobacterium bovis subsp bovis AF2122/97
uccaggaauucccca

SEQ ID NO: 3077068 - RNA, 20 nt, Mycobacterium bovis subsp bovis AF2122/97
uccaggaauuccccaccguc

SEQ ID NO: 3077069 - RNA, 19 nt, Mycobacterium bovis subsp bovis AF2122/97
uccaggcacuccagcggcg

SEQ ID NO: 3077070 - RNA, 19 nt, Mycobacterium bovis subsp bovis AF2122/97
uccaggcccagccgagcgg

SEQ ID NO: 3077071 - RNA, 18 nt, Mycobacterium bovis subsp bovis AF2122/97
uccaggcccuggccagcc

SEQ ID NO: 3077072 - RNA, 21 nt, Mycobacterium bovis subsp bovis AF2122/97
uccaggcccuggccagcccga

SEQ ID NO: 3077073 - RNA, 13 nt, Mycobacterium bovis subsp bovis AF2122/97
uccaggccggcag

SEQ ID NO: 3077074 - RNA, 23 nt, Mycobacterium bovis subsp bovis AF2122/97
uccaggccuaguccggcacugcg

SEQ ID NO: 3077075 - RNA, 16 nt, Mycobacterium bovis subsp bovis AF2122/97
uccaggcgagugaacu

SEQ ID NO: 3077076 - RNA, 13 nt, Mycobacterium bovis subsp bovis AF2122/97
uccaggcgccacc

SEQ ID NO: 3077077 - RNA, 16 nt, Mycobacterium bovis subsp bovis AF2122/97
uccaggcgcgcaccac

SEQ ID NO: 3077078 - RNA, 19 nt, Mycobacterium bovis subsp bovis AF2122/97
uccaggcgcgcaccaccgc

SEQ ID NO: 3077079 - RNA, 20 nt, Mycobacterium bovis subsp bovis AF2122/97
uccaggcgcgccgcacccgg

SEQ ID NO: 3077080 - RNA, 21 nt, Mycobacterium bovis subsp bovis AF2122/97
uccaggcgcugcagcauggcu

SEQ ID NO: 3077081 - RNA, 18 nt, Mycobacterium bovis subsp bovis AF2122/97
uccaggcgggcggcaccg

SEQ ID NO: 3077082 - RNA, 17 nt, Mycobacterium bovis subsp bovis AF2122/97
uccagggccgacgcgaa

SEQ ID NO: 3077083 - RNA, 21 nt, Mycobacterium bovis subsp bovis AF2122/97
uccaggguccggacgaaaucg

SEQ ID NO: 3077084 - RNA, 22 nt, Mycobacterium bovis subsp bovis AF2122/97
uccagggugccggucacgucga

SEQ ID NO: 3077085 - RNA, 16 nt, Mycobacterium bovis subsp bovis AF2122/97
uccaggguggucgucg

SEQ ID NO: 3077086 - RNA, 13 nt, Mycobacterium bovis subsp bovis AF2122/97
uccaggucgacau

SEQ ID NO: 3077087 - RNA, 21 nt, Mycobacterium bovis subsp bovis AF2122/97
uccaggucgccuucccagccg

SEQ ID NO: 3077088 - RNA, 21 nt, Mycobacterium bovis subsp bovis AF2122/97
uccagguggcgcggacccgcc

SEQ ID NO: 3077089 - RNA, 15 nt, Mycobacterium bovis subsp bovis AF2122/97
uccagguuccagguc

SEQ ID NO: 3077090 - RNA, 19 nt, Mycobacterium bovis subsp bovis AF2122/97
uccagguucuucuccacca

SEQ ID NO: 3077091 - RNA, 21 nt, Mycobacterium bovis subsp bovis AF2122/97
uccagguucuucuccaccacc

SEQ ID NO: 3077092 - RNA, 14 nt, Mycobacterium bovis subsp bovis AF2122/97
uccaguaaccgucc

SEQ ID NO: 3077093 - RNA, 19 nt, Mycobacterium bovis subsp bovis AF2122/97
uccaguaaccguccgcgga

SEQ ID NO: 3077094 - RNA, 17 nt, Mycobacterium bovis subsp bovis AF2122/97
uccaguccaugugccca

SEQ ID NO: 3077095 - RNA, 14 nt, Mycobacterium bovis subsp bovis AF2122/97
uccagugcggccuu

SEQ ID NO: 3077096 - RNA, 20 nt, Mycobacterium bovis subsp bovis AF2122/97
uccagugcgguggccagugc

SEQ ID NO: 3077097 - RNA, 18 nt, Mycobacterium bovis subsp bovis AF2122/97
uccaguggcgccagggcc

SEQ ID NO: 3077098 - RNA, 16 nt, Mycobacterium bovis subsp bovis AF2122/97
uccaguucaccgcgcu

SEQ ID NO: 3077099 - RNA, 16 nt, Mycobacterium bovis subsp bovis AF2122/97
uccauacagccgccga

SEQ ID NO: 3077100 - RNA, 14 nt, Mycobacterium bovis subsp bovis AF2122/97
uccaucaaggucau

SEQ ID NO: 3077101 - RNA, 13 nt, Mycobacterium bovis subsp bovis AF2122/97
uccaucacaucca

SEQ ID NO: 3077102 - RNA, 19 nt, Mycobacterium bovis subsp bovis AF2122/97
uccaucaccacaccggcag

SEQ ID NO: 3077103 - RNA, 17 nt, Mycobacterium bovis subsp bovis AF2122/97
uccaucacggaccaggc

SEQ ID NO: 3077104 - RNA, 19 nt, Mycobacterium bovis subsp bovis AF2122/97
uccaucacggaccaggccu

SEQ ID NO: 3077105 - RNA, 15 nt, Mycobacterium bovis subsp bovis AF2122/97
uccaucagagacagc

SEQ ID NO: 3077106 - RNA, 13 nt, Mycobacterium bovis subsp bovis AF2122/97
uccaucagcgcga

SEQ ID NO: 3077107 - RNA, 14 nt, Mycobacterium bovis subsp bovis AF2122/97
uccaucagggccuu

SEQ ID NO: 3077108 - RNA, 13 nt, Mycobacterium bovis subsp bovis AF2122/97
uccaucaugugcg

SEQ ID NO: 3077109 - RNA, 21 nt, Mycobacterium bovis subsp bovis AF2122/97
uccaucccgagcuccgcggcg

SEQ ID NO: 3077110 - RNA, 21 nt, Mycobacterium bovis subsp bovis AF2122/97
uccaucgcgaccucggaggcg

SEQ ID NO: 3077111 - RNA, 14 nt, Mycobacterium bovis subsp bovis AF2122/97
uccaucgcgcaccg

SEQ ID NO: 3077112 - RNA, 15 nt, Mycobacterium bovis subsp bovis AF2122/97
uccaucgcgcaccgc

SEQ ID NO: 3077113 - RNA, 14 nt, Mycobacterium bovis subsp bovis AF2122/97
uccaucgcgcugcg

SEQ ID NO: 3077114 - RNA, 17 nt, Mycobacterium bovis subsp bovis AF2122/97
uccaucgcgcugcggcc

SEQ ID NO: 3077115 - RNA, 15 nt, Mycobacterium bovis subsp bovis AF2122/97
uccaugacaaaccug

SEQ ID NO: 3077116 - RNA, 16 nt, Mycobacterium bovis subsp bovis AF2122/97
uccaugacaaaccugc

SEQ ID NO: 3077117 - RNA, 13 nt, Mycobacterium bovis subsp bovis AF2122/97
uccaugagccgua

SEQ ID NO: 3077118 - RNA, 14 nt, Mycobacterium bovis subsp bovis AF2122/97
uccaugauggccgu

SEQ ID NO: 3077119 - RNA, 15 nt, Mycobacterium bovis subsp bovis AF2122/97
uccccgcgcugagca

SEQ ID NO: 3077120 - RNA, 16 nt, Mycobacterium bovis subsp bovis AF2122/97
uccccgcgcugagcac

SEQ ID NO: 3077121 - RNA, 14 nt, Mycobacterium bovis subsp bovis AF2122/97
uccccgcuuggcga

SEQ ID NO: 3077122 - RNA, 20 nt, Mycobacterium bovis subsp bovis AF2122/97
uccccgcuuggcgagccacg

SEQ ID NO: 3077123 - RNA, 21 nt, Mycobacterium bovis subsp bovis AF2122/97
uccccggauuccucgucaccg

SEQ ID NO: 3077124 - RNA, 14 nt, Mycobacterium bovis subsp bovis AF2122/97
uccccggccagccu

SEQ ID NO: 3077125 - RNA, 20 nt, Mycobacterium bovis subsp bovis AF2122/97
uccccggcggcagcauaucc

SEQ ID NO: 3077126 - RNA, 17 nt, Mycobacterium bovis subsp bovis AF2122/97
uccccggcugccagcgc

SEQ ID NO: 3077127 - RNA, 19 nt, Mycobacterium bovis subsp bovis AF2122/97
uccccggcugccagcgccg

SEQ ID NO: 3077128 - RNA, 21 nt, Mycobacterium bovis subsp bovis AF2122/97
uccccggcugccagcgccgcc

SEQ ID NO: 3077129 - RNA, 14 nt, Mycobacterium bovis subsp bovis AF2122/97
uccccgggcucggu

SEQ ID NO: 3077130 - RNA, 16 nt, Mycobacterium bovis subsp bovis AF2122/97
uccccgguacgucgag

SEQ ID NO: 3077131 - RNA, 22 nt, Mycobacterium bovis subsp bovis AF2122/97
uccccgguacgucgagggugac

SEQ ID NO: 3077132 - RNA, 22 nt, Mycobacterium bovis subsp bovis AF2122/97
uccccgguagccccgucgaccu

SEQ ID NO: 3077133 - RNA, 22 nt, Mycobacterium bovis subsp bovis AF2122/97
uccccgguagcguucggcgagc

SEQ ID NO: 3077134 - RNA, 15 nt, Mycobacterium bovis subsp bovis AF2122/97
uccccggucgccgcg

SEQ ID NO: 3077135 - RNA, 21 nt, Mycobacterium bovis subsp bovis AF2122/97
uccccgguucugcgcccaccc

SEQ ID NO: 3077136 - RNA, 19 nt, Mycobacterium bovis subsp bovis AF2122/97
uccccguccugccaguccg

SEQ ID NO: 3077137 - RNA, 13 nt, Mycobacterium bovis subsp bovis AF2122/97
uccccgucgggac

SEQ ID NO: 3077138 - RNA, 23 nt, Mycobacterium bovis subsp bovis AF2122/97
uccccgucggggaaaacguaacg

SEQ ID NO: 3077139 - RNA, 14 nt, Mycobacterium bovis subsp bovis AF2122/97
uccccucgcaaccg

SEQ ID NO: 3077140 - RNA, 14 nt, Mycobacterium bovis subsp bovis AF2122/97
uccccucggccgcc

SEQ ID NO: 3077141 - RNA, 16 nt, Mycobacterium bovis subsp bovis AF2122/97
uccccugcgcugcagc

SEQ ID NO: 3077142 - RNA, 17 nt, Mycobacterium bovis subsp bovis AF2122/97
uccccuugguggccagc

SEQ ID NO: 3077143 - RNA, 15 nt, Mycobacterium bovis subsp bovis AF2122/97
ucccgaaacgccggg

SEQ ID NO: 3077144 - RNA, 17 nt, Mycobacterium bovis subsp bovis AF2122/97
ucccgaaauucucgccc

SEQ ID NO: 3077145 - RNA, 21 nt, Mycobacterium bovis subsp bovis AF2122/97
ucccgaacaauucacgcacca

SEQ ID NO: 3077146 - RNA, 23 nt, Mycobacterium bovis subsp bovis AF2122/97
ucccgaacaauucacgcaccaca

SEQ ID NO: 3077147 - RNA, 18 nt, Mycobacterium bovis subsp bovis AF2122/97
ucccgaaccccgaccgcu

SEQ ID NO: 3077148 - RNA, 20 nt, Mycobacterium bovis subsp bovis AF2122/97
ucccgaaucgugcggcgacc

SEQ ID NO: 3077149 - RNA, 18 nt, Mycobacterium bovis subsp bovis AF2122/97
ucccgaccaccucagcug

SEQ ID NO: 3077150 - RNA, 14 nt, Mycobacterium bovis subsp bovis AF2122/97
ucccgaccagcaga

SEQ ID NO: 3077151 - RNA, 19 nt, Mycobacterium bovis subsp bovis AF2122/97
ucccgacccugcugcaggg

SEQ ID NO: 3077152 - RNA, 15 nt, Mycobacterium bovis subsp bovis AF2122/97
ucccgacgucggccu

SEQ ID NO: 3077153 - RNA, 13 nt, Mycobacterium bovis subsp bovis AF2122/97
ucccgagccacaa

SEQ ID NO: 3077154 - RNA, 23 nt, Mycobacterium bovis subsp bovis AF2122/97
ucccgagccacaaaggcgccggg

SEQ ID NO: 3077155 - RNA, 20 nt, Mycobacterium bovis subsp bovis AF2122/97
ucccgagcccgucagcuccc

SEQ ID NO: 3077156 - RNA, 18 nt, Mycobacterium bovis subsp bovis AF2122/97
ucccgagcuccgcggcga

SEQ ID NO: 3077157 - RNA, 21 nt, Mycobacterium bovis subsp bovis AF2122/97
ucccgagcucuaucgggaagc

SEQ ID NO: 3077158 - RNA, 18 nt, Mycobacterium bovis subsp bovis AF2122/97
ucccgauacggccggccg

SEQ ID NO: 3077159 - RNA, 17 nt, Mycobacterium bovis subsp bovis AF2122/97
ucccgaucccggccagc

SEQ ID NO: 3077160 - RNA, 18 nt, Mycobacterium bovis subsp bovis AF2122/97
ucccgaucccggccagcu

SEQ ID NO: 3077161 - RNA, 14 nt, Mycobacterium bovis subsp bovis AF2122/97
ucccgauccugccc

SEQ ID NO: 3077162 - RNA, 19 nt, Mycobacterium bovis subsp bovis AF2122/97
ucccgauccugcccaccau

SEQ ID NO: 3077163 - RNA, 20 nt, Mycobacterium bovis subsp bovis AF2122/97
ucccgauccugcccaccauc

SEQ ID NO: 3077164 - RNA, 17 nt, Mycobacterium bovis subsp bovis AF2122/97
ucccgaucgcgcuggga

SEQ ID NO: 3077165 - RNA, 16 nt, Mycobacterium bovis subsp bovis AF2122/97
ucccgaugguggccgc

SEQ ID NO: 3077166 - RNA, 21 nt, Mycobacterium bovis subsp bovis AF2122/97
ucccgaugguggccgcgcggu

SEQ ID NO: 3077167 - RNA, 20 nt, Mycobacterium bovis subsp bovis AF2122/97
ucccgauguaugacagguca

SEQ ID NO: 3077168 - RNA, 22 nt, Mycobacterium bovis subsp bovis AF2122/97
ucccgaugugaacgcacccgaa

SEQ ID NO: 3077169 - RNA, 22 nt, Mycobacterium bovis subsp bovis AF2122/97
ucccgcaaaaucgucagcgccg

SEQ ID NO: 3077170 - RNA, 14 nt, Mycobacterium bovis subsp bovis AF2122/97
ucccgcaaugcgag

SEQ ID NO: 3077171 - RNA, 17 nt, Mycobacterium bovis subsp bovis AF2122/97
ucccgcaauucgcgguc

SEQ ID NO: 3077172 - RNA, 13 nt, Mycobacterium bovis subsp bovis AF2122/97
ucccgcacggccg

SEQ ID NO: 3077173 - RNA, 14 nt, Mycobacterium bovis subsp bovis AF2122/97
ucccgcacggccgg

SEQ ID NO: 3077174 - RNA, 15 nt, Mycobacterium bovis subsp bovis AF2122/97
ucccgcagccgggca

SEQ ID NO: 3077175 - RNA, 20 nt, Mycobacterium bovis subsp bovis AF2122/97
ucccgcaggcucaccgagcc

SEQ ID NO: 3077176 - RNA, 21 nt, Mycobacterium bovis subsp bovis AF2122/97
ucccgcaggcucaccgagccg

SEQ ID NO: 3077177 - RNA, 20 nt, Mycobacterium bovis subsp bovis AF2122/97
ucccgccacaccaacgucga

SEQ ID NO: 3077178 - RNA, 13 nt, Mycobacterium bovis subsp bovis AF2122/97
ucccgccacgucg

SEQ ID NO: 3077179 - RNA, 14 nt, Mycobacterium bovis subsp bovis AF2122/97
ucccgccacgucgc

SEQ ID NO: 3077180 - RNA, 14 nt, Mycobacterium bovis subsp bovis AF2122/97
ucccgcccagcagc

SEQ ID NO: 3077181 - RNA, 18 nt, Mycobacterium bovis subsp bovis AF2122/97
ucccgccgaccgacacca

SEQ ID NO: 3077182 - RNA, 19 nt, Mycobacterium bovis subsp bovis AF2122/97
ucccgccgaucgaaccgcu

SEQ ID NO: 3077183 - RNA, 13 nt, Mycobacterium bovis subsp bovis AF2122/97
ucccgccgcaccg

SEQ ID NO: 3077184 - RNA, 15 nt, Mycobacterium bovis subsp bovis AF2122/97
ucccgccgcaccgcc

SEQ ID NO: 3077185 - RNA, 15 nt, Mycobacterium bovis subsp bovis AF2122/97
ucccgccgcccgcau

SEQ ID NO: 3077186 - RNA, 14 nt, Mycobacterium bovis subsp bovis AF2122/97
ucccgccgccugga

SEQ ID NO: 3077187 - RNA, 20 nt, Mycobacterium bovis subsp bovis AF2122/97
ucccgccgcugccgccggug

SEQ ID NO: 3077188 - RNA, 17 nt, Mycobacterium bovis subsp bovis AF2122/97
ucccgccggcuccgcca

SEQ ID NO: 3077189 - RNA, 22 nt, Mycobacterium bovis subsp bovis AF2122/97
ucccgccggucacgacguccga

SEQ ID NO: 3077190 - RNA, 18 nt, Mycobacterium bovis subsp bovis AF2122/97
ucccgccgugccgcggcg

SEQ ID NO: 3077191 - RNA, 21 nt, Mycobacterium bovis subsp bovis AF2122/97
ucccgccgugccgcggcgacg

SEQ ID NO: 3077192 - RNA, 16 nt, Mycobacterium bovis subsp bovis AF2122/97
ucccgccguugccgcc

SEQ ID NO: 3077193 - RNA, 19 nt, Mycobacterium bovis subsp bovis AF2122/97
ucccgccguugccgccguc

SEQ ID NO: 3077194 - RNA, 22 nt, Mycobacterium bovis subsp bovis AF2122/97
ucccgccguugccgccgucacc

SEQ ID NO: 3077195 - RNA, 15 nt, Mycobacterium bovis subsp bovis AF2122/97
ucccgccuucucccg

SEQ ID NO: 3077196 - RNA, 21 nt, Mycobacterium bovis subsp bovis AF2122/97
ucccgcgaugcgcaccagcgg

SEQ ID NO: 3077197 - RNA, 14 nt, Mycobacterium bovis subsp bovis AF2122/97
ucccgcgccggcgu

SEQ ID NO: 3077198 - RNA, 15 nt, Mycobacterium bovis subsp bovis AF2122/97
ucccgcgccggcguu

SEQ ID NO: 3077199 - RNA, 14 nt, Mycobacterium bovis subsp bovis AF2122/97
ucccgcgcgggcgg

SEQ ID NO: 3077200 - RNA, 23 nt, Mycobacterium bovis subsp bovis AF2122/97
ucccgcggaccgcaacgacggcc

SEQ ID NO: 3077201 - RNA, 13 nt, Mycobacterium bovis subsp bovis AF2122/97
ucccgcggcaccu

SEQ ID NO: 3077202 - RNA, 14 nt, Mycobacterium bovis subsp bovis AF2122/97
ucccgcggcaccuu

SEQ ID NO: 3077203 - RNA, 16 nt, Mycobacterium bovis subsp bovis AF2122/97
ucccgcggccgggccg

SEQ ID NO: 3077204 - RNA, 15 nt, Mycobacterium bovis subsp bovis AF2122/97
ucccgcucgagcagc

SEQ ID NO: 3077205 - RNA, 13 nt, Mycobacterium bovis subsp bovis AF2122/97
ucccgcucgcagg

SEQ ID NO: 3077206 - RNA, 16 nt, Mycobacterium bovis subsp bovis AF2122/97
ucccgcucgcaggccg

SEQ ID NO: 3077207 - RNA, 20 nt, Mycobacterium bovis subsp bovis AF2122/97
ucccgcucgcaggccggcgg

SEQ ID NO: 3077208 - RNA, 17 nt, Mycobacterium bovis subsp bovis AF2122/97
ucccgcucuggucgucg

SEQ ID NO: 3077209 - RNA, 15 nt, Mycobacterium bovis subsp bovis AF2122/97
ucccggaacgccgcc

SEQ ID NO: 3077210 - RNA, 13 nt, Mycobacterium bovis subsp bovis AF2122/97
ucccggacccacc

SEQ ID NO: 3077211 - RNA, 12 nt, Mycobacterium bovis subsp bovis AF2122/97
ucccggccaggc

SEQ ID NO: 3077212 - RNA, 13 nt, Mycobacterium bovis subsp bovis AF2122/97
ucccggccgccga

SEQ ID NO: 3077213 - RNA, 19 nt, Mycobacterium bovis subsp bovis AF2122/97
ucccggccucgaugucgcg

SEQ ID NO: 3077214 - RNA, 23 nt, Mycobacterium bovis subsp bovis AF2122/97
ucccggccucgaugucgcggucg

SEQ ID NO: 3077215 - RNA, 16 nt, Mycobacterium bovis subsp bovis AF2122/97
ucccggcgaccggguc

SEQ ID NO: 3077216 - RNA, 22 nt, Mycobacterium bovis subsp bovis AF2122/97
ucccggcgaccggguccggcgu

SEQ ID NO: 3077217 - RNA, 18 nt, Mycobacterium bovis subsp bovis AF2122/97
ucccggcgagcacccgcu

SEQ ID NO: 3077218 - RNA, 24 nt, Mycobacterium bovis subsp bovis AF2122/97
ucccggcgagcacccgcuggucga

SEQ ID NO: 3077219 - RNA, 14 nt, Mycobacterium bovis subsp bovis AF2122/97
ucccggcgccgcgg

SEQ ID NO: 3077220 - RNA, 15 nt, Mycobacterium bovis subsp bovis AF2122/97
ucccggcggcgcgcc

SEQ ID NO: 3077221 - RNA, 16 nt, Mycobacterium bovis subsp bovis AF2122/97
ucccggcggucagcgg

SEQ ID NO: 3077222 - RNA, 19 nt, Mycobacterium bovis subsp bovis AF2122/97
ucccggcggucagcggcuc

SEQ ID NO: 3077223 - RNA, 23 nt, Mycobacterium bovis subsp bovis AF2122/97
ucccggcucgagcucggcgaugc

SEQ ID NO: 3077224 - RNA, 15 nt, Mycobacterium bovis subsp bovis AF2122/97
ucccggcucggccag

SEQ ID NO: 3077225 - RNA, 16 nt, Mycobacterium bovis subsp bovis AF2122/97
ucccggcucggccagc

SEQ ID NO: 3077226 - RNA, 18 nt, Mycobacterium bovis subsp bovis AF2122/97
ucccggcucggccagcca

SEQ ID NO: 3077227 - RNA, 23 nt, Mycobacterium bovis subsp bovis AF2122/97
ucccgggcccgcugggcuugggg

SEQ ID NO: 3077228 - RNA, 14 nt, Mycobacterium bovis subsp bovis AF2122/97
ucccgggccgccgc

SEQ ID NO: 3077229 - RNA, 21 nt, Mycobacterium bovis subsp bovis AF2122/97
ucccgggccgccgcgauggcc

SEQ ID NO: 3077230 - RNA, 14 nt, Mycobacterium bovis subsp bovis AF2122/97
ucccgggcgagccg

SEQ ID NO: 3077231 - RNA, 19 nt, Mycobacterium bovis subsp bovis AF2122/97
ucccgggcggcggccuggg

SEQ ID NO: 3077232 - RNA, 22 nt, Mycobacterium bovis subsp bovis AF2122/97
ucccggggugccgaucgaugcc

SEQ ID NO: 3077233 - RNA, 21 nt, Mycobacterium bovis subsp bovis AF2122/97
ucccggguccuggaucagcca

SEQ ID NO: 3077234 - RNA, 18 nt, Mycobacterium bovis subsp bovis AF2122/97
ucccgggugcgacgcgac

SEQ ID NO: 3077235 - RNA, 21 nt, Mycobacterium bovis subsp bovis AF2122/97
ucccgggugcgacgcgaccgc

SEQ ID NO: 3077236 - RNA, 14 nt, Mycobacterium bovis subsp bovis AF2122/97
ucccgguccagccc

SEQ ID NO: 3077237 - RNA, 21 nt, Mycobacterium bovis subsp bovis AF2122/97
ucccggucgguguggacuggg

SEQ ID NO: 3077238 - RNA, 23 nt, Mycobacterium bovis subsp bovis AF2122/97
ucccggucuuuaauccagcgccg

SEQ ID NO: 3077239 - RNA, 18 nt, Mycobacterium bovis subsp bovis AF2122/97
ucccggugaccacuugca

SEQ ID NO: 3077240 - RNA, 15 nt, Mycobacterium bovis subsp bovis AF2122/97
ucccgguguccagcc

SEQ ID NO: 3077241 - RNA, 16 nt, Mycobacterium bovis subsp bovis AF2122/97
ucccgguguccagcca

SEQ ID NO: 3077242 - RNA, 18 nt, Mycobacterium bovis subsp bovis AF2122/97
ucccgguguccagccacg

SEQ ID NO: 3077243 - RNA, 13 nt, Mycobacterium bovis subsp bovis AF2122/97
ucccggugucgau

SEQ ID NO: 3077244 - RNA, 15 nt, Mycobacterium bovis subsp bovis AF2122/97
ucccggugucgaugc

SEQ ID NO: 3077245 - RNA, 18 nt, Mycobacterium bovis subsp bovis AF2122/97
ucccgucacucaccccaa

SEQ ID NO: 3077246 - RNA, 20 nt, Mycobacterium bovis subsp bovis AF2122/97
ucccgucccagcugaccagc

SEQ ID NO: 3077247 - RNA, 13 nt, Mycobacterium bovis subsp bovis AF2122/97
ucccgucgccgcc

SEQ ID NO: 3077248 - RNA, 20 nt, Mycobacterium bovis subsp bovis AF2122/97
ucccgucucgacaguggcga

SEQ ID NO: 3077249 - RNA, 21 nt, Mycobacterium bovis subsp bovis AF2122/97
ucccgucucgacaguggcgac

SEQ ID NO: 3077250 - RNA, 16 nt, Mycobacterium bovis subsp bovis AF2122/97
ucccgugauccgccga

SEQ ID NO: 3077251 - RNA, 17 nt, Mycobacterium bovis subsp bovis AF2122/97
ucccgugauccgccgac

SEQ ID NO: 3077252 - RNA, 18 nt, Mycobacterium bovis subsp bovis AF2122/97
ucccguucgcccgcccgu

SEQ ID NO: 3077253 - RNA, 22 nt, Mycobacterium bovis subsp bovis AF2122/97
ucccguucggggccccgcggcg

SEQ ID NO: 3077254 - RNA, 17 nt, Mycobacterium bovis subsp bovis AF2122/97
ucccguugccgcccacu

SEQ ID NO: 3077255 - RNA, 19 nt, Mycobacterium bovis subsp bovis AF2122/97
ucccuacgccgccagcauu

SEQ ID NO: 3077256 - RNA, 23 nt, Mycobacterium bovis subsp bovis AF2122/97
ucccucaguguacaccgcgcccg

SEQ ID NO: 3077257 - RNA, 17 nt, Mycobacterium bovis subsp bovis AF2122/97
ucccucaugcuggaagu

SEQ ID NO: 3077258 - RNA, 17 nt, Mycobacterium bovis subsp bovis AF2122/97
ucccucgaaaaccgugg

SEQ ID NO: 3077259 - RNA, 14 nt, Mycobacterium bovis subsp bovis AF2122/97
ucccucgacagugc

SEQ ID NO: 3077260 - RNA, 17 nt, Mycobacterium bovis subsp bovis AF2122/97
ucccugaaauaccaguc

SEQ ID NO: 3077261 - RNA, 16 nt, Mycobacterium bovis subsp bovis AF2122/97
ucccugcacccagccg

SEQ ID NO: 3077262 - RNA, 19 nt, Mycobacterium bovis subsp bovis AF2122/97
ucccugcaguccacugauc

SEQ ID NO: 3077263 - RNA, 13 nt, Mycobacterium bovis subsp bovis AF2122/97
ucccuggccgccg

SEQ ID NO: 3077264 - RNA, 14 nt, Mycobacterium bovis subsp bovis AF2122/97
ucccugggcgucga

SEQ ID NO: 3077265 - RNA, 17 nt, Mycobacterium bovis subsp bovis AF2122/97
ucccugggcgucgacca

SEQ ID NO: 3077266 - RNA, 20 nt, Mycobacterium bovis subsp bovis AF2122/97
ucccuggggccguccggcuu

SEQ ID NO: 3077267 - RNA, 15 nt, Mycobacterium bovis subsp bovis AF2122/97
ucccugugccagcag

SEQ ID NO: 3077268 - RNA, 22 nt, Mycobacterium bovis subsp bovis AF2122/97
ucccugugccagcagcagcgcc

SEQ ID NO: 3077269 - RNA, 20 nt, Mycobacterium bovis subsp bovis AF2122/97
ucccugugucgccgucgcgg

SEQ ID NO: 3077270 - RNA, 16 nt, Mycobacterium bovis subsp bovis AF2122/97
ucccuugacggugaga

SEQ ID NO: 3077271 - RNA, 23 nt, Mycobacterium bovis subsp bovis AF2122/97
ucccuuguggucugccagcaccc

SEQ ID NO: 3077272 - RNA, 13 nt, Mycobacterium bovis subsp bovis AF2122/97
ucccuuguucccg

SEQ ID NO: 3077273 - RNA, 19 nt, Mycobacterium bovis subsp bovis AF2122/97
uccgaaaucgucaguaccg

SEQ ID NO: 3077274 - RNA, 15 nt, Mycobacterium bovis subsp bovis AF2122/97
uccgaacacggugaa

SEQ ID NO: 3077275 - RNA, 16 nt, Mycobacterium bovis subsp bovis AF2122/97
uccgaacauggccagc

SEQ ID NO: 3077276 - RNA, 20 nt, Mycobacterium bovis subsp bovis AF2122/97
uccgaaccaccuguccggug

SEQ ID NO: 3077277 - RNA, 15 nt, Mycobacterium bovis subsp bovis AF2122/97
uccgaacucgcgggc

SEQ ID NO: 3077278 - RNA, 20 nt, Mycobacterium bovis subsp bovis AF2122/97
uccgaacucgcgggcgacca

SEQ ID NO: 3077279 - RNA, 19 nt, Mycobacterium bovis subsp bovis AF2122/97
uccgaacuggucgacgccg

SEQ ID NO: 3077280 - RNA, 15 nt, Mycobacterium bovis subsp bovis AF2122/97
uccgaagagccagca

SEQ ID NO: 3077281 - RNA, 17 nt, Mycobacterium bovis subsp bovis AF2122/97
uccgaagagccagcaac

SEQ ID NO: 3077282 - RNA, 20 nt, Mycobacterium bovis subsp bovis AF2122/97
uccgaagagccagcaacggu

SEQ ID NO: 3077283 - RNA, 16 nt, Mycobacterium bovis subsp bovis AF2122/97
uccgaaguacuggccg

SEQ ID NO: 3077284 - RNA, 21 nt, Mycobacterium bovis subsp bovis AF2122/97
uccgacaagcugucggcgacc

SEQ ID NO: 3077285 - RNA, 23 nt, Mycobacterium bovis subsp bovis AF2122/97
uccgacaccacggaccagcgccg

SEQ ID NO: 3077286 - RNA, 16 nt, Mycobacterium bovis subsp bovis AF2122/97
uccgacaccggcggca

SEQ ID NO: 3077287 - RNA, 12 nt, Mycobacterium bovis subsp bovis AF2122/97
uccgacaguccg

SEQ ID NO: 3077288 - RNA, 15 nt, Mycobacterium bovis subsp bovis AF2122/97
uccgacaguccgcgc

SEQ ID NO: 3077289 - RNA, 21 nt, Mycobacterium bovis subsp bovis AF2122/97
uccgacaguccgcgccggcgg

SEQ ID NO: 3077290 - RNA, 23 nt, Mycobacterium bovis subsp bovis AF2122/97
uccgacauuggccgucaucgccg

SEQ ID NO: 3077291 - RNA, 22 nt, Mycobacterium bovis subsp bovis AF2122/97
uccgccgaggccgccguugccg

SEQ ID NO: 3077292 - RNA, 19 nt, Mycobacterium bovis subsp bovis AF2122/97
uccgccgcagacgccgacu

SEQ ID NO: 3077293 - RNA, 13 nt, Mycobacterium bovis subsp bovis AF2122/97
uccgccgccgccg

SEQ ID NO: 3077294 - RNA, 14 nt, Mycobacterium bovis subsp bovis AF2122/97
uccgccgccgccgg

SEQ ID NO: 3077295 - RNA, 16 nt, Mycobacterium bovis subsp bovis AF2122/97
uccgccgccgccgggu

SEQ ID NO: 3077296 - RNA, 18 nt, Mycobacterium bovis subsp bovis AF2122/97
uccgccgccgccgggucg

SEQ ID NO: 3077297 - RNA, 14 nt, Mycobacterium bovis subsp bovis AF2122/97
uccgccgccggguu

SEQ ID NO: 3077298 - RNA, 11 nt, Mycobacterium bovis subsp bovis AF2122/97
uccgccggcaa

SEQ ID NO: 3077299 - RNA, 13 nt, Mycobacterium bovis subsp bovis AF2122/97
uccgccggcgaca

SEQ ID NO: 3077300 - RNA, 16 nt, Mycobacterium bovis subsp bovis AF2122/97
uccgccgggccaggcc

SEQ ID NO: 3077301 - RNA, 21 nt, Mycobacterium bovis subsp bovis AF2122/97
uccgccgggccaggccgaugc

SEQ ID NO: 3077302 - RNA, 12 nt, Mycobacterium bovis subsp bovis AF2122/97
uccgccgggcgc

SEQ ID NO: 3077303 - RNA, 17 nt, Mycobacterium bovis subsp bovis AF2122/97
uccgccguaugccgcca

SEQ ID NO: 3077304 - RNA, 20 nt, Mycobacterium bovis subsp bovis AF2122/97
uccgccgucaccccgauucg

SEQ ID NO: 3077305 - RNA, 16 nt, Mycobacterium bovis subsp bovis AF2122/97
uccgccgucgccaccg

SEQ ID NO: 3077306 - RNA, 15 nt, Mycobacterium bovis subsp bovis AF2122/97
uccgccgucgccgcc

SEQ ID NO: 3077307 - RNA, 19 nt, Mycobacterium bovis subsp bovis AF2122/97
uccgccgucgccgccggcg

SEQ ID NO: 3077308 - RNA, 15 nt, Mycobacterium bovis subsp bovis AF2122/97
uccgccguucucgcg

SEQ ID NO: 3077309 - RNA, 15 nt, Mycobacterium bovis subsp bovis AF2122/97
uccgccguugccgau

SEQ ID NO: 3077310 - RNA, 22 nt, Mycobacterium bovis subsp bovis AF2122/97
uccgccguugccgauccccagg

SEQ ID NO: 3077311 - RNA, 17 nt, Mycobacterium bovis subsp bovis AF2122/97
uccgccguugccgccgc

SEQ ID NO: 3077312 - RNA, 19 nt, Mycobacterium bovis subsp bovis AF2122/97
uccgccguugccgccgccu

SEQ ID NO: 3077313 - RNA, 17 nt, Mycobacterium bovis subsp bovis AF2122/97
uccgccucgggugcauu

SEQ ID NO: 3077314 - RNA, 19 nt, Mycobacterium bovis subsp bovis AF2122/97
uccgccugcaccgccgccg

SEQ ID NO: 3077315 - RNA, 16 nt, Mycobacterium bovis subsp bovis AF2122/97
uccgccugcuccugcg

SEQ ID NO: 3077316 - RNA, 15 nt, Mycobacterium bovis subsp bovis AF2122/97
uccgccuguacggcg

SEQ ID NO: 3077317 - RNA, 13 nt, Mycobacterium bovis subsp bovis AF2122/97
uccgcgaaauagc

SEQ ID NO: 3077318 - RNA, 21 nt, Mycobacterium bovis subsp bovis AF2122/97
uccgcgacaccuguucaccaa

SEQ ID NO: 3077319 - RNA, 21 nt, Mycobacterium bovis subsp bovis AF2122/97
uccgcgacgcucgcugcagca

SEQ ID NO: 3077320 - RNA, 21 nt, Mycobacterium bovis subsp bovis AF2122/97
uccgcgacggccuuggcgacg

SEQ ID NO: 3077321 - RNA, 13 nt, Mycobacterium bovis subsp bovis AF2122/97
uccgcgacggcgg

SEQ ID NO: 3077322 - RNA, 19 nt, Mycobacterium bovis subsp bovis AF2122/97
uccgcgacguaguggaagc

SEQ ID NO: 3077323 - RNA, 14 nt, Mycobacterium bovis subsp bovis AF2122/97
uccgcgagcccggc

SEQ ID NO: 3077324 - RNA, 15 nt, Mycobacterium bovis subsp bovis AF2122/97
uccgcgauggccgcg

SEQ ID NO: 3077325 - RNA, 16 nt, Mycobacterium bovis subsp bovis AF2122/97
uccgcgauucgaccgg

SEQ ID NO: 3077326 - RNA, 22 nt, Mycobacterium bovis subsp bovis AF2122/97
uccgcgcaacuuccauuuucgc

SEQ ID NO: 3077327 - RNA, 23 nt, Mycobacterium bovis subsp bovis AF2122/97
uccgcgcaccgcaggguccacac

SEQ ID NO: 3077328 - RNA, 15 nt, Mycobacterium bovis subsp bovis AF2122/97
uccgcgcagccaggg

SEQ ID NO: 3077329 - RNA, 15 nt, Mycobacterium bovis subsp bovis AF2122/97
uccgcgcccgagccg

SEQ ID NO: 3077330 - RNA, 12 nt, Mycobacterium bovis subsp bovis AF2122/97
uccgcgccgauc

SEQ ID NO: 3077331 - RNA, 24 nt, Mycobacterium bovis subsp bovis AF2122/97
uccgcgcgcaagucgauguacacc

SEQ ID NO: 3077332 - RNA, 13 nt, Mycobacterium bovis subsp bovis AF2122/97
uccgcgcgccggc

SEQ ID NO: 3077333 - RNA, 14 nt, Mycobacterium bovis subsp bovis AF2122/97
uccgcgcgccggcg

SEQ ID NO: 3077334 - RNA, 15 nt, Mycobacterium bovis subsp bovis AF2122/97
uccgcgcgccggcgg

SEQ ID NO: 3077335 - RNA, 12 nt, Mycobacterium bovis subsp bovis AF2122/97
uccgcgcgguuu

SEQ ID NO: 3077336 - RNA, 17 nt, Mycobacterium bovis subsp bovis AF2122/97
uccgcgcguccgucggc

SEQ ID NO: 3077337 - RNA, 15 nt, Mycobacterium bovis subsp bovis AF2122/97
uccgcgcucaaccgc

SEQ ID NO: 3077338 - RNA, 12 nt, Mycobacterium bovis subsp bovis AF2122/97
uccgcggaaccc

SEQ ID NO: 3077339 - RNA, 16 nt, Mycobacterium bovis subsp bovis AF2122/97
uccgcggacuuggcgg

SEQ ID NO: 3077340 - RNA, 23 nt, Mycobacterium bovis subsp bovis AF2122/97
uccgcggaucaccaucgccgccg

SEQ ID NO: 3077341 - RNA, 20 nt, Mycobacterium bovis subsp bovis AF2122/97
uccgcggaucugguccagug

SEQ ID NO: 3077342 - RNA, 13 nt, Mycobacterium bovis subsp bovis AF2122/97
uccgcggcacgcu

SEQ ID NO: 3077343 - RNA, 19 nt, Mycobacterium bovis subsp bovis AF2122/97
uccgcggcacgcuccagcu

SEQ ID NO: 3077344 - RNA, 18 nt, Mycobacterium bovis subsp bovis AF2122/97
uccgcggcauuggcgucg

SEQ ID NO: 3077345 - RNA, 14 nt, Mycobacterium bovis subsp bovis AF2122/97
uccgcggccgcggu

SEQ ID NO: 3077346 - RNA, 19 nt, Mycobacterium bovis subsp bovis AF2122/97
uccgcggcgcagcacggcg

SEQ ID NO: 3077347 - RNA, 15 nt, Mycobacterium bovis subsp bovis AF2122/97
uccgcggcgcgcaac

SEQ ID NO: 3077348 - RNA, 21 nt, Mycobacterium bovis subsp bovis AF2122/97
uccgcgggguugauugacccg

SEQ ID NO: 3077349 - RNA, 21 nt, Mycobacterium bovis subsp bovis AF2122/97
uccgcggguuugaucuccacc

SEQ ID NO: 3077350 - RNA, 16 nt, Mycobacterium bovis subsp bovis AF2122/97
uccgcggucgcagcag

SEQ ID NO: 3077351 - RNA, 19 nt, Mycobacterium bovis subsp bovis AF2122/97
uccgcguagagcagcagcg

SEQ ID NO: 3077352 - RNA, 14 nt, Mycobacterium bovis subsp bovis AF2122/97
uccgcguccaaggc

SEQ ID NO: 3077353 - RNA, 16 nt, Mycobacterium bovis subsp bovis AF2122/97
uccgcguccaaggcgc

SEQ ID NO: 3077354 - RNA, 13 nt, Mycobacterium bovis subsp bovis AF2122/97
uccgcgucgccgg

SEQ ID NO: 3077355 - RNA, 16 nt, Mycobacterium bovis subsp bovis AF2122/97
uccgcgucgccggccu

SEQ ID NO: 3077356 - RNA, 18 nt, Mycobacterium bovis subsp bovis AF2122/97
uccgcgucggcggcgacc

SEQ ID NO: 3077357 - RNA, 17 nt, Mycobacterium bovis subsp bovis AF2122/97
uccgcgucugcucgcga

SEQ ID NO: 3077358 - RNA, 18 nt, Mycobacterium bovis subsp bovis AF2122/97
uccgcgucugcucggcgg

SEQ ID NO: 3077359 - RNA, 16 nt, Mycobacterium bovis subsp bovis AF2122/97
uccgcguggugcugac

SEQ ID NO: 3077360 - RNA, 18 nt, Mycobacterium bovis subsp bovis AF2122/97
uccgcguggugcugaccg

SEQ ID NO: 3077361 - RNA, 17 nt, Mycobacterium bovis subsp bovis AF2122/97
uccgcuaggucagguga

SEQ ID NO: 3077362 - RNA, 17 nt, Mycobacterium bovis subsp bovis AF2122/97
uccgcucacccgcccgg

SEQ ID NO: 3077363 - RNA, 19 nt, Mycobacterium bovis subsp bovis AF2122/97
uccgcucgguaccggucga

SEQ ID NO: 3077364 - RNA, 16 nt, Mycobacterium bovis subsp bovis AF2122/97
uccgcucguucgugca

SEQ ID NO: 3077365 - RNA, 15 nt, Mycobacterium bovis subsp bovis AF2122/97
uccgcugaacaccgu

SEQ ID NO: 3077366 - RNA, 14 nt, Mycobacterium bovis subsp bovis AF2122/97
uccgcugacccgcc

SEQ ID NO: 3077367 - RNA, 16 nt, Mycobacterium bovis subsp bovis AF2122/97
uccgcugaugagccgc

SEQ ID NO: 3077368 - RNA, 15 nt, Mycobacterium bovis subsp bovis AF2122/97
uccgcugccgcccgc

SEQ ID NO: 3077369 - RNA, 17 nt, Mycobacterium bovis subsp bovis AF2122/97
uccgcugccgcccgcgc

SEQ ID NO: 3077370 - RNA, 16 nt, Mycobacterium bovis subsp bovis AF2122/97
uccgcugcgccgaggc

SEQ ID NO: 3077371 - RNA, 16 nt, Mycobacterium bovis subsp bovis AF2122/97
uccgcuggguggccgc

SEQ ID NO: 3077372 - RNA, 20 nt, Mycobacterium bovis subsp bovis AF2122/97
uccgcugucgagccggugcc

SEQ ID NO: 3077373 - RNA, 15 nt, Mycobacterium bovis subsp bovis AF2122/97
uccgcuguuccucga

SEQ ID NO: 3077374 - RNA, 19 nt, Mycobacterium bovis subsp bovis AF2122/97
uccggaaauuccggcgcgg

SEQ ID NO: 3077375 - RNA, 20 nt, Mycobacterium bovis subsp bovis AF2122/97
uccggaaauuccggcgcggc

SEQ ID NO: 3077376 - RNA, 19 nt, Mycobacterium bovis subsp bovis AF2122/97
uccggaaccgguaucgcca

SEQ ID NO: 3077377 - RNA, 21 nt, Mycobacterium bovis subsp bovis AF2122/97
uccggaaccgguaucgccaaa

SEQ ID NO: 3077378 - RNA, 22 nt, Mycobacterium bovis subsp bovis AF2122/97
uccggcggugccgucgccgccc

SEQ ID NO: 3077379 - RNA, 16 nt, Mycobacterium bovis subsp bovis AF2122/97
uccggcguacgccgua

SEQ ID NO: 3077380 - RNA, 16 nt, Mycobacterium bovis subsp bovis AF2122/97
uccggcgugcagcacc

SEQ ID NO: 3077381 - RNA, 16 nt, Mycobacterium bovis subsp bovis AF2122/97
uccggcguggccccac

SEQ ID NO: 3077382 - RNA, 14 nt, Mycobacterium bovis subsp bovis AF2122/97
uccggcgugggcac

SEQ ID NO: 3077383 - RNA, 16 nt, Mycobacterium bovis subsp bovis AF2122/97
uccggcguucccgcca

SEQ ID NO: 3077384 - RNA, 15 nt, Mycobacterium bovis subsp bovis AF2122/97
uccggcucauccgac

SEQ ID NO: 3077385 - RNA, 16 nt, Mycobacterium bovis subsp bovis AF2122/97
uccggcucauccgacg

SEQ ID NO: 3077386 - RNA, 18 nt, Mycobacterium bovis subsp bovis AF2122/97
uccggcucauccgacggg

SEQ ID NO: 3077387 - RNA, 18 nt, Mycobacterium bovis subsp bovis AF2122/97
uccggcucgucagguucc

SEQ ID NO: 3077388 - RNA, 12 nt, Mycobacterium bovis subsp bovis AF2122/97
uccggcugcggu

SEQ ID NO: 3077389 - RNA, 17 nt, Mycobacterium bovis subsp bovis AF2122/97
uccggcuggaagcggcg

SEQ ID NO: 3077390 - RNA, 18 nt, Mycobacterium bovis subsp bovis AF2122/97
uccggcuggaagcggcga

SEQ ID NO: 3077391 - RNA, 23 nt, Mycobacterium bovis subsp bovis AF2122/97
uccggcuggaagcggcgacuacc

SEQ ID NO: 3077392 - RNA, 16 nt, Mycobacterium bovis subsp bovis AF2122/97
uccggcuuaccggcgg

SEQ ID NO: 3077393 - RNA, 16 nt, Mycobacterium bovis subsp bovis AF2122/97
uccggcuucguccacc

SEQ ID NO: 3077394 - RNA, 18 nt, Mycobacterium bovis subsp bovis AF2122/97
uccggcuucguccaccgc

SEQ ID NO: 3077395 - RNA, 20 nt, Mycobacterium bovis subsp bovis AF2122/97
uccggcuucguccaccgcga

SEQ ID NO: 3077396 - RNA, 16 nt, Mycobacterium bovis subsp bovis AF2122/97
uccggcuuggcggcga

SEQ ID NO: 3077397 - RNA, 16 nt, Mycobacterium bovis subsp bovis AF2122/97
uccgggaccaggccaa

SEQ ID NO: 3077398 - RNA, 19 nt, Mycobacterium bovis subsp bovis AF2122/97
uccgggaccaggccaacgg

SEQ ID NO: 3077399 - RNA, 14 nt, Mycobacterium bovis subsp bovis AF2122/97
uccgggacggugaa

SEQ ID NO: 3077400 - RNA, 15 nt, Mycobacterium bovis subsp bovis AF2122/97
uccgggacuaccacc

SEQ ID NO: 3077401 - RNA, 19 nt, Mycobacterium bovis subsp bovis AF2122/97
uccgggacuaccacccgca

SEQ ID NO: 3077402 - RNA, 22 nt, Mycobacterium bovis subsp bovis AF2122/97
uccgggaugaagcucgaccgcc

SEQ ID NO: 3077403 - RNA, 19 nt, Mycobacterium bovis subsp bovis AF2122/97
uccgggcaaucacaucaaa

SEQ ID NO: 3077404 - RNA, 13 nt, Mycobacterium bovis subsp bovis AF2122/97
uccgggcagcugg

SEQ ID NO: 3077405 - RNA, 20 nt, Mycobacterium bovis subsp bovis AF2122/97
uccgggccauguggggaccu

SEQ ID NO: 3077406 - RNA, 12 nt, Mycobacterium bovis subsp bovis AF2122/97
uccgggccccac

SEQ ID NO: 3077407 - RNA, 18 nt, Mycobacterium bovis subsp bovis AF2122/97
uccgggccgagcgcacca

SEQ ID NO: 3077408 - RNA, 20 nt, Mycobacterium bovis subsp bovis AF2122/97
uccgggccgagcgcaccacg

SEQ ID NO: 3077409 - RNA, 15 nt, Mycobacterium bovis subsp bovis AF2122/97
uccgggccgaucacc

SEQ ID NO: 3077410 - RNA, 16 nt, Mycobacterium bovis subsp bovis AF2122/97
uccgggccuaucccga

SEQ ID NO: 3077411 - RNA, 17 nt, Mycobacterium bovis subsp bovis AF2122/97
uccgggccuggccugcc

SEQ ID NO: 3077412 - RNA, 20 nt, Mycobacterium bovis subsp bovis AF2122/97
uccgggcgaccaccaccgcc

SEQ ID NO: 3077413 - RNA, 23 nt, Mycobacterium bovis subsp bovis AF2122/97
uccgggcgcguggaaaccggugg

SEQ ID NO: 3077414 - RNA, 16 nt, Mycobacterium bovis subsp bovis AF2122/97
uccgggcggccucccg

SEQ ID NO: 3077415 - RNA, 20 nt, Mycobacterium bovis subsp bovis AF2122/97
uccggggaaagccgcagccg

SEQ ID NO: 3077416 - RNA, 20 nt, Mycobacterium bovis subsp bovis AF2122/97
uccggggggauccagcaggc

SEQ ID NO: 3077417 - RNA, 22 nt, Mycobacterium bovis subsp bovis AF2122/97
uccggggggauccagcaggccg

SEQ ID NO: 3077418 - RNA, 14 nt, Mycobacterium bovis subsp bovis AF2122/97
uccgggguggacgg

SEQ ID NO: 3077419 - RNA, 20 nt, Mycobacterium bovis subsp bovis AF2122/97
uccggguagcggcgccgccc

SEQ ID NO: 3077420 - RNA, 14 nt, Mycobacterium bovis subsp bovis AF2122/97
uccggguccaggaa

SEQ ID NO: 3077421 - RNA, 14 nt, Mycobacterium bovis subsp bovis AF2122/97
uccgggucgacgac

SEQ ID NO: 3077422 - RNA, 17 nt, Mycobacterium bovis subsp bovis AF2122/97
uccgggugcagaucgcc

SEQ ID NO: 3077423 - RNA, 17 nt, Mycobacterium bovis subsp bovis AF2122/97
uccgggugccggugcgc

SEQ ID NO: 3077424 - RNA, 14 nt, Mycobacterium bovis subsp bovis AF2122/97
uccggguuggccac

SEQ ID NO: 3077425 - RNA, 15 nt, Mycobacterium bovis subsp bovis AF2122/97
uccggguuggcgacg

SEQ ID NO: 3077426 - RNA, 17 nt, Mycobacterium bovis subsp bovis AF2122/97
uccggguuuugcgcggc

SEQ ID NO: 3077427 - RNA, 19 nt, Mycobacterium bovis subsp bovis AF2122/97
uccggguuuugcgcggcca

SEQ ID NO: 3077428 - RNA, 17 nt, Mycobacterium bovis subsp bovis AF2122/97
uccgguagcuguggugg

SEQ ID NO: 3077429 - RNA, 14 nt, Mycobacterium bovis subsp bovis AF2122/97
uccgguaggcgaga

SEQ ID NO: 3077430 - RNA, 14 nt, Mycobacterium bovis subsp bovis AF2122/97
uccgguaucggcga

SEQ ID NO: 3077431 - RNA, 16 nt, Mycobacterium bovis subsp bovis AF2122/97
uccgguaucggcgacc

SEQ ID NO: 3077432 - RNA, 17 nt, Mycobacterium bovis subsp bovis AF2122/97
uccggucaacacccgcc

SEQ ID NO: 3077433 - RNA, 15 nt, Mycobacterium bovis subsp bovis AF2122/97
uccggucagcgcggc

SEQ ID NO: 3077434 - RNA, 21 nt, Mycobacterium bovis subsp bovis AF2122/97
uccgguccagcggccgccgcg

SEQ ID NO: 3077435 - RNA, 13 nt, Mycobacterium bovis subsp bovis AF2122/97
uccggucccgccg

SEQ ID NO: 3077436 - RNA, 20 nt, Mycobacterium bovis subsp bovis AF2122/97
uccggucccgccgugccgcg

SEQ ID NO: 3077437 - RNA, 15 nt, Mycobacterium bovis subsp bovis AF2122/97
uccgguccgccagcg

SEQ ID NO: 3077438 - RNA, 14 nt, Mycobacterium bovis subsp bovis AF2122/97
uccggucgccaagu

SEQ ID NO: 3077439 - RNA, 17 nt, Mycobacterium bovis subsp bovis AF2122/97
uccggucgccucaccgg

SEQ ID NO: 3077440 - RNA, 15 nt, Mycobacterium bovis subsp bovis AF2122/97
uccggucggccaggc

SEQ ID NO: 3077441 - RNA, 16 nt, Mycobacterium bovis subsp bovis AF2122/97
uccggucggccaggcc

SEQ ID NO: 3077442 - RNA, 15 nt, Mycobacterium bovis subsp bovis AF2122/97
uccggucggcccaca

SEQ ID NO: 3077443 - RNA, 15 nt, Mycobacterium bovis subsp bovis AF2122/97
uccggucggucucgg

SEQ ID NO: 3077444 - RNA, 16 nt, Mycobacterium bovis subsp bovis AF2122/97
uccggugaacccgauu

SEQ ID NO: 3077445 - RNA, 16 nt, Mycobacterium bovis subsp bovis AF2122/97
uccggugaucaccgac

SEQ ID NO: 3077446 - RNA, 21 nt, Mycobacterium bovis subsp bovis AF2122/97
uccggugauccaacuggccgc

SEQ ID NO: 3077447 - RNA, 18 nt, Mycobacterium bovis subsp bovis AF2122/97
uccggugaucgcgguggc

SEQ ID NO: 3077448 - RNA, 14 nt, Mycobacterium bovis subsp bovis AF2122/97
uccggugcccgcac

SEQ ID NO: 3077449 - RNA, 18 nt, Mycobacterium bovis subsp bovis AF2122/97
uccggugccgcgaucgcg

SEQ ID NO: 3077450 - RNA, 12 nt, Mycobacterium bovis subsp bovis AF2122/97
uccggugccggg

SEQ ID NO: 3077451 - RNA, 21 nt, Mycobacterium bovis subsp bovis AF2122/97
uccggugccgggaugccgccg

SEQ ID NO: 3077452 - RNA, 20 nt, Mycobacterium bovis subsp bovis AF2122/97
uccggugcgaucccacccuc

SEQ ID NO: 3077453 - RNA, 21 nt, Mycobacterium bovis subsp bovis AF2122/97
uccggugcgccgaucccgccc

SEQ ID NO: 3077454 - RNA, 19 nt, Mycobacterium bovis subsp bovis AF2122/97
uccggugcugguccagccg

SEQ ID NO: 3077455 - RNA, 20 nt, Mycobacterium bovis subsp bovis AF2122/97
uccgguggaauccaccagcc

SEQ ID NO: 3077456 - RNA, 15 nt, Mycobacterium bovis subsp bovis AF2122/97
uccgguggaccgccg

SEQ ID NO: 3077457 - RNA, 21 nt, Mycobacterium bovis subsp bovis AF2122/97
uccgguggaccgccgaucggc

SEQ ID NO: 3077458 - RNA, 20 nt, Mycobacterium bovis subsp bovis AF2122/97
uccgguggccaacaccgcca

SEQ ID NO: 3077459 - RNA, 20 nt, Mycobacterium bovis subsp bovis AF2122/97
uccgguggcuggccgccacc

SEQ ID NO: 3077460 - RNA, 21 nt, Mycobacterium bovis subsp bovis AF2122/97
uccgguggcuggccgccaccg

SEQ ID NO: 3077461 - RNA, 23 nt, Mycobacterium bovis subsp bovis AF2122/97
uccgguggcuggccgccaccgca

SEQ ID NO: 3077462 - RNA, 17 nt, Mycobacterium bovis subsp bovis AF2122/97
uccgguggugcucgucg

SEQ ID NO: 3077463 - RNA, 12 nt, Mycobacterium bovis subsp bovis AF2122/97
uccgguguugag

SEQ ID NO: 3077464 - RNA, 12 nt, Mycobacterium bovis subsp bovis AF2122/97
uccgguucgccg

SEQ ID NO: 3077465 - RNA, 22 nt, Mycobacterium bovis subsp bovis AF2122/97
uccucgucgacgucggcaucgg

SEQ ID NO: 3077466 - RNA, 21 nt, Mycobacterium bovis subsp bovis AF2122/97
uccucgucgaggucagcuccc

SEQ ID NO: 3077467 - RNA, 14 nt, Mycobacterium bovis subsp bovis AF2122/97
uccucgucggcgaa

SEQ ID NO: 3077468 - RNA, 15 nt, Mycobacterium bovis subsp bovis AF2122/97
uccucgucuucgucg

SEQ ID NO: 3077469 - RNA, 13 nt, Mycobacterium bovis subsp bovis AF2122/97
uccucgugcagca

SEQ ID NO: 3077470 - RNA, 16 nt, Mycobacterium bovis subsp bovis AF2122/97
uccucugguugggagc

SEQ ID NO: 3077471 - RNA, 14 nt, Mycobacterium bovis subsp bovis AF2122/97
uccugaccagccag

SEQ ID NO: 3077472 - RNA, 19 nt, Mycobacterium bovis subsp bovis AF2122/97
uccugaccagccaggugau

SEQ ID NO: 3077473 - RNA, 14 nt, Mycobacterium bovis subsp bovis AF2122/97
uccugaguuccggu

SEQ ID NO: 3077474 - RNA, 19 nt, Mycobacterium bovis subsp bovis AF2122/97
uccugcacacaggacuugu

SEQ ID NO: 3077475 - RNA, 14 nt, Mycobacterium bovis subsp bovis AF2122/97
uccugcagcccggg

SEQ ID NO: 3077476 - RNA, 13 nt, Mycobacterium bovis subsp bovis AF2122/97
uccugcagcuggc

SEQ ID NO: 3077477 - RNA, 15 nt, Mycobacterium bovis subsp bovis AF2122/97
uccugcagcuggcga

SEQ ID NO: 3077478 - RNA, 16 nt, Mycobacterium bovis subsp bovis AF2122/97
uccugcaggaucaaaa

SEQ ID NO: 3077479 - RNA, 13 nt, Mycobacterium bovis subsp bovis AF2122/97
uccugcccaccau

SEQ ID NO: 3077480 - RNA, 14 nt, Mycobacterium bovis subsp bovis AF2122/97
uccugcccaccauc

SEQ ID NO: 3077481 - RNA, 19 nt, Mycobacterium bovis subsp bovis AF2122/97
uccugcccaccaucccgcu

SEQ ID NO: 3077482 - RNA, 15 nt, Mycobacterium bovis subsp bovis AF2122/97
uccugcccgucgucg

SEQ ID NO: 3077483 - RNA, 22 nt, Mycobacterium bovis subsp bovis AF2122/97
uccugcgagaggugcugcaccu

SEQ ID NO: 3077484 - RNA, 22 nt, Mycobacterium bovis subsp bovis AF2122/97
uccugcgccgcacgccgaccgg

SEQ ID NO: 3077485 - RNA, 20 nt, Mycobacterium bovis subsp bovis AF2122/97
uccugcgccgguaacugucc

SEQ ID NO: 3077486 - RNA, 14 nt, Mycobacterium bovis subsp bovis AF2122/97
uccugcguccagau

SEQ ID NO: 3077487 - RNA, 20 nt, Mycobacterium bovis subsp bovis AF2122/97
uccuggaaaggacggccggc

SEQ ID NO: 3077488 - RNA, 20 nt, Mycobacterium bovis subsp bovis AF2122/97
uccuggaugaaguguuuggc

SEQ ID NO: 3077489 - RNA, 17 nt, Mycobacterium bovis subsp bovis AF2122/97
uccuggccacucccagc

SEQ ID NO: 3077490 - RNA, 19 nt, Mycobacterium bovis subsp bovis AF2122/97
uccuggccacucccagcca

SEQ ID NO: 3077491 - RNA, 20 nt, Mycobacterium bovis subsp bovis AF2122/97
uccuggcccgauaaaugccg

SEQ ID NO: 3077492 - RNA, 21 nt, Mycobacterium bovis subsp bovis AF2122/97
uccuggccggugguagcggac

SEQ ID NO: 3077493 - RNA, 13 nt, Mycobacterium bovis subsp bovis AF2122/97
uccuggcggcugc

SEQ ID NO: 3077494 - RNA, 21 nt, Mycobacterium bovis subsp bovis AF2122/97
uccuggcggcugcagccgacc

SEQ ID NO: 3077495 - RNA, 16 nt, Mycobacterium bovis subsp bovis AF2122/97
uccuggcggguggcga

SEQ ID NO: 3077496 - RNA, 17 nt, Mycobacterium bovis subsp bovis AF2122/97
uccuggcguagugcagc

SEQ ID NO: 3077497 - RNA, 16 nt, Mycobacterium bovis subsp bovis AF2122/97
uccugggccgccgccc

SEQ ID NO: 3077498 - RNA, 21 nt, Mycobacterium bovis subsp bovis AF2122/97
uccuggguguagcaagucgcc

SEQ ID NO: 3077499 - RNA, 17 nt, Mycobacterium bovis subsp bovis AF2122/97
uccuggguuggcaucca

SEQ ID NO: 3077500 - RNA, 14 nt, Mycobacterium bovis subsp bovis AF2122/97
uccuggguugugcc

SEQ ID NO: 3077501 - RNA, 18 nt, Mycobacterium bovis subsp bovis AF2122/97
uccugguaaggccggccg

SEQ ID NO: 3077502 - RNA, 17 nt, Mycobacterium bovis subsp bovis AF2122/97
uccugguaggugucgug

SEQ ID NO: 3077503 - RNA, 14 nt, Mycobacterium bovis subsp bovis AF2122/97
uccugguggcagac

SEQ ID NO: 3077504 - RNA, 14 nt, Mycobacterium bovis subsp bovis AF2122/97
uccugucgcaccag

SEQ ID NO: 3077505 - RNA, 18 nt, Mycobacterium bovis subsp bovis AF2122/97
uccugugcggagccgcca

SEQ ID NO: 3077506 - RNA, 17 nt, Mycobacterium bovis subsp bovis AF2122/97
uccuguugaucugcccu

SEQ ID NO: 3077507 - RNA, 13 nt, Mycobacterium bovis subsp bovis AF2122/97
uccuucaccagcu

SEQ ID NO: 3077508 - RNA, 16 nt, Mycobacterium bovis subsp bovis AF2122/97
uccuucagggcgucga

SEQ ID NO: 3077509 - RNA, 18 nt, Mycobacterium bovis subsp bovis AF2122/97
uccuucgcguuggcccgc

SEQ ID NO: 3077510 - RNA, 20 nt, Mycobacterium bovis subsp bovis AF2122/97
uccuugaacguucuuaaacg

SEQ ID NO: 3077511 - RNA, 17 nt, Mycobacterium bovis subsp bovis AF2122/97
uccuugacgcggccaca

SEQ ID NO: 3077512 - RNA, 21 nt, Mycobacterium bovis subsp bovis AF2122/97
uccuugagccgggcaaccagc

SEQ ID NO: 3077513 - RNA, 19 nt, Mycobacterium bovis subsp bovis AF2122/97
uccuugaucaaggugucga

SEQ ID NO: 3077514 - RNA, 14 nt, Mycobacterium bovis subsp bovis AF2122/97
uccuugaugccuuc

SEQ ID NO: 3077515 - RNA, 19 nt, Mycobacterium bovis subsp bovis AF2122/97
uccuugcgccagcgggcug

SEQ ID NO: 3077516 - RNA, 22 nt, Mycobacterium bovis subsp bovis AF2122/97
uccuuggcccagcgguaguccg

SEQ ID NO: 3077517 - RNA, 13 nt, Mycobacterium bovis subsp bovis AF2122/97
uccuuggccgcca

SEQ ID NO: 3077518 - RNA, 22 nt, Mycobacterium bovis subsp bovis AF2122/97
uccuuggcgaacgccacggcau

SEQ ID NO: 3077519 - RNA, 17 nt, Mycobacterium bovis subsp bovis AF2122/97
uccuugggcgucaagca

SEQ ID NO: 3077520 - RNA, 14 nt, Mycobacterium bovis subsp bovis AF2122/97
uccuuguuggccag

SEQ ID NO: 3077521 - RNA, 18 nt, Mycobacterium bovis subsp bovis AF2122/97
ucgaaaaccgaggcauuc

SEQ ID NO: 3077522 - RNA, 21 nt, Mycobacterium bovis subsp bovis AF2122/97
ucgaaagagaaggcggcgucg

SEQ ID NO: 3077523 - RNA, 23 nt, Mycobacterium bovis subsp bovis AF2122/97
ucgaaagcaccgaugcugacgau

SEQ ID NO: 3077524 - RNA, 17 nt, Mycobacterium bovis subsp bovis AF2122/97
ucgaaagccaacucgac

SEQ ID NO: 3077525 - RNA, 13 nt, Mycobacterium bovis subsp bovis AF2122/97
ucgaaagccgcgg

SEQ ID NO: 3077526 - RNA, 17 nt, Mycobacterium bovis subsp bovis AF2122/97
ucgaaagcgauauugga

SEQ ID NO: 3077527 - RNA, 20 nt, Mycobacterium bovis subsp bovis AF2122/97
ucgaaagcgauauuggaugc

SEQ ID NO: 3077528 - RNA, 19 nt, Mycobacterium bovis subsp bovis AF2122/97
ucgaaauccugguggcaga

SEQ ID NO: 3077529 - RNA, 23 nt, Mycobacterium bovis subsp bovis AF2122/97
ucgaaaucgauuccgggugcgau

SEQ ID NO: 3077530 - RNA, 17 nt, Mycobacterium bovis subsp bovis AF2122/97
ucgaaaucgcacagcgc

SEQ ID NO: 3077531 - RNA, 13 nt, Mycobacterium bovis subsp bovis AF2122/97
ucgaacaccgucc

SEQ ID NO: 3077532 - RNA, 19 nt, Mycobacterium bovis subsp bovis AF2122/97
ucgaacaccguccaauugg

SEQ ID NO: 3077533 - RNA, 19 nt, Mycobacterium bovis subsp bovis AF2122/97
ucgaacacggcacaaucgg

SEQ ID NO: 3077534 - RNA, 23 nt, Mycobacterium bovis subsp bovis AF2122/97
ucgaacacggcacaaucggcgcc

SEQ ID NO: 3077535 - RNA, 15 nt, Mycobacterium bovis subsp bovis AF2122/97
ucgaacagcaccgcc

SEQ ID NO: 3077536 - RNA, 15 nt, Mycobacterium bovis subsp bovis AF2122/97
ucgaacaggaucagc

SEQ ID NO: 3077537 - RNA, 16 nt, Mycobacterium bovis subsp bovis AF2122/97
ucgaacaggccggccg

SEQ ID NO: 3077538 - RNA, 18 nt, Mycobacterium bovis subsp bovis AF2122/97
ucgaacaugauccgccgg

SEQ ID NO: 3077539 - RNA, 20 nt, Mycobacterium bovis subsp bovis AF2122/97
ucgaaccagguaaucaccug

SEQ ID NO: 3077540 - RNA, 14 nt, Mycobacterium bovis subsp bovis AF2122/97
ucgaaccuaccgug

SEQ ID NO: 3077541 - RNA, 22 nt, Mycobacterium bovis subsp bovis AF2122/97
ucgaaccugucgaucacggccg

SEQ ID NO: 3077542 - RNA, 20 nt, Mycobacterium bovis subsp bovis AF2122/97
ucgaacgcagccagcgccau

SEQ ID NO: 3077543 - RNA, 14 nt, Mycobacterium bovis subsp bovis AF2122/97
ucgaacgcccugac

SEQ ID NO: 3077544 - RNA, 14 nt, Mycobacterium bovis subsp bovis AF2122/97
ucgaacgcugagga

SEQ ID NO: 3077545 - RNA, 21 nt, Mycobacterium bovis subsp bovis AF2122/97
ucgaacggcagcccgggcgug

SEQ ID NO: 3077546 - RNA, 21 nt, Mycobacterium bovis subsp bovis AF2122/97
ucgaacggcuuggcgucggcc

SEQ ID NO: 3077547 - RNA, 22 nt, Mycobacterium bovis subsp bovis AF2122/97
ucgaacggcuuggcgucggccg

SEQ ID NO: 3077548 - RNA, 22 nt, Mycobacterium bovis subsp bovis AF2122/97
ucgaacuccccggucgccgcgu

SEQ ID NO: 3077549 - RNA, 23 nt, Mycobacterium bovis subsp bovis AF2122/97
ucgaacugccggacuaccgccgg

SEQ ID NO: 3077550 - RNA, 13 nt, Mycobacterium bovis subsp bovis AF2122/97
ucgaacugggcgc

SEQ ID NO: 3077551 - RNA, 21 nt, Mycobacterium bovis subsp bovis AF2122/97
ucgaccgccagccgcgagccg

SEQ ID NO: 3077552 - RNA, 19 nt, Mycobacterium bovis subsp bovis AF2122/97
ucgaccgccagcgccgcca

SEQ ID NO: 3077553 - RNA, 12 nt, Mycobacterium bovis subsp bovis AF2122/97
ucgaccgcccgc

SEQ ID NO: 3077554 - RNA, 15 nt, Mycobacterium bovis subsp bovis AF2122/97
ucgaccgcccgccag

SEQ ID NO: 3077555 - RNA, 21 nt, Mycobacterium bovis subsp bovis AF2122/97
ucgaccgccgagauagcaacg

SEQ ID NO: 3077556 - RNA, 14 nt, Mycobacterium bovis subsp bovis AF2122/97
ucgaccgccgcgag

SEQ ID NO: 3077557 - RNA, 13 nt, Mycobacterium bovis subsp bovis AF2122/97
ucgaccgcggccc

SEQ ID NO: 3077558 - RNA, 22 nt, Mycobacterium bovis subsp bovis AF2122/97
ucgaccgcggccggguggcccg

SEQ ID NO: 3077559 - RNA, 13 nt, Mycobacterium bovis subsp bovis AF2122/97
ucgaccgcuggau

SEQ ID NO: 3077560 - RNA, 21 nt, Mycobacterium bovis subsp bovis AF2122/97
ucgaccggaaugcccgggccc

SEQ ID NO: 3077561 - RNA, 19 nt, Mycobacterium bovis subsp bovis AF2122/97
ucgaccggacaaagcugcu

SEQ ID NO: 3077562 - RNA, 21 nt, Mycobacterium bovis subsp bovis AF2122/97
ucgaccggacaaagcugcucg

SEQ ID NO: 3077563 - RNA, 11 nt, Mycobacterium bovis subsp bovis AF2122/97
ucgaccggcgg

SEQ ID NO: 3077564 - RNA, 13 nt, Mycobacterium bovis subsp bovis AF2122/97
ucgaccggugaug

SEQ ID NO: 3077565 - RNA, 18 nt, Mycobacterium bovis subsp bovis AF2122/97
ucgaccguauugaccagc

SEQ ID NO: 3077566 - RNA, 19 nt, Mycobacterium bovis subsp bovis AF2122/97
ucgaccguauugaccagcg

SEQ ID NO: 3077567 - RNA, 21 nt, Mycobacterium bovis subsp bovis AF2122/97
ucgaccgucacgcguacgucg

SEQ ID NO: 3077568 - RNA, 19 nt, Mycobacterium bovis subsp bovis AF2122/97
ucgaccguccgggucacca

SEQ ID NO: 3077569 - RNA, 22 nt, Mycobacterium bovis subsp bovis AF2122/97
ucgaccguccgggucaccagcg

SEQ ID NO: 3077570 - RNA, 18 nt, Mycobacterium bovis subsp bovis AF2122/97
ucgaccgugcgucgaugg

SEQ ID NO: 3077571 - RNA, 20 nt, Mycobacterium bovis subsp bovis AF2122/97
ucgaccgugcgucgauggcg

SEQ ID NO: 3077572 - RNA, 20 nt, Mycobacterium bovis subsp bovis AF2122/97
ucgaccguggcugcgcucgc

SEQ ID NO: 3077573 - RNA, 21 nt, Mycobacterium bovis subsp bovis AF2122/97
ucgaccguggcugcgcucgcc

SEQ ID NO: 3077574 - RNA, 10 nt, Mycobacterium bovis subsp bovis AF2122/97
ucgaccgugu

SEQ ID NO: 3077575 - RNA, 21 nt, Mycobacterium bovis subsp bovis AF2122/97
ucgaccgugucaccgccggga

SEQ ID NO: 3077576 - RNA, 16 nt, Mycobacterium bovis subsp bovis AF2122/97
ucgaccucagacagcu

SEQ ID NO: 3077577 - RNA, 21 nt, Mycobacterium bovis subsp bovis AF2122/97
ucgaccucggcaaccaccucg

SEQ ID NO: 3077578 - RNA, 13 nt, Mycobacterium bovis subsp bovis AF2122/97
ucgaccucgucgg

SEQ ID NO: 3077579 - RNA, 19 nt, Mycobacterium bovis subsp bovis AF2122/97
ucgaccucgucggccgaca

SEQ ID NO: 3077580 - RNA, 23 nt, Mycobacterium bovis subsp bovis AF2122/97
ucgaccugaggcaccucggccuu

SEQ ID NO: 3077581 - RNA, 18 nt, Mycobacterium bovis subsp bovis AF2122/97
ucgaccuggauugccacc

SEQ ID NO: 3077582 - RNA, 19 nt, Mycobacterium bovis subsp bovis AF2122/97
ucgaccuguugucguggcg

SEQ ID NO: 3077583 - RNA, 20 nt, Mycobacterium bovis subsp bovis AF2122/97
ucgaccuucucgaugcugac

SEQ ID NO: 3077584 - RNA, 19 nt, Mycobacterium bovis subsp bovis AF2122/97
ucgacgaacaccccgggcg

SEQ ID NO: 3077585 - RNA, 12 nt, Mycobacterium bovis subsp bovis AF2122/97
ucgacgaacucc

SEQ ID NO: 3077586 - RNA, 14 nt, Mycobacterium bovis subsp bovis AF2122/97
ucgacgaacuccgc

SEQ ID NO: 3077587 - RNA, 19 nt, Mycobacterium bovis subsp bovis AF2122/97
ucgacgaagaucgcgugcc

SEQ ID NO: 3077588 - RNA, 21 nt, Mycobacterium bovis subsp bovis AF2122/97
ucgacgacgcccucacaacga

SEQ ID NO: 3077589 - RNA, 13 nt, Mycobacterium bovis subsp bovis AF2122/97
ucgacgacgucgc

SEQ ID NO: 3077590 - RNA, 23 nt, Mycobacterium bovis subsp bovis AF2122/97
ucgacgacguggcugcguucgcc

SEQ ID NO: 3077591 - RNA, 21 nt, Mycobacterium bovis subsp bovis AF2122/97
ucgacgacuccuauugcagca

SEQ ID NO: 3077592 - RNA, 22 nt, Mycobacterium bovis subsp bovis AF2122/97
ucgacgagacgaaccgccgacg

SEQ ID NO: 3077593 - RNA, 23 nt, Mycobacterium bovis subsp bovis AF2122/97
ucgacgagauagcauccgcccga

SEQ ID NO: 3077594 - RNA, 17 nt, Mycobacterium bovis subsp bovis AF2122/97
ucgacgagauccagcgc

SEQ ID NO: 3077595 - RNA, 13 nt, Mycobacterium bovis subsp bovis AF2122/97
ucgacgagcaccg

SEQ ID NO: 3077596 - RNA, 19 nt, Mycobacterium bovis subsp bovis AF2122/97
ucgacgagcaccgcgccgc

SEQ ID NO: 3077597 - RNA, 21 nt, Mycobacterium bovis subsp bovis AF2122/97
ucgacgagcaccgcgccgcgc

SEQ ID NO: 3077598 - RNA, 18 nt, Mycobacterium bovis subsp bovis AF2122/97
ucgacgagcacgccgacc

SEQ ID NO: 3077599 - RNA, 15 nt, Mycobacterium bovis subsp bovis AF2122/97
ucgacgagccgcggu

SEQ ID NO: 3077600 - RNA, 22 nt, Mycobacterium bovis subsp bovis AF2122/97
ucgacgagccgcggucggcgug

SEQ ID NO: 3077601 - RNA, 15 nt, Mycobacterium bovis subsp bovis AF2122/97
ucgacgaggucagcg

SEQ ID NO: 3077602 - RNA, 19 nt, Mycobacterium bovis subsp bovis AF2122/97
ucgacgaggucagcgguug

SEQ ID NO: 3077603 - RNA, 13 nt, Mycobacterium bovis subsp bovis AF2122/97
ucgacgagucggc

SEQ ID NO: 3077604 - RNA, 17 nt, Mycobacterium bovis subsp bovis AF2122/97
ucgacgagucggcgggc

SEQ ID NO: 3077605 - RNA, 21 nt, Mycobacterium bovis subsp bovis AF2122/97
ucgacgagucggcgggcgaca

SEQ ID NO: 3077606 - RNA, 18 nt, Mycobacterium bovis subsp bovis AF2122/97
ucgacgaucugcagcacu

SEQ ID NO: 3077607 - RNA, 22 nt, Mycobacterium bovis subsp bovis AF2122/97
ucgacgcaccuauggucaaccg

SEQ ID NO: 3077608 - RNA, 20 nt, Mycobacterium bovis subsp bovis AF2122/97
ucgacgcagugcccgaucgc

SEQ ID NO: 3077609 - RNA, 19 nt, Mycobacterium bovis subsp bovis AF2122/97
ucgacgccaaaucggccaa

SEQ ID NO: 3077610 - RNA, 20 nt, Mycobacterium bovis subsp bovis AF2122/97
ucgacgccccaggacaccuu

SEQ ID NO: 3077611 - RNA, 23 nt, Mycobacterium bovis subsp bovis AF2122/97
ucgacgcccucgguagcauccag

SEQ ID NO: 3077612 - RNA, 15 nt, Mycobacterium bovis subsp bovis AF2122/97
ucgacgccgagaccg

SEQ ID NO: 3077613 - RNA, 19 nt, Mycobacterium bovis subsp bovis AF2122/97
ucgacgccgagaccgccgc

SEQ ID NO: 3077614 - RNA, 20 nt, Mycobacterium bovis subsp bovis AF2122/97
ucgacgccgaucgcggcggc

SEQ ID NO: 3077615 - RNA, 23 nt, Mycobacterium bovis subsp bovis AF2122/97
ucgacgccgccacccggcgggcg

SEQ ID NO: 3077616 - RNA, 17 nt, Mycobacterium bovis subsp bovis AF2122/97
ucgacgccggccagcgg

SEQ ID NO: 3077617 - RNA, 19 nt, Mycobacterium bovis subsp bovis AF2122/97
ucgacgccggccagcggcc

SEQ ID NO: 3077618 - RNA, 21 nt, Mycobacterium bovis subsp bovis AF2122/97
ucgacgcgcauucgccgggcg

SEQ ID NO: 3077619 - RNA, 22 nt, Mycobacterium bovis subsp bovis AF2122/97
ucgacgcgcgcuugggguuggg

SEQ ID NO: 3077620 - RNA, 16 nt, Mycobacterium bovis subsp bovis AF2122/97
ucgacgcgcucgggcg

SEQ ID NO: 3077621 - RNA, 16 nt, Mycobacterium bovis subsp bovis AF2122/97
ucgacgcggcgaccgu

SEQ ID NO: 3077622 - RNA, 20 nt, Mycobacterium bovis subsp bovis AF2122/97
ucgacgcgguccucgagccg

SEQ ID NO: 3077623 - RNA, 17 nt, Mycobacterium bovis subsp bovis AF2122/97
ucgacgcgucgccggcc

SEQ ID NO: 3077624 - RNA, 21 nt, Mycobacterium bovis subsp bovis AF2122/97
ucgacgcuguggcucgacgau

SEQ ID NO: 3077625 - RNA, 18 nt, Mycobacterium bovis subsp bovis AF2122/97
ucgacggaaucgucggcg

SEQ ID NO: 3077626 - RNA, 22 nt, Mycobacterium bovis subsp bovis AF2122/97
ucgacggaaucgucggcgcggc

SEQ ID NO: 3077627 - RNA, 14 nt, Mycobacterium bovis subsp bovis AF2122/97
ucgacggccagccc

SEQ ID NO: 3077628 - RNA, 18 nt, Mycobacterium bovis subsp bovis AF2122/97
ucgacggccagugcgcag

SEQ ID NO: 3077629 - RNA, 14 nt, Mycobacterium bovis subsp bovis AF2122/97
ucgacggcccgccg

SEQ ID NO: 3077630 - RNA, 21 nt, Mycobacterium bovis subsp bovis AF2122/97
ucgacggcccgccguccggcg

SEQ ID NO: 3077631 - RNA, 19 nt, Mycobacterium bovis subsp bovis AF2122/97
ucgacggccucgucgaugu

SEQ ID NO: 3077632 - RNA, 15 nt, Mycobacterium bovis subsp bovis AF2122/97
ucgacggcgauggcg

SEQ ID NO: 3077633 - RNA, 15 nt, Mycobacterium bovis subsp bovis AF2122/97
ucgacggcgccgccc

SEQ ID NO: 3077634 - RNA, 23 nt, Mycobacterium bovis subsp bovis AF2122/97
ucgacggcggccgccacuccgug

SEQ ID NO: 3077635 - RNA, 17 nt, Mycobacterium bovis subsp bovis AF2122/97
ucgacggcggccgcgau

SEQ ID NO: 3077636 - RNA, 22 nt, Mycobacterium bovis subsp bovis AF2122/97
ucgacggcggccuucggccggc

SEQ ID NO: 3077637 - RNA, 14 nt, Mycobacterium bovis subsp bovis AF2122/97
ucgagccggcggcc

SEQ ID NO: 3077638 - RNA, 15 nt, Mycobacterium bovis subsp bovis AF2122/97
ucgagcgacccccag

SEQ ID NO: 3077639 - RNA, 20 nt, Mycobacterium bovis subsp bovis AF2122/97
ucgagcgacccccagcgccc

SEQ ID NO: 3077640 - RNA, 22 nt, Mycobacterium bovis subsp bovis AF2122/97
ucgagcgacguuguuuuugcac

SEQ ID NO: 3077641 - RNA, 16 nt, Mycobacterium bovis subsp bovis AF2122/97
ucgagcgccgcggacu

SEQ ID NO: 3077642 - RNA, 21 nt, Mycobacterium bovis subsp bovis AF2122/97
ucgagcgccgcggacucgggc

SEQ ID NO: 3077643 - RNA, 12 nt, Mycobacterium bovis subsp bovis AF2122/97
ucgagcgccggc

SEQ ID NO: 3077644 - RNA, 14 nt, Mycobacterium bovis subsp bovis AF2122/97
ucgagcgccggccg

SEQ ID NO: 3077645 - RNA, 15 nt, Mycobacterium bovis subsp bovis AF2122/97
ucgagcgccggccgc

SEQ ID NO: 3077646 - RNA, 16 nt, Mycobacterium bovis subsp bovis AF2122/97
ucgagcgccggccgcg

SEQ ID NO: 3077647 - RNA, 17 nt, Mycobacterium bovis subsp bovis AF2122/97
ucgagcgcgaucgggcc

SEQ ID NO: 3077648 - RNA, 22 nt, Mycobacterium bovis subsp bovis AF2122/97
ucgagcgcgaucgggccggcgc

SEQ ID NO: 3077649 - RNA, 23 nt, Mycobacterium bovis subsp bovis AF2122/97
ucgagcgcgaucgggccggcgcg

SEQ ID NO: 3077650 - RNA, 12 nt, Mycobacterium bovis subsp bovis AF2122/97
ucgagcgcugcu

SEQ ID NO: 3077651 - RNA, 20 nt, Mycobacterium bovis subsp bovis AF2122/97
ucgagcgcuucgucgccgaa

SEQ ID NO: 3077652 - RNA, 18 nt, Mycobacterium bovis subsp bovis AF2122/97
ucgagcgguugccauccg

SEQ ID NO: 3077653 - RNA, 18 nt, Mycobacterium bovis subsp bovis AF2122/97
ucgagcguaacgguaacc

SEQ ID NO: 3077654 - RNA, 23 nt, Mycobacterium bovis subsp bovis AF2122/97
ucgagcguaacgguaaccggccc

SEQ ID NO: 3077655 - RNA, 14 nt, Mycobacterium bovis subsp bovis AF2122/97
ucgagcgugaaccu

SEQ ID NO: 3077656 - RNA, 21 nt, Mycobacterium bovis subsp bovis AF2122/97
ucgagcucgaggcccgggugc

SEQ ID NO: 3077657 - RNA, 20 nt, Mycobacterium bovis subsp bovis AF2122/97
ucgagcucggcgaugcugag

SEQ ID NO: 3077658 - RNA, 19 nt, Mycobacterium bovis subsp bovis AF2122/97
ucgagcugacgauggccag

SEQ ID NO: 3077659 - RNA, 16 nt, Mycobacterium bovis subsp bovis AF2122/97
ucgagcugcuggcgcg

SEQ ID NO: 3077660 - RNA, 17 nt, Mycobacterium bovis subsp bovis AF2122/97
ucgagcuucaucccgga

SEQ ID NO: 3077661 - RNA, 20 nt, Mycobacterium bovis subsp bovis AF2122/97
ucgagcuugccgucgcugac

SEQ ID NO: 3077662 - RNA, 20 nt, Mycobacterium bovis subsp bovis AF2122/97
ucgaggaccaccacuagguc

SEQ ID NO: 3077663 - RNA, 21 nt, Mycobacterium bovis subsp bovis AF2122/97
ucgaggaccaccuggucgcgu

SEQ ID NO: 3077664 - RNA, 19 nt, Mycobacterium bovis subsp bovis AF2122/97
ucgaggaccugcucgggcg

SEQ ID NO: 3077665 - RNA, 20 nt, Mycobacterium bovis subsp bovis AF2122/97
ucgaggcaggccucggcgcc

SEQ ID NO: 3077666 - RNA, 23 nt, Mycobacterium bovis subsp bovis AF2122/97
ucgaggcaggccucggcgccgcc

SEQ ID NO: 3077667 - RNA, 18 nt, Mycobacterium bovis subsp bovis AF2122/97
ucgaggcgaagcggugag

SEQ ID NO: 3077668 - RNA, 12 nt, Mycobacterium bovis subsp bovis AF2122/97
ucgaggcggcgg

SEQ ID NO: 3077669 - RNA, 14 nt, Mycobacterium bovis subsp bovis AF2122/97
ucgaggcggcgguc

SEQ ID NO: 3077670 - RNA, 15 nt, Mycobacterium bovis subsp bovis AF2122/97
ucgaggcgucggcaa

SEQ ID NO: 3077671 - RNA, 23 nt, Mycobacterium bovis subsp bovis AF2122/97
ucgaggcugaccguggcgccggu

SEQ ID NO: 3077672 - RNA, 15 nt, Mycobacterium bovis subsp bovis AF2122/97
ucgagggcaacggca

SEQ ID NO: 3077673 - RNA, 20 nt, Mycobacterium bovis subsp bovis AF2122/97
ucgagggcagccgcccaccc

SEQ ID NO: 3077674 - RNA, 14 nt, Mycobacterium bovis subsp bovis AF2122/97
ucgagggcaucggg

SEQ ID NO: 3077675 - RNA, 22 nt, Mycobacterium bovis subsp bovis AF2122/97
ucgagggcaucgggccuagccg

SEQ ID NO: 3077676 - RNA, 11 nt, Mycobacterium bovis subsp bovis AF2122/97
ucgagggcuuu

SEQ ID NO: 3077677 - RNA, 15 nt, Mycobacterium bovis subsp bovis AF2122/97
ucgagggugaccccc

SEQ ID NO: 3077678 - RNA, 22 nt, Mycobacterium bovis subsp bovis AF2122/97
ucgaggguuuccauggcgugcc

SEQ ID NO: 3077679 - RNA, 23 nt, Mycobacterium bovis subsp bovis AF2122/97
ucgagguacagcgggcacgcuau

SEQ ID NO: 3077680 - RNA, 15 nt, Mycobacterium bovis subsp bovis AF2122/97
ucgagguccaccacc

SEQ ID NO: 3077681 - RNA, 16 nt, Mycobacterium bovis subsp bovis AF2122/97
ucgagguccaccaccc

SEQ ID NO: 3077682 - RNA, 23 nt, Mycobacterium bovis subsp bovis AF2122/97
ucgagguccaccacccugcacug

SEQ ID NO: 3077683 - RNA, 21 nt, Mycobacterium bovis subsp bovis AF2122/97
ucgagguccucgucggcgucg

SEQ ID NO: 3077684 - RNA, 17 nt, Mycobacterium bovis subsp bovis AF2122/97
ucgagguccuugaggau

SEQ ID NO: 3077685 - RNA, 14 nt, Mycobacterium bovis subsp bovis AF2122/97
ucgaggucggcgau

SEQ ID NO: 3077686 - RNA, 21 nt, Mycobacterium bovis subsp bovis AF2122/97
ucgaggugacuugcacgcugu

SEQ ID NO: 3077687 - RNA, 19 nt, Mycobacterium bovis subsp bovis AF2122/97
ucgagguggcgcacaucgc

SEQ ID NO: 3077688 - RNA, 17 nt, Mycobacterium bovis subsp bovis AF2122/97
ucgagguggcugcgccg

SEQ ID NO: 3077689 - RNA, 18 nt, Mycobacterium bovis subsp bovis AF2122/97
ucgagguguagcccuccg

SEQ ID NO: 3077690 - RNA, 19 nt, Mycobacterium bovis subsp bovis AF2122/97
ucgaguagucgcuggccag

SEQ ID NO: 3077691 - RNA, 20 nt, Mycobacterium bovis subsp bovis AF2122/97
ucgaguagugcaggugcccg

SEQ ID NO: 3077692 - RNA, 18 nt, Mycobacterium bovis subsp bovis AF2122/97
ucgaguaguucgucgacg

SEQ ID NO: 3077693 - RNA, 14 nt, Mycobacterium bovis subsp bovis AF2122/97
ucgaguccgacggg

SEQ ID NO: 3077694 - RNA, 22 nt, Mycobacterium bovis subsp bovis AF2122/97
ucgaguccugguaccccagcac

SEQ ID NO: 3077695 - RNA, 13 nt, Mycobacterium bovis subsp bovis AF2122/97
ucgagucgccgag

SEQ ID NO: 3077696 - RNA, 15 nt, Mycobacterium bovis subsp bovis AF2122/97
ucgagugccgccacc

SEQ ID NO: 3077697 - RNA, 17 nt, Mycobacterium bovis subsp bovis AF2122/97
ucgagugccgccaccgc

SEQ ID NO: 3077698 - RNA, 18 nt, Mycobacterium bovis subsp bovis AF2122/97
ucgagugccgccaccgcc

SEQ ID NO: 3077699 - RNA, 23 nt, Mycobacterium bovis subsp bovis AF2122/97
ucgagugcggacuucgccgcccg

SEQ ID NO: 3077700 - RNA, 16 nt, Mycobacterium bovis subsp bovis AF2122/97
ucgagugcggucgaga

SEQ ID NO: 3077701 - RNA, 15 nt, Mycobacterium bovis subsp bovis AF2122/97
ucgagugggugaggc

SEQ ID NO: 3077702 - RNA, 16 nt, Mycobacterium bovis subsp bovis AF2122/97
ucgaguuccgcaucgg

SEQ ID NO: 3077703 - RNA, 17 nt, Mycobacterium bovis subsp bovis AF2122/97
ucgaguuccgcaucggc

SEQ ID NO: 3077704 - RNA, 14 nt, Mycobacterium bovis subsp bovis AF2122/97
ucgaguuccggccg

SEQ ID NO: 3077705 - RNA, 15 nt, Mycobacterium bovis subsp bovis AF2122/97
ucgaguuccggccgg

SEQ ID NO: 3077706 - RNA, 18 nt, Mycobacterium bovis subsp bovis AF2122/97
ucgaguucgcagucgaug

SEQ ID NO: 3077707 - RNA, 16 nt, Mycobacterium bovis subsp bovis AF2122/97
ucgaguucggccgcgg

SEQ ID NO: 3077708 - RNA, 18 nt, Mycobacterium bovis subsp bovis AF2122/97
ucgaguucgggcugcggc

SEQ ID NO: 3077709 - RNA, 16 nt, Mycobacterium bovis subsp bovis AF2122/97
ucgaguugcucgacac

SEQ ID NO: 3077710 - RNA, 18 nt, Mycobacterium bovis subsp bovis AF2122/97
ucgaguugcucggccgau

SEQ ID NO: 3077711 - RNA, 15 nt, Mycobacterium bovis subsp bovis AF2122/97
ucgaguuuggccagu

SEQ ID NO: 3077712 - RNA, 17 nt, Mycobacterium bovis subsp bovis AF2122/97
ucgaguuuggcgacgag

SEQ ID NO: 3077713 - RNA, 15 nt, Mycobacterium bovis subsp bovis AF2122/97
ucgauaauggccgag

SEQ ID NO: 3077714 - RNA, 14 nt, Mycobacterium bovis subsp bovis AF2122/97
ucgauaccgcacca

SEQ ID NO: 3077715 - RNA, 14 nt, Mycobacterium bovis subsp bovis AF2122/97
ucgauaccggcgug

SEQ ID NO: 3077716 - RNA, 22 nt, Mycobacterium bovis subsp bovis AF2122/97
ucgauauaacccggcuccagca

SEQ ID NO: 3077717 - RNA, 22 nt, Mycobacterium bovis subsp bovis AF2122/97
ucgaucaacaccaacgacagcg

SEQ ID NO: 3077718 - RNA, 17 nt, Mycobacterium bovis subsp bovis AF2122/97
ucgaucacacguccgcg

SEQ ID NO: 3077719 - RNA, 12 nt, Mycobacterium bovis subsp bovis AF2122/97
ucgaucaccgac

SEQ ID NO: 3077720 - RNA, 18 nt, Mycobacterium bovis subsp bovis AF2122/97
ucgaucaccgacaccgug

SEQ ID NO: 3077721 - RNA, 21 nt, Mycobacterium bovis subsp bovis AF2122/97
ucgaucaccugcagcacgacg

SEQ ID NO: 3077722 - RNA, 19 nt, Mycobacterium bovis subsp bovis AF2122/97
ucgaucacggcggccccgg

SEQ ID NO: 3077723 - RNA, 14 nt, Mycobacterium bovis subsp bovis AF2122/97
ucgcaaucagcugg

SEQ ID NO: 3077724 - RNA, 15 nt, Mycobacterium bovis subsp bovis AF2122/97
ucgcaaucagcuggu

SEQ ID NO: 3077725 - RNA, 18 nt, Mycobacterium bovis subsp bovis AF2122/97
ucgcaaucguuggccaug

SEQ ID NO: 3077726 - RNA, 17 nt, Mycobacterium bovis subsp bovis AF2122/97
ucgcaaugggcucacac

SEQ ID NO: 3077727 - RNA, 20 nt, Mycobacterium bovis subsp bovis AF2122/97
ucgcaauggucguagggugg

SEQ ID NO: 3077728 - RNA, 15 nt, Mycobacterium bovis subsp bovis AF2122/97
ucgcacaauggcggc

SEQ ID NO: 3077729 - RNA, 21 nt, Mycobacterium bovis subsp bovis AF2122/97
ucgcacaauggcggcgccguc

SEQ ID NO: 3077730 - RNA, 16 nt, Mycobacterium bovis subsp bovis AF2122/97
ucgcacaccaacaccg

SEQ ID NO: 3077731 - RNA, 14 nt, Mycobacterium bovis subsp bovis AF2122/97
ucgcacagcaccac

SEQ ID NO: 3077732 - RNA, 13 nt, Mycobacterium bovis subsp bovis AF2122/97
ucgcacagcgcga

SEQ ID NO: 3077733 - RNA, 18 nt, Mycobacterium bovis subsp bovis AF2122/97
ucgcaccaccugggcggc

SEQ ID NO: 3077734 - RNA, 18 nt, Mycobacterium bovis subsp bovis AF2122/97
ucgcaccagaucagguga

SEQ ID NO: 3077735 - RNA, 14 nt, Mycobacterium bovis subsp bovis AF2122/97
ucgcaccagucguc

SEQ ID NO: 3077736 - RNA, 16 nt, Mycobacterium bovis subsp bovis AF2122/97
ucgcaccccggcggcg

SEQ ID NO: 3077737 - RNA, 13 nt, Mycobacterium bovis subsp bovis AF2122/97
ucgcacccgcucg

SEQ ID NO: 3077738 - RNA, 18 nt, Mycobacterium bovis subsp bovis AF2122/97
ucgcacccgcucggcgcg

SEQ ID NO: 3077739 - RNA, 21 nt, Mycobacterium bovis subsp bovis AF2122/97
ucgcacccguucgugagcggc

SEQ ID NO: 3077740 - RNA, 16 nt, Mycobacterium bovis subsp bovis AF2122/97
ucgcaccgugggcccu

SEQ ID NO: 3077741 - RNA, 17 nt, Mycobacterium bovis subsp bovis AF2122/97
ucgcacgacgcgacacg

SEQ ID NO: 3077742 - RNA, 20 nt, Mycobacterium bovis subsp bovis AF2122/97
ucgcacgacgcgacacgccg

SEQ ID NO: 3077743 - RNA, 21 nt, Mycobacterium bovis subsp bovis AF2122/97
ucgcacgagccaacaagucga

SEQ ID NO: 3077744 - RNA, 21 nt, Mycobacterium bovis subsp bovis AF2122/97
ucgcacggaaggcccggcgcg

SEQ ID NO: 3077745 - RNA, 15 nt, Mycobacterium bovis subsp bovis AF2122/97
ucgcacggaugaugc

SEQ ID NO: 3077746 - RNA, 17 nt, Mycobacterium bovis subsp bovis AF2122/97
ucgcacgggccaccagc

SEQ ID NO: 3077747 - RNA, 18 nt, Mycobacterium bovis subsp bovis AF2122/97
ucgcacgggccaccagcg

SEQ ID NO: 3077748 - RNA, 21 nt, Mycobacterium bovis subsp bovis AF2122/97
ucgcacggugccgccgucgau

SEQ ID NO: 3077749 - RNA, 19 nt, Mycobacterium bovis subsp bovis AF2122/97
ucgcacucauagaacucgc

SEQ ID NO: 3077750 - RNA, 22 nt, Mycobacterium bovis subsp bovis AF2122/97
ucgcacucauagaacucgccgc

SEQ ID NO: 3077751 - RNA, 19 nt, Mycobacterium bovis subsp bovis AF2122/97
ucgcacugcgccggccggc

SEQ ID NO: 3077752 - RNA, 21 nt, Mycobacterium bovis subsp bovis AF2122/97
ucgcagaaaccauucggcgag

SEQ ID NO: 3077753 - RNA, 23 nt, Mycobacterium bovis subsp bovis AF2122/97
ucgcagacacugcugcggcagcg

SEQ ID NO: 3077754 - RNA, 18 nt, Mycobacterium bovis subsp bovis AF2122/97
ucgcagaucaggacgcga

SEQ ID NO: 3077755 - RNA, 19 nt, Mycobacterium bovis subsp bovis AF2122/97
ucgcagaucaggacgcgau

SEQ ID NO: 3077756 - RNA, 19 nt, Mycobacterium bovis subsp bovis AF2122/97
ucgcagcagcaucuggggg

SEQ ID NO: 3077757 - RNA, 20 nt, Mycobacterium bovis subsp bovis AF2122/97
ucgcagcagcaucugggggu

SEQ ID NO: 3077758 - RNA, 11 nt, Mycobacterium bovis subsp bovis AF2122/97
ucgcagcaugu

SEQ ID NO: 3077759 - RNA, 20 nt, Mycobacterium bovis subsp bovis AF2122/97
ucgcagcauguccgcagcgg

SEQ ID NO: 3077760 - RNA, 20 nt, Mycobacterium bovis subsp bovis AF2122/97
ucgcagccacguuacgcucg

SEQ ID NO: 3077761 - RNA, 15 nt, Mycobacterium bovis subsp bovis AF2122/97
ucgcagccaggcacg

SEQ ID NO: 3077762 - RNA, 19 nt, Mycobacterium bovis subsp bovis AF2122/97
ucgcagccaggcacguccg

SEQ ID NO: 3077763 - RNA, 13 nt, Mycobacterium bovis subsp bovis AF2122/97
ucgcagcgacacg

SEQ ID NO: 3077764 - RNA, 21 nt, Mycobacterium bovis subsp bovis AF2122/97
ucgcagcgcacacuaccgccg

SEQ ID NO: 3077765 - RNA, 22 nt, Mycobacterium bovis subsp bovis AF2122/97
ucgcagcgccauuccaagacgu

SEQ ID NO: 3077766 - RNA, 15 nt, Mycobacterium bovis subsp bovis AF2122/97
ucgcaggaucggcgg

SEQ ID NO: 3077767 - RNA, 14 nt, Mycobacterium bovis subsp bovis AF2122/97
ucgcaggauuccca

SEQ ID NO: 3077768 - RNA, 20 nt, Mycobacterium bovis subsp bovis AF2122/97
ucgcaggauucccaguccag

SEQ ID NO: 3077769 - RNA, 20 nt, Mycobacterium bovis subsp bovis AF2122/97
ucgcaggcaccccgaucacc

SEQ ID NO: 3077770 - RNA, 18 nt, Mycobacterium bovis subsp bovis AF2122/97
ucgcaggccagggucagc

SEQ ID NO: 3077771 - RNA, 15 nt, Mycobacterium bovis subsp bovis AF2122/97
ucgcaggccggcggc

SEQ ID NO: 3077772 - RNA, 20 nt, Mycobacterium bovis subsp bovis AF2122/97
ucgcaggcucagcugguggc

SEQ ID NO: 3077773 - RNA, 18 nt, Mycobacterium bovis subsp bovis AF2122/97
ucgcaguacuugguugcg

SEQ ID NO: 3077774 - RNA, 20 nt, Mycobacterium bovis subsp bovis AF2122/97
ucgcaguccgguuacgcucg

SEQ ID NO: 3077775 - RNA, 21 nt, Mycobacterium bovis subsp bovis AF2122/97
ucgcaguccgguuacgcucgc

SEQ ID NO: 3077776 - RNA, 20 nt, Mycobacterium bovis subsp bovis AF2122/97
ucgcagugagcagccggacc

SEQ ID NO: 3077777 - RNA, 22 nt, Mycobacterium bovis subsp bovis AF2122/97
ucgcagugagcagccggaccgu

SEQ ID NO: 3077778 - RNA, 18 nt, Mycobacterium bovis subsp bovis AF2122/97
ucgcauagugcggcugca

SEQ ID NO: 3077779 - RNA, 18 nt, Mycobacterium bovis subsp bovis AF2122/97
ucgcauccacuuccgggc

SEQ ID NO: 3077780 - RNA, 15 nt, Mycobacterium bovis subsp bovis AF2122/97
ucgcauccgcgguug

SEQ ID NO: 3077781 - RNA, 15 nt, Mycobacterium bovis subsp bovis AF2122/97
ucgcaucucgcagag

SEQ ID NO: 3077782 - RNA, 14 nt, Mycobacterium bovis subsp bovis AF2122/97
ucgcauggcggcug

SEQ ID NO: 3077783 - RNA, 19 nt, Mycobacterium bovis subsp bovis AF2122/97
ucgcaugucggacacgugg

SEQ ID NO: 3077784 - RNA, 22 nt, Mycobacterium bovis subsp bovis AF2122/97
ucgcaugucggacacguggcgu

SEQ ID NO: 3077785 - RNA, 22 nt, Mycobacterium bovis subsp bovis AF2122/97
ucgcauguucuccacgccgauc

SEQ ID NO: 3077786 - RNA, 19 nt, Mycobacterium bovis subsp bovis AF2122/97
ucgcauucggcgagccgcg

SEQ ID NO: 3077787 - RNA, 23 nt, Mycobacterium bovis subsp bovis AF2122/97
ucgccaaacccaugucggcgcgc

SEQ ID NO: 3077788 - RNA, 19 nt, Mycobacterium bovis subsp bovis AF2122/97
ucgccaaauccgacgugga

SEQ ID NO: 3077789 - RNA, 15 nt, Mycobacterium bovis subsp bovis AF2122/97
ucgccaaauccggug

SEQ ID NO: 3077790 - RNA, 15 nt, Mycobacterium bovis subsp bovis AF2122/97
ucgccaacaccaacc

SEQ ID NO: 3077791 - RNA, 20 nt, Mycobacterium bovis subsp bovis AF2122/97
ucgccaacgacucacccacc

SEQ ID NO: 3077792 - RNA, 18 nt, Mycobacterium bovis subsp bovis AF2122/97
ucgccaacgccagcacca

SEQ ID NO: 3077793 - RNA, 19 nt, Mycobacterium bovis subsp bovis AF2122/97
ucgccaagcccaggcgauc

SEQ ID NO: 3077794 - RNA, 17 nt, Mycobacterium bovis subsp bovis AF2122/97
ucgccaaucugcgcgag

SEQ ID NO: 3077795 - RNA, 18 nt, Mycobacterium bovis subsp bovis AF2122/97
ucgccaaugcccaggugu

SEQ ID NO: 3077796 - RNA, 11 nt, Mycobacterium bovis subsp bovis AF2122/97
ucgccacaccc

SEQ ID NO: 3077797 - RNA, 22 nt, Mycobacterium bovis subsp bovis AF2122/97
ucgccacacccaaaccggcccg

SEQ ID NO: 3077798 - RNA, 14 nt, Mycobacterium bovis subsp bovis AF2122/97
ucgccacacccgcg

SEQ ID NO: 3077799 - RNA, 16 nt, Mycobacterium bovis subsp bovis AF2122/97
ucgccacaccggggcg

SEQ ID NO: 3077800 - RNA, 22 nt, Mycobacterium bovis subsp bovis AF2122/97
ucgccacauuucaccaccgugg

SEQ ID NO: 3077801 - RNA, 15 nt, Mycobacterium bovis subsp bovis AF2122/97
ucgccaccaucaccg

SEQ ID NO: 3077802 - RNA, 23 nt, Mycobacterium bovis subsp bovis AF2122/97
ucgccaccaucaccgccuuugcc

SEQ ID NO: 3077803 - RNA, 22 nt, Mycobacterium bovis subsp bovis AF2122/97
ucgccacccgacaugcgccgag

SEQ ID NO: 3077804 - RNA, 14 nt, Mycobacterium bovis subsp bovis AF2122/97
ucgccaccgcggcg

SEQ ID NO: 3077805 - RNA, 18 nt, Mycobacterium bovis subsp bovis AF2122/97
ucgccaccggcgccaccg

SEQ ID NO: 3077806 - RNA, 22 nt, Mycobacterium bovis subsp bovis AF2122/97
ucgccaccggcgccaccggcgc

SEQ ID NO: 3077807 - RNA, 18 nt, Mycobacterium bovis subsp bovis AF2122/97
ucgccaccgguaccggcg

SEQ ID NO: 3077808 - RNA, 17 nt, Mycobacterium bovis subsp bovis AF2122/97
ucgccacgacaggucgc

SEQ ID NO: 3077809 - RNA, 22 nt, Mycobacterium bovis subsp bovis AF2122/97
ucgccgaccagcuugaccgacc

SEQ ID NO: 3077810 - RNA, 15 nt, Mycobacterium bovis subsp bovis AF2122/97
ucgccgacccgccgc

SEQ ID NO: 3077811 - RNA, 17 nt, Mycobacterium bovis subsp bovis AF2122/97
ucgccgacccgccgcgg

SEQ ID NO: 3077812 - RNA, 19 nt, Mycobacterium bovis subsp bovis AF2122/97
ucgccgacccgccgcggac

SEQ ID NO: 3077813 - RNA, 18 nt, Mycobacterium bovis subsp bovis AF2122/97
ucgccgaccuuggcgucg

SEQ ID NO: 3077814 - RNA, 22 nt, Mycobacterium bovis subsp bovis AF2122/97
ucgccgacgauuuuggcugcag

SEQ ID NO: 3077815 - RNA, 12 nt, Mycobacterium bovis subsp bovis AF2122/97
ucgccgacgcga

SEQ ID NO: 3077816 - RNA, 13 nt, Mycobacterium bovis subsp bovis AF2122/97
ucgccgacggcga

SEQ ID NO: 3077817 - RNA, 18 nt, Mycobacterium bovis subsp bovis AF2122/97
ucgccgacggcgaccacc

SEQ ID NO: 3077818 - RNA, 13 nt, Mycobacterium bovis subsp bovis AF2122/97
ucgccgacgucca

SEQ ID NO: 3077819 - RNA, 17 nt, Mycobacterium bovis subsp bovis AF2122/97
ucgccgacgucgacgcc

SEQ ID NO: 3077820 - RNA, 15 nt, Mycobacterium bovis subsp bovis AF2122/97
ucgccgagaaccagc

SEQ ID NO: 3077821 - RNA, 17 nt, Mycobacterium bovis subsp bovis AF2122/97
ucgccgaggacgccggc

SEQ ID NO: 3077822 - RNA, 19 nt, Mycobacterium bovis subsp bovis AF2122/97
ucgccgaggcagcgucguc

SEQ ID NO: 3077823 - RNA, 19 nt, Mycobacterium bovis subsp bovis AF2122/97
ucgccgaggccuaccaggc

SEQ ID NO: 3077824 - RNA, 22 nt, Mycobacterium bovis subsp bovis AF2122/97
ucgccgaggucgaaccgccggc

SEQ ID NO: 3077825 - RNA, 18 nt, Mycobacterium bovis subsp bovis AF2122/97
ucgccgaguaccggccag

SEQ ID NO: 3077826 - RNA, 20 nt, Mycobacterium bovis subsp bovis AF2122/97
ucgccgaguaccggccagcc

SEQ ID NO: 3077827 - RNA, 21 nt, Mycobacterium bovis subsp bovis AF2122/97
ucgccgaguaccggccagccg

SEQ ID NO: 3077828 - RNA, 23 nt, Mycobacterium bovis subsp bovis AF2122/97
ucgccgaguaccggccagccgcg

SEQ ID NO: 3077829 - RNA, 21 nt, Mycobacterium bovis subsp bovis AF2122/97
ucgccgauaucugccacguug

SEQ ID NO: 3077830 - RNA, 20 nt, Mycobacterium bovis subsp bovis AF2122/97
ucgccgaucaacagcaccgu

SEQ ID NO: 3077831 - RNA, 21 nt, Mycobacterium bovis subsp bovis AF2122/97
ucgccgaucaccgcaucggug

SEQ ID NO: 3077832 - RNA, 20 nt, Mycobacterium bovis subsp bovis AF2122/97
ucgccgaucagcugcgcauc

SEQ ID NO: 3077833 - RNA, 21 nt, Mycobacterium bovis subsp bovis AF2122/97
ucgccgaucagcugcgcaucg

SEQ ID NO: 3077834 - RNA, 22 nt, Mycobacterium bovis subsp bovis AF2122/97
ucgccgaugauguuuuccccgc

SEQ ID NO: 3077835 - RNA, 23 nt, Mycobacterium bovis subsp bovis AF2122/97
ucgccgaugauguuuuccccgcc

SEQ ID NO: 3077836 - RNA, 21 nt, Mycobacterium bovis subsp bovis AF2122/97
ucgccgauguuggcagggcca

SEQ ID NO: 3077837 - RNA, 18 nt, Mycobacterium bovis subsp bovis AF2122/97
ucgccgcaacauggguga

SEQ ID NO: 3077838 - RNA, 21 nt, Mycobacterium bovis subsp bovis AF2122/97
ucgccgcaacaugggugaugc

SEQ ID NO: 3077839 - RNA, 16 nt, Mycobacterium bovis subsp bovis AF2122/97
ucgccgcacgccggca

SEQ ID NO: 3077840 - RNA, 15 nt, Mycobacterium bovis subsp bovis AF2122/97
ucgccgcagcgucgu

SEQ ID NO: 3077841 - RNA, 19 nt, Mycobacterium bovis subsp bovis AF2122/97
ucgccgccaccagggcacg

SEQ ID NO: 3077842 - RNA, 15 nt, Mycobacterium bovis subsp bovis AF2122/97
ucgccgccaccggcg

SEQ ID NO: 3077843 - RNA, 20 nt, Mycobacterium bovis subsp bovis AF2122/97
ucgccgccaccggcgacgcc

SEQ ID NO: 3077844 - RNA, 14 nt, Mycobacterium bovis subsp bovis AF2122/97
ucgccgccagcgcu

SEQ ID NO: 3077845 - RNA, 18 nt, Mycobacterium bovis subsp bovis AF2122/97
ucgccgccauugccgccg

SEQ ID NO: 3077846 - RNA, 20 nt, Mycobacterium bovis subsp bovis AF2122/97
ucgccgccauugccgccggu

SEQ ID NO: 3077847 - RNA, 24 nt, Mycobacterium bovis subsp bovis AF2122/97
ucgccgccauugccgccggugccg

SEQ ID NO: 3077848 - RNA, 16 nt, Mycobacterium bovis subsp bovis AF2122/97
ucgccgccauuggcuu

SEQ ID NO: 3077849 - RNA, 16 nt, Mycobacterium bovis subsp bovis AF2122/97
ucgccgcccgcagggc

SEQ ID NO: 3077850 - RNA, 15 nt, Mycobacterium bovis subsp bovis AF2122/97
ucgccgcccgugccg

SEQ ID NO: 3077851 - RNA, 15 nt, Mycobacterium bovis subsp bovis AF2122/97
ucgccgcccuggccg

SEQ ID NO: 3077852 - RNA, 20 nt, Mycobacterium bovis subsp bovis AF2122/97
ucgccgcccuggccgccggc

SEQ ID NO: 3077853 - RNA, 17 nt, Mycobacterium bovis subsp bovis AF2122/97
ucgccgccgccacggca

SEQ ID NO: 3077854 - RNA, 13 nt, Mycobacterium bovis subsp bovis AF2122/97
ucgccgccgcgcg

SEQ ID NO: 3077855 - RNA, 14 nt, Mycobacterium bovis subsp bovis AF2122/97
ucgccgccgcgcgu

SEQ ID NO: 3077856 - RNA, 19 nt, Mycobacterium bovis subsp bovis AF2122/97
ucgccgccgcgggcgccgg

SEQ ID NO: 3077857 - RNA, 21 nt, Mycobacterium bovis subsp bovis AF2122/97
ucgccgccgcgggcgccgguu

SEQ ID NO: 3077858 - RNA, 17 nt, Mycobacterium bovis subsp bovis AF2122/97
ucgccgccgcuaccgcc

SEQ ID NO: 3077859 - RNA, 18 nt, Mycobacterium bovis subsp bovis AF2122/97
ucgccgccgcuaccgccg

SEQ ID NO: 3077860 - RNA, 20 nt, Mycobacterium bovis subsp bovis AF2122/97
ucgccgccgcuaccgccggg

SEQ ID NO: 3077861 - RNA, 15 nt, Mycobacterium bovis subsp bovis AF2122/97
ucgccgccggcgccg

SEQ ID NO: 3077862 - RNA, 20 nt, Mycobacterium bovis subsp bovis AF2122/97
ucgccgccggcuccggcggu

SEQ ID NO: 3077863 - RNA, 12 nt, Mycobacterium bovis subsp bovis AF2122/97
ucgccgccgggc

SEQ ID NO: 3077864 - RNA, 15 nt, Mycobacterium bovis subsp bovis AF2122/97
ucgccgccggugccg

SEQ ID NO: 3077865 - RNA, 20 nt, Mycobacterium bovis subsp bovis AF2122/97
ucgccgccggugccgcccga

SEQ ID NO: 3077866 - RNA, 15 nt, Mycobacterium bovis subsp bovis AF2122/97
ucgccgccgucaccg

SEQ ID NO: 3077867 - RNA, 17 nt, Mycobacterium bovis subsp bovis AF2122/97
ucgccgccgucaccgcc

SEQ ID NO: 3077868 - RNA, 15 nt, Mycobacterium bovis subsp bovis AF2122/97
ucgccgccguugccg

SEQ ID NO: 3077869 - RNA, 17 nt, Mycobacterium bovis subsp bovis AF2122/97
ucgccgccguugccgcc

SEQ ID NO: 3077870 - RNA, 18 nt, Mycobacterium bovis subsp bovis AF2122/97
ucgccgccguugccgccg

SEQ ID NO: 3077871 - RNA, 21 nt, Mycobacterium bovis subsp bovis AF2122/97
ucgccgccguugccgccggcg

SEQ ID NO: 3077872 - RNA, 24 nt, Mycobacterium bovis subsp bovis AF2122/97
ucgccgccguugccgccggcgccg

SEQ ID NO: 3077873 - RNA, 23 nt, Mycobacterium bovis subsp bovis AF2122/97
ucgccgccguugccgccgguguu

SEQ ID NO: 3077874 - RNA, 20 nt, Mycobacterium bovis subsp bovis AF2122/97
ucgccgccguugccgccguc

SEQ ID NO: 3077875 - RNA, 23 nt, Mycobacterium bovis subsp bovis AF2122/97
ucgccgccguugccgccgucguu

SEQ ID NO: 3077876 - RNA, 23 nt, Mycobacterium bovis subsp bovis AF2122/97
ucgccgccguuggcucgagccgc

SEQ ID NO: 3077877 - RNA, 17 nt, Mycobacterium bovis subsp bovis AF2122/97
ucgccgccuuacgcacc

SEQ ID NO: 3077878 - RNA, 19 nt, Mycobacterium bovis subsp bovis AF2122/97
ucgccgccuuccuggcggg

SEQ ID NO: 3077879 - RNA, 23 nt, Mycobacterium bovis subsp bovis AF2122/97
ucgccgccuucuucucggcgagc

SEQ ID NO: 3077880 - RNA, 20 nt, Mycobacterium bovis subsp bovis AF2122/97
ucgccgcgaaugucgccgcc

SEQ ID NO: 3077881 - RNA, 15 nt, Mycobacterium bovis subsp bovis AF2122/97
ucgccgcgacugcac

SEQ ID NO: 3077882 - RNA, 14 nt, Mycobacterium bovis subsp bovis AF2122/97
ucgccgcgauggcg

SEQ ID NO: 3077883 - RNA, 14 nt, Mycobacterium bovis subsp bovis AF2122/97
ucgccgcgcagcgu

SEQ ID NO: 3077884 - RNA, 19 nt, Mycobacterium bovis subsp bovis AF2122/97
ucgccgcgcagcgugcgau

SEQ ID NO: 3077885 - RNA, 14 nt, Mycobacterium bovis subsp bovis AF2122/97
ucgccgcgccguag

SEQ ID NO: 3077886 - RNA, 17 nt, Mycobacterium bovis subsp bovis AF2122/97
ucgccgcgcgucaaguc

SEQ ID NO: 3077887 - RNA, 19 nt, Mycobacterium bovis subsp bovis AF2122/97
ucgccgcgcuugcgaucgc

SEQ ID NO: 3077888 - RNA, 21 nt, Mycobacterium bovis subsp bovis AF2122/97
ucgccgcgcuugcgaucgccg

SEQ ID NO: 3077889 - RNA, 14 nt, Mycobacterium bovis subsp bovis AF2122/97
ucgccgcggcagcg

SEQ ID NO: 3077890 - RNA, 20 nt, Mycobacterium bovis subsp bovis AF2122/97
ucgccgcggcagcguugacg

SEQ ID NO: 3077891 - RNA, 13 nt, Mycobacterium bovis subsp bovis AF2122/97
ucgccgcggcggc

SEQ ID NO: 3077892 - RNA, 20 nt, Mycobacterium bovis subsp bovis AF2122/97
ucgccgcggcggcagcggcg

SEQ ID NO: 3077893 - RNA, 21 nt, Mycobacterium bovis subsp bovis AF2122/97
ucgccgcggcggcagcggcga

SEQ ID NO: 3077894 - RNA, 15 nt, Mycobacterium bovis subsp bovis AF2122/97
ucgccgcgggcagcg

SEQ ID NO: 3077895 - RNA, 19 nt, Mycobacterium bovis subsp bovis AF2122/97
ucgccgucggugccgccgc

SEQ ID NO: 3077896 - RNA, 20 nt, Mycobacterium bovis subsp bovis AF2122/97
ucgccgucggugccgccgcc

SEQ ID NO: 3077897 - RNA, 13 nt, Mycobacterium bovis subsp bovis AF2122/97
ucgccgucgucga

SEQ ID NO: 3077898 - RNA, 14 nt, Mycobacterium bovis subsp bovis AF2122/97
ucgccgucgucgau

SEQ ID NO: 3077899 - RNA, 17 nt, Mycobacterium bovis subsp bovis AF2122/97
ucgccgucgucgaucga

SEQ ID NO: 3077900 - RNA, 16 nt, Mycobacterium bovis subsp bovis AF2122/97
ucgccgucgugccacc

SEQ ID NO: 3077901 - RNA, 17 nt, Mycobacterium bovis subsp bovis AF2122/97
ucgccgucgugccaccg

SEQ ID NO: 3077902 - RNA, 15 nt, Mycobacterium bovis subsp bovis AF2122/97
ucgccgugcgccgug

SEQ ID NO: 3077903 - RNA, 15 nt, Mycobacterium bovis subsp bovis AF2122/97
ucgccguugccggcg

SEQ ID NO: 3077904 - RNA, 16 nt, Mycobacterium bovis subsp bovis AF2122/97
ucgccucaccggcgcg

SEQ ID NO: 3077905 - RNA, 22 nt, Mycobacterium bovis subsp bovis AF2122/97
ucgccuccagcagguccgcggc

SEQ ID NO: 3077906 - RNA, 24 nt, Mycobacterium bovis subsp bovis AF2122/97
ucgccuccagcagguccgcggccg

SEQ ID NO: 3077907 - RNA, 18 nt, Mycobacterium bovis subsp bovis AF2122/97
ucgccuccagccggcgaa

SEQ ID NO: 3077908 - RNA, 13 nt, Mycobacterium bovis subsp bovis AF2122/97
ucgccuccaggcg

SEQ ID NO: 3077909 - RNA, 15 nt, Mycobacterium bovis subsp bovis AF2122/97
ucgccuccaggcgcc

SEQ ID NO: 3077910 - RNA, 19 nt, Mycobacterium bovis subsp bovis AF2122/97
ucgccuccaggcgccaccc

SEQ ID NO: 3077911 - RNA, 15 nt, Mycobacterium bovis subsp bovis AF2122/97
ucgccuccgggguga

SEQ ID NO: 3077912 - RNA, 17 nt, Mycobacterium bovis subsp bovis AF2122/97
ucgccucgaggaccacc

SEQ ID NO: 3077913 - RNA, 14 nt, Mycobacterium bovis subsp bovis AF2122/97
ucgccucgaugcca

SEQ ID NO: 3077914 - RNA, 24 nt, Mycobacterium bovis subsp bovis AF2122/97
ucgccucgauggcguagggcuguc

SEQ ID NO: 3077915 - RNA, 21 nt, Mycobacterium bovis subsp bovis AF2122/97
ucgccucggacacggcagccu

SEQ ID NO: 3077916 - RNA, 23 nt, Mycobacterium bovis subsp bovis AF2122/97
ucgccucggcguaggcgauggcg

SEQ ID NO: 3077917 - RNA, 15 nt, Mycobacterium bovis subsp bovis AF2122/97
ucgccugcacgcccg

SEQ ID NO: 3077918 - RNA, 17 nt, Mycobacterium bovis subsp bovis AF2122/97
ucgccugcacgcccggc

SEQ ID NO: 3077919 - RNA, 20 nt, Mycobacterium bovis subsp bovis AF2122/97
ucgccugcccgaaccaccac

SEQ ID NO: 3077920 - RNA, 16 nt, Mycobacterium bovis subsp bovis AF2122/97
ucgccugccgacgagg

SEQ ID NO: 3077921 - RNA, 23 nt, Mycobacterium bovis subsp bovis AF2122/97
ucgccugcgggaacgcggcggcg

SEQ ID NO: 3077922 - RNA, 14 nt, Mycobacterium bovis subsp bovis AF2122/97
ucgccuggaugccg

SEQ ID NO: 3077923 - RNA, 12 nt, Mycobacterium bovis subsp bovis AF2122/97
ucgccugggcuu

SEQ ID NO: 3077924 - RNA, 14 nt, Mycobacterium bovis subsp bovis AF2122/97
ucgccuucccagcc

SEQ ID NO: 3077925 - RNA, 18 nt, Mycobacterium bovis subsp bovis AF2122/97
ucgccuucccagccgacg

SEQ ID NO: 3077926 - RNA, 19 nt, Mycobacterium bovis subsp bovis AF2122/97
ucgccuucguaaccacgac

SEQ ID NO: 3077927 - RNA, 15 nt, Mycobacterium bovis subsp bovis AF2122/97
ucgcgaaaccggacc

SEQ ID NO: 3077928 - RNA, 18 nt, Mycobacterium bovis subsp bovis AF2122/97
ucgcgaaauagcugcgga

SEQ ID NO: 3077929 - RNA, 19 nt, Mycobacterium bovis subsp bovis AF2122/97
ucgcgaacaucgccagcgc

SEQ ID NO: 3077930 - RNA, 21 nt, Mycobacterium bovis subsp bovis AF2122/97
ucgcgaacaucgccagcgccg

SEQ ID NO: 3077931 - RNA, 13 nt, Mycobacterium bovis subsp bovis AF2122/97
ucgcgaacucggg

SEQ ID NO: 3077932 - RNA, 20 nt, Mycobacterium bovis subsp bovis AF2122/97
ucgcgaagaacgacgccacc

SEQ ID NO: 3077933 - RNA, 23 nt, Mycobacterium bovis subsp bovis AF2122/97
ucgcgaagccgguucgcccagca

SEQ ID NO: 3077934 - RNA, 15 nt, Mycobacterium bovis subsp bovis AF2122/97
ucgcgaagcugugcc

SEQ ID NO: 3077935 - RNA, 17 nt, Mycobacterium bovis subsp bovis AF2122/97
ucgcgaauccuggcggg

SEQ ID NO: 3077936 - RNA, 14 nt, Mycobacterium bovis subsp bovis AF2122/97
ucgcgacaacucgc

SEQ ID NO: 3077937 - RNA, 17 nt, Mycobacterium bovis subsp bovis AF2122/97
ucgcgacaucgguggcg

SEQ ID NO: 3077938 - RNA, 15 nt, Mycobacterium bovis subsp bovis AF2122/97
ucgcgacccgaucgc

SEQ ID NO: 3077939 - RNA, 14 nt, Mycobacterium bovis subsp bovis AF2122/97
ucgcgaccgaccgc

SEQ ID NO: 3077940 - RNA, 15 nt, Mycobacterium bovis subsp bovis AF2122/97
ucgcgaccgaccgca

SEQ ID NO: 3077941 - RNA, 22 nt, Mycobacterium bovis subsp bovis AF2122/97
ucgcgaccuugcccgcuagcgc

SEQ ID NO: 3077942 - RNA, 18 nt, Mycobacterium bovis subsp bovis AF2122/97
ucgcgacgaugccccggu

SEQ ID NO: 3077943 - RNA, 15 nt, Mycobacterium bovis subsp bovis AF2122/97
ucgcgacgcgacggu

SEQ ID NO: 3077944 - RNA, 15 nt, Mycobacterium bovis subsp bovis AF2122/97
ucgcgacgcgcgaga

SEQ ID NO: 3077945 - RNA, 23 nt, Mycobacterium bovis subsp bovis AF2122/97
ucgcgacgcgcgagaacacccgu

SEQ ID NO: 3077946 - RNA, 18 nt, Mycobacterium bovis subsp bovis AF2122/97
ucgcgacggcccgauccc

SEQ ID NO: 3077947 - RNA, 12 nt, Mycobacterium bovis subsp bovis AF2122/97
ucgcgacgucgg

SEQ ID NO: 3077948 - RNA, 17 nt, Mycobacterium bovis subsp bovis AF2122/97
ucgcgagaaggugcugc

SEQ ID NO: 3077949 - RNA, 19 nt, Mycobacterium bovis subsp bovis AF2122/97
ucgcgagcagacgcggaau

SEQ ID NO: 3077950 - RNA, 13 nt, Mycobacterium bovis subsp bovis AF2122/97
ucgcgagcgccgc

SEQ ID NO: 3077951 - RNA, 21 nt, Mycobacterium bovis subsp bovis AF2122/97
ucgcgaggcuguccgaaccga

SEQ ID NO: 3077952 - RNA, 17 nt, Mycobacterium bovis subsp bovis AF2122/97
ucgcgaggugaagccga

SEQ ID NO: 3077953 - RNA, 15 nt, Mycobacterium bovis subsp bovis AF2122/97
ucgcgauagccgccg

SEQ ID NO: 3077954 - RNA, 18 nt, Mycobacterium bovis subsp bovis AF2122/97
ucgcgauccacuccggcg

SEQ ID NO: 3077955 - RNA, 23 nt, Mycobacterium bovis subsp bovis AF2122/97
ucgcgaugcucaaugugccgccg

SEQ ID NO: 3077956 - RNA, 22 nt, Mycobacterium bovis subsp bovis AF2122/97
ucgcgaugcuucccggaugccg

SEQ ID NO: 3077957 - RNA, 16 nt, Mycobacterium bovis subsp bovis AF2122/97
ucgcgauguccucgag

SEQ ID NO: 3077958 - RNA, 17 nt, Mycobacterium bovis subsp bovis AF2122/97
ucgcgauuccggcggcc

SEQ ID NO: 3077959 - RNA, 20 nt, Mycobacterium bovis subsp bovis AF2122/97
ucgcgauuccggcggccacg

SEQ ID NO: 3077960 - RNA, 23 nt, Mycobacterium bovis subsp bovis AF2122/97
ucgcgcaaaugccugcuggucgg

SEQ ID NO: 3077961 - RNA, 16 nt, Mycobacterium bovis subsp bovis AF2122/97
ucgcgcaaggcgccgc

SEQ ID NO: 3077962 - RNA, 22 nt, Mycobacterium bovis subsp bovis AF2122/97
ucgcgcaaggcgccgcagggcc

SEQ ID NO: 3077963 - RNA, 15 nt, Mycobacterium bovis subsp bovis AF2122/97
ucgcgcacccagccc

SEQ ID NO: 3077964 - RNA, 22 nt, Mycobacterium bovis subsp bovis AF2122/97
ucgcgcaccggaucgccgucgc

SEQ ID NO: 3077965 - RNA, 22 nt, Mycobacterium bovis subsp bovis AF2122/97
ucgcgcacgcccugaagggccg

SEQ ID NO: 3077966 - RNA, 12 nt, Mycobacterium bovis subsp bovis AF2122/97
ucgcgcacgucg

SEQ ID NO: 3077967 - RNA, 13 nt, Mycobacterium bovis subsp bovis AF2122/97
ucgcgcacgucgg

SEQ ID NO: 3077968 - RNA, 14 nt, Mycobacterium bovis subsp bovis AF2122/97
ucgcgcagccgccg

SEQ ID NO: 3077969 - RNA, 16 nt, Mycobacterium bovis subsp bovis AF2122/97
ucgcgcagccgccgcg

SEQ ID NO: 3077970 - RNA, 13 nt, Mycobacterium bovis subsp bovis AF2122/97
ucgcgcagcgccg

SEQ ID NO: 3077971 - RNA, 17 nt, Mycobacterium bovis subsp bovis AF2122/97
ucgcgcagcgcgaucgc

SEQ ID NO: 3077972 - RNA, 15 nt, Mycobacterium bovis subsp bovis AF2122/97
ucgcgcagcgucauc

SEQ ID NO: 3077973 - RNA, 18 nt, Mycobacterium bovis subsp bovis AF2122/97
ucgcgcagguagcgccgc

SEQ ID NO: 3077974 - RNA, 14 nt, Mycobacterium bovis subsp bovis AF2122/97
ucgcgcaucaacgg

SEQ ID NO: 3077975 - RNA, 18 nt, Mycobacterium bovis subsp bovis AF2122/97
ucgcgcaucgccuccucg

SEQ ID NO: 3077976 - RNA, 20 nt, Mycobacterium bovis subsp bovis AF2122/97
ucgcgcaucgccuccucgac

SEQ ID NO: 3077977 - RNA, 23 nt, Mycobacterium bovis subsp bovis AF2122/97
ucgcgcauugccgacgcgcggcc

SEQ ID NO: 3077978 - RNA, 22 nt, Mycobacterium bovis subsp bovis AF2122/97
ucgcgcauuucguugagaacau

SEQ ID NO: 3077979 - RNA, 16 nt, Mycobacterium bovis subsp bovis AF2122/97
ucgcgccaggccacgu

SEQ ID NO: 3077980 - RNA, 14 nt, Mycobacterium bovis subsp bovis AF2122/97
ucgcgccaggcgcg

SEQ ID NO: 3077981 - RNA, 21 nt, Mycobacterium bovis subsp bovis AF2122/97
ucgcgccaggcuugcggcacc

SEQ ID NO: 3077982 - RNA, 16 nt, Mycobacterium bovis subsp bovis AF2122/97
ucgcggcggcgugcuc

SEQ ID NO: 3077983 - RNA, 18 nt, Mycobacterium bovis subsp bovis AF2122/97
ucgcggcuauggcgccgc

SEQ ID NO: 3077984 - RNA, 20 nt, Mycobacterium bovis subsp bovis AF2122/97
ucgcggcuauggcgccgcgg

SEQ ID NO: 3077985 - RNA, 16 nt, Mycobacterium bovis subsp bovis AF2122/97
ucgcgggacaacagca

SEQ ID NO: 3077986 - RNA, 20 nt, Mycobacterium bovis subsp bovis AF2122/97
ucgcgggagaacgugccgag

SEQ ID NO: 3077987 - RNA, 23 nt, Mycobacterium bovis subsp bovis AF2122/97
ucgcgggcagggccucggucgcc

SEQ ID NO: 3077988 - RNA, 15 nt, Mycobacterium bovis subsp bovis AF2122/97
ucgcgggccaagccg

SEQ ID NO: 3077989 - RNA, 14 nt, Mycobacterium bovis subsp bovis AF2122/97
ucgcgggcccgcgc

SEQ ID NO: 3077990 - RNA, 23 nt, Mycobacterium bovis subsp bovis AF2122/97
ucgcgggcccgcgcggcgguguc

SEQ ID NO: 3077991 - RNA, 11 nt, Mycobacterium bovis subsp bovis AF2122/97
ucgcgggccga

SEQ ID NO: 3077992 - RNA, 16 nt, Mycobacterium bovis subsp bovis AF2122/97
ucgcgggccgaggccg

SEQ ID NO: 3077993 - RNA, 19 nt, Mycobacterium bovis subsp bovis AF2122/97
ucgcgggccgaggccgucg

SEQ ID NO: 3077994 - RNA, 16 nt, Mycobacterium bovis subsp bovis AF2122/97
ucgcgggccgcgucga

SEQ ID NO: 3077995 - RNA, 21 nt, Mycobacterium bovis subsp bovis AF2122/97
ucgcgggcgaccaccgcggca

SEQ ID NO: 3077996 - RNA, 16 nt, Mycobacterium bovis subsp bovis AF2122/97
ucgcgggcgaucggca

SEQ ID NO: 3077997 - RNA, 19 nt, Mycobacterium bovis subsp bovis AF2122/97
ucgcgggcgucccgcauac

SEQ ID NO: 3077998 - RNA, 21 nt, Mycobacterium bovis subsp bovis AF2122/97
ucgcgggucuuggcgaucucc

SEQ ID NO: 3077999 - RNA, 18 nt, Mycobacterium bovis subsp bovis AF2122/97
ucgcgggugaucuccacc

SEQ ID NO: 3078000 - RNA, 20 nt, Mycobacterium bovis subsp bovis AF2122/97
ucgcgggugaucuccaccgg

SEQ ID NO: 3078001 - RNA, 19 nt, Mycobacterium bovis subsp bovis AF2122/97
ucgcgggugcgcugcagcg

SEQ ID NO: 3078002 - RNA, 18 nt, Mycobacterium bovis subsp bovis AF2122/97
ucgcgguaccaucaccgc

SEQ ID NO: 3078003 - RNA, 22 nt, Mycobacterium bovis subsp bovis AF2122/97
ucgcgguaccaucaccgcgcca

SEQ ID NO: 3078004 - RNA, 13 nt, Mycobacterium bovis subsp bovis AF2122/97
ucgcgguagcagc

SEQ ID NO: 3078005 - RNA, 15 nt, Mycobacterium bovis subsp bovis AF2122/97
ucgcgguagcagccg

SEQ ID NO: 3078006 - RNA, 16 nt, Mycobacterium bovis subsp bovis AF2122/97
ucgcgguagucguugc

SEQ ID NO: 3078007 - RNA, 20 nt, Mycobacterium bovis subsp bovis AF2122/97
ucgcgguaguuaacccaggg

SEQ ID NO: 3078008 - RNA, 19 nt, Mycobacterium bovis subsp bovis AF2122/97
ucgcggucagguugcgcca

SEQ ID NO: 3078009 - RNA, 18 nt, Mycobacterium bovis subsp bovis AF2122/97
ucgcggucccacggccgg

SEQ ID NO: 3078010 - RNA, 21 nt, Mycobacterium bovis subsp bovis AF2122/97
ucgcggucccacggccggccg

SEQ ID NO: 3078011 - RNA, 20 nt, Mycobacterium bovis subsp bovis AF2122/97
ucgcgguccgagcggcaucg

SEQ ID NO: 3078012 - RNA, 16 nt, Mycobacterium bovis subsp bovis AF2122/97
ucgcggucgacagcgc

SEQ ID NO: 3078013 - RNA, 13 nt, Mycobacterium bovis subsp bovis AF2122/97
ucgcggucgaggu

SEQ ID NO: 3078014 - RNA, 12 nt, Mycobacterium bovis subsp bovis AF2122/97
ucgcggucgauc

SEQ ID NO: 3078015 - RNA, 15 nt, Mycobacterium bovis subsp bovis AF2122/97
ucgcggucgccaccg

SEQ ID NO: 3078016 - RNA, 17 nt, Mycobacterium bovis subsp bovis AF2122/97
ucgcggucgcccgcuac

SEQ ID NO: 3078017 - RNA, 23 nt, Mycobacterium bovis subsp bovis AF2122/97
ucgcggucuuugagccgguagcu

SEQ ID NO: 3078018 - RNA, 12 nt, Mycobacterium bovis subsp bovis AF2122/97
ucgcggugaccu

SEQ ID NO: 3078019 - RNA, 20 nt, Mycobacterium bovis subsp bovis AF2122/97
ucgcgguggcggugucggcg

SEQ ID NO: 3078020 - RNA, 23 nt, Mycobacterium bovis subsp bovis AF2122/97
ucgcgguggcggugucggcgccg

SEQ ID NO: 3078021 - RNA, 18 nt, Mycobacterium bovis subsp bovis AF2122/97
ucgcggugggccccgauc

SEQ ID NO: 3078022 - RNA, 19 nt, Mycobacterium bovis subsp bovis AF2122/97
ucgcggugggccccgaucc

SEQ ID NO: 3078023 - RNA, 21 nt, Mycobacterium bovis subsp bovis AF2122/97
ucgcggugggccccgaucccg

SEQ ID NO: 3078024 - RNA, 22 nt, Mycobacterium bovis subsp bovis AF2122/97
ucgcggugugcggcagcccgcu

SEQ ID NO: 3078025 - RNA, 17 nt, Mycobacterium bovis subsp bovis AF2122/97
ucgcgguuguccuccga

SEQ ID NO: 3078026 - RNA, 19 nt, Mycobacterium bovis subsp bovis AF2122/97
ucgcgguuuuggucgcgau

SEQ ID NO: 3078027 - RNA, 22 nt, Mycobacterium bovis subsp bovis AF2122/97
ucgcguaacuugccgcauauca

SEQ ID NO: 3078028 - RNA, 16 nt, Mycobacterium bovis subsp bovis AF2122/97
ucgcguaauuuggcuu

SEQ ID NO: 3078029 - RNA, 16 nt, Mycobacterium bovis subsp bovis AF2122/97
ucgcguagggccagcg

SEQ ID NO: 3078030 - RNA, 15 nt, Mycobacterium bovis subsp bovis AF2122/97
ucgcgucacccgggg

SEQ ID NO: 3078031 - RNA, 22 nt, Mycobacterium bovis subsp bovis AF2122/97
ucgcgucacccggggcucucgg

SEQ ID NO: 3078032 - RNA, 15 nt, Mycobacterium bovis subsp bovis AF2122/97
ucgcgucaucaacgu

SEQ ID NO: 3078033 - RNA, 18 nt, Mycobacterium bovis subsp bovis AF2122/97
ucgcgucgacccgaacug

SEQ ID NO: 3078034 - RNA, 16 nt, Mycobacterium bovis subsp bovis AF2122/97
ucgcgucgagagaacg

SEQ ID NO: 3078035 - RNA, 17 nt, Mycobacterium bovis subsp bovis AF2122/97
ucgcgucgagagaacgu

SEQ ID NO: 3078036 - RNA, 13 nt, Mycobacterium bovis subsp bovis AF2122/97
ucgcgucgagcgc

SEQ ID NO: 3078037 - RNA, 13 nt, Mycobacterium bovis subsp bovis AF2122/97
ucgcgucgccgau

SEQ ID NO: 3078038 - RNA, 15 nt, Mycobacterium bovis subsp bovis AF2122/97
ucgcgucgccgauga

SEQ ID NO: 3078039 - RNA, 18 nt, Mycobacterium bovis subsp bovis AF2122/97
ucgcgucggaccguuucg

SEQ ID NO: 3078040 - RNA, 17 nt, Mycobacterium bovis subsp bovis AF2122/97
ucgcgucugggugcagg

SEQ ID NO: 3078041 - RNA, 14 nt, Mycobacterium bovis subsp bovis AF2122/97
ucgcgugcaucgcc

SEQ ID NO: 3078042 - RNA, 17 nt, Mycobacterium bovis subsp bovis AF2122/97
ucgcguucuccggcacc

SEQ ID NO: 3078043 - RNA, 21 nt, Mycobacterium bovis subsp bovis AF2122/97
ucgcguugacucugcguccac

SEQ ID NO: 3078044 - RNA, 15 nt, Mycobacterium bovis subsp bovis AF2122/97
ucgcguugagcgcag

SEQ ID NO: 3078045 - RNA, 17 nt, Mycobacterium bovis subsp bovis AF2122/97
ucgcguugcagaccacc

SEQ ID NO: 3078046 - RNA, 19 nt, Mycobacterium bovis subsp bovis AF2122/97
ucgcguugcagaccaccag

SEQ ID NO: 3078047 - RNA, 14 nt, Mycobacterium bovis subsp bovis AF2122/97
ucgcguuguaggcu

SEQ ID NO: 3078048 - RNA, 16 nt, Mycobacterium bovis subsp bovis AF2122/97
ucgcguuucgcagccg

SEQ ID NO: 3078049 - RNA, 21 nt, Mycobacterium bovis subsp bovis AF2122/97
ucgcguuucgcagccgcaccg

SEQ ID NO: 3078050 - RNA, 15 nt, Mycobacterium bovis subsp bovis AF2122/97
ucgcuaauugcggcc

SEQ ID NO: 3078051 - RNA, 17 nt, Mycobacterium bovis subsp bovis AF2122/97
ucgcuacccgccacggu

SEQ ID NO: 3078052 - RNA, 15 nt, Mycobacterium bovis subsp bovis AF2122/97
ucgcuaccuucuugg

SEQ ID NO: 3078053 - RNA, 20 nt, Mycobacterium bovis subsp bovis AF2122/97
ucgcuacgucgaccgacggg

SEQ ID NO: 3078054 - RNA, 13 nt, Mycobacterium bovis subsp bovis AF2122/97
ucgcuauccggcg

SEQ ID NO: 3078055 - RNA, 13 nt, Mycobacterium bovis subsp bovis AF2122/97
ucgcuaugcgccg

SEQ ID NO: 3078056 - RNA, 18 nt, Mycobacterium bovis subsp bovis AF2122/97
ucgcucaccaccgaccuc

SEQ ID NO: 3078057 - RNA, 14 nt, Mycobacterium bovis subsp bovis AF2122/97
ucgcucaccggcgc

SEQ ID NO: 3078058 - RNA, 15 nt, Mycobacterium bovis subsp bovis AF2122/97
ucgcucaccggcgcg

SEQ ID NO: 3078059 - RNA, 14 nt, Mycobacterium bovis subsp bovis AF2122/97
ucgcucaccggcug

SEQ ID NO: 3078060 - RNA, 15 nt, Mycobacterium bovis subsp bovis AF2122/97
ucgcucaccggcugg

SEQ ID NO: 3078061 - RNA, 18 nt, Mycobacterium bovis subsp bovis AF2122/97
ucgcucagggugucgaca

SEQ ID NO: 3078062 - RNA, 16 nt, Mycobacterium bovis subsp bovis AF2122/97
ucgcucaucgucaccu

SEQ ID NO: 3078063 - RNA, 13 nt, Mycobacterium bovis subsp bovis AF2122/97
ucgcucccccgcu

SEQ ID NO: 3078064 - RNA, 12 nt, Mycobacterium bovis subsp bovis AF2122/97
ucgcuccgaccg

SEQ ID NO: 3078065 - RNA, 13 nt, Mycobacterium bovis subsp bovis AF2122/97
ucgcuccgaccgg

SEQ ID NO: 3078066 - RNA, 16 nt, Mycobacterium bovis subsp bovis AF2122/97
ucgcuccgaccggugg

SEQ ID NO: 3078067 - RNA, 18 nt, Mycobacterium bovis subsp bovis AF2122/97
ucgcuccgcggcgcagca

SEQ ID NO: 3078068 - RNA, 19 nt, Mycobacterium bovis subsp bovis AF2122/97
ucgcuccggcccugccgcc

SEQ ID NO: 3078069 - RNA, 13 nt, Mycobacterium bovis subsp bovis AF2122/97
ucggcauccgcgg

SEQ ID NO: 3078070 - RNA, 22 nt, Mycobacterium bovis subsp bovis AF2122/97
ucggcaucgacugccagcgccg

SEQ ID NO: 3078071 - RNA, 14 nt, Mycobacterium bovis subsp bovis AF2122/97
ucggcaucgccgag

SEQ ID NO: 3078072 - RNA, 15 nt, Mycobacterium bovis subsp bovis AF2122/97
ucggcaucgccgcgg

SEQ ID NO: 3078073 - RNA, 14 nt, Mycobacterium bovis subsp bovis AF2122/97
ucggcaucggcgac

SEQ ID NO: 3078074 - RNA, 15 nt, Mycobacterium bovis subsp bovis AF2122/97
ucggcaucggcgacg

SEQ ID NO: 3078075 - RNA, 21 nt, Mycobacterium bovis subsp bovis AF2122/97
ucggcaucggcgacgaacuga

SEQ ID NO: 3078076 - RNA, 15 nt, Mycobacterium bovis subsp bovis AF2122/97
ucggcaucggcggcg

SEQ ID NO: 3078077 - RNA, 23 nt, Mycobacterium bovis subsp bovis AF2122/97
ucggcauguuccuugcggccgcu

SEQ ID NO: 3078078 - RNA, 22 nt, Mycobacterium bovis subsp bovis AF2122/97
ucggcauucgcaccaccugggc

SEQ ID NO: 3078079 - RNA, 19 nt, Mycobacterium bovis subsp bovis AF2122/97
ucggcauugcgcaggaugu

SEQ ID NO: 3078080 - RNA, 20 nt, Mycobacterium bovis subsp bovis AF2122/97
ucggccaacagguccaccgg

SEQ ID NO: 3078081 - RNA, 12 nt, Mycobacterium bovis subsp bovis AF2122/97
ucggccaacccg

SEQ ID NO: 3078082 - RNA, 23 nt, Mycobacterium bovis subsp bovis AF2122/97
ucggccaagcuguuuggggucgc

SEQ ID NO: 3078083 - RNA, 14 nt, Mycobacterium bovis subsp bovis AF2122/97
ucggccaccaaccu

SEQ ID NO: 3078084 - RNA, 15 nt, Mycobacterium bovis subsp bovis AF2122/97
ucggccaccaaccuc

SEQ ID NO: 3078085 - RNA, 20 nt, Mycobacterium bovis subsp bovis AF2122/97
ucggccaccaaccucaucgc

SEQ ID NO: 3078086 - RNA, 22 nt, Mycobacterium bovis subsp bovis AF2122/97
ucggccaccagaaccagcgacc

SEQ ID NO: 3078087 - RNA, 22 nt, Mycobacterium bovis subsp bovis AF2122/97
ucggccaccagcgcccggcccg

SEQ ID NO: 3078088 - RNA, 12 nt, Mycobacterium bovis subsp bovis AF2122/97
ucggccaccauc

SEQ ID NO: 3078089 - RNA, 14 nt, Mycobacterium bovis subsp bovis AF2122/97
ucggccaccaucgc

SEQ ID NO: 3078090 - RNA, 13 nt, Mycobacterium bovis subsp bovis AF2122/97
ucggccaccgccu

SEQ ID NO: 3078091 - RNA, 19 nt, Mycobacterium bovis subsp bovis AF2122/97
ucggccaccgccugagcgg

SEQ ID NO: 3078092 - RNA, 18 nt, Mycobacterium bovis subsp bovis AF2122/97
ucggccaccggcgucugc

SEQ ID NO: 3078093 - RNA, 19 nt, Mycobacterium bovis subsp bovis AF2122/97
ucggccaccggcgucugcc

SEQ ID NO: 3078094 - RNA, 12 nt, Mycobacterium bovis subsp bovis AF2122/97
ucggccagcaac

SEQ ID NO: 3078095 - RNA, 13 nt, Mycobacterium bovis subsp bovis AF2122/97
ucggccagcaacu

SEQ ID NO: 3078096 - RNA, 15 nt, Mycobacterium bovis subsp bovis AF2122/97
ucggccagcacgccg

SEQ ID NO: 3078097 - RNA, 20 nt, Mycobacterium bovis subsp bovis AF2122/97
ucggccagcacgccgccggc

SEQ ID NO: 3078098 - RNA, 23 nt, Mycobacterium bovis subsp bovis AF2122/97
ucggccagcagcgacuccagcgc

SEQ ID NO: 3078099 - RNA, 18 nt, Mycobacterium bovis subsp bovis AF2122/97
ucggccagcaucagcucg

SEQ ID NO: 3078100 - RNA, 18 nt, Mycobacterium bovis subsp bovis AF2122/97
ucggccagccagcgggcg

SEQ ID NO: 3078101 - RNA, 17 nt, Mycobacterium bovis subsp bovis AF2122/97
ucggccagcgcccgcag

SEQ ID NO: 3078102 - RNA, 15 nt, Mycobacterium bovis subsp bovis AF2122/97
ucggccagcgucagc

SEQ ID NO: 3078103 - RNA, 18 nt, Mycobacterium bovis subsp bovis AF2122/97
ucggccagcguguccgcc

SEQ ID NO: 3078104 - RNA, 19 nt, Mycobacterium bovis subsp bovis AF2122/97
ucggccagcuccgccugcc

SEQ ID NO: 3078105 - RNA, 19 nt, Mycobacterium bovis subsp bovis AF2122/97
ucggccagcucgcgggccg

SEQ ID NO: 3078106 - RNA, 17 nt, Mycobacterium bovis subsp bovis AF2122/97
ucggccaggaucaaccg

SEQ ID NO: 3078107 - RNA, 21 nt, Mycobacterium bovis subsp bovis AF2122/97
ucggccaggaugaagacgcgg

SEQ ID NO: 3078108 - RNA, 21 nt, Mycobacterium bovis subsp bovis AF2122/97
ucggccagguaauugccgacc

SEQ ID NO: 3078109 - RNA, 17 nt, Mycobacterium bovis subsp bovis AF2122/97
ucggccauagcgccgcg

SEQ ID NO: 3078110 - RNA, 14 nt, Mycobacterium bovis subsp bovis AF2122/97
ucggccauccaccg

SEQ ID NO: 3078111 - RNA, 16 nt, Mycobacterium bovis subsp bovis AF2122/97
ucggccaucguccagc

SEQ ID NO: 3078112 - RNA, 20 nt, Mycobacterium bovis subsp bovis AF2122/97
ucggccaucguccagcagga

SEQ ID NO: 3078113 - RNA, 15 nt, Mycobacterium bovis subsp bovis AF2122/97
ucggccaucugcucg

SEQ ID NO: 3078114 - RNA, 12 nt, Mycobacterium bovis subsp bovis AF2122/97
ucggccauggcg

SEQ ID NO: 3078115 - RNA, 17 nt, Mycobacterium bovis subsp bovis AF2122/97
ucggccauggcggcgcc

SEQ ID NO: 3078116 - RNA, 21 nt, Mycobacterium bovis subsp bovis AF2122/97
ucggccauugcccgggcggga

SEQ ID NO: 3078117 - RNA, 17 nt, Mycobacterium bovis subsp bovis AF2122/97
ucggcccacgguguccc

SEQ ID NO: 3078118 - RNA, 18 nt, Mycobacterium bovis subsp bovis AF2122/97
ucggcccacggugucccg

SEQ ID NO: 3078119 - RNA, 21 nt, Mycobacterium bovis subsp bovis AF2122/97
ucggcccauaacagcuggcgg

SEQ ID NO: 3078120 - RNA, 21 nt, Mycobacterium bovis subsp bovis AF2122/97
ucggcccccaagcucugcguc

SEQ ID NO: 3078121 - RNA, 22 nt, Mycobacterium bovis subsp bovis AF2122/97
ucggccccgccgccggugcgga

SEQ ID NO: 3078122 - RNA, 14 nt, Mycobacterium bovis subsp bovis AF2122/97
ucggccccggccgc

SEQ ID NO: 3078123 - RNA, 18 nt, Mycobacterium bovis subsp bovis AF2122/97
ucggccccggccgcguca

SEQ ID NO: 3078124 - RNA, 19 nt, Mycobacterium bovis subsp bovis AF2122/97
ucggcccgaucaccaucca

SEQ ID NO: 3078125 - RNA, 14 nt, Mycobacterium bovis subsp bovis AF2122/97
ucggcccgcucacc

SEQ ID NO: 3078126 - RNA, 13 nt, Mycobacterium bovis subsp bovis AF2122/97
ucggcccgcugac

SEQ ID NO: 3078127 - RNA, 14 nt, Mycobacterium bovis subsp bovis AF2122/97
ucggcccgcugacc

SEQ ID NO: 3078128 - RNA, 16 nt, Mycobacterium bovis subsp bovis AF2122/97
ucggcccgugccacag

SEQ ID NO: 3078129 - RNA, 14 nt, Mycobacterium bovis subsp bovis AF2122/97
ucggcccuccaccg

SEQ ID NO: 3078130 - RNA, 15 nt, Mycobacterium bovis subsp bovis AF2122/97
ucggccgacaccgcc

SEQ ID NO: 3078131 - RNA, 20 nt, Mycobacterium bovis subsp bovis AF2122/97
ucggccgacaccgccaccac

SEQ ID NO: 3078132 - RNA, 12 nt, Mycobacterium bovis subsp bovis AF2122/97
ucggccgaccgg

SEQ ID NO: 3078133 - RNA, 18 nt, Mycobacterium bovis subsp bovis AF2122/97
ucggccgaccgggcucug

SEQ ID NO: 3078134 - RNA, 17 nt, Mycobacterium bovis subsp bovis AF2122/97
ucggccgagucgauugc

SEQ ID NO: 3078135 - RNA, 13 nt, Mycobacterium bovis subsp bovis AF2122/97
ucggccgaugcgc

SEQ ID NO: 3078136 - RNA, 15 nt, Mycobacterium bovis subsp bovis AF2122/97
ucggccgaugcgcag

SEQ ID NO: 3078137 - RNA, 18 nt, Mycobacterium bovis subsp bovis AF2122/97
ucggccgaugcgcagugc

SEQ ID NO: 3078138 - RNA, 14 nt, Mycobacterium bovis subsp bovis AF2122/97
ucggccgcaaggcg

SEQ ID NO: 3078139 - RNA, 12 nt, Mycobacterium bovis subsp bovis AF2122/97
ucggccgcacug

SEQ ID NO: 3078140 - RNA, 20 nt, Mycobacterium bovis subsp bovis AF2122/97
ucggccgcacugggugcguc

SEQ ID NO: 3078141 - RNA, 16 nt, Mycobacterium bovis subsp bovis AF2122/97
ucggccgcagccagcg

SEQ ID NO: 3078142 - RNA, 22 nt, Mycobacterium bovis subsp bovis AF2122/97
ucggccgccgaauuggcggaac

SEQ ID NO: 3078143 - RNA, 15 nt, Mycobacterium bovis subsp bovis AF2122/97
ucggccgccggauca

SEQ ID NO: 3078144 - RNA, 20 nt, Mycobacterium bovis subsp bovis AF2122/97
ucggccgccggguccggaac

SEQ ID NO: 3078145 - RNA, 11 nt, Mycobacterium bovis subsp bovis AF2122/97
ucggccgcgag

SEQ ID NO: 3078146 - RNA, 16 nt, Mycobacterium bovis subsp bovis AF2122/97
ucggccggagccgccg

SEQ ID NO: 3078147 - RNA, 20 nt, Mycobacterium bovis subsp bovis AF2122/97
ucggccggagccgccggccc

SEQ ID NO: 3078148 - RNA, 21 nt, Mycobacterium bovis subsp bovis AF2122/97
ucggccggaugagcgaacgcc

SEQ ID NO: 3078149 - RNA, 12 nt, Mycobacterium bovis subsp bovis AF2122/97
ucggccggcaac

SEQ ID NO: 3078150 - RNA, 16 nt, Mycobacterium bovis subsp bovis AF2122/97
ucggccggcaccccac

SEQ ID NO: 3078151 - RNA, 21 nt, Mycobacterium bovis subsp bovis AF2122/97
ucggccgggccguguccgccg

SEQ ID NO: 3078152 - RNA, 15 nt, Mycobacterium bovis subsp bovis AF2122/97
ucggccgggcucuau

SEQ ID NO: 3078153 - RNA, 16 nt, Mycobacterium bovis subsp bovis AF2122/97
ucggccggggccaccc

SEQ ID NO: 3078154 - RNA, 20 nt, Mycobacterium bovis subsp bovis AF2122/97
ucggccggguuaucggcagc

SEQ ID NO: 3078155 - RNA, 18 nt, Mycobacterium bovis subsp bovis AF2122/97
ucggccguaucgucgagc

SEQ ID NO: 3078156 - RNA, 16 nt, Mycobacterium bovis subsp bovis AF2122/97
ucggcgccgcgccguc

SEQ ID NO: 3078157 - RNA, 14 nt, Mycobacterium bovis subsp bovis AF2122/97
ucggcgccggcggc

SEQ ID NO: 3078158 - RNA, 20 nt, Mycobacterium bovis subsp bovis AF2122/97
ucggcgccggcggccgcggu

SEQ ID NO: 3078159 - RNA, 23 nt, Mycobacterium bovis subsp bovis AF2122/97
ucggcgccggcggccgcggugcc

SEQ ID NO: 3078160 - RNA, 20 nt, Mycobacterium bovis subsp bovis AF2122/97
ucggcgccgucucgaucgcg

SEQ ID NO: 3078161 - RNA, 22 nt, Mycobacterium bovis subsp bovis AF2122/97
ucggcgccgucucgaucgcggu

SEQ ID NO: 3078162 - RNA, 19 nt, Mycobacterium bovis subsp bovis AF2122/97
ucggcgccuaaagacucga

SEQ ID NO: 3078163 - RNA, 23 nt, Mycobacterium bovis subsp bovis AF2122/97
ucggcgccuggcggcgccgcaga

SEQ ID NO: 3078164 - RNA, 12 nt, Mycobacterium bovis subsp bovis AF2122/97
ucggcgcgcacc

SEQ ID NO: 3078165 - RNA, 21 nt, Mycobacterium bovis subsp bovis AF2122/97
ucggcgcgcaccucggcgaag

SEQ ID NO: 3078166 - RNA, 14 nt, Mycobacterium bovis subsp bovis AF2122/97
ucggcgcgcagcga

SEQ ID NO: 3078167 - RNA, 17 nt, Mycobacterium bovis subsp bovis AF2122/97
ucggcgcgccggucgcc

SEQ ID NO: 3078168 - RNA, 19 nt, Mycobacterium bovis subsp bovis AF2122/97
ucggcgcgccggucgccga

SEQ ID NO: 3078169 - RNA, 16 nt, Mycobacterium bovis subsp bovis AF2122/97
ucggcgcgguggggcg

SEQ ID NO: 3078170 - RNA, 14 nt, Mycobacterium bovis subsp bovis AF2122/97
ucggcgcgucgauc

SEQ ID NO: 3078171 - RNA, 21 nt, Mycobacterium bovis subsp bovis AF2122/97
ucggcgcugaucgcgcgcacc

SEQ ID NO: 3078172 - RNA, 22 nt, Mycobacterium bovis subsp bovis AF2122/97
ucggcgcugaucgcgcgcaccg

SEQ ID NO: 3078173 - RNA, 15 nt, Mycobacterium bovis subsp bovis AF2122/97
ucggcgcugcgcacc

SEQ ID NO: 3078174 - RNA, 19 nt, Mycobacterium bovis subsp bovis AF2122/97
ucggcgcugcgcaccgccg

SEQ ID NO: 3078175 - RNA, 21 nt, Mycobacterium bovis subsp bovis AF2122/97
ucggcggaagaccggaucgcc

SEQ ID NO: 3078176 - RNA, 16 nt, Mycobacterium bovis subsp bovis AF2122/97
ucggcggacaggcccg

SEQ ID NO: 3078177 - RNA, 22 nt, Mycobacterium bovis subsp bovis AF2122/97
ucggcggacaggcccgguggcg

SEQ ID NO: 3078178 - RNA, 16 nt, Mycobacterium bovis subsp bovis AF2122/97
ucggcggacccgguga

SEQ ID NO: 3078179 - RNA, 17 nt, Mycobacterium bovis subsp bovis AF2122/97
ucggcggaccgcagcgu

SEQ ID NO: 3078180 - RNA, 21 nt, Mycobacterium bovis subsp bovis AF2122/97
ucggcggagagcacugggcug

SEQ ID NO: 3078181 - RNA, 13 nt, Mycobacterium bovis subsp bovis AF2122/97
ucggcggagucga

SEQ ID NO: 3078182 - RNA, 17 nt, Mycobacterium bovis subsp bovis AF2122/97
ucggcggcaaccgccgc

SEQ ID NO: 3078183 - RNA, 14 nt, Mycobacterium bovis subsp bovis AF2122/97
ucggcggcaacggc

SEQ ID NO: 3078184 - RNA, 15 nt, Mycobacterium bovis subsp bovis AF2122/97
ucggcggcagcggcg

SEQ ID NO: 3078185 - RNA, 23 nt, Mycobacterium bovis subsp bovis AF2122/97
ucggcggcauaaacaucgguggc

SEQ ID NO: 3078186 - RNA, 19 nt, Mycobacterium bovis subsp bovis AF2122/97
ucggcggcauguucaucgc

SEQ ID NO: 3078187 - RNA, 16 nt, Mycobacterium bovis subsp bovis AF2122/97
ucggcggccaacagca

SEQ ID NO: 3078188 - RNA, 20 nt, Mycobacterium bovis subsp bovis AF2122/97
ucggcggccagcucggccag

SEQ ID NO: 3078189 - RNA, 15 nt, Mycobacterium bovis subsp bovis AF2122/97
ucggcggccgagcgc

SEQ ID NO: 3078190 - RNA, 18 nt, Mycobacterium bovis subsp bovis AF2122/97
ucggcggccgagcgcacc

SEQ ID NO: 3078191 - RNA, 20 nt, Mycobacterium bovis subsp bovis AF2122/97
ucggcggccgagcgcaccgc

SEQ ID NO: 3078192 - RNA, 21 nt, Mycobacterium bovis subsp bovis AF2122/97
ucggcggccgagcgcaccgcu

SEQ ID NO: 3078193 - RNA, 14 nt, Mycobacterium bovis subsp bovis AF2122/97
ucggcggccgccag

SEQ ID NO: 3078194 - RNA, 13 nt, Mycobacterium bovis subsp bovis AF2122/97
ucggcggccgccg

SEQ ID NO: 3078195 - RNA, 14 nt, Mycobacterium bovis subsp bovis AF2122/97
ucggcggccgcgac

SEQ ID NO: 3078196 - RNA, 22 nt, Mycobacterium bovis subsp bovis AF2122/97
ucggcggccgcgaccagcgccg

SEQ ID NO: 3078197 - RNA, 19 nt, Mycobacterium bovis subsp bovis AF2122/97
ucggcggccgcgugcucgc

SEQ ID NO: 3078198 - RNA, 22 nt, Mycobacterium bovis subsp bovis AF2122/97
ucggcggccgcgugcucgccgu

SEQ ID NO: 3078199 - RNA, 16 nt, Mycobacterium bovis subsp bovis AF2122/97
ucggcggccggcgccg

SEQ ID NO: 3078200 - RNA, 15 nt, Mycobacterium bovis subsp bovis AF2122/97
ucggcggcgaccgcc

SEQ ID NO: 3078201 - RNA, 19 nt, Mycobacterium bovis subsp bovis AF2122/97
ucggcggcgaccgccagcg

SEQ ID NO: 3078202 - RNA, 17 nt, Mycobacterium bovis subsp bovis AF2122/97
ucggcggcgacguggcg

SEQ ID NO: 3078203 - RNA, 14 nt, Mycobacterium bovis subsp bovis AF2122/97
ucggcggcgaugac

SEQ ID NO: 3078204 - RNA, 15 nt, Mycobacterium bovis subsp bovis AF2122/97
ucggcggcgccgaag

SEQ ID NO: 3078205 - RNA, 14 nt, Mycobacterium bovis subsp bovis AF2122/97
ucggcggcgcgccg

SEQ ID NO: 3078206 - RNA, 21 nt, Mycobacterium bovis subsp bovis AF2122/97
ucggcggcgcgugcgguggcg

SEQ ID NO: 3078207 - RNA, 12 nt, Mycobacterium bovis subsp bovis AF2122/97
ucggcggcggcu

SEQ ID NO: 3078208 - RNA, 13 nt, Mycobacterium bovis subsp bovis AF2122/97
ucggcggcgucga

SEQ ID NO: 3078209 - RNA, 17 nt, Mycobacterium bovis subsp bovis AF2122/97
ucggcggcgucgacguc

SEQ ID NO: 3078210 - RNA, 19 nt, Mycobacterium bovis subsp bovis AF2122/97
ucggcggcucuagaucgcc

SEQ ID NO: 3078211 - RNA, 16 nt, Mycobacterium bovis subsp bovis AF2122/97
ucggcggcugccagcg

SEQ ID NO: 3078212 - RNA, 21 nt, Mycobacterium bovis subsp bovis AF2122/97
ucggcggcuucgauugcgcug

SEQ ID NO: 3078213 - RNA, 22 nt, Mycobacterium bovis subsp bovis AF2122/97
ucggcggcuucgauugcgcugc

SEQ ID NO: 3078214 - RNA, 17 nt, Mycobacterium bovis subsp bovis AF2122/97
ucggcggcuucguggcg

SEQ ID NO: 3078215 - RNA, 22 nt, Mycobacterium bovis subsp bovis AF2122/97
ucggcggcuucguggcggcgcg

SEQ ID NO: 3078216 - RNA, 15 nt, Mycobacterium bovis subsp bovis AF2122/97
ucggcggcuuggccg

SEQ ID NO: 3078217 - RNA, 19 nt, Mycobacterium bovis subsp bovis AF2122/97
ucggcggcuuggccgcccc

SEQ ID NO: 3078218 - RNA, 22 nt, Mycobacterium bovis subsp bovis AF2122/97
ucggcggcuuggccgccccggc

SEQ ID NO: 3078219 - RNA, 14 nt, Mycobacterium bovis subsp bovis AF2122/97
ucggcgggcaccuc

SEQ ID NO: 3078220 - RNA, 19 nt, Mycobacterium bovis subsp bovis AF2122/97
ucggcgggcgugugcaguc

SEQ ID NO: 3078221 - RNA, 17 nt, Mycobacterium bovis subsp bovis AF2122/97
ucggcggggaccgcggu

SEQ ID NO: 3078222 - RNA, 20 nt, Mycobacterium bovis subsp bovis AF2122/97
ucggcgggggaccccgccag

SEQ ID NO: 3078223 - RNA, 20 nt, Mycobacterium bovis subsp bovis AF2122/97
ucggcggguagaaccagccc

SEQ ID NO: 3078224 - RNA, 21 nt, Mycobacterium bovis subsp bovis AF2122/97
ucggcggguagaaccagcccg

SEQ ID NO: 3078225 - RNA, 17 nt, Mycobacterium bovis subsp bovis AF2122/97
ucggcgggucaggccag

SEQ ID NO: 3078226 - RNA, 23 nt, Mycobacterium bovis subsp bovis AF2122/97
ucggcgguaaaugccugcccacc

SEQ ID NO: 3078227 - RNA, 19 nt, Mycobacterium bovis subsp bovis AF2122/97
ucggcgguagccgaccagc

SEQ ID NO: 3078228 - RNA, 16 nt, Mycobacterium bovis subsp bovis AF2122/97
ucggcggucgccgcgc

SEQ ID NO: 3078229 - RNA, 23 nt, Mycobacterium bovis subsp bovis AF2122/97
ucggcggugaaaucgcacagcgc

SEQ ID NO: 3078230 - RNA, 18 nt, Mycobacterium bovis subsp bovis AF2122/97
ucggcggugacggugccg

SEQ ID NO: 3078231 - RNA, 16 nt, Mycobacterium bovis subsp bovis AF2122/97
ucggcggugcagaucg

SEQ ID NO: 3078232 - RNA, 15 nt, Mycobacterium bovis subsp bovis AF2122/97
ucggcggugccacca

SEQ ID NO: 3078233 - RNA, 20 nt, Mycobacterium bovis subsp bovis AF2122/97
ucggcggugcccagcagcgc

SEQ ID NO: 3078234 - RNA, 21 nt, Mycobacterium bovis subsp bovis AF2122/97
ucggcggugccgcggcuaggc

SEQ ID NO: 3078235 - RNA, 22 nt, Mycobacterium bovis subsp bovis AF2122/97
ucggcgguguccuacuuuucca

SEQ ID NO: 3078236 - RNA, 16 nt, Mycobacterium bovis subsp bovis AF2122/97
ucggcgguucgauccc

SEQ ID NO: 3078237 - RNA, 21 nt, Mycobacterium bovis subsp bovis AF2122/97
ucggcguacaaaccgucgggg

SEQ ID NO: 3078238 - RNA, 22 nt, Mycobacterium bovis subsp bovis AF2122/97
ucggcguacccguuaugcgccg

SEQ ID NO: 3078239 - RNA, 19 nt, Mycobacterium bovis subsp bovis AF2122/97
ucggcguacucgugcaccg

SEQ ID NO: 3078240 - RNA, 19 nt, Mycobacterium bovis subsp bovis AF2122/97
ucggcgucaccguguugca

SEQ ID NO: 3078241 - RNA, 17 nt, Mycobacterium bovis subsp bovis AF2122/97
ucggcgucauccaccgc

SEQ ID NO: 3078242 - RNA, 23 nt, Mycobacterium bovis subsp bovis AF2122/97
ucgggccgaucucuccggcggcg

SEQ ID NO: 3078243 - RNA, 17 nt, Mycobacterium bovis subsp bovis AF2122/97
ucgggccgccgagcucg

SEQ ID NO: 3078244 - RNA, 17 nt, Mycobacterium bovis subsp bovis AF2122/97
ucgggccggagccggug

SEQ ID NO: 3078245 - RNA, 23 nt, Mycobacterium bovis subsp bovis AF2122/97
ucgggccggagccggugccgacg

SEQ ID NO: 3078246 - RNA, 13 nt, Mycobacterium bovis subsp bovis AF2122/97
ucgggccggccgc

SEQ ID NO: 3078247 - RNA, 19 nt, Mycobacterium bovis subsp bovis AF2122/97
ucgggccguccucccacag

SEQ ID NO: 3078248 - RNA, 19 nt, Mycobacterium bovis subsp bovis AF2122/97
ucgggccgucgggugugcg

SEQ ID NO: 3078249 - RNA, 21 nt, Mycobacterium bovis subsp bovis AF2122/97
ucgggcgaagcuagcgcccgc

SEQ ID NO: 3078250 - RNA, 20 nt, Mycobacterium bovis subsp bovis AF2122/97
ucgggcgagcucgucgagcg

SEQ ID NO: 3078251 - RNA, 20 nt, Mycobacterium bovis subsp bovis AF2122/97
ucgggcgcaacgggacguca

SEQ ID NO: 3078252 - RNA, 17 nt, Mycobacterium bovis subsp bovis AF2122/97
ucgggcgcccaugcuga

SEQ ID NO: 3078253 - RNA, 21 nt, Mycobacterium bovis subsp bovis AF2122/97
ucgggcgcgaggacgcugauc

SEQ ID NO: 3078254 - RNA, 19 nt, Mycobacterium bovis subsp bovis AF2122/97
ucgggcgcggggcggccug

SEQ ID NO: 3078255 - RNA, 17 nt, Mycobacterium bovis subsp bovis AF2122/97
ucgggcgcgguaaccac

SEQ ID NO: 3078256 - RNA, 18 nt, Mycobacterium bovis subsp bovis AF2122/97
ucgggcgcugaugcgcug

SEQ ID NO: 3078257 - RNA, 11 nt, Mycobacterium bovis subsp bovis AF2122/97
ucgggcggcgu

SEQ ID NO: 3078258 - RNA, 14 nt, Mycobacterium bovis subsp bovis AF2122/97
ucgggcgucagcag

SEQ ID NO: 3078259 - RNA, 21 nt, Mycobacterium bovis subsp bovis AF2122/97
ucgggcgucaugaugucgaca

SEQ ID NO: 3078260 - RNA, 18 nt, Mycobacterium bovis subsp bovis AF2122/97
ucgggcgugaucccgccc

SEQ ID NO: 3078261 - RNA, 19 nt, Mycobacterium bovis subsp bovis AF2122/97
ucgggcgugcucgccgggu

SEQ ID NO: 3078262 - RNA, 17 nt, Mycobacterium bovis subsp bovis AF2122/97
ucgggcgugucgggaac

SEQ ID NO: 3078263 - RNA, 16 nt, Mycobacterium bovis subsp bovis AF2122/97
ucgggcucguccagca

SEQ ID NO: 3078264 - RNA, 18 nt, Mycobacterium bovis subsp bovis AF2122/97
ucgggcucguccagcaac

SEQ ID NO: 3078265 - RNA, 20 nt, Mycobacterium bovis subsp bovis AF2122/97
ucgggcucguccagcaaccu

SEQ ID NO: 3078266 - RNA, 18 nt, Mycobacterium bovis subsp bovis AF2122/97
ucgggcugccgcaugcgc

SEQ ID NO: 3078267 - RNA, 21 nt, Mycobacterium bovis subsp bovis AF2122/97
ucgggcugccgcaugcgcucc

SEQ ID NO: 3078268 - RNA, 15 nt, Mycobacterium bovis subsp bovis AF2122/97
ucgggcuucggccag

SEQ ID NO: 3078269 - RNA, 19 nt, Mycobacterium bovis subsp bovis AF2122/97
ucgggcuugacccuugggc

SEQ ID NO: 3078270 - RNA, 22 nt, Mycobacterium bovis subsp bovis AF2122/97
ucgggcuugcgcagcagcgugc

SEQ ID NO: 3078271 - RNA, 22 nt, Mycobacterium bovis subsp bovis AF2122/97
ucggggaagccugcgggccggc

SEQ ID NO: 3078272 - RNA, 18 nt, Mycobacterium bovis subsp bovis AF2122/97
ucggggaccacgccgacg

SEQ ID NO: 3078273 - RNA, 17 nt, Mycobacterium bovis subsp bovis AF2122/97
ucggggacggcgaaucg

SEQ ID NO: 3078274 - RNA, 15 nt, Mycobacterium bovis subsp bovis AF2122/97
ucggggagcugcggc

SEQ ID NO: 3078275 - RNA, 16 nt, Mycobacterium bovis subsp bovis AF2122/97
ucggggagcugcggcg

SEQ ID NO: 3078276 - RNA, 18 nt, Mycobacterium bovis subsp bovis AF2122/97
ucggggaugcugaccuuc

SEQ ID NO: 3078277 - RNA, 20 nt, Mycobacterium bovis subsp bovis AF2122/97
ucggggcaccacgccagccc

SEQ ID NO: 3078278 - RNA, 18 nt, Mycobacterium bovis subsp bovis AF2122/97
ucggggcccccgccggac

SEQ ID NO: 3078279 - RNA, 17 nt, Mycobacterium bovis subsp bovis AF2122/97
ucggggccccgcggcgc

SEQ ID NO: 3078280 - RNA, 12 nt, Mycobacterium bovis subsp bovis AF2122/97
ucggggccgucg

SEQ ID NO: 3078281 - RNA, 15 nt, Mycobacterium bovis subsp bovis AF2122/97
ucggggccugcgucc

SEQ ID NO: 3078282 - RNA, 13 nt, Mycobacterium bovis subsp bovis AF2122/97
ucggggcgaugag

SEQ ID NO: 3078283 - RNA, 20 nt, Mycobacterium bovis subsp bovis AF2122/97
ucggggcgcgguaccggugu

SEQ ID NO: 3078284 - RNA, 16 nt, Mycobacterium bovis subsp bovis AF2122/97
ucggggcgucguucgc

SEQ ID NO: 3078285 - RNA, 20 nt, Mycobacterium bovis subsp bovis AF2122/97
ucggggcuacaacugccgag

SEQ ID NO: 3078286 - RNA, 19 nt, Mycobacterium bovis subsp bovis AF2122/97
ucgggggauuucgcgucug

SEQ ID NO: 3078287 - RNA, 20 nt, Mycobacterium bovis subsp bovis AF2122/97
ucgggggauuucgcgucugc

SEQ ID NO: 3078288 - RNA, 15 nt, Mycobacterium bovis subsp bovis AF2122/97
ucgggggccgagccg

SEQ ID NO: 3078289 - RNA, 16 nt, Mycobacterium bovis subsp bovis AF2122/97
ucgggggccgcgucuc

SEQ ID NO: 3078290 - RNA, 14 nt, Mycobacterium bovis subsp bovis AF2122/97
ucgggggcgccggc

SEQ ID NO: 3078291 - RNA, 15 nt, Mycobacterium bovis subsp bovis AF2122/97
ucgggggcgccggcg

SEQ ID NO: 3078292 - RNA, 13 nt, Mycobacterium bovis subsp bovis AF2122/97
ucgggggcgcgcg

SEQ ID NO: 3078293 - RNA, 18 nt, Mycobacterium bovis subsp bovis AF2122/97
ucgggggcugcacgcucg

SEQ ID NO: 3078294 - RNA, 19 nt, Mycobacterium bovis subsp bovis AF2122/97
ucgggggcuuaugcgucug

SEQ ID NO: 3078295 - RNA, 20 nt, Mycobacterium bovis subsp bovis AF2122/97
ucgggggcuuaugcgucugc

SEQ ID NO: 3078296 - RNA, 19 nt, Mycobacterium bovis subsp bovis AF2122/97
ucgggggcuuuugcgucug

SEQ ID NO: 3078297 - RNA, 20 nt, Mycobacterium bovis subsp bovis AF2122/97
ucgggggcuuuugcgucugc

SEQ ID NO: 3078298 - RNA, 17 nt, Mycobacterium bovis subsp bovis AF2122/97
ucggggggaucucgguc

SEQ ID NO: 3078299 - RNA, 20 nt, Mycobacterium bovis subsp bovis AF2122/97
ucggggggcaggucgagcgc

SEQ ID NO: 3078300 - RNA, 21 nt, Mycobacterium bovis subsp bovis AF2122/97
ucggggggcaggucgagcgcc

SEQ ID NO: 3078301 - RNA, 22 nt, Mycobacterium bovis subsp bovis AF2122/97
ucggggucgaacaugauccgcc

SEQ ID NO: 3078302 - RNA, 19 nt, Mycobacterium bovis subsp bovis AF2122/97
ucggggucgcaggccaggg

SEQ ID NO: 3078303 - RNA, 19 nt, Mycobacterium bovis subsp bovis AF2122/97
ucggggucguugaggccgg

SEQ ID NO: 3078304 - RNA, 15 nt, Mycobacterium bovis subsp bovis AF2122/97
ucggggugcacaccg

SEQ ID NO: 3078305 - RNA, 20 nt, Mycobacterium bovis subsp bovis AF2122/97
ucgggguggucgcaccgccg

SEQ ID NO: 3078306 - RNA, 14 nt, Mycobacterium bovis subsp bovis AF2122/97
ucgggguuacguug

SEQ ID NO: 3078307 - RNA, 22 nt, Mycobacterium bovis subsp bovis AF2122/97
ucgggguugacuggccgcccgg

SEQ ID NO: 3078308 - RNA, 13 nt, Mycobacterium bovis subsp bovis AF2122/97
ucgggguugcgga

SEQ ID NO: 3078309 - RNA, 23 nt, Mycobacterium bovis subsp bovis AF2122/97
ucgggguuuaguuuaucggccgu

SEQ ID NO: 3078310 - RNA, 13 nt, Mycobacterium bovis subsp bovis AF2122/97
ucggguaccagca

SEQ ID NO: 3078311 - RNA, 13 nt, Mycobacterium bovis subsp bovis AF2122/97
ucggguagaucgc

SEQ ID NO: 3078312 - RNA, 14 nt, Mycobacterium bovis subsp bovis AF2122/97
ucggguagccccgu

SEQ ID NO: 3078313 - RNA, 15 nt, Mycobacterium bovis subsp bovis AF2122/97
ucggguagccgggaa

SEQ ID NO: 3078314 - RNA, 22 nt, Mycobacterium bovis subsp bovis AF2122/97
ucggguagggcaucgucgccga

SEQ ID NO: 3078315 - RNA, 19 nt, Mycobacterium bovis subsp bovis AF2122/97
ucgggucaaugcuggcagc

SEQ ID NO: 3078316 - RNA, 13 nt, Mycobacterium bovis subsp bovis AF2122/97
ucgggucagcacc

SEQ ID NO: 3078317 - RNA, 19 nt, Mycobacterium bovis subsp bovis AF2122/97
ucgggucaucuugccaccg

SEQ ID NO: 3078318 - RNA, 17 nt, Mycobacterium bovis subsp bovis AF2122/97
ucgggucgaucaccgac

SEQ ID NO: 3078319 - RNA, 18 nt, Mycobacterium bovis subsp bovis AF2122/97
ucgggucguuggcggcgg

SEQ ID NO: 3078320 - RNA, 13 nt, Mycobacterium bovis subsp bovis AF2122/97
ucgggugcauucu

SEQ ID NO: 3078321 - RNA, 13 nt, Mycobacterium bovis subsp bovis AF2122/97
ucgggugcugaug

SEQ ID NO: 3078322 - RNA, 19 nt, Mycobacterium bovis subsp bovis AF2122/97
ucggguggaucuucaccuc

SEQ ID NO: 3078323 - RNA, 15 nt, Mycobacterium bovis subsp bovis AF2122/97
ucggguggcggguca

SEQ ID NO: 3078324 - RNA, 21 nt, Mycobacterium bovis subsp bovis AF2122/97
ucgggugguacagggugugcg

SEQ ID NO: 3078325 - RNA, 16 nt, Mycobacterium bovis subsp bovis AF2122/97
ucggguguggucacca

SEQ ID NO: 3078326 - RNA, 21 nt, Mycobacterium bovis subsp bovis AF2122/97
ucggguguggucaccaggccg

SEQ ID NO: 3078327 - RNA, 18 nt, Mycobacterium bovis subsp bovis AF2122/97
ucggguuccacgaucacc

SEQ ID NO: 3078328 - RNA, 19 nt, Mycobacterium bovis subsp bovis AF2122/97
ucggugccgccgccggcgc

SEQ ID NO: 3078329 - RNA, 21 nt, Mycobacterium bovis subsp bovis AF2122/97
ucggugccgccgccggcgccg

SEQ ID NO: 3078330 - RNA, 15 nt, Mycobacterium bovis subsp bovis AF2122/97
ucggugccgcggacg

SEQ ID NO: 3078331 - RNA, 11 nt, Mycobacterium bovis subsp bovis AF2122/97
ucggugccggc

SEQ ID NO: 3078332 - RNA, 21 nt, Mycobacterium bovis subsp bovis AF2122/97
ucggugccggggcugccgccg

SEQ ID NO: 3078333 - RNA, 23 nt, Mycobacterium bovis subsp bovis AF2122/97
ucggugccggggcugccgccguu

SEQ ID NO: 3078334 - RNA, 19 nt, Mycobacterium bovis subsp bovis AF2122/97
ucggugccgugaucggcgc

SEQ ID NO: 3078335 - RNA, 17 nt, Mycobacterium bovis subsp bovis AF2122/97
ucggugcgccagaucac

SEQ ID NO: 3078336 - RNA, 13 nt, Mycobacterium bovis subsp bovis AF2122/97
ucggugcgcgcgg

SEQ ID NO: 3078337 - RNA, 15 nt, Mycobacterium bovis subsp bovis AF2122/97
ucggugcgcgcggcg

SEQ ID NO: 3078338 - RNA, 22 nt, Mycobacterium bovis subsp bovis AF2122/97
ucggugcggaacaccgcccggc

SEQ ID NO: 3078339 - RNA, 23 nt, Mycobacterium bovis subsp bovis AF2122/97
ucggugcggaacaccgcccggcc

SEQ ID NO: 3078340 - RNA, 16 nt, Mycobacterium bovis subsp bovis AF2122/97
ucggugcggucaucgc

SEQ ID NO: 3078341 - RNA, 21 nt, Mycobacterium bovis subsp bovis AF2122/97
ucggugcggugauuccagccg

SEQ ID NO: 3078342 - RNA, 20 nt, Mycobacterium bovis subsp bovis AF2122/97
ucggugcugaccccgccggc

SEQ ID NO: 3078343 - RNA, 19 nt, Mycobacterium bovis subsp bovis AF2122/97
ucgguggcaacgggucggc

SEQ ID NO: 3078344 - RNA, 20 nt, Mycobacterium bovis subsp bovis AF2122/97
ucgguggcgccgaacgccag

SEQ ID NO: 3078345 - RNA, 15 nt, Mycobacterium bovis subsp bovis AF2122/97
ucgguggcgccgggg

SEQ ID NO: 3078346 - RNA, 14 nt, Mycobacterium bovis subsp bovis AF2122/97
ucgguggcugccac

SEQ ID NO: 3078347 - RNA, 12 nt, Mycobacterium bovis subsp bovis AF2122/97
ucggugggcggc

SEQ ID NO: 3078348 - RNA, 16 nt, Mycobacterium bovis subsp bovis AF2122/97
ucggugggcggcgagc

SEQ ID NO: 3078349 - RNA, 16 nt, Mycobacterium bovis subsp bovis AF2122/97
ucggugggcgugacgu

SEQ ID NO: 3078350 - RNA, 22 nt, Mycobacterium bovis subsp bovis AF2122/97
ucggugggcuugccgcgcacca

SEQ ID NO: 3078351 - RNA, 21 nt, Mycobacterium bovis subsp bovis AF2122/97
ucggugggguauucguuggcg

SEQ ID NO: 3078352 - RNA, 20 nt, Mycobacterium bovis subsp bovis AF2122/97
ucgguggggucgcugccgcc

SEQ ID NO: 3078353 - RNA, 21 nt, Mycobacterium bovis subsp bovis AF2122/97
ucgguggggucgcugccgccg

SEQ ID NO: 3078354 - RNA, 16 nt, Mycobacterium bovis subsp bovis AF2122/97
ucggugggucucggcg

SEQ ID NO: 3078355 - RNA, 18 nt, Mycobacterium bovis subsp bovis AF2122/97
ucggugguaccggcggcg

SEQ ID NO: 3078356 - RNA, 15 nt, Mycobacterium bovis subsp bovis AF2122/97
ucggugguccagcgc

SEQ ID NO: 3078357 - RNA, 19 nt, Mycobacterium bovis subsp bovis AF2122/97
ucgguggucucgacggcgc

SEQ ID NO: 3078358 - RNA, 19 nt, Mycobacterium bovis subsp bovis AF2122/97
ucgguggucuuggcccggc

SEQ ID NO: 3078359 - RNA, 18 nt, Mycobacterium bovis subsp bovis AF2122/97
ucggugguggcgucgaug

SEQ ID NO: 3078360 - RNA, 19 nt, Mycobacterium bovis subsp bovis AF2122/97
ucggugguggguugaucgc

SEQ ID NO: 3078361 - RNA, 18 nt, Mycobacterium bovis subsp bovis AF2122/97
ucggugguuuggcgcgcc

SEQ ID NO: 3078362 - RNA, 19 nt, Mycobacterium bovis subsp bovis AF2122/97
ucgguguagaucagcaacg

SEQ ID NO: 3078363 - RNA, 22 nt, Mycobacterium bovis subsp bovis AF2122/97
ucgguguagcaacgguagcggc

SEQ ID NO: 3078364 - RNA, 17 nt, Mycobacterium bovis subsp bovis AF2122/97
ucggugucgaugcugaa

SEQ ID NO: 3078365 - RNA, 14 nt, Mycobacterium bovis subsp bovis AF2122/97
ucggugucgccacc

SEQ ID NO: 3078366 - RNA, 14 nt, Mycobacterium bovis subsp bovis AF2122/97
ucggugucgccgaa

SEQ ID NO: 3078367 - RNA, 20 nt, Mycobacterium bovis subsp bovis AF2122/97
ucggugucgguucggucggc

SEQ ID NO: 3078368 - RNA, 16 nt, Mycobacterium bovis subsp bovis AF2122/97
ucggugucuuccaacc

SEQ ID NO: 3078369 - RNA, 20 nt, Mycobacterium bovis subsp bovis AF2122/97
ucggugucuuccuccucgac

SEQ ID NO: 3078370 - RNA, 22 nt, Mycobacterium bovis subsp bovis AF2122/97
ucggugugccagugcugcaccg

SEQ ID NO: 3078371 - RNA, 14 nt, Mycobacterium bovis subsp bovis AF2122/97
ucggugugcggcgc

SEQ ID NO: 3078372 - RNA, 18 nt, Mycobacterium bovis subsp bovis AF2122/97
ucggugugcggcgcaugc

SEQ ID NO: 3078373 - RNA, 18 nt, Mycobacterium bovis subsp bovis AF2122/97
ucggugugcucgccgacc

SEQ ID NO: 3078374 - RNA, 12 nt, Mycobacterium bovis subsp bovis AF2122/97
ucgguguggacu

SEQ ID NO: 3078375 - RNA, 18 nt, Mycobacterium bovis subsp bovis AF2122/97
ucgguguggacugggcca

SEQ ID NO: 3078376 - RNA, 22 nt, Mycobacterium bovis subsp bovis AF2122/97
ucgguguggcccaacaccgcca

SEQ ID NO: 3078377 - RNA, 13 nt, Mycobacterium bovis subsp bovis AF2122/97
ucgguguggccgu

SEQ ID NO: 3078378 - RNA, 17 nt, Mycobacterium bovis subsp bovis AF2122/97
ucgguguucgguggucc

SEQ ID NO: 3078379 - RNA, 22 nt, Mycobacterium bovis subsp bovis AF2122/97
ucgguguuuaugguugugcggc

SEQ ID NO: 3078380 - RNA, 18 nt, Mycobacterium bovis subsp bovis AF2122/97
ucgguguuuggccgccga

SEQ ID NO: 3078381 - RNA, 20 nt, Mycobacterium bovis subsp bovis AF2122/97
ucgguuccauugcgaacucg

SEQ ID NO: 3078382 - RNA, 17 nt, Mycobacterium bovis subsp bovis AF2122/97
ucgguucguagcgggca

SEQ ID NO: 3078383 - RNA, 15 nt, Mycobacterium bovis subsp bovis AF2122/97
ucgguugaggacgag

SEQ ID NO: 3078384 - RNA, 18 nt, Mycobacterium bovis subsp bovis AF2122/97
ucgguugccacgccgccg

SEQ ID NO: 3078385 - RNA, 19 nt, Mycobacterium bovis subsp bovis AF2122/97
ucgguugcccccagggccg

SEQ ID NO: 3078386 - RNA, 12 nt, Mycobacterium bovis subsp bovis AF2122/97
ucgguuggcagc

SEQ ID NO: 3078387 - RNA, 19 nt, Mycobacterium bovis subsp bovis AF2122/97
ucgguuggcucgggccaga

SEQ ID NO: 3078388 - RNA, 19 nt, Mycobacterium bovis subsp bovis AF2122/97
ucgguuucgaccugcggga

SEQ ID NO: 3078389 - RNA, 19 nt, Mycobacterium bovis subsp bovis AF2122/97
ucgguuugggaauccgcau

SEQ ID NO: 3078390 - RNA, 20 nt, Mycobacterium bovis subsp bovis AF2122/97
ucguaaucggcaaugagcua

SEQ ID NO: 3078391 - RNA, 19 nt, Mycobacterium bovis subsp bovis AF2122/97
ucguacaccucgagcgcgg

SEQ ID NO: 3078392 - RNA, 18 nt, Mycobacterium bovis subsp bovis AF2122/97
ucguaccagccaugcucg

SEQ ID NO: 3078393 - RNA, 17 nt, Mycobacterium bovis subsp bovis AF2122/97
ucguaccgcgcguugug

SEQ ID NO: 3078394 - RNA, 21 nt, Mycobacterium bovis subsp bovis AF2122/97
ucguacggaccgucgccggug

SEQ ID NO: 3078395 - RNA, 15 nt, Mycobacterium bovis subsp bovis AF2122/97
ucguacucccaggcc

SEQ ID NO: 3078396 - RNA, 22 nt, Mycobacterium bovis subsp bovis AF2122/97
ucguacucccaggccgccgcca

SEQ ID NO: 3078397 - RNA, 14 nt, Mycobacterium bovis subsp bovis AF2122/97
ucguagaaccgggg

SEQ ID NO: 3078398 - RNA, 20 nt, Mycobacterium bovis subsp bovis AF2122/97
ucguagacagucugcgacug

SEQ ID NO: 3078399 - RNA, 17 nt, Mycobacterium bovis subsp bovis AF2122/97
ucguagaggacugcggu

SEQ ID NO: 3078400 - RNA, 13 nt, Mycobacterium bovis subsp bovis AF2122/97
ucguagccgccgu

SEQ ID NO: 3078401 - RNA, 21 nt, Mycobacterium bovis subsp bovis AF2122/97
ucguagccgccgucgccggug

SEQ ID NO: 3078402 - RNA, 15 nt, Mycobacterium bovis subsp bovis AF2122/97
ucguaggagccguca

SEQ ID NO: 3078403 - RNA, 13 nt, Mycobacterium bovis subsp bovis AF2122/97
ucguaggcgauga

SEQ ID NO: 3078404 - RNA, 21 nt, Mycobacterium bovis subsp bovis AF2122/97
ucguaggcgcuaggaacgcca

SEQ ID NO: 3078405 - RNA, 17 nt, Mycobacterium bovis subsp bovis AF2122/97
ucguagggacgccgagc

SEQ ID NO: 3078406 - RNA, 20 nt, Mycobacterium bovis subsp bovis AF2122/97
ucguagggauagcagugcag

SEQ ID NO: 3078407 - RNA, 15 nt, Mycobacterium bovis subsp bovis AF2122/97
ucguagggaugcggc

SEQ ID NO: 3078408 - RNA, 17 nt, Mycobacterium bovis subsp bovis AF2122/97
ucguagggugggucggc

SEQ ID NO: 3078409 - RNA, 16 nt, Mycobacterium bovis subsp bovis AF2122/97
ucguagguggccggcu

SEQ ID NO: 3078410 - RNA, 14 nt, Mycobacterium bovis subsp bovis AF2122/97
ucguaggugggcuc

SEQ ID NO: 3078411 - RNA, 22 nt, Mycobacterium bovis subsp bovis AF2122/97
ucguagucucgacaaagcggcu

SEQ ID NO: 3078412 - RNA, 17 nt, Mycobacterium bovis subsp bovis AF2122/97
ucguaucccgcaaaccg

SEQ ID NO: 3078413 - RNA, 17 nt, Mycobacterium bovis subsp bovis AF2122/97
ucguaugauucacgcuc

SEQ ID NO: 3078414 - RNA, 15 nt, Mycobacterium bovis subsp bovis AF2122/97
ucgucgaucgccgcg

SEQ ID NO: 3078415 - RNA, 16 nt, Mycobacterium bovis subsp bovis AF2122/97
ucgucgaucgccgcga

SEQ ID NO: 3078416 - RNA, 18 nt, Mycobacterium bovis subsp bovis AF2122/97
ucgucgaucgccgcgccg

SEQ ID NO: 3078417 - RNA, 18 nt, Mycobacterium bovis subsp bovis AF2122/97
ucgucgaucucgaucgac

SEQ ID NO: 3078418 - RNA, 13 nt, Mycobacterium bovis subsp bovis AF2122/97
ucgucgaugucga

SEQ ID NO: 3078419 - RNA, 15 nt, Mycobacterium bovis subsp bovis AF2122/97
ucgucgaugucgacg

SEQ ID NO: 3078420 - RNA, 13 nt, Mycobacterium bovis subsp bovis AF2122/97
ucgucgccagggc

SEQ ID NO: 3078421 - RNA, 22 nt, Mycobacterium bovis subsp bovis AF2122/97
ucgucgcccaggcgugucgucg

SEQ ID NO: 3078422 - RNA, 22 nt, Mycobacterium bovis subsp bovis AF2122/97
ucgucgccccggggguccaccu

SEQ ID NO: 3078423 - RNA, 15 nt, Mycobacterium bovis subsp bovis AF2122/97
ucgucgccgccggug

SEQ ID NO: 3078424 - RNA, 14 nt, Mycobacterium bovis subsp bovis AF2122/97
ucgucgccgcgcag

SEQ ID NO: 3078425 - RNA, 22 nt, Mycobacterium bovis subsp bovis AF2122/97
ucgucgccgcgguagacgccgc

SEQ ID NO: 3078426 - RNA, 15 nt, Mycobacterium bovis subsp bovis AF2122/97
ucgucgccggcggcg

SEQ ID NO: 3078427 - RNA, 19 nt, Mycobacterium bovis subsp bovis AF2122/97
ucgucgccgucggugccgc

SEQ ID NO: 3078428 - RNA, 22 nt, Mycobacterium bovis subsp bovis AF2122/97
ucgucgccgucggugccgccgc

SEQ ID NO: 3078429 - RNA, 20 nt, Mycobacterium bovis subsp bovis AF2122/97
ucgucgccuagccgcuccgc

SEQ ID NO: 3078430 - RNA, 20 nt, Mycobacterium bovis subsp bovis AF2122/97
ucgucgcgauccacuccggc

SEQ ID NO: 3078431 - RNA, 18 nt, Mycobacterium bovis subsp bovis AF2122/97
ucgucgcggaaucgcgac

SEQ ID NO: 3078432 - RNA, 14 nt, Mycobacterium bovis subsp bovis AF2122/97
ucgucgcggccgcg

SEQ ID NO: 3078433 - RNA, 18 nt, Mycobacterium bovis subsp bovis AF2122/97
ucgucgcgggccaccgcu

SEQ ID NO: 3078434 - RNA, 20 nt, Mycobacterium bovis subsp bovis AF2122/97
ucgucgcgugcaucgccugc

SEQ ID NO: 3078435 - RNA, 13 nt, Mycobacterium bovis subsp bovis AF2122/97
ucgucgcugagca

SEQ ID NO: 3078436 - RNA, 20 nt, Mycobacterium bovis subsp bovis AF2122/97
ucgucgcugagcagcgccgc

SEQ ID NO: 3078437 - RNA, 15 nt, Mycobacterium bovis subsp bovis AF2122/97
ucgucgcugccgcca

SEQ ID NO: 3078438 - RNA, 21 nt, Mycobacterium bovis subsp bovis AF2122/97
ucgucgcuguaggcgauaucg

SEQ ID NO: 3078439 - RNA, 15 nt, Mycobacterium bovis subsp bovis AF2122/97
ucgucggacucgucc

SEQ ID NO: 3078440 - RNA, 21 nt, Mycobacterium bovis subsp bovis AF2122/97
ucgucggcaaccaaccgcgcg

SEQ ID NO: 3078441 - RNA, 18 nt, Mycobacterium bovis subsp bovis AF2122/97
ucgucggcaugggccggc

SEQ ID NO: 3078442 - RNA, 14 nt, Mycobacterium bovis subsp bovis AF2122/97
ucgucggccaccgc

SEQ ID NO: 3078443 - RNA, 18 nt, Mycobacterium bovis subsp bovis AF2122/97
ucgucggccaccgcggcg

SEQ ID NO: 3078444 - RNA, 12 nt, Mycobacterium bovis subsp bovis AF2122/97
ucgucggccagc

SEQ ID NO: 3078445 - RNA, 19 nt, Mycobacterium bovis subsp bovis AF2122/97
ucgucggccaugguguucg

SEQ ID NO: 3078446 - RNA, 20 nt, Mycobacterium bovis subsp bovis AF2122/97
ucgucggccgacaccgccac

SEQ ID NO: 3078447 - RNA, 17 nt, Mycobacterium bovis subsp bovis AF2122/97
ucgucggccggcacccc

SEQ ID NO: 3078448 - RNA, 16 nt, Mycobacterium bovis subsp bovis AF2122/97
ucgucggccugcgccg

SEQ ID NO: 3078449 - RNA, 20 nt, Mycobacterium bovis subsp bovis AF2122/97
ucgucggccugcgccggcgc

SEQ ID NO: 3078450 - RNA, 16 nt, Mycobacterium bovis subsp bovis AF2122/97
ucgucggcgacggcca

SEQ ID NO: 3078451 - RNA, 18 nt, Mycobacterium bovis subsp bovis AF2122/97
ucgucggcgacggccagc

SEQ ID NO: 3078452 - RNA, 11 nt, Mycobacterium bovis subsp bovis AF2122/97
ucgucggcgcc

SEQ ID NO: 3078453 - RNA, 14 nt, Mycobacterium bovis subsp bovis AF2122/97
ucgucggcgccggc

SEQ ID NO: 3078454 - RNA, 16 nt, Mycobacterium bovis subsp bovis AF2122/97
ucgucggcgccggcgg

SEQ ID NO: 3078455 - RNA, 17 nt, Mycobacterium bovis subsp bovis AF2122/97
ucgucggcgccggcggc

SEQ ID NO: 3078456 - RNA, 22 nt, Mycobacterium bovis subsp bovis AF2122/97
ucgucggcggcgacguggcgcc

SEQ ID NO: 3078457 - RNA, 14 nt, Mycobacterium bovis subsp bovis AF2122/97
ucgucggcgggcgg

SEQ ID NO: 3078458 - RNA, 15 nt, Mycobacterium bovis subsp bovis AF2122/97
ucgucggcgggcggc

SEQ ID NO: 3078459 - RNA, 18 nt, Mycobacterium bovis subsp bovis AF2122/97
ucgucggcgggcugcagu

SEQ ID NO: 3078460 - RNA, 18 nt, Mycobacterium bovis subsp bovis AF2122/97
ucgucgggaucguuggcc

SEQ ID NO: 3078461 - RNA, 13 nt, Mycobacterium bovis subsp bovis AF2122/97
ucgucgggcaugc

SEQ ID NO: 3078462 - RNA, 21 nt, Mycobacterium bovis subsp bovis AF2122/97
ucgucgggcgucccggcgguc

SEQ ID NO: 3078463 - RNA, 19 nt, Mycobacterium bovis subsp bovis AF2122/97
ucgucggguagaucgccuu

SEQ ID NO: 3078464 - RNA, 22 nt, Mycobacterium bovis subsp bovis AF2122/97
ucgucggguagggcaucgucgc

SEQ ID NO: 3078465 - RNA, 17 nt, Mycobacterium bovis subsp bovis AF2122/97
ucgucgguaccguccuc

SEQ ID NO: 3078466 - RNA, 21 nt, Mycobacterium bovis subsp bovis AF2122/97
ucgucggucaaaccggugccg

SEQ ID NO: 3078467 - RNA, 22 nt, Mycobacterium bovis subsp bovis AF2122/97
ucgucggucaugucggccaccg

SEQ ID NO: 3078468 - RNA, 15 nt, Mycobacterium bovis subsp bovis AF2122/97
ucgucggucccaggu

SEQ ID NO: 3078469 - RNA, 12 nt, Mycobacterium bovis subsp bovis AF2122/97
ucgucggucuca

SEQ ID NO: 3078470 - RNA, 22 nt, Mycobacterium bovis subsp bovis AF2122/97
ucgucggucucaugcacccggu

SEQ ID NO: 3078471 - RNA, 13 nt, Mycobacterium bovis subsp bovis AF2122/97
ucgucggugauca

SEQ ID NO: 3078472 - RNA, 21 nt, Mycobacterium bovis subsp bovis AF2122/97
ucgucggugaucaccgcggcg

SEQ ID NO: 3078473 - RNA, 14 nt, Mycobacterium bovis subsp bovis AF2122/97
ucgucgguguccuc

SEQ ID NO: 3078474 - RNA, 16 nt, Mycobacterium bovis subsp bovis AF2122/97
ucgucggugucuucca

SEQ ID NO: 3078475 - RNA, 19 nt, Mycobacterium bovis subsp bovis AF2122/97
ucgucgguugccacgccgc

SEQ ID NO: 3078476 - RNA, 16 nt, Mycobacterium bovis subsp bovis AF2122/97
ucgucgucaacccggu

SEQ ID NO: 3078477 - RNA, 22 nt, Mycobacterium bovis subsp bovis AF2122/97
ucgucgucccagggcugccggu

SEQ ID NO: 3078478 - RNA, 23 nt, Mycobacterium bovis subsp bovis AF2122/97
ucgucguccggccacgguccggc

SEQ ID NO: 3078479 - RNA, 13 nt, Mycobacterium bovis subsp bovis AF2122/97
ucgucgucgacgg

SEQ ID NO: 3078480 - RNA, 14 nt, Mycobacterium bovis subsp bovis AF2122/97
ucgucgucgacggc

SEQ ID NO: 3078481 - RNA, 15 nt, Mycobacterium bovis subsp bovis AF2122/97
ucgucgucgacggcc

SEQ ID NO: 3078482 - RNA, 15 nt, Mycobacterium bovis subsp bovis AF2122/97
ucgucgucgcugccg

SEQ ID NO: 3078483 - RNA, 21 nt, Mycobacterium bovis subsp bovis AF2122/97
ucgucgucggcaggcagcucg

SEQ ID NO: 3078484 - RNA, 13 nt, Mycobacterium bovis subsp bovis AF2122/97
ucgucgucgguca

SEQ ID NO: 3078485 - RNA, 20 nt, Mycobacterium bovis subsp bovis AF2122/97
ucgucgucucgaugcauggc

SEQ ID NO: 3078486 - RNA, 16 nt, Mycobacterium bovis subsp bovis AF2122/97
ucgucgucuugguugu

SEQ ID NO: 3078487 - RNA, 18 nt, Mycobacterium bovis subsp bovis AF2122/97
ucgucgugagacugggcg

SEQ ID NO: 3078488 - RNA, 15 nt, Mycobacterium bovis subsp bovis AF2122/97
ucgucgugcacgacg

SEQ ID NO: 3078489 - RNA, 17 nt, Mycobacterium bovis subsp bovis AF2122/97
ucgucgugcacggcggc

SEQ ID NO: 3078490 - RNA, 14 nt, Mycobacterium bovis subsp bovis AF2122/97
ucgucgugcaggcg

SEQ ID NO: 3078491 - RNA, 15 nt, Mycobacterium bovis subsp bovis AF2122/97
ucgucgugcgggcgg

SEQ ID NO: 3078492 - RNA, 14 nt, Mycobacterium bovis subsp bovis AF2122/97
ucgucgugucgccg

SEQ ID NO: 3078493 - RNA, 17 nt, Mycobacterium bovis subsp bovis AF2122/97
ucgucgugucgccgccg

SEQ ID NO: 3078494 - RNA, 19 nt, Mycobacterium bovis subsp bovis AF2122/97
ucgucgugucgccgccguu

SEQ ID NO: 3078495 - RNA, 20 nt, Mycobacterium bovis subsp bovis AF2122/97
ucgucguguuggccgggucg

SEQ ID NO: 3078496 - RNA, 20 nt, Mycobacterium bovis subsp bovis AF2122/97
ucgucguucaaugucguugc

SEQ ID NO: 3078497 - RNA, 21 nt, Mycobacterium bovis subsp bovis AF2122/97
ucgucguugugauccgguggu

SEQ ID NO: 3078498 - RNA, 14 nt, Mycobacterium bovis subsp bovis AF2122/97
ucgucucggccacg

SEQ ID NO: 3078499 - RNA, 17 nt, Mycobacterium bovis subsp bovis AF2122/97
ucgucugguggcagcgc

SEQ ID NO: 3078500 - RNA, 18 nt, Mycobacterium bovis subsp bovis AF2122/97
ucgucugucucggugccu

SEQ ID NO: 3078501 - RNA, 22 nt, Mycobacterium bovis subsp bovis AF2122/97
ucguugaugcggcuauuggccu

SEQ ID NO: 3078502 - RNA, 16 nt, Mycobacterium bovis subsp bovis AF2122/97
ucguugauuucggcgg

SEQ ID NO: 3078503 - RNA, 16 nt, Mycobacterium bovis subsp bovis AF2122/97
ucguugcccgacccgc

SEQ ID NO: 3078504 - RNA, 17 nt, Mycobacterium bovis subsp bovis AF2122/97
ucguugcccgacccgcc

SEQ ID NO: 3078505 - RNA, 21 nt, Mycobacterium bovis subsp bovis AF2122/97
ucguugccgcggucggcgacg

SEQ ID NO: 3078506 - RNA, 17 nt, Mycobacterium bovis subsp bovis AF2122/97
ucguugccggacaaccu

SEQ ID NO: 3078507 - RNA, 20 nt, Mycobacterium bovis subsp bovis AF2122/97
ucguugccggacaaccuggg

SEQ ID NO: 3078508 - RNA, 15 nt, Mycobacterium bovis subsp bovis AF2122/97
ucguugccggugccg

SEQ ID NO: 3078509 - RNA, 20 nt, Mycobacterium bovis subsp bovis AF2122/97
ucguugccggugccgccgcg

SEQ ID NO: 3078510 - RNA, 18 nt, Mycobacterium bovis subsp bovis AF2122/97
ucguugccguccaccgau

SEQ ID NO: 3078511 - RNA, 19 nt, Mycobacterium bovis subsp bovis AF2122/97
ucguugccucgucgccgcg

SEQ ID NO: 3078512 - RNA, 21 nt, Mycobacterium bovis subsp bovis AF2122/97
ucguugcucggucucgucgcg

SEQ ID NO: 3078513 - RNA, 19 nt, Mycobacterium bovis subsp bovis AF2122/97
ucguugcuggcggccagca

SEQ ID NO: 3078514 - RNA, 21 nt, Mycobacterium bovis subsp bovis AF2122/97
ucguuggcaaagacgcuggcc

SEQ ID NO: 3078515 - RNA, 21 nt, Mycobacterium bovis subsp bovis AF2122/97
ucguuggccaugccacaacgc

SEQ ID NO: 3078516 - RNA, 16 nt, Mycobacterium bovis subsp bovis AF2122/97
ucguuggcgaccaccg

SEQ ID NO: 3078517 - RNA, 20 nt, Mycobacterium bovis subsp bovis AF2122/97
ucguuggcgaccaccgcguc

SEQ ID NO: 3078518 - RNA, 21 nt, Mycobacterium bovis subsp bovis AF2122/97
ucguuggcgaccaccgcgucg

SEQ ID NO: 3078519 - RNA, 14 nt, Mycobacterium bovis subsp bovis AF2122/97
ucguuggcggcggu

SEQ ID NO: 3078520 - RNA, 23 nt, Mycobacterium bovis subsp bovis AF2122/97
ucguuguaugcguuacgccgcga

SEQ ID NO: 3078521 - RNA, 16 nt, Mycobacterium bovis subsp bovis AF2122/97
ucguuguccagcgucu

SEQ ID NO: 3078522 - RNA, 13 nt, Mycobacterium bovis subsp bovis AF2122/97
ucguugucuuggg

SEQ ID NO: 3078523 - RNA, 13 nt, Mycobacterium bovis subsp bovis AF2122/97
ucguugugccggu

SEQ ID NO: 3078524 - RNA, 19 nt, Mycobacterium bovis subsp bovis AF2122/97
ucguugugccggucgauga

SEQ ID NO: 3078525 - RNA, 23 nt, Mycobacterium bovis subsp bovis AF2122/97
ucguugugcggacaucaccggca

SEQ ID NO: 3078526 - RNA, 19 nt, Mycobacterium bovis subsp bovis AF2122/97
ucguuuuccagccgacgua

SEQ ID NO: 3078527 - RNA, 23 nt, Mycobacterium bovis subsp bovis AF2122/97
ucuacgcaucccgaauggccgau

SEQ ID NO: 3078528 - RNA, 21 nt, Mycobacterium bovis subsp bovis AF2122/97
ucuacgccgggaauuucgaca

SEQ ID NO: 3078529 - RNA, 14 nt, Mycobacterium bovis subsp bovis AF2122/97
ucuacuucggcgcc

SEQ ID NO: 3078530 - RNA, 16 nt, Mycobacterium bovis subsp bovis AF2122/97
ucuagcaaagccagcg

SEQ ID NO: 3078531 - RNA, 18 nt, Mycobacterium bovis subsp bovis AF2122/97
ucuagcaaagccagcgca

SEQ ID NO: 3078532 - RNA, 22 nt, Mycobacterium bovis subsp bovis AF2122/97
ucuagcgccucgccggccaccc

SEQ ID NO: 3078533 - RNA, 15 nt, Mycobacterium bovis subsp bovis AF2122/97
ucuagcggccuagga

SEQ ID NO: 3078534 - RNA, 18 nt, Mycobacterium bovis subsp bovis AF2122/97
ucuagcuugacaacccug

SEQ ID NO: 3078535 - RNA, 24 nt, Mycobacterium bovis subsp bovis AF2122/97
ucuagguucaguuccaccgcgcag

SEQ ID NO: 3078536 - RNA, 19 nt, Mycobacterium bovis subsp bovis AF2122/97
ucuauccggcgcagguucu

SEQ ID NO: 3078537 - RNA, 21 nt, Mycobacterium bovis subsp bovis AF2122/97
ucucaagggcaucaaccaacu

SEQ ID NO: 3078538 - RNA, 14 nt, Mycobacterium bovis subsp bovis AF2122/97
ucucaucccagucg

SEQ ID NO: 3078539 - RNA, 18 nt, Mycobacterium bovis subsp bovis AF2122/97
ucucaugcaucugcuucu

SEQ ID NO: 3078540 - RNA, 15 nt, Mycobacterium bovis subsp bovis AF2122/97
ucuccaccaccgacg

SEQ ID NO: 3078541 - RNA, 15 nt, Mycobacterium bovis subsp bovis AF2122/97
ucuccaccagcgugg

SEQ ID NO: 3078542 - RNA, 23 nt, Mycobacterium bovis subsp bovis AF2122/97
ucuccaccagcguggacguacug

SEQ ID NO: 3078543 - RNA, 19 nt, Mycobacterium bovis subsp bovis AF2122/97
ucuccaccccgucugcagg

SEQ ID NO: 3078544 - RNA, 23 nt, Mycobacterium bovis subsp bovis AF2122/97
ucuccacccgccggccgucggcc

SEQ ID NO: 3078545 - RNA, 14 nt, Mycobacterium bovis subsp bovis AF2122/97
ucuccaccgucgcc

SEQ ID NO: 3078546 - RNA, 12 nt, Mycobacterium bovis subsp bovis AF2122/97
ucuccaccuucu

SEQ ID NO: 3078547 - RNA, 19 nt, Mycobacterium bovis subsp bovis AF2122/97
ucuccagacguuccaucac

SEQ ID NO: 3078548 - RNA, 20 nt, Mycobacterium bovis subsp bovis AF2122/97
ucuccagaggaaaccgcuag

SEQ ID NO: 3078549 - RNA, 14 nt, Mycobacterium bovis subsp bovis AF2122/97
ucuccagauguccg

SEQ ID NO: 3078550 - RNA, 20 nt, Mycobacterium bovis subsp bovis AF2122/97
ucuccaucaugugcgcgacc

SEQ ID NO: 3078551 - RNA, 14 nt, Mycobacterium bovis subsp bovis AF2122/97
ucuccaucgucggc

SEQ ID NO: 3078552 - RNA, 12 nt, Mycobacterium bovis subsp bovis AF2122/97
ucuccaugcucg

SEQ ID NO: 3078553 - RNA, 16 nt, Mycobacterium bovis subsp bovis AF2122/97
ucuccauguuggcgaa

SEQ ID NO: 3078554 - RNA, 17 nt, Mycobacterium bovis subsp bovis AF2122/97
ucucccauacgccggcc

SEQ ID NO: 3078555 - RNA, 23 nt, Mycobacterium bovis subsp bovis AF2122/97
ucuccccagagcugguccuccaa

SEQ ID NO: 3078556 - RNA, 15 nt, Mycobacterium bovis subsp bovis AF2122/97
ucucccgcacggccg

SEQ ID NO: 3078557 - RNA, 13 nt, Mycobacterium bovis subsp bovis AF2122/97
ucucccggccgca

SEQ ID NO: 3078558 - RNA, 18 nt, Mycobacterium bovis subsp bovis AF2122/97
ucucccggcugaugccug

SEQ ID NO: 3078559 - RNA, 14 nt, Mycobacterium bovis subsp bovis AF2122/97
ucucccuugccgcc

SEQ ID NO: 3078560 - RNA, 15 nt, Mycobacterium bovis subsp bovis AF2122/97
ucucccuugccgcca

SEQ ID NO: 3078561 - RNA, 20 nt, Mycobacterium bovis subsp bovis AF2122/97
ucuccgaaucugccggccgg

SEQ ID NO: 3078562 - RNA, 14 nt, Mycobacterium bovis subsp bovis AF2122/97
ucuccgacauuggc

SEQ ID NO: 3078563 - RNA, 14 nt, Mycobacterium bovis subsp bovis AF2122/97
ucuccgccgcccag

SEQ ID NO: 3078564 - RNA, 14 nt, Mycobacterium bovis subsp bovis AF2122/97
ucuccgccgucgcc

SEQ ID NO: 3078565 - RNA, 20 nt, Mycobacterium bovis subsp bovis AF2122/97
ucuccgccgucgccaccggu

SEQ ID NO: 3078566 - RNA, 20 nt, Mycobacterium bovis subsp bovis AF2122/97
ucuccgccgugaguucacgu

SEQ ID NO: 3078567 - RNA, 15 nt, Mycobacterium bovis subsp bovis AF2122/97
ucuccgcguccgcca

SEQ ID NO: 3078568 - RNA, 19 nt, Mycobacterium bovis subsp bovis AF2122/97
ucuccggcaacagcaccag

SEQ ID NO: 3078569 - RNA, 14 nt, Mycobacterium bovis subsp bovis AF2122/97
ucuccggcgccacc

SEQ ID NO: 3078570 - RNA, 23 nt, Mycobacterium bovis subsp bovis AF2122/97
ucuccgggucgaugucggggccg

SEQ ID NO: 3078571 - RNA, 22 nt, Mycobacterium bovis subsp bovis AF2122/97
ucuccggugaucaccgacaccg

SEQ ID NO: 3078572 - RNA, 23 nt, Mycobacterium bovis subsp bovis AF2122/97
ucuccggugaucaccgacaccgu

SEQ ID NO: 3078573 - RNA, 18 nt, Mycobacterium bovis subsp bovis AF2122/97
ucuccguccccgcagcgc

SEQ ID NO: 3078574 - RNA, 18 nt, Mycobacterium bovis subsp bovis AF2122/97
ucuccguccucgucccag

SEQ ID NO: 3078575 - RNA, 12 nt, Mycobacterium bovis subsp bovis AF2122/97
ucuccgucggcc

SEQ ID NO: 3078576 - RNA, 18 nt, Mycobacterium bovis subsp bovis AF2122/97
ucuccgugagccggaccg

SEQ ID NO: 3078577 - RNA, 13 nt, Mycobacterium bovis subsp bovis AF2122/97
ucuccuccaccag

SEQ ID NO: 3078578 - RNA, 17 nt, Mycobacterium bovis subsp bovis AF2122/97
ucuccuccaccagugcc

SEQ ID NO: 3078579 - RNA, 14 nt, Mycobacterium bovis subsp bovis AF2122/97
ucuccuccagagac

SEQ ID NO: 3078580 - RNA, 21 nt, Mycobacterium bovis subsp bovis AF2122/97
ucuccuccgcguagagcagca

SEQ ID NO: 3078581 - RNA, 17 nt, Mycobacterium bovis subsp bovis AF2122/97
ucuccucuugcaccagg

SEQ ID NO: 3078582 - RNA, 20 nt, Mycobacterium bovis subsp bovis AF2122/97
ucuccucuugcaccagggcc

SEQ ID NO: 3078583 - RNA, 15 nt, Mycobacterium bovis subsp bovis AF2122/97
ucuccugcccuccgu

SEQ ID NO: 3078584 - RNA, 21 nt, Mycobacterium bovis subsp bovis AF2122/97
ucuccugcugugggauucggg

SEQ ID NO: 3078585 - RNA, 22 nt, Mycobacterium bovis subsp bovis AF2122/97
ucuccuggaaaggacggccggc

SEQ ID NO: 3078586 - RNA, 22 nt, Mycobacterium bovis subsp bovis AF2122/97
ucuccuugggcgacgcggcgcc

SEQ ID NO: 3078587 - RNA, 15 nt, Mycobacterium bovis subsp bovis AF2122/97
ucugcgacaagaccg

SEQ ID NO: 3078588 - RNA, 12 nt, Mycobacterium bovis subsp bovis AF2122/97
ucugcgacacca

SEQ ID NO: 3078589 - RNA, 13 nt, Mycobacterium bovis subsp bovis AF2122/97
ucugcgacccggg

SEQ ID NO: 3078590 - RNA, 16 nt, Mycobacterium bovis subsp bovis AF2122/97
ucugcgacccgggccg

SEQ ID NO: 3078591 - RNA, 17 nt, Mycobacterium bovis subsp bovis AF2122/97
ucugcgaucccgaucgc

SEQ ID NO: 3078592 - RNA, 20 nt, Mycobacterium bovis subsp bovis AF2122/97
ucugcgcagguggucgauca

SEQ ID NO: 3078593 - RNA, 14 nt, Mycobacterium bovis subsp bovis AF2122/97
ucugcgccaaaauc

SEQ ID NO: 3078594 - RNA, 14 nt, Mycobacterium bovis subsp bovis AF2122/97
ucugcgccacagca

SEQ ID NO: 3078595 - RNA, 17 nt, Mycobacterium bovis subsp bovis AF2122/97
ucugcgccacagcagcg

SEQ ID NO: 3078596 - RNA, 18 nt, Mycobacterium bovis subsp bovis AF2122/97
ucugcgccacagcagcgu

SEQ ID NO: 3078597 - RNA, 15 nt, Mycobacterium bovis subsp bovis AF2122/97
ucugcgcccacccgc

SEQ ID NO: 3078598 - RNA, 14 nt, Mycobacterium bovis subsp bovis AF2122/97
ucugcgcgaggggc

SEQ ID NO: 3078599 - RNA, 20 nt, Mycobacterium bovis subsp bovis AF2122/97
ucugcgcggugcccgcgaac

SEQ ID NO: 3078600 - RNA, 20 nt, Mycobacterium bovis subsp bovis AF2122/97
ucugcgcgucaggccagcgc

SEQ ID NO: 3078601 - RNA, 22 nt, Mycobacterium bovis subsp bovis AF2122/97
ucugcgcucccguacgccggcg

SEQ ID NO: 3078602 - RNA, 17 nt, Mycobacterium bovis subsp bovis AF2122/97
ucugcggaggcgacccc

SEQ ID NO: 3078603 - RNA, 15 nt, Mycobacterium bovis subsp bovis AF2122/97
ucugcggccacgccg

SEQ ID NO: 3078604 - RNA, 20 nt, Mycobacterium bovis subsp bovis AF2122/97
ucugcggccacgccgaugcg

SEQ ID NO: 3078605 - RNA, 21 nt, Mycobacterium bovis subsp bovis AF2122/97
ucugcggccgcgugccgcccg

SEQ ID NO: 3078606 - RNA, 15 nt, Mycobacterium bovis subsp bovis AF2122/97
ucugcggcgcccggu

SEQ ID NO: 3078607 - RNA, 20 nt, Mycobacterium bovis subsp bovis AF2122/97
ucugcggcggucucgucaac

SEQ ID NO: 3078608 - RNA, 14 nt, Mycobacterium bovis subsp bovis AF2122/97
ucugcguccaccgg

SEQ ID NO: 3078609 - RNA, 17 nt, Mycobacterium bovis subsp bovis AF2122/97
ucugcgucugcucggcg

SEQ ID NO: 3078610 - RNA, 23 nt, Mycobacterium bovis subsp bovis AF2122/97
ucugcucagggcgcaaaccaccc

SEQ ID NO: 3078611 - RNA, 13 nt, Mycobacterium bovis subsp bovis AF2122/97
ucugcuccaggcg

SEQ ID NO: 3078612 - RNA, 15 nt, Mycobacterium bovis subsp bovis AF2122/97
ucugcucgccagcgg

SEQ ID NO: 3078613 - RNA, 14 nt, Mycobacterium bovis subsp bovis AF2122/97
ucugcucgccgggc

SEQ ID NO: 3078614 - RNA, 22 nt, Mycobacterium bovis subsp bovis AF2122/97
ucugcucgccgggcuuaggccg

SEQ ID NO: 3078615 - RNA, 21 nt, Mycobacterium bovis subsp bovis AF2122/97
ucugcucggcgcgguggggcg

SEQ ID NO: 3078616 - RNA, 16 nt, Mycobacterium bovis subsp bovis AF2122/97
ucugcugaccggaguu

SEQ ID NO: 3078617 - RNA, 21 nt, Mycobacterium bovis subsp bovis AF2122/97
ucuggaaccccgagcugccaa

SEQ ID NO: 3078618 - RNA, 20 nt, Mycobacterium bovis subsp bovis AF2122/97
ucuggacaucggccggcguc

SEQ ID NO: 3078619 - RNA, 22 nt, Mycobacterium bovis subsp bovis AF2122/97
ucuggagugaggcugugcccca

SEQ ID NO: 3078620 - RNA, 13 nt, Mycobacterium bovis subsp bovis AF2122/97
ucuggauacccag

SEQ ID NO: 3078621 - RNA, 21 nt, Mycobacterium bovis subsp bovis AF2122/97
ucuggaucagaucccgccgcg

SEQ ID NO: 3078622 - RNA, 20 nt, Mycobacterium bovis subsp bovis AF2122/97
ucuggcaacccccgccggcg

SEQ ID NO: 3078623 - RNA, 13 nt, Mycobacterium bovis subsp bovis AF2122/97
ucuggcaggccag

SEQ ID NO: 3078624 - RNA, 22 nt, Mycobacterium bovis subsp bovis AF2122/97
ucuggcaggugaacugguugac

SEQ ID NO: 3078625 - RNA, 15 nt, Mycobacterium bovis subsp bovis AF2122/97
ucuggccggcggugu

SEQ ID NO: 3078626 - RNA, 17 nt, Mycobacterium bovis subsp bovis AF2122/97
ucuggccguugcccgac

SEQ ID NO: 3078627 - RNA, 24 nt, Mycobacterium bovis subsp bovis AF2122/97
ucuggcgagggcuaccggcgccgc

SEQ ID NO: 3078628 - RNA, 18 nt, Mycobacterium bovis subsp bovis AF2122/97
ucuggcgaugacgaucgc

SEQ ID NO: 3078629 - RNA, 12 nt, Mycobacterium bovis subsp bovis AF2122/97
ucuggcgcagca

SEQ ID NO: 3078630 - RNA, 16 nt, Mycobacterium bovis subsp bovis AF2122/97
ucuggcggauggccgc

SEQ ID NO: 3078631 - RNA, 14 nt, Mycobacterium bovis subsp bovis AF2122/97
ucuggcucgcgaac

SEQ ID NO: 3078632 - RNA, 17 nt, Mycobacterium bovis subsp bovis AF2122/97
ucugggagccggugggu

SEQ ID NO: 3078633 - RNA, 18 nt, Mycobacterium bovis subsp bovis AF2122/97
ucugggcggugaaggccc

SEQ ID NO: 3078634 - RNA, 12 nt, Mycobacterium bovis subsp bovis AF2122/97
ucugggcuggca

SEQ ID NO: 3078635 - RNA, 17 nt, Mycobacterium bovis subsp bovis AF2122/97
ucugggcuuucagcacc

SEQ ID NO: 3078636 - RNA, 22 nt, Mycobacterium bovis subsp bovis AF2122/97
ucugggcuuucgcgugcggcug

SEQ ID NO: 3078637 - RNA, 21 nt, Mycobacterium bovis subsp bovis AF2122/97
ucugggcuuucugcacccgcc

SEQ ID NO: 3078638 - RNA, 14 nt, Mycobacterium bovis subsp bovis AF2122/97
ucugggcuuugcag

SEQ ID NO: 3078639 - RNA, 17 nt, Mycobacterium bovis subsp bovis AF2122/97
ucuggggguagccgccg

SEQ ID NO: 3078640 - RNA, 20 nt, Mycobacterium bovis subsp bovis AF2122/97
ucuggggguagccgccggcg

SEQ ID NO: 3078641 - RNA, 18 nt, Mycobacterium bovis subsp bovis AF2122/97
ucugggguuggcucggcg

SEQ ID NO: 3078642 - RNA, 23 nt, Mycobacterium bovis subsp bovis AF2122/97
ucuggguaagggacaccagcucg

SEQ ID NO: 3078643 - RNA, 14 nt, Mycobacterium bovis subsp bovis AF2122/97
ucugggugcagguu

SEQ ID NO: 3078644 - RNA, 20 nt, Mycobacterium bovis subsp bovis AF2122/97
ucugguaggcggccauguca

SEQ ID NO: 3078645 - RNA, 16 nt, Mycobacterium bovis subsp bovis AF2122/97
ucuggucaagacccgc

SEQ ID NO: 3078646 - RNA, 20 nt, Mycobacterium bovis subsp bovis AF2122/97
ucuggucagccgcggcggca

SEQ ID NO: 3078647 - RNA, 16 nt, Mycobacterium bovis subsp bovis AF2122/97
ucuggucauggccgaa

SEQ ID NO: 3078648 - RNA, 14 nt, Mycobacterium bovis subsp bovis AF2122/97
ucuggucgggucgc

SEQ ID NO: 3078649 - RNA, 15 nt, Mycobacterium bovis subsp bovis AF2122/97
ucugguggcagcgca

SEQ ID NO: 3078650 - RNA, 19 nt, Mycobacterium bovis subsp bovis AF2122/97
ucugguggcgcugaagccg

SEQ ID NO: 3078651 - RNA, 13 nt, Mycobacterium bovis subsp bovis AF2122/97
ucugguggucggc

SEQ ID NO: 3078652 - RNA, 17 nt, Mycobacterium bovis subsp bovis AF2122/97
ucugguggucggcgacg

SEQ ID NO: 3078653 - RNA, 16 nt, Mycobacterium bovis subsp bovis AF2122/97
ucugguuguugccgac

SEQ ID NO: 3078654 - RNA, 15 nt, Mycobacterium bovis subsp bovis AF2122/97
ucuguaaccuccucg

SEQ ID NO: 3078655 - RNA, 16 nt, Mycobacterium bovis subsp bovis AF2122/97
ucugucccggcgcgcc

SEQ ID NO: 3078656 - RNA, 14 nt, Mycobacterium bovis subsp bovis AF2122/97
ucugugcugcgcug

SEQ ID NO: 3078657 - RNA, 22 nt, Mycobacterium bovis subsp bovis AF2122/97
ucuucaacgucgagauccucgu

SEQ ID NO: 3078658 - RNA, 23 nt, Mycobacterium bovis subsp bovis AF2122/97
ucuucaacgucgagauccucguc

SEQ ID NO: 3078659 - RNA, 12 nt, Mycobacterium bovis subsp bovis AF2122/97
ucuucaacuccg

SEQ ID NO: 3078660 - RNA, 14 nt, Mycobacterium bovis subsp bovis AF2122/97
ucuucacccaacgg

SEQ ID NO: 3078661 - RNA, 22 nt, Mycobacterium bovis subsp bovis AF2122/97
ucuucagcugcggauacagccg

SEQ ID NO: 3078662 - RNA, 15 nt, Mycobacterium bovis subsp bovis AF2122/97
ucuucagguccaccg

SEQ ID NO: 3078663 - RNA, 23 nt, Mycobacterium bovis subsp bovis AF2122/97
ucuuccaacccaaccgagaugcg

SEQ ID NO: 3078664 - RNA, 15 nt, Mycobacterium bovis subsp bovis AF2122/97
ucuuccagccaggcc

SEQ ID NO: 3078665 - RNA, 18 nt, Mycobacterium bovis subsp bovis AF2122/97
ucuuccaggagcgccguc

SEQ ID NO: 3078666 - RNA, 14 nt, Mycobacterium bovis subsp bovis AF2122/97
ucuucccaaccgcc

SEQ ID NO: 3078667 - RNA, 15 nt, Mycobacterium bovis subsp bovis AF2122/97
ucuuccccucggccg

SEQ ID NO: 3078668 - RNA, 15 nt, Mycobacterium bovis subsp bovis AF2122/97
ucuuccggugcgccg

SEQ ID NO: 3078669 - RNA, 19 nt, Mycobacterium bovis subsp bovis AF2122/97
ucuuccggugcgccgaucc

SEQ ID NO: 3078670 - RNA, 14 nt, Mycobacterium bovis subsp bovis AF2122/97
ucuuccucggccac

SEQ ID NO: 3078671 - RNA, 16 nt, Mycobacterium bovis subsp bovis AF2122/97
ucuucgauaccgaccg

SEQ ID NO: 3078672 - RNA, 20 nt, Mycobacterium bovis subsp bovis AF2122/97
ucuucgccgaugaauuucau

SEQ ID NO: 3078673 - RNA, 21 nt, Mycobacterium bovis subsp bovis AF2122/97
ucuucgccgccaccggcgacg

SEQ ID NO: 3078674 - RNA, 20 nt, Mycobacterium bovis subsp bovis AF2122/97
ugaagaacaugcucacgauc

SEQ ID NO: 3078675 - RNA, 22 nt, Mycobacterium bovis subsp bovis AF2122/97
ugaagaacaugcucacgaucac

SEQ ID NO: 3078676 - RNA, 11 nt, Mycobacterium bovis subsp bovis AF2122/97
ugaagaagccc

SEQ ID NO: 3078677 - RNA, 13 nt, Mycobacterium bovis subsp bovis AF2122/97
ugaagaagccggu

SEQ ID NO: 3078678 - RNA, 20 nt, Mycobacterium bovis subsp bovis AF2122/97
ugaagaaugccgucugauca

SEQ ID NO: 3078679 - RNA, 15 nt, Mycobacterium bovis subsp bovis AF2122/97
ugaagacaccaggcc

SEQ ID NO: 3078680 - RNA, 16 nt, Mycobacterium bovis subsp bovis AF2122/97
ugaagacaccggcguc

SEQ ID NO: 3078681 - RNA, 19 nt, Mycobacterium bovis subsp bovis AF2122/97
ugaagaccaccgcccacag

SEQ ID NO: 3078682 - RNA, 13 nt, Mycobacterium bovis subsp bovis AF2122/97
ugaagagaagucu

SEQ ID NO: 3078683 - RNA, 14 nt, Mycobacterium bovis subsp bovis AF2122/97
ugaagagaagucuc

SEQ ID NO: 3078684 - RNA, 19 nt, Mycobacterium bovis subsp bovis AF2122/97
ugaagaugauuucgccgag

SEQ ID NO: 3078685 - RNA, 19 nt, Mycobacterium bovis subsp bovis AF2122/97
ugaagaugucuuccugcgc

SEQ ID NO: 3078686 - RNA, 14 nt, Mycobacterium bovis subsp bovis AF2122/97
ugaagcagacguca

SEQ ID NO: 3078687 - RNA, 22 nt, Mycobacterium bovis subsp bovis AF2122/97
ugaagccaaaugcgcugucgcc

SEQ ID NO: 3078688 - RNA, 20 nt, Mycobacterium bovis subsp bovis AF2122/97
ugaagccaagaaucacggcc

SEQ ID NO: 3078689 - RNA, 19 nt, Mycobacterium bovis subsp bovis AF2122/97
ugaagccaagcgacucgcc

SEQ ID NO: 3078690 - RNA, 19 nt, Mycobacterium bovis subsp bovis AF2122/97
ugaagccagcgcagcaccg

SEQ ID NO: 3078691 - RNA, 22 nt, Mycobacterium bovis subsp bovis AF2122/97
ugaagcccaacagcaacccgcc

SEQ ID NO: 3078692 - RNA, 14 nt, Mycobacterium bovis subsp bovis AF2122/97
ugaagcccuggcca

SEQ ID NO: 3078693 - RNA, 20 nt, Mycobacterium bovis subsp bovis AF2122/97
ugaagccgcuggaagucggu

SEQ ID NO: 3078694 - RNA, 23 nt, Mycobacterium bovis subsp bovis AF2122/97
ugaagccgcuggaagucggucug

SEQ ID NO: 3078695 - RNA, 12 nt, Mycobacterium bovis subsp bovis AF2122/97
ugaaggagaucc

SEQ ID NO: 3078696 - RNA, 18 nt, Mycobacterium bovis subsp bovis AF2122/97
ugaaggcaaacaccagcc

SEQ ID NO: 3078697 - RNA, 22 nt, Mycobacterium bovis subsp bovis AF2122/97
ugaaggccgguagcgcgggugg

SEQ ID NO: 3078698 - RNA, 13 nt, Mycobacterium bovis subsp bovis AF2122/97
ugaaggcgccggu

SEQ ID NO: 3078699 - RNA, 22 nt, Mycobacterium bovis subsp bovis AF2122/97
ugaagggccgccucgcggauga

SEQ ID NO: 3078700 - RNA, 13 nt, Mycobacterium bovis subsp bovis AF2122/97
ugaaggugccggc

SEQ ID NO: 3078701 - RNA, 23 nt, Mycobacterium bovis subsp bovis AF2122/97
ugaaguccgagacgucggcguag

SEQ ID NO: 3078702 - RNA, 14 nt, Mycobacterium bovis subsp bovis AF2122/97
ugaagucggugccg

SEQ ID NO: 3078703 - RNA, 19 nt, Mycobacterium bovis subsp bovis AF2122/97
ugaagucggugccgagcgc

SEQ ID NO: 3078704 - RNA, 19 nt, Mycobacterium bovis subsp bovis AF2122/97
ugaagugaaagacaguggc

SEQ ID NO: 3078705 - RNA, 19 nt, Mycobacterium bovis subsp bovis AF2122/97
ugaagugaaaguucaugcc

SEQ ID NO: 3078706 - RNA, 13 nt, Mycobacterium bovis subsp bovis AF2122/97
ugaaguggcacaa

SEQ ID NO: 3078707 - RNA, 21 nt, Mycobacterium bovis subsp bovis AF2122/97
ugaaguggcgucagugcagaa

SEQ ID NO: 3078708 - RNA, 18 nt, Mycobacterium bovis subsp bovis AF2122/97
ugaaguucgggcaacggc

SEQ ID NO: 3078709 - RNA, 19 nt, Mycobacterium bovis subsp bovis AF2122/97
ugaaguucgggcaacggca

SEQ ID NO: 3078710 - RNA, 15 nt, Mycobacterium bovis subsp bovis AF2122/97
ugaaguuggcguggu

SEQ ID NO: 3078711 - RNA, 18 nt, Mycobacterium bovis subsp bovis AF2122/97
ugaaucaccggagcgccg

SEQ ID NO: 3078712 - RNA, 18 nt, Mycobacterium bovis subsp bovis AF2122/97
ugaaucggaccgaccggc

SEQ ID NO: 3078713 - RNA, 16 nt, Mycobacterium bovis subsp bovis AF2122/97
ugaaucgguucggcca

SEQ ID NO: 3078714 - RNA, 13 nt, Mycobacterium bovis subsp bovis AF2122/97
ugaauggcagcac

SEQ ID NO: 3078715 - RNA, 15 nt, Mycobacterium bovis subsp bovis AF2122/97
ugaauguugccgccg

SEQ ID NO: 3078716 - RNA, 19 nt, Mycobacterium bovis subsp bovis AF2122/97
ugaauguugccgccgcggc

SEQ ID NO: 3078717 - RNA, 23 nt, Mycobacterium bovis subsp bovis AF2122/97
ugaauguugccgccgcggcgccc

SEQ ID NO: 3078718 - RNA, 13 nt, Mycobacterium bovis subsp bovis AF2122/97
ugaauugcgcgcc

SEQ ID NO: 3078719 - RNA, 17 nt, Mycobacterium bovis subsp bovis AF2122/97
ugaauuucgaugaggug

SEQ ID NO: 3078720 - RNA, 19 nt, Mycobacterium bovis subsp bovis AF2122/97
ugacaacggccacaugcca

SEQ ID NO: 3078721 - RNA, 18 nt, Mycobacterium bovis subsp bovis AF2122/97
ugacaagcgauuuggcgu

SEQ ID NO: 3078722 - RNA, 14 nt, Mycobacterium bovis subsp bovis AF2122/97
ugacaaggaugguc

SEQ ID NO: 3078723 - RNA, 16 nt, Mycobacterium bovis subsp bovis AF2122/97
ugacacaacaccggcg

SEQ ID NO: 3078724 - RNA, 14 nt, Mycobacterium bovis subsp bovis AF2122/97
ugacacccaccucg

SEQ ID NO: 3078725 - RNA, 17 nt, Mycobacterium bovis subsp bovis AF2122/97
ugacacccaccucgcca

SEQ ID NO: 3078726 - RNA, 19 nt, Mycobacterium bovis subsp bovis AF2122/97
ugacacccaucgaccgccc

SEQ ID NO: 3078727 - RNA, 23 nt, Mycobacterium bovis subsp bovis AF2122/97
ugacacccaucgaccgcccgcca

SEQ ID NO: 3078728 - RNA, 17 nt, Mycobacterium bovis subsp bovis AF2122/97
ugacaccgaccgggucg

SEQ ID NO: 3078729 - RNA, 17 nt, Mycobacterium bovis subsp bovis AF2122/97
ugacaccgaggucggcc

SEQ ID NO: 3078730 - RNA, 22 nt, Mycobacterium bovis subsp bovis AF2122/97
ugacaccgauccggccgccgau

SEQ ID NO: 3078731 - RNA, 13 nt, Mycobacterium bovis subsp bovis AF2122/97
ugacaccggccac

SEQ ID NO: 3078732 - RNA, 18 nt, Mycobacterium bovis subsp bovis AF2122/97
ugacaccggccaccagcc

SEQ ID NO: 3078733 - RNA, 20 nt, Mycobacterium bovis subsp bovis AF2122/97
ugacaccggccaccagcccg

SEQ ID NO: 3078734 - RNA, 22 nt, Mycobacterium bovis subsp bovis AF2122/97
ugacaccggccaccagcccgau

SEQ ID NO: 3078735 - RNA, 18 nt, Mycobacterium bovis subsp bovis AF2122/97
ugacaccggggacgucga

SEQ ID NO: 3078736 - RNA, 20 nt, Mycobacterium bovis subsp bovis AF2122/97
ugacacgacgugcaggaaca

SEQ ID NO: 3078737 - RNA, 18 nt, Mycobacterium bovis subsp bovis AF2122/97
ugacacgaugcccggcau

SEQ ID NO: 3078738 - RNA, 17 nt, Mycobacterium bovis subsp bovis AF2122/97
ugacacuggggugcugc

SEQ ID NO: 3078739 - RNA, 21 nt, Mycobacterium bovis subsp bovis AF2122/97
ugacagacaucgcgacgaucg

SEQ ID NO: 3078740 - RNA, 15 nt, Mycobacterium bovis subsp bovis AF2122/97
ugacagccccgccgc

SEQ ID NO: 3078741 - RNA, 20 nt, Mycobacterium bovis subsp bovis AF2122/97
ugacagcuuucuuggcgggc

SEQ ID NO: 3078742 - RNA, 15 nt, Mycobacterium bovis subsp bovis AF2122/97
ugacagggcggcaac

SEQ ID NO: 3078743 - RNA, 23 nt, Mycobacterium bovis subsp bovis AF2122/97
ugacagggcggcaaccucaugca

SEQ ID NO: 3078744 - RNA, 20 nt, Mycobacterium bovis subsp bovis AF2122/97
ugacauagaccucgccggug

SEQ ID NO: 3078745 - RNA, 18 nt, Mycobacterium bovis subsp bovis AF2122/97
ugacauagguaugcccgg

SEQ ID NO: 3078746 - RNA, 20 nt, Mycobacterium bovis subsp bovis AF2122/97
ugacauccuugacgcggcca

SEQ ID NO: 3078747 - RNA, 14 nt, Mycobacterium bovis subsp bovis AF2122/97
ugacaucggccaag

SEQ ID NO: 3078748 - RNA, 22 nt, Mycobacterium bovis subsp bovis AF2122/97
ugacaucggccaagguugucgc

SEQ ID NO: 3078749 - RNA, 15 nt, Mycobacterium bovis subsp bovis AF2122/97
ugacaucggucagca

SEQ ID NO: 3078750 - RNA, 19 nt, Mycobacterium bovis subsp bovis AF2122/97
ugacaucgucgccagggcc

SEQ ID NO: 3078751 - RNA, 16 nt, Mycobacterium bovis subsp bovis AF2122/97
ugacauuuccaccacg

SEQ ID NO: 3078752 - RNA, 23 nt, Mycobacterium bovis subsp bovis AF2122/97
ugaccaaugucagugccccgccc

SEQ ID NO: 3078753 - RNA, 16 nt, Mycobacterium bovis subsp bovis AF2122/97
ugaccaaugugccggu

SEQ ID NO: 3078754 - RNA, 20 nt, Mycobacterium bovis subsp bovis AF2122/97
ugaccacaaccgugagcacc

SEQ ID NO: 3078755 - RNA, 12 nt, Mycobacterium bovis subsp bovis AF2122/97
ugaccaccgccg

SEQ ID NO: 3078756 - RNA, 14 nt, Mycobacterium bovis subsp bovis AF2122/97
ugaccacgccgacg

SEQ ID NO: 3078757 - RNA, 17 nt, Mycobacterium bovis subsp bovis AF2122/97
ugaccacgcugcuggug

SEQ ID NO: 3078758 - RNA, 14 nt, Mycobacterium bovis subsp bovis AF2122/97
ugaccacgucggac

SEQ ID NO: 3078759 - RNA, 17 nt, Mycobacterium bovis subsp bovis AF2122/97
ugaccagaaccuggagc

SEQ ID NO: 3078760 - RNA, 15 nt, Mycobacterium bovis subsp bovis AF2122/97
ugaccgggagucggu

SEQ ID NO: 3078761 - RNA, 17 nt, Mycobacterium bovis subsp bovis AF2122/97
ugaccgggucgaugacg

SEQ ID NO: 3078762 - RNA, 19 nt, Mycobacterium bovis subsp bovis AF2122/97
ugaccgggucgaugacgcc

SEQ ID NO: 3078763 - RNA, 18 nt, Mycobacterium bovis subsp bovis AF2122/97
ugaccgguauuaccgccg

SEQ ID NO: 3078764 - RNA, 22 nt, Mycobacterium bovis subsp bovis AF2122/97
ugaccgguauuaccgccguggc

SEQ ID NO: 3078765 - RNA, 18 nt, Mycobacterium bovis subsp bovis AF2122/97
ugaccgguucccgggcag

SEQ ID NO: 3078766 - RNA, 19 nt, Mycobacterium bovis subsp bovis AF2122/97
ugaccguauagccgacgcc

SEQ ID NO: 3078767 - RNA, 18 nt, Mycobacterium bovis subsp bovis AF2122/97
ugaccgucagcccgaacc

SEQ ID NO: 3078768 - RNA, 14 nt, Mycobacterium bovis subsp bovis AF2122/97
ugaccguccaccga

SEQ ID NO: 3078769 - RNA, 15 nt, Mycobacterium bovis subsp bovis AF2122/97
ugaccguccaccgac

SEQ ID NO: 3078770 - RNA, 17 nt, Mycobacterium bovis subsp bovis AF2122/97
ugaccgugccgucggcg

SEQ ID NO: 3078771 - RNA, 13 nt, Mycobacterium bovis subsp bovis AF2122/97
ugaccgugcugaa

SEQ ID NO: 3078772 - RNA, 14 nt, Mycobacterium bovis subsp bovis AF2122/97
ugaccuauugaacc

SEQ ID NO: 3078773 - RNA, 20 nt, Mycobacterium bovis subsp bovis AF2122/97
ugaccuauuugcgaccccgc

SEQ ID NO: 3078774 - RNA, 18 nt, Mycobacterium bovis subsp bovis AF2122/97
ugaccucauguccgccgu

SEQ ID NO: 3078775 - RNA, 13 nt, Mycobacterium bovis subsp bovis AF2122/97
ugaccucggcgac

SEQ ID NO: 3078776 - RNA, 15 nt, Mycobacterium bovis subsp bovis AF2122/97
ugaccucggcgacga

SEQ ID NO: 3078777 - RNA, 19 nt, Mycobacterium bovis subsp bovis AF2122/97
ugaccucgugguucugcag

SEQ ID NO: 3078778 - RNA, 17 nt, Mycobacterium bovis subsp bovis AF2122/97
ugaccugauccggccgg

SEQ ID NO: 3078779 - RNA, 15 nt, Mycobacterium bovis subsp bovis AF2122/97
ugaccugcagcgcau

SEQ ID NO: 3078780 - RNA, 13 nt, Mycobacterium bovis subsp bovis AF2122/97
ugaccugcuggcg

SEQ ID NO: 3078781 - RNA, 17 nt, Mycobacterium bovis subsp bovis AF2122/97
ugaccugggcgccccag

SEQ ID NO: 3078782 - RNA, 22 nt, Mycobacterium bovis subsp bovis AF2122/97
ugaccuguagaucagcagcggc

SEQ ID NO: 3078783 - RNA, 15 nt, Mycobacterium bovis subsp bovis AF2122/97
ugaccuugcccacca

SEQ ID NO: 3078784 - RNA, 17 nt, Mycobacterium bovis subsp bovis AF2122/97
ugaccuuguugaccacc

SEQ ID NO: 3078785 - RNA, 15 nt, Mycobacterium bovis subsp bovis AF2122/97
ugacgaaagcgccca

SEQ ID NO: 3078786 - RNA, 14 nt, Mycobacterium bovis subsp bovis AF2122/97
ugacgaacaagaaa

SEQ ID NO: 3078787 - RNA, 12 nt, Mycobacterium bovis subsp bovis AF2122/97
ugacgaacaugc

SEQ ID NO: 3078788 - RNA, 16 nt, Mycobacterium bovis subsp bovis AF2122/97
ugacgaacaugccaug

SEQ ID NO: 3078789 - RNA, 14 nt, Mycobacterium bovis subsp bovis AF2122/97
ugacgaacccaccg

SEQ ID NO: 3078790 - RNA, 17 nt, Mycobacterium bovis subsp bovis AF2122/97
ugacgaacuucgaugcc

SEQ ID NO: 3078791 - RNA, 20 nt, Mycobacterium bovis subsp bovis AF2122/97
ugacgaaggguauccgugug

SEQ ID NO: 3078792 - RNA, 23 nt, Mycobacterium bovis subsp bovis AF2122/97
ugacgaauccacuggucaacggg

SEQ ID NO: 3078793 - RNA, 14 nt, Mycobacterium bovis subsp bovis AF2122/97
ugacgaaucgccua

SEQ ID NO: 3078794 - RNA, 12 nt, Mycobacterium bovis subsp bovis AF2122/97
ugacgacaaacg

SEQ ID NO: 3078795 - RNA, 22 nt, Mycobacterium bovis subsp bovis AF2122/97
ugacgacaaacggcgacccagc

SEQ ID NO: 3078796 - RNA, 21 nt, Mycobacterium bovis subsp bovis AF2122/97
ugacgaccagccccgcugguc

SEQ ID NO: 3078797 - RNA, 18 nt, Mycobacterium bovis subsp bovis AF2122/97
ugacgaccgaucggcgcg

SEQ ID NO: 3078798 - RNA, 19 nt, Mycobacterium bovis subsp bovis AF2122/97
ugacgaccggcuaccggcg

SEQ ID NO: 3078799 - RNA, 22 nt, Mycobacterium bovis subsp bovis AF2122/97
ugacgacgagggccagcagccg

SEQ ID NO: 3078800 - RNA, 20 nt, Mycobacterium bovis subsp bovis AF2122/97
ugacgacgagggcgggaccc

SEQ ID NO: 3078801 - RNA, 12 nt, Mycobacterium bovis subsp bovis AF2122/97
ugacgacggcau

SEQ ID NO: 3078802 - RNA, 15 nt, Mycobacterium bovis subsp bovis AF2122/97
ugacgacggugaccg

SEQ ID NO: 3078803 - RNA, 15 nt, Mycobacterium bovis subsp bovis AF2122/97
ugacgacgucgccgc

SEQ ID NO: 3078804 - RNA, 17 nt, Mycobacterium bovis subsp bovis AF2122/97
ugacgacgucgccgccg

SEQ ID NO: 3078805 - RNA, 20 nt, Mycobacterium bovis subsp bovis AF2122/97
ugacgacgucgccgccgcgg

SEQ ID NO: 3078806 - RNA, 12 nt, Mycobacterium bovis subsp bovis AF2122/97
ugacgacugggc

SEQ ID NO: 3078807 - RNA, 13 nt, Mycobacterium bovis subsp bovis AF2122/97
ugacgagccacca

SEQ ID NO: 3078808 - RNA, 14 nt, Mycobacterium bovis subsp bovis AF2122/97
ugacgagccaccac

SEQ ID NO: 3078809 - RNA, 15 nt, Mycobacterium bovis subsp bovis AF2122/97
ugacgagccaccacc

SEQ ID NO: 3078810 - RNA, 16 nt, Mycobacterium bovis subsp bovis AF2122/97
ugacgagccaccaccg

SEQ ID NO: 3078811 - RNA, 16 nt, Mycobacterium bovis subsp bovis AF2122/97
ugacgagccgguggcg

SEQ ID NO: 3078812 - RNA, 19 nt, Mycobacterium bovis subsp bovis AF2122/97
ugacgaggcgagcggccag

SEQ ID NO: 3078813 - RNA, 23 nt, Mycobacterium bovis subsp bovis AF2122/97
ugacgaguugaugcaagcgggca

SEQ ID NO: 3078814 - RNA, 20 nt, Mycobacterium bovis subsp bovis AF2122/97
ugacgaucaggccgucgccg

SEQ ID NO: 3078815 - RNA, 19 nt, Mycobacterium bovis subsp bovis AF2122/97
ugacgaucaggucgccgag

SEQ ID NO: 3078816 - RNA, 20 nt, Mycobacterium bovis subsp bovis AF2122/97
ugacgaucaggucgccgaga

SEQ ID NO: 3078817 - RNA, 13 nt, Mycobacterium bovis subsp bovis AF2122/97
ugacgaucgcggc

SEQ ID NO: 3078818 - RNA, 16 nt, Mycobacterium bovis subsp bovis AF2122/97
ugacgaucgcggcggg

SEQ ID NO: 3078819 - RNA, 15 nt, Mycobacterium bovis subsp bovis AF2122/97
ugacgaucggcggcg

SEQ ID NO: 3078820 - RNA, 16 nt, Mycobacterium bovis subsp bovis AF2122/97
ugacgaucguagccgu

SEQ ID NO: 3078821 - RNA, 19 nt, Mycobacterium bovis subsp bovis AF2122/97
ugacgaugaccgcgcggcc

SEQ ID NO: 3078822 - RNA, 21 nt, Mycobacterium bovis subsp bovis AF2122/97
ugacgaugaccgcgcggcccg

SEQ ID NO: 3078823 - RNA, 12 nt, Mycobacterium bovis subsp bovis AF2122/97
ugacgaugccgc

SEQ ID NO: 3078824 - RNA, 16 nt, Mycobacterium bovis subsp bovis AF2122/97
ugacgaugccgccgaa

SEQ ID NO: 3078825 - RNA, 21 nt, Mycobacterium bovis subsp bovis AF2122/97
ugacgaugguguacugcugcu

SEQ ID NO: 3078826 - RNA, 15 nt, Mycobacterium bovis subsp bovis AF2122/97
ugacgauugccacca

SEQ ID NO: 3078827 - RNA, 16 nt, Mycobacterium bovis subsp bovis AF2122/97
ugacgauugccaccaa

SEQ ID NO: 3078828 - RNA, 16 nt, Mycobacterium bovis subsp bovis AF2122/97
ugacgcacagcagcac

SEQ ID NO: 3078829 - RNA, 20 nt, Mycobacterium bovis subsp bovis AF2122/97
ugacgcagcucgugaccgcc

SEQ ID NO: 3078830 - RNA, 13 nt, Mycobacterium bovis subsp bovis AF2122/97
ugacgccaacgug

SEQ ID NO: 3078831 - RNA, 17 nt, Mycobacterium bovis subsp bovis AF2122/97
ugacgccacgaccgccg

SEQ ID NO: 3078832 - RNA, 20 nt, Mycobacterium bovis subsp bovis AF2122/97
ugacgccauuguugggccgc

SEQ ID NO: 3078833 - RNA, 16 nt, Mycobacterium bovis subsp bovis AF2122/97
ugacgcccuccuggcg

SEQ ID NO: 3078834 - RNA, 14 nt, Mycobacterium bovis subsp bovis AF2122/97
ugacgccgagcugg

SEQ ID NO: 3078835 - RNA, 18 nt, Mycobacterium bovis subsp bovis AF2122/97
ugacgccgaugaagccaa

SEQ ID NO: 3078836 - RNA, 21 nt, Mycobacterium bovis subsp bovis AF2122/97
ugacgccgccagcaccucggc

SEQ ID NO: 3078837 - RNA, 14 nt, Mycobacterium bovis subsp bovis AF2122/97
ugacgccgucggcg

SEQ ID NO: 3078838 - RNA, 16 nt, Mycobacterium bovis subsp bovis AF2122/97
ugacgccgucggcgcg

SEQ ID NO: 3078839 - RNA, 18 nt, Mycobacterium bovis subsp bovis AF2122/97
ugacgccgucggcgcgca

SEQ ID NO: 3078840 - RNA, 16 nt, Mycobacterium bovis subsp bovis AF2122/97
ugacgccucgacaccc

SEQ ID NO: 3078841 - RNA, 20 nt, Mycobacterium bovis subsp bovis AF2122/97
ugacgccucgacacccagcc

SEQ ID NO: 3078842 - RNA, 15 nt, Mycobacterium bovis subsp bovis AF2122/97
ugacgcgacgagccg

SEQ ID NO: 3078843 - RNA, 24 nt, Mycobacterium bovis subsp bovis AF2122/97
ugacgcgcaacgccgccagccugg

SEQ ID NO: 3078844 - RNA, 13 nt, Mycobacterium bovis subsp bovis AF2122/97
ugacgcgcccgac

SEQ ID NO: 3078845 - RNA, 15 nt, Mycobacterium bovis subsp bovis AF2122/97
ugacgcgccguaaca

SEQ ID NO: 3078846 - RNA, 12 nt, Mycobacterium bovis subsp bovis AF2122/97
ugacgcgcucgc

SEQ ID NO: 3078847 - RNA, 12 nt, Mycobacterium bovis subsp bovis AF2122/97
ugagcaggugcc

SEQ ID NO: 3078848 - RNA, 22 nt, Mycobacterium bovis subsp bovis AF2122/97
ugagcaguucguuccagaugag

SEQ ID NO: 3078849 - RNA, 12 nt, Mycobacterium bovis subsp bovis AF2122/97
ugagcaucaccg

SEQ ID NO: 3078850 - RNA, 13 nt, Mycobacterium bovis subsp bovis AF2122/97
ugagcaugcccag

SEQ ID NO: 3078851 - RNA, 16 nt, Mycobacterium bovis subsp bovis AF2122/97
ugagcauggcuagggc

SEQ ID NO: 3078852 - RNA, 15 nt, Mycobacterium bovis subsp bovis AF2122/97
ugagccacagggaag

SEQ ID NO: 3078853 - RNA, 20 nt, Mycobacterium bovis subsp bovis AF2122/97
ugagccaccaacaccgcguc

SEQ ID NO: 3078854 - RNA, 21 nt, Mycobacterium bovis subsp bovis AF2122/97
ugagccaccaacaccgcguca

SEQ ID NO: 3078855 - RNA, 15 nt, Mycobacterium bovis subsp bovis AF2122/97
ugagccaccccgggu

SEQ ID NO: 3078856 - RNA, 23 nt, Mycobacterium bovis subsp bovis AF2122/97
ugagccaggcgguagucgucgac

SEQ ID NO: 3078857 - RNA, 15 nt, Mycobacterium bovis subsp bovis AF2122/97
ugagccaugccgcuc

SEQ ID NO: 3078858 - RNA, 14 nt, Mycobacterium bovis subsp bovis AF2122/97
ugagcccagccgcg

SEQ ID NO: 3078859 - RNA, 19 nt, Mycobacterium bovis subsp bovis AF2122/97
ugagcccagccgcgggccg

SEQ ID NO: 3078860 - RNA, 15 nt, Mycobacterium bovis subsp bovis AF2122/97
ugagcccgccgcgac

SEQ ID NO: 3078861 - RNA, 16 nt, Mycobacterium bovis subsp bovis AF2122/97
ugagcccgccgcgacc

SEQ ID NO: 3078862 - RNA, 17 nt, Mycobacterium bovis subsp bovis AF2122/97
ugagcccgccgcgacca

SEQ ID NO: 3078863 - RNA, 20 nt, Mycobacterium bovis subsp bovis AF2122/97
ugagcccguugaccugcgca

SEQ ID NO: 3078864 - RNA, 14 nt, Mycobacterium bovis subsp bovis AF2122/97
ugagccgagccagc

SEQ ID NO: 3078865 - RNA, 22 nt, Mycobacterium bovis subsp bovis AF2122/97
ugagccgcagcaccucgucgau

SEQ ID NO: 3078866 - RNA, 18 nt, Mycobacterium bovis subsp bovis AF2122/97
ugagccgcaucuggccgg

SEQ ID NO: 3078867 - RNA, 23 nt, Mycobacterium bovis subsp bovis AF2122/97
ugagccggaccggcuuccccagc

SEQ ID NO: 3078868 - RNA, 23 nt, Mycobacterium bovis subsp bovis AF2122/97
ugagccggcgccgccgugcgggu

SEQ ID NO: 3078869 - RNA, 17 nt, Mycobacterium bovis subsp bovis AF2122/97
ugagccggucuugcauc

SEQ ID NO: 3078870 - RNA, 15 nt, Mycobacterium bovis subsp bovis AF2122/97
ugagccgguggcccg

SEQ ID NO: 3078871 - RNA, 21 nt, Mycobacterium bovis subsp bovis AF2122/97
ugagcgaccgcgagggccagc

SEQ ID NO: 3078872 - RNA, 22 nt, Mycobacterium bovis subsp bovis AF2122/97
ugagcgacugcagcggcgcaua

SEQ ID NO: 3078873 - RNA, 15 nt, Mycobacterium bovis subsp bovis AF2122/97
ugagcgagcgcgcgu

SEQ ID NO: 3078874 - RNA, 22 nt, Mycobacterium bovis subsp bovis AF2122/97
ugagcgcaaccagcaaugccga

SEQ ID NO: 3078875 - RNA, 16 nt, Mycobacterium bovis subsp bovis AF2122/97
ugagcgccacgccgag

SEQ ID NO: 3078876 - RNA, 14 nt, Mycobacterium bovis subsp bovis AF2122/97
ugagcgccgcggcg

SEQ ID NO: 3078877 - RNA, 23 nt, Mycobacterium bovis subsp bovis AF2122/97
ugagcgccgcuaauggauccagc

SEQ ID NO: 3078878 - RNA, 19 nt, Mycobacterium bovis subsp bovis AF2122/97
ugagcgcgcccaaccuggg

SEQ ID NO: 3078879 - RNA, 15 nt, Mycobacterium bovis subsp bovis AF2122/97
ugagcgcgcgcggug

SEQ ID NO: 3078880 - RNA, 13 nt, Mycobacterium bovis subsp bovis AF2122/97
ugagcgcgcuggc

SEQ ID NO: 3078881 - RNA, 21 nt, Mycobacterium bovis subsp bovis AF2122/97
ugagcgcggguggcagcggcg

SEQ ID NO: 3078882 - RNA, 15 nt, Mycobacterium bovis subsp bovis AF2122/97
ugagcgcucgggcaa

SEQ ID NO: 3078883 - RNA, 19 nt, Mycobacterium bovis subsp bovis AF2122/97
ugagcggacucgagucugc

SEQ ID NO: 3078884 - RNA, 22 nt, Mycobacterium bovis subsp bovis AF2122/97
ugagcggagcaauuccacgauc

SEQ ID NO: 3078885 - RNA, 23 nt, Mycobacterium bovis subsp bovis AF2122/97
ugagcggccaccguagccagcag

SEQ ID NO: 3078886 - RNA, 12 nt, Mycobacterium bovis subsp bovis AF2122/97
ugagcggccagc

SEQ ID NO: 3078887 - RNA, 14 nt, Mycobacterium bovis subsp bovis AF2122/97
ugagcggccggcau

SEQ ID NO: 3078888 - RNA, 19 nt, Mycobacterium bovis subsp bovis AF2122/97
ugagcgggcaacugcagca

SEQ ID NO: 3078889 - RNA, 19 nt, Mycobacterium bovis subsp bovis AF2122/97
ugagcgggcaagucgccca

SEQ ID NO: 3078890 - RNA, 17 nt, Mycobacterium bovis subsp bovis AF2122/97
ugagcgguaccccccag

SEQ ID NO: 3078891 - RNA, 23 nt, Mycobacterium bovis subsp bovis AF2122/97
ugagcguaggccagcgaguccuc

SEQ ID NO: 3078892 - RNA, 15 nt, Mycobacterium bovis subsp bovis AF2122/97
ugagcgucgcugacc

SEQ ID NO: 3078893 - RNA, 15 nt, Mycobacterium bovis subsp bovis AF2122/97
ugagcgugagcgccg

SEQ ID NO: 3078894 - RNA, 18 nt, Mycobacterium bovis subsp bovis AF2122/97
ugagcgugccgcagcggc

SEQ ID NO: 3078895 - RNA, 21 nt, Mycobacterium bovis subsp bovis AF2122/97
ugagcgugccgcagcggcggc

SEQ ID NO: 3078896 - RNA, 21 nt, Mycobacterium bovis subsp bovis AF2122/97
ugagcuagccguucggcugcc

SEQ ID NO: 3078897 - RNA, 22 nt, Mycobacterium bovis subsp bovis AF2122/97
ugagcuagccguucggcugccg

SEQ ID NO: 3078898 - RNA, 15 nt, Mycobacterium bovis subsp bovis AF2122/97
ugagcuaugcuggca

SEQ ID NO: 3078899 - RNA, 15 nt, Mycobacterium bovis subsp bovis AF2122/97
ugagcucccgcaaca

SEQ ID NO: 3078900 - RNA, 17 nt, Mycobacterium bovis subsp bovis AF2122/97
ugagcucccgccgggau

SEQ ID NO: 3078901 - RNA, 23 nt, Mycobacterium bovis subsp bovis AF2122/97
ugagcucgaugucagcggccgcg

SEQ ID NO: 3078902 - RNA, 20 nt, Mycobacterium bovis subsp bovis AF2122/97
ugagcucuucggacacagcc

SEQ ID NO: 3078903 - RNA, 19 nt, Mycobacterium bovis subsp bovis AF2122/97
ugagcugcucgccggccaa

SEQ ID NO: 3078904 - RNA, 13 nt, Mycobacterium bovis subsp bovis AF2122/97
ugagcuggcagcu

SEQ ID NO: 3078905 - RNA, 15 nt, Mycobacterium bovis subsp bovis AF2122/97
ugagcuucucgucgg

SEQ ID NO: 3078906 - RNA, 11 nt, Mycobacterium bovis subsp bovis AF2122/97
ugaggaagccc

SEQ ID NO: 3078907 - RNA, 15 nt, Mycobacterium bovis subsp bovis AF2122/97
ugaggaagcggccgg

SEQ ID NO: 3078908 - RNA, 15 nt, Mycobacterium bovis subsp bovis AF2122/97
ugaggaagcggcggc

SEQ ID NO: 3078909 - RNA, 16 nt, Mycobacterium bovis subsp bovis AF2122/97
ugaggaagcggcggca

SEQ ID NO: 3078910 - RNA, 18 nt, Mycobacterium bovis subsp bovis AF2122/97
ugaggacauccggcgccg

SEQ ID NO: 3078911 - RNA, 20 nt, Mycobacterium bovis subsp bovis AF2122/97
ugaggacuugcacgucggcu

SEQ ID NO: 3078912 - RNA, 22 nt, Mycobacterium bovis subsp bovis AF2122/97
ugaggacuugcacgucggcugc

SEQ ID NO: 3078913 - RNA, 14 nt, Mycobacterium bovis subsp bovis AF2122/97
ugaggaucagcgug

SEQ ID NO: 3078914 - RNA, 14 nt, Mycobacterium bovis subsp bovis AF2122/97
ugaggaucaugucc

SEQ ID NO: 3078915 - RNA, 16 nt, Mycobacterium bovis subsp bovis AF2122/97
ugaggaucccggccgg

SEQ ID NO: 3078916 - RNA, 14 nt, Mycobacterium bovis subsp bovis AF2122/97
ugaggcaccucggc

SEQ ID NO: 3078917 - RNA, 21 nt, Mycobacterium bovis subsp bovis AF2122/97
ugaggccggugaacggcagca

SEQ ID NO: 3078918 - RNA, 22 nt, Mycobacterium bovis subsp bovis AF2122/97
ugaggccggugaacggcagcac

SEQ ID NO: 3078919 - RNA, 15 nt, Mycobacterium bovis subsp bovis AF2122/97
ugaggcgcagcgcca

SEQ ID NO: 3078920 - RNA, 15 nt, Mycobacterium bovis subsp bovis AF2122/97
ugaggcgcuggcccg

SEQ ID NO: 3078921 - RNA, 15 nt, Mycobacterium bovis subsp bovis AF2122/97
ugaggcggcgacgac

SEQ ID NO: 3078922 - RNA, 19 nt, Mycobacterium bovis subsp bovis AF2122/97
ugaggcgggucgccgccau

SEQ ID NO: 3078923 - RNA, 13 nt, Mycobacterium bovis subsp bovis AF2122/97
ugaggcuggucug

SEQ ID NO: 3078924 - RNA, 16 nt, Mycobacterium bovis subsp bovis AF2122/97
ugaggcugugccccag

SEQ ID NO: 3078925 - RNA, 20 nt, Mycobacterium bovis subsp bovis AF2122/97
ugagggcggaaaaucggcug

SEQ ID NO: 3078926 - RNA, 20 nt, Mycobacterium bovis subsp bovis AF2122/97
ugagggcggaauaucggccg

SEQ ID NO: 3078927 - RNA, 21 nt, Mycobacterium bovis subsp bovis AF2122/97
ugagggcgucgucgaguuggc

SEQ ID NO: 3078928 - RNA, 19 nt, Mycobacterium bovis subsp bovis AF2122/97
ugagggcucgguggcgccg

SEQ ID NO: 3078929 - RNA, 20 nt, Mycobacterium bovis subsp bovis AF2122/97
ugagggugagccgagccagc

SEQ ID NO: 3078930 - RNA, 23 nt, Mycobacterium bovis subsp bovis AF2122/97
ugagguacuucauauaccgcucg

SEQ ID NO: 3078931 - RNA, 18 nt, Mycobacterium bovis subsp bovis AF2122/97
ugagguagccgaggucgc

SEQ ID NO: 3078932 - RNA, 16 nt, Mycobacterium bovis subsp bovis AF2122/97
ugagguagcugcgcgg

SEQ ID NO: 3078933 - RNA, 21 nt, Mycobacterium bovis subsp bovis AF2122/97
ugaucggcgaacccaccgcau

SEQ ID NO: 3078934 - RNA, 19 nt, Mycobacterium bovis subsp bovis AF2122/97
ugaucggcgaggucccggc

SEQ ID NO: 3078935 - RNA, 23 nt, Mycobacterium bovis subsp bovis AF2122/97
ugaucggcgaggucccggccgag

SEQ ID NO: 3078936 - RNA, 15 nt, Mycobacterium bovis subsp bovis AF2122/97
ugaucggcgcggccg

SEQ ID NO: 3078937 - RNA, 18 nt, Mycobacterium bovis subsp bovis AF2122/97
ugaucggcgcggccguag

SEQ ID NO: 3078938 - RNA, 18 nt, Mycobacterium bovis subsp bovis AF2122/97
ugaucggcggcaaccgcc

SEQ ID NO: 3078939 - RNA, 14 nt, Mycobacterium bovis subsp bovis AF2122/97
ugaucggcguccuu

SEQ ID NO: 3078940 - RNA, 21 nt, Mycobacterium bovis subsp bovis AF2122/97
ugaucggguacccaucugcuc

SEQ ID NO: 3078941 - RNA, 14 nt, Mycobacterium bovis subsp bovis AF2122/97
ugaucggugggcgg

SEQ ID NO: 3078942 - RNA, 17 nt, Mycobacterium bovis subsp bovis AF2122/97
ugaucgucccgcggcgc

SEQ ID NO: 3078943 - RNA, 16 nt, Mycobacterium bovis subsp bovis AF2122/97
ugaucguggcgaccac

SEQ ID NO: 3078944 - RNA, 21 nt, Mycobacterium bovis subsp bovis AF2122/97
ugaucguggcgaccacgauga

SEQ ID NO: 3078945 - RNA, 23 nt, Mycobacterium bovis subsp bovis AF2122/97
ugaucucacccagcucgcgcacc

SEQ ID NO: 3078946 - RNA, 17 nt, Mycobacterium bovis subsp bovis AF2122/97
ugaucucgccggugagc

SEQ ID NO: 3078947 - RNA, 21 nt, Mycobacterium bovis subsp bovis AF2122/97
ugaucucgccggugagccgga

SEQ ID NO: 3078948 - RNA, 13 nt, Mycobacterium bovis subsp bovis AF2122/97
ugaucucggcgaa

SEQ ID NO: 3078949 - RNA, 17 nt, Mycobacterium bovis subsp bovis AF2122/97
ugaucugagcgcgggug

SEQ ID NO: 3078950 - RNA, 19 nt, Mycobacterium bovis subsp bovis AF2122/97
ugaucugcuugccaccgcc

SEQ ID NO: 3078951 - RNA, 13 nt, Mycobacterium bovis subsp bovis AF2122/97
ugaucuggccacg

SEQ ID NO: 3078952 - RNA, 21 nt, Mycobacterium bovis subsp bovis AF2122/97
ugaucugggcugcggccgcga

SEQ ID NO: 3078953 - RNA, 21 nt, Mycobacterium bovis subsp bovis AF2122/97
ugaucugguauucaugcccgu

SEQ ID NO: 3078954 - RNA, 15 nt, Mycobacterium bovis subsp bovis AF2122/97
ugaucuggugcgcgg

SEQ ID NO: 3078955 - RNA, 17 nt, Mycobacterium bovis subsp bovis AF2122/97
ugaucugucagcgcggc

SEQ ID NO: 3078956 - RNA, 19 nt, Mycobacterium bovis subsp bovis AF2122/97
ugaucuugccacuccagga

SEQ ID NO: 3078957 - RNA, 18 nt, Mycobacterium bovis subsp bovis AF2122/97
ugaucuugccgcccuuga

SEQ ID NO: 3078958 - RNA, 18 nt, Mycobacterium bovis subsp bovis AF2122/97
ugaucuuggcccgggccc

SEQ ID NO: 3078959 - RNA, 17 nt, Mycobacterium bovis subsp bovis AF2122/97
ugaugaaacgcgccguc

SEQ ID NO: 3078960 - RNA, 18 nt, Mycobacterium bovis subsp bovis AF2122/97
ugaugaacaccggcgccu

SEQ ID NO: 3078961 - RNA, 18 nt, Mycobacterium bovis subsp bovis AF2122/97
ugaugaccaggucgguca

SEQ ID NO: 3078962 - RNA, 21 nt, Mycobacterium bovis subsp bovis AF2122/97
ugaugaccaggucggucaggu

SEQ ID NO: 3078963 - RNA, 22 nt, Mycobacterium bovis subsp bovis AF2122/97
ugaugaccgccaucgccaacac

SEQ ID NO: 3078964 - RNA, 13 nt, Mycobacterium bovis subsp bovis AF2122/97
ugaugaccgccgc

SEQ ID NO: 3078965 - RNA, 15 nt, Mycobacterium bovis subsp bovis AF2122/97
ugaugaccgccgccg

SEQ ID NO: 3078966 - RNA, 18 nt, Mycobacterium bovis subsp bovis AF2122/97
ugaugaccgccgccggau

SEQ ID NO: 3078967 - RNA, 21 nt, Mycobacterium bovis subsp bovis AF2122/97
ugaugaccguauagccgacgc

SEQ ID NO: 3078968 - RNA, 19 nt, Mycobacterium bovis subsp bovis AF2122/97
ugaugacgccgucggcgcg

SEQ ID NO: 3078969 - RNA, 23 nt, Mycobacterium bovis subsp bovis AF2122/97
ugaugacgccgucggcgcgcacc

SEQ ID NO: 3078970 - RNA, 14 nt, Mycobacterium bovis subsp bovis AF2122/97
ugaugacggcgucg

SEQ ID NO: 3078971 - RNA, 22 nt, Mycobacterium bovis subsp bovis AF2122/97
ugaugaucgguucgggacgcga

SEQ ID NO: 3078972 - RNA, 16 nt, Mycobacterium bovis subsp bovis AF2122/97
ugaugcaacgccaaaa

SEQ ID NO: 3078973 - RNA, 14 nt, Mycobacterium bovis subsp bovis AF2122/97
ugaugcaacucggc

SEQ ID NO: 3078974 - RNA, 17 nt, Mycobacterium bovis subsp bovis AF2122/97
ugaugcaacucggcaga

SEQ ID NO: 3078975 - RNA, 16 nt, Mycobacterium bovis subsp bovis AF2122/97
ugaugccacggcgucg

SEQ ID NO: 3078976 - RNA, 21 nt, Mycobacterium bovis subsp bovis AF2122/97
ugaugccaucaacgacuucgg

SEQ ID NO: 3078977 - RNA, 17 nt, Mycobacterium bovis subsp bovis AF2122/97
ugaugccgaugaccgcc

SEQ ID NO: 3078978 - RNA, 12 nt, Mycobacterium bovis subsp bovis AF2122/97
ugaugccgaugu

SEQ ID NO: 3078979 - RNA, 13 nt, Mycobacterium bovis subsp bovis AF2122/97
ugaugccgccgug

SEQ ID NO: 3078980 - RNA, 21 nt, Mycobacterium bovis subsp bovis AF2122/97
ugaugccguucggacccaccu

SEQ ID NO: 3078981 - RNA, 19 nt, Mycobacterium bovis subsp bovis AF2122/97
ugaugccuggucgcggggc

SEQ ID NO: 3078982 - RNA, 16 nt, Mycobacterium bovis subsp bovis AF2122/97
ugaugcgccccggagc

SEQ ID NO: 3078983 - RNA, 13 nt, Mycobacterium bovis subsp bovis AF2122/97
ugaugcggccgcg

SEQ ID NO: 3078984 - RNA, 14 nt, Mycobacterium bovis subsp bovis AF2122/97
ugaugcggccgcgg

SEQ ID NO: 3078985 - RNA, 12 nt, Mycobacterium bovis subsp bovis AF2122/97
ugaugcggccgg

SEQ ID NO: 3078986 - RNA, 16 nt, Mycobacterium bovis subsp bovis AF2122/97
ugaugcgggcucggcu

SEQ ID NO: 3078987 - RNA, 14 nt, Mycobacterium bovis subsp bovis AF2122/97
ugaugcucgaugcg

SEQ ID NO: 3078988 - RNA, 20 nt, Mycobacterium bovis subsp bovis AF2122/97
ugaugcugccggcaccaacc

SEQ ID NO: 3078989 - RNA, 17 nt, Mycobacterium bovis subsp bovis AF2122/97
ugauggacaccagccag

SEQ ID NO: 3078990 - RNA, 14 nt, Mycobacterium bovis subsp bovis AF2122/97
ugauggacagcugc

SEQ ID NO: 3078991 - RNA, 15 nt, Mycobacterium bovis subsp bovis AF2122/97
ugauggacggugcgc

SEQ ID NO: 3078992 - RNA, 14 nt, Mycobacterium bovis subsp bovis AF2122/97
ugauggaguggcug

SEQ ID NO: 3078993 - RNA, 14 nt, Mycobacterium bovis subsp bovis AF2122/97
ugauggccgcgccc

SEQ ID NO: 3078994 - RNA, 22 nt, Mycobacterium bovis subsp bovis AF2122/97
ugauggccucgcgaauccuggc

SEQ ID NO: 3078995 - RNA, 24 nt, Mycobacterium bovis subsp bovis AF2122/97
ugauggcguauagcaugccgcggc

SEQ ID NO: 3078996 - RNA, 20 nt, Mycobacterium bovis subsp bovis AF2122/97
ugauggcguuugccggccga

SEQ ID NO: 3078997 - RNA, 21 nt, Mycobacterium bovis subsp bovis AF2122/97
ugauggcguuugccggccgau

SEQ ID NO: 3078998 - RNA, 17 nt, Mycobacterium bovis subsp bovis AF2122/97
ugauggcuccggccgcg

SEQ ID NO: 3078999 - RNA, 18 nt, Mycobacterium bovis subsp bovis AF2122/97
ugauggcuccggccgcgu

SEQ ID NO: 3079000 - RNA, 19 nt, Mycobacterium bovis subsp bovis AF2122/97
ugaugggcauggugguggc

SEQ ID NO: 3079001 - RNA, 17 nt, Mycobacterium bovis subsp bovis AF2122/97
ugaugggggagccggug

SEQ ID NO: 3079002 - RNA, 19 nt, Mycobacterium bovis subsp bovis AF2122/97
ugaugggggagccggugac

SEQ ID NO: 3079003 - RNA, 23 nt, Mycobacterium bovis subsp bovis AF2122/97
ugaugggggugcacgccuugagc

SEQ ID NO: 3079004 - RNA, 14 nt, Mycobacterium bovis subsp bovis AF2122/97
ugaugggucaccuc

SEQ ID NO: 3079005 - RNA, 15 nt, Mycobacterium bovis subsp bovis AF2122/97
ugaugguaccgccac

SEQ ID NO: 3079006 - RNA, 18 nt, Mycobacterium bovis subsp bovis AF2122/97
ugauggucagcuggccgc

SEQ ID NO: 3079007 - RNA, 23 nt, Mycobacterium bovis subsp bovis AF2122/97
ugauggucuccaccaggugcgca

SEQ ID NO: 3079008 - RNA, 13 nt, Mycobacterium bovis subsp bovis AF2122/97
ugauggugccauc

SEQ ID NO: 3079009 - RNA, 16 nt, Mycobacterium bovis subsp bovis AF2122/97
ugaugguggcaacggg

SEQ ID NO: 3079010 - RNA, 18 nt, Mycobacterium bovis subsp bovis AF2122/97
ugaugguguacacgucgc

SEQ ID NO: 3079011 - RNA, 18 nt, Mycobacterium bovis subsp bovis AF2122/97
ugaugguguccucgucga

SEQ ID NO: 3079012 - RNA, 17 nt, Mycobacterium bovis subsp bovis AF2122/97
ugauggugugcagcagc

SEQ ID NO: 3079013 - RNA, 16 nt, Mycobacterium bovis subsp bovis AF2122/97
ugaugguucaugaaca

SEQ ID NO: 3079014 - RNA, 23 nt, Mycobacterium bovis subsp bovis AF2122/97
ugaugguucaugaacaucggccg

SEQ ID NO: 3079015 - RNA, 18 nt, Mycobacterium bovis subsp bovis AF2122/97
ugauguacccggcgacgu

SEQ ID NO: 3079016 - RNA, 17 nt, Mycobacterium bovis subsp bovis AF2122/97
ugauguagggcugcucc

SEQ ID NO: 3079017 - RNA, 17 nt, Mycobacterium bovis subsp bovis AF2122/97
ugaugucacccgcccga

SEQ ID NO: 3079018 - RNA, 17 nt, Mycobacterium bovis subsp bovis AF2122/97
ugauguccgcacaacga

SEQ ID NO: 3079019 - RNA, 21 nt, Mycobacterium bovis subsp bovis AF2122/97
ugcacgacgacaucgagccaa

SEQ ID NO: 3079020 - RNA, 16 nt, Mycobacterium bovis subsp bovis AF2122/97
ugcacgacgguguccg

SEQ ID NO: 3079021 - RNA, 17 nt, Mycobacterium bovis subsp bovis AF2122/97
ugcacgagugcggcgac

SEQ ID NO: 3079022 - RNA, 18 nt, Mycobacterium bovis subsp bovis AF2122/97
ugcacgcaccacaaucca

SEQ ID NO: 3079023 - RNA, 20 nt, Mycobacterium bovis subsp bovis AF2122/97
ugcacgcaccacaauccacg

SEQ ID NO: 3079024 - RNA, 23 nt, Mycobacterium bovis subsp bovis AF2122/97
ugcacgcccaggcgaccgcugag

SEQ ID NO: 3079025 - RNA, 15 nt, Mycobacterium bovis subsp bovis AF2122/97
ugcacgcccggcgug

SEQ ID NO: 3079026 - RNA, 13 nt, Mycobacterium bovis subsp bovis AF2122/97
ugcacgccggcgc

SEQ ID NO: 3079027 - RNA, 16 nt, Mycobacterium bovis subsp bovis AF2122/97
ugcacgcgcucgcgca

SEQ ID NO: 3079028 - RNA, 17 nt, Mycobacterium bovis subsp bovis AF2122/97
ugcacgcucggcgccgu

SEQ ID NO: 3079029 - RNA, 22 nt, Mycobacterium bovis subsp bovis AF2122/97
ugcacgcucugcgccacagcag

SEQ ID NO: 3079030 - RNA, 24 nt, Mycobacterium bovis subsp bovis AF2122/97
ugcacggacaguuccccgggcucg

SEQ ID NO: 3079031 - RNA, 21 nt, Mycobacterium bovis subsp bovis AF2122/97
ugcacggccaugaucacaccg

SEQ ID NO: 3079032 - RNA, 20 nt, Mycobacterium bovis subsp bovis AF2122/97
ugcacggccgagcagguucc

SEQ ID NO: 3079033 - RNA, 15 nt, Mycobacterium bovis subsp bovis AF2122/97
ugcacggcgaggccg

SEQ ID NO: 3079034 - RNA, 18 nt, Mycobacterium bovis subsp bovis AF2122/97
ugcacggggaccuuggcg

SEQ ID NO: 3079035 - RNA, 19 nt, Mycobacterium bovis subsp bovis AF2122/97
ugcacggggaccuuggcga

SEQ ID NO: 3079036 - RNA, 21 nt, Mycobacterium bovis subsp bovis AF2122/97
ugcacgguaucggugcugguc

SEQ ID NO: 3079037 - RNA, 19 nt, Mycobacterium bovis subsp bovis AF2122/97
ugcacggucaacgaucccg

SEQ ID NO: 3079038 - RNA, 18 nt, Mycobacterium bovis subsp bovis AF2122/97
ugcacggucaugccgccg

SEQ ID NO: 3079039 - RNA, 21 nt, Mycobacterium bovis subsp bovis AF2122/97
ugcacggucaugccgccgccg

SEQ ID NO: 3079040 - RNA, 23 nt, Mycobacterium bovis subsp bovis AF2122/97
ugcacggugcccagggcgaucug

SEQ ID NO: 3079041 - RNA, 12 nt, Mycobacterium bovis subsp bovis AF2122/97
ugcacgguggca

SEQ ID NO: 3079042 - RNA, 15 nt, Mycobacterium bovis subsp bovis AF2122/97
ugcacgucgagcagg

SEQ ID NO: 3079043 - RNA, 22 nt, Mycobacterium bovis subsp bovis AF2122/97
ugcacgucggcugccgcaaacg

SEQ ID NO: 3079044 - RNA, 12 nt, Mycobacterium bovis subsp bovis AF2122/97
ugcacgugaccc

SEQ ID NO: 3079045 - RNA, 14 nt, Mycobacterium bovis subsp bovis AF2122/97
ugcacuacaggguu

SEQ ID NO: 3079046 - RNA, 15 nt, Mycobacterium bovis subsp bovis AF2122/97
ugcacuacaggguug

SEQ ID NO: 3079047 - RNA, 23 nt, Mycobacterium bovis subsp bovis AF2122/97
ugcacucggcgcccuccuuggcg

SEQ ID NO: 3079048 - RNA, 18 nt, Mycobacterium bovis subsp bovis AF2122/97
ugcacugcgaacccugcg

SEQ ID NO: 3079049 - RNA, 19 nt, Mycobacterium bovis subsp bovis AF2122/97
ugcacuucggugccgugau

SEQ ID NO: 3079050 - RNA, 20 nt, Mycobacterium bovis subsp bovis AF2122/97
ugcagaaacagccgcagcgg

SEQ ID NO: 3079051 - RNA, 15 nt, Mycobacterium bovis subsp bovis AF2122/97
ugcagaaaggccaac

SEQ ID NO: 3079052 - RNA, 16 nt, Mycobacterium bovis subsp bovis AF2122/97
ugcagaauucggcgcg

SEQ ID NO: 3079053 - RNA, 21 nt, Mycobacterium bovis subsp bovis AF2122/97
ugcagacccgguaguccgcgc

SEQ ID NO: 3079054 - RNA, 18 nt, Mycobacterium bovis subsp bovis AF2122/97
ugcagaccuguccggcau

SEQ ID NO: 3079055 - RNA, 13 nt, Mycobacterium bovis subsp bovis AF2122/97
ugcagacgggugg

SEQ ID NO: 3079056 - RNA, 15 nt, Mycobacterium bovis subsp bovis AF2122/97
ugcagacucggcgau

SEQ ID NO: 3079057 - RNA, 16 nt, Mycobacterium bovis subsp bovis AF2122/97
ugcagacucggcgaua

SEQ ID NO: 3079058 - RNA, 18 nt, Mycobacterium bovis subsp bovis AF2122/97
ugcagaucgccccagcca

SEQ ID NO: 3079059 - RNA, 12 nt, Mycobacterium bovis subsp bovis AF2122/97
ugcagaucggcc

SEQ ID NO: 3079060 - RNA, 15 nt, Mycobacterium bovis subsp bovis AF2122/97
ugcagaucggccgga

SEQ ID NO: 3079061 - RNA, 16 nt, Mycobacterium bovis subsp bovis AF2122/97
ugcagaucguagugcg

SEQ ID NO: 3079062 - RNA, 20 nt, Mycobacterium bovis subsp bovis AF2122/97
ugcagaucguagugcgcgcc

SEQ ID NO: 3079063 - RNA, 19 nt, Mycobacterium bovis subsp bovis AF2122/97
ugcagcaauugcaccuucu

SEQ ID NO: 3079064 - RNA, 23 nt, Mycobacterium bovis subsp bovis AF2122/97
ugcagcaccagccacgccagcca

SEQ ID NO: 3079065 - RNA, 18 nt, Mycobacterium bovis subsp bovis AF2122/97
ugcagcacccccucggcu

SEQ ID NO: 3079066 - RNA, 19 nt, Mycobacterium bovis subsp bovis AF2122/97
ugcagcacccccucggcuu

SEQ ID NO: 3079067 - RNA, 12 nt, Mycobacterium bovis subsp bovis AF2122/97
ugcagcacgcgu

SEQ ID NO: 3079068 - RNA, 14 nt, Mycobacterium bovis subsp bovis AF2122/97
ugcagcacgcgugg

SEQ ID NO: 3079069 - RNA, 18 nt, Mycobacterium bovis subsp bovis AF2122/97
ugcagcacggcgccgcca

SEQ ID NO: 3079070 - RNA, 13 nt, Mycobacterium bovis subsp bovis AF2122/97
ugcagcacggcuu

SEQ ID NO: 3079071 - RNA, 13 nt, Mycobacterium bovis subsp bovis AF2122/97
ugcagcacguccg

SEQ ID NO: 3079072 - RNA, 17 nt, Mycobacterium bovis subsp bovis AF2122/97
ugcagcacguccgcgga

SEQ ID NO: 3079073 - RNA, 22 nt, Mycobacterium bovis subsp bovis AF2122/97
ugcagcacucggugucggccgc

SEQ ID NO: 3079074 - RNA, 18 nt, Mycobacterium bovis subsp bovis AF2122/97
ugcagcacuuggccagcu

SEQ ID NO: 3079075 - RNA, 11 nt, Mycobacterium bovis subsp bovis AF2122/97
ugcagcagcgc

SEQ ID NO: 3079076 - RNA, 13 nt, Mycobacterium bovis subsp bovis AF2122/97
ugcagcagcgcgc

SEQ ID NO: 3079077 - RNA, 17 nt, Mycobacterium bovis subsp bovis AF2122/97
ugcagccaaaucagaug

SEQ ID NO: 3079078 - RNA, 13 nt, Mycobacterium bovis subsp bovis AF2122/97
ugcagccacauac

SEQ ID NO: 3079079 - RNA, 21 nt, Mycobacterium bovis subsp bovis AF2122/97
ugcagccacauacaggcccgc

SEQ ID NO: 3079080 - RNA, 23 nt, Mycobacterium bovis subsp bovis AF2122/97
ugcagccagauucauuggccugg

SEQ ID NO: 3079081 - RNA, 17 nt, Mycobacterium bovis subsp bovis AF2122/97
ugcagcccaaggcgacg

SEQ ID NO: 3079082 - RNA, 12 nt, Mycobacterium bovis subsp bovis AF2122/97
ugcagcccgccg

SEQ ID NO: 3079083 - RNA, 23 nt, Mycobacterium bovis subsp bovis AF2122/97
ugcagcccgccggauccgccaga

SEQ ID NO: 3079084 - RNA, 17 nt, Mycobacterium bovis subsp bovis AF2122/97
ugcagcccgggcagcac

SEQ ID NO: 3079085 - RNA, 21 nt, Mycobacterium bovis subsp bovis AF2122/97
ugcagcccgggcagcaccagc

SEQ ID NO: 3079086 - RNA, 17 nt, Mycobacterium bovis subsp bovis AF2122/97
ugcagcccugcgcagcc

SEQ ID NO: 3079087 - RNA, 18 nt, Mycobacterium bovis subsp bovis AF2122/97
ugcagcccugcgcagccg

SEQ ID NO: 3079088 - RNA, 17 nt, Mycobacterium bovis subsp bovis AF2122/97
ugcagccgcaggugggc

SEQ ID NO: 3079089 - RNA, 13 nt, Mycobacterium bovis subsp bovis AF2122/97
ugcagccgggaaa

SEQ ID NO: 3079090 - RNA, 23 nt, Mycobacterium bovis subsp bovis AF2122/97
ugcagcgaaaugccggugccggg

SEQ ID NO: 3079091 - RNA, 16 nt, Mycobacterium bovis subsp bovis AF2122/97
ugcagcgauaucacaa

SEQ ID NO: 3079092 - RNA, 17 nt, Mycobacterium bovis subsp bovis AF2122/97
ugcagcgaucccggcaa

SEQ ID NO: 3079093 - RNA, 18 nt, Mycobacterium bovis subsp bovis AF2122/97
ugcagcgaugcggcguug

SEQ ID NO: 3079094 - RNA, 19 nt, Mycobacterium bovis subsp bovis AF2122/97
ugcagcgcacgcagccgau

SEQ ID NO: 3079095 - RNA, 20 nt, Mycobacterium bovis subsp bovis AF2122/97
ugcagcgcaggauucugcug

SEQ ID NO: 3079096 - RNA, 18 nt, Mycobacterium bovis subsp bovis AF2122/97
ugcagcgcgauggccugg

SEQ ID NO: 3079097 - RNA, 21 nt, Mycobacterium bovis subsp bovis AF2122/97
ugcagcgcgguggucagcacc

SEQ ID NO: 3079098 - RNA, 21 nt, Mycobacterium bovis subsp bovis AF2122/97
ugcagcggcgccgccaagggc

SEQ ID NO: 3079099 - RNA, 17 nt, Mycobacterium bovis subsp bovis AF2122/97
ugcagcggcuugcccag

SEQ ID NO: 3079100 - RNA, 20 nt, Mycobacterium bovis subsp bovis AF2122/97
ugcagcggcuugcccaggcg

SEQ ID NO: 3079101 - RNA, 22 nt, Mycobacterium bovis subsp bovis AF2122/97
ugcagcgggccacugagccaca

SEQ ID NO: 3079102 - RNA, 17 nt, Mycobacterium bovis subsp bovis AF2122/97
ugcagcuccccgccgga

SEQ ID NO: 3079103 - RNA, 19 nt, Mycobacterium bovis subsp bovis AF2122/97
ugcagcucgggcagggacc

SEQ ID NO: 3079104 - RNA, 16 nt, Mycobacterium bovis subsp bovis AF2122/97
ugcagcuuggcauuga

SEQ ID NO: 3079105 - RNA, 17 nt, Mycobacterium bovis subsp bovis AF2122/97
ugccacccaacagcgcu

SEQ ID NO: 3079106 - RNA, 14 nt, Mycobacterium bovis subsp bovis AF2122/97
ugccacccagcacg

SEQ ID NO: 3079107 - RNA, 16 nt, Mycobacterium bovis subsp bovis AF2122/97
ugccacccuugccgcc

SEQ ID NO: 3079108 - RNA, 18 nt, Mycobacterium bovis subsp bovis AF2122/97
ugccacccuugccgccgg

SEQ ID NO: 3079109 - RNA, 20 nt, Mycobacterium bovis subsp bovis AF2122/97
ugccacccuugccgccggug

SEQ ID NO: 3079110 - RNA, 21 nt, Mycobacterium bovis subsp bovis AF2122/97
ugccacccuugccgccggugg

SEQ ID NO: 3079111 - RNA, 14 nt, Mycobacterium bovis subsp bovis AF2122/97
ugccaccgccgccg

SEQ ID NO: 3079112 - RNA, 14 nt, Mycobacterium bovis subsp bovis AF2122/97
ugccaccgcggccg

SEQ ID NO: 3079113 - RNA, 16 nt, Mycobacterium bovis subsp bovis AF2122/97
ugccaccgcggccgcg

SEQ ID NO: 3079114 - RNA, 14 nt, Mycobacterium bovis subsp bovis AF2122/97
ugccaccgcggugg

SEQ ID NO: 3079115 - RNA, 22 nt, Mycobacterium bovis subsp bovis AF2122/97
ugccaccgcuugaccccuggcc

SEQ ID NO: 3079116 - RNA, 19 nt, Mycobacterium bovis subsp bovis AF2122/97
ugccaccggccggcgcagu

SEQ ID NO: 3079117 - RNA, 15 nt, Mycobacterium bovis subsp bovis AF2122/97
ugccaccggcuggug

SEQ ID NO: 3079118 - RNA, 18 nt, Mycobacterium bovis subsp bovis AF2122/97
ugccaccgguaccgccgg

SEQ ID NO: 3079119 - RNA, 12 nt, Mycobacterium bovis subsp bovis AF2122/97
ugccaccgugca

SEQ ID NO: 3079120 - RNA, 18 nt, Mycobacterium bovis subsp bovis AF2122/97
ugccaccguugggccgac

SEQ ID NO: 3079121 - RNA, 22 nt, Mycobacterium bovis subsp bovis AF2122/97
ugccacgacgaacaccagcgcg

SEQ ID NO: 3079122 - RNA, 16 nt, Mycobacterium bovis subsp bovis AF2122/97
ugccacgaucggcggg

SEQ ID NO: 3079123 - RNA, 19 nt, Mycobacterium bovis subsp bovis AF2122/97
ugccacgaucggcgggggu

SEQ ID NO: 3079124 - RNA, 14 nt, Mycobacterium bovis subsp bovis AF2122/97
ugccacgccgccgg

SEQ ID NO: 3079125 - RNA, 16 nt, Mycobacterium bovis subsp bovis AF2122/97
ugccacgccgccggug

SEQ ID NO: 3079126 - RNA, 20 nt, Mycobacterium bovis subsp bovis AF2122/97
ugccacgccugagccaccaa

SEQ ID NO: 3079127 - RNA, 19 nt, Mycobacterium bovis subsp bovis AF2122/97
ugccacgcgugacucggcc

SEQ ID NO: 3079128 - RNA, 21 nt, Mycobacterium bovis subsp bovis AF2122/97
ugccacgcguuccuccagcag

SEQ ID NO: 3079129 - RNA, 22 nt, Mycobacterium bovis subsp bovis AF2122/97
ugccacgcucggugcugcgccg

SEQ ID NO: 3079130 - RNA, 23 nt, Mycobacterium bovis subsp bovis AF2122/97
ugccacggcaagccaaccagccc

SEQ ID NO: 3079131 - RNA, 22 nt, Mycobacterium bovis subsp bovis AF2122/97
ugccacggcgccuacaccggcg

SEQ ID NO: 3079132 - RNA, 23 nt, Mycobacterium bovis subsp bovis AF2122/97
ugccacggcgccuacaccggcgc

SEQ ID NO: 3079133 - RNA, 23 nt, Mycobacterium bovis subsp bovis AF2122/97
ugccacggugacccugguggugc

SEQ ID NO: 3079134 - RNA, 17 nt, Mycobacterium bovis subsp bovis AF2122/97
ugccacguucgcgggcg

SEQ ID NO: 3079135 - RNA, 17 nt, Mycobacterium bovis subsp bovis AF2122/97
ugccacucgaugcuuuc

SEQ ID NO: 3079136 - RNA, 18 nt, Mycobacterium bovis subsp bovis AF2122/97
ugccacugccguugccgc

SEQ ID NO: 3079137 - RNA, 19 nt, Mycobacterium bovis subsp bovis AF2122/97
ugccacugccguugccgcc

SEQ ID NO: 3079138 - RNA, 21 nt, Mycobacterium bovis subsp bovis AF2122/97
ugccacugccguugccgccgg

SEQ ID NO: 3079139 - RNA, 19 nt, Mycobacterium bovis subsp bovis AF2122/97
ugccacuuccacggcgugg

SEQ ID NO: 3079140 - RNA, 15 nt, Mycobacterium bovis subsp bovis AF2122/97
ugccacuuggacgaa

SEQ ID NO: 3079141 - RNA, 14 nt, Mycobacterium bovis subsp bovis AF2122/97
ugccagaccagggc

SEQ ID NO: 3079142 - RNA, 22 nt, Mycobacterium bovis subsp bovis AF2122/97
ugccagaccagggcagcggcca

SEQ ID NO: 3079143 - RNA, 14 nt, Mycobacterium bovis subsp bovis AF2122/97
ugccagaucagcac

SEQ ID NO: 3079144 - RNA, 18 nt, Mycobacterium bovis subsp bovis AF2122/97
ugccagaucggucggcca

SEQ ID NO: 3079145 - RNA, 11 nt, Mycobacterium bovis subsp bovis AF2122/97
ugccagcacca

SEQ ID NO: 3079146 - RNA, 16 nt, Mycobacterium bovis subsp bovis AF2122/97
ugccagcagcaaucag

SEQ ID NO: 3079147 - RNA, 14 nt, Mycobacterium bovis subsp bovis AF2122/97
ugccagcagcagcg

SEQ ID NO: 3079148 - RNA, 17 nt, Mycobacterium bovis subsp bovis AF2122/97
ugccagcagcagcgccg

SEQ ID NO: 3079149 - RNA, 19 nt, Mycobacterium bovis subsp bovis AF2122/97
ugccagcagcagcgccgcg

SEQ ID NO: 3079150 - RNA, 22 nt, Mycobacterium bovis subsp bovis AF2122/97
ugccagcagcagcgccgcgugg

SEQ ID NO: 3079151 - RNA, 19 nt, Mycobacterium bovis subsp bovis AF2122/97
ugccagcaggccgaagaaa

SEQ ID NO: 3079152 - RNA, 17 nt, Mycobacterium bovis subsp bovis AF2122/97
ugccagccacgaacuga

SEQ ID NO: 3079153 - RNA, 14 nt, Mycobacterium bovis subsp bovis AF2122/97
ugccagccauggcc

SEQ ID NO: 3079154 - RNA, 12 nt, Mycobacterium bovis subsp bovis AF2122/97
ugccagccgguc

SEQ ID NO: 3079155 - RNA, 19 nt, Mycobacterium bovis subsp bovis AF2122/97
ugccagcgccgccgccgac

SEQ ID NO: 3079156 - RNA, 16 nt, Mycobacterium bovis subsp bovis AF2122/97
ugccagcggcacaccc

SEQ ID NO: 3079157 - RNA, 16 nt, Mycobacterium bovis subsp bovis AF2122/97
ugccagcggccgggcg

SEQ ID NO: 3079158 - RNA, 16 nt, Mycobacterium bovis subsp bovis AF2122/97
ugccagcuguugcggg

SEQ ID NO: 3079159 - RNA, 14 nt, Mycobacterium bovis subsp bovis AF2122/97
ugccaggaccgcgc

SEQ ID NO: 3079160 - RNA, 20 nt, Mycobacterium bovis subsp bovis AF2122/97
ugccaggacuggcaccgcca

SEQ ID NO: 3079161 - RNA, 16 nt, Mycobacterium bovis subsp bovis AF2122/97
ugccaggaucgcggcg

SEQ ID NO: 3079162 - RNA, 12 nt, Mycobacterium bovis subsp bovis AF2122/97
ugccaggcccgu

SEQ ID NO: 3079163 - RNA, 13 nt, Mycobacterium bovis subsp bovis AF2122/97
ugccaggccgcug

SEQ ID NO: 3079164 - RNA, 18 nt, Mycobacterium bovis subsp bovis AF2122/97
ugccaggugcuguuuggu

SEQ ID NO: 3079165 - RNA, 15 nt, Mycobacterium bovis subsp bovis AF2122/97
ugccaggugggugaa

SEQ ID NO: 3079166 - RNA, 14 nt, Mycobacterium bovis subsp bovis AF2122/97
ugccaguccgcagc

SEQ ID NO: 3079167 - RNA, 19 nt, Mycobacterium bovis subsp bovis AF2122/97
ugccagucgaucgcggccc

SEQ ID NO: 3079168 - RNA, 22 nt, Mycobacterium bovis subsp bovis AF2122/97
ugccagucgaucgcggcccgca

SEQ ID NO: 3079169 - RNA, 17 nt, Mycobacterium bovis subsp bovis AF2122/97
ugccagugcaucgguca

SEQ ID NO: 3079170 - RNA, 20 nt, Mycobacterium bovis subsp bovis AF2122/97
ugccagugccagcguccguc

SEQ ID NO: 3079171 - RNA, 16 nt, Mycobacterium bovis subsp bovis AF2122/97
ugccagugccgcccac

SEQ ID NO: 3079172 - RNA, 20 nt, Mycobacterium bovis subsp bovis AF2122/97
ugccagugccgcccaccaca

SEQ ID NO: 3079173 - RNA, 23 nt, Mycobacterium bovis subsp bovis AF2122/97
ugccagugccgcccaccacacag

SEQ ID NO: 3079174 - RNA, 19 nt, Mycobacterium bovis subsp bovis AF2122/97
ugccagugcgcagcccgca

SEQ ID NO: 3079175 - RNA, 15 nt, Mycobacterium bovis subsp bovis AF2122/97
ugccagugcugcacc

SEQ ID NO: 3079176 - RNA, 15 nt, Mycobacterium bovis subsp bovis AF2122/97
ugccagugggccgac

SEQ ID NO: 3079177 - RNA, 19 nt, Mycobacterium bovis subsp bovis AF2122/97
ugccagugggccgacguga

SEQ ID NO: 3079178 - RNA, 17 nt, Mycobacterium bovis subsp bovis AF2122/97
ugccaguucuuggcgac

SEQ ID NO: 3079179 - RNA, 21 nt, Mycobacterium bovis subsp bovis AF2122/97
ugccauacagcaccccgccgg

SEQ ID NO: 3079180 - RNA, 17 nt, Mycobacterium bovis subsp bovis AF2122/97
ugccaucaaggccaccu

SEQ ID NO: 3079181 - RNA, 19 nt, Mycobacterium bovis subsp bovis AF2122/97
ugccauccuuaugcgcggu

SEQ ID NO: 3079182 - RNA, 22 nt, Mycobacterium bovis subsp bovis AF2122/97
ugccaucgcggcguugugaccg

SEQ ID NO: 3079183 - RNA, 12 nt, Mycobacterium bovis subsp bovis AF2122/97
ugccaucggcac

SEQ ID NO: 3079184 - RNA, 17 nt, Mycobacterium bovis subsp bovis AF2122/97
ugccaucggcaccagcg

SEQ ID NO: 3079185 - RNA, 18 nt, Mycobacterium bovis subsp bovis AF2122/97
ugccaucggcaccagcgc

SEQ ID NO: 3079186 - RNA, 18 nt, Mycobacterium bovis subsp bovis AF2122/97
ugccaucgggaccgggga

SEQ ID NO: 3079187 - RNA, 14 nt, Mycobacterium bovis subsp bovis AF2122/97
ugccaucgggcgcg

SEQ ID NO: 3079188 - RNA, 15 nt, Mycobacterium bovis subsp bovis AF2122/97
ugccaucgguggugg

SEQ ID NO: 3079189 - RNA, 14 nt, Mycobacterium bovis subsp bovis AF2122/97
ugccaucuccggug

SEQ ID NO: 3079190 - RNA, 22 nt, Mycobacterium bovis subsp bovis AF2122/97
ugccauugccucccgcgccggc

SEQ ID NO: 3079191 - RNA, 11 nt, Mycobacterium bovis subsp bovis AF2122/97
ugcccgccguu

SEQ ID NO: 3079192 - RNA, 20 nt, Mycobacterium bovis subsp bovis AF2122/97
ugcccgcgaacgaucccgcc

SEQ ID NO: 3079193 - RNA, 20 nt, Mycobacterium bovis subsp bovis AF2122/97
ugcccgcgcucgcacccgcu

SEQ ID NO: 3079194 - RNA, 24 nt, Mycobacterium bovis subsp bovis AF2122/97
ugcccgcggugacgagcacaugcu

SEQ ID NO: 3079195 - RNA, 14 nt, Mycobacterium bovis subsp bovis AF2122/97
ugcccgcguugcca

SEQ ID NO: 3079196 - RNA, 19 nt, Mycobacterium bovis subsp bovis AF2122/97
ugcccgcguugccaaagcc

SEQ ID NO: 3079197 - RNA, 21 nt, Mycobacterium bovis subsp bovis AF2122/97
ugcccggacgauggcgucggc

SEQ ID NO: 3079198 - RNA, 23 nt, Mycobacterium bovis subsp bovis AF2122/97
ugcccggacgauggcgucggcca

SEQ ID NO: 3079199 - RNA, 18 nt, Mycobacterium bovis subsp bovis AF2122/97
ugcccggcaaccuggacu

SEQ ID NO: 3079200 - RNA, 14 nt, Mycobacterium bovis subsp bovis AF2122/97
ugcccggcacggug

SEQ ID NO: 3079201 - RNA, 19 nt, Mycobacterium bovis subsp bovis AF2122/97
ugcccggcccgcucagccg

SEQ ID NO: 3079202 - RNA, 11 nt, Mycobacterium bovis subsp bovis AF2122/97
ugcccggccgc

SEQ ID NO: 3079203 - RNA, 12 nt, Mycobacterium bovis subsp bovis AF2122/97
ugcccggccgcc

SEQ ID NO: 3079204 - RNA, 21 nt, Mycobacterium bovis subsp bovis AF2122/97
ugcccggccgccagcgcgccg

SEQ ID NO: 3079205 - RNA, 23 nt, Mycobacterium bovis subsp bovis AF2122/97
ugcccggcgccguagugcgcauc

SEQ ID NO: 3079206 - RNA, 14 nt, Mycobacterium bovis subsp bovis AF2122/97
ugcccggcgcgaag

SEQ ID NO: 3079207 - RNA, 18 nt, Mycobacterium bovis subsp bovis AF2122/97
ugcccggcggccaacgac

SEQ ID NO: 3079208 - RNA, 17 nt, Mycobacterium bovis subsp bovis AF2122/97
ugcccgggcccgucguc

SEQ ID NO: 3079209 - RNA, 19 nt, Mycobacterium bovis subsp bovis AF2122/97
ugcccgggcggucgaagac

SEQ ID NO: 3079210 - RNA, 22 nt, Mycobacterium bovis subsp bovis AF2122/97
ugcccgggguauucccgcagau

SEQ ID NO: 3079211 - RNA, 12 nt, Mycobacterium bovis subsp bovis AF2122/97
ugcccgggucgg

SEQ ID NO: 3079212 - RNA, 14 nt, Mycobacterium bovis subsp bovis AF2122/97
ugcccgggucggcc

SEQ ID NO: 3079213 - RNA, 16 nt, Mycobacterium bovis subsp bovis AF2122/97
ugcccgggucggccgg

SEQ ID NO: 3079214 - RNA, 21 nt, Mycobacterium bovis subsp bovis AF2122/97
ugcccggucuauuugccugcc

SEQ ID NO: 3079215 - RNA, 15 nt, Mycobacterium bovis subsp bovis AF2122/97
ugcccgguuucuucu

SEQ ID NO: 3079216 - RNA, 15 nt, Mycobacterium bovis subsp bovis AF2122/97
ugcccgucccgcucg

SEQ ID NO: 3079217 - RNA, 16 nt, Mycobacterium bovis subsp bovis AF2122/97
ugcccguggugauggu

SEQ ID NO: 3079218 - RNA, 22 nt, Mycobacterium bovis subsp bovis AF2122/97
ugcccguguuaaagaagccuga

SEQ ID NO: 3079219 - RNA, 20 nt, Mycobacterium bovis subsp bovis AF2122/97
ugcccguucaugcggcggcg

SEQ ID NO: 3079220 - RNA, 22 nt, Mycobacterium bovis subsp bovis AF2122/97
ugcccguucaugcggcggcgcu

SEQ ID NO: 3079221 - RNA, 18 nt, Mycobacterium bovis subsp bovis AF2122/97
ugcccguucugcccaggc

SEQ ID NO: 3079222 - RNA, 14 nt, Mycobacterium bovis subsp bovis AF2122/97
ugcccuagcagcaa

SEQ ID NO: 3079223 - RNA, 16 nt, Mycobacterium bovis subsp bovis AF2122/97
ugcccucaacgaucgc

SEQ ID NO: 3079224 - RNA, 20 nt, Mycobacterium bovis subsp bovis AF2122/97
ugcccucaacgaucgcgccg

SEQ ID NO: 3079225 - RNA, 21 nt, Mycobacterium bovis subsp bovis AF2122/97
ugcccuccggguauggcggcg

SEQ ID NO: 3079226 - RNA, 15 nt, Mycobacterium bovis subsp bovis AF2122/97
ugcccuccgugggca

SEQ ID NO: 3079227 - RNA, 13 nt, Mycobacterium bovis subsp bovis AF2122/97
ugcccucggccgc

SEQ ID NO: 3079228 - RNA, 14 nt, Mycobacterium bovis subsp bovis AF2122/97
ugcccucggccgcc

SEQ ID NO: 3079229 - RNA, 18 nt, Mycobacterium bovis subsp bovis AF2122/97
ugcccugacgccccgcca

SEQ ID NO: 3079230 - RNA, 21 nt, Mycobacterium bovis subsp bovis AF2122/97
ugcccugcacuucgggauaag

SEQ ID NO: 3079231 - RNA, 19 nt, Mycobacterium bovis subsp bovis AF2122/97
ugcccugcauaggcgcggu

SEQ ID NO: 3079232 - RNA, 22 nt, Mycobacterium bovis subsp bovis AF2122/97
ugcccugccggcagcggcgagu

SEQ ID NO: 3079233 - RNA, 16 nt, Mycobacterium bovis subsp bovis AF2122/97
ugcccugcgugcagau

SEQ ID NO: 3079234 - RNA, 17 nt, Mycobacterium bovis subsp bovis AF2122/97
ugcccuggaccagcggg

SEQ ID NO: 3079235 - RNA, 16 nt, Mycobacterium bovis subsp bovis AF2122/97
ugcccugggugauggc

SEQ ID NO: 3079236 - RNA, 18 nt, Mycobacterium bovis subsp bovis AF2122/97
ugcccuucuucgaccgcg

SEQ ID NO: 3079237 - RNA, 14 nt, Mycobacterium bovis subsp bovis AF2122/97
ugcccuugaagaaa

SEQ ID NO: 3079238 - RNA, 16 nt, Mycobacterium bovis subsp bovis AF2122/97
ugcccuugcggaagaa

SEQ ID NO: 3079239 - RNA, 14 nt, Mycobacterium bovis subsp bovis AF2122/97
ugcccuuggccagc

SEQ ID NO: 3079240 - RNA, 15 nt, Mycobacterium bovis subsp bovis AF2122/97
ugcccuuucccaccu

SEQ ID NO: 3079241 - RNA, 17 nt, Mycobacterium bovis subsp bovis AF2122/97
ugcccuuucccaccuuc

SEQ ID NO: 3079242 - RNA, 22 nt, Mycobacterium bovis subsp bovis AF2122/97
ugcccuuucccaccuucaguuu

SEQ ID NO: 3079243 - RNA, 15 nt, Mycobacterium bovis subsp bovis AF2122/97
ugccgaaaaucgcag

SEQ ID NO: 3079244 - RNA, 17 nt, Mycobacterium bovis subsp bovis AF2122/97
ugccgaaacccgaguuc

SEQ ID NO: 3079245 - RNA, 19 nt, Mycobacterium bovis subsp bovis AF2122/97
ugccgaaacgccgaccgcg

SEQ ID NO: 3079246 - RNA, 20 nt, Mycobacterium bovis subsp bovis AF2122/97
ugccgaaacgccgaccgcgc

SEQ ID NO: 3079247 - RNA, 19 nt, Mycobacterium bovis subsp bovis AF2122/97
ugccgaacaguucggcgag

SEQ ID NO: 3079248 - RNA, 20 nt, Mycobacterium bovis subsp bovis AF2122/97
ugccgaaccacgcgcccgca

SEQ ID NO: 3079249 - RNA, 16 nt, Mycobacterium bovis subsp bovis AF2122/97
ugccgaacccggcgga

SEQ ID NO: 3079250 - RNA, 14 nt, Mycobacterium bovis subsp bovis AF2122/97
ugccgaaccggcgc

SEQ ID NO: 3079251 - RNA, 17 nt, Mycobacterium bovis subsp bovis AF2122/97
ugccgaacgccagaccg

SEQ ID NO: 3079252 - RNA, 15 nt, Mycobacterium bovis subsp bovis AF2122/97
ugccgaagaugaccg

SEQ ID NO: 3079253 - RNA, 17 nt, Mycobacterium bovis subsp bovis AF2122/97
ugccgaagcccgagcuc

SEQ ID NO: 3079254 - RNA, 16 nt, Mycobacterium bovis subsp bovis AF2122/97
ugccgaagcggccacc

SEQ ID NO: 3079255 - RNA, 20 nt, Mycobacterium bovis subsp bovis AF2122/97
ugccgaagcugcccaaccgg

SEQ ID NO: 3079256 - RNA, 13 nt, Mycobacterium bovis subsp bovis AF2122/97
ugccgaaguugaa

SEQ ID NO: 3079257 - RNA, 19 nt, Mycobacterium bovis subsp bovis AF2122/97
ugccgaaguugaagaagcc

SEQ ID NO: 3079258 - RNA, 15 nt, Mycobacterium bovis subsp bovis AF2122/97
ugccgaauugggcga

SEQ ID NO: 3079259 - RNA, 15 nt, Mycobacterium bovis subsp bovis AF2122/97
ugccgacccgccgcg

SEQ ID NO: 3079260 - RNA, 17 nt, Mycobacterium bovis subsp bovis AF2122/97
ugccgaccgauacaccg

SEQ ID NO: 3079261 - RNA, 21 nt, Mycobacterium bovis subsp bovis AF2122/97
ugccgacgaacgaaccgccgc

SEQ ID NO: 3079262 - RNA, 21 nt, Mycobacterium bovis subsp bovis AF2122/97
ugccgacgaggggcgcgggug

SEQ ID NO: 3079263 - RNA, 21 nt, Mycobacterium bovis subsp bovis AF2122/97
ugccgacgaucgacgccgcca

SEQ ID NO: 3079264 - RNA, 14 nt, Mycobacterium bovis subsp bovis AF2122/97
ugccgacgaugacg

SEQ ID NO: 3079265 - RNA, 18 nt, Mycobacterium bovis subsp bovis AF2122/97
ugccgacgccccgaucgg

SEQ ID NO: 3079266 - RNA, 20 nt, Mycobacterium bovis subsp bovis AF2122/97
ugccgacgccccgaucggcc

SEQ ID NO: 3079267 - RNA, 22 nt, Mycobacterium bovis subsp bovis AF2122/97
ugccgacgccccgaucggccac

SEQ ID NO: 3079268 - RNA, 23 nt, Mycobacterium bovis subsp bovis AF2122/97
ugccgacgccccgaucggccacc

SEQ ID NO: 3079269 - RNA, 19 nt, Mycobacterium bovis subsp bovis AF2122/97
ugccgacgcgcggccagcc

SEQ ID NO: 3079270 - RNA, 20 nt, Mycobacterium bovis subsp bovis AF2122/97
ugccgacgcgcggccagccc

SEQ ID NO: 3079271 - RNA, 18 nt, Mycobacterium bovis subsp bovis AF2122/97
ugccgacggcgcccgccc

SEQ ID NO: 3079272 - RNA, 15 nt, Mycobacterium bovis subsp bovis AF2122/97
ugccgacggcgccga

SEQ ID NO: 3079273 - RNA, 17 nt, Mycobacterium bovis subsp bovis AF2122/97
ugccgacggcgccgaac

SEQ ID NO: 3079274 - RNA, 18 nt, Mycobacterium bovis subsp bovis AF2122/97
ugccgacggcgccgaacc

SEQ ID NO: 3079275 - RNA, 16 nt, Mycobacterium bovis subsp bovis AF2122/97
ugccgacggugauggg

SEQ ID NO: 3079276 - RNA, 17 nt, Mycobacterium bovis subsp bovis AF2122/97
ugccgacggugaugggg

SEQ ID NO: 3079277 - RNA, 23 nt, Mycobacterium bovis subsp bovis AF2122/97
ugccgccgaucgacacccgcucg

SEQ ID NO: 3079278 - RNA, 17 nt, Mycobacterium bovis subsp bovis AF2122/97
ugccgccgcagaugggc

SEQ ID NO: 3079279 - RNA, 14 nt, Mycobacterium bovis subsp bovis AF2122/97
ugccgccgccgccg

SEQ ID NO: 3079280 - RNA, 15 nt, Mycobacterium bovis subsp bovis AF2122/97
ugccgccgccgccgg

SEQ ID NO: 3079281 - RNA, 17 nt, Mycobacterium bovis subsp bovis AF2122/97
ugccgccgccgccggcg

SEQ ID NO: 3079282 - RNA, 17 nt, Mycobacterium bovis subsp bovis AF2122/97
ugccgccgccggcgccg

SEQ ID NO: 3079283 - RNA, 20 nt, Mycobacterium bovis subsp bovis AF2122/97
ugccgccgccuccgccgagg

SEQ ID NO: 3079284 - RNA, 22 nt, Mycobacterium bovis subsp bovis AF2122/97
ugccgccgccuccgccgaggcc

SEQ ID NO: 3079285 - RNA, 23 nt, Mycobacterium bovis subsp bovis AF2122/97
ugccgccgccuccgccgaggccg

SEQ ID NO: 3079286 - RNA, 13 nt, Mycobacterium bovis subsp bovis AF2122/97
ugccgccgcggca

SEQ ID NO: 3079287 - RNA, 14 nt, Mycobacterium bovis subsp bovis AF2122/97
ugccgccgcggcca

SEQ ID NO: 3079288 - RNA, 15 nt, Mycobacterium bovis subsp bovis AF2122/97
ugccgccgcggccac

SEQ ID NO: 3079289 - RNA, 13 nt, Mycobacterium bovis subsp bovis AF2122/97
ugccgccgcggcg

SEQ ID NO: 3079290 - RNA, 11 nt, Mycobacterium bovis subsp bovis AF2122/97
ugccgccggag

SEQ ID NO: 3079291 - RNA, 18 nt, Mycobacterium bovis subsp bovis AF2122/97
ugccgccggcaccgccgg

SEQ ID NO: 3079292 - RNA, 16 nt, Mycobacterium bovis subsp bovis AF2122/97
ugccgccggccagucc

SEQ ID NO: 3079293 - RNA, 12 nt, Mycobacterium bovis subsp bovis AF2122/97
ugccgccggccc

SEQ ID NO: 3079294 - RNA, 17 nt, Mycobacterium bovis subsp bovis AF2122/97
ugccgccggccccgcca

SEQ ID NO: 3079295 - RNA, 23 nt, Mycobacterium bovis subsp bovis AF2122/97
ugccgccggccccgccagcgccg

SEQ ID NO: 3079296 - RNA, 20 nt, Mycobacterium bovis subsp bovis AF2122/97
ugccgccggccccgccgcua

SEQ ID NO: 3079297 - RNA, 20 nt, Mycobacterium bovis subsp bovis AF2122/97
ugccgccggccccgccggcg

SEQ ID NO: 3079298 - RNA, 23 nt, Mycobacterium bovis subsp bovis AF2122/97
ugccgccggccccgccggcgccg

SEQ ID NO: 3079299 - RNA, 22 nt, Mycobacterium bovis subsp bovis AF2122/97
ugccgccggccccgccgucgcc

SEQ ID NO: 3079300 - RNA, 16 nt, Mycobacterium bovis subsp bovis AF2122/97
ugccgccggcgccacc

SEQ ID NO: 3079301 - RNA, 23 nt, Mycobacterium bovis subsp bovis AF2122/97
ugccgccggcgccacccgcgccg

SEQ ID NO: 3079302 - RNA, 14 nt, Mycobacterium bovis subsp bovis AF2122/97
ugccgccggcgccg

SEQ ID NO: 3079303 - RNA, 15 nt, Mycobacterium bovis subsp bovis AF2122/97
ugccgccggcgccgc

SEQ ID NO: 3079304 - RNA, 17 nt, Mycobacterium bovis subsp bovis AF2122/97
ugccgccggcgccgccg

SEQ ID NO: 3079305 - RNA, 19 nt, Mycobacterium bovis subsp bovis AF2122/97
ugccgccggcgccgccgau

SEQ ID NO: 3079306 - RNA, 17 nt, Mycobacterium bovis subsp bovis AF2122/97
ugccgccggcgccggca

SEQ ID NO: 3079307 - RNA, 11 nt, Mycobacterium bovis subsp bovis AF2122/97
ugccgccgggg

SEQ ID NO: 3079308 - RNA, 13 nt, Mycobacterium bovis subsp bovis AF2122/97
ugccgccggugcc

SEQ ID NO: 3079309 - RNA, 14 nt, Mycobacterium bovis subsp bovis AF2122/97
ugccgccggugccg

SEQ ID NO: 3079310 - RNA, 22 nt, Mycobacterium bovis subsp bovis AF2122/97
ugccgccggugccgaucagcag

SEQ ID NO: 3079311 - RNA, 18 nt, Mycobacterium bovis subsp bovis AF2122/97
ugccgccggugccgccgg

SEQ ID NO: 3079312 - RNA, 17 nt, Mycobacterium bovis subsp bovis AF2122/97
ugccgccgguggugccg

SEQ ID NO: 3079313 - RNA, 23 nt, Mycobacterium bovis subsp bovis AF2122/97
ugccgccgguguugccguuaccg

SEQ ID NO: 3079314 - RNA, 20 nt, Mycobacterium bovis subsp bovis AF2122/97
ugccgccgguuccgccggcc

SEQ ID NO: 3079315 - RNA, 21 nt, Mycobacterium bovis subsp bovis AF2122/97
ugccgccgguuccgccggccc

SEQ ID NO: 3079316 - RNA, 12 nt, Mycobacterium bovis subsp bovis AF2122/97
ugccgccgucac

SEQ ID NO: 3079317 - RNA, 19 nt, Mycobacterium bovis subsp bovis AF2122/97
ugccgccguccccgccgac

SEQ ID NO: 3079318 - RNA, 13 nt, Mycobacterium bovis subsp bovis AF2122/97
ugccgccgucgcc

SEQ ID NO: 3079319 - RNA, 15 nt, Mycobacterium bovis subsp bovis AF2122/97
ugccgccgucgccac

SEQ ID NO: 3079320 - RNA, 16 nt, Mycobacterium bovis subsp bovis AF2122/97
ugccgccgucgccacg

SEQ ID NO: 3079321 - RNA, 17 nt, Mycobacterium bovis subsp bovis AF2122/97
ugccgccgucgccgccg

SEQ ID NO: 3079322 - RNA, 19 nt, Mycobacterium bovis subsp bovis AF2122/97
ugccgccgucgccgccgcu

SEQ ID NO: 3079323 - RNA, 22 nt, Mycobacterium bovis subsp bovis AF2122/97
ugccgccgucgccgccgucacc

SEQ ID NO: 3079324 - RNA, 14 nt, Mycobacterium bovis subsp bovis AF2122/97
ugccgccguuaccg

SEQ ID NO: 3079325 - RNA, 18 nt, Mycobacterium bovis subsp bovis AF2122/97
ugccgccguugccgccgg

SEQ ID NO: 3079326 - RNA, 20 nt, Mycobacterium bovis subsp bovis AF2122/97
ugccgccguugccgccggug

SEQ ID NO: 3079327 - RNA, 19 nt, Mycobacterium bovis subsp bovis AF2122/97
ugccgccguugccgccguu

SEQ ID NO: 3079328 - RNA, 22 nt, Mycobacterium bovis subsp bovis AF2122/97
ugccgccguugccgucgucgcc

SEQ ID NO: 3079329 - RNA, 16 nt, Mycobacterium bovis subsp bovis AF2122/97
ugccgccuccgccugc

SEQ ID NO: 3079330 - RNA, 19 nt, Mycobacterium bovis subsp bovis AF2122/97
ugccgccuccgccugcccc

SEQ ID NO: 3079331 - RNA, 20 nt, Mycobacterium bovis subsp bovis AF2122/97
ugccgccuccggugcauauu

SEQ ID NO: 3079332 - RNA, 17 nt, Mycobacterium bovis subsp bovis AF2122/97
ugccgccugcgccgcca

SEQ ID NO: 3079333 - RNA, 11 nt, Mycobacterium bovis subsp bovis AF2122/97
ugccgccuguc

SEQ ID NO: 3079334 - RNA, 21 nt, Mycobacterium bovis subsp bovis AF2122/97
ugccgccugucccgccggccc

SEQ ID NO: 3079335 - RNA, 20 nt, Mycobacterium bovis subsp bovis AF2122/97
ugccgccuuugcccccggug

SEQ ID NO: 3079336 - RNA, 20 nt, Mycobacterium bovis subsp bovis AF2122/97
ugccgcgaaugaagcccucg

SEQ ID NO: 3079337 - RNA, 12 nt, Mycobacterium bovis subsp bovis AF2122/97
ugccgcgaucgc

SEQ ID NO: 3079338 - RNA, 14 nt, Mycobacterium bovis subsp bovis AF2122/97
ugccgcgcagcugc

SEQ ID NO: 3079339 - RNA, 15 nt, Mycobacterium bovis subsp bovis AF2122/97
ugccgcgcagcugcc

SEQ ID NO: 3079340 - RNA, 19 nt, Mycobacterium bovis subsp bovis AF2122/97
ugccgcgcagcugccgcac

SEQ ID NO: 3079341 - RNA, 14 nt, Mycobacterium bovis subsp bovis AF2122/97
ugccgcgccacugu

SEQ ID NO: 3079342 - RNA, 13 nt, Mycobacterium bovis subsp bovis AF2122/97
ugccgcgcgcccg

SEQ ID NO: 3079343 - RNA, 12 nt, Mycobacterium bovis subsp bovis AF2122/97
ugccgcgcggcg

SEQ ID NO: 3079344 - RNA, 20 nt, Mycobacterium bovis subsp bovis AF2122/97
ugccgcggaggcggccagcc

SEQ ID NO: 3079345 - RNA, 14 nt, Mycobacterium bovis subsp bovis AF2122/97
ugccgcggccaccg

SEQ ID NO: 3079346 - RNA, 15 nt, Mycobacterium bovis subsp bovis AF2122/97
ugccgcggccaccgc

SEQ ID NO: 3079347 - RNA, 21 nt, Mycobacterium bovis subsp bovis AF2122/97
ugccgcggccaccgccgccgc

SEQ ID NO: 3079348 - RNA, 21 nt, Mycobacterium bovis subsp bovis AF2122/97
ugccgcggccaguacgucgau

SEQ ID NO: 3079349 - RNA, 22 nt, Mycobacterium bovis subsp bovis AF2122/97
ugccgcggccaguacgucgauc

SEQ ID NO: 3079350 - RNA, 21 nt, Mycobacterium bovis subsp bovis AF2122/97
ugccgcggccggcgugccagc

SEQ ID NO: 3079351 - RNA, 12 nt, Mycobacterium bovis subsp bovis AF2122/97
ugccgcggcgga

SEQ ID NO: 3079352 - RNA, 21 nt, Mycobacterium bovis subsp bovis AF2122/97
ugccgcggcugccaucccgau

SEQ ID NO: 3079353 - RNA, 17 nt, Mycobacterium bovis subsp bovis AF2122/97
ugccgcgggcagcgugu

SEQ ID NO: 3079354 - RNA, 15 nt, Mycobacterium bovis subsp bovis AF2122/97
ugccgcggucggcga

SEQ ID NO: 3079355 - RNA, 16 nt, Mycobacterium bovis subsp bovis AF2122/97
ugccgcggucggcgac

SEQ ID NO: 3079356 - RNA, 17 nt, Mycobacterium bovis subsp bovis AF2122/97
ugccgcggucggcgacg

SEQ ID NO: 3079357 - RNA, 22 nt, Mycobacterium bovis subsp bovis AF2122/97
ugccgcggucggcgacguagac

SEQ ID NO: 3079358 - RNA, 21 nt, Mycobacterium bovis subsp bovis AF2122/97
ugccgcguacgacccccgauc

SEQ ID NO: 3079359 - RNA, 22 nt, Mycobacterium bovis subsp bovis AF2122/97
ugccgcguagcuggucccacac

SEQ ID NO: 3079360 - RNA, 18 nt, Mycobacterium bovis subsp bovis AF2122/97
ugccgcgucaaccgaucg

SEQ ID NO: 3079361 - RNA, 14 nt, Mycobacterium bovis subsp bovis AF2122/97
ugccgcugacgguu

SEQ ID NO: 3079362 - RNA, 14 nt, Mycobacterium bovis subsp bovis AF2122/97
ugccgcuggucguc

SEQ ID NO: 3079363 - RNA, 21 nt, Mycobacterium bovis subsp bovis AF2122/97
ugccgcuuagcaaucggcagg

SEQ ID NO: 3079364 - RNA, 23 nt, Mycobacterium bovis subsp bovis AF2122/97
ugccggugauggccgaccagccg

SEQ ID NO: 3079365 - RNA, 16 nt, Mycobacterium bovis subsp bovis AF2122/97
ugccggugauguccgc

SEQ ID NO: 3079366 - RNA, 14 nt, Mycobacterium bovis subsp bovis AF2122/97
ugccggugcagguc

SEQ ID NO: 3079367 - RNA, 17 nt, Mycobacterium bovis subsp bovis AF2122/97
ugccggugcgcaccagc

SEQ ID NO: 3079368 - RNA, 13 nt, Mycobacterium bovis subsp bovis AF2122/97
ugccggugcgcua

SEQ ID NO: 3079369 - RNA, 20 nt, Mycobacterium bovis subsp bovis AF2122/97
ugccggugcgguggugcgca

SEQ ID NO: 3079370 - RNA, 16 nt, Mycobacterium bovis subsp bovis AF2122/97
ugccgguggcggcggc

SEQ ID NO: 3079371 - RNA, 18 nt, Mycobacterium bovis subsp bovis AF2122/97
ugccgguggugacggcgg

SEQ ID NO: 3079372 - RNA, 17 nt, Mycobacterium bovis subsp bovis AF2122/97
ugccgguguguccagcg

SEQ ID NO: 3079373 - RNA, 24 nt, Mycobacterium bovis subsp bovis AF2122/97
ugccgguguguccagcggaucguc

SEQ ID NO: 3079374 - RNA, 19 nt, Mycobacterium bovis subsp bovis AF2122/97
ugccgguguugauuccggc

SEQ ID NO: 3079375 - RNA, 18 nt, Mycobacterium bovis subsp bovis AF2122/97
ugccgguguugccgaagc

SEQ ID NO: 3079376 - RNA, 20 nt, Mycobacterium bovis subsp bovis AF2122/97
ugccgguguugccgccggug

SEQ ID NO: 3079377 - RNA, 23 nt, Mycobacterium bovis subsp bovis AF2122/97
ugccgguguugccgccggugccg

SEQ ID NO: 3079378 - RNA, 15 nt, Mycobacterium bovis subsp bovis AF2122/97
ugccgguucggcgau

SEQ ID NO: 3079379 - RNA, 18 nt, Mycobacterium bovis subsp bovis AF2122/97
ugccgguugcggcugcgu

SEQ ID NO: 3079380 - RNA, 23 nt, Mycobacterium bovis subsp bovis AF2122/97
ugccgguugcggcugcguuggcu

SEQ ID NO: 3079381 - RNA, 16 nt, Mycobacterium bovis subsp bovis AF2122/97
ugccgguuuccgucug

SEQ ID NO: 3079382 - RNA, 16 nt, Mycobacterium bovis subsp bovis AF2122/97
ugccgguuuggccgaa

SEQ ID NO: 3079383 - RNA, 16 nt, Mycobacterium bovis subsp bovis AF2122/97
ugccguacagcccggc

SEQ ID NO: 3079384 - RNA, 14 nt, Mycobacterium bovis subsp bovis AF2122/97
ugccguacgcccag

SEQ ID NO: 3079385 - RNA, 21 nt, Mycobacterium bovis subsp bovis AF2122/97
ugccguagguugcgccccgac

SEQ ID NO: 3079386 - RNA, 16 nt, Mycobacterium bovis subsp bovis AF2122/97
ugccguauagcgcaua

SEQ ID NO: 3079387 - RNA, 14 nt, Mycobacterium bovis subsp bovis AF2122/97
ugccguauccaggc

SEQ ID NO: 3079388 - RNA, 16 nt, Mycobacterium bovis subsp bovis AF2122/97
ugccgucagcugaccg

SEQ ID NO: 3079389 - RNA, 16 nt, Mycobacterium bovis subsp bovis AF2122/97
ugccgucagggucagc

SEQ ID NO: 3079390 - RNA, 17 nt, Mycobacterium bovis subsp bovis AF2122/97
ugccgucagggucagcu

SEQ ID NO: 3079391 - RNA, 14 nt, Mycobacterium bovis subsp bovis AF2122/97
ugccguccaccgau

SEQ ID NO: 3079392 - RNA, 14 nt, Mycobacterium bovis subsp bovis AF2122/97
ugccguccggcgcu

SEQ ID NO: 3079393 - RNA, 15 nt, Mycobacterium bovis subsp bovis AF2122/97
ugccgucgaguccag

SEQ ID NO: 3079394 - RNA, 18 nt, Mycobacterium bovis subsp bovis AF2122/97
ugccgucgccgcccuggc

SEQ ID NO: 3079395 - RNA, 22 nt, Mycobacterium bovis subsp bovis AF2122/97
ugccgucgccgcccuggccgcc

SEQ ID NO: 3079396 - RNA, 13 nt, Mycobacterium bovis subsp bovis AF2122/97
ugccgucgccggu

SEQ ID NO: 3079397 - RNA, 14 nt, Mycobacterium bovis subsp bovis AF2122/97
ugccgucgccgguc

SEQ ID NO: 3079398 - RNA, 19 nt, Mycobacterium bovis subsp bovis AF2122/97
ugccgucgccggucaggcc

SEQ ID NO: 3079399 - RNA, 17 nt, Mycobacterium bovis subsp bovis AF2122/97
ugccgucggagaccagc

SEQ ID NO: 3079400 - RNA, 20 nt, Mycobacterium bovis subsp bovis AF2122/97
ugccgucggagaccagcucg

SEQ ID NO: 3079401 - RNA, 12 nt, Mycobacterium bovis subsp bovis AF2122/97
ugccgucggccu

SEQ ID NO: 3079402 - RNA, 23 nt, Mycobacterium bovis subsp bovis AF2122/97
ugccgucggcgugcagcagcuug

SEQ ID NO: 3079403 - RNA, 23 nt, Mycobacterium bovis subsp bovis AF2122/97
ugccgucggugauggagccggug

SEQ ID NO: 3079404 - RNA, 15 nt, Mycobacterium bovis subsp bovis AF2122/97
ugccgucggugccgc

SEQ ID NO: 3079405 - RNA, 18 nt, Mycobacterium bovis subsp bovis AF2122/97
ugccgucggugccgcgga

SEQ ID NO: 3079406 - RNA, 22 nt, Mycobacterium bovis subsp bovis AF2122/97
ugccgucuuugucacgcaccgc

SEQ ID NO: 3079407 - RNA, 13 nt, Mycobacterium bovis subsp bovis AF2122/97
ugccgugcccggu

SEQ ID NO: 3079408 - RNA, 22 nt, Mycobacterium bovis subsp bovis AF2122/97
ugccgugccgguguguccagcg

SEQ ID NO: 3079409 - RNA, 18 nt, Mycobacterium bovis subsp bovis AF2122/97
ugccgugcggaucacucc

SEQ ID NO: 3079410 - RNA, 16 nt, Mycobacterium bovis subsp bovis AF2122/97
ugccgugcucacggca

SEQ ID NO: 3079411 - RNA, 15 nt, Mycobacterium bovis subsp bovis AF2122/97
ugccgugcugggccg

SEQ ID NO: 3079412 - RNA, 16 nt, Mycobacterium bovis subsp bovis AF2122/97
ugccguggaagacguc

SEQ ID NO: 3079413 - RNA, 16 nt, Mycobacterium bovis subsp bovis AF2122/97
ugccgugguggacgau

SEQ ID NO: 3079414 - RNA, 21 nt, Mycobacterium bovis subsp bovis AF2122/97
ugccgugguggacgaugcggu

SEQ ID NO: 3079415 - RNA, 17 nt, Mycobacterium bovis subsp bovis AF2122/97
ugccguguucagcaccc

SEQ ID NO: 3079416 - RNA, 17 nt, Mycobacterium bovis subsp bovis AF2122/97
ugccguucagcggcggg

SEQ ID NO: 3079417 - RNA, 15 nt, Mycobacterium bovis subsp bovis AF2122/97
ugccguuccagcauc

SEQ ID NO: 3079418 - RNA, 13 nt, Mycobacterium bovis subsp bovis AF2122/97
ugccguucggacc

SEQ ID NO: 3079419 - RNA, 14 nt, Mycobacterium bovis subsp bovis AF2122/97
ugccguucucgucg

SEQ ID NO: 3079420 - RNA, 15 nt, Mycobacterium bovis subsp bovis AF2122/97
ugccguucucgucga

SEQ ID NO: 3079421 - RNA, 19 nt, Mycobacterium bovis subsp bovis AF2122/97
ugccguugagugggagcua

SEQ ID NO: 3079422 - RNA, 19 nt, Mycobacterium bovis subsp bovis AF2122/97
ugccguugauucggccgcc

SEQ ID NO: 3079423 - RNA, 17 nt, Mycobacterium bovis subsp bovis AF2122/97
ugccguugccgccggug

SEQ ID NO: 3079424 - RNA, 13 nt, Mycobacterium bovis subsp bovis AF2122/97
ugccguugcgauc

SEQ ID NO: 3079425 - RNA, 15 nt, Mycobacterium bovis subsp bovis AF2122/97
ugccguugcgaucgc

SEQ ID NO: 3079426 - RNA, 16 nt, Mycobacterium bovis subsp bovis AF2122/97
ugccguugcgaucgcg

SEQ ID NO: 3079427 - RNA, 22 nt, Mycobacterium bovis subsp bovis AF2122/97
ugccguugcgaucgcgugcggu

SEQ ID NO: 3079428 - RNA, 17 nt, Mycobacterium bovis subsp bovis AF2122/97
ugccguuggagccgcca

SEQ ID NO: 3079429 - RNA, 19 nt, Mycobacterium bovis subsp bovis AF2122/97
ugccguuguagacggcggc

SEQ ID NO: 3079430 - RNA, 23 nt, Mycobacterium bovis subsp bovis AF2122/97
ugccuacaccggcaagccacgcc

SEQ ID NO: 3079431 - RNA, 14 nt, Mycobacterium bovis subsp bovis AF2122/97
ugccuaccgggccc

SEQ ID NO: 3079432 - RNA, 14 nt, Mycobacterium bovis subsp bovis AF2122/97
ugccucaccgccgc

SEQ ID NO: 3079433 - RNA, 11 nt, Mycobacterium bovis subsp bovis AF2122/97
ugccuccagaa

SEQ ID NO: 3079434 - RNA, 16 nt, Mycobacterium bovis subsp bovis AF2122/97
ugccucccuuccgcgc

SEQ ID NO: 3079435 - RNA, 14 nt, Mycobacterium bovis subsp bovis AF2122/97
ugccuccgacacca

SEQ ID NO: 3079436 - RNA, 20 nt, Mycobacterium bovis subsp bovis AF2122/97
ugccucgaggacggcguaga

SEQ ID NO: 3079437 - RNA, 16 nt, Mycobacterium bovis subsp bovis AF2122/97
ugccucgauggucucc

SEQ ID NO: 3079438 - RNA, 19 nt, Mycobacterium bovis subsp bovis AF2122/97
ugccucgcggggucugucg

SEQ ID NO: 3079439 - RNA, 19 nt, Mycobacterium bovis subsp bovis AF2122/97
ugccugaguuuaugcccgg

SEQ ID NO: 3079440 - RNA, 12 nt, Mycobacterium bovis subsp bovis AF2122/97
ugccugcaacgc

SEQ ID NO: 3079441 - RNA, 17 nt, Mycobacterium bovis subsp bovis AF2122/97
ugccugccacccggcca

SEQ ID NO: 3079442 - RNA, 17 nt, Mycobacterium bovis subsp bovis AF2122/97
ugccugccgcacguucg

SEQ ID NO: 3079443 - RNA, 12 nt, Mycobacterium bovis subsp bovis AF2122/97
ugccugcgcacg

SEQ ID NO: 3079444 - RNA, 16 nt, Mycobacterium bovis subsp bovis AF2122/97
ugccugcuagcagcag

SEQ ID NO: 3079445 - RNA, 15 nt, Mycobacterium bovis subsp bovis AF2122/97
ugccugcuuggccac

SEQ ID NO: 3079446 - RNA, 11 nt, Mycobacterium bovis subsp bovis AF2122/97
ugccuggcccg

SEQ ID NO: 3079447 - RNA, 13 nt, Mycobacterium bovis subsp bovis AF2122/97
ugccuggcccguc

SEQ ID NO: 3079448 - RNA, 22 nt, Mycobacterium bovis subsp bovis AF2122/97
ugccugggcgaccggcucggaa

SEQ ID NO: 3079449 - RNA, 21 nt, Mycobacterium bovis subsp bovis AF2122/97
ugccugucagaaggaucagcg

SEQ ID NO: 3079450 - RNA, 18 nt, Mycobacterium bovis subsp bovis AF2122/97
ugccuuacacgccuggcu

SEQ ID NO: 3079451 - RNA, 18 nt, Mycobacterium bovis subsp bovis AF2122/97
ugcgaucggugcgaucag

SEQ ID NO: 3079452 - RNA, 14 nt, Mycobacterium bovis subsp bovis AF2122/97
ugcgaucgucacgc

SEQ ID NO: 3079453 - RNA, 20 nt, Mycobacterium bovis subsp bovis AF2122/97
ugcgaucugaaacagucgac

SEQ ID NO: 3079454 - RNA, 14 nt, Mycobacterium bovis subsp bovis AF2122/97
ugcgaugcacaacc

SEQ ID NO: 3079455 - RNA, 15 nt, Mycobacterium bovis subsp bovis AF2122/97
ugcgaugcacaaccg

SEQ ID NO: 3079456 - RNA, 15 nt, Mycobacterium bovis subsp bovis AF2122/97
ugcgaugcagcgcgc

SEQ ID NO: 3079457 - RNA, 12 nt, Mycobacterium bovis subsp bovis AF2122/97
ugcgaugcccac

SEQ ID NO: 3079458 - RNA, 12 nt, Mycobacterium bovis subsp bovis AF2122/97
ugcgaugcccgu

SEQ ID NO: 3079459 - RNA, 15 nt, Mycobacterium bovis subsp bovis AF2122/97
ugcgaugcgcgccga

SEQ ID NO: 3079460 - RNA, 13 nt, Mycobacterium bovis subsp bovis AF2122/97
ugcgauggccgac

SEQ ID NO: 3079461 - RNA, 18 nt, Mycobacterium bovis subsp bovis AF2122/97
ugcgauuccgcgucugcu

SEQ ID NO: 3079462 - RNA, 20 nt, Mycobacterium bovis subsp bovis AF2122/97
ugcgauuccgcgucugcucg

SEQ ID NO: 3079463 - RNA, 21 nt, Mycobacterium bovis subsp bovis AF2122/97
ugcgauucugcguccugcucg

SEQ ID NO: 3079464 - RNA, 18 nt, Mycobacterium bovis subsp bovis AF2122/97
ugcgauucugcgucugcu

SEQ ID NO: 3079465 - RNA, 19 nt, Mycobacterium bovis subsp bovis AF2122/97
ugcgauucugcgucugcuc

SEQ ID NO: 3079466 - RNA, 21 nt, Mycobacterium bovis subsp bovis AF2122/97
ugcgauucugugucugcucgg

SEQ ID NO: 3079467 - RNA, 18 nt, Mycobacterium bovis subsp bovis AF2122/97
ugcgauuuugugucugcu

SEQ ID NO: 3079468 - RNA, 20 nt, Mycobacterium bovis subsp bovis AF2122/97
ugcgauuuugugucugcucg

SEQ ID NO: 3079469 - RNA, 22 nt, Mycobacterium bovis subsp bovis AF2122/97
ugcgcaaauaggacugcgccac

SEQ ID NO: 3079470 - RNA, 19 nt, Mycobacterium bovis subsp bovis AF2122/97
ugcgcaacaccgugcacca

SEQ ID NO: 3079471 - RNA, 16 nt, Mycobacterium bovis subsp bovis AF2122/97
ugcgcaaccgcggccc

SEQ ID NO: 3079472 - RNA, 18 nt, Mycobacterium bovis subsp bovis AF2122/97
ugcgcaacgcgucgucgg

SEQ ID NO: 3079473 - RNA, 14 nt, Mycobacterium bovis subsp bovis AF2122/97
ugcgcaacuucgac

SEQ ID NO: 3079474 - RNA, 15 nt, Mycobacterium bovis subsp bovis AF2122/97
ugcgcaaggccgcgu

SEQ ID NO: 3079475 - RNA, 21 nt, Mycobacterium bovis subsp bovis AF2122/97
ugcgcaauagcgacagcagcg

SEQ ID NO: 3079476 - RNA, 15 nt, Mycobacterium bovis subsp bovis AF2122/97
ugcgcaaugccgacg

SEQ ID NO: 3079477 - RNA, 18 nt, Mycobacterium bovis subsp bovis AF2122/97
ugcgcacacccugcagcu

SEQ ID NO: 3079478 - RNA, 13 nt, Mycobacterium bovis subsp bovis AF2122/97
ugcgcacaccgac

SEQ ID NO: 3079479 - RNA, 15 nt, Mycobacterium bovis subsp bovis AF2122/97
ugcgcacaccgaccc

SEQ ID NO: 3079480 - RNA, 18 nt, Mycobacterium bovis subsp bovis AF2122/97
ugcgcacaccgacccgcu

SEQ ID NO: 3079481 - RNA, 16 nt, Mycobacterium bovis subsp bovis AF2122/97
ugcgcacaggcgcgau

SEQ ID NO: 3079482 - RNA, 13 nt, Mycobacterium bovis subsp bovis AF2122/97
ugcgcaccaaggc

SEQ ID NO: 3079483 - RNA, 19 nt, Mycobacterium bovis subsp bovis AF2122/97
ugcgcaccaaggccgugau

SEQ ID NO: 3079484 - RNA, 14 nt, Mycobacterium bovis subsp bovis AF2122/97
ugcgcaccaccgag

SEQ ID NO: 3079485 - RNA, 17 nt, Mycobacterium bovis subsp bovis AF2122/97
ugcgcaccaccgagccg

SEQ ID NO: 3079486 - RNA, 12 nt, Mycobacterium bovis subsp bovis AF2122/97
ugcgcaccagca

SEQ ID NO: 3079487 - RNA, 15 nt, Mycobacterium bovis subsp bovis AF2122/97
ugcgcaccauggguc

SEQ ID NO: 3079488 - RNA, 23 nt, Mycobacterium bovis subsp bovis AF2122/97
ugcgcaccaugggucuggcaggc

SEQ ID NO: 3079489 - RNA, 11 nt, Mycobacterium bovis subsp bovis AF2122/97
ugcgcaccccg

SEQ ID NO: 3079490 - RNA, 20 nt, Mycobacterium bovis subsp bovis AF2122/97
ugcgcacccgcgggucgucc

SEQ ID NO: 3079491 - RNA, 12 nt, Mycobacterium bovis subsp bovis AF2122/97
ugcgcaccgguc

SEQ ID NO: 3079492 - RNA, 18 nt, Mycobacterium bovis subsp bovis AF2122/97
ugcgcaccggucaacgug

SEQ ID NO: 3079493 - RNA, 20 nt, Mycobacterium bovis subsp bovis AF2122/97
ugcgcaccugggucgacgag

SEQ ID NO: 3079494 - RNA, 12 nt, Mycobacterium bovis subsp bovis AF2122/97
ugcgcacgaccc

SEQ ID NO: 3079495 - RNA, 18 nt, Mycobacterium bovis subsp bovis AF2122/97
ugcgcacggcgccgaccc

SEQ ID NO: 3079496 - RNA, 12 nt, Mycobacterium bovis subsp bovis AF2122/97
ugcgcacgucgg

SEQ ID NO: 3079497 - RNA, 14 nt, Mycobacterium bovis subsp bovis AF2122/97
ugcgcacucccggc

SEQ ID NO: 3079498 - RNA, 20 nt, Mycobacterium bovis subsp bovis AF2122/97
ugcgcagaaacgccgagcgc

SEQ ID NO: 3079499 - RNA, 16 nt, Mycobacterium bovis subsp bovis AF2122/97
ugcgcagaacaccacc

SEQ ID NO: 3079500 - RNA, 17 nt, Mycobacterium bovis subsp bovis AF2122/97
ugcgcagauuugcucca

SEQ ID NO: 3079501 - RNA, 12 nt, Mycobacterium bovis subsp bovis AF2122/97
ugcgcagcagcg

SEQ ID NO: 3079502 - RNA, 21 nt, Mycobacterium bovis subsp bovis AF2122/97
ugcgcagcagcgugcacaccc

SEQ ID NO: 3079503 - RNA, 17 nt, Mycobacterium bovis subsp bovis AF2122/97
ugcgcagcgcaacaucg

SEQ ID NO: 3079504 - RNA, 16 nt, Mycobacterium bovis subsp bovis AF2122/97
ugcgcagcgccugcgg

SEQ ID NO: 3079505 - RNA, 18 nt, Mycobacterium bovis subsp bovis AF2122/97
ugcgcagcgugaaaugca

SEQ ID NO: 3079506 - RNA, 23 nt, Mycobacterium bovis subsp bovis AF2122/97
ugcgcagcgugaaaugcacgauc

SEQ ID NO: 3079507 - RNA, 17 nt, Mycobacterium bovis subsp bovis AF2122/97
ugcgcagcuuggccagc

SEQ ID NO: 3079508 - RNA, 19 nt, Mycobacterium bovis subsp bovis AF2122/97
ugcgcagcuuggccagcca

SEQ ID NO: 3079509 - RNA, 17 nt, Mycobacterium bovis subsp bovis AF2122/97
ugcgcagggccuggaag

SEQ ID NO: 3079510 - RNA, 19 nt, Mycobacterium bovis subsp bovis AF2122/97
ugcgcagggccuggaagac

SEQ ID NO: 3079511 - RNA, 18 nt, Mycobacterium bovis subsp bovis AF2122/97
ugcgcagugacgccucga

SEQ ID NO: 3079512 - RNA, 17 nt, Mycobacterium bovis subsp bovis AF2122/97
ugcgcaucgccaccauc

SEQ ID NO: 3079513 - RNA, 15 nt, Mycobacterium bovis subsp bovis AF2122/97
ugcgcaucgccggua

SEQ ID NO: 3079514 - RNA, 17 nt, Mycobacterium bovis subsp bovis AF2122/97
ugcgccaaaauccgccc

SEQ ID NO: 3079515 - RNA, 18 nt, Mycobacterium bovis subsp bovis AF2122/97
ugcgccaaaauccgccca

SEQ ID NO: 3079516 - RNA, 23 nt, Mycobacterium bovis subsp bovis AF2122/97
ugcgccaaaauccgcccaccggu

SEQ ID NO: 3079517 - RNA, 13 nt, Mycobacterium bovis subsp bovis AF2122/97
ugcgccaccggug

SEQ ID NO: 3079518 - RNA, 23 nt, Mycobacterium bovis subsp bovis AF2122/97
ugcgccagcgagcgcaaaucgau

SEQ ID NO: 3079519 - RNA, 23 nt, Mycobacterium bovis subsp bovis AF2122/97
ugcgccagcgggcuguaggcgau

SEQ ID NO: 3079520 - RNA, 21 nt, Mycobacterium bovis subsp bovis AF2122/97
ugcgccagcgguggaccaccg

SEQ ID NO: 3079521 - RNA, 19 nt, Mycobacterium bovis subsp bovis AF2122/97
ugcgccaggagcgcggccc

SEQ ID NO: 3079522 - RNA, 21 nt, Mycobacterium bovis subsp bovis AF2122/97
ugcgccaggagcgcggcccgc

SEQ ID NO: 3079523 - RNA, 13 nt, Mycobacterium bovis subsp bovis AF2122/97
ugcgccaggcggc

SEQ ID NO: 3079524 - RNA, 20 nt, Mycobacterium bovis subsp bovis AF2122/97
ugcgccauaacaccggguag

SEQ ID NO: 3079525 - RNA, 23 nt, Mycobacterium bovis subsp bovis AF2122/97
ugcgccaucacaucggccucuga

SEQ ID NO: 3079526 - RNA, 13 nt, Mycobacterium bovis subsp bovis AF2122/97
ugcgccauucccg

SEQ ID NO: 3079527 - RNA, 19 nt, Mycobacterium bovis subsp bovis AF2122/97
ugcgccauucccgguggcu

SEQ ID NO: 3079528 - RNA, 16 nt, Mycobacterium bovis subsp bovis AF2122/97
ugcgcccaauccaccg

SEQ ID NO: 3079529 - RNA, 21 nt, Mycobacterium bovis subsp bovis AF2122/97
ugcgcccacccgcgccuaccc

SEQ ID NO: 3079530 - RNA, 13 nt, Mycobacterium bovis subsp bovis AF2122/97
ugcgcccaccgaa

SEQ ID NO: 3079531 - RNA, 19 nt, Mycobacterium bovis subsp bovis AF2122/97
ugcgcccaccgaaaccggu

SEQ ID NO: 3079532 - RNA, 15 nt, Mycobacterium bovis subsp bovis AF2122/97
ugcgcccagcgaccc

SEQ ID NO: 3079533 - RNA, 21 nt, Mycobacterium bovis subsp bovis AF2122/97
ugcgccccggagccucgaaca

SEQ ID NO: 3079534 - RNA, 22 nt, Mycobacterium bovis subsp bovis AF2122/97
ugcgcccggccaagccggcgag

SEQ ID NO: 3079535 - RNA, 23 nt, Mycobacterium bovis subsp bovis AF2122/97
ugcgcccggccaagccggcgagu

SEQ ID NO: 3079536 - RNA, 16 nt, Mycobacterium bovis subsp bovis AF2122/97
ugcgcccugagcagau

SEQ ID NO: 3079537 - RNA, 19 nt, Mycobacterium bovis subsp bovis AF2122/97
ugcgccgaacaccacaccg

SEQ ID NO: 3079538 - RNA, 15 nt, Mycobacterium bovis subsp bovis AF2122/97
ugcgcgugcugcgga

SEQ ID NO: 3079539 - RNA, 21 nt, Mycobacterium bovis subsp bovis AF2122/97
ugcgcguuacccaucgccaca

SEQ ID NO: 3079540 - RNA, 17 nt, Mycobacterium bovis subsp bovis AF2122/97
ugcgcguucgaccucga

SEQ ID NO: 3079541 - RNA, 18 nt, Mycobacterium bovis subsp bovis AF2122/97
ugcgcguucgaccucgac

SEQ ID NO: 3079542 - RNA, 13 nt, Mycobacterium bovis subsp bovis AF2122/97
ugcgcguugaccg

SEQ ID NO: 3079543 - RNA, 16 nt, Mycobacterium bovis subsp bovis AF2122/97
ugcgcguuggucauca

SEQ ID NO: 3079544 - RNA, 22 nt, Mycobacterium bovis subsp bovis AF2122/97
ugcgcuccaacaacuccagcag

SEQ ID NO: 3079545 - RNA, 20 nt, Mycobacterium bovis subsp bovis AF2122/97
ugcgcucguugguucagcuc

SEQ ID NO: 3079546 - RNA, 15 nt, Mycobacterium bovis subsp bovis AF2122/97
ugcgcugcagcgaga

SEQ ID NO: 3079547 - RNA, 19 nt, Mycobacterium bovis subsp bovis AF2122/97
ugcgcuggaggcuccuggu

SEQ ID NO: 3079548 - RNA, 18 nt, Mycobacterium bovis subsp bovis AF2122/97
ugcgcuggaucucguugg

SEQ ID NO: 3079549 - RNA, 15 nt, Mycobacterium bovis subsp bovis AF2122/97
ugcgcuggcacacuc

SEQ ID NO: 3079550 - RNA, 12 nt, Mycobacterium bovis subsp bovis AF2122/97
ugcgcuggcgcc

SEQ ID NO: 3079551 - RNA, 15 nt, Mycobacterium bovis subsp bovis AF2122/97
ugcgcugggccaggg

SEQ ID NO: 3079552 - RNA, 17 nt, Mycobacterium bovis subsp bovis AF2122/97
ugcgcugggugaugagc

SEQ ID NO: 3079553 - RNA, 19 nt, Mycobacterium bovis subsp bovis AF2122/97
ugcgcugggugaugagcgc

SEQ ID NO: 3079554 - RNA, 13 nt, Mycobacterium bovis subsp bovis AF2122/97
ugcgcuggucgca

SEQ ID NO: 3079555 - RNA, 16 nt, Mycobacterium bovis subsp bovis AF2122/97
ugcgcuguugcuggcg

SEQ ID NO: 3079556 - RNA, 19 nt, Mycobacterium bovis subsp bovis AF2122/97
ugcgcuuccaacaccaacg

SEQ ID NO: 3079557 - RNA, 18 nt, Mycobacterium bovis subsp bovis AF2122/97
ugcgcuuccaucgccacu

SEQ ID NO: 3079558 - RNA, 22 nt, Mycobacterium bovis subsp bovis AF2122/97
ugcgcuuggucgaccgccgaga

SEQ ID NO: 3079559 - RNA, 18 nt, Mycobacterium bovis subsp bovis AF2122/97
ugcggaaacccggccgcc

SEQ ID NO: 3079560 - RNA, 19 nt, Mycobacterium bovis subsp bovis AF2122/97
ugcggaaacccggccgccg

SEQ ID NO: 3079561 - RNA, 17 nt, Mycobacterium bovis subsp bovis AF2122/97
ugcggaaaccgcugggg

SEQ ID NO: 3079562 - RNA, 14 nt, Mycobacterium bovis subsp bovis AF2122/97
ugcggaaaucggac

SEQ ID NO: 3079563 - RNA, 21 nt, Mycobacterium bovis subsp bovis AF2122/97
ugcggaacaccaccaggcugu

SEQ ID NO: 3079564 - RNA, 21 nt, Mycobacterium bovis subsp bovis AF2122/97
ugcggaacaccagcaggcggc

SEQ ID NO: 3079565 - RNA, 14 nt, Mycobacterium bovis subsp bovis AF2122/97
ugcggaacaccgcc

SEQ ID NO: 3079566 - RNA, 21 nt, Mycobacterium bovis subsp bovis AF2122/97
ugcggaacaccgcccggcccg

SEQ ID NO: 3079567 - RNA, 22 nt, Mycobacterium bovis subsp bovis AF2122/97
ugcggaagaagugcucacaucc

SEQ ID NO: 3079568 - RNA, 18 nt, Mycobacterium bovis subsp bovis AF2122/97
ugcggacacguugcgacg

SEQ ID NO: 3079569 - RNA, 14 nt, Mycobacterium bovis subsp bovis AF2122/97
ugcggacugacguc

SEQ ID NO: 3079570 - RNA, 17 nt, Mycobacterium bovis subsp bovis AF2122/97
ugcggacuucgaugucg

SEQ ID NO: 3079571 - RNA, 13 nt, Mycobacterium bovis subsp bovis AF2122/97
ugcggagccgccg

SEQ ID NO: 3079572 - RNA, 18 nt, Mycobacterium bovis subsp bovis AF2122/97
ugcggaggcgggugcggc

SEQ ID NO: 3079573 - RNA, 17 nt, Mycobacterium bovis subsp bovis AF2122/97
ugcggauacagccgccg

SEQ ID NO: 3079574 - RNA, 22 nt, Mycobacterium bovis subsp bovis AF2122/97
ugcggauacuguucugcuggcu

SEQ ID NO: 3079575 - RNA, 14 nt, Mycobacterium bovis subsp bovis AF2122/97
ugcggauagcaacg

SEQ ID NO: 3079576 - RNA, 19 nt, Mycobacterium bovis subsp bovis AF2122/97
ugcggauagcaacggugcu

SEQ ID NO: 3079577 - RNA, 22 nt, Mycobacterium bovis subsp bovis AF2122/97
ugcggaucacucccccacacac

SEQ ID NO: 3079578 - RNA, 13 nt, Mycobacterium bovis subsp bovis AF2122/97
ugcggauccacca

SEQ ID NO: 3079579 - RNA, 20 nt, Mycobacterium bovis subsp bovis AF2122/97
ugcggaucgcgcugcgggaa

SEQ ID NO: 3079580 - RNA, 15 nt, Mycobacterium bovis subsp bovis AF2122/97
ugcggaucggacaac

SEQ ID NO: 3079581 - RNA, 13 nt, Mycobacterium bovis subsp bovis AF2122/97
ugcggaucggcgg
